United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 70

SEQ ID NO: 2952307 - DNA, 13 bp, Homo sapiens
gtttacagaaaaa

SEQ ID NO: 2952308 - DNA, 22 bp, Homo sapiens
gtttacagacaaggcaggcctg

SEQ ID NO: 2952309 - DNA, 17 bp, Homo sapiens
gtttacataagagaaag

SEQ ID NO: 2952310 - DNA, 22 bp, Homo sapiens
gtttacctgaataaatggtagt

SEQ ID NO: 2952311 - DNA, 15 bp, Homo sapiens
gtttactgtaaattt

SEQ ID NO: 2952312 - DNA, 22 bp, Homo sapiens
gtttacttaaagatttatcaaa

SEQ ID NO: 2952313 - DNA, 12 bp, Homo sapiens
gtttagaagcct

SEQ ID NO: 2952314 - DNA, 19 bp, Homo sapiens
gtttagagaatgagaaatg

SEQ ID NO: 2952315 - DNA, 13 bp, Homo sapiens
gtttagattgtat

SEQ ID NO: 2952316 - DNA, 15 bp, Homo sapiens
gtttagtgccaatgt

SEQ ID NO: 2952317 - DNA, 17 bp, Homo sapiens
gtttagtgccaatgttg

SEQ ID NO: 2952318 - DNA, 19 bp, Homo sapiens
gtttagtgccaatgttgtg

SEQ ID NO: 2952319 - DNA, 13 bp, Homo sapiens
gtttataaaatat

SEQ ID NO: 2952320 - DNA, 13 bp, Homo sapiens
gtttataaatctt

SEQ ID NO: 2952321 - DNA, 17 bp, Homo sapiens
gtttataactattcagt

SEQ ID NO: 2952322 - DNA, 22 bp, Homo sapiens
gtttataatttgatagatgttt

SEQ ID NO: 2952323 - DNA, 13 bp, Homo sapiens
gtttatacagtgt

SEQ ID NO: 2952324 - DNA, 21 bp, Homo sapiens
gtttatacagtgtacatgtac

SEQ ID NO: 2952325 - DNA, 15 bp, Homo sapiens
gtttatatgaaaaca

SEQ ID NO: 2952326 - DNA, 23 bp, Homo sapiens
gtttatatttttttaactgtgat

SEQ ID NO: 2952327 - DNA, 18 bp, Homo sapiens
gtttatcaactcaagaat

SEQ ID NO: 2952328 - DNA, 15 bp, Homo sapiens
gtttatcattcaagt

SEQ ID NO: 2952329 - DNA, 17 bp, Homo sapiens
gtttatcattcaagtgt

SEQ ID NO: 2952330 - DNA, 19 bp, Homo sapiens
gtttatgagaactggttct

SEQ ID NO: 2952331 - DNA, 16 bp, Homo sapiens
gtttatggcagaaggg

SEQ ID NO: 2952332 - DNA, 15 bp, Homo sapiens
gtttatgggtttctt

SEQ ID NO: 2952333 - DNA, 18 bp, Homo sapiens
gtttatgtaaatgtttgt

SEQ ID NO: 2952334 - DNA, 13 bp, Homo sapiens
gtttattaaatct

SEQ ID NO: 2952335 - DNA, 16 bp, Homo sapiens
gtttattcttctagag

SEQ ID NO: 2952336 - DNA, 19 bp, Homo sapiens
gtttattcttctagagttc

SEQ ID NO: 2952337 - DNA, 18 bp, Homo sapiens
gtttatttgttgttttct

SEQ ID NO: 2952338 - DNA, 19 bp, Homo sapiens
gtttatttttttgatggct

SEQ ID NO: 2952339 - DNA, 23 bp, Homo sapiens
gtttcaaaataaaaaccaagaag

SEQ ID NO: 2952340 - DNA, 19 bp, Homo sapiens
gtttcaaagatgctgtgag

SEQ ID NO: 2952341 - DNA, 17 bp, Homo sapiens
gtttcaacccaactgac

SEQ ID NO: 2952342 - DNA, 18 bp, Homo sapiens
gtttcaaggcactctaga

SEQ ID NO: 2952343 - DNA, 14 bp, Homo sapiens
gtttcaatcactgt

SEQ ID NO: 2952344 - DNA, 15 bp, Homo sapiens
gtttcaatcactgtc

SEQ ID NO: 2952345 - DNA, 17 bp, Homo sapiens
gtttcaattgcatctcc

SEQ ID NO: 2952346 - DNA, 22 bp, Homo sapiens
gtttcaattgcatctcccagat

SEQ ID NO: 2952347 - DNA, 22 bp, Homo sapiens
gtttcaatttactttttaaaca

SEQ ID NO: 2952348 - DNA, 17 bp, Homo sapiens
gtttcactattcctatg

SEQ ID NO: 2952349 - DNA, 14 bp, Homo sapiens
gtttcagctggaaa

SEQ ID NO: 2952350 - DNA, 20 bp, Homo sapiens
gtttcagctggaaacttctg

SEQ ID NO: 2952351 - DNA, 18 bp, Homo sapiens
gtttcagctttcttcagc

SEQ ID NO: 2952352 - DNA, 12 bp, Homo sapiens
gtttcagtttga

SEQ ID NO: 2952353 - DNA, 15 bp, Homo sapiens
gtttcatcaggctct

SEQ ID NO: 2952354 - DNA, 21 bp, Homo sapiens
gtttcatgttggatctgtcat

SEQ ID NO: 2952355 - DNA, 13 bp, Homo sapiens
gtttcccccactc

SEQ ID NO: 2952356 - DNA, 17 bp, Homo sapiens
gtttcctgacattgtct

SEQ ID NO: 2952357 - DNA, 19 bp, Homo sapiens
gtttcctgccttcagagta

SEQ ID NO: 2952358 - DNA, 13 bp, Homo sapiens
gtttcctgctgct

SEQ ID NO: 2952359 - DNA, 20 bp, Homo sapiens
gtttcctggaagcagagcaa

SEQ ID NO: 2952360 - DNA, 14 bp, Homo sapiens
gtttcctgtctgat

SEQ ID NO: 2952361 - DNA, 23 bp, Homo sapiens
gtttccttttctgtctctctctt

SEQ ID NO: 2952362 - DNA, 14 bp, Homo sapiens
gtttcgtttctgta

SEQ ID NO: 2952363 - DNA, 15 bp, Homo sapiens
gtttcgtttctgtat

SEQ ID NO: 2952364 - DNA, 20 bp, Homo sapiens
gtttctaaccaaagagtctc

SEQ ID NO: 2952365 - DNA, 17 bp, Homo sapiens
gtttctaagattctaaa

SEQ ID NO: 2952366 - DNA, 18 bp, Homo sapiens
gtttctaagattctaaag

SEQ ID NO: 2952367 - DNA, 11 bp, Homo sapiens
gtttctaaggt

SEQ ID NO: 2952368 - DNA, 13 bp, Homo sapiens
gtttctatacaaa

SEQ ID NO: 2952369 - DNA, 23 bp, Homo sapiens
gtttctatttagttatttaagaa

SEQ ID NO: 2952370 - DNA, 19 bp, Homo sapiens
gtttctcagatccttgttt

SEQ ID NO: 2952371 - DNA, 21 bp, Homo sapiens
gtttctcagatccttgtttca

SEQ ID NO: 2952372 - DNA, 17 bp, Homo sapiens
gtttctccatgttggtc

SEQ ID NO: 2952373 - DNA, 20 bp, Homo sapiens
gtttctccctctcactgtct

SEQ ID NO: 2952374 - DNA, 22 bp, Homo sapiens
gtttctccctctcactgtctga

SEQ ID NO: 2952375 - DNA, 16 bp, Homo sapiens
gtttctctataaagta

SEQ ID NO: 2952376 - DNA, 19 bp, Homo sapiens
gtttctctgagctttgtta

SEQ ID NO: 2952377 - DNA, 12 bp, Homo sapiens
gtttctgaaaag

SEQ ID NO: 2952378 - DNA, 13 bp, Homo sapiens
gtttctgaaaaga

SEQ ID NO: 2952379 - DNA, 14 bp, Homo sapiens
gtttctgaaaagaa

SEQ ID NO: 2952380 - DNA, 22 bp, Homo sapiens
gtttctgaaaagaaataataat

SEQ ID NO: 2952381 - DNA, 13 bp, Homo sapiens
gtttctgaatgtt

SEQ ID NO: 2952382 - DNA, 12 bp, Homo sapiens
gtttctgggggc

SEQ ID NO: 2952383 - DNA, 23 bp, Homo sapiens
gtttctgtatatgattctctgtg

SEQ ID NO: 2952384 - DNA, 17 bp, Homo sapiens
gtttctgtgcatggtgg

SEQ ID NO: 2952385 - DNA, 11 bp, Homo sapiens
gtttctgttct

SEQ ID NO: 2952386 - DNA, 12 bp, Homo sapiens
gtttctgttctg

SEQ ID NO: 2952387 - DNA, 15 bp, Homo sapiens
gtttctgttctgtgg

SEQ ID NO: 2952388 - DNA, 20 bp, Homo sapiens
gtttctgttctgtggaaagt

SEQ ID NO: 2952389 - DNA, 15 bp, Homo sapiens
gtttcttatagattt

SEQ ID NO: 2952390 - DNA, 15 bp, Homo sapiens
gtttcttcacttctt

SEQ ID NO: 2952391 - DNA, 12 bp, Homo sapiens
gtttcttcccca

SEQ ID NO: 2952392 - DNA, 13 bp, Homo sapiens
gtttcttccccaa

SEQ ID NO: 2952393 - DNA, 11 bp, Homo sapiens
gtttcttcttc

SEQ ID NO: 2952394 - DNA, 13 bp, Homo sapiens
gtttcttggtaaa

SEQ ID NO: 2952395 - DNA, 16 bp, Homo sapiens
gtttgaaacaaagaag

SEQ ID NO: 2952396 - DNA, 15 bp, Homo sapiens
gtttgaaattctgaa

SEQ ID NO: 2952397 - DNA, 21 bp, Homo sapiens
gtttgaaattctgaatttgca

SEQ ID NO: 2952398 - DNA, 22 bp, Homo sapiens
gtttgaaattctgaatttgcaa

SEQ ID NO: 2952399 - DNA, 23 bp, Homo sapiens
gtttgaaattctgaatttgcaaa

SEQ ID NO: 2952400 - DNA, 16 bp, Homo sapiens
gtttgaaggaaacagt

SEQ ID NO: 2952401 - DNA, 16 bp, Homo sapiens
gtttgacgaagaaaca

SEQ ID NO: 2952402 - DNA, 20 bp, Homo sapiens
gtttgacgaagaaacaaaaa

SEQ ID NO: 2952403 - DNA, 13 bp, Homo sapiens
gtttgactttaaa

SEQ ID NO: 2952404 - DNA, 20 bp, Homo sapiens
gtttgagaagaaaacatcta

SEQ ID NO: 2952405 - DNA, 15 bp, Homo sapiens
gtttgagaccaggct

SEQ ID NO: 2952406 - DNA, 21 bp, Homo sapiens
gtttgagcacaatctgttcta

SEQ ID NO: 2952407 - DNA, 22 bp, Homo sapiens
gtttgagcacaatctgttctac

SEQ ID NO: 2952408 - DNA, 15 bp, Homo sapiens
gtttgagctcagacc

SEQ ID NO: 2952409 - DNA, 12 bp, Homo sapiens
gtttgaggctgc

SEQ ID NO: 2952410 - DNA, 12 bp, Homo sapiens
gtttgatagtgc

SEQ ID NO: 2952411 - DNA, 21 bp, Homo sapiens
gtttgatagtgcttcttgtaa

SEQ ID NO: 2952412 - DNA, 13 bp, Homo sapiens
gtttgattttcat

SEQ ID NO: 2952413 - DNA, 22 bp, Homo sapiens
gtttgcacagagggcgctcctg

SEQ ID NO: 2952414 - DNA, 23 bp, Homo sapiens
gtttgcacagagggcgctcctgt

SEQ ID NO: 2952415 - DNA, 17 bp, Homo sapiens
gtttgcacctttctagt

SEQ ID NO: 2952416 - DNA, 23 bp, Homo sapiens
gtttgcacgttatggtgtttctc

SEQ ID NO: 2952417 - DNA, 22 bp, Homo sapiens
gtttgccaaataaaaaacagaa

SEQ ID NO: 2952418 - DNA, 20 bp, Homo sapiens
gtttgctatcttaattttgg

SEQ ID NO: 2952419 - DNA, 17 bp, Homo sapiens
gtttgctattagagcat

SEQ ID NO: 2952420 - DNA, 17 bp, Homo sapiens
gtttgctgtgccaggag

SEQ ID NO: 2952421 - DNA, 21 bp, Homo sapiens
gtttgcttggtgctggtttat

SEQ ID NO: 2952422 - DNA, 17 bp, Homo sapiens
gtttgctttgctttgta

SEQ ID NO: 2952423 - DNA, 17 bp, Homo sapiens
gtttggaagatcctgtg

SEQ ID NO: 2952424 - DNA, 18 bp, Homo sapiens
gtttggattcttatgtag

SEQ ID NO: 2952425 - DNA, 13 bp, Homo sapiens
gtttggcccaaga

SEQ ID NO: 2952426 - DNA, 20 bp, Homo sapiens
gtttggcccaagactgggct

SEQ ID NO: 2952427 - DNA, 13 bp, Homo sapiens
gtttggcccaagt

SEQ ID NO: 2952428 - DNA, 18 bp, Homo sapiens
gtttggctttcagggagg

SEQ ID NO: 2952429 - DNA, 16 bp, Homo sapiens
gtttgggaaagatgga

SEQ ID NO: 2952430 - DNA, 16 bp, Homo sapiens
gtttgggacccctggt

SEQ ID NO: 2952431 - DNA, 11 bp, Homo sapiens
gtttgggcttc

SEQ ID NO: 2952432 - DNA, 13 bp, Homo sapiens
gtttgggcttcag

SEQ ID NO: 2952433 - DNA, 21 bp, Homo sapiens
gtttggggagcaagtgttaat

SEQ ID NO: 2952434 - DNA, 18 bp, Homo sapiens
gtttggggcaagtcatgt

SEQ ID NO: 2952435 - DNA, 21 bp, Homo sapiens
gtttggggcaagtcatgtaaa

SEQ ID NO: 2952436 - DNA, 23 bp, Homo sapiens
gtttggtcttaggtcttcctgtg

SEQ ID NO: 2952437 - DNA, 11 bp, Homo sapiens
gtttggttttg

SEQ ID NO: 2952438 - DNA, 14 bp, Homo sapiens
gtttgtaaaaatat

SEQ ID NO: 2952439 - DNA, 13 bp, Homo sapiens
gtttgtaagaaaa

SEQ ID NO: 2952440 - DNA, 18 bp, Homo sapiens
gtttgtagctttcctgga

SEQ ID NO: 2952441 - DNA, 21 bp, Homo sapiens
gtttgtagctttcctggaagt

SEQ ID NO: 2952442 - DNA, 20 bp, Homo sapiens
gtttgtatgtgtgtagacaa

SEQ ID NO: 2952443 - DNA, 16 bp, Homo sapiens
gtttgtattcatgttc

SEQ ID NO: 2952444 - DNA, 17 bp, Homo sapiens
gtttgtcagcatctgac

SEQ ID NO: 2952445 - DNA, 22 bp, Homo sapiens
gtttgtcctgatgcttttgtct

SEQ ID NO: 2952446 - DNA, 15 bp, Homo sapiens
gtttgtgtctgtggt

SEQ ID NO: 2952447 - DNA, 12 bp, Homo sapiens
gtttgtgtgtct

SEQ ID NO: 2952448 - DNA, 15 bp, Homo sapiens
gtttgtgtgttgtct

SEQ ID NO: 2952449 - DNA, 14 bp, Homo sapiens
gtttgttactttga

SEQ ID NO: 2952450 - DNA, 16 bp, Homo sapiens
gtttgttactttgaat

SEQ ID NO: 2952451 - DNA, 16 bp, Homo sapiens
gtttgttggtcacatg

SEQ ID NO: 2952452 - DNA, 17 bp, Homo sapiens
gtttgtttcctgtctga

SEQ ID NO: 2952453 - DNA, 18 bp, Homo sapiens
gtttgttttcttgtctgt

SEQ ID NO: 2952454 - DNA, 21 bp, Homo sapiens
gtttgtttttaaaaagcaaat

SEQ ID NO: 2952455 - DNA, 19 bp, Homo sapiens
gttttaaggaaaaaagatt

SEQ ID NO: 2952456 - DNA, 22 bp, Homo sapiens
gttttaagtgaaagtgaggaaa

SEQ ID NO: 2952457 - DNA, 22 bp, Homo sapiens
gttttaattccatgaatcgctt

SEQ ID NO: 2952458 - DNA, 21 bp, Homo sapiens
gttttacattgttgagctatt

SEQ ID NO: 2952459 - DNA, 23 bp, Homo sapiens
gttttactgttacaatattaggt

SEQ ID NO: 2952460 - DNA, 15 bp, Homo sapiens
gttttacttacaaaa

SEQ ID NO: 2952461 - DNA, 22 bp, Homo sapiens
gttttagacaaatactcatgtg

SEQ ID NO: 2952462 - DNA, 18 bp, Homo sapiens
gttttagaggcattgtta

SEQ ID NO: 2952463 - DNA, 21 bp, Homo sapiens
gttttagattttctggttcta

SEQ ID NO: 2952464 - DNA, 13 bp, Homo sapiens
gttttaggttcta

SEQ ID NO: 2952465 - DNA, 21 bp, Homo sapiens
gttttaggttctaaagttcta

SEQ ID NO: 2952466 - DNA, 16 bp, Homo sapiens
gttttagtgccaggct

SEQ ID NO: 2952467 - DNA, 16 bp, Homo sapiens
gttttataaaatcaag

SEQ ID NO: 2952468 - DNA, 19 bp, Homo sapiens
gttttatctccatactttg

SEQ ID NO: 2952469 - DNA, 20 bp, Homo sapiens
gttttatctccatactttgg

SEQ ID NO: 2952470 - DNA, 21 bp, Homo sapiens
gttttatctccatactttgga

SEQ ID NO: 2952471 - DNA, 16 bp, Homo sapiens
gttttattataaattc

SEQ ID NO: 2952472 - DNA, 12 bp, Homo sapiens
gttttatttaac

SEQ ID NO: 2952473 - DNA, 17 bp, Homo sapiens
gttttcagactcagact

SEQ ID NO: 2952474 - DNA, 18 bp, Homo sapiens
gttttccaaaagtaaaga

SEQ ID NO: 2952475 - DNA, 17 bp, Homo sapiens
gttttccattgtttgaa

SEQ ID NO: 2952476 - DNA, 13 bp, Homo sapiens
gttttcccacttt

SEQ ID NO: 2952477 - DNA, 13 bp, Homo sapiens
gttttcctccctt

SEQ ID NO: 2952478 - DNA, 18 bp, Homo sapiens
gttttcctcccttctgct

SEQ ID NO: 2952479 - DNA, 22 bp, Homo sapiens
gttttcctcccttctgctactg

SEQ ID NO: 2952480 - DNA, 22 bp, Homo sapiens
gttttctaaaaaaaaaaactgt

SEQ ID NO: 2952481 - DNA, 16 bp, Homo sapiens
gttttctagatgacat

SEQ ID NO: 2952482 - DNA, 18 bp, Homo sapiens
gttttctgggggaaaaag

SEQ ID NO: 2952483 - DNA, 14 bp, Homo sapiens
gttttctgtgcact

SEQ ID NO: 2952484 - DNA, 15 bp, Homo sapiens
gttttcttctaatca

SEQ ID NO: 2952485 - DNA, 14 bp, Homo sapiens
gttttgaaactaga

SEQ ID NO: 2952486 - DNA, 19 bp, Homo sapiens
gttttgaagctactgtgtg

SEQ ID NO: 2952487 - DNA, 21 bp, Homo sapiens
gttttgaaggcaaaattgcaa

SEQ ID NO: 2952488 - DNA, 16 bp, Homo sapiens
gttttgcaataacttc

SEQ ID NO: 2952489 - DNA, 12 bp, Homo sapiens
gttttgccagcc

SEQ ID NO: 2952490 - DNA, 22 bp, Homo sapiens
gttttgcctgtgactgtaaaga

SEQ ID NO: 2952491 - DNA, 17 bp, Homo sapiens
gttttgctgctataatt

SEQ ID NO: 2952492 - DNA, 16 bp, Homo sapiens
gttttgctgtttcctt

SEQ ID NO: 2952493 - DNA, 11 bp, Homo sapiens
gttttgctttt

SEQ ID NO: 2952494 - DNA, 21 bp, Homo sapiens
gttttgcttttatccactggc

SEQ ID NO: 2952495 - DNA, 22 bp, Homo sapiens
gttttgcttttatccactggca

SEQ ID NO: 2952496 - DNA, 16 bp, Homo sapiens
gttttggactccatct

SEQ ID NO: 2952497 - DNA, 21 bp, Homo sapiens
gttttgggggtgtgagtgttt

SEQ ID NO: 2952498 - DNA, 16 bp, Homo sapiens
gttttggtgtaacatc

SEQ ID NO: 2952499 - DNA, 13 bp, Homo sapiens
gttttgtaaatgt

SEQ ID NO: 2952500 - DNA, 23 bp, Homo sapiens
gttttgtaaatgtactggtaatt

SEQ ID NO: 2952501 - DNA, 20 bp, Homo sapiens
gttttgtaagccctctttaa

SEQ ID NO: 2952502 - DNA, 12 bp, Homo sapiens
gttttgtacatg

SEQ ID NO: 2952503 - DNA, 19 bp, Homo sapiens
gttttgtaccagtgaattt

SEQ ID NO: 2952504 - DNA, 17 bp, Homo sapiens
gttttgtaggagacttg

SEQ ID NO: 2952505 - DNA, 14 bp, Homo sapiens
gttttgtgtgtata

SEQ ID NO: 2952506 - DNA, 15 bp, Homo sapiens
gttttgttctttaaa

SEQ ID NO: 2952507 - DNA, 17 bp, Homo sapiens
gttttgtttattaaata

SEQ ID NO: 2952508 - DNA, 17 bp, Homo sapiens
gtttttaaaaagcaaat

SEQ ID NO: 2952509 - DNA, 18 bp, Homo sapiens
gtttttaaatagagtttg

SEQ ID NO: 2952510 - DNA, 15 bp, Homo sapiens
gtttttaaattttgt

SEQ ID NO: 2952511 - DNA, 19 bp, Homo sapiens
gtttttaaattttgtaatg

SEQ ID NO: 2952512 - DNA, 20 bp, Homo sapiens
gtttttaactcatctttaga

SEQ ID NO: 2952513 - DNA, 17 bp, Homo sapiens
gtttttacagttagggt

SEQ ID NO: 2952514 - DNA, 18 bp, Homo sapiens
gtttttatggggctgaac

SEQ ID NO: 2952515 - DNA, 17 bp, Homo sapiens
gtttttattcaaagcag

SEQ ID NO: 2952516 - DNA, 23 bp, Homo sapiens
gtttttcatggaaaagccttctt

SEQ ID NO: 2952517 - DNA, 17 bp, Homo sapiens
gtttttccactactgct

SEQ ID NO: 2952518 - DNA, 19 bp, Homo sapiens
gtttttccatgtgttttgc

SEQ ID NO: 2952519 - DNA, 14 bp, Homo sapiens
gtttttcttgtaaa

SEQ ID NO: 2952520 - DNA, 21 bp, Homo sapiens
gtttttctttaatatgattct

SEQ ID NO: 2952521 - DNA, 15 bp, Homo sapiens
gtttttgacatttat

SEQ ID NO: 2952522 - DNA, 23 bp, Homo sapiens
gtttttgaggctttctgttgcca

SEQ ID NO: 2952523 - DNA, 15 bp, Homo sapiens
gtttttgcactgtct

SEQ ID NO: 2952524 - DNA, 17 bp, Homo sapiens
gtttttgcccatcctcc

SEQ ID NO: 2952525 - DNA, 16 bp, Homo sapiens
gtttttggaaagaaat

SEQ ID NO: 2952526 - DNA, 15 bp, Homo sapiens
gtttttggtttctta

SEQ ID NO: 2952527 - DNA, 15 bp, Homo sapiens
gtttttgtaaagtgt

SEQ ID NO: 2952528 - DNA, 16 bp, Homo sapiens
gtttttgtaaagtgtg

SEQ ID NO: 2952529 - DNA, 19 bp, Homo sapiens
gtttttgtatgaagtactt

SEQ ID NO: 2952530 - DNA, 20 bp, Homo sapiens
gtttttgttgagtctctgaa

SEQ ID NO: 2952531 - DNA, 19 bp, Homo sapiens
gttttttaaacaaatgagt

SEQ ID NO: 2952532 - DNA, 22 bp, Homo sapiens
gttttttaaggtgagttctcac

SEQ ID NO: 2952533 - DNA, 20 bp, Homo sapiens
gttttttacttttttacact

SEQ ID NO: 2952534 - DNA, 14 bp, Homo sapiens
gttttttcaaaata

SEQ ID NO: 2952535 - DNA, 15 bp, Homo sapiens
gttttttcaaaatag

SEQ ID NO: 2952536 - DNA, 19 bp, Homo sapiens
gttttttcttcttttaaaa

SEQ ID NO: 2952537 - DNA, 15 bp, Homo sapiens
gttttttgtttgagt

SEQ ID NO: 2952538 - DNA, 15 bp, Homo sapiens
gttttttttttaaaa

SEQ ID NO: 2952539 - DNA, 17 bp, Homo sapiens
gttttttttttgtttgt

SEQ ID NO: 2952540 - DNA, 19 bp, Homo sapiens
taaaaaaaaaaaagttata

SEQ ID NO: 2952541 - DNA, 13 bp, Homo sapiens
taaaaaaaaaaac

SEQ ID NO: 2952542 - DNA, 16 bp, Homo sapiens
taaaaaaaaaaactgt

SEQ ID NO: 2952543 - DNA, 14 bp, Homo sapiens
taaaaaaaaagaat

SEQ ID NO: 2952544 - DNA, 17 bp, Homo sapiens
taaaaaaaagaagtgtg

SEQ ID NO: 2952545 - DNA, 12 bp, Homo sapiens
taaaaaaaatgt

SEQ ID NO: 2952546 - DNA, 13 bp, Homo sapiens
taaaaaaagaaaa

SEQ ID NO: 2952547 - DNA, 14 bp, Homo sapiens
taaaaaaatggcag

SEQ ID NO: 2952548 - DNA, 18 bp, Homo sapiens
taaaaaaatttttgcaaa

SEQ ID NO: 2952549 - DNA, 14 bp, Homo sapiens
taaaaaacaaagaa

SEQ ID NO: 2952550 - DNA, 12 bp, Homo sapiens
taaaaaacaaga

SEQ ID NO: 2952551 - DNA, 15 bp, Homo sapiens
taaaaaagctgtgtg

SEQ ID NO: 2952552 - DNA, 18 bp, Homo sapiens
taaaaaaggagaattgaa

SEQ ID NO: 2952553 - DNA, 12 bp, Homo sapiens
taaaaaatggaa

SEQ ID NO: 2952554 - DNA, 19 bp, Homo sapiens
taaaaacattgcctttgaa

SEQ ID NO: 2952555 - DNA, 12 bp, Homo sapiens
taaaaacattta

SEQ ID NO: 2952556 - DNA, 19 bp, Homo sapiens
taaaaactagtagttctct

SEQ ID NO: 2952557 - DNA, 21 bp, Homo sapiens
taaaaactgagtgactctata

SEQ ID NO: 2952558 - DNA, 18 bp, Homo sapiens
taaaaagaaacaagatgc

SEQ ID NO: 2952559 - DNA, 19 bp, Homo sapiens
taaaaagaaacaagatgct

SEQ ID NO: 2952560 - DNA, 23 bp, Homo sapiens
taaaaagaggatgatttcagaag

SEQ ID NO: 2952561 - DNA, 13 bp, Homo sapiens
taaaaagatgact

SEQ ID NO: 2952562 - DNA, 12 bp, Homo sapiens
taaaaagcaaat

SEQ ID NO: 2952563 - DNA, 15 bp, Homo sapiens
taaaaagcagaattt

SEQ ID NO: 2952564 - DNA, 21 bp, Homo sapiens
taaaaagcagaattttaatgt

SEQ ID NO: 2952565 - DNA, 15 bp, Homo sapiens
taaaaagcaggaaat

SEQ ID NO: 2952566 - DNA, 17 bp, Homo sapiens
taaaaaggaactgcagc

SEQ ID NO: 2952567 - DNA, 17 bp, Homo sapiens
taaaaagggagaaagaa

SEQ ID NO: 2952568 - DNA, 19 bp, Homo sapiens
taaaaagggagaaagaaaa

SEQ ID NO: 2952569 - DNA, 19 bp, Homo sapiens
taaaaagtgagaaagaaag

SEQ ID NO: 2952570 - DNA, 11 bp, Homo sapiens
taaaaagttaa

SEQ ID NO: 2952571 - DNA, 14 bp, Homo sapiens
taaaaagttgttca

SEQ ID NO: 2952572 - DNA, 19 bp, Homo sapiens
taaaaataaatcccatgga

SEQ ID NO: 2952573 - DNA, 11 bp, Homo sapiens
taaaaatacaa

SEQ ID NO: 2952574 - DNA, 12 bp, Homo sapiens
taaaaatagaaa

SEQ ID NO: 2952575 - DNA, 15 bp, Homo sapiens
taaaaatagaaacat

SEQ ID NO: 2952576 - DNA, 22 bp, Homo sapiens
taaaaatatacaagctacagtt

SEQ ID NO: 2952577 - DNA, 22 bp, Homo sapiens
taaaaatgtcttgctgttgaca

SEQ ID NO: 2952578 - DNA, 23 bp, Homo sapiens
taaaaatgtcttgctgttgacat

SEQ ID NO: 2952579 - DNA, 16 bp, Homo sapiens
taaaaattgtagcttt

SEQ ID NO: 2952580 - DNA, 18 bp, Homo sapiens
taaaaattgtcttcatgt

SEQ ID NO: 2952581 - DNA, 19 bp, Homo sapiens
taaaaattgtcttcatgta

SEQ ID NO: 2952582 - DNA, 23 bp, Homo sapiens
taaaaattgtttcaaaataaaaa

SEQ ID NO: 2952583 - DNA, 20 bp, Homo sapiens
taaaacaaaaggaaagaaac

SEQ ID NO: 2952584 - DNA, 22 bp, Homo sapiens
taaaacaagcactaaacaaaga

SEQ ID NO: 2952585 - DNA, 16 bp, Homo sapiens
taaaacacctctgctt

SEQ ID NO: 2952586 - DNA, 19 bp, Homo sapiens
taaaacacctctgctttct

SEQ ID NO: 2952587 - DNA, 13 bp, Homo sapiens
taaaacacttctg

SEQ ID NO: 2952588 - DNA, 23 bp, Homo sapiens
taaaacagtattctgtaaagctt

SEQ ID NO: 2952589 - DNA, 14 bp, Homo sapiens
taaaacatgtaata

SEQ ID NO: 2952590 - DNA, 12 bp, Homo sapiens
taaaacattaat

SEQ ID NO: 2952591 - DNA, 13 bp, Homo sapiens
taaaaccaagcct

SEQ ID NO: 2952592 - DNA, 15 bp, Homo sapiens
taaaaccttgaaggt

SEQ ID NO: 2952593 - DNA, 17 bp, Homo sapiens
taaaactggctttggct

SEQ ID NO: 2952594 - DNA, 18 bp, Homo sapiens
taaaactgtatttaagga

SEQ ID NO: 2952595 - DNA, 20 bp, Homo sapiens
taaaagaaaatgtaaaaaac

SEQ ID NO: 2952596 - DNA, 14 bp, Homo sapiens
taaaagacaaacac

SEQ ID NO: 2952597 - DNA, 13 bp, Homo sapiens
taaaagactttga

SEQ ID NO: 2952598 - DNA, 14 bp, Homo sapiens
taaaagactttgat

SEQ ID NO: 2952599 - DNA, 13 bp, Homo sapiens
taaaagatgcaga

SEQ ID NO: 2952600 - DNA, 12 bp, Homo sapiens
taaaagatgctt

SEQ ID NO: 2952601 - DNA, 20 bp, Homo sapiens
taaaagcatggccctgctgc

SEQ ID NO: 2952602 - DNA, 12 bp, Homo sapiens
taaaagctgtgg

SEQ ID NO: 2952603 - DNA, 18 bp, Homo sapiens
taaaaggcaaatgtgtac

SEQ ID NO: 2952604 - DNA, 17 bp, Homo sapiens
taaaagggtcaaacctg

SEQ ID NO: 2952605 - DNA, 18 bp, Homo sapiens
taaaagggtcaaacctgt

SEQ ID NO: 2952606 - DNA, 20 bp, Homo sapiens
taaaagggtcaaacctgtag

SEQ ID NO: 2952607 - DNA, 21 bp, Homo sapiens
taaaagtcatttaactgaaga

SEQ ID NO: 2952608 - DNA, 19 bp, Homo sapiens
taaaagtgggcttgattct

SEQ ID NO: 2952609 - DNA, 22 bp, Homo sapiens
taaaagtgttgttatcatgact

SEQ ID NO: 2952610 - DNA, 17 bp, Homo sapiens
taaaagttcctctccct

SEQ ID NO: 2952611 - DNA, 23 bp, Homo sapiens
taaaagttcctctcccttccctt

SEQ ID NO: 2952612 - DNA, 23 bp, Homo sapiens
taaaataaaccaaatatgttaaa

SEQ ID NO: 2952613 - DNA, 14 bp, Homo sapiens
taaaataaacctgt

SEQ ID NO: 2952614 - DNA, 11 bp, Homo sapiens
taaaataacta

SEQ ID NO: 2952615 - DNA, 20 bp, Homo sapiens
taaaataactatcaggcaga

SEQ ID NO: 2952616 - DNA, 18 bp, Homo sapiens
taaaataatgcaaagaat

SEQ ID NO: 2952617 - DNA, 22 bp, Homo sapiens
taaaataattttatctctttct

SEQ ID NO: 2952618 - DNA, 17 bp, Homo sapiens
taaaatagagtgtagtt

SEQ ID NO: 2952619 - DNA, 23 bp, Homo sapiens
taaaatagagtgtagtttacaga

SEQ ID NO: 2952620 - DNA, 19 bp, Homo sapiens
taaaatatgaagacataaa

SEQ ID NO: 2952621 - DNA, 13 bp, Homo sapiens
taaaatattactg

SEQ ID NO: 2952622 - DNA, 11 bp, Homo sapiens
taaaatattta

SEQ ID NO: 2952623 - DNA, 12 bp, Homo sapiens
taaaatatttaa

SEQ ID NO: 2952624 - DNA, 17 bp, Homo sapiens
taaaatcaagttttaag

SEQ ID NO: 2952625 - DNA, 19 bp, Homo sapiens
taaaatccccatgcctgtg

SEQ ID NO: 2952626 - DNA, 23 bp, Homo sapiens
taaaatccccatgcctgtggctg

SEQ ID NO: 2952627 - DNA, 13 bp, Homo sapiens
taaaatctgtcac

SEQ ID NO: 2952628 - DNA, 19 bp, Homo sapiens
taaaatcttatagttctag

SEQ ID NO: 2952629 - DNA, 14 bp, Homo sapiens
taaaatcttcagct

SEQ ID NO: 2952630 - DNA, 21 bp, Homo sapiens
taaaatcttgcagttttgtaa

SEQ ID NO: 2952631 - DNA, 14 bp, Homo sapiens
taaaatgatcctgc

SEQ ID NO: 2952632 - DNA, 17 bp, Homo sapiens
taaaatgcagtaacatt

SEQ ID NO: 2952633 - DNA, 19 bp, Homo sapiens
taaaatgcccatttcgaag

SEQ ID NO: 2952634 - DNA, 17 bp, Homo sapiens
taaaatgctcaatttca

SEQ ID NO: 2952635 - DNA, 18 bp, Homo sapiens
taaaatggatgccttgaa

SEQ ID NO: 2952636 - DNA, 16 bp, Homo sapiens
taaaatggtacatttc

SEQ ID NO: 2952637 - DNA, 16 bp, Homo sapiens
taaaatggtttgtcct

SEQ ID NO: 2952638 - DNA, 18 bp, Homo sapiens
taaaatggtttgtcctga

SEQ ID NO: 2952639 - DNA, 23 bp, Homo sapiens
taaaatgtaaagccatgctggaa

SEQ ID NO: 2952640 - DNA, 14 bp, Homo sapiens
taaaatgtaagatt

SEQ ID NO: 2952641 - DNA, 15 bp, Homo sapiens
taaaatgtcaagaaa

SEQ ID NO: 2952642 - DNA, 14 bp, Homo sapiens
taaaatgtttactg

SEQ ID NO: 2952643 - DNA, 20 bp, Homo sapiens
taaaatgtttactgtaaatt

SEQ ID NO: 2952644 - DNA, 16 bp, Homo sapiens
taaaattagatgcatg

SEQ ID NO: 2952645 - DNA, 19 bp, Homo sapiens
taaaattatagatgggaat

SEQ ID NO: 2952646 - DNA, 14 bp, Homo sapiens
taaaatttacattt

SEQ ID NO: 2952647 - DNA, 15 bp, Homo sapiens
taaaatttacattta

SEQ ID NO: 2952648 - DNA, 22 bp, Homo sapiens
taaaatttacatttaatacaga

SEQ ID NO: 2952649 - DNA, 17 bp, Homo sapiens
taaaatttatattgtaa

SEQ ID NO: 2952650 - DNA, 23 bp, Homo sapiens
taaaatttattctacttttaaat

SEQ ID NO: 2952651 - DNA, 15 bp, Homo sapiens
taaaatttggtgctt

SEQ ID NO: 2952652 - DNA, 14 bp, Homo sapiens
taaaatttgtagaa

SEQ ID NO: 2952653 - DNA, 14 bp, Homo sapiens
taaaatttgttgca

SEQ ID NO: 2952654 - DNA, 22 bp, Homo sapiens
taaaatttttttggtctttttg

SEQ ID NO: 2952655 - DNA, 16 bp, Homo sapiens
taaaattttttttcat

SEQ ID NO: 2952656 - DNA, 18 bp, Homo sapiens
taaacaaggtcatacata

SEQ ID NO: 2952657 - DNA, 17 bp, Homo sapiens
taaacaagtattttata

SEQ ID NO: 2952658 - DNA, 13 bp, Homo sapiens
taaacaataaact

SEQ ID NO: 2952659 - DNA, 16 bp, Homo sapiens
taaacacttgcaacct

SEQ ID NO: 2952660 - DNA, 13 bp, Homo sapiens
taaacagcagggt

SEQ ID NO: 2952661 - DNA, 16 bp, Homo sapiens
taaacatatgaatgca

SEQ ID NO: 2952662 - DNA, 18 bp, Homo sapiens
taaaccaggtttgcacct

SEQ ID NO: 2952663 - DNA, 18 bp, Homo sapiens
taaacccacaagctgcct

SEQ ID NO: 2952664 - DNA, 20 bp, Homo sapiens
taaacccacaagctgcctct

SEQ ID NO: 2952665 - DNA, 20 bp, Homo sapiens
taaaccgctttggcctgagt

SEQ ID NO: 2952666 - DNA, 13 bp, Homo sapiens
taaacctgtgcct

SEQ ID NO: 2952667 - DNA, 20 bp, Homo sapiens
taaacctgtttttttttcat

SEQ ID NO: 2952668 - DNA, 21 bp, Homo sapiens
taaacctgtttttttttcatt

SEQ ID NO: 2952669 - DNA, 21 bp, Homo sapiens
taaaccttgtttctttctgaa

SEQ ID NO: 2952670 - DNA, 21 bp, Homo sapiens
taaacctttttcttgatctta

SEQ ID NO: 2952671 - DNA, 22 bp, Homo sapiens
taaacctttttcttgatcttaa

SEQ ID NO: 2952672 - DNA, 14 bp, Homo sapiens
taaacgaagataaa

SEQ ID NO: 2952673 - DNA, 22 bp, Homo sapiens
taaacgattagtgatgtcctta

SEQ ID NO: 2952674 - DNA, 20 bp, Homo sapiens
taaacgcagaagagggggag

SEQ ID NO: 2952675 - DNA, 13 bp, Homo sapiens
taaactaaacacg

SEQ ID NO: 2952676 - DNA, 15 bp, Homo sapiens
taaactagagaaggg

SEQ ID NO: 2952677 - DNA, 16 bp, Homo sapiens
taaactagagaaggga

SEQ ID NO: 2952678 - DNA, 11 bp, Homo sapiens
taaactagatg

SEQ ID NO: 2952679 - DNA, 15 bp, Homo sapiens
taaactagatgacct

SEQ ID NO: 2952680 - DNA, 17 bp, Homo sapiens
taaactagggttttggc

SEQ ID NO: 2952681 - DNA, 19 bp, Homo sapiens
taaactagggttttggcct

SEQ ID NO: 2952682 - DNA, 12 bp, Homo sapiens
taaactgagcct

SEQ ID NO: 2952683 - DNA, 18 bp, Homo sapiens
taaactgagctcgcagcc

SEQ ID NO: 2952684 - DNA, 14 bp, Homo sapiens
taaactgtgcacca

SEQ ID NO: 2952685 - DNA, 15 bp, Homo sapiens
taaacttagaggaaa

SEQ ID NO: 2952686 - DNA, 13 bp, Homo sapiens
taaacttgtagga

SEQ ID NO: 2952687 - DNA, 17 bp, Homo sapiens
taaagaaaagcctcagc

SEQ ID NO: 2952688 - DNA, 18 bp, Homo sapiens
taaagaaaatctctgtga

SEQ ID NO: 2952689 - DNA, 14 bp, Homo sapiens
taaagaaagagaga

SEQ ID NO: 2952690 - DNA, 12 bp, Homo sapiens
taaattcctctt

SEQ ID NO: 2952691 - DNA, 23 bp, Homo sapiens
taaattcgctgtgagtgagtggt

SEQ ID NO: 2952692 - DNA, 19 bp, Homo sapiens
taaattctcaaagttttat

SEQ ID NO: 2952693 - DNA, 19 bp, Homo sapiens
taaattctctctaacataa

SEQ ID NO: 2952694 - DNA, 16 bp, Homo sapiens
taaattctttttcaaa

SEQ ID NO: 2952695 - DNA, 18 bp, Homo sapiens
taaattctttttcaaaaa

SEQ ID NO: 2952696 - DNA, 13 bp, Homo sapiens
taaattgaataat

SEQ ID NO: 2952697 - DNA, 16 bp, Homo sapiens
taaattgaataatggt

SEQ ID NO: 2952698 - DNA, 17 bp, Homo sapiens
taaattgatagcagata

SEQ ID NO: 2952699 - DNA, 17 bp, Homo sapiens
taaattgcagacagtgt

SEQ ID NO: 2952700 - DNA, 16 bp, Homo sapiens
taaattgcatttctat

SEQ ID NO: 2952701 - DNA, 17 bp, Homo sapiens
taaattggtattaacta

SEQ ID NO: 2952702 - DNA, 22 bp, Homo sapiens
taaatttaagcttaagccataa

SEQ ID NO: 2952703 - DNA, 18 bp, Homo sapiens
taaatttactctgttgaa

SEQ ID NO: 2952704 - DNA, 16 bp, Homo sapiens
taaatttatttgaaaa

SEQ ID NO: 2952705 - DNA, 18 bp, Homo sapiens
taaatttccccaacagtg

SEQ ID NO: 2952706 - DNA, 19 bp, Homo sapiens
taaatttccccaacagtgt

SEQ ID NO: 2952707 - DNA, 20 bp, Homo sapiens
taaatttccccaacagtgtg

SEQ ID NO: 2952708 - DNA, 21 bp, Homo sapiens
taaatttccccaacagtgtga

SEQ ID NO: 2952709 - DNA, 23 bp, Homo sapiens
taaatttccccaacagtgtgaag

SEQ ID NO: 2952710 - DNA, 21 bp, Homo sapiens
taaatttctctttttgaaaaa

SEQ ID NO: 2952711 - DNA, 21 bp, Homo sapiens
taaatttgaactccatgggat

SEQ ID NO: 2952712 - DNA, 18 bp, Homo sapiens
taaatttgttgtcatgtg

SEQ ID NO: 2952713 - DNA, 19 bp, Homo sapiens
taaatttgttgtcatgtgt

SEQ ID NO: 2952714 - DNA, 14 bp, Homo sapiens
taaattttctccag

SEQ ID NO: 2952715 - DNA, 18 bp, Homo sapiens
taaattttctttttgttt

SEQ ID NO: 2952716 - DNA, 13 bp, Homo sapiens
taaattttgtaat

SEQ ID NO: 2952717 - DNA, 14 bp, Homo sapiens
taaattttgtgcaa

SEQ ID NO: 2952718 - DNA, 20 bp, Homo sapiens
taacaaaccaacatctttgc

SEQ ID NO: 2952719 - DNA, 12 bp, Homo sapiens
taacaaagatat

SEQ ID NO: 2952720 - DNA, 22 bp, Homo sapiens
taacaaagatatcttttcttta

SEQ ID NO: 2952721 - DNA, 19 bp, Homo sapiens
taacaaatgctattaaagt

SEQ ID NO: 2952722 - DNA, 13 bp, Homo sapiens
taacaaattctga

SEQ ID NO: 2952723 - DNA, 14 bp, Homo sapiens
taacaagaagatga

SEQ ID NO: 2952724 - DNA, 15 bp, Homo sapiens
taacaagaagatgaa

SEQ ID NO: 2952725 - DNA, 14 bp, Homo sapiens
taacaatcagctcc

SEQ ID NO: 2952726 - DNA, 16 bp, Homo sapiens
taacaatgtattttaa

SEQ ID NO: 2952727 - DNA, 16 bp, Homo sapiens
taacaattaggcagac

SEQ ID NO: 2952728 - DNA, 14 bp, Homo sapiens
taacaattcctcta

SEQ ID NO: 2952729 - DNA, 21 bp, Homo sapiens
taacaattttttattaaattt

SEQ ID NO: 2952730 - DNA, 20 bp, Homo sapiens
taacacaattaaatgactta

SEQ ID NO: 2952731 - DNA, 14 bp, Homo sapiens
taacacatgtcctt

SEQ ID NO: 2952732 - DNA, 18 bp, Homo sapiens
taacacctgattaactga

SEQ ID NO: 2952733 - DNA, 16 bp, Homo sapiens
taacagattatgtatt

SEQ ID NO: 2952734 - DNA, 13 bp, Homo sapiens
taacaggctgtag

SEQ ID NO: 2952735 - DNA, 14 bp, Homo sapiens
taacaggtattttc

SEQ ID NO: 2952736 - DNA, 15 bp, Homo sapiens
taacaggttttcttc

SEQ ID NO: 2952737 - DNA, 17 bp, Homo sapiens
taacaggttttcttcta

SEQ ID NO: 2952738 - DNA, 16 bp, Homo sapiens
taacagtctagtgcaa

SEQ ID NO: 2952739 - DNA, 13 bp, Homo sapiens
taacatatctaaa

SEQ ID NO: 2952740 - DNA, 18 bp, Homo sapiens
taacatatctaaagtcat

SEQ ID NO: 2952741 - DNA, 19 bp, Homo sapiens
taacatcagaactgaaata

SEQ ID NO: 2952742 - DNA, 21 bp, Homo sapiens
taacatcagccatttttagat

SEQ ID NO: 2952743 - DNA, 18 bp, Homo sapiens
taacatgaaatgatagat

SEQ ID NO: 2952744 - DNA, 19 bp, Homo sapiens
taacatgaaatgatagatt

SEQ ID NO: 2952745 - DNA, 16 bp, Homo sapiens
taacatttaggagaag

SEQ ID NO: 2952746 - DNA, 19 bp, Homo sapiens
taacatttaggagaagttg

SEQ ID NO: 2952747 - DNA, 15 bp, Homo sapiens
taaccaaagaacgta

SEQ ID NO: 2952748 - DNA, 17 bp, Homo sapiens
taaccaatcgcaaagca

SEQ ID NO: 2952749 - DNA, 16 bp, Homo sapiens
taaccacattttagga

SEQ ID NO: 2952750 - DNA, 18 bp, Homo sapiens
taaccacctctctgtctt

SEQ ID NO: 2952751 - DNA, 15 bp, Homo sapiens
taaccactgaaggga

SEQ ID NO: 2952752 - DNA, 20 bp, Homo sapiens
taaccactgcaagtcctttt

SEQ ID NO: 2952753 - DNA, 17 bp, Homo sapiens
taaccagctcagtgttt

SEQ ID NO: 2952754 - DNA, 18 bp, Homo sapiens
taaccagctcagtgtttt

SEQ ID NO: 2952755 - DNA, 23 bp, Homo sapiens
taaccatctttaatcaatgtgac

SEQ ID NO: 2952756 - DNA, 16 bp, Homo sapiens
taaccattgatgagca

SEQ ID NO: 2952757 - DNA, 20 bp, Homo sapiens
taaccattttataaagtgct

SEQ ID NO: 2952758 - DNA, 18 bp, Homo sapiens
taacccccactggactga

SEQ ID NO: 2952759 - DNA, 18 bp, Homo sapiens
taacccccagcccacaga

SEQ ID NO: 2952760 - DNA, 22 bp, Homo sapiens
taacccccagcccacagagcct

SEQ ID NO: 2952761 - DNA, 13 bp, Homo sapiens
taaccctgtggtt

SEQ ID NO: 2952762 - DNA, 17 bp, Homo sapiens
taaccctgttacaaagc

SEQ ID NO: 2952763 - DNA, 13 bp, Homo sapiens
taaccgctccagg

SEQ ID NO: 2952764 - DNA, 14 bp, Homo sapiens
taaccgtttttcaa

SEQ ID NO: 2952765 - DNA, 22 bp, Homo sapiens
taacctagtttgttactttaaa

SEQ ID NO: 2952766 - DNA, 20 bp, Homo sapiens
taacctataagcatgacata

SEQ ID NO: 2952767 - DNA, 22 bp, Homo sapiens
taacctcaagtgatcctcccac

SEQ ID NO: 2952768 - DNA, 14 bp, Homo sapiens
taacctcatcttct

SEQ ID NO: 2952769 - DNA, 13 bp, Homo sapiens
taacctgtgtctg

SEQ ID NO: 2952770 - DNA, 13 bp, Homo sapiens
taacctttgctat

SEQ ID NO: 2952771 - DNA, 15 bp, Homo sapiens
taacgaacccctaga

SEQ ID NO: 2952772 - DNA, 20 bp, Homo sapiens
taacgataaaagacagtgaa

SEQ ID NO: 2952773 - DNA, 17 bp, Homo sapiens
taacggttaagaaagca

SEQ ID NO: 2952774 - DNA, 20 bp, Homo sapiens
taacggttaagaaagcactt

SEQ ID NO: 2952775 - DNA, 20 bp, Homo sapiens
taacgtgcattataattttt

SEQ ID NO: 2952776 - DNA, 22 bp, Homo sapiens
taacgtgtatctttaagaaaaa

SEQ ID NO: 2952777 - DNA, 14 bp, Homo sapiens
taactaagaagtgg

SEQ ID NO: 2952778 - DNA, 17 bp, Homo sapiens
taactagacaccaaagt

SEQ ID NO: 2952779 - DNA, 14 bp, Homo sapiens
taactaggagactg

SEQ ID NO: 2952780 - DNA, 18 bp, Homo sapiens
taactatataagacatta

SEQ ID NO: 2952781 - DNA, 22 bp, Homo sapiens
taactattcagttgtgtttgtt

SEQ ID NO: 2952782 - DNA, 22 bp, Homo sapiens
taactcagaaacatcagttact

SEQ ID NO: 2952783 - DNA, 23 bp, Homo sapiens
taactcagtgaaggcccatgaag

SEQ ID NO: 2952784 - DNA, 11 bp, Homo sapiens
taactccacca

SEQ ID NO: 2952785 - DNA, 14 bp, Homo sapiens
taactcccactcct

SEQ ID NO: 2952786 - DNA, 17 bp, Homo sapiens
tacctgacactcccttg

SEQ ID NO: 2952787 - DNA, 20 bp, Homo sapiens
tacctgacactcccttgggc

SEQ ID NO: 2952788 - DNA, 18 bp, Homo sapiens
tacctgatcaatgacaga

SEQ ID NO: 2952789 - DNA, 21 bp, Homo sapiens
tacctgatttcttcagggctg

SEQ ID NO: 2952790 - DNA, 18 bp, Homo sapiens
tacctgcaacacaacatt

SEQ ID NO: 2952791 - DNA, 19 bp, Homo sapiens
tacctgcaacacaacattt

SEQ ID NO: 2952792 - DNA, 23 bp, Homo sapiens
tacctgcaacacaacatttgtgt

SEQ ID NO: 2952793 - DNA, 23 bp, Homo sapiens
tacctggatataaattaattgtg

SEQ ID NO: 2952794 - DNA, 12 bp, Homo sapiens
tacctggtgctc

SEQ ID NO: 2952795 - DNA, 18 bp, Homo sapiens
tacctgtaaatgtcctga

SEQ ID NO: 2952796 - DNA, 15 bp, Homo sapiens
tacctgtattcccag

SEQ ID NO: 2952797 - DNA, 18 bp, Homo sapiens
tacctgtatttaaaaata

SEQ ID NO: 2952798 - DNA, 22 bp, Homo sapiens
tacctgtatttaaaaatagaaa

SEQ ID NO: 2952799 - DNA, 20 bp, Homo sapiens
tacctgtgtccgatgctgga

SEQ ID NO: 2952800 - DNA, 14 bp, Homo sapiens
tacctgttcctccc

SEQ ID NO: 2952801 - DNA, 12 bp, Homo sapiens
tacctgttctgt

SEQ ID NO: 2952802 - DNA, 13 bp, Homo sapiens
tacctgttgagca

SEQ ID NO: 2952803 - DNA, 14 bp, Homo sapiens
tacctgttgagcat

SEQ ID NO: 2952804 - DNA, 22 bp, Homo sapiens
taccttattgagcgtgattctg

SEQ ID NO: 2952805 - DNA, 16 bp, Homo sapiens
taccttcatttcatcc

SEQ ID NO: 2952806 - DNA, 22 bp, Homo sapiens
taccttgaaaataagaatagaa

SEQ ID NO: 2952807 - DNA, 15 bp, Homo sapiens
taccttgaaaggaag

SEQ ID NO: 2952808 - DNA, 18 bp, Homo sapiens
taccttgacctttgtaca

SEQ ID NO: 2952809 - DNA, 16 bp, Homo sapiens
taccttgactgttgat

SEQ ID NO: 2952810 - DNA, 22 bp, Homo sapiens
taccttggttcccccactgatc

SEQ ID NO: 2952811 - DNA, 18 bp, Homo sapiens
taccttgtgagggagaga

SEQ ID NO: 2952812 - DNA, 14 bp, Homo sapiens
tacctttgtagtta

SEQ ID NO: 2952813 - DNA, 12 bp, Homo sapiens
taccttttgata

SEQ ID NO: 2952814 - DNA, 21 bp, Homo sapiens
taccttttgttaccacagagt

SEQ ID NO: 2952815 - DNA, 21 bp, Homo sapiens
taccttttttgttttttcaaa

SEQ ID NO: 2952816 - DNA, 17 bp, Homo sapiens
tacgaatgcccctgttc

SEQ ID NO: 2952817 - DNA, 22 bp, Homo sapiens
tacgaatgcccctgttcatgtt

SEQ ID NO: 2952818 - DNA, 15 bp, Homo sapiens
tacgataaggaagaa

SEQ ID NO: 2952819 - DNA, 16 bp, Homo sapiens
tacgataaggaagaaa

SEQ ID NO: 2952820 - DNA, 14 bp, Homo sapiens
tacgatcaggcaca

SEQ ID NO: 2952821 - DNA, 15 bp, Homo sapiens
tacgcaaggaaggac

SEQ ID NO: 2952822 - DNA, 22 bp, Homo sapiens
tacgcagcgtgctttaaaaaat

SEQ ID NO: 2952823 - DNA, 17 bp, Homo sapiens
tacgcctgcatgtaaac

SEQ ID NO: 2952824 - DNA, 17 bp, Homo sapiens
tacgctagagcatgctg

SEQ ID NO: 2952825 - DNA, 21 bp, Homo sapiens
tacgctctcctttctttctaa

SEQ ID NO: 2952826 - DNA, 22 bp, Homo sapiens
tacgctgaagatggcatcctgt

SEQ ID NO: 2952827 - DNA, 18 bp, Homo sapiens
tacgggagtgacccagct

SEQ ID NO: 2952828 - DNA, 23 bp, Homo sapiens
tacggtctggtgtaaaagtagtg

SEQ ID NO: 2952829 - DNA, 13 bp, Homo sapiens
tacgtagccacag

SEQ ID NO: 2952830 - DNA, 21 bp, Homo sapiens
tacgtatgcatttttttagtt

SEQ ID NO: 2952831 - DNA, 18 bp, Homo sapiens
tacgtcaaacatgaagtg

SEQ ID NO: 2952832 - DNA, 12 bp, Homo sapiens
tacgtcccagcg

SEQ ID NO: 2952833 - DNA, 16 bp, Homo sapiens
tacgtgcctcccgaga

SEQ ID NO: 2952834 - DNA, 16 bp, Homo sapiens
tacgtgtgaaatctgt

SEQ ID NO: 2952835 - DNA, 18 bp, Homo sapiens
tacgtgtgaaatctgtct

SEQ ID NO: 2952836 - DNA, 20 bp, Homo sapiens
tacgtgtgaaatctgtcttt

SEQ ID NO: 2952837 - DNA, 14 bp, Homo sapiens
tacgttgtttctta

SEQ ID NO: 2952838 - DNA, 19 bp, Homo sapiens
tacgttgtttcttatagat

SEQ ID NO: 2952839 - DNA, 22 bp, Homo sapiens
tacgtttgcaccgcctgccctc

SEQ ID NO: 2952840 - DNA, 14 bp, Homo sapiens
tacgtttgtatgtg

SEQ ID NO: 2952841 - DNA, 12 bp, Homo sapiens
tactaacctccc

SEQ ID NO: 2952842 - DNA, 23 bp, Homo sapiens
tactaacctcccttaagcagcaa

SEQ ID NO: 2952843 - DNA, 14 bp, Homo sapiens
tactaactgccatc

SEQ ID NO: 2952844 - DNA, 15 bp, Homo sapiens
tactaagatgacatt

SEQ ID NO: 2952845 - DNA, 14 bp, Homo sapiens
tactaagccaggag

SEQ ID NO: 2952846 - DNA, 18 bp, Homo sapiens
tactaaggagtaatctgt

SEQ ID NO: 2952847 - DNA, 22 bp, Homo sapiens
tactaaggagtaatctgtgtac

SEQ ID NO: 2952848 - DNA, 23 bp, Homo sapiens
tactaaggagtaatctgtgtaca

SEQ ID NO: 2952849 - DNA, 20 bp, Homo sapiens
tactaaggtgactttctgaa

SEQ ID NO: 2952850 - DNA, 18 bp, Homo sapiens
tactaagttattttatga

SEQ ID NO: 2952851 - DNA, 18 bp, Homo sapiens
tactaagtttccttttaa

SEQ ID NO: 2952852 - DNA, 22 bp, Homo sapiens
tactacctagaagtaagaagag

SEQ ID NO: 2952853 - DNA, 18 bp, Homo sapiens
tactacctataggaaagt

SEQ ID NO: 2952854 - DNA, 13 bp, Homo sapiens
tactactgttatc

SEQ ID NO: 2952855 - DNA, 23 bp, Homo sapiens
tactaggaagaacgttttttcct

SEQ ID NO: 2952856 - DNA, 21 bp, Homo sapiens
tactagtgtccgcataagaaa

SEQ ID NO: 2952857 - DNA, 14 bp, Homo sapiens
tactagttacacat

SEQ ID NO: 2952858 - DNA, 14 bp, Homo sapiens
tactatatttgtga

SEQ ID NO: 2952859 - DNA, 18 bp, Homo sapiens
tactatttttctttccaa

SEQ ID NO: 2952860 - DNA, 14 bp, Homo sapiens
tactcaaagtggaa

SEQ ID NO: 2952861 - DNA, 22 bp, Homo sapiens
tactcaaccaaattaaaaattt

SEQ ID NO: 2952862 - DNA, 14 bp, Homo sapiens
tactcaatggattt

SEQ ID NO: 2952863 - DNA, 14 bp, Homo sapiens
tactcaccatattt

SEQ ID NO: 2952864 - DNA, 20 bp, Homo sapiens
tactcaccatatttgaattg

SEQ ID NO: 2952865 - DNA, 22 bp, Homo sapiens
tactcaccatatttgaattggc

SEQ ID NO: 2952866 - DNA, 14 bp, Homo sapiens
tactcagagctgcg

SEQ ID NO: 2952867 - DNA, 15 bp, Homo sapiens
tactcagagctgcgg

SEQ ID NO: 2952868 - DNA, 17 bp, Homo sapiens
tactcagagctgcgggc

SEQ ID NO: 2952869 - DNA, 19 bp, Homo sapiens
tactcagagctgcgggctg

SEQ ID NO: 2952870 - DNA, 22 bp, Homo sapiens
tactcagagctgcgggctgagg

SEQ ID NO: 2952871 - DNA, 16 bp, Homo sapiens
tactcagataaggtaa

SEQ ID NO: 2952872 - DNA, 16 bp, Homo sapiens
tactcagcagcagaga

SEQ ID NO: 2952873 - DNA, 22 bp, Homo sapiens
tactcagcagcagagagccctg

SEQ ID NO: 2952874 - DNA, 15 bp, Homo sapiens
tactcagcagccctc

SEQ ID NO: 2952875 - DNA, 19 bp, Homo sapiens
tactcagcagccctcctca

SEQ ID NO: 2952876 - DNA, 13 bp, Homo sapiens
tactcagccctgg

SEQ ID NO: 2952877 - DNA, 16 bp, Homo sapiens
tactcagccctgggcc

SEQ ID NO: 2952878 - DNA, 22 bp, Homo sapiens
tactcagccctgggccccacca

SEQ ID NO: 2952879 - DNA, 22 bp, Homo sapiens
tactcaggaggctgaggcagaa

SEQ ID NO: 2952880 - DNA, 15 bp, Homo sapiens
tactcataatgtgaa

SEQ ID NO: 2952881 - DNA, 20 bp, Homo sapiens
tactcataatgtgaagtgtt

SEQ ID NO: 2952882 - DNA, 16 bp, Homo sapiens
tactccaaaaagacaa

SEQ ID NO: 2952883 - DNA, 20 bp, Homo sapiens
tactccaaaaagacaagtgc

SEQ ID NO: 2952884 - DNA, 12 bp, Homo sapiens
tactccagcctg

SEQ ID NO: 2952885 - DNA, 13 bp, Homo sapiens
tactccatggttc

SEQ ID NO: 2952886 - DNA, 14 bp, Homo sapiens
tactcccagacacc

SEQ ID NO: 2952887 - DNA, 17 bp, Homo sapiens
tactccctacactgatg

SEQ ID NO: 2952888 - DNA, 18 bp, Homo sapiens
tactccctacactgatgc

SEQ ID NO: 2952889 - DNA, 23 bp, Homo sapiens
tactccgtgaggctgctgccatc

SEQ ID NO: 2952890 - DNA, 22 bp, Homo sapiens
tactcgggaggctgaggcacaa

SEQ ID NO: 2952891 - DNA, 18 bp, Homo sapiens
tactctaagatcttagat

SEQ ID NO: 2952892 - DNA, 21 bp, Homo sapiens
tactctagatacctaaaacat

SEQ ID NO: 2952893 - DNA, 22 bp, Homo sapiens
tactctcacactggttctcaat

SEQ ID NO: 2952894 - DNA, 16 bp, Homo sapiens
tactctccaacctgga

SEQ ID NO: 2952895 - DNA, 15 bp, Homo sapiens
tactctcctgtttgg

SEQ ID NO: 2952896 - DNA, 20 bp, Homo sapiens
tactctctgagtacattgtg

SEQ ID NO: 2952897 - DNA, 13 bp, Homo sapiens
tactctcttccct

SEQ ID NO: 2952898 - DNA, 14 bp, Homo sapiens
tactctcttccctt

SEQ ID NO: 2952899 - DNA, 12 bp, Homo sapiens
tactctgaaggg

SEQ ID NO: 2952900 - DNA, 21 bp, Homo sapiens
tactctgagacaaaagaaaaa

SEQ ID NO: 2952901 - DNA, 17 bp, Homo sapiens
tactctgttgaatattt

SEQ ID NO: 2952902 - DNA, 21 bp, Homo sapiens
tactctgttgcctcctctctc

SEQ ID NO: 2952903 - DNA, 14 bp, Homo sapiens
tactcttaagccat

SEQ ID NO: 2952904 - DNA, 21 bp, Homo sapiens
tactcttaagccatcttggta

SEQ ID NO: 2952905 - DNA, 22 bp, Homo sapiens
tactcttaagccatcttggtaa

SEQ ID NO: 2952906 - DNA, 13 bp, Homo sapiens
tactcttaatgat

SEQ ID NO: 2952907 - DNA, 16 bp, Homo sapiens
tactctttgctttgta

SEQ ID NO: 2952908 - DNA, 19 bp, Homo sapiens
tactcttttgaagtgtttt

SEQ ID NO: 2952909 - DNA, 14 bp, Homo sapiens
tactctttttgttt

SEQ ID NO: 2952910 - DNA, 14 bp, Homo sapiens
tactgaaaaagcaa

SEQ ID NO: 2952911 - DNA, 15 bp, Homo sapiens
tactgaactttctta

SEQ ID NO: 2952912 - DNA, 17 bp, Homo sapiens
tactgaaggtaaaattg

SEQ ID NO: 2952913 - DNA, 14 bp, Homo sapiens
tactgacaatgtat

SEQ ID NO: 2952914 - DNA, 15 bp, Homo sapiens
tactgaccctggggc

SEQ ID NO: 2952915 - DNA, 19 bp, Homo sapiens
tactgaccctggggctggc

SEQ ID NO: 2952916 - DNA, 15 bp, Homo sapiens
tactgactgtatttt

SEQ ID NO: 2952917 - DNA, 21 bp, Homo sapiens
tactgagcgcaagccacagcc

SEQ ID NO: 2952918 - DNA, 23 bp, Homo sapiens
tactgagctgctaaaataaacct

SEQ ID NO: 2952919 - DNA, 14 bp, Homo sapiens
tactgattgtttca

SEQ ID NO: 2952920 - DNA, 13 bp, Homo sapiens
tactgcaacttaa

SEQ ID NO: 2952921 - DNA, 23 bp, Homo sapiens
tactgcaacttaacttaaaattg

SEQ ID NO: 2952922 - DNA, 20 bp, Homo sapiens
tactgcaatcactgtgctat

SEQ ID NO: 2952923 - DNA, 11 bp, Homo sapiens
tactgcagttg

SEQ ID NO: 2952924 - DNA, 13 bp, Homo sapiens
tactgcattctga

SEQ ID NO: 2952925 - DNA, 17 bp, Homo sapiens
tactgccagatgctgat

SEQ ID NO: 2952926 - DNA, 20 bp, Homo sapiens
tactgcctgaataaagagcc

SEQ ID NO: 2952927 - DNA, 20 bp, Homo sapiens
tactgctatctactaagttt

SEQ ID NO: 2952928 - DNA, 23 bp, Homo sapiens
tactgctgatgctgaaataaact

SEQ ID NO: 2952929 - DNA, 19 bp, Homo sapiens
tactgcttaattcaaataa

SEQ ID NO: 2952930 - DNA, 22 bp, Homo sapiens
tactggcattggcccttggtgg

SEQ ID NO: 2952931 - DNA, 12 bp, Homo sapiens
tactggcgtgga

SEQ ID NO: 2952932 - DNA, 23 bp, Homo sapiens
tactggcgtggattaaacttatg

SEQ ID NO: 2952933 - DNA, 18 bp, Homo sapiens
tactggctcctctgtggt

SEQ ID NO: 2952934 - DNA, 16 bp, Homo sapiens
tactgggagcctaccc

SEQ ID NO: 2952935 - DNA, 18 bp, Homo sapiens
tactgggccctgagtctg

SEQ ID NO: 2952936 - DNA, 17 bp, Homo sapiens
tactggggaggctgagg

SEQ ID NO: 2952937 - DNA, 22 bp, Homo sapiens
tactggggaggctgaggcagga

SEQ ID NO: 2952938 - DNA, 16 bp, Homo sapiens
tactggtaattgtaca

SEQ ID NO: 2952939 - DNA, 17 bp, Homo sapiens
tactggtaattgtacaa

SEQ ID NO: 2952940 - DNA, 18 bp, Homo sapiens
tactggtaattgtacaat

SEQ ID NO: 2952941 - DNA, 21 bp, Homo sapiens
tactggttatcctgtgctaca

SEQ ID NO: 2952942 - DNA, 18 bp, Homo sapiens
tactgtaaagaaagagag

SEQ ID NO: 2952943 - DNA, 19 bp, Homo sapiens
tactgtaaagaaagagaga

SEQ ID NO: 2952944 - DNA, 20 bp, Homo sapiens
tactgtaaagaaagagagaa

SEQ ID NO: 2952945 - DNA, 13 bp, Homo sapiens
tactgtaaatttt

SEQ ID NO: 2952946 - DNA, 14 bp, Homo sapiens
tactgtaagaataa

SEQ ID NO: 2952947 - DNA, 19 bp, Homo sapiens
tactgtaagaataatttat

SEQ ID NO: 2952948 - DNA, 20 bp, Homo sapiens
tactgtaagaataatttata

SEQ ID NO: 2952949 - DNA, 14 bp, Homo sapiens
tactgtaagacatt

SEQ ID NO: 2952950 - DNA, 16 bp, Homo sapiens
tactgtaattcctcaa

SEQ ID NO: 2952951 - DNA, 16 bp, Homo sapiens
tactgtatgtgatgaa

SEQ ID NO: 2952952 - DNA, 18 bp, Homo sapiens
tactgtctaagcagtttt

SEQ ID NO: 2952953 - DNA, 22 bp, Homo sapiens
tactgtctaagcagttttgtaa

SEQ ID NO: 2952954 - DNA, 23 bp, Homo sapiens
tactgtgaatgttccccaccgct

SEQ ID NO: 2952955 - DNA, 21 bp, Homo sapiens
tactgttaagaataataaaat

SEQ ID NO: 2952956 - DNA, 13 bp, Homo sapiens
tactgttactggg

SEQ ID NO: 2952957 - DNA, 21 bp, Homo sapiens
tactgttctaaagctctgaca

SEQ ID NO: 2952958 - DNA, 16 bp, Homo sapiens
tacttaaacagctttt

SEQ ID NO: 2952959 - DNA, 14 bp, Homo sapiens
tagcatgccaacaa

SEQ ID NO: 2952960 - DNA, 21 bp, Homo sapiens
tagcatgtcgtcaaagctgaa

SEQ ID NO: 2952961 - DNA, 17 bp, Homo sapiens
tagcatttaccaacatg

SEQ ID NO: 2952962 - DNA, 20 bp, Homo sapiens
tagccacaaaattgggaaag

SEQ ID NO: 2952963 - DNA, 13 bp, Homo sapiens
tagccacaggagc

SEQ ID NO: 2952964 - DNA, 19 bp, Homo sapiens
tagccacaggagccctgct

SEQ ID NO: 2952965 - DNA, 16 bp, Homo sapiens
tagccacatttggaat

SEQ ID NO: 2952966 - DNA, 20 bp, Homo sapiens
tagccacatttggaatactt

SEQ ID NO: 2952967 - DNA, 16 bp, Homo sapiens
tagccaccttgatttt

SEQ ID NO: 2952968 - DNA, 15 bp, Homo sapiens
tagccagaggactgt

SEQ ID NO: 2952969 - DNA, 15 bp, Homo sapiens
tagccagatttgtct

SEQ ID NO: 2952970 - DNA, 19 bp, Homo sapiens
tagccagcacacagggcag

SEQ ID NO: 2952971 - DNA, 15 bp, Homo sapiens
tagccagctgctccc

SEQ ID NO: 2952972 - DNA, 19 bp, Homo sapiens
tagccaggtccccctgcag

SEQ ID NO: 2952973 - DNA, 16 bp, Homo sapiens
tagccagtgaaacact

SEQ ID NO: 2952974 - DNA, 16 bp, Homo sapiens
tagccatcaagcactt

SEQ ID NO: 2952975 - DNA, 18 bp, Homo sapiens
tagccattgtcgtttcat

SEQ ID NO: 2952976 - DNA, 16 bp, Homo sapiens
tagcccacccccctcc

SEQ ID NO: 2952977 - DNA, 20 bp, Homo sapiens
tagcccacccccctccccaa

SEQ ID NO: 2952978 - DNA, 14 bp, Homo sapiens
tagccccagactgg

SEQ ID NO: 2952979 - DNA, 13 bp, Homo sapiens
tagccccagtgac

SEQ ID NO: 2952980 - DNA, 20 bp, Homo sapiens
tagcccctcccaagctggct

SEQ ID NO: 2952981 - DNA, 22 bp, Homo sapiens
tagcccctcccaagctggctgg

SEQ ID NO: 2952982 - DNA, 22 bp, Homo sapiens
tagccctctccctctaggctct

SEQ ID NO: 2952983 - DNA, 17 bp, Homo sapiens
tagccgagagcctgctc

SEQ ID NO: 2952984 - DNA, 13 bp, Homo sapiens
tagccgccctgag

SEQ ID NO: 2952985 - DNA, 15 bp, Homo sapiens
tagccgccctgagag

SEQ ID NO: 2952986 - DNA, 18 bp, Homo sapiens
tagccgctgccctgggtc

SEQ ID NO: 2952987 - DNA, 23 bp, Homo sapiens
tagccggaaggccgaggtcccat

SEQ ID NO: 2952988 - DNA, 20 bp, Homo sapiens
tagcctcgccgtctgtgaat

SEQ ID NO: 2952989 - DNA, 14 bp, Homo sapiens
tagcctctggatct

SEQ ID NO: 2952990 - DNA, 15 bp, Homo sapiens
tagcctctggatcta

SEQ ID NO: 2952991 - DNA, 20 bp, Homo sapiens
tagcctggatacagtataaa

SEQ ID NO: 2952992 - DNA, 22 bp, Homo sapiens
tagcctggatattattcttgta

SEQ ID NO: 2952993 - DNA, 19 bp, Homo sapiens
tagcctggggcttgaattt

SEQ ID NO: 2952994 - DNA, 23 bp, Homo sapiens
tagcctggggcttgaatttgcat

SEQ ID NO: 2952995 - DNA, 16 bp, Homo sapiens
tagccttgaaaacaaa

SEQ ID NO: 2952996 - DNA, 16 bp, Homo sapiens
tagccttgctgtagag

SEQ ID NO: 2952997 - DNA, 22 bp, Homo sapiens
tagcctttacatggacagaatt

SEQ ID NO: 2952998 - DNA, 23 bp, Homo sapiens
tagcctttacatggacagaattt

SEQ ID NO: 2952999 - DNA, 17 bp, Homo sapiens
tagcgcctgtataagta

SEQ ID NO: 2953000 - DNA, 20 bp, Homo sapiens
tagcgcctgtataagtagat

SEQ ID NO: 2953001 - DNA, 15 bp, Homo sapiens
tagcgctctggacag

SEQ ID NO: 2953002 - DNA, 23 bp, Homo sapiens
tagctaaaagaggcctgttcata

SEQ ID NO: 2953003 - DNA, 18 bp, Homo sapiens
tagctaaacggattccaa

SEQ ID NO: 2953004 - DNA, 18 bp, Homo sapiens
tagctactgtatgcaaag

SEQ ID NO: 2953005 - DNA, 15 bp, Homo sapiens
tagctagaggaacca

SEQ ID NO: 2953006 - DNA, 17 bp, Homo sapiens
tagctcaatactctctg

SEQ ID NO: 2953007 - DNA, 23 bp, Homo sapiens
tagctcaatactctctgagtaca

SEQ ID NO: 2953008 - DNA, 16 bp, Homo sapiens
tagctccaagctgtta

SEQ ID NO: 2953009 - DNA, 20 bp, Homo sapiens
tagctccaagctgttaaaga

SEQ ID NO: 2953010 - DNA, 16 bp, Homo sapiens
tagctcctcactgtgg

SEQ ID NO: 2953011 - DNA, 17 bp, Homo sapiens
tagctctacacaacatg

SEQ ID NO: 2953012 - DNA, 17 bp, Homo sapiens
tagctctatgtttacaa

SEQ ID NO: 2953013 - DNA, 16 bp, Homo sapiens
tagctcttgggcctga

SEQ ID NO: 2953014 - DNA, 12 bp, Homo sapiens
tagctctttctc

SEQ ID NO: 2953015 - DNA, 15 bp, Homo sapiens
tagctctttgagata

SEQ ID NO: 2953016 - DNA, 16 bp, Homo sapiens
tagctgaaaaaactat

SEQ ID NO: 2953017 - DNA, 14 bp, Homo sapiens
tagctgccaagccc

SEQ ID NO: 2953018 - DNA, 13 bp, Homo sapiens
tagctgctacaaa

SEQ ID NO: 2953019 - DNA, 15 bp, Homo sapiens
tagctgctacaaaga

SEQ ID NO: 2953020 - DNA, 19 bp, Homo sapiens
tagctgctacaaagaagac

SEQ ID NO: 2953021 - DNA, 20 bp, Homo sapiens
tagctgctacaaagaagaca

SEQ ID NO: 2953022 - DNA, 17 bp, Homo sapiens
tagctgggactgcaggc

SEQ ID NO: 2953023 - DNA, 18 bp, Homo sapiens
tagctgggggtgggccag

SEQ ID NO: 2953024 - DNA, 14 bp, Homo sapiens
tagctgtggtgagg

SEQ ID NO: 2953025 - DNA, 18 bp, Homo sapiens
tagctgtggtgaggtggg

SEQ ID NO: 2953026 - DNA, 23 bp, Homo sapiens
tagcttaagaggcctgtgattat

SEQ ID NO: 2953027 - DNA, 16 bp, Homo sapiens
tagcttaagggaatat

SEQ ID NO: 2953028 - DNA, 16 bp, Homo sapiens
tagcttaccagaagct

SEQ ID NO: 2953029 - DNA, 22 bp, Homo sapiens
tagcttatctccctgcttcata

SEQ ID NO: 2953030 - DNA, 12 bp, Homo sapiens
tagcttcaggaa

SEQ ID NO: 2953031 - DNA, 15 bp, Homo sapiens
tagcttggggccagg

SEQ ID NO: 2953032 - DNA, 17 bp, Homo sapiens
tagcttggggccaggga

SEQ ID NO: 2953033 - DNA, 19 bp, Homo sapiens
tagctttactgtttgttat

SEQ ID NO: 2953034 - DNA, 12 bp, Homo sapiens
tagctttctgga

SEQ ID NO: 2953035 - DNA, 14 bp, Homo sapiens
tagcttttgattag

SEQ ID NO: 2953036 - DNA, 20 bp, Homo sapiens
tagctttttcatccccttac

SEQ ID NO: 2953037 - DNA, 19 bp, Homo sapiens
tagcttttttcctcctttc

SEQ ID NO: 2953038 - DNA, 23 bp, Homo sapiens
tagcttttttcctcctttctctg

SEQ ID NO: 2953039 - DNA, 22 bp, Homo sapiens
taggaaaaaaactattaaggat

SEQ ID NO: 2953040 - DNA, 18 bp, Homo sapiens
taggaaaagcatctgcca

SEQ ID NO: 2953041 - DNA, 16 bp, Homo sapiens
taggaacatatgaaaa

SEQ ID NO: 2953042 - DNA, 17 bp, Homo sapiens
taggaactttatgttct

SEQ ID NO: 2953043 - DNA, 13 bp, Homo sapiens
taggaagaatttt

SEQ ID NO: 2953044 - DNA, 22 bp, Homo sapiens
taggaagaattttaaaaatgaa

SEQ ID NO: 2953045 - DNA, 19 bp, Homo sapiens
taggaagatcgttccacct

SEQ ID NO: 2953046 - DNA, 19 bp, Homo sapiens
taggaagtcacagattctt

SEQ ID NO: 2953047 - DNA, 14 bp, Homo sapiens
taggaatactgttt

SEQ ID NO: 2953048 - DNA, 16 bp, Homo sapiens
taggaccaggatccag

SEQ ID NO: 2953049 - DNA, 20 bp, Homo sapiens
taggaccaggatccagcctc

SEQ ID NO: 2953050 - DNA, 19 bp, Homo sapiens
taggaccatggttaagagt

SEQ ID NO: 2953051 - DNA, 15 bp, Homo sapiens
taggacgttggcctc

SEQ ID NO: 2953052 - DNA, 16 bp, Homo sapiens
taggactaaagttgtg

SEQ ID NO: 2953053 - DNA, 15 bp, Homo sapiens
taggactctggacaa

SEQ ID NO: 2953054 - DNA, 22 bp, Homo sapiens
taggactttcttctaaatgagc

SEQ ID NO: 2953055 - DNA, 12 bp, Homo sapiens
taggagaagcca

SEQ ID NO: 2953056 - DNA, 20 bp, Homo sapiens
taggagacttgccagagccg

SEQ ID NO: 2953057 - DNA, 15 bp, Homo sapiens
taggagagggagatg

SEQ ID NO: 2953058 - DNA, 15 bp, Homo sapiens
taggatacaatgtat

SEQ ID NO: 2953059 - DNA, 18 bp, Homo sapiens
taggatagctaactgtaa

SEQ ID NO: 2953060 - DNA, 20 bp, Homo sapiens
taggatattggaatgcacag

SEQ ID NO: 2953061 - DNA, 22 bp, Homo sapiens
taggatcatatgaattgctgtc

SEQ ID NO: 2953062 - DNA, 20 bp, Homo sapiens
taggatctaaggctgtttgc

SEQ ID NO: 2953063 - DNA, 20 bp, Homo sapiens
taggatctcgcctggaaaca

SEQ ID NO: 2953064 - DNA, 21 bp, Homo sapiens
taggatctcgcctggaaacag

SEQ ID NO: 2953065 - DNA, 22 bp, Homo sapiens
taggatctcgcctggaaacaga

SEQ ID NO: 2953066 - DNA, 16 bp, Homo sapiens
taggatcttatttgga

SEQ ID NO: 2953067 - DNA, 18 bp, Homo sapiens
taggatgaaaagattctt

SEQ ID NO: 2953068 - DNA, 18 bp, Homo sapiens
taggattccccctgccct

SEQ ID NO: 2953069 - DNA, 12 bp, Homo sapiens
taggattctaaa

SEQ ID NO: 2953070 - DNA, 14 bp, Homo sapiens
taggattgctgggg

SEQ ID NO: 2953071 - DNA, 13 bp, Homo sapiens
taggattttcaca

SEQ ID NO: 2953072 - DNA, 22 bp, Homo sapiens
taggattttcacattcttggct

SEQ ID NO: 2953073 - DNA, 13 bp, Homo sapiens
taggatttttaga

SEQ ID NO: 2953074 - DNA, 14 bp, Homo sapiens
tatatactggaagt

SEQ ID NO: 2953075 - DNA, 17 bp, Homo sapiens
tatatagcaaagatata

SEQ ID NO: 2953076 - DNA, 21 bp, Homo sapiens
tatataggttttgtttgctat

SEQ ID NO: 2953077 - DNA, 13 bp, Homo sapiens
tatatatacagta

SEQ ID NO: 2953078 - DNA, 14 bp, Homo sapiens
tatatatacatata

SEQ ID NO: 2953079 - DNA, 14 bp, Homo sapiens
tatatatatatatg

SEQ ID NO: 2953080 - DNA, 15 bp, Homo sapiens
tatatatcttttgta

SEQ ID NO: 2953081 - DNA, 19 bp, Homo sapiens
tatatcacatgttttctct

SEQ ID NO: 2953082 - DNA, 15 bp, Homo sapiens
tatatcatatgtata

SEQ ID NO: 2953083 - DNA, 16 bp, Homo sapiens
tatatcatgaagcctt

SEQ ID NO: 2953084 - DNA, 18 bp, Homo sapiens
tatatctaaattgaataa

SEQ ID NO: 2953085 - DNA, 17 bp, Homo sapiens
tatatctatatatataa

SEQ ID NO: 2953086 - DNA, 12 bp, Homo sapiens
tatatctgaaga

SEQ ID NO: 2953087 - DNA, 14 bp, Homo sapiens
tatatctgaagatt

SEQ ID NO: 2953088 - DNA, 16 bp, Homo sapiens
tatatctttatactta

SEQ ID NO: 2953089 - DNA, 14 bp, Homo sapiens
tatatgaaaacctg

SEQ ID NO: 2953090 - DNA, 17 bp, Homo sapiens
tatatgaagcaagctgt

SEQ ID NO: 2953091 - DNA, 21 bp, Homo sapiens
tatatgcacttataattttcc

SEQ ID NO: 2953092 - DNA, 17 bp, Homo sapiens
tatatggcctcaagatc

SEQ ID NO: 2953093 - DNA, 15 bp, Homo sapiens
tatatggtatatata

SEQ ID NO: 2953094 - DNA, 12 bp, Homo sapiens
tatatgtacatg

SEQ ID NO: 2953095 - DNA, 11 bp, Homo sapiens
tatatgtattt

SEQ ID NO: 2953096 - DNA, 15 bp, Homo sapiens
tatatgtatttctat

SEQ ID NO: 2953097 - DNA, 16 bp, Homo sapiens
tatatgtattttttga

SEQ ID NO: 2953098 - DNA, 22 bp, Homo sapiens
tatatgttatggcttattgtgt

SEQ ID NO: 2953099 - DNA, 16 bp, Homo sapiens
tatattaaaatatgaa

SEQ ID NO: 2953100 - DNA, 22 bp, Homo sapiens
tatattatcatgcaaatgctgt

SEQ ID NO: 2953101 - DNA, 22 bp, Homo sapiens
tatattattccgtattacattt

SEQ ID NO: 2953102 - DNA, 16 bp, Homo sapiens
tatattcaccaatgtt

SEQ ID NO: 2953103 - DNA, 19 bp, Homo sapiens
tatattcaccaatgttgta

SEQ ID NO: 2953104 - DNA, 14 bp, Homo sapiens
tatattcatcaaat

SEQ ID NO: 2953105 - DNA, 23 bp, Homo sapiens
tatattcatcaaataaaccttgt

SEQ ID NO: 2953106 - DNA, 20 bp, Homo sapiens
tatattgcccaggctggtct

SEQ ID NO: 2953107 - DNA, 17 bp, Homo sapiens
tatattgggctcagaga

SEQ ID NO: 2953108 - DNA, 15 bp, Homo sapiens
tatattgtctgtaaa

SEQ ID NO: 2953109 - DNA, 18 bp, Homo sapiens
tatattgtgtttgtgtat

SEQ ID NO: 2953110 - DNA, 19 bp, Homo sapiens
tatattgtgtttgtgtatt

SEQ ID NO: 2953111 - DNA, 19 bp, Homo sapiens
tatatttcagatgtaatgt

SEQ ID NO: 2953112 - DNA, 21 bp, Homo sapiens
tatatttccctgaaggaacca

SEQ ID NO: 2953113 - DNA, 12 bp, Homo sapiens
tatatttctcat

SEQ ID NO: 2953114 - DNA, 15 bp, Homo sapiens
tatatttctcataat

SEQ ID NO: 2953115 - DNA, 13 bp, Homo sapiens
tatatttgagttg

SEQ ID NO: 2953116 - DNA, 22 bp, Homo sapiens
tatatttgggcctgctccagac

SEQ ID NO: 2953117 - DNA, 13 bp, Homo sapiens
tatatttgtagga

SEQ ID NO: 2953118 - DNA, 17 bp, Homo sapiens
tatatttgtaggagaaa

SEQ ID NO: 2953119 - DNA, 17 bp, Homo sapiens
tatatttgtgctatagt

SEQ ID NO: 2953120 - DNA, 21 bp, Homo sapiens
tatatttgtgctatagtattt

SEQ ID NO: 2953121 - DNA, 13 bp, Homo sapiens
tatattttaatag

SEQ ID NO: 2953122 - DNA, 14 bp, Homo sapiens
tatattttatactg

SEQ ID NO: 2953123 - DNA, 16 bp, Homo sapiens
tatatttttttaactg

SEQ ID NO: 2953124 - DNA, 18 bp, Homo sapiens
tatatttttttaactgtg

SEQ ID NO: 2953125 - DNA, 19 bp, Homo sapiens
tatcaaaataggatttctt

SEQ ID NO: 2953126 - DNA, 19 bp, Homo sapiens
tatcaaatattagatgtga

SEQ ID NO: 2953127 - DNA, 21 bp, Homo sapiens
tatcaaatattagatgtgatt

SEQ ID NO: 2953128 - DNA, 23 bp, Homo sapiens
tatcaaatgcagtatatttcttc

SEQ ID NO: 2953129 - DNA, 18 bp, Homo sapiens
tatcaaccccagacactg

SEQ ID NO: 2953130 - DNA, 20 bp, Homo sapiens
tatcaagtgttctaaaatga

SEQ ID NO: 2953131 - DNA, 19 bp, Homo sapiens
tatcaataaattccatgtt

SEQ ID NO: 2953132 - DNA, 19 bp, Homo sapiens
tatcaatataatgttttta

SEQ ID NO: 2953133 - DNA, 23 bp, Homo sapiens
tatcacaagagtccccagactct

SEQ ID NO: 2953134 - DNA, 20 bp, Homo sapiens
tatcacacactttctcttca

SEQ ID NO: 2953135 - DNA, 12 bp, Homo sapiens
tatcacatgttt

SEQ ID NO: 2953136 - DNA, 18 bp, Homo sapiens
tatcacatgttttctctg

SEQ ID NO: 2953137 - DNA, 21 bp, Homo sapiens
tatcaccaggatttatacata

SEQ ID NO: 2953138 - DNA, 19 bp, Homo sapiens
tatcaccgtgggctccctg

SEQ ID NO: 2953139 - DNA, 23 bp, Homo sapiens
tatcaccgtgggctccctgactg

SEQ ID NO: 2953140 - DNA, 13 bp, Homo sapiens
tatcactgaagga

SEQ ID NO: 2953141 - DNA, 19 bp, Homo sapiens
tatcactgccttcgtttat

SEQ ID NO: 2953142 - DNA, 23 bp, Homo sapiens
tatcactgccttcgtttatattt

SEQ ID NO: 2953143 - DNA, 16 bp, Homo sapiens
tatcagaagagagggg

SEQ ID NO: 2953144 - DNA, 18 bp, Homo sapiens
tatcagaattgaaacact

SEQ ID NO: 2953145 - DNA, 19 bp, Homo sapiens
tatcagaattgaaacactt

SEQ ID NO: 2953146 - DNA, 14 bp, Homo sapiens
tatcagcaaaaaag

SEQ ID NO: 2953147 - DNA, 11 bp, Homo sapiens
tatcagcacta

SEQ ID NO: 2953148 - DNA, 15 bp, Homo sapiens
tatcaggaatataaa

SEQ ID NO: 2953149 - DNA, 21 bp, Homo sapiens
tatcagtaatgctaaatgtgt

SEQ ID NO: 2953150 - DNA, 9 bp, Homo sapiens
tatcagtag

SEQ ID NO: 2953151 - DNA, 21 bp, Homo sapiens
tatcagtcaatatttttagat

SEQ ID NO: 2953152 - DNA, 16 bp, Homo sapiens
tatcatccacattgtt

SEQ ID NO: 2953153 - DNA, 17 bp, Homo sapiens
tatcatgcaaatgctgt

SEQ ID NO: 2953154 - DNA, 13 bp, Homo sapiens
tatcatgctaaaa

SEQ ID NO: 2953155 - DNA, 18 bp, Homo sapiens
tatcatgctaaaattcta

SEQ ID NO: 2953156 - DNA, 14 bp, Homo sapiens
tatcatgtgtaatc

SEQ ID NO: 2953157 - DNA, 22 bp, Homo sapiens
tatcatgtgtaatcaataaacg

SEQ ID NO: 2953158 - DNA, 18 bp, Homo sapiens
tatcattaaaagaacata

SEQ ID NO: 2953159 - DNA, 12 bp, Homo sapiens
tatcattaaagt

SEQ ID NO: 2953160 - DNA, 13 bp, Homo sapiens
tatcattcaagtg

SEQ ID NO: 2953161 - DNA, 18 bp, Homo sapiens
tatccaaaatgtgtattt

SEQ ID NO: 2953162 - DNA, 17 bp, Homo sapiens
tatccaactttttcata

SEQ ID NO: 2953163 - DNA, 20 bp, Homo sapiens
tatccacaatagctgacggc

SEQ ID NO: 2953164 - DNA, 15 bp, Homo sapiens
tatccacactgtcaa

SEQ ID NO: 2953165 - DNA, 12 bp, Homo sapiens
tatccacccagc

SEQ ID NO: 2953166 - DNA, 14 bp, Homo sapiens
tatccacccagccc

SEQ ID NO: 2953167 - DNA, 18 bp, Homo sapiens
tatccaggtaatccaaga

SEQ ID NO: 2953168 - DNA, 17 bp, Homo sapiens
tatccaggtcaacagaa

SEQ ID NO: 2953169 - DNA, 18 bp, Homo sapiens
tatccaggtcaacagaat

SEQ ID NO: 2953170 - DNA, 12 bp, Homo sapiens
tatccatctttt

SEQ ID NO: 2953171 - DNA, 20 bp, Homo sapiens
tatccatctttttcttttta

SEQ ID NO: 2953172 - DNA, 16 bp, Homo sapiens
tatccattatcatgtg

SEQ ID NO: 2953173 - DNA, 17 bp, Homo sapiens
tatcccaacagtcatgt

SEQ ID NO: 2953174 - DNA, 22 bp, Homo sapiens
tatcctagcacatgcttcaata

SEQ ID NO: 2953175 - DNA, 24 bp, Homo sapiens
tatcctagcacatgcttcaatagt

SEQ ID NO: 2953176 - DNA, 14 bp, Homo sapiens
tatcctatttcagt

SEQ ID NO: 2953177 - DNA, 16 bp, Homo sapiens
tatcctcctgttctga

SEQ ID NO: 2953178 - DNA, 18 bp, Homo sapiens
tatcctcctgttctgaaa

SEQ ID NO: 2953179 - DNA, 18 bp, Homo sapiens
tatcctgctagcaggccc

SEQ ID NO: 2953180 - DNA, 20 bp, Homo sapiens
tatcctgctagcaggccccc

SEQ ID NO: 2953181 - DNA, 15 bp, Homo sapiens
tatcctgctgttcta

SEQ ID NO: 2953182 - DNA, 14 bp, Homo sapiens
tatcctgtgctaca

SEQ ID NO: 2953183 - DNA, 14 bp, Homo sapiens
tatccttctacttg

SEQ ID NO: 2953184 - DNA, 15 bp, Homo sapiens
tatcctttcatcaat

SEQ ID NO: 2953185 - DNA, 24 bp, Homo sapiens
tatcctttcctcattaaattacct

SEQ ID NO: 2953186 - DNA, 23 bp, Homo sapiens
tatcggcagatgatgctttggaa

SEQ ID NO: 2953187 - DNA, 18 bp, Homo sapiens
tatcgttattataaatgt

SEQ ID NO: 2953188 - DNA, 14 bp, Homo sapiens
tatctaaagttata

SEQ ID NO: 2953189 - DNA, 20 bp, Homo sapiens
tatctaaagttatatttcag

SEQ ID NO: 2953190 - DNA, 17 bp, Homo sapiens
tatctaaattgaataat

SEQ ID NO: 2953191 - DNA, 21 bp, Homo sapiens
tatctaaattgaataatggta

SEQ ID NO: 2953192 - DNA, 23 bp, Homo sapiens
tatctaagaatacagctttctga

SEQ ID NO: 2953193 - DNA, 20 bp, Homo sapiens
tatctaagttaatttaaagt

SEQ ID NO: 2953194 - DNA, 22 bp, Homo sapiens
tatctaagttaatttaaagttg

SEQ ID NO: 2953195 - DNA, 13 bp, Homo sapiens
tatctaatccttt

SEQ ID NO: 2953196 - DNA, 16 bp, Homo sapiens
tatctacatctttttt

SEQ ID NO: 2953197 - DNA, 14 bp, Homo sapiens
tatctacctgttct

SEQ ID NO: 2953198 - DNA, 17 bp, Homo sapiens
tatctacctgttctgta

SEQ ID NO: 2953199 - DNA, 21 bp, Homo sapiens
tatctacctgttctgtagctt

SEQ ID NO: 2953200 - DNA, 22 bp, Homo sapiens
tatctacctgttctgtagcttt

SEQ ID NO: 2953201 - DNA, 20 bp, Homo sapiens
tatctagaacattcagattt

SEQ ID NO: 2953202 - DNA, 14 bp, Homo sapiens
tatctagatttcta

SEQ ID NO: 2953203 - DNA, 18 bp, Homo sapiens
tatctatcctgaatctaa

SEQ ID NO: 2953204 - DNA, 15 bp, Homo sapiens
tatgtaaataactct

SEQ ID NO: 2953205 - DNA, 16 bp, Homo sapiens
tatgtaaataactcta

SEQ ID NO: 2953206 - DNA, 16 bp, Homo sapiens
tatgtaatgcttatgt

SEQ ID NO: 2953207 - DNA, 18 bp, Homo sapiens
tatgtacgtttgtatgtg

SEQ ID NO: 2953208 - DNA, 19 bp, Homo sapiens
tatgtacgtttgtatgtgt

SEQ ID NO: 2953209 - DNA, 21 bp, Homo sapiens
tatgtacgtttgtatgtgtgt

SEQ ID NO: 2953210 - DNA, 22 bp, Homo sapiens
tatgtacgtttgtatgtgtgta

SEQ ID NO: 2953211 - DNA, 15 bp, Homo sapiens
tatgtacttgtcaaa

SEQ ID NO: 2953212 - DNA, 13 bp, Homo sapiens
tatgtagaaacat

SEQ ID NO: 2953213 - DNA, 17 bp, Homo sapiens
tatgtagaaacatttag

SEQ ID NO: 2953214 - DNA, 17 bp, Homo sapiens
tatgtagacattgtaaa

SEQ ID NO: 2953215 - DNA, 18 bp, Homo sapiens
tatgtaggaaaaaaatag

SEQ ID NO: 2953216 - DNA, 14 bp, Homo sapiens
tatgtagtaattga

SEQ ID NO: 2953217 - DNA, 18 bp, Homo sapiens
tatgtattaataaataga

SEQ ID NO: 2953218 - DNA, 23 bp, Homo sapiens
tatgtattagtgatatttctcta

SEQ ID NO: 2953219 - DNA, 22 bp, Homo sapiens
ggcacccaagacctcagggcac

SEQ ID NO: 2953220 - DNA, 14 bp, Homo sapiens
ggcacccaccctgg

SEQ ID NO: 2953221 - DNA, 17 bp, Homo sapiens
ggcacccctttccccag

SEQ ID NO: 2953222 - DNA, 18 bp, Homo sapiens
ggcacccctttccccagc

SEQ ID NO: 2953223 - DNA, 14 bp, Homo sapiens
ggcacctgcctagc

SEQ ID NO: 2953224 - DNA, 18 bp, Homo sapiens
ggcacgaacccacctgct

SEQ ID NO: 2953225 - DNA, 16 bp, Homo sapiens
ggcactcccccaggat

SEQ ID NO: 2953226 - DNA, 16 bp, Homo sapiens
ggcactccctccagca

SEQ ID NO: 2953227 - DNA, 18 bp, Homo sapiens
ggcactccctccagcaca

SEQ ID NO: 2953228 - DNA, 13 bp, Homo sapiens
ggcactctagatt

SEQ ID NO: 2953229 - DNA, 22 bp, Homo sapiens
ggcactctgttatttagactca

SEQ ID NO: 2953230 - DNA, 16 bp, Homo sapiens
ggcactggagctggga

SEQ ID NO: 2953231 - DNA, 15 bp, Homo sapiens
ggcactggggcaggg

SEQ ID NO: 2953232 - DNA, 14 bp, Homo sapiens
ggcacttcctcccc

SEQ ID NO: 2953233 - DNA, 21 bp, Homo sapiens
ggcactttagtgattgctttt

SEQ ID NO: 2953234 - DNA, 22 bp, Homo sapiens
ggcagaaaccttgtttgtttta

SEQ ID NO: 2953235 - DNA, 14 bp, Homo sapiens
ggcagaactgctgg

SEQ ID NO: 2953236 - DNA, 15 bp, Homo sapiens
ggcagaactgctggg

SEQ ID NO: 2953237 - DNA, 20 bp, Homo sapiens
ggcagaactgctggggctgg

SEQ ID NO: 2953238 - DNA, 22 bp, Homo sapiens
ggcagaagaattgaacccagga

SEQ ID NO: 2953239 - DNA, 11 bp, Homo sapiens
ggcagaaggga

SEQ ID NO: 2953240 - DNA, 16 bp, Homo sapiens
ggcagaatcctgggcc

SEQ ID NO: 2953241 - DNA, 21 bp, Homo sapiens
ggcagaatcctgggcccccag

SEQ ID NO: 2953242 - DNA, 14 bp, Homo sapiens
ggcagacacaaccc

SEQ ID NO: 2953243 - DNA, 15 bp, Homo sapiens
ggcagagcctgtccc

SEQ ID NO: 2953244 - DNA, 16 bp, Homo sapiens
ggcagagcgggaggga

SEQ ID NO: 2953245 - DNA, 16 bp, Homo sapiens
ggcagagctgagggcc

SEQ ID NO: 2953246 - DNA, 18 bp, Homo sapiens
ggcagagctgagggccct

SEQ ID NO: 2953247 - DNA, 19 bp, Homo sapiens
ggcagagctgagggccctg

SEQ ID NO: 2953248 - DNA, 13 bp, Homo sapiens
ggcagaggctgga

SEQ ID NO: 2953249 - DNA, 23 bp, Homo sapiens
ggcagaggctggaggcagggcct

SEQ ID NO: 2953250 - DNA, 20 bp, Homo sapiens
ggcagagggcagaggctgga

SEQ ID NO: 2953251 - DNA, 21 bp, Homo sapiens
ggcagagggctggaggcccag

SEQ ID NO: 2953252 - DNA, 22 bp, Homo sapiens
ggcagagggctttcagcgcccc

SEQ ID NO: 2953253 - DNA, 21 bp, Homo sapiens
ggcagaggttgcagtgagccg

SEQ ID NO: 2953254 - DNA, 17 bp, Homo sapiens
ggcagataactgctgta

SEQ ID NO: 2953255 - DNA, 18 bp, Homo sapiens
ggcagatcacctgaggtc

SEQ ID NO: 2953256 - DNA, 14 bp, Homo sapiens
ggcagatccaggac

SEQ ID NO: 2953257 - DNA, 22 bp, Homo sapiens
ggcagatgtaaatgatgtgttg

SEQ ID NO: 2953258 - DNA, 24 bp, Homo sapiens
ggcagatttagtgaaagctagaga

SEQ ID NO: 2953259 - DNA, 13 bp, Homo sapiens
ggcagcacctctg

SEQ ID NO: 2953260 - DNA, 13 bp, Homo sapiens
ggcagcacggccc

SEQ ID NO: 2953261 - DNA, 16 bp, Homo sapiens
ggcagcactgggaagc

SEQ ID NO: 2953262 - DNA, 10 bp, Homo sapiens
ggcagcagca

SEQ ID NO: 2953263 - DNA, 16 bp, Homo sapiens
ggcagcagcatcccag

SEQ ID NO: 2953264 - DNA, 18 bp, Homo sapiens
ggcagcagcatcccagcc

SEQ ID NO: 2953265 - DNA, 21 bp, Homo sapiens
ggcagcagggctaccctgagc

SEQ ID NO: 2953266 - DNA, 16 bp, Homo sapiens
ggcagccacaccactg

SEQ ID NO: 2953267 - DNA, 18 bp, Homo sapiens
ggcagccaggctgggccg

SEQ ID NO: 2953268 - DNA, 18 bp, Homo sapiens
ggcagcccaacagcactt

SEQ ID NO: 2953269 - DNA, 11 bp, Homo sapiens
ggcagccctcc

SEQ ID NO: 2953270 - DNA, 21 bp, Homo sapiens
ggcagccctccatggtcctgt

SEQ ID NO: 2953271 - DNA, 14 bp, Homo sapiens
ggcagcctcccatc

SEQ ID NO: 2953272 - DNA, 17 bp, Homo sapiens
ggcagcctctcttcact

SEQ ID NO: 2953273 - DNA, 18 bp, Homo sapiens
ggcagcctctcttcactg

SEQ ID NO: 2953274 - DNA, 23 bp, Homo sapiens
ggcagccttgggggggctgcctt

SEQ ID NO: 2953275 - DNA, 14 bp, Homo sapiens
ggcagcgccaggct

SEQ ID NO: 2953276 - DNA, 22 bp, Homo sapiens
ggcagcgccaggctgaccacag

SEQ ID NO: 2953277 - DNA, 19 bp, Homo sapiens
ggcagcgcctgtcccctca

SEQ ID NO: 2953278 - DNA, 21 bp, Homo sapiens
ggcagcgcctgtcccctcaca

SEQ ID NO: 2953279 - DNA, 12 bp, Homo sapiens
ggcagctcttct

SEQ ID NO: 2953280 - DNA, 17 bp, Homo sapiens
ggcagctcttctgggca

SEQ ID NO: 2953281 - DNA, 24 bp, Homo sapiens
ggcagctcttctgggcagagcctg

SEQ ID NO: 2953282 - DNA, 11 bp, Homo sapiens
ggcagctgccc

SEQ ID NO: 2953283 - DNA, 12 bp, Homo sapiens
ggcagctgcccc

SEQ ID NO: 2953284 - DNA, 13 bp, Homo sapiens
ggcagctgcccct

SEQ ID NO: 2953285 - DNA, 15 bp, Homo sapiens
ggcagctgcccctcc

SEQ ID NO: 2953286 - DNA, 18 bp, Homo sapiens
ggcagctgcccctcctgg

SEQ ID NO: 2953287 - DNA, 22 bp, Homo sapiens
ggcagctgcccctggcacctgt

SEQ ID NO: 2953288 - DNA, 16 bp, Homo sapiens
ggcagctgcctggcca

SEQ ID NO: 2953289 - DNA, 18 bp, Homo sapiens
ggcagctgcctggccatg

SEQ ID NO: 2953290 - DNA, 14 bp, Homo sapiens
ggcagctgggccca

SEQ ID NO: 2953291 - DNA, 23 bp, Homo sapiens
ggcagctgggcccacagccccca

SEQ ID NO: 2953292 - DNA, 18 bp, Homo sapiens
ggcaggacaacgaggaag

SEQ ID NO: 2953293 - DNA, 22 bp, Homo sapiens
ggcaggaccgccatggtgctgg

SEQ ID NO: 2953294 - DNA, 21 bp, Homo sapiens
ggcaggaccttcgggctgtgc

SEQ ID NO: 2953295 - DNA, 18 bp, Homo sapiens
ggcaggacgtgggctggg

SEQ ID NO: 2953296 - DNA, 20 bp, Homo sapiens
ggccgtgtgtttagaagcct

SEQ ID NO: 2953297 - DNA, 15 bp, Homo sapiens
ggccgttcagcctgt

SEQ ID NO: 2953298 - DNA, 17 bp, Homo sapiens
ggcctaggggccagggc

SEQ ID NO: 2953299 - DNA, 22 bp, Homo sapiens
ggcctaggtgcagctcctcagc

SEQ ID NO: 2953300 - DNA, 20 bp, Homo sapiens
ggcctcactactcgagccca

SEQ ID NO: 2953301 - DNA, 23 bp, Homo sapiens
ggcctcagactgcacccaggagg

SEQ ID NO: 2953302 - DNA, 19 bp, Homo sapiens
ggcctcagggccaggaagg

SEQ ID NO: 2953303 - DNA, 24 bp, Homo sapiens
ggcctccaccaaccccgcggccca

SEQ ID NO: 2953304 - DNA, 20 bp, Homo sapiens
ggcctccagaactcactggg

SEQ ID NO: 2953305 - DNA, 13 bp, Homo sapiens
ggcctccaggccc

SEQ ID NO: 2953306 - DNA, 14 bp, Homo sapiens
ggcctccaggcccg

SEQ ID NO: 2953307 - DNA, 12 bp, Homo sapiens
ggcctccagtcc

SEQ ID NO: 2953308 - DNA, 19 bp, Homo sapiens
ggcctcccaaagtgctggg

SEQ ID NO: 2953309 - DNA, 17 bp, Homo sapiens
ggcctcccagagtgctg

SEQ ID NO: 2953310 - DNA, 19 bp, Homo sapiens
ggcctcccagagtgctggg

SEQ ID NO: 2953311 - DNA, 22 bp, Homo sapiens
ggcctccccgaggttgtgggga

SEQ ID NO: 2953312 - DNA, 15 bp, Homo sapiens
ggcctcccctgagga

SEQ ID NO: 2953313 - DNA, 22 bp, Homo sapiens
ggcctcccctgaggatcccctg

SEQ ID NO: 2953314 - DNA, 16 bp, Homo sapiens
ggcctcccgaggaggg

SEQ ID NO: 2953315 - DNA, 23 bp, Homo sapiens
ggcctcccttgagtaggccctgc

SEQ ID NO: 2953316 - DNA, 22 bp, Homo sapiens
ggcctccgatgcctggcctgcc

SEQ ID NO: 2953317 - DNA, 17 bp, Homo sapiens
ggcctcgcctgccctcc

SEQ ID NO: 2953318 - DNA, 19 bp, Homo sapiens
ggcctcggaggctcctccc

SEQ ID NO: 2953319 - DNA, 21 bp, Homo sapiens
ggcctcggaggctcctccctc

SEQ ID NO: 2953320 - DNA, 14 bp, Homo sapiens
ggcctcggcccctc

SEQ ID NO: 2953321 - DNA, 17 bp, Homo sapiens
ggcctctcggtgctcca

SEQ ID NO: 2953322 - DNA, 20 bp, Homo sapiens
ggcctctctgtacactgccc

SEQ ID NO: 2953323 - DNA, 11 bp, Homo sapiens
ggcctctgcct

SEQ ID NO: 2953324 - DNA, 14 bp, Homo sapiens
ggcctctgcctggg

SEQ ID NO: 2953325 - DNA, 18 bp, Homo sapiens
ggcctcttggcacctgcc

SEQ ID NO: 2953326 - DNA, 22 bp, Homo sapiens
ggcctcttggcacctgcctagc

SEQ ID NO: 2953327 - DNA, 19 bp, Homo sapiens
ggcctgaacagatgtaaat

SEQ ID NO: 2953328 - DNA, 13 bp, Homo sapiens
ggcctgacctcca

SEQ ID NO: 2953329 - DNA, 20 bp, Homo sapiens
ggcctgacctccagtcctgc

SEQ ID NO: 2953330 - DNA, 23 bp, Homo sapiens
ggcctgagaaacactatttgtga

SEQ ID NO: 2953331 - DNA, 20 bp, Homo sapiens
ggcctgagacccaggactcc

SEQ ID NO: 2953332 - DNA, 14 bp, Homo sapiens
ggcctgaggtcaat

SEQ ID NO: 2953333 - DNA, 13 bp, Homo sapiens
ggcctgccctgct

SEQ ID NO: 2953334 - DNA, 15 bp, Homo sapiens
ggcctgccctgctat

SEQ ID NO: 2953335 - DNA, 18 bp, Homo sapiens
ggcctgccttctcaggga

SEQ ID NO: 2953336 - DNA, 21 bp, Homo sapiens
ggcctgctcttacttccccca

SEQ ID NO: 2953337 - DNA, 21 bp, Homo sapiens
ggcctgctgggctctccacct

SEQ ID NO: 2953338 - DNA, 20 bp, Homo sapiens
ggcctggagcatggacagtg

SEQ ID NO: 2953339 - DNA, 14 bp, Homo sapiens
ggcctggcagctca

SEQ ID NO: 2953340 - DNA, 16 bp, Homo sapiens
ggcctggcagctcagc

SEQ ID NO: 2953341 - DNA, 16 bp, Homo sapiens
ggcctggcatctgtgc

SEQ ID NO: 2953342 - DNA, 21 bp, Homo sapiens
ggcctggcatctgtgtgcgtg

SEQ ID NO: 2953343 - DNA, 13 bp, Homo sapiens
ggcctggccagtc

SEQ ID NO: 2953344 - DNA, 19 bp, Homo sapiens
ggcctggccgttcagcctg

SEQ ID NO: 2953345 - DNA, 13 bp, Homo sapiens
ggcctgggcagga

SEQ ID NO: 2953346 - DNA, 17 bp, Homo sapiens
ggcctgggcaggaggga

SEQ ID NO: 2953347 - DNA, 11 bp, Homo sapiens
ggcctggtccc

SEQ ID NO: 2953348 - DNA, 22 bp, Homo sapiens
ggctctagatcataaggcttca

SEQ ID NO: 2953349 - DNA, 21 bp, Homo sapiens
ggctctattggatttgtccaa

SEQ ID NO: 2953350 - DNA, 16 bp, Homo sapiens
ggctctccacctcagc

SEQ ID NO: 2953351 - DNA, 19 bp, Homo sapiens
ggctctccacctcagcctt

SEQ ID NO: 2953352 - DNA, 22 bp, Homo sapiens
ggctctccacctcagccttgga

SEQ ID NO: 2953353 - DNA, 18 bp, Homo sapiens
ggctctcgggtgggggag

SEQ ID NO: 2953354 - DNA, 20 bp, Homo sapiens
ggctctctgagtcctggccc

SEQ ID NO: 2953355 - DNA, 18 bp, Homo sapiens
ggctctgcccacctctct

SEQ ID NO: 2953356 - DNA, 19 bp, Homo sapiens
ggctctgggccgggcctgg

SEQ ID NO: 2953357 - DNA, 16 bp, Homo sapiens
ggctctgggggcagat

SEQ ID NO: 2953358 - DNA, 16 bp, Homo sapiens
ggctctgtgaaatcag

SEQ ID NO: 2953359 - DNA, 12 bp, Homo sapiens
ggctctgtgcct

SEQ ID NO: 2953360 - DNA, 14 bp, Homo sapiens
ggctctgttcctca

SEQ ID NO: 2953361 - DNA, 19 bp, Homo sapiens
ggctcttgaactgagcttg

SEQ ID NO: 2953362 - DNA, 20 bp, Homo sapiens
ggctcttgaactgagcttgg

SEQ ID NO: 2953363 - DNA, 16 bp, Homo sapiens
ggctgaacagtgctct

SEQ ID NO: 2953364 - DNA, 16 bp, Homo sapiens
ggctgaatagcagaag

SEQ ID NO: 2953365 - DNA, 19 bp, Homo sapiens
ggctgaccacagcacagcc

SEQ ID NO: 2953366 - DNA, 17 bp, Homo sapiens
ggctgacccagtccctg

SEQ ID NO: 2953367 - DNA, 22 bp, Homo sapiens
ggctgacttgtgttcatgtgga

SEQ ID NO: 2953368 - DNA, 20 bp, Homo sapiens
ggctgagatagcagaggggc

SEQ ID NO: 2953369 - DNA, 13 bp, Homo sapiens
ggctgaggcagaa

SEQ ID NO: 2953370 - DNA, 18 bp, Homo sapiens
ggctgagggcatctctga

SEQ ID NO: 2953371 - DNA, 23 bp, Homo sapiens
ggctgagggtgcccttttccagc

SEQ ID NO: 2953372 - DNA, 15 bp, Homo sapiens
ggctgcactggagcc

SEQ ID NO: 2953373 - DNA, 20 bp, Homo sapiens
ggctgcagagtctgccccac

SEQ ID NO: 2953374 - DNA, 12 bp, Homo sapiens
ggctgcagccag

SEQ ID NO: 2953375 - DNA, 14 bp, Homo sapiens
ggctgcagccaggc

SEQ ID NO: 2953376 - DNA, 22 bp, Homo sapiens
ggctgcagccaggccactggcc

SEQ ID NO: 2953377 - DNA, 16 bp, Homo sapiens
ggctgcagccaggcct

SEQ ID NO: 2953378 - DNA, 17 bp, Homo sapiens
ggctgcagtcagccctg

SEQ ID NO: 2953379 - DNA, 17 bp, Homo sapiens
ggctgccattggtccac

SEQ ID NO: 2953380 - DNA, 20 bp, Homo sapiens
ggctgccattggtccaccct

SEQ ID NO: 2953381 - DNA, 12 bp, Homo sapiens
ggctgccccagg

SEQ ID NO: 2953382 - DNA, 14 bp, Homo sapiens
ggctgccccaggcc

SEQ ID NO: 2953383 - DNA, 17 bp, Homo sapiens
ggctgccccaggccgga

SEQ ID NO: 2953384 - DNA, 14 bp, Homo sapiens
ggctgcctcctgat

SEQ ID NO: 2953385 - DNA, 14 bp, Homo sapiens
ggctgcctggagcc

SEQ ID NO: 2953386 - DNA, 18 bp, Homo sapiens
ggctgcggtgggcagcca

SEQ ID NO: 2953387 - DNA, 18 bp, Homo sapiens
ggctgctcctccagggcc

SEQ ID NO: 2953388 - DNA, 16 bp, Homo sapiens
ggctgctcgcccagga

SEQ ID NO: 2953389 - DNA, 16 bp, Homo sapiens
ggctgctgacctccac

SEQ ID NO: 2953390 - DNA, 21 bp, Homo sapiens
ggctgctgacctccacagctt

SEQ ID NO: 2953391 - DNA, 11 bp, Homo sapiens
ggctgctgcca

SEQ ID NO: 2953392 - DNA, 11 bp, Homo sapiens
ggctgctgggg

SEQ ID NO: 2953393 - DNA, 21 bp, Homo sapiens
ggctgctggggcctcagacga

SEQ ID NO: 2953394 - DNA, 17 bp, Homo sapiens
ggctgctgggggctccc

SEQ ID NO: 2953395 - DNA, 20 bp, Homo sapiens
ggctgctgggggctcccctt

SEQ ID NO: 2953396 - DNA, 20 bp, Homo sapiens
ggctgcttgcagccaggaga

SEQ ID NO: 2953397 - DNA, 23 bp, Homo sapiens
ggctgcttgcagccaggagaagg

SEQ ID NO: 2953398 - DNA, 15 bp, Homo sapiens
ggctgctttccaaag

SEQ ID NO: 2953399 - DNA, 17 bp, Homo sapiens
ggctggaatgagggagg

SEQ ID NO: 2953400 - DNA, 18 bp, Homo sapiens
ggctggaatgagggaggc

SEQ ID NO: 2953401 - DNA, 13 bp, Homo sapiens
ggctggacttgga

SEQ ID NO: 2953402 - DNA, 18 bp, Homo sapiens
ggctggacttggaggtag

SEQ ID NO: 2953403 - DNA, 17 bp, Homo sapiens
ggctggaggcagggcct

SEQ ID NO: 2953404 - DNA, 20 bp, Homo sapiens
ggctggagggcagtggcacg

SEQ ID NO: 2953405 - DNA, 13 bp, Homo sapiens
ggctggaggtgct

SEQ ID NO: 2953406 - DNA, 15 bp, Homo sapiens
ggctggaggtgctgg

SEQ ID NO: 2953407 - DNA, 16 bp, Homo sapiens
ggctggagtgaggaaa

SEQ ID NO: 2953408 - DNA, 14 bp, Homo sapiens
ggctggcacaggac

SEQ ID NO: 2953409 - DNA, 12 bp, Homo sapiens
ggctggccagcc

SEQ ID NO: 2953410 - DNA, 23 bp, Homo sapiens
ggctggccagccgctctcctgcc

SEQ ID NO: 2953411 - DNA, 13 bp, Homo sapiens
ggctggccctgtg

SEQ ID NO: 2953412 - DNA, 14 bp, Homo sapiens
ggctggccctgtgc

SEQ ID NO: 2953413 - DNA, 14 bp, Homo sapiens
ggctggcctggagg

SEQ ID NO: 2953414 - DNA, 15 bp, Homo sapiens
ggctggcctggaggc

SEQ ID NO: 2953415 - DNA, 17 bp, Homo sapiens
ggctggcctggaggctc

SEQ ID NO: 2953416 - DNA, 21 bp, Homo sapiens
ggctggcctggaggctcagcc

SEQ ID NO: 2953417 - DNA, 17 bp, Homo sapiens
ggctggctaactggaag

SEQ ID NO: 2953418 - DNA, 16 bp, Homo sapiens
ggctggctgcttgcag

SEQ ID NO: 2953419 - DNA, 23 bp, Homo sapiens
ggctggctttggaatagatggac

SEQ ID NO: 2953420 - DNA, 20 bp, Homo sapiens
ggctgggaggagggcaggca

SEQ ID NO: 2953421 - DNA, 13 bp, Homo sapiens
ggctgggcagcct

SEQ ID NO: 2953422 - DNA, 13 bp, Homo sapiens
ggctgggcccagc

SEQ ID NO: 2953423 - DNA, 20 bp, Homo sapiens
ggctgggcccagcaggggcc

SEQ ID NO: 2953424 - DNA, 18 bp, Homo sapiens
ggctgggccgcaagggcc

SEQ ID NO: 2953425 - DNA, 20 bp, Homo sapiens
ggctgggccgcaagggcctg

SEQ ID NO: 2953426 - DNA, 23 bp, Homo sapiens
ggctgggccgcaagggcctggac

SEQ ID NO: 2953427 - DNA, 17 bp, Homo sapiens
ggctgggcctccttctt

SEQ ID NO: 2953428 - DNA, 12 bp, Homo sapiens
ggctggggaggg

SEQ ID NO: 2953429 - DNA, 15 bp, Homo sapiens
ggctggggagggggt

SEQ ID NO: 2953430 - DNA, 16 bp, Homo sapiens
ggctgggggagggact

SEQ ID NO: 2953431 - DNA, 16 bp, Homo sapiens
ggctggggtggcctgt

SEQ ID NO: 2953432 - DNA, 19 bp, Homo sapiens
ggctgggtccttgggcctg

SEQ ID NO: 2953433 - DNA, 14 bp, Homo sapiens
ggctggtattctct

SEQ ID NO: 2953434 - DNA, 20 bp, Homo sapiens
ggctggtctcgaactcctga

SEQ ID NO: 2953435 - DNA, 16 bp, Homo sapiens
ggctggtgaggccggc

SEQ ID NO: 2953436 - DNA, 20 bp, Homo sapiens
ggctggtgaggccggccctg

SEQ ID NO: 2953437 - DNA, 22 bp, Homo sapiens
ggctttcagcgcccccaggcct

SEQ ID NO: 2953438 - DNA, 23 bp, Homo sapiens
ggctttcagcgcccccaggcctg

SEQ ID NO: 2953439 - DNA, 18 bp, Homo sapiens
ggctttcagggcagcccc

SEQ ID NO: 2953440 - DNA, 23 bp, Homo sapiens
ggctttcatcctgtgtcccctga

SEQ ID NO: 2953441 - DNA, 11 bp, Homo sapiens
ggctttcatgt

SEQ ID NO: 2953442 - DNA, 22 bp, Homo sapiens
ggctttcccacttcccaccctg

SEQ ID NO: 2953443 - DNA, 23 bp, Homo sapiens
ggctttcccacttcccaccctgc

SEQ ID NO: 2953444 - DNA, 23 bp, Homo sapiens
ggctttcgtccacagcttcctgt

SEQ ID NO: 2953445 - DNA, 22 bp, Homo sapiens
ggctttgattagttttcttgtt

SEQ ID NO: 2953446 - DNA, 18 bp, Homo sapiens
ggcttttaggaactttat

SEQ ID NO: 2953447 - DNA, 18 bp, Homo sapiens
ggcttttgttctgagggg

SEQ ID NO: 2953448 - DNA, 22 bp, Homo sapiens
gggaaaaatgcaaaaaagaaac

SEQ ID NO: 2953449 - DNA, 17 bp, Homo sapiens
gggaaacgtctcccaga

SEQ ID NO: 2953450 - DNA, 18 bp, Homo sapiens
gggaaacgtctcccagat

SEQ ID NO: 2953451 - DNA, 17 bp, Homo sapiens
gggaaacttgtcacttg

SEQ ID NO: 2953452 - DNA, 21 bp, Homo sapiens
gggaaagacatccataaagaa

SEQ ID NO: 2953453 - DNA, 12 bp, Homo sapiens
gggaaattaatc

SEQ ID NO: 2953454 - DNA, 14 bp, Homo sapiens
gggaacagacagga

SEQ ID NO: 2953455 - DNA, 15 bp, Homo sapiens
gggaacagacaggag

SEQ ID NO: 2953456 - DNA, 16 bp, Homo sapiens
gggaacagacaggaga

SEQ ID NO: 2953457 - DNA, 13 bp, Homo sapiens
gggaacagccact

SEQ ID NO: 2953458 - DNA, 22 bp, Homo sapiens
gggaacagccactcccctccac

SEQ ID NO: 2953459 - DNA, 18 bp, Homo sapiens
gggaacgtgactgcccca

SEQ ID NO: 2953460 - DNA, 19 bp, Homo sapiens
gggaactgaatcaggaaac

SEQ ID NO: 2953461 - DNA, 20 bp, Homo sapiens
gggaactgatgtagaaggca

SEQ ID NO: 2953462 - DNA, 22 bp, Homo sapiens
gggaactgcttgcccagggtgc

SEQ ID NO: 2953463 - DNA, 22 bp, Homo sapiens
gggaagatgaaaccgtccctga

SEQ ID NO: 2953464 - DNA, 17 bp, Homo sapiens
gggaagcatcctcccca

SEQ ID NO: 2953465 - DNA, 18 bp, Homo sapiens
gggaagcatcctccccac

SEQ ID NO: 2953466 - DNA, 19 bp, Homo sapiens
gggaagcatcctccccacc

SEQ ID NO: 2953467 - DNA, 15 bp, Homo sapiens
gggaagctggagtgc

SEQ ID NO: 2953468 - DNA, 14 bp, Homo sapiens
gggaaggacagaaa

SEQ ID NO: 2953469 - DNA, 16 bp, Homo sapiens
gggaaggacagctgtg

SEQ ID NO: 2953470 - DNA, 12 bp, Homo sapiens
gggaaggatggg

SEQ ID NO: 2953471 - DNA, 16 bp, Homo sapiens
gggaagggagagggcc

SEQ ID NO: 2953472 - DNA, 18 bp, Homo sapiens
gggaagggagagggcctc

SEQ ID NO: 2953473 - DNA, 12 bp, Homo sapiens
gggaagggcagg

SEQ ID NO: 2953474 - DNA, 13 bp, Homo sapiens
gggaagggcaggc

SEQ ID NO: 2953475 - DNA, 18 bp, Homo sapiens
gggaaggggacccccgcc

SEQ ID NO: 2953476 - DNA, 15 bp, Homo sapiens
gggaaggggcctccc

SEQ ID NO: 2953477 - DNA, 16 bp, Homo sapiens
gggaagtcctgggagg

SEQ ID NO: 2953478 - DNA, 16 bp, Homo sapiens
gggaagtcgaggctgc

SEQ ID NO: 2953479 - DNA, 17 bp, Homo sapiens
gggaagtgaggaagcca

SEQ ID NO: 2953480 - DNA, 14 bp, Homo sapiens
gggaataaatatgc

SEQ ID NO: 2953481 - DNA, 23 bp, Homo sapiens
gggaatagtctagatggctcctc

SEQ ID NO: 2953482 - DNA, 24 bp, Homo sapiens
gggaatgaagcttgtgtatccatt

SEQ ID NO: 2953483 - DNA, 16 bp, Homo sapiens
gggaatgggcaggtgg

SEQ ID NO: 2953484 - DNA, 21 bp, Homo sapiens
gggaatgggcaggtggcctct

SEQ ID NO: 2953485 - DNA, 20 bp, Homo sapiens
gggaattctcagtgccaact

SEQ ID NO: 2953486 - DNA, 22 bp, Homo sapiens
gggacaacaatgaatcagaaca

SEQ ID NO: 2953487 - DNA, 18 bp, Homo sapiens
gggacaagtggactcagg

SEQ ID NO: 2953488 - DNA, 19 bp, Homo sapiens
gggacaagtggactcaggg

SEQ ID NO: 2953489 - DNA, 22 bp, Homo sapiens
gggacaagtggactcagggcag

SEQ ID NO: 2953490 - DNA, 15 bp, Homo sapiens
gggacactggcccca

SEQ ID NO: 2953491 - DNA, 18 bp, Homo sapiens
gggacagaggccccagcc

SEQ ID NO: 2953492 - DNA, 15 bp, Homo sapiens
gggacaggaaggtct

SEQ ID NO: 2953493 - DNA, 15 bp, Homo sapiens
gggacatctctttga

SEQ ID NO: 2953494 - DNA, 15 bp, Homo sapiens
gggacattgggaagg

SEQ ID NO: 2953495 - DNA, 20 bp, Homo sapiens
gggaccactgggcccctcag

SEQ ID NO: 2953496 - DNA, 23 bp, Homo sapiens
gggaccagaaacctgggagagac

SEQ ID NO: 2953497 - DNA, 15 bp, Homo sapiens
gggacccagtgcaga

SEQ ID NO: 2953498 - DNA, 16 bp, Homo sapiens
gggacccatgggggct

SEQ ID NO: 2953499 - DNA, 19 bp, Homo sapiens
gggacccccgccccctgcc

SEQ ID NO: 2953500 - DNA, 24 bp, Homo sapiens
gggacccccgccccctgccctccc

SEQ ID NO: 2953501 - DNA, 16 bp, Homo sapiens
gggaccccgagcctgg

SEQ ID NO: 2953502 - DNA, 23 bp, Homo sapiens
gggacccggggtctcctggacct

SEQ ID NO: 2953503 - DNA, 12 bp, Homo sapiens
gggaccctgctt

SEQ ID NO: 2953504 - DNA, 13 bp, Homo sapiens
gggaccctgcttt

SEQ ID NO: 2953505 - DNA, 16 bp, Homo sapiens
gggacctcagcctgca

SEQ ID NO: 2953506 - DNA, 16 bp, Homo sapiens
gggacctctcccaggg

SEQ ID NO: 2953507 - DNA, 21 bp, Homo sapiens
gggacctgatggagagtgaga

SEQ ID NO: 2953508 - DNA, 20 bp, Homo sapiens
gggaccttctgagccttcta

SEQ ID NO: 2953509 - DNA, 17 bp, Homo sapiens
gggacgaagaagagcca

SEQ ID NO: 2953510 - DNA, 21 bp, Homo sapiens
gggacgcaggcccctctcctc

SEQ ID NO: 2953511 - DNA, 21 bp, Homo sapiens
gggacgcctgggggtgccagg

SEQ ID NO: 2953512 - DNA, 20 bp, Homo sapiens
gggacgctccgctgccgtgc

SEQ ID NO: 2953513 - DNA, 14 bp, Homo sapiens
gggacgggacagac

SEQ ID NO: 2953514 - DNA, 19 bp, Homo sapiens
gggacgggcaagtgagagg

SEQ ID NO: 2953515 - DNA, 14 bp, Homo sapiens
gggacgtggctcag

SEQ ID NO: 2953516 - DNA, 20 bp, Homo sapiens
gggacgtggctcagccagca

SEQ ID NO: 2953517 - DNA, 21 bp, Homo sapiens
gggactagtgagtcagcacct

SEQ ID NO: 2953518 - DNA, 23 bp, Homo sapiens
gggactcactggcagccccagca

SEQ ID NO: 2953519 - DNA, 18 bp, Homo sapiens
gggactgaaaacctctcc

SEQ ID NO: 2953520 - DNA, 15 bp, Homo sapiens
gggactgctaaataa

SEQ ID NO: 2953521 - DNA, 16 bp, Homo sapiens
gggactgctaaataaa

SEQ ID NO: 2953522 - DNA, 12 bp, Homo sapiens
gggactgctggc

SEQ ID NO: 2953523 - DNA, 15 bp, Homo sapiens
gggactgggccatgg

SEQ ID NO: 2953524 - DNA, 24 bp, Homo sapiens
gggactgggccatgggtcctcggc

SEQ ID NO: 2953525 - DNA, 24 bp, Homo sapiens
gggacttgtaggaatctgccttcc

SEQ ID NO: 2953526 - DNA, 10 bp, Homo sapiens
gggagaaaac

SEQ ID NO: 2953527 - DNA, 18 bp, Homo sapiens
gggagaaaagacggatgg

SEQ ID NO: 2953528 - DNA, 19 bp, Homo sapiens
gggagaaaagacggatggc

SEQ ID NO: 2953529 - DNA, 18 bp, Homo sapiens
gggagggccagggaggca

SEQ ID NO: 2953530 - DNA, 18 bp, Homo sapiens
gggaggggaaggggccgg

SEQ ID NO: 2953531 - DNA, 15 bp, Homo sapiens
gggagggtaccagca

SEQ ID NO: 2953532 - DNA, 14 bp, Homo sapiens
gggagggtgagctg

SEQ ID NO: 2953533 - DNA, 15 bp, Homo sapiens
gggaggtcgaggtag

SEQ ID NO: 2953534 - DNA, 19 bp, Homo sapiens
gggaggtctcgtcccagcc

SEQ ID NO: 2953535 - DNA, 23 bp, Homo sapiens
gggaggtgcttctagttctgcca

SEQ ID NO: 2953536 - DNA, 20 bp, Homo sapiens
gggaggtggaggttgcattg

SEQ ID NO: 2953537 - DNA, 18 bp, Homo sapiens
gggaggtgggaggccagg

SEQ ID NO: 2953538 - DNA, 13 bp, Homo sapiens
gggaggtgttcac

SEQ ID NO: 2953539 - DNA, 16 bp, Homo sapiens
gggagtctcaggagga

SEQ ID NO: 2953540 - DNA, 20 bp, Homo sapiens
gggagtctcaggaggaggct

SEQ ID NO: 2953541 - DNA, 21 bp, Homo sapiens
gggagtctcaggaggaggctg

SEQ ID NO: 2953542 - DNA, 23 bp, Homo sapiens
gggagtctgaagcagatgcaaag

SEQ ID NO: 2953543 - DNA, 16 bp, Homo sapiens
gggagttaagacctgg

SEQ ID NO: 2953544 - DNA, 17 bp, Homo sapiens
gggagttaagacctggc

SEQ ID NO: 2953545 - DNA, 23 bp, Homo sapiens
gggagttaagacctggcagctct

SEQ ID NO: 2953546 - DNA, 23 bp, Homo sapiens
gggagttcgagaccaacctgacc

SEQ ID NO: 2953547 - DNA, 22 bp, Homo sapiens
gggatactttagaagtagaatt

SEQ ID NO: 2953548 - DNA, 17 bp, Homo sapiens
gggatagtctgggtcag

SEQ ID NO: 2953549 - DNA, 22 bp, Homo sapiens
gggatattttgaaatgaacttt

SEQ ID NO: 2953550 - DNA, 17 bp, Homo sapiens
gggatcacaggtgtcag

SEQ ID NO: 2953551 - DNA, 12 bp, Homo sapiens
gggatcctgccc

SEQ ID NO: 2953552 - DNA, 13 bp, Homo sapiens
gggatcctgcccc

SEQ ID NO: 2953553 - DNA, 14 bp, Homo sapiens
gggatcctgccccc

SEQ ID NO: 2953554 - DNA, 20 bp, Homo sapiens
gggatgaaactaaagcaata

SEQ ID NO: 2953555 - DNA, 20 bp, Homo sapiens
gggatgacatgcactcagct

SEQ ID NO: 2953556 - DNA, 21 bp, Homo sapiens
gggatgctatttcagccaatc

SEQ ID NO: 2953557 - DNA, 23 bp, Homo sapiens
gggatgctatttcagccaatctg

SEQ ID NO: 2953558 - DNA, 20 bp, Homo sapiens
gggatgtgctttgtggcttc

SEQ ID NO: 2953559 - DNA, 18 bp, Homo sapiens
gggatgtttacctggtgc

SEQ ID NO: 2953560 - DNA, 16 bp, Homo sapiens
gggattacccaagcaa

SEQ ID NO: 2953561 - DNA, 23 bp, Homo sapiens
gggattttattaattataaaatg

SEQ ID NO: 2953562 - DNA, 23 bp, Homo sapiens
gggcaaaatcgccataggccaag

SEQ ID NO: 2953563 - DNA, 17 bp, Homo sapiens
gggcaaacctagccgga

SEQ ID NO: 2953564 - DNA, 21 bp, Homo sapiens
gggcaacattgttcacctttg

SEQ ID NO: 2953565 - DNA, 22 bp, Homo sapiens
gggcaagtctttaggtctttgt

SEQ ID NO: 2953566 - DNA, 21 bp, Homo sapiens
gggcaagtgagaggggaggga

SEQ ID NO: 2953567 - DNA, 18 bp, Homo sapiens
gggcaatttagaaaaaga

SEQ ID NO: 2953568 - DNA, 21 bp, Homo sapiens
gggcacacccctggggctgag

SEQ ID NO: 2953569 - DNA, 13 bp, Homo sapiens
gggcactccccca

SEQ ID NO: 2953570 - DNA, 17 bp, Homo sapiens
gggcactggagctggga

SEQ ID NO: 2953571 - DNA, 12 bp, Homo sapiens
gggcactgggcg

SEQ ID NO: 2953572 - DNA, 12 bp, Homo sapiens
gggcagagccca

SEQ ID NO: 2953573 - DNA, 10 bp, Homo sapiens
gggcagcagc

SEQ ID NO: 2953574 - DNA, 18 bp, Homo sapiens
gggcagccacaccactgc

SEQ ID NO: 2953575 - DNA, 12 bp, Homo sapiens
gggcagccaggc

SEQ ID NO: 2953576 - DNA, 19 bp, Homo sapiens
gggcagccaggctgggccg

SEQ ID NO: 2953577 - DNA, 20 bp, Homo sapiens
gggcagcccaacagcacttt

SEQ ID NO: 2953578 - DNA, 17 bp, Homo sapiens
gggcagcccctgcagac

SEQ ID NO: 2953579 - DNA, 13 bp, Homo sapiens
gggcagccctcca

SEQ ID NO: 2953580 - DNA, 21 bp, Homo sapiens
gggcagccctccatggtcctg

SEQ ID NO: 2953581 - DNA, 13 bp, Homo sapiens
gggcagccctcct

SEQ ID NO: 2953582 - DNA, 18 bp, Homo sapiens
gggcagcctcccccggct

SEQ ID NO: 2953583 - DNA, 15 bp, Homo sapiens
gggcagcgccaggct

SEQ ID NO: 2953584 - DNA, 15 bp, Homo sapiens
gggcagctgcctggc

SEQ ID NO: 2953585 - DNA, 17 bp, Homo sapiens
gggcagctgcctggcca

SEQ ID NO: 2953586 - DNA, 16 bp, Homo sapiens
gggcaggagggagggt

SEQ ID NO: 2953587 - DNA, 15 bp, Homo sapiens
gggcaggccagagct

SEQ ID NO: 2953588 - DNA, 14 bp, Homo sapiens
gggcaggcgtgact

SEQ ID NO: 2953589 - DNA, 23 bp, Homo sapiens
gggcagggacccggggtctcctg

SEQ ID NO: 2953590 - DNA, 12 bp, Homo sapiens
gggcagggagcg

SEQ ID NO: 2953591 - DNA, 19 bp, Homo sapiens
gggcagggagctgggcccg

SEQ ID NO: 2953592 - DNA, 21 bp, Homo sapiens
gggcaggggagccagggtaga

SEQ ID NO: 2953593 - DNA, 13 bp, Homo sapiens
gggcaggggctgg

SEQ ID NO: 2953594 - DNA, 15 bp, Homo sapiens
gggcaggtggccgcc

SEQ ID NO: 2953595 - DNA, 16 bp, Homo sapiens
gggcaggtggcctctg

SEQ ID NO: 2953596 - DNA, 19 bp, Homo sapiens
gggcaggtggcctctgctg

SEQ ID NO: 2953597 - DNA, 22 bp, Homo sapiens
gggcaggtggcctctgctggtc

SEQ ID NO: 2953598 - DNA, 17 bp, Homo sapiens
gggcaggtgggagctga

SEQ ID NO: 2953599 - DNA, 14 bp, Homo sapiens
gggcaggtggggtg

SEQ ID NO: 2953600 - DNA, 17 bp, Homo sapiens
gggcagtcattatccag

SEQ ID NO: 2953601 - DNA, 19 bp, Homo sapiens
gggcagtctgagagaggcc

SEQ ID NO: 2953602 - DNA, 21 bp, Homo sapiens
gggcagtctgagagaggccat

SEQ ID NO: 2953603 - DNA, 17 bp, Homo sapiens
gggcagtgccagccaat

SEQ ID NO: 2953604 - DNA, 21 bp, Homo sapiens
gggcatgacccagtgaagatg

SEQ ID NO: 2953605 - DNA, 17 bp, Homo sapiens
gggcatgggtcgggaga

SEQ ID NO: 2953606 - DNA, 22 bp, Homo sapiens
gggcatgggtcgggagagggga

SEQ ID NO: 2953607 - DNA, 19 bp, Homo sapiens
gggcatggtggcaggcgcc

SEQ ID NO: 2953608 - DNA, 17 bp, Homo sapiens
gggcatgtctgcctgga

SEQ ID NO: 2953609 - DNA, 18 bp, Homo sapiens
gggcattgatggggaagg

SEQ ID NO: 2953610 - DNA, 14 bp, Homo sapiens
gggcattgctttcc

SEQ ID NO: 2953611 - DNA, 19 bp, Homo sapiens
gggccacatgggaggctca

SEQ ID NO: 2953612 - DNA, 13 bp, Homo sapiens
gggccacccctcc

SEQ ID NO: 2953613 - DNA, 14 bp, Homo sapiens
gggccacccctcct

SEQ ID NO: 2953614 - DNA, 14 bp, Homo sapiens
gggccacgtgccag

SEQ ID NO: 2953615 - DNA, 13 bp, Homo sapiens
gggccagagccag

SEQ ID NO: 2953616 - DNA, 19 bp, Homo sapiens
gggccagatccagcctggg

SEQ ID NO: 2953617 - DNA, 13 bp, Homo sapiens
gggccaggaagga

SEQ ID NO: 2953618 - DNA, 12 bp, Homo sapiens
gggccaggccct

SEQ ID NO: 2953619 - DNA, 13 bp, Homo sapiens
gggccaggccctg

SEQ ID NO: 2953620 - DNA, 15 bp, Homo sapiens
gggccaggccctgga

SEQ ID NO: 2953621 - DNA, 16 bp, Homo sapiens
gggccaggccctggag

SEQ ID NO: 2953622 - DNA, 17 bp, Homo sapiens
gggccaggccctggagg

SEQ ID NO: 2953623 - DNA, 22 bp, Homo sapiens
gggccaggccgggcctgtacag

SEQ ID NO: 2953624 - DNA, 23 bp, Homo sapiens
gggccaggccgggcctgtacagt

SEQ ID NO: 2953625 - DNA, 24 bp, Homo sapiens
gggccaggctggtccgagctgagg

SEQ ID NO: 2953626 - DNA, 13 bp, Homo sapiens
gggccagggaggc

SEQ ID NO: 2953627 - DNA, 14 bp, Homo sapiens
gggccagggaggca

SEQ ID NO: 2953628 - DNA, 13 bp, Homo sapiens
ggcatgagaaata

SEQ ID NO: 2953629 - DNA, 12 bp, Homo sapiens
ggcatgagatag

SEQ ID NO: 2953630 - DNA, 21 bp, Homo sapiens
ggcatgagttactgtgcattg

SEQ ID NO: 2953631 - DNA, 18 bp, Homo sapiens
ggcatgatccaagcaaga

SEQ ID NO: 2953632 - DNA, 21 bp, Homo sapiens
ggcatgcacacggctggtcac

SEQ ID NO: 2953633 - DNA, 16 bp, Homo sapiens
ggcatgcacctgcaat

SEQ ID NO: 2953634 - DNA, 21 bp, Homo sapiens
ggcatgcacctgcaatcccag

SEQ ID NO: 2953635 - DNA, 21 bp, Homo sapiens
ggcatgcacgggcatgcacac

SEQ ID NO: 2953636 - DNA, 12 bp, Homo sapiens
ggcatgccagga

SEQ ID NO: 2953637 - DNA, 19 bp, Homo sapiens
ggcatggaaggggcttctg

SEQ ID NO: 2953638 - DNA, 16 bp, Homo sapiens
ggcatggggcatgtcc

SEQ ID NO: 2953639 - DNA, 18 bp, Homo sapiens
ggcatggggcatgtcctt

SEQ ID NO: 2953640 - DNA, 21 bp, Homo sapiens
ggcatgggtcgggagagggga

SEQ ID NO: 2953641 - DNA, 19 bp, Homo sapiens
ggcatggtggcgcaagcct

SEQ ID NO: 2953642 - DNA, 22 bp, Homo sapiens
ggcatggtggcgcaagcctgta

SEQ ID NO: 2953643 - DNA, 19 bp, Homo sapiens
ggcatgtgggttgtgatat

SEQ ID NO: 2953644 - DNA, 23 bp, Homo sapiens
ggcatgttagcccttcctccaat

SEQ ID NO: 2953645 - DNA, 12 bp, Homo sapiens
ggcatgtttaat

SEQ ID NO: 2953646 - DNA, 16 bp, Homo sapiens
ggcattctacacctgg

SEQ ID NO: 2953647 - DNA, 20 bp, Homo sapiens
ggcattctttgcaatactgc

SEQ ID NO: 2953648 - DNA, 12 bp, Homo sapiens
ggcattgctttc

SEQ ID NO: 2953649 - DNA, 17 bp, Homo sapiens
ggcattgttagtttagt

SEQ ID NO: 2953650 - DNA, 16 bp, Homo sapiens
ggcattttatagacac

SEQ ID NO: 2953651 - DNA, 20 bp, Homo sapiens
ggcattttgaatgtgatcat

SEQ ID NO: 2953652 - DNA, 21 bp, Homo sapiens
ggcatttttaccatcactgag

SEQ ID NO: 2953653 - DNA, 15 bp, Homo sapiens
ggccaaacctctgtt

SEQ ID NO: 2953654 - DNA, 17 bp, Homo sapiens
ggccaacatggcgaaac

SEQ ID NO: 2953655 - DNA, 23 bp, Homo sapiens
ggccaacccttctcctcttgtaa

SEQ ID NO: 2953656 - DNA, 21 bp, Homo sapiens
ggccaagaatgtacgtccagc

SEQ ID NO: 2953657 - DNA, 14 bp, Homo sapiens
ggccaagagaaggg

SEQ ID NO: 2953658 - DNA, 17 bp, Homo sapiens
ggccaagcagtgcctgc

SEQ ID NO: 2953659 - DNA, 14 bp, Homo sapiens
ggccaaggagctgc

SEQ ID NO: 2953660 - DNA, 17 bp, Homo sapiens
ggccacactgtgacaca

SEQ ID NO: 2953661 - DNA, 15 bp, Homo sapiens
ggccacagcgtgctg

SEQ ID NO: 2953662 - DNA, 12 bp, Homo sapiens
ggccacagggca

SEQ ID NO: 2953663 - DNA, 20 bp, Homo sapiens
ggccacagtagtcttgatga

SEQ ID NO: 2953664 - DNA, 19 bp, Homo sapiens
ggccacatcaaagaggctg

SEQ ID NO: 2953665 - DNA, 12 bp, Homo sapiens
ggccacatggcg

SEQ ID NO: 2953666 - DNA, 18 bp, Homo sapiens
ggccacatgggaggctca

SEQ ID NO: 2953667 - DNA, 20 bp, Homo sapiens
ggccacattttcagccaaag

SEQ ID NO: 2953668 - DNA, 13 bp, Homo sapiens
ggccacctcaccc

SEQ ID NO: 2953669 - DNA, 19 bp, Homo sapiens
ggccacctcaccctctccg

SEQ ID NO: 2953670 - DNA, 14 bp, Homo sapiens
ggccacggcccagg

SEQ ID NO: 2953671 - DNA, 22 bp, Homo sapiens
ggccacgtatagtcctagctga

SEQ ID NO: 2953672 - DNA, 11 bp, Homo sapiens
ggccacgtgcc

SEQ ID NO: 2953673 - DNA, 18 bp, Homo sapiens
ggccacgtgccaggcccg

SEQ ID NO: 2953674 - DNA, 18 bp, Homo sapiens
ggccactcaacagagagg

SEQ ID NO: 2953675 - DNA, 20 bp, Homo sapiens
ggccactgtgtttctgtgct

SEQ ID NO: 2953676 - DNA, 11 bp, Homo sapiens
ggccagagcca

SEQ ID NO: 2953677 - DNA, 13 bp, Homo sapiens
ggccagagccagg

SEQ ID NO: 2953678 - DNA, 15 bp, Homo sapiens
ggccagatgcgggga

SEQ ID NO: 2953679 - DNA, 13 bp, Homo sapiens
ggccagcaggcag

SEQ ID NO: 2953680 - DNA, 14 bp, Homo sapiens
ggccagcaggcagc

SEQ ID NO: 2953681 - DNA, 15 bp, Homo sapiens
ggccagcaggcagcg

SEQ ID NO: 2953682 - DNA, 17 bp, Homo sapiens
ggccagcaggcagcgcc

SEQ ID NO: 2953683 - DNA, 19 bp, Homo sapiens
ggccagcaggcagcgcctg

SEQ ID NO: 2953684 - DNA, 21 bp, Homo sapiens
ggccagccagccactctacca

SEQ ID NO: 2953685 - DNA, 15 bp, Homo sapiens
ggccagccgctctcc

SEQ ID NO: 2953686 - DNA, 21 bp, Homo sapiens
ggccagccgctctcctgccac

SEQ ID NO: 2953687 - DNA, 22 bp, Homo sapiens
ggccagcgccagggcccaggcc

SEQ ID NO: 2953688 - DNA, 19 bp, Homo sapiens
ggccagctgccccagccag

SEQ ID NO: 2953689 - DNA, 16 bp, Homo sapiens
ggccagctggcagcag

SEQ ID NO: 2953690 - DNA, 17 bp, Homo sapiens
ggccagctggcagcaga

SEQ ID NO: 2953691 - DNA, 15 bp, Homo sapiens
ggccaggacaggccc

SEQ ID NO: 2953692 - DNA, 14 bp, Homo sapiens
ggccaggccctgga

SEQ ID NO: 2953693 - DNA, 18 bp, Homo sapiens
ggccaggccctggagggc

SEQ ID NO: 2953694 - DNA, 21 bp, Homo sapiens
ggccaggccctggagggcaga

SEQ ID NO: 2953695 - DNA, 16 bp, Homo sapiens
ggccaggccctgggtc

SEQ ID NO: 2953696 - DNA, 17 bp, Homo sapiens
ggccaggccctgggtct

SEQ ID NO: 2953697 - DNA, 18 bp, Homo sapiens
ggccaggccctgggtctt

SEQ ID NO: 2953698 - DNA, 19 bp, Homo sapiens
ggccaggccgggcctgtac

SEQ ID NO: 2953699 - DNA, 22 bp, Homo sapiens
ggccaggcctcgcacttgcaga

SEQ ID NO: 2953700 - DNA, 20 bp, Homo sapiens
ggccaggcgagcctgactct

SEQ ID NO: 2953701 - DNA, 18 bp, Homo sapiens
ggccaggctgcctggcct

SEQ ID NO: 2953702 - DNA, 13 bp, Homo sapiens
ggccaggctggtc

SEQ ID NO: 2953703 - DNA, 21 bp, Homo sapiens
ggccagggaggcagagcggga

SEQ ID NO: 2953704 - DNA, 17 bp, Homo sapiens
ggccagggcggccaggg

SEQ ID NO: 2953705 - DNA, 10 bp, Homo sapiens
ggccagggct

SEQ ID NO: 2953706 - DNA, 22 bp, Homo sapiens
ggccagggctcctgtggcagct

SEQ ID NO: 2953707 - DNA, 11 bp, Homo sapiens
ggccagggctg

SEQ ID NO: 2953708 - DNA, 22 bp, Homo sapiens
ggccagggctgggtcacaggaa

SEQ ID NO: 2953709 - DNA, 18 bp, Homo sapiens
ggccaggtgggcggacaa

SEQ ID NO: 2953710 - DNA, 22 bp, Homo sapiens
ggccaggttggaaaagaaatca

SEQ ID NO: 2953711 - DNA, 18 bp, Homo sapiens
ggccagtacctttccatt

SEQ ID NO: 2953712 - DNA, 17 bp, Homo sapiens
ggccagtcctggtcctg

SEQ ID NO: 2953713 - DNA, 22 bp, Homo sapiens
ggccagtcctggtcctggctgc

SEQ ID NO: 2953714 - DNA, 16 bp, Homo sapiens
ggccagtcttcctctt

SEQ ID NO: 2953715 - DNA, 13 bp, Homo sapiens
ggccatcactcag

SEQ ID NO: 2953716 - DNA, 14 bp, Homo sapiens
ggccatcactcagc

SEQ ID NO: 2953717 - DNA, 22 bp, Homo sapiens
ggccatctgggctcctccaggg

SEQ ID NO: 2953718 - DNA, 21 bp, Homo sapiens
ggccatctggttaggatggca

SEQ ID NO: 2953719 - DNA, 15 bp, Homo sapiens
ggccatgatggcaac

SEQ ID NO: 2953720 - DNA, 18 bp, Homo sapiens
ggccatgatggcaacaga

SEQ ID NO: 2953721 - DNA, 22 bp, Homo sapiens
ggccatgatggcaacagatctg

SEQ ID NO: 2953722 - DNA, 14 bp, Homo sapiens
ggccatgctgtccc

SEQ ID NO: 2953723 - DNA, 16 bp, Homo sapiens
ggccatgctgtccctg

SEQ ID NO: 2953724 - DNA, 21 bp, Homo sapiens
ggccatgctgtccctgcactg

SEQ ID NO: 2953725 - DNA, 13 bp, Homo sapiens
ggccatggcctct

SEQ ID NO: 2953726 - DNA, 15 bp, Homo sapiens
ggccatggcctctgc

SEQ ID NO: 2953727 - DNA, 16 bp, Homo sapiens
ggccatggctttcatc

SEQ ID NO: 2953728 - DNA, 14 bp, Homo sapiens
ggccatgggtcctc

SEQ ID NO: 2953729 - DNA, 22 bp, Homo sapiens
ggccatgggtcctcggcccatc

SEQ ID NO: 2953730 - DNA, 19 bp, Homo sapiens
ggccatgtggcctgcccag

SEQ ID NO: 2953731 - DNA, 14 bp, Homo sapiens
ggccattaggaaac

SEQ ID NO: 2953732 - DNA, 21 bp, Homo sapiens
ggccattctttttttcttggc

SEQ ID NO: 2953733 - DNA, 13 bp, Homo sapiens
ggcccaagagccc

SEQ ID NO: 2953734 - DNA, 14 bp, Homo sapiens
ggcccaagagcccg

SEQ ID NO: 2953735 - DNA, 17 bp, Homo sapiens
ggcccaagagcccgtgc

SEQ ID NO: 2953736 - DNA, 17 bp, Homo sapiens
ggcccaagtttctaagg

SEQ ID NO: 2953737 - DNA, 14 bp, Homo sapiens
ggcccacacacagg

SEQ ID NO: 2953738 - DNA, 15 bp, Homo sapiens
ggcccacacacaggt

SEQ ID NO: 2953739 - DNA, 15 bp, Homo sapiens
ggcccacagccccca

SEQ ID NO: 2953740 - DNA, 13 bp, Homo sapiens
ggcccacagctcc

SEQ ID NO: 2953741 - DNA, 14 bp, Homo sapiens
ggcccacagctccc

SEQ ID NO: 2953742 - DNA, 19 bp, Homo sapiens
ggcccacagctcccacccc

SEQ ID NO: 2953743 - DNA, 17 bp, Homo sapiens
ggcccacagggtaccag

SEQ ID NO: 2953744 - DNA, 22 bp, Homo sapiens
ggcccacccagtccatgctcca

SEQ ID NO: 2953745 - DNA, 16 bp, Homo sapiens
ggcccactgctggctg

SEQ ID NO: 2953746 - DNA, 17 bp, Homo sapiens
ggcccagacccagcccg

SEQ ID NO: 2953747 - DNA, 18 bp, Homo sapiens
ggcccagaccggcttctc

SEQ ID NO: 2953748 - DNA, 12 bp, Homo sapiens
ggcccagagccc

SEQ ID NO: 2953749 - DNA, 13 bp, Homo sapiens
ggcccagagccca

SEQ ID NO: 2953750 - DNA, 22 bp, Homo sapiens
ggcccagcaccccctctcctgg

SEQ ID NO: 2953751 - DNA, 18 bp, Homo sapiens
ggcccagcgctctcctgg

SEQ ID NO: 2953752 - DNA, 22 bp, Homo sapiens
ggcccagcgctctcctggacgc

SEQ ID NO: 2953753 - DNA, 12 bp, Homo sapiens
ggcccaggagct

SEQ ID NO: 2953754 - DNA, 13 bp, Homo sapiens
ggcccaggagctc

SEQ ID NO: 2953755 - DNA, 14 bp, Homo sapiens
ggcccaggagctct

SEQ ID NO: 2953756 - DNA, 17 bp, Homo sapiens
ggcccaggagctctgcg

SEQ ID NO: 2953757 - DNA, 18 bp, Homo sapiens
ggcccaggagctctgcgc

SEQ ID NO: 2953758 - DNA, 23 bp, Homo sapiens
ggcccaggaggaggattgtgctg

SEQ ID NO: 2953759 - DNA, 15 bp, Homo sapiens
ggcccaggcaggtct

SEQ ID NO: 2953760 - DNA, 12 bp, Homo sapiens
ggcccaggcctg

SEQ ID NO: 2953761 - DNA, 17 bp, Homo sapiens
ggcccaggcctggagcg

SEQ ID NO: 2953762 - DNA, 16 bp, Homo sapiens
ggcccaggccttgctg

SEQ ID NO: 2953763 - DNA, 14 bp, Homo sapiens
ggcccaggctggga

SEQ ID NO: 2953764 - DNA, 11 bp, Homo sapiens
ggcccagggac

SEQ ID NO: 2953765 - DNA, 13 bp, Homo sapiens
gcctaaggaagct

SEQ ID NO: 2953766 - DNA, 12 bp, Homo sapiens
gcctaaggccct

SEQ ID NO: 2953767 - DNA, 16 bp, Homo sapiens
gcctacccacccccag

SEQ ID NO: 2953768 - DNA, 21 bp, Homo sapiens
gcctaccttgtgagggagaga

SEQ ID NO: 2953769 - DNA, 14 bp, Homo sapiens
gcctactgtccctc

SEQ ID NO: 2953770 - DNA, 20 bp, Homo sapiens
gcctagagcactctcacccc

SEQ ID NO: 2953771 - DNA, 14 bp, Homo sapiens
gcctagctcttggg

SEQ ID NO: 2953772 - DNA, 19 bp, Homo sapiens
gcctagctcttgggcctga

SEQ ID NO: 2953773 - DNA, 14 bp, Homo sapiens
gcctagctgctaca

SEQ ID NO: 2953774 - DNA, 18 bp, Homo sapiens
gcctaggaggactggggt

SEQ ID NO: 2953775 - DNA, 13 bp, Homo sapiens
gcctaggattcta

SEQ ID NO: 2953776 - DNA, 16 bp, Homo sapiens
gcctaggatttcagcc

SEQ ID NO: 2953777 - DNA, 17 bp, Homo sapiens
gcctaggatttcagcca

SEQ ID NO: 2953778 - DNA, 13 bp, Homo sapiens
gcctaggcctcag

SEQ ID NO: 2953779 - DNA, 16 bp, Homo sapiens
gcctaggcctcagcca

SEQ ID NO: 2953780 - DNA, 18 bp, Homo sapiens
gcctaggcctcagccaga

SEQ ID NO: 2953781 - DNA, 14 bp, Homo sapiens
gcctagtggcttgt

SEQ ID NO: 2953782 - DNA, 19 bp, Homo sapiens
gcctagtggggtctccctc

SEQ ID NO: 2953783 - DNA, 22 bp, Homo sapiens
gcctagtggggtctccctctcc

SEQ ID NO: 2953784 - DNA, 15 bp, Homo sapiens
gcctataactttttt

SEQ ID NO: 2953785 - DNA, 20 bp, Homo sapiens
gcctatgcacatatggactc

SEQ ID NO: 2953786 - DNA, 16 bp, Homo sapiens
gcctatggcagaaaaa

SEQ ID NO: 2953787 - DNA, 14 bp, Homo sapiens
gcctcaagccatct

SEQ ID NO: 2953788 - DNA, 17 bp, Homo sapiens
gcctcaagccatcttcc

SEQ ID NO: 2953789 - DNA, 19 bp, Homo sapiens
gcctcaagccatcttcccg

SEQ ID NO: 2953790 - DNA, 22 bp, Homo sapiens
gcctcaaggttttaggttctaa

SEQ ID NO: 2953791 - DNA, 24 bp, Homo sapiens
gcctcaagtgagccaagaaacact

SEQ ID NO: 2953792 - DNA, 13 bp, Homo sapiens
gcctcacagaaga

SEQ ID NO: 2953793 - DNA, 19 bp, Homo sapiens
gcctcacagatgctggcct

SEQ ID NO: 2953794 - DNA, 15 bp, Homo sapiens
gcctcacccacccct

SEQ ID NO: 2953795 - DNA, 17 bp, Homo sapiens
gcctcacccacccctgc

SEQ ID NO: 2953796 - DNA, 18 bp, Homo sapiens
gcctcacccacccctgca

SEQ ID NO: 2953797 - DNA, 20 bp, Homo sapiens
gcctcacgtatttcacagag

SEQ ID NO: 2953798 - DNA, 23 bp, Homo sapiens
gcctcacgtatttcacagagcac

SEQ ID NO: 2953799 - DNA, 19 bp, Homo sapiens
gcctcactaatttttgtat

SEQ ID NO: 2953800 - DNA, 20 bp, Homo sapiens
gcctcacttggtctgccagg

SEQ ID NO: 2953801 - DNA, 13 bp, Homo sapiens
gcctcagaagaaa

SEQ ID NO: 2953802 - DNA, 17 bp, Homo sapiens
gcctcagactgcaccca

SEQ ID NO: 2953803 - DNA, 22 bp, Homo sapiens
gcctcagccctgaccctgtgga

SEQ ID NO: 2953804 - DNA, 14 bp, Homo sapiens
gcctcagcctactc

SEQ ID NO: 2953805 - DNA, 15 bp, Homo sapiens
gcctcagcctactcc

SEQ ID NO: 2953806 - DNA, 15 bp, Homo sapiens
gcctcagcctcccga

SEQ ID NO: 2953807 - DNA, 23 bp, Homo sapiens
gcctcagcggaccactcttctct

SEQ ID NO: 2953808 - DNA, 12 bp, Homo sapiens
gcctcagctcat

SEQ ID NO: 2953809 - DNA, 19 bp, Homo sapiens
gcctcaggcactctcctgt

SEQ ID NO: 2953810 - DNA, 18 bp, Homo sapiens
gcctcagggccaggaagg

SEQ ID NO: 2953811 - DNA, 16 bp, Homo sapiens
gcctcagtgtgcccat

SEQ ID NO: 2953812 - DNA, 13 bp, Homo sapiens
gcctcatgctctg

SEQ ID NO: 2953813 - DNA, 15 bp, Homo sapiens
gcctcatgttctgtg

SEQ ID NO: 2953814 - DNA, 16 bp, Homo sapiens
gcctcatgttctgtgg

SEQ ID NO: 2953815 - DNA, 15 bp, Homo sapiens
gcctccaccatcccc

SEQ ID NO: 2953816 - DNA, 12 bp, Homo sapiens
gcctccaccgct

SEQ ID NO: 2953817 - DNA, 18 bp, Homo sapiens
gcctccaccgctgcctaa

SEQ ID NO: 2953818 - DNA, 19 bp, Homo sapiens
gcctccagaactcactggg

SEQ ID NO: 2953819 - DNA, 22 bp, Homo sapiens
gcctccagaggggctcaggtca

SEQ ID NO: 2953820 - DNA, 15 bp, Homo sapiens
gcttttattttttct

SEQ ID NO: 2953821 - DNA, 14 bp, Homo sapiens
gcttttccttgggg

SEQ ID NO: 2953822 - DNA, 20 bp, Homo sapiens
gcttttccttggggcaggca

SEQ ID NO: 2953823 - DNA, 17 bp, Homo sapiens
gcttttcgaactgtgct

SEQ ID NO: 2953824 - DNA, 14 bp, Homo sapiens
gcttttcttcctag

SEQ ID NO: 2953825 - DNA, 13 bp, Homo sapiens
gcttttgaaatct

SEQ ID NO: 2953826 - DNA, 14 bp, Homo sapiens
gcttttgcttgcaa

SEQ ID NO: 2953827 - DNA, 18 bp, Homo sapiens
gcttttgttccaatgtca

SEQ ID NO: 2953828 - DNA, 14 bp, Homo sapiens
gcttttgttgttta

SEQ ID NO: 2953829 - DNA, 15 bp, Homo sapiens
gctttttatttctgc

SEQ ID NO: 2953830 - DNA, 23 bp, Homo sapiens
gcttttttcctcctttctctgta

SEQ ID NO: 2953831 - DNA, 23 bp, Homo sapiens
ggaaaaaaaaaaaaagaaattcg

SEQ ID NO: 2953832 - DNA, 12 bp, Homo sapiens
ggaaaaaaagac

SEQ ID NO: 2953833 - DNA, 15 bp, Homo sapiens
ggaaaaaaattacaa

SEQ ID NO: 2953834 - DNA, 21 bp, Homo sapiens
ggaaaaaagatttttaaaatg

SEQ ID NO: 2953835 - DNA, 21 bp, Homo sapiens
ggaaaaaataaaaatcaaaca

SEQ ID NO: 2953836 - DNA, 16 bp, Homo sapiens
ggaaaaaataacaatg

SEQ ID NO: 2953837 - DNA, 20 bp, Homo sapiens
ggaaaaaataacaatgaaag

SEQ ID NO: 2953838 - DNA, 21 bp, Homo sapiens
ggaaaaacatctgaaagccac

SEQ ID NO: 2953839 - DNA, 19 bp, Homo sapiens
ggaaaaaccacccccaaat

SEQ ID NO: 2953840 - DNA, 13 bp, Homo sapiens
ggaaaaagaaaga

SEQ ID NO: 2953841 - DNA, 20 bp, Homo sapiens
ggaaaaataatcaagatttt

SEQ ID NO: 2953842 - DNA, 15 bp, Homo sapiens
ggaaaaatgaactgt

SEQ ID NO: 2953843 - DNA, 22 bp, Homo sapiens
ggaaaaatgcaaaaaagaaaca

SEQ ID NO: 2953844 - DNA, 16 bp, Homo sapiens
ggaaaactgacagagg

SEQ ID NO: 2953845 - DNA, 22 bp, Homo sapiens
ggaaaacttgcagctaaggagg

SEQ ID NO: 2953846 - DNA, 16 bp, Homo sapiens
ggaaaagcgtctttaa

SEQ ID NO: 2953847 - DNA, 18 bp, Homo sapiens
ggaaaagcgtctttaaga

SEQ ID NO: 2953848 - DNA, 21 bp, Homo sapiens
ggaaaagcgtctttaagagac

SEQ ID NO: 2953849 - DNA, 20 bp, Homo sapiens
ggaaaagggtcttgggaaat

SEQ ID NO: 2953850 - DNA, 21 bp, Homo sapiens
ggaaaagggtcttgggaaata

SEQ ID NO: 2953851 - DNA, 20 bp, Homo sapiens
ggaaaatgcagcagggatgc

SEQ ID NO: 2953852 - DNA, 12 bp, Homo sapiens
ggaaaattattt

SEQ ID NO: 2953853 - DNA, 23 bp, Homo sapiens
ggaaacaaagcttagcaggagag

SEQ ID NO: 2953854 - DNA, 16 bp, Homo sapiens
ggaaacaagggaaggg

SEQ ID NO: 2953855 - DNA, 12 bp, Homo sapiens
ggaaacaatata

SEQ ID NO: 2953856 - DNA, 15 bp, Homo sapiens
ggaaacactccttgc

SEQ ID NO: 2953857 - DNA, 22 bp, Homo sapiens
ggaaacagactcgattcatatt

SEQ ID NO: 2953858 - DNA, 18 bp, Homo sapiens
ggaaaccaaaaggccgtg

SEQ ID NO: 2953859 - DNA, 21 bp, Homo sapiens
ggaaaccaagtcaggccaggt

SEQ ID NO: 2953860 - DNA, 17 bp, Homo sapiens
ggaaaccacaaccttgc

SEQ ID NO: 2953861 - DNA, 15 bp, Homo sapiens
ggaaaccttggtgta

SEQ ID NO: 2953862 - DNA, 15 bp, Homo sapiens
ggaaactcttgctat

SEQ ID NO: 2953863 - DNA, 13 bp, Homo sapiens
ggaaactgtgaat

SEQ ID NO: 2953864 - DNA, 15 bp, Homo sapiens
ggaaacttctgtaag

SEQ ID NO: 2953865 - DNA, 20 bp, Homo sapiens
ggaaacttctgtaaggggca

SEQ ID NO: 2953866 - DNA, 17 bp, Homo sapiens
ggaaacttgtcacttgc

SEQ ID NO: 2953867 - DNA, 14 bp, Homo sapiens
ggaaagacactgcc

SEQ ID NO: 2953868 - DNA, 15 bp, Homo sapiens
ggaaagacaggaaga

SEQ ID NO: 2953869 - DNA, 19 bp, Homo sapiens
ggaaagacaggaagaccaa

SEQ ID NO: 2953870 - DNA, 17 bp, Homo sapiens
ggaaagagaaagagaca

SEQ ID NO: 2953871 - DNA, 19 bp, Homo sapiens
ggaaagaggtgaaaatgaa

SEQ ID NO: 2953872 - DNA, 15 bp, Homo sapiens
ggaaagatggataaa

SEQ ID NO: 2953873 - DNA, 21 bp, Homo sapiens
ggaaaggagtagaaaaagcag

SEQ ID NO: 2953874 - DNA, 20 bp, Homo sapiens
ggaaaggatcctacaatatt

SEQ ID NO: 2953875 - DNA, 20 bp, Homo sapiens
ggaaaggccagctggcagca

SEQ ID NO: 2953876 - DNA, 23 bp, Homo sapiens
ggaaaggtttcaagacttgatac

SEQ ID NO: 2953877 - DNA, 11 bp, Homo sapiens
ggaaagtggtg

SEQ ID NO: 2953878 - DNA, 18 bp, Homo sapiens
ggaaagtgtaaagcattc

SEQ ID NO: 2953879 - DNA, 19 bp, Homo sapiens
ggaaagttcagagttttct

SEQ ID NO: 2953880 - DNA, 18 bp, Homo sapiens
ggaaataccttgagcaga

SEQ ID NO: 2953881 - DNA, 20 bp, Homo sapiens
ggaaataccttgagcagaat

SEQ ID NO: 2953882 - DNA, 14 bp, Homo sapiens
ggaaatgagcaggg

SEQ ID NO: 2953883 - DNA, 16 bp, Homo sapiens
ggaaatgcaagctctg

SEQ ID NO: 2953884 - DNA, 12 bp, Homo sapiens
ggaaattaaagt

SEQ ID NO: 2953885 - DNA, 19 bp, Homo sapiens
ggaacaaaaattacaaaga

SEQ ID NO: 2953886 - DNA, 15 bp, Homo sapiens
ggaacaaattatttt

SEQ ID NO: 2953887 - DNA, 21 bp, Homo sapiens
ggaacactagacaagccagaa

SEQ ID NO: 2953888 - DNA, 16 bp, Homo sapiens
ggaacactgccctcgc

SEQ ID NO: 2953889 - DNA, 14 bp, Homo sapiens
ggaacactggcaga

SEQ ID NO: 2953890 - DNA, 13 bp, Homo sapiens
ggaacagaaattg

SEQ ID NO: 2953891 - DNA, 17 bp, Homo sapiens
ggaacagtggccttgct

SEQ ID NO: 2953892 - DNA, 23 bp, Homo sapiens
ggaaccaggagaagggctggggc

SEQ ID NO: 2953893 - DNA, 11 bp, Homo sapiens
ggaacccagac

SEQ ID NO: 2953894 - DNA, 14 bp, Homo sapiens
ggaacccagactca

SEQ ID NO: 2953895 - DNA, 20 bp, Homo sapiens
ggaaccgaggcagggaagga

SEQ ID NO: 2953896 - DNA, 15 bp, Homo sapiens
ggaaccgcaggaagc

SEQ ID NO: 2953897 - DNA, 16 bp, Homo sapiens
ggaaccgcaggaagct

SEQ ID NO: 2953898 - DNA, 18 bp, Homo sapiens
ggaaccgttgccaaccga

SEQ ID NO: 2953899 - DNA, 15 bp, Homo sapiens
ggaacctcagcctgg

SEQ ID NO: 2953900 - DNA, 22 bp, Homo sapiens
ggaacctcagcctggccagaca

SEQ ID NO: 2953901 - DNA, 21 bp, Homo sapiens
ggaacctcagggtattgcttg

SEQ ID NO: 2953902 - DNA, 17 bp, Homo sapiens
ggaacctcgagtactgt

SEQ ID NO: 2953903 - DNA, 13 bp, Homo sapiens
ggaacgcagcctc

SEQ ID NO: 2953904 - DNA, 22 bp, Homo sapiens
ggaacggatgctccgaggactg

SEQ ID NO: 2953905 - DNA, 14 bp, Homo sapiens
ggaactcttaagca

SEQ ID NO: 2953906 - DNA, 18 bp, Homo sapiens
ggaactgaatcaggaaac

SEQ ID NO: 2953907 - DNA, 15 bp, Homo sapiens
ggaactggagggtga

SEQ ID NO: 2953908 - DNA, 16 bp, Homo sapiens
ggaacttgaactgatt

SEQ ID NO: 2953909 - DNA, 22 bp, Homo sapiens
ggaacttggggagttaagacct

SEQ ID NO: 2953910 - DNA, 23 bp, Homo sapiens
ggaagacatatattatatataga

SEQ ID NO: 2953911 - DNA, 15 bp, Homo sapiens
ggaagacatttttcc

SEQ ID NO: 2953912 - DNA, 22 bp, Homo sapiens
ggaagagagagactgtggagct

SEQ ID NO: 2953913 - DNA, 13 bp, Homo sapiens
ggaagagcaggac

SEQ ID NO: 2953914 - DNA, 16 bp, Homo sapiens
ggaagagcaggactcc

SEQ ID NO: 2953915 - DNA, 18 bp, Homo sapiens
ggaagaggaaaaggctgg

SEQ ID NO: 2953916 - DNA, 16 bp, Homo sapiens
ggaagatcctgtgagg

SEQ ID NO: 2953917 - DNA, 24 bp, Homo sapiens
ggaagatctacctgcaacacaaca

SEQ ID NO: 2953918 - DNA, 19 bp, Homo sapiens
ggaagatctctgcagggcc

SEQ ID NO: 2953919 - DNA, 18 bp, Homo sapiens
ggaagatttctaaataaa

SEQ ID NO: 2953920 - DNA, 12 bp, Homo sapiens
ggaagcagagca

SEQ ID NO: 2953921 - DNA, 23 bp, Homo sapiens
ggaagcagagcaaaatgctcttg

SEQ ID NO: 2953922 - DNA, 13 bp, Homo sapiens
ggaagcagggaga

SEQ ID NO: 2953923 - DNA, 16 bp, Homo sapiens
ggaagcatcctcccca

SEQ ID NO: 2953924 - DNA, 17 bp, Homo sapiens
ggaagcatcctccccac

SEQ ID NO: 2953925 - DNA, 20 bp, Homo sapiens
ggaagcatgtaggagaatcc

SEQ ID NO: 2953926 - DNA, 14 bp, Homo sapiens
ggaagccaaagagt

SEQ ID NO: 2953927 - DNA, 16 bp, Homo sapiens
ggaagcccactgcctc

SEQ ID NO: 2953928 - DNA, 21 bp, Homo sapiens
ggaagcccccaccgtgggcag

SEQ ID NO: 2953929 - DNA, 11 bp, Homo sapiens
ggaagccctcc

SEQ ID NO: 2953930 - DNA, 15 bp, Homo sapiens
ggaagccctccttcc

SEQ ID NO: 2953931 - DNA, 16 bp, Homo sapiens
ggaagccctccttcca

SEQ ID NO: 2953932 - DNA, 17 bp, Homo sapiens
ggaagccctccttccac

SEQ ID NO: 2953933 - DNA, 11 bp, Homo sapiens
ggaagccctgg

SEQ ID NO: 2953934 - DNA, 15 bp, Homo sapiens
ggaagccctggattt

SEQ ID NO: 2953935 - DNA, 17 bp, Homo sapiens
ctttgtgtttgcttggt

SEQ ID NO: 2953936 - DNA, 18 bp, Homo sapiens
ctttgttacaataaaact

SEQ ID NO: 2953937 - DNA, 15 bp, Homo sapiens
ctttgttcctgcttt

SEQ ID NO: 2953938 - DNA, 18 bp, Homo sapiens
ctttgttcttcctgtctc

SEQ ID NO: 2953939 - DNA, 15 bp, Homo sapiens
ctttgttcttgtcat

SEQ ID NO: 2953940 - DNA, 19 bp, Homo sapiens
ctttgttgttctgcctgtc

SEQ ID NO: 2953941 - DNA, 12 bp, Homo sapiens
ctttgtttattt

SEQ ID NO: 2953942 - DNA, 21 bp, Homo sapiens
ctttgtttctgcatcagttca

SEQ ID NO: 2953943 - DNA, 23 bp, Homo sapiens
ctttgtttttccatgtgttttgc

SEQ ID NO: 2953944 - DNA, 19 bp, Homo sapiens
cttttaaaaatacaattat

SEQ ID NO: 2953945 - DNA, 21 bp, Homo sapiens
cttttaaaataaattctctcc

SEQ ID NO: 2953946 - DNA, 13 bp, Homo sapiens
cttttaaaatgca

SEQ ID NO: 2953947 - DNA, 17 bp, Homo sapiens
cttttaaaatttgtaga

SEQ ID NO: 2953948 - DNA, 22 bp, Homo sapiens
cttttaaaatttgtagaattga

SEQ ID NO: 2953949 - DNA, 12 bp, Homo sapiens
cttttaaacaaa

SEQ ID NO: 2953950 - DNA, 15 bp, Homo sapiens
cttttaaacaaaagt

SEQ ID NO: 2953951 - DNA, 12 bp, Homo sapiens
cttttaaacaca

SEQ ID NO: 2953952 - DNA, 22 bp, Homo sapiens
cttttaaactactatttttctt

SEQ ID NO: 2953953 - DNA, 19 bp, Homo sapiens
cttttaaagactacctggg

SEQ ID NO: 2953954 - DNA, 19 bp, Homo sapiens
cttttaacacctgatgtgt

SEQ ID NO: 2953955 - DNA, 20 bp, Homo sapiens
cttttaacatttatctaaaa

SEQ ID NO: 2953956 - DNA, 21 bp, Homo sapiens
cttttaacctctttaagtatt

SEQ ID NO: 2953957 - DNA, 20 bp, Homo sapiens
cttttaacgtatgtatttca

SEQ ID NO: 2953958 - DNA, 15 bp, Homo sapiens
cttttaactgtgcaa

SEQ ID NO: 2953959 - DNA, 18 bp, Homo sapiens
cttttaatcatgagcctg

SEQ ID NO: 2953960 - DNA, 19 bp, Homo sapiens
cttttaatcatgagcctgt

SEQ ID NO: 2953961 - DNA, 22 bp, Homo sapiens
cttttaatcatgagcctgttta

SEQ ID NO: 2953962 - DNA, 15 bp, Homo sapiens
cttttaatgaacaaa

SEQ ID NO: 2953963 - DNA, 18 bp, Homo sapiens
cttttaattgacagtcac

SEQ ID NO: 2953964 - DNA, 17 bp, Homo sapiens
cttttacatactgctgt

SEQ ID NO: 2953965 - DNA, 18 bp, Homo sapiens
cttttacattaaagaaat

SEQ ID NO: 2953966 - DNA, 17 bp, Homo sapiens
cttttacattctgtgtg

SEQ ID NO: 2953967 - DNA, 20 bp, Homo sapiens
cttttacccctgcacagttt

SEQ ID NO: 2953968 - DNA, 13 bp, Homo sapiens
cttttacttgttc

SEQ ID NO: 2953969 - DNA, 16 bp, Homo sapiens
cttttaggccaaaaaa

SEQ ID NO: 2953970 - DNA, 18 bp, Homo sapiens
cttttaggccaaaaaaat

SEQ ID NO: 2953971 - DNA, 17 bp, Homo sapiens
cttttagtaaaaacatt

SEQ ID NO: 2953972 - DNA, 22 bp, Homo sapiens
cttttataactagtcctttact

SEQ ID NO: 2953973 - DNA, 21 bp, Homo sapiens
cttttatagttgtattttgta

SEQ ID NO: 2953974 - DNA, 14 bp, Homo sapiens
cttttatatctgta

SEQ ID NO: 2953975 - DNA, 21 bp, Homo sapiens
cttttatatttgaaaaaatta

SEQ ID NO: 2953976 - DNA, 13 bp, Homo sapiens
cttttatatttgt

SEQ ID NO: 2953977 - DNA, 18 bp, Homo sapiens
cttttatgtagtaattga

SEQ ID NO: 2953978 - DNA, 16 bp, Homo sapiens
cttttatgtttgtaca

SEQ ID NO: 2953979 - DNA, 16 bp, Homo sapiens
cttttattaatgcact

SEQ ID NO: 2953980 - DNA, 14 bp, Homo sapiens
cttttatttcattc

SEQ ID NO: 2953981 - DNA, 15 bp, Homo sapiens
cttttattttttctt

SEQ ID NO: 2953982 - DNA, 18 bp, Homo sapiens
cttttcaagttaaataaa

SEQ ID NO: 2953983 - DNA, 17 bp, Homo sapiens
cttttcaattatattgt

SEQ ID NO: 2953984 - DNA, 13 bp, Homo sapiens
cttttcacattct

SEQ ID NO: 2953985 - DNA, 17 bp, Homo sapiens
cttttcacattcttata

SEQ ID NO: 2953986 - DNA, 20 bp, Homo sapiens
cttttcacattcttataaat

SEQ ID NO: 2953987 - DNA, 16 bp, Homo sapiens
cttttcacctccttca

SEQ ID NO: 2953988 - DNA, 18 bp, Homo sapiens
cttttcacctccttcaat

SEQ ID NO: 2953989 - DNA, 12 bp, Homo sapiens
cttttcaccttt

SEQ ID NO: 2953990 - DNA, 18 bp, Homo sapiens
cttttcatatctcttgcc

SEQ ID NO: 2953991 - DNA, 19 bp, Homo sapiens
cttttccactccattgtcg

SEQ ID NO: 2953992 - DNA, 16 bp, Homo sapiens
cttttccagaaagaaa

SEQ ID NO: 2953993 - DNA, 22 bp, Homo sapiens
cttttccagaaagaaaatgaat

SEQ ID NO: 2953994 - DNA, 23 bp, Homo sapiens
cttttcccaacccccagccccca

SEQ ID NO: 2953995 - DNA, 17 bp, Homo sapiens
cttttcccatttgtaat

SEQ ID NO: 2953996 - DNA, 22 bp, Homo sapiens
cttttcccctcattgcatttat

SEQ ID NO: 2953997 - DNA, 17 bp, Homo sapiens
cttttcctctctgtctg

SEQ ID NO: 2953998 - DNA, 19 bp, Homo sapiens
cttttcctgggccttctca

SEQ ID NO: 2953999 - DNA, 17 bp, Homo sapiens
cttttccttggggcagg

SEQ ID NO: 2954000 - DNA, 20 bp, Homo sapiens
cttttcgaactgtgctccca

SEQ ID NO: 2954001 - DNA, 18 bp, Homo sapiens
cttttctaaaagacttcc

SEQ ID NO: 2954002 - DNA, 15 bp, Homo sapiens
cttttctaaactgca

SEQ ID NO: 2954003 - DNA, 19 bp, Homo sapiens
cttttctaagtggcgtgtg

SEQ ID NO: 2954004 - DNA, 20 bp, Homo sapiens
cttttctaagtggcgtgtgc

SEQ ID NO: 2954005 - DNA, 17 bp, Homo sapiens
cttttctagttaacttt

SEQ ID NO: 2954006 - DNA, 18 bp, Homo sapiens
cttttctagttaactttt

SEQ ID NO: 2954007 - DNA, 12 bp, Homo sapiens
cttttctatgtt

SEQ ID NO: 2954008 - DNA, 13 bp, Homo sapiens
cttttctattaat

SEQ ID NO: 2954009 - DNA, 14 bp, Homo sapiens
cttttctcctcttt

SEQ ID NO: 2954010 - DNA, 18 bp, Homo sapiens
cttttctcctctttgaac

SEQ ID NO: 2954011 - DNA, 21 bp, Homo sapiens
cttttctcctgcatgtgtata

SEQ ID NO: 2954012 - DNA, 18 bp, Homo sapiens
cttttctgagttcttgaa

SEQ ID NO: 2954013 - DNA, 22 bp, Homo sapiens
cttttctgagttcttgaagcat

SEQ ID NO: 2954014 - DNA, 18 bp, Homo sapiens
cttttctgtctctctctt

SEQ ID NO: 2954015 - DNA, 20 bp, Homo sapiens
cttttctgtgaagccctttg

SEQ ID NO: 2954016 - DNA, 15 bp, Homo sapiens
cttttcttcctggct

SEQ ID NO: 2954017 - DNA, 21 bp, Homo sapiens
cttttcttggaactgtcccag

SEQ ID NO: 2954018 - DNA, 19 bp, Homo sapiens
cttttctttctttcattct

SEQ ID NO: 2954019 - DNA, 15 bp, Homo sapiens
cttttctttgttata

SEQ ID NO: 2954020 - DNA, 13 bp, Homo sapiens
cttttgaacccag

SEQ ID NO: 2954021 - DNA, 21 bp, Homo sapiens
cttttgaacgcccccccccac

SEQ ID NO: 2954022 - DNA, 18 bp, Homo sapiens
cttttgaacgtatgtgct

SEQ ID NO: 2954023 - DNA, 12 bp, Homo sapiens
cttttgaacttg

SEQ ID NO: 2954024 - DNA, 15 bp, Homo sapiens
cttttgaacttgtca

SEQ ID NO: 2954025 - DNA, 15 bp, Homo sapiens
cttttgaagtgtttt

SEQ ID NO: 2954026 - DNA, 16 bp, Homo sapiens
cttttgaatgtccaaa

SEQ ID NO: 2954027 - DNA, 16 bp, Homo sapiens
cttttgaattgttaca

SEQ ID NO: 2954028 - DNA, 23 bp, Homo sapiens
cttttgacagctggtccctgcct

SEQ ID NO: 2954029 - DNA, 21 bp, Homo sapiens
cttttgataaaatgttccttt

SEQ ID NO: 2954030 - DNA, 23 bp, Homo sapiens
cttttgataaaatgttccttttg

SEQ ID NO: 2954031 - DNA, 18 bp, Homo sapiens
gcctgaaacccatttact

SEQ ID NO: 2954032 - DNA, 14 bp, Homo sapiens
gcctgaaaggagcc

SEQ ID NO: 2954033 - DNA, 17 bp, Homo sapiens
gcctgaaaggagccctt

SEQ ID NO: 2954034 - DNA, 23 bp, Homo sapiens
gcctgaaaggagcccttatctgt

SEQ ID NO: 2954035 - DNA, 18 bp, Homo sapiens
gcctgaacagatgtaaat

SEQ ID NO: 2954036 - DNA, 20 bp, Homo sapiens
gcctgaactgaggccttgtg

SEQ ID NO: 2954037 - DNA, 12 bp, Homo sapiens
gcctgaataaag

SEQ ID NO: 2954038 - DNA, 15 bp, Homo sapiens
gcctgaccaaacagc

SEQ ID NO: 2954039 - DNA, 13 bp, Homo sapiens
gcctgacctccag

SEQ ID NO: 2954040 - DNA, 18 bp, Homo sapiens
gcctgacctccagtcctg

SEQ ID NO: 2954041 - DNA, 19 bp, Homo sapiens
gcctgacctccagtcctgc

SEQ ID NO: 2954042 - DNA, 20 bp, Homo sapiens
gcctgacctccagtcctgct

SEQ ID NO: 2954043 - DNA, 23 bp, Homo sapiens
gcctgacctccagtcctgctggc

SEQ ID NO: 2954044 - DNA, 12 bp, Homo sapiens
gcctgagaccca

SEQ ID NO: 2954045 - DNA, 13 bp, Homo sapiens
gcctgagacccag

SEQ ID NO: 2954046 - DNA, 14 bp, Homo sapiens
gcctgagacccagg

SEQ ID NO: 2954047 - DNA, 15 bp, Homo sapiens
gcctgagacccagga

SEQ ID NO: 2954048 - DNA, 13 bp, Homo sapiens
gcctgagcccctc

SEQ ID NO: 2954049 - DNA, 16 bp, Homo sapiens
gcctgagcccctcaga

SEQ ID NO: 2954050 - DNA, 22 bp, Homo sapiens
gcctgagcccctcagacagccc

SEQ ID NO: 2954051 - DNA, 16 bp, Homo sapiens
gcctgagcctggccag

SEQ ID NO: 2954052 - DNA, 14 bp, Homo sapiens
gcctgaggcaggag

SEQ ID NO: 2954053 - DNA, 16 bp, Homo sapiens
gcctgaggcaggagaa

SEQ ID NO: 2954054 - DNA, 20 bp, Homo sapiens
gcctgagtgacagagcgaga

SEQ ID NO: 2954055 - DNA, 18 bp, Homo sapiens
gcctgatcaggcttcctg

SEQ ID NO: 2954056 - DNA, 20 bp, Homo sapiens
gcctgcaaacgctgcctgcc

SEQ ID NO: 2954057 - DNA, 23 bp, Homo sapiens
gcctgcaccgaccccgggccgga

SEQ ID NO: 2954058 - DNA, 22 bp, Homo sapiens
gcctgcaccgacccgaggccca

SEQ ID NO: 2954059 - DNA, 15 bp, Homo sapiens
gcctgcacctggtgg

SEQ ID NO: 2954060 - DNA, 15 bp, Homo sapiens
gcctgcactccctgg

SEQ ID NO: 2954061 - DNA, 17 bp, Homo sapiens
gcctgcactccctggcc

SEQ ID NO: 2954062 - DNA, 18 bp, Homo sapiens
gcctgcactccctggcct

SEQ ID NO: 2954063 - DNA, 17 bp, Homo sapiens
gcctgcactcctcaggg

SEQ ID NO: 2954064 - DNA, 12 bp, Homo sapiens
gcctgcagagct

SEQ ID NO: 2954065 - DNA, 14 bp, Homo sapiens
gcctgcagcacatg

SEQ ID NO: 2954066 - DNA, 14 bp, Homo sapiens
gcctgcaggacctg

SEQ ID NO: 2954067 - DNA, 19 bp, Homo sapiens
gcctgcaggacctgcctgt

SEQ ID NO: 2954068 - DNA, 16 bp, Homo sapiens
gcctgcagggccatgg

SEQ ID NO: 2954069 - DNA, 24 bp, Homo sapiens
gcctgcagttaattagcattctgg

SEQ ID NO: 2954070 - DNA, 11 bp, Homo sapiens
gcctgccagca

SEQ ID NO: 2954071 - DNA, 21 bp, Homo sapiens
gcctgccagcagttactgtga

SEQ ID NO: 2954072 - DNA, 18 bp, Homo sapiens
gcctgccagctgcactga

SEQ ID NO: 2954073 - DNA, 12 bp, Homo sapiens
gcctgccatctt

SEQ ID NO: 2954074 - DNA, 20 bp, Homo sapiens
gcctgccatcttctccccga

SEQ ID NO: 2954075 - DNA, 17 bp, Homo sapiens
gcctgcccacctgcctg

SEQ ID NO: 2954076 - DNA, 13 bp, Homo sapiens
gcctgcccagcct

SEQ ID NO: 2954077 - DNA, 16 bp, Homo sapiens
gcctgcccagcctcaa

SEQ ID NO: 2954078 - DNA, 20 bp, Homo sapiens
gcctgcccagcctcaatgtc

SEQ ID NO: 2954079 - DNA, 14 bp, Homo sapiens
gcctgcccctccca

SEQ ID NO: 2954080 - DNA, 15 bp, Homo sapiens
gcctgcccctcccag

SEQ ID NO: 2954081 - DNA, 20 bp, Homo sapiens
gcctgcccgcaccctggcct

SEQ ID NO: 2954082 - DNA, 16 bp, Homo sapiens
gcctgcccgtaaacac

SEQ ID NO: 2954083 - DNA, 21 bp, Homo sapiens
gcctgcccgtaaacacgcctg

SEQ ID NO: 2954084 - DNA, 17 bp, Homo sapiens
gcctgccctcccgcacc

SEQ ID NO: 2954085 - DNA, 17 bp, Homo sapiens
gcctgccctcctctccc

SEQ ID NO: 2954086 - DNA, 13 bp, Homo sapiens
gcctgccctgcta

SEQ ID NO: 2954087 - DNA, 14 bp, Homo sapiens
gcctgccctgctat

SEQ ID NO: 2954088 - DNA, 17 bp, Homo sapiens
gcctgccctgctatttc

SEQ ID NO: 2954089 - DNA, 19 bp, Homo sapiens
gcctgccggacacagcacc

SEQ ID NO: 2954090 - DNA, 10 bp, Homo sapiens
gcctgcctcc

SEQ ID NO: 2954091 - DNA, 16 bp, Homo sapiens
gcctgcctcctggctc

SEQ ID NO: 2954092 - DNA, 18 bp, Homo sapiens
gcctgcctcctggctcag

SEQ ID NO: 2954093 - DNA, 13 bp, Homo sapiens
gcctgcctcgcct

SEQ ID NO: 2954094 - DNA, 17 bp, Homo sapiens
gcctgcctcgccttgtg

SEQ ID NO: 2954095 - DNA, 13 bp, Homo sapiens
gcctgcctggcag

SEQ ID NO: 2954096 - DNA, 18 bp, Homo sapiens
gcctgccttttctagttt

SEQ ID NO: 2954097 - DNA, 21 bp, Homo sapiens
gcctgcgccaccgcccagaga

SEQ ID NO: 2954098 - DNA, 16 bp, Homo sapiens
gcctgcgcctccatcc

SEQ ID NO: 2954099 - DNA, 15 bp, Homo sapiens
gcctgcgctcggcag

SEQ ID NO: 2954100 - DNA, 17 bp, Homo sapiens
gcctgcgctcggcagga

SEQ ID NO: 2954101 - DNA, 19 bp, Homo sapiens
gcctgcgctcggcaggaag

SEQ ID NO: 2954102 - DNA, 23 bp, Homo sapiens
gcctgcgctcggcaggaaggagc

SEQ ID NO: 2954103 - DNA, 20 bp, Homo sapiens
gcctgctatttgaagtgtaa

SEQ ID NO: 2954104 - DNA, 15 bp, Homo sapiens
gcctgctccagacct

SEQ ID NO: 2954105 - DNA, 13 bp, Homo sapiens
gcctgctccccca

SEQ ID NO: 2954106 - DNA, 19 bp, Homo sapiens
gcctgctcccccaccccct

SEQ ID NO: 2954107 - DNA, 23 bp, Homo sapiens
gcctgctcttacttcccccaccc

SEQ ID NO: 2954108 - DNA, 18 bp, Homo sapiens
gcctgctgggctctccac

SEQ ID NO: 2954109 - DNA, 22 bp, Homo sapiens
gcctgctgggctctccacctca

SEQ ID NO: 2954110 - DNA, 24 bp, Homo sapiens
gcctgctgggctctccacctcagc

SEQ ID NO: 2954111 - DNA, 16 bp, Homo sapiens
gcctgctgtgctggga

SEQ ID NO: 2954112 - DNA, 22 bp, Homo sapiens
gcctgctgttggtcctctctct

SEQ ID NO: 2954113 - DNA, 14 bp, Homo sapiens
gcctgctttctcca

SEQ ID NO: 2954114 - DNA, 22 bp, Homo sapiens
gcctgctttgacgggccaggcc

SEQ ID NO: 2954115 - DNA, 12 bp, Homo sapiens
gcctggaagcac

SEQ ID NO: 2954116 - DNA, 21 bp, Homo sapiens
gcctggaagcactacagagca

SEQ ID NO: 2954117 - DNA, 16 bp, Homo sapiens
gcctggaagctttgtc

SEQ ID NO: 2954118 - DNA, 16 bp, Homo sapiens
gcctggaccagcctct

SEQ ID NO: 2954119 - DNA, 17 bp, Homo sapiens
gcctggaccagcctctc

SEQ ID NO: 2954120 - DNA, 18 bp, Homo sapiens
gcctggagcatggacagt

SEQ ID NO: 2954121 - DNA, 13 bp, Homo sapiens
gcctggagccctc

SEQ ID NO: 2954122 - DNA, 19 bp, Homo sapiens
gcctggaggctcagcccac

SEQ ID NO: 2954123 - DNA, 14 bp, Homo sapiens
gcctggagggggag

SEQ ID NO: 2954124 - DNA, 21 bp, Homo sapiens
gcctggatattattcttgtag

SEQ ID NO: 2954125 - DNA, 20 bp, Homo sapiens
gcctggatgcggatggccgg

SEQ ID NO: 2954126 - DNA, 13 bp, Homo sapiens
gcctggcagctca

SEQ ID NO: 2954127 - DNA, 20 bp, Homo sapiens
gcctggcagctcagcttccc

SEQ ID NO: 2954128 - DNA, 14 bp, Homo sapiens
gcctggcaggctgt

SEQ ID NO: 2954129 - DNA, 16 bp, Homo sapiens
gcctggccagacacag

SEQ ID NO: 2954130 - DNA, 23 bp, Homo sapiens
gcctggccagcaggtccccagct

SEQ ID NO: 2954131 - DNA, 18 bp, Homo sapiens
gcctggccagtcctggtc

SEQ ID NO: 2954132 - DNA, 14 bp, Homo sapiens
gcctggccagtctt

SEQ ID NO: 2954133 - DNA, 17 bp, Homo sapiens
gcctggccagtcttcct

SEQ ID NO: 2954134 - DNA, 17 bp, Homo sapiens
gcctggccatgctgtcc

SEQ ID NO: 2954135 - DNA, 19 bp, Homo sapiens
gcctggccatgctgtccct

SEQ ID NO: 2954136 - DNA, 16 bp, Homo sapiens
gcctggccccatggtc

SEQ ID NO: 2954137 - DNA, 22 bp, Homo sapiens
gcctggccggccagccagccac

SEQ ID NO: 2954138 - DNA, 14 bp, Homo sapiens
gcctggcctagact

SEQ ID NO: 2954139 - DNA, 12 bp, Homo sapiens
gcctggcctcca

SEQ ID NO: 2954140 - DNA, 18 bp, Homo sapiens
gcctggcctccaggcccg

SEQ ID NO: 2954141 - DNA, 23 bp, Homo sapiens
gcctggctccaaaccctcgaggc

SEQ ID NO: 2954142 - DNA, 12 bp, Homo sapiens
gcctggctcccc

SEQ ID NO: 2954143 - DNA, 14 bp, Homo sapiens
gcctggctccccga

SEQ ID NO: 2954144 - DNA, 15 bp, Homo sapiens
gcctggctccccgag

SEQ ID NO: 2954145 - DNA, 22 bp, Homo sapiens
gcctggctccccgagggctcag

SEQ ID NO: 2954146 - DNA, 23 bp, Homo sapiens
gcctggctccccgagggctcaga

SEQ ID NO: 2954147 - DNA, 17 bp, Homo sapiens
gcctggctctgattctt

SEQ ID NO: 2954148 - DNA, 21 bp, Homo sapiens
gcctggctctgattcttcatt

SEQ ID NO: 2954149 - DNA, 13 bp, Homo sapiens
gcctgggcagtgc

SEQ ID NO: 2954150 - DNA, 23 bp, Homo sapiens
gcctgggcttggcccgcggcctg

SEQ ID NO: 2954151 - DNA, 21 bp, Homo sapiens
gcctggggcaaacctagccgg

SEQ ID NO: 2954152 - DNA, 17 bp, Homo sapiens
gcctggggctggcctcc

SEQ ID NO: 2954153 - DNA, 21 bp, Homo sapiens
gcctggggcttgaatttgcat

SEQ ID NO: 2954154 - DNA, 16 bp, Homo sapiens
gcctgggggtgccagg

SEQ ID NO: 2954155 - DNA, 21 bp, Homo sapiens
gcctgggtcacacacggaggc

SEQ ID NO: 2954156 - DNA, 18 bp, Homo sapiens
gcctgggtcacagagtga

SEQ ID NO: 2954157 - DNA, 16 bp, Homo sapiens
gcctgggtccagggga

SEQ ID NO: 2954158 - DNA, 20 bp, Homo sapiens
gcctgggtgacagagcgaga

SEQ ID NO: 2954159 - DNA, 20 bp, Homo sapiens
gcctgggtgacagagtgaga

SEQ ID NO: 2954160 - DNA, 22 bp, Homo sapiens
gcctgggtgacagagtgagacc

SEQ ID NO: 2954161 - DNA, 14 bp, Homo sapiens
gcctggtccctggg

SEQ ID NO: 2954162 - DNA, 15 bp, Homo sapiens
gcctggtccctggga

SEQ ID NO: 2954163 - DNA, 16 bp, Homo sapiens
gcctggtccctgggag

SEQ ID NO: 2954164 - DNA, 13 bp, Homo sapiens
gcctggtctggga

SEQ ID NO: 2954165 - DNA, 15 bp, Homo sapiens
gcctggtctgggagt

SEQ ID NO: 2954166 - DNA, 13 bp, Homo sapiens
gcctggttgaaga

SEQ ID NO: 2954167 - DNA, 22 bp, Homo sapiens
gcctggttttcgtcatcttccc

SEQ ID NO: 2954168 - DNA, 23 bp, Homo sapiens
gcctggttttcgtcatcttccct

SEQ ID NO: 2954169 - DNA, 19 bp, Homo sapiens
gcctgtaacaagccagatt

SEQ ID NO: 2954170 - DNA, 18 bp, Homo sapiens
gcctgtaatcccagctac

SEQ ID NO: 2954171 - DNA, 18 bp, Homo sapiens
gcctgtaatctttttctc

SEQ ID NO: 2954172 - DNA, 19 bp, Homo sapiens
gcctgtaatctttttctcc

SEQ ID NO: 2954173 - DNA, 23 bp, Homo sapiens
gcctgtaatctttttctccaccc

SEQ ID NO: 2954174 - DNA, 21 bp, Homo sapiens
gcctgtacagtctgtcttctg

SEQ ID NO: 2954175 - DNA, 22 bp, Homo sapiens
gcctgtacagtctgtcttctgt

SEQ ID NO: 2954176 - DNA, 20 bp, Homo sapiens
gcctgtagaatagcctgtgg

SEQ ID NO: 2954177 - DNA, 19 bp, Homo sapiens
gcctgtagagccagccttg

SEQ ID NO: 2954178 - DNA, 13 bp, Homo sapiens
gcctgtagcccac

SEQ ID NO: 2954179 - DNA, 20 bp, Homo sapiens
gcctgtagccccagtgacag

SEQ ID NO: 2954180 - DNA, 21 bp, Homo sapiens
gcctgtagccccagtgacagc

SEQ ID NO: 2954181 - DNA, 13 bp, Homo sapiens
gcctgtataagta

SEQ ID NO: 2954182 - DNA, 22 bp, Homo sapiens
gcctgtataagtagatctgctt

SEQ ID NO: 2954183 - DNA, 22 bp, Homo sapiens
gcctgtatcctccctggcagac

SEQ ID NO: 2954184 - DNA, 23 bp, Homo sapiens
gcctgtcccaggactcaccctcc

SEQ ID NO: 2954185 - DNA, 24 bp, Homo sapiens
gcctgtcccaggactcaccctcca

SEQ ID NO: 2954186 - DNA, 18 bp, Homo sapiens
gcctgtccccgccttccc

SEQ ID NO: 2954187 - DNA, 19 bp, Homo sapiens
gcctgtcccctcacagact

SEQ ID NO: 2954188 - DNA, 14 bp, Homo sapiens
gcctgtctaaagcc

SEQ ID NO: 2954189 - DNA, 12 bp, Homo sapiens
gcctgtctcagt

SEQ ID NO: 2954190 - DNA, 15 bp, Homo sapiens
gcctgtctcagtgat

SEQ ID NO: 2954191 - DNA, 15 bp, Homo sapiens
gcctgtctgtgacct

SEQ ID NO: 2954192 - DNA, 24 bp, Homo sapiens
gcctgtcttgtcaggtggaccctg

SEQ ID NO: 2954193 - DNA, 16 bp, Homo sapiens
gcctgtgaccttggga

SEQ ID NO: 2954194 - DNA, 14 bp, Homo sapiens
gcctgtgaggcagg

SEQ ID NO: 2954195 - DNA, 16 bp, Homo sapiens
gcctgtgaggggcccc

SEQ ID NO: 2954196 - DNA, 19 bp, Homo sapiens
gcctgtgcgttcccttcag

SEQ ID NO: 2954197 - DNA, 18 bp, Homo sapiens
gcctgtggcggtgcctgg

SEQ ID NO: 2954198 - DNA, 13 bp, Homo sapiens
gcctgtggctgcg

SEQ ID NO: 2954199 - DNA, 12 bp, Homo sapiens
gcctgtggctgt

SEQ ID NO: 2954200 - DNA, 15 bp, Homo sapiens
gcctgtgtgactcca

SEQ ID NO: 2954201 - DNA, 23 bp, Homo sapiens
gcctgtgtggccacttctgtcca

SEQ ID NO: 2954202 - DNA, 20 bp, Homo sapiens
gcctgttaggagaagctgca

SEQ ID NO: 2954203 - DNA, 12 bp, Homo sapiens
gcctgttcagtt

SEQ ID NO: 2954204 - DNA, 15 bp, Homo sapiens
gcctgttcagttaca

SEQ ID NO: 2954205 - DNA, 16 bp, Homo sapiens
gcctgttcagttacag

SEQ ID NO: 2954206 - DNA, 21 bp, Homo sapiens
gcctgttcagttacagaaagt

SEQ ID NO: 2954207 - DNA, 24 bp, Homo sapiens
gcctgttcagttacagaaagtggt

SEQ ID NO: 2954208 - DNA, 20 bp, Homo sapiens
gcctgttcatacaagccaac

SEQ ID NO: 2954209 - DNA, 18 bp, Homo sapiens
gcgcccccctcccagagg

SEQ ID NO: 2954210 - DNA, 18 bp, Homo sapiens
gcgccctccctccgcctc

SEQ ID NO: 2954211 - DNA, 20 bp, Homo sapiens
gcgccctccgacctctctcg

SEQ ID NO: 2954212 - DNA, 18 bp, Homo sapiens
gcgccgcaaaccacactg

SEQ ID NO: 2954213 - DNA, 19 bp, Homo sapiens
gcgcctagagcgcggctgg

SEQ ID NO: 2954214 - DNA, 20 bp, Homo sapiens
gcgcctagtggggtctccct

SEQ ID NO: 2954215 - DNA, 17 bp, Homo sapiens
gcgcctataatcccagc

SEQ ID NO: 2954216 - DNA, 16 bp, Homo sapiens
gcgcctgcccctccca

SEQ ID NO: 2954217 - DNA, 17 bp, Homo sapiens
gcgcctgcccctcccag

SEQ ID NO: 2954218 - DNA, 13 bp, Homo sapiens
gcgcctggagagc

SEQ ID NO: 2954219 - DNA, 23 bp, Homo sapiens
gcgcctggagagcgaggaggcgc

SEQ ID NO: 2954220 - DNA, 21 bp, Homo sapiens
gcgcctgtataagtagatctg

SEQ ID NO: 2954221 - DNA, 18 bp, Homo sapiens
gcgccttctcggagctgg

SEQ ID NO: 2954222 - DNA, 23 bp, Homo sapiens
gcgccttctcggagctggcccag

SEQ ID NO: 2954223 - DNA, 18 bp, Homo sapiens
gcgcgcccttccttcccg

SEQ ID NO: 2954224 - DNA, 14 bp, Homo sapiens
gcgcgcctgccttt

SEQ ID NO: 2954225 - DNA, 15 bp, Homo sapiens
gcgcgcgctctctct

SEQ ID NO: 2954226 - DNA, 17 bp, Homo sapiens
gcgcggcctcccgagga

SEQ ID NO: 2954227 - DNA, 22 bp, Homo sapiens
gcgcggcctcccgaggaggggc

SEQ ID NO: 2954228 - DNA, 15 bp, Homo sapiens
gcgcggcggctctgc

SEQ ID NO: 2954229 - DNA, 19 bp, Homo sapiens
gcgcgggccccggcgcccc

SEQ ID NO: 2954230 - DNA, 19 bp, Homo sapiens
gcgcggtggctcacgcctg

SEQ ID NO: 2954231 - DNA, 13 bp, Homo sapiens
gcgctagtgcctt

SEQ ID NO: 2954232 - DNA, 22 bp, Homo sapiens
gcgctagtgccttgcccacagg

SEQ ID NO: 2954233 - DNA, 16 bp, Homo sapiens
gcgctcgttccggtcc

SEQ ID NO: 2954234 - DNA, 12 bp, Homo sapiens
gcgctctctctc

SEQ ID NO: 2954235 - DNA, 14 bp, Homo sapiens
gcgctctggacaga

SEQ ID NO: 2954236 - DNA, 23 bp, Homo sapiens
gcgctctgtggatgccagggccg

SEQ ID NO: 2954237 - DNA, 16 bp, Homo sapiens
gcgctgccgcacccca

SEQ ID NO: 2954238 - DNA, 12 bp, Homo sapiens
gcgctgcctggc

SEQ ID NO: 2954239 - DNA, 21 bp, Homo sapiens
gcgctgcctggccaggccctg

SEQ ID NO: 2954240 - DNA, 15 bp, Homo sapiens
gcgctgggcacttcc

SEQ ID NO: 2954241 - DNA, 19 bp, Homo sapiens
gcgctgtatttacagacac

SEQ ID NO: 2954242 - DNA, 21 bp, Homo sapiens
gcgctttgaacgtgccagcag

SEQ ID NO: 2954243 - DNA, 22 bp, Homo sapiens
gcgctttgaacgtgccagcagc

SEQ ID NO: 2954244 - DNA, 20 bp, Homo sapiens
gcggaataaactagagaagg

SEQ ID NO: 2954245 - DNA, 16 bp, Homo sapiens
gcggacaaaagggcca

SEQ ID NO: 2954246 - DNA, 19 bp, Homo sapiens
gcggacaaaagggccaggt

SEQ ID NO: 2954247 - DNA, 17 bp, Homo sapiens
gcggacaccgtggcctg

SEQ ID NO: 2954248 - DNA, 19 bp, Homo sapiens
gcggacaccgtggcctggg

SEQ ID NO: 2954249 - DNA, 20 bp, Homo sapiens
gcggacaccgtggcctgggc

SEQ ID NO: 2954250 - DNA, 16 bp, Homo sapiens
gcggacatcagctggt

SEQ ID NO: 2954251 - DNA, 15 bp, Homo sapiens
gcggacgtgctggcc

SEQ ID NO: 2954252 - DNA, 21 bp, Homo sapiens
gcggactcacttgatgtttcc

SEQ ID NO: 2954253 - DNA, 15 bp, Homo sapiens
gcggagacctcctga

SEQ ID NO: 2954254 - DNA, 12 bp, Homo sapiens
gcggagccagca

SEQ ID NO: 2954255 - DNA, 12 bp, Homo sapiens
gcggagctggcc

SEQ ID NO: 2954256 - DNA, 19 bp, Homo sapiens
gcggcagctcttctgggca

SEQ ID NO: 2954257 - DNA, 21 bp, Homo sapiens
gcggcagctcttctgggcaga

SEQ ID NO: 2954258 - DNA, 15 bp, Homo sapiens
gcggcagggccaggc

SEQ ID NO: 2954259 - DNA, 13 bp, Homo sapiens
gcggccaccaccc

SEQ ID NO: 2954260 - DNA, 17 bp, Homo sapiens
gcggccagggcggccag

SEQ ID NO: 2954261 - DNA, 19 bp, Homo sapiens
gcggccagggcggccaggg

SEQ ID NO: 2954262 - DNA, 17 bp, Homo sapiens
gcggcccaagagcccgt

SEQ ID NO: 2954263 - DNA, 16 bp, Homo sapiens
gcggcccagacccagc

SEQ ID NO: 2954264 - DNA, 19 bp, Homo sapiens
gcggcccagacccagcccg

SEQ ID NO: 2954265 - DNA, 24 bp, Homo sapiens
gcggccctgctgaagctgctgcag

SEQ ID NO: 2954266 - DNA, 15 bp, Homo sapiens
gcggccgatgggagt

SEQ ID NO: 2954267 - DNA, 16 bp, Homo sapiens
gcggccgcagagactg

SEQ ID NO: 2954268 - DNA, 18 bp, Homo sapiens
gcggccgcattccctgag

SEQ ID NO: 2954269 - DNA, 21 bp, Homo sapiens
gcggcctcccgaggaggggcc

SEQ ID NO: 2954270 - DNA, 21 bp, Homo sapiens
gcggcctgcaccgaccccggg

SEQ ID NO: 2954271 - DNA, 10 bp, Homo sapiens
gcggcctgga

SEQ ID NO: 2954272 - DNA, 17 bp, Homo sapiens
gcggcctggacccctgg

SEQ ID NO: 2954273 - DNA, 20 bp, Homo sapiens
gcggccttgaagacagagca

SEQ ID NO: 2954274 - DNA, 20 bp, Homo sapiens
gcggcggagctggccccgcc

SEQ ID NO: 2954275 - DNA, 15 bp, Homo sapiens
gcggcggctctgccc

SEQ ID NO: 2954276 - DNA, 19 bp, Homo sapiens
gcggcgtcagacttttctt

SEQ ID NO: 2954277 - DNA, 22 bp, Homo sapiens
gcggcgtggagactggcaggcg

SEQ ID NO: 2954278 - DNA, 14 bp, Homo sapiens
gcggctctgcccac

SEQ ID NO: 2954279 - DNA, 19 bp, Homo sapiens
gcggctctggtcctcggag

SEQ ID NO: 2954280 - DNA, 11 bp, Homo sapiens
gcggctgcctc

SEQ ID NO: 2954281 - DNA, 12 bp, Homo sapiens
gcggctgcctcc

SEQ ID NO: 2954282 - DNA, 18 bp, Homo sapiens
gcggctgctcgcccagga

SEQ ID NO: 2954283 - DNA, 16 bp, Homo sapiens
gcggctggacttggag

SEQ ID NO: 2954284 - DNA, 13 bp, Homo sapiens
gcggctggctctg

SEQ ID NO: 2954285 - DNA, 14 bp, Homo sapiens
gcggctggctctgt

SEQ ID NO: 2954286 - DNA, 22 bp, Homo sapiens
gcggctgggaggagggcaggca

SEQ ID NO: 2954287 - DNA, 19 bp, Homo sapiens
gcgggaatggcagctgcca

SEQ ID NO: 2954288 - DNA, 20 bp, Homo sapiens
gcgggaccggtacagaaagg

SEQ ID NO: 2954289 - DNA, 15 bp, Homo sapiens
gcgggcacagccagc

SEQ ID NO: 2954290 - DNA, 17 bp, Homo sapiens
gcgggcacctgtagtcc

SEQ ID NO: 2954291 - DNA, 14 bp, Homo sapiens
gcgggcagggccgc

SEQ ID NO: 2954292 - DNA, 22 bp, Homo sapiens
gcgggcagggccgctcgatgcc

SEQ ID NO: 2954293 - DNA, 13 bp, Homo sapiens
gcgggccacaggg

SEQ ID NO: 2954294 - DNA, 14 bp, Homo sapiens
gcgggccacagggc

SEQ ID NO: 2954295 - DNA, 14 bp, Homo sapiens
gcgggcccagcact

SEQ ID NO: 2954296 - DNA, 20 bp, Homo sapiens
gcgggccgtctcccttggcc

SEQ ID NO: 2954297 - DNA, 14 bp, Homo sapiens
gcggggaccttggt

SEQ ID NO: 2954298 - DNA, 16 bp, Homo sapiens
gcggggactgctggct

SEQ ID NO: 2954299 - DNA, 15 bp, Homo sapiens
gcggggcctgtctca

SEQ ID NO: 2954300 - DNA, 19 bp, Homo sapiens
gcggggggggcgcctggag

SEQ ID NO: 2954301 - DNA, 20 bp, Homo sapiens
gcggggggggcgcctggaga

SEQ ID NO: 2954302 - DNA, 18 bp, Homo sapiens
gcggggtggggtgggggt

SEQ ID NO: 2954303 - DNA, 15 bp, Homo sapiens
gcgggtcctcagctg

SEQ ID NO: 2954304 - DNA, 20 bp, Homo sapiens
gcgggtcctcagctgctccc

SEQ ID NO: 2954305 - DNA, 15 bp, Homo sapiens
gcgggtggctgcaag

SEQ ID NO: 2954306 - DNA, 21 bp, Homo sapiens
gcggtagccagcacacagggc

SEQ ID NO: 2954307 - DNA, 22 bp, Homo sapiens
gcggtagccagcacacagggca

SEQ ID NO: 2954308 - DNA, 15 bp, Homo sapiens
gcggtcctgcacaga

SEQ ID NO: 2954309 - DNA, 22 bp, Homo sapiens
gcgtgtgcatagcgtcctgccc

SEQ ID NO: 2954310 - DNA, 17 bp, Homo sapiens
gcgtgtgcctgtgtgcg

SEQ ID NO: 2954311 - DNA, 12 bp, Homo sapiens
gcgtgtggcagc

SEQ ID NO: 2954312 - DNA, 22 bp, Homo sapiens
gcgtgtggcagccacacgcagg

SEQ ID NO: 2954313 - DNA, 23 bp, Homo sapiens
gcgtgttcatatctactctttac

SEQ ID NO: 2954314 - DNA, 13 bp, Homo sapiens
gcgtgttcctttg

SEQ ID NO: 2954315 - DNA, 15 bp, Homo sapiens
gcgtgtttgcacgtt

SEQ ID NO: 2954316 - DNA, 16 bp, Homo sapiens
gcgttcgcctctggcc

SEQ ID NO: 2954317 - DNA, 23 bp, Homo sapiens
gcgttcttaggctgctgggatgg

SEQ ID NO: 2954318 - DNA, 14 bp, Homo sapiens
gcgttggtctctgc

SEQ ID NO: 2954319 - DNA, 14 bp, Homo sapiens
gcgttgtgggcagg

SEQ ID NO: 2954320 - DNA, 22 bp, Homo sapiens
gcgtttgaccttttatgtagta

SEQ ID NO: 2954321 - DNA, 14 bp, Homo sapiens
gcgtttttacagtt

SEQ ID NO: 2954322 - DNA, 11 bp, Homo sapiens
gctaaaaatgg

SEQ ID NO: 2954323 - DNA, 20 bp, Homo sapiens
gctaaaaatgggacttcttt

SEQ ID NO: 2954324 - DNA, 18 bp, Homo sapiens
gctaaaacaccttggctt

SEQ ID NO: 2954325 - DNA, 16 bp, Homo sapiens
gctaaaagaggcctgt

SEQ ID NO: 2954326 - DNA, 21 bp, Homo sapiens
gctaaaagcatggccctgctg

SEQ ID NO: 2954327 - DNA, 13 bp, Homo sapiens
gctaaaataaacc

SEQ ID NO: 2954328 - DNA, 14 bp, Homo sapiens
gctaaaattcagat

SEQ ID NO: 2954329 - DNA, 19 bp, Homo sapiens
gctaaagcaatatgcattt

SEQ ID NO: 2954330 - DNA, 18 bp, Homo sapiens
gctaaagccaaccagcct

SEQ ID NO: 2954331 - DNA, 16 bp, Homo sapiens
gctaaataactatata

SEQ ID NO: 2954332 - DNA, 17 bp, Homo sapiens
gctaaatgtaacagtct

SEQ ID NO: 2954333 - DNA, 14 bp, Homo sapiens
gctaacatgagtat

SEQ ID NO: 2954334 - DNA, 21 bp, Homo sapiens
gctaacccccagcccacagag

SEQ ID NO: 2954335 - DNA, 19 bp, Homo sapiens
gctaacgttttttcttctt

SEQ ID NO: 2954336 - DNA, 22 bp, Homo sapiens
gctaactccgagagcagtgggc

SEQ ID NO: 2954337 - DNA, 17 bp, Homo sapiens
gctaactgaactttgaa

SEQ ID NO: 2954338 - DNA, 18 bp, Homo sapiens
gctaactgaactttgaag

SEQ ID NO: 2954339 - DNA, 13 bp, Homo sapiens
gctaactgtaaat

SEQ ID NO: 2954340 - DNA, 16 bp, Homo sapiens
gctaagaacctggaac

SEQ ID NO: 2954341 - DNA, 17 bp, Homo sapiens
gctaagaatatttgaat

SEQ ID NO: 2954342 - DNA, 18 bp, Homo sapiens
gctaagagctagcgctgc

SEQ ID NO: 2954343 - DNA, 21 bp, Homo sapiens
gctaaggaagtatcagcacta

SEQ ID NO: 2954344 - DNA, 11 bp, Homo sapiens
gctaaggctct

SEQ ID NO: 2954345 - DNA, 15 bp, Homo sapiens
gctaaggttctaagg

SEQ ID NO: 2954346 - DNA, 17 bp, Homo sapiens
gctaaggttctaaggcc

SEQ ID NO: 2954347 - DNA, 11 bp, Homo sapiens
gctaataaatc

SEQ ID NO: 2954348 - DNA, 17 bp, Homo sapiens
gctaataaatctcttct

SEQ ID NO: 2954349 - DNA, 20 bp, Homo sapiens
gctaatatcaatagaaggat

SEQ ID NO: 2954350 - DNA, 13 bp, Homo sapiens
gctaatattttat

SEQ ID NO: 2954351 - DNA, 19 bp, Homo sapiens
gctaatattttatttgaaa

SEQ ID NO: 2954352 - DNA, 19 bp, Homo sapiens
gctaatgcctttcatcttg

SEQ ID NO: 2954353 - DNA, 18 bp, Homo sapiens
gctaattgctgttgaaag

SEQ ID NO: 2954354 - DNA, 23 bp, Homo sapiens
gctaattgctgttgaaagcaaaa

SEQ ID NO: 2954355 - DNA, 12 bp, Homo sapiens
gctaatttgcat

SEQ ID NO: 2954356 - DNA, 15 bp, Homo sapiens
gctaatttgcattaa

SEQ ID NO: 2954357 - DNA, 17 bp, Homo sapiens
gctaatttttacttttt

SEQ ID NO: 2954358 - DNA, 16 bp, Homo sapiens
gctaatttttgtaatt

SEQ ID NO: 2954359 - DNA, 16 bp, Homo sapiens
gctaatttttttgtat

SEQ ID NO: 2954360 - DNA, 22 bp, Homo sapiens
gctacaaaacgcgcagatgtgc

SEQ ID NO: 2954361 - DNA, 22 bp, Homo sapiens
gctacaaaataaagctgttctc

SEQ ID NO: 2954362 - DNA, 16 bp, Homo sapiens
gctacaaagaagacat

SEQ ID NO: 2954363 - DNA, 20 bp, Homo sapiens
gctacaaagaagacatgttt

SEQ ID NO: 2954364 - DNA, 12 bp, Homo sapiens
gctacaacagcc

SEQ ID NO: 2954365 - DNA, 14 bp, Homo sapiens
gctacaacagcctc

SEQ ID NO: 2954366 - DNA, 17 bp, Homo sapiens
gctacaacagcctcact

SEQ ID NO: 2954367 - DNA, 14 bp, Homo sapiens
gctacaagtaactc

SEQ ID NO: 2954368 - DNA, 17 bp, Homo sapiens
gctacacccttttccag

SEQ ID NO: 2954369 - DNA, 20 bp, Homo sapiens
gctacacctttctcctttgt

SEQ ID NO: 2954370 - DNA, 21 bp, Homo sapiens
gctacactcattgaaatgtaa

SEQ ID NO: 2954371 - DNA, 14 bp, Homo sapiens
gctacacttctgat

SEQ ID NO: 2954372 - DNA, 16 bp, Homo sapiens
gctacagaaagcacaa

SEQ ID NO: 2954373 - DNA, 23 bp, Homo sapiens
gctacagagaaaatcaaagcagt

SEQ ID NO: 2954374 - DNA, 12 bp, Homo sapiens
gctacaggttac

SEQ ID NO: 2954375 - DNA, 15 bp, Homo sapiens
gctacaggttacaac

SEQ ID NO: 2954376 - DNA, 22 bp, Homo sapiens
gctacccgcagagttctcagaa

SEQ ID NO: 2954377 - DNA, 12 bp, Homo sapiens
gctacctccctc

SEQ ID NO: 2954378 - DNA, 15 bp, Homo sapiens
gctacgtgtgaaatc

SEQ ID NO: 2954379 - DNA, 15 bp, Homo sapiens
gctacgtgtgatttt

SEQ ID NO: 2954380 - DNA, 16 bp, Homo sapiens
gctactcagcagccct

SEQ ID NO: 2954381 - DNA, 17 bp, Homo sapiens
gctactcagcagccctc

SEQ ID NO: 2954382 - DNA, 16 bp, Homo sapiens
gctactcaggaggctg

SEQ ID NO: 2954383 - DNA, 20 bp, Homo sapiens
gctactcaggaggctgagac

SEQ ID NO: 2954384 - DNA, 21 bp, Homo sapiens
gctactcaggaggctgagaca

SEQ ID NO: 2954385 - DNA, 21 bp, Homo sapiens
gctactcccctttcttccaaa

SEQ ID NO: 2954386 - DNA, 22 bp, Homo sapiens
gctactctccccacgagggctg

SEQ ID NO: 2954387 - DNA, 23 bp, Homo sapiens
gctactctccccacgagggctgg

SEQ ID NO: 2954388 - DNA, 13 bp, Homo sapiens
gctactgaaactt

SEQ ID NO: 2954389 - DNA, 17 bp, Homo sapiens
gctactgaaccagccac

SEQ ID NO: 2954390 - DNA, 18 bp, Homo sapiens
gctactgaaccagccacg

SEQ ID NO: 2954391 - DNA, 20 bp, Homo sapiens
gctactgactgtattttgtt

SEQ ID NO: 2954392 - DNA, 18 bp, Homo sapiens
gctactgccgtcagtgct

SEQ ID NO: 2954393 - DNA, 18 bp, Homo sapiens
gctactggcatagtttca

SEQ ID NO: 2954394 - DNA, 12 bp, Homo sapiens
gctactgtctca

SEQ ID NO: 2954395 - DNA, 21 bp, Homo sapiens
gctactgtctcactgaaacat

SEQ ID NO: 2954396 - DNA, 18 bp, Homo sapiens
gctactgtgtgtgtgaat

SEQ ID NO: 2954397 - DNA, 23 bp, Homo sapiens
gctacttcttattcacttttgta

SEQ ID NO: 2954398 - DNA, 17 bp, Homo sapiens
gctacttgctctgctct

SEQ ID NO: 2954399 - DNA, 17 bp, Homo sapiens
gctacttgggagcctga

SEQ ID NO: 2954400 - DNA, 23 bp, Homo sapiens
gctacttgggagcctgaggcagg

SEQ ID NO: 2954401 - DNA, 23 bp, Homo sapiens
gctacttttacttgttcatttct

SEQ ID NO: 2954402 - DNA, 14 bp, Homo sapiens
gctagagcagacag

SEQ ID NO: 2954403 - DNA, 20 bp, Homo sapiens
gctagagcatgctgcctgag

SEQ ID NO: 2954404 - DNA, 13 bp, Homo sapiens
gctagagggccca

SEQ ID NO: 2954405 - DNA, 19 bp, Homo sapiens
gctagatcatttgttctgg

SEQ ID NO: 2954406 - DNA, 16 bp, Homo sapiens
gctagcaaatagtaat

SEQ ID NO: 2954407 - DNA, 20 bp, Homo sapiens
gctagcaggccccctaggat

SEQ ID NO: 2954408 - DNA, 13 bp, Homo sapiens
gctagccagccaa

SEQ ID NO: 2954409 - DNA, 22 bp, Homo sapiens
gctagcgctgccgcaccccaga

SEQ ID NO: 2954410 - DNA, 17 bp, Homo sapiens
gctagctagccagccaa

SEQ ID NO: 2954411 - DNA, 15 bp, Homo sapiens
gctagctggagcctg

SEQ ID NO: 2954412 - DNA, 20 bp, Homo sapiens
gctaggaagagcaggactcc

SEQ ID NO: 2954413 - DNA, 15 bp, Homo sapiens
gctaggcccctgtgt

SEQ ID NO: 2954414 - DNA, 14 bp, Homo sapiens
gctgctccatgttt

SEQ ID NO: 2954415 - DNA, 21 bp, Homo sapiens
gctgctcccacacttgtgcca

SEQ ID NO: 2954416 - DNA, 24 bp, Homo sapiens
gctgctcccacacttgtgccagcc

SEQ ID NO: 2954417 - DNA, 21 bp, Homo sapiens
gctgctccccacccctaccga

SEQ ID NO: 2954418 - DNA, 16 bp, Homo sapiens
gctgctccccagcagc

SEQ ID NO: 2954419 - DNA, 19 bp, Homo sapiens
gctgctccccagcagcgga

SEQ ID NO: 2954420 - DNA, 16 bp, Homo sapiens
gctgctcctagaggga

SEQ ID NO: 2954421 - DNA, 18 bp, Homo sapiens
gctgctcctagagggagg

SEQ ID NO: 2954422 - DNA, 23 bp, Homo sapiens
gctgctcctccagggccacgtgc

SEQ ID NO: 2954423 - DNA, 18 bp, Homo sapiens
gctgctcctctttcccct

SEQ ID NO: 2954424 - DNA, 17 bp, Homo sapiens
gctgctccttagctgcc

SEQ ID NO: 2954425 - DNA, 18 bp, Homo sapiens
gctgctccttagctgcca

SEQ ID NO: 2954426 - DNA, 19 bp, Homo sapiens
gctgctccttagctgccaa

SEQ ID NO: 2954427 - DNA, 19 bp, Homo sapiens
gctgctgacctccacagct

SEQ ID NO: 2954428 - DNA, 20 bp, Homo sapiens
gctgctgatgcgctgggatc

SEQ ID NO: 2954429 - DNA, 13 bp, Homo sapiens
gctgctgcagccc

SEQ ID NO: 2954430 - DNA, 20 bp, Homo sapiens
gctgctgcagccctgccagt

SEQ ID NO: 2954431 - DNA, 22 bp, Homo sapiens
gctgctgccaccaaatctgtct

SEQ ID NO: 2954432 - DNA, 17 bp, Homo sapiens
gctgctgccactctgct

SEQ ID NO: 2954433 - DNA, 19 bp, Homo sapiens
gctgctgccactctgctgc

SEQ ID NO: 2954434 - DNA, 15 bp, Homo sapiens
gctgctgccagggct

SEQ ID NO: 2954435 - DNA, 16 bp, Homo sapiens
gctgctgccatccatg

SEQ ID NO: 2954436 - DNA, 12 bp, Homo sapiens
gctgctggcctc

SEQ ID NO: 2954437 - DNA, 20 bp, Homo sapiens
gctgctggcctccctccgtc

SEQ ID NO: 2954438 - DNA, 20 bp, Homo sapiens
gctgctgggatggtgggctt

SEQ ID NO: 2954439 - DNA, 18 bp, Homo sapiens
gctgctggggcctcagac

SEQ ID NO: 2954440 - DNA, 11 bp, Homo sapiens
gctgctggggg

SEQ ID NO: 2954441 - DNA, 12 bp, Homo sapiens
gctgctgggggc

SEQ ID NO: 2954442 - DNA, 17 bp, Homo sapiens
gctgctgggggctcccc

SEQ ID NO: 2954443 - DNA, 17 bp, Homo sapiens
gctgctgtcacctctcc

SEQ ID NO: 2954444 - DNA, 11 bp, Homo sapiens
gctgctgtgct

SEQ ID NO: 2954445 - DNA, 12 bp, Homo sapiens
gctgctgtgctt

SEQ ID NO: 2954446 - DNA, 16 bp, Homo sapiens
gctgctgttcaggagc

SEQ ID NO: 2954447 - DNA, 15 bp, Homo sapiens
gctgctgttgaactt

SEQ ID NO: 2954448 - DNA, 16 bp, Homo sapiens
gctgcttccaggctgg

SEQ ID NO: 2954449 - DNA, 17 bp, Homo sapiens
gctgcttccaggctggg

SEQ ID NO: 2954450 - DNA, 14 bp, Homo sapiens
gctgcttcctaact

SEQ ID NO: 2954451 - DNA, 16 bp, Homo sapiens
gctgcttcctaactta

SEQ ID NO: 2954452 - DNA, 13 bp, Homo sapiens
gctgcttctgtct

SEQ ID NO: 2954453 - DNA, 15 bp, Homo sapiens
gctgcttgcagccag

SEQ ID NO: 2954454 - DNA, 17 bp, Homo sapiens
gctgcttgtgcctccct

SEQ ID NO: 2954455 - DNA, 23 bp, Homo sapiens
gctgcttgtgcctcccttcccag

SEQ ID NO: 2954456 - DNA, 20 bp, Homo sapiens
gctgctttgttgttctgcct

SEQ ID NO: 2954457 - DNA, 21 bp, Homo sapiens
gctgctttgttgttctgcctg

SEQ ID NO: 2954458 - DNA, 19 bp, Homo sapiens
gctgcttttatatctgtat

SEQ ID NO: 2954459 - DNA, 22 bp, Homo sapiens
gctggaaaagggtcttgggaaa

SEQ ID NO: 2954460 - DNA, 20 bp, Homo sapiens
gctggaaaccaagtcaggcc

SEQ ID NO: 2954461 - DNA, 23 bp, Homo sapiens
gctggaaagcaaacaggaagatt

SEQ ID NO: 2954462 - DNA, 21 bp, Homo sapiens
gctggaacctgcaaaaaatac

SEQ ID NO: 2954463 - DNA, 15 bp, Homo sapiens
gctggaatgagggag

SEQ ID NO: 2954464 - DNA, 16 bp, Homo sapiens
gctggaatgagggagg

SEQ ID NO: 2954465 - DNA, 16 bp, Homo sapiens
gctggagcccagggag

SEQ ID NO: 2954466 - DNA, 14 bp, Homo sapiens
gctggaggcagggc

SEQ ID NO: 2954467 - DNA, 13 bp, Homo sapiens
gctggaggcccag

SEQ ID NO: 2954468 - DNA, 20 bp, Homo sapiens
gctggaggcccaggctggga

SEQ ID NO: 2954469 - DNA, 20 bp, Homo sapiens
gctggagtacagtggtgtga

SEQ ID NO: 2954470 - DNA, 20 bp, Homo sapiens
gctggagtgcaatggtgtga

SEQ ID NO: 2954471 - DNA, 15 bp, Homo sapiens
gctggagtgctgctt

SEQ ID NO: 2954472 - DNA, 17 bp, Homo sapiens
gctggagtgctgcttgt

SEQ ID NO: 2954473 - DNA, 15 bp, Homo sapiens
gctggagttgtcact

SEQ ID NO: 2954474 - DNA, 18 bp, Homo sapiens
gctggatgtctgccaatt

SEQ ID NO: 2954475 - DNA, 16 bp, Homo sapiens
gctggccaaagagcct

SEQ ID NO: 2954476 - DNA, 13 bp, Homo sapiens
gctggcccagggc

SEQ ID NO: 2954477 - DNA, 15 bp, Homo sapiens
gctggcccagggccc

SEQ ID NO: 2954478 - DNA, 21 bp, Homo sapiens
gctggcccagggcccagagcc

SEQ ID NO: 2954479 - DNA, 18 bp, Homo sapiens
gctggcccagggggcctg

SEQ ID NO: 2954480 - DNA, 13 bp, Homo sapiens
gctggccccgccg

SEQ ID NO: 2954481 - DNA, 22 bp, Homo sapiens
gctggccccgccgcctggtact

SEQ ID NO: 2954482 - DNA, 21 bp, Homo sapiens
gctggcccctttgggccctgc

SEQ ID NO: 2954483 - DNA, 23 bp, Homo sapiens
gctggcccctttgggccctgcat

SEQ ID NO: 2954484 - DNA, 17 bp, Homo sapiens
gctggcccgtgacagac

SEQ ID NO: 2954485 - DNA, 11 bp, Homo sapiens
gctggccctgt

SEQ ID NO: 2954486 - DNA, 16 bp, Homo sapiens
gctggccctgtgcaga

SEQ ID NO: 2954487 - DNA, 22 bp, Homo sapiens
gctggccctgtgcagaccttac

SEQ ID NO: 2954488 - DNA, 13 bp, Homo sapiens
gctggccgggacc

SEQ ID NO: 2954489 - DNA, 21 bp, Homo sapiens
gctggcctcccaaatgagcca

SEQ ID NO: 2954490 - DNA, 22 bp, Homo sapiens
gctggccttggtatgtgccagg

SEQ ID NO: 2954491 - DNA, 20 bp, Homo sapiens
gctggcgacactcagggcag

SEQ ID NO: 2954492 - DNA, 22 bp, Homo sapiens
gctggcgacactcagggcagct

SEQ ID NO: 2954493 - DNA, 18 bp, Homo sapiens
gctggctcgtaggcctgc

SEQ ID NO: 2954494 - DNA, 12 bp, Homo sapiens
gctggctgcttg

SEQ ID NO: 2954495 - DNA, 14 bp, Homo sapiens
gctggctggcctca

SEQ ID NO: 2954496 - DNA, 22 bp, Homo sapiens
gctggctggggtggcctgtgtg

SEQ ID NO: 2954497 - DNA, 20 bp, Homo sapiens
gctggctggtgcctgagccc

SEQ ID NO: 2954498 - DNA, 22 bp, Homo sapiens
gctggctggtgcctgagcccct

SEQ ID NO: 2954499 - DNA, 15 bp, Homo sapiens
gctggcttttctgtt

SEQ ID NO: 2954500 - DNA, 18 bp, Homo sapiens
gctggcttttctgtttcc

SEQ ID NO: 2954501 - DNA, 17 bp, Homo sapiens
gctgggacgtggctcag

SEQ ID NO: 2954502 - DNA, 19 bp, Homo sapiens
gctgggacgtggctcagcc

SEQ ID NO: 2954503 - DNA, 21 bp, Homo sapiens
gctgggacgtggctcagccag

SEQ ID NO: 2954504 - DNA, 19 bp, Homo sapiens
gctgggaggagggcaggca

SEQ ID NO: 2954505 - DNA, 21 bp, Homo sapiens
gctgggaggtctcgtcccagc

SEQ ID NO: 2954506 - DNA, 16 bp, Homo sapiens
gctgggatcccacagc

SEQ ID NO: 2954507 - DNA, 17 bp, Homo sapiens
gctgggatcccacagcc

SEQ ID NO: 2954508 - DNA, 18 bp, Homo sapiens
gctgggatcccacagccc

SEQ ID NO: 2954509 - DNA, 23 bp, Homo sapiens
gctgggatggtgggcttcagggc

SEQ ID NO: 2954510 - DNA, 14 bp, Homo sapiens
gctgggattttaaa

SEQ ID NO: 2954511 - DNA, 15 bp, Homo sapiens
gctgggattttaaac

SEQ ID NO: 2954512 - DNA, 22 bp, Homo sapiens
gctgggcacacgcctcccactg

SEQ ID NO: 2954513 - DNA, 14 bp, Homo sapiens
gctgggcacttccc

SEQ ID NO: 2954514 - DNA, 17 bp, Homo sapiens
gctgggcagtgccagcc

SEQ ID NO: 2954515 - DNA, 14 bp, Homo sapiens
gctgggcccacagc

SEQ ID NO: 2954516 - DNA, 20 bp, Homo sapiens
gctgggcccgacatggctcc

SEQ ID NO: 2954517 - DNA, 19 bp, Homo sapiens
gctgggccgcaagggcctg

SEQ ID NO: 2954518 - DNA, 20 bp, Homo sapiens
gctgggccgcaagggcctgg

SEQ ID NO: 2954519 - DNA, 21 bp, Homo sapiens
gctgggctcttaactgttgct

SEQ ID NO: 2954520 - DNA, 18 bp, Homo sapiens
gctgggctgagccaaagc

SEQ ID NO: 2954521 - DNA, 15 bp, Homo sapiens
gctgggcttacaggc

SEQ ID NO: 2954522 - DNA, 21 bp, Homo sapiens
gctggggaagtacgtcccagc

SEQ ID NO: 2954523 - DNA, 12 bp, Homo sapiens
gctggggagggg

SEQ ID NO: 2954524 - DNA, 15 bp, Homo sapiens
gctggggagggggta

SEQ ID NO: 2954525 - DNA, 22 bp, Homo sapiens
gctggggaggtgggaggccagg

SEQ ID NO: 2954526 - DNA, 14 bp, Homo sapiens
gctggggcctcaga

SEQ ID NO: 2954527 - DNA, 17 bp, Homo sapiens
gctggggcctcagacga

SEQ ID NO: 2954528 - DNA, 16 bp, Homo sapiens
gctggggctggtgagg

SEQ ID NO: 2954529 - DNA, 20 bp, Homo sapiens
gctgggggtggggaggggcc

SEQ ID NO: 2954530 - DNA, 14 bp, Homo sapiens
gctggggtggcctg

SEQ ID NO: 2954531 - DNA, 19 bp, Homo sapiens
gctggggtggcctgtgtgg

SEQ ID NO: 2954532 - DNA, 15 bp, Homo sapiens
gctgggtccttgggc

SEQ ID NO: 2954533 - DNA, 19 bp, Homo sapiens
gctgggtccttgggcctgg

SEQ ID NO: 2954534 - DNA, 22 bp, Homo sapiens
gctgggtccttgggcctggcca

SEQ ID NO: 2954535 - DNA, 23 bp, Homo sapiens
gctgggtccttgggcctggccag

SEQ ID NO: 2954536 - DNA, 17 bp, Homo sapiens
gctgggtggcccctgtc

SEQ ID NO: 2954537 - DNA, 13 bp, Homo sapiens
gctgggtgtttca

SEQ ID NO: 2954538 - DNA, 20 bp, Homo sapiens
gctggtattctctctatgca

SEQ ID NO: 2954539 - DNA, 22 bp, Homo sapiens
gctggtcaaacaaactctctga

SEQ ID NO: 2954540 - DNA, 16 bp, Homo sapiens
gctggtcactctgccc

SEQ ID NO: 2954541 - DNA, 17 bp, Homo sapiens
gctggtcactctgccct

SEQ ID NO: 2954542 - DNA, 21 bp, Homo sapiens
gctggtcactctgccctctgc

SEQ ID NO: 2954543 - DNA, 12 bp, Homo sapiens
gctatcttaatt

SEQ ID NO: 2954544 - DNA, 15 bp, Homo sapiens
gctatcttaattttg

SEQ ID NO: 2954545 - DNA, 14 bp, Homo sapiens
gctatgagggcctt

SEQ ID NO: 2954546 - DNA, 20 bp, Homo sapiens
gctatgataagattgaaatt

SEQ ID NO: 2954547 - DNA, 15 bp, Homo sapiens
gctatggtgagatgc

SEQ ID NO: 2954548 - DNA, 22 bp, Homo sapiens
gctatggtgagatgcagctgga

SEQ ID NO: 2954549 - DNA, 13 bp, Homo sapiens
gctatgtaagggt

SEQ ID NO: 2954550 - DNA, 16 bp, Homo sapiens
gctatgtgtttggttt

SEQ ID NO: 2954551 - DNA, 17 bp, Homo sapiens
gctattatactgttatc

SEQ ID NO: 2954552 - DNA, 18 bp, Homo sapiens
gctattgtaaggtctttg

SEQ ID NO: 2954553 - DNA, 19 bp, Homo sapiens
gctatttatgggcccctgg

SEQ ID NO: 2954554 - DNA, 15 bp, Homo sapiens
gctatttcaggccct

SEQ ID NO: 2954555 - DNA, 15 bp, Homo sapiens
gctcaaaaaatgagc

SEQ ID NO: 2954556 - DNA, 19 bp, Homo sapiens
gctcaaagagcctcacagt

SEQ ID NO: 2954557 - DNA, 12 bp, Homo sapiens
gctcaaaggcac

SEQ ID NO: 2954558 - DNA, 16 bp, Homo sapiens
gctcaaaggcacagtg

SEQ ID NO: 2954559 - DNA, 21 bp, Homo sapiens
gctcaagcaatcctctcacct

SEQ ID NO: 2954560 - DNA, 17 bp, Homo sapiens
gctcaagcattctgttt

SEQ ID NO: 2954561 - DNA, 20 bp, Homo sapiens
gctcaaggaaaggcctgaaa

SEQ ID NO: 2954562 - DNA, 17 bp, Homo sapiens
gctcaataaatatttgt

SEQ ID NO: 2954563 - DNA, 21 bp, Homo sapiens
gctcacaccctaccttcccca

SEQ ID NO: 2954564 - DNA, 16 bp, Homo sapiens
gctcacagttcctcgc

SEQ ID NO: 2954565 - DNA, 17 bp, Homo sapiens
gctcacagttcctcgcc

SEQ ID NO: 2954566 - DNA, 23 bp, Homo sapiens
gctcacagttcctcgccctgggt

SEQ ID NO: 2954567 - DNA, 21 bp, Homo sapiens
gctcacctgttgcttacaatt

SEQ ID NO: 2954568 - DNA, 22 bp, Homo sapiens
gctcacctgttgcttacaattt

SEQ ID NO: 2954569 - DNA, 17 bp, Homo sapiens
gctcacgccccgctgtg

SEQ ID NO: 2954570 - DNA, 20 bp, Homo sapiens
gctcacgccccgctgtgtcc

SEQ ID NO: 2954571 - DNA, 15 bp, Homo sapiens
gctcacgcctgtaat

SEQ ID NO: 2954572 - DNA, 22 bp, Homo sapiens
gctcacgtgagagtgtcttcac

SEQ ID NO: 2954573 - DNA, 22 bp, Homo sapiens
gctcactgaactccttccccac

SEQ ID NO: 2954574 - DNA, 13 bp, Homo sapiens
gctcagaagagca

SEQ ID NO: 2954575 - DNA, 17 bp, Homo sapiens
gctcagagaaggaaaag

SEQ ID NO: 2954576 - DNA, 13 bp, Homo sapiens
gctcagagccaag

SEQ ID NO: 2954577 - DNA, 18 bp, Homo sapiens
gctcagagccaagggggc

SEQ ID NO: 2954578 - DNA, 18 bp, Homo sapiens
gctcagagggtgtcctgc

SEQ ID NO: 2954579 - DNA, 14 bp, Homo sapiens
gctcagccagcact

SEQ ID NO: 2954580 - DNA, 17 bp, Homo sapiens
gctcagctcccacaaat

SEQ ID NO: 2954581 - DNA, 13 bp, Homo sapiens
gctcagcttctcc

SEQ ID NO: 2954582 - DNA, 16 bp, Homo sapiens
gctcagcttctcctgt

SEQ ID NO: 2954583 - DNA, 21 bp, Homo sapiens
gctcagctttttgtcttttct

SEQ ID NO: 2954584 - DNA, 21 bp, Homo sapiens
gctcaggaaccgaggcaggga

SEQ ID NO: 2954585 - DNA, 16 bp, Homo sapiens
gctcaggactcagaag

SEQ ID NO: 2954586 - DNA, 17 bp, Homo sapiens
gctcaggggacactggc

SEQ ID NO: 2954587 - DNA, 12 bp, Homo sapiens
gctcagggtggt

SEQ ID NO: 2954588 - DNA, 16 bp, Homo sapiens
gctcaggtacttgtaa

SEQ ID NO: 2954589 - DNA, 15 bp, Homo sapiens
gctcaggtccctggg

SEQ ID NO: 2954590 - DNA, 11 bp, Homo sapiens
gctcagtctgt

SEQ ID NO: 2954591 - DNA, 14 bp, Homo sapiens
gctcagtctgttca

SEQ ID NO: 2954592 - DNA, 15 bp, Homo sapiens
gctcagtctgttcac

SEQ ID NO: 2954593 - DNA, 18 bp, Homo sapiens
gctcagtctgttcactgc

SEQ ID NO: 2954594 - DNA, 19 bp, Homo sapiens
gctcagtgcaacctctgct

SEQ ID NO: 2954595 - DNA, 20 bp, Homo sapiens
gctcagtgcaacctctgctt

SEQ ID NO: 2954596 - DNA, 15 bp, Homo sapiens
gctcagttctgcctt

SEQ ID NO: 2954597 - DNA, 12 bp, Homo sapiens
gctcagttgtag

SEQ ID NO: 2954598 - DNA, 20 bp, Homo sapiens
gctcatagtgaacacagcag

SEQ ID NO: 2954599 - DNA, 14 bp, Homo sapiens
gctcatctgagcca

SEQ ID NO: 2954600 - DNA, 16 bp, Homo sapiens
gctcatgccccttggg

SEQ ID NO: 2954601 - DNA, 13 bp, Homo sapiens
gctcatgtgtgtg

SEQ ID NO: 2954602 - DNA, 15 bp, Homo sapiens
gctcatgtttggaaa

SEQ ID NO: 2954603 - DNA, 15 bp, Homo sapiens
gctcattcattttat

SEQ ID NO: 2954604 - DNA, 18 bp, Homo sapiens
gctcattcattttatatt

SEQ ID NO: 2954605 - DNA, 16 bp, Homo sapiens
gctccaaaccctcgag

SEQ ID NO: 2954606 - DNA, 18 bp, Homo sapiens
gctccaacctgcaaagat

SEQ ID NO: 2954607 - DNA, 21 bp, Homo sapiens
gctccaacctgcaaagatctg

SEQ ID NO: 2954608 - DNA, 23 bp, Homo sapiens
gctccaactcctttcagccacat

SEQ ID NO: 2954609 - DNA, 15 bp, Homo sapiens
gctccaagattctag

SEQ ID NO: 2954610 - DNA, 16 bp, Homo sapiens
gctccaagattctaga

SEQ ID NO: 2954611 - DNA, 16 bp, Homo sapiens
gctccaagctgttaaa

SEQ ID NO: 2954612 - DNA, 23 bp, Homo sapiens
gctccaaggggaatcagaactca

SEQ ID NO: 2954613 - DNA, 23 bp, Homo sapiens
gctccaccagcatcacctgcctg

SEQ ID NO: 2954614 - DNA, 16 bp, Homo sapiens
gctccaccctggccga

SEQ ID NO: 2954615 - DNA, 14 bp, Homo sapiens
gctccacctttcag

SEQ ID NO: 2954616 - DNA, 20 bp, Homo sapiens
gctccagaatgtgctgcctt

SEQ ID NO: 2954617 - DNA, 21 bp, Homo sapiens
gctccagacctgatcctggag

SEQ ID NO: 2954618 - DNA, 22 bp, Homo sapiens
gctccagacctgatcctggagg

SEQ ID NO: 2954619 - DNA, 12 bp, Homo sapiens
gctccagagggc

SEQ ID NO: 2954620 - DNA, 17 bp, Homo sapiens
gctccagatgcagggca

SEQ ID NO: 2954621 - DNA, 12 bp, Homo sapiens
gctccagctgcc

SEQ ID NO: 2954622 - DNA, 13 bp, Homo sapiens
gctccagctgccc

SEQ ID NO: 2954623 - DNA, 15 bp, Homo sapiens
gctccagttttcgta

SEQ ID NO: 2954624 - DNA, 15 bp, Homo sapiens
gctccatagagcagt

SEQ ID NO: 2954625 - DNA, 19 bp, Homo sapiens
gctccatagtttggcattt

SEQ ID NO: 2954626 - DNA, 20 bp, Homo sapiens
gctccatctccgcctccaca

SEQ ID NO: 2954627 - DNA, 20 bp, Homo sapiens
gctccatttttagtgaaata

SEQ ID NO: 2954628 - DNA, 21 bp, Homo sapiens
gctcccaactcccttctgctt

SEQ ID NO: 2954629 - DNA, 19 bp, Homo sapiens
gctcccaagagcttccaga

SEQ ID NO: 2954630 - DNA, 19 bp, Homo sapiens
gctcccacagaacacagca

SEQ ID NO: 2954631 - DNA, 21 bp, Homo sapiens
gctcccaccccacccccttca

SEQ ID NO: 2954632 - DNA, 15 bp, Homo sapiens
gctcccacctagtgc

SEQ ID NO: 2954633 - DNA, 12 bp, Homo sapiens
gctcccaggcca

SEQ ID NO: 2954634 - DNA, 13 bp, Homo sapiens
gctcccaggccaa

SEQ ID NO: 2954635 - DNA, 21 bp, Homo sapiens
gctccccaggaagcccactgc

SEQ ID NO: 2954636 - DNA, 17 bp, Homo sapiens
gctccccctctgcttct

SEQ ID NO: 2954637 - DNA, 23 bp, Homo sapiens
gctccccgagggctcagaagagc

SEQ ID NO: 2954638 - DNA, 11 bp, Homo sapiens
gctcccctcca

SEQ ID NO: 2954639 - DNA, 23 bp, Homo sapiens
gctcccctccatccccatcggcc

SEQ ID NO: 2954640 - DNA, 12 bp, Homo sapiens
gctcccctgagg

SEQ ID NO: 2954641 - DNA, 13 bp, Homo sapiens
gctcccctgagga

SEQ ID NO: 2954642 - DNA, 18 bp, Homo sapiens
gctcccctttcgcccaca

SEQ ID NO: 2954643 - DNA, 14 bp, Homo sapiens
gctcccgctgtggc

SEQ ID NO: 2954644 - DNA, 20 bp, Homo sapiens
gctcccgggactcactggca

SEQ ID NO: 2954645 - DNA, 20 bp, Homo sapiens
gctccctaccacctccccag

SEQ ID NO: 2954646 - DNA, 19 bp, Homo sapiens
gctccctcccaggactctg

SEQ ID NO: 2954647 - DNA, 21 bp, Homo sapiens
gctccctcccaggactctgac

SEQ ID NO: 2954648 - DNA, 13 bp, Homo sapiens
gctccctctcccc

SEQ ID NO: 2954649 - DNA, 14 bp, Homo sapiens
gctccctctctcct

SEQ ID NO: 2954650 - DNA, 17 bp, Homo sapiens
gctccctctctcctgga

SEQ ID NO: 2954651 - DNA, 18 bp, Homo sapiens
gctccctctctcctggac

SEQ ID NO: 2954652 - DNA, 16 bp, Homo sapiens
gctccctgactgggag

SEQ ID NO: 2954653 - DNA, 18 bp, Homo sapiens
gctccctgactgggagtt

SEQ ID NO: 2954654 - DNA, 19 bp, Homo sapiens
gctcccttcgctctgctgg

SEQ ID NO: 2954655 - DNA, 18 bp, Homo sapiens
gcttcagctccagcccct

SEQ ID NO: 2954656 - DNA, 13 bp, Homo sapiens
gcttcaggaacct

SEQ ID NO: 2954657 - DNA, 15 bp, Homo sapiens
gcttcaggtccaggc

SEQ ID NO: 2954658 - DNA, 15 bp, Homo sapiens
gcttcatatctctcc

SEQ ID NO: 2954659 - DNA, 16 bp, Homo sapiens
gcttcatatctctccc

SEQ ID NO: 2954660 - DNA, 17 bp, Homo sapiens
gcttcatcattccctct

SEQ ID NO: 2954661 - DNA, 15 bp, Homo sapiens
gcttccatgattcta

SEQ ID NO: 2954662 - DNA, 14 bp, Homo sapiens
gcttcccctctctc

SEQ ID NO: 2954663 - DNA, 20 bp, Homo sapiens
gcttccccttggcctctctg

SEQ ID NO: 2954664 - DNA, 18 bp, Homo sapiens
gcttccccttttgccaat

SEQ ID NO: 2954665 - DNA, 18 bp, Homo sapiens
gcttccctgactcattct

SEQ ID NO: 2954666 - DNA, 17 bp, Homo sapiens
gcttccctgacttgctt

SEQ ID NO: 2954667 - DNA, 15 bp, Homo sapiens
gcttccctgtcccag

SEQ ID NO: 2954668 - DNA, 16 bp, Homo sapiens
gcttcctaacttattg

SEQ ID NO: 2954669 - DNA, 23 bp, Homo sapiens
gcttcctatttctagggctggga

SEQ ID NO: 2954670 - DNA, 21 bp, Homo sapiens
gcttcctcttccgggcagaaa

SEQ ID NO: 2954671 - DNA, 16 bp, Homo sapiens
gcttcctggtgagaac

SEQ ID NO: 2954672 - DNA, 14 bp, Homo sapiens
gcttcctgtttgta

SEQ ID NO: 2954673 - DNA, 16 bp, Homo sapiens
gcttcctttcccaagc

SEQ ID NO: 2954674 - DNA, 21 bp, Homo sapiens
gcttcggagatggagtccctt

SEQ ID NO: 2954675 - DNA, 18 bp, Homo sapiens
gcttcgggcccttcccac

SEQ ID NO: 2954676 - DNA, 19 bp, Homo sapiens
gcttctaattttgtgctct

SEQ ID NO: 2954677 - DNA, 15 bp, Homo sapiens
gcttctacatgatgc

SEQ ID NO: 2954678 - DNA, 19 bp, Homo sapiens
gcttctaccatgaacagaa

SEQ ID NO: 2954679 - DNA, 17 bp, Homo sapiens
gcttctagttctgccag

SEQ ID NO: 2954680 - DNA, 18 bp, Homo sapiens
gcttctagtttgcaactt

SEQ ID NO: 2954681 - DNA, 15 bp, Homo sapiens
gcttctcctgtgtga

SEQ ID NO: 2954682 - DNA, 20 bp, Homo sapiens
gcttctcctttggcatgttt

SEQ ID NO: 2954683 - DNA, 19 bp, Homo sapiens
gcttctcggggtccagtgc

SEQ ID NO: 2954684 - DNA, 16 bp, Homo sapiens
gcttctctctgtggga

SEQ ID NO: 2954685 - DNA, 17 bp, Homo sapiens
gcttctctgtctctgtg

SEQ ID NO: 2954686 - DNA, 18 bp, Homo sapiens
gcttctctgtctctgtgg

SEQ ID NO: 2954687 - DNA, 17 bp, Homo sapiens
gcttctgcgtccaccag

SEQ ID NO: 2954688 - DNA, 21 bp, Homo sapiens
gcttctgcgtccaccaggcct

SEQ ID NO: 2954689 - DNA, 23 bp, Homo sapiens
gcttctgcgtccaccaggcctca

SEQ ID NO: 2954690 - DNA, 15 bp, Homo sapiens
gcttctggccaggaa

SEQ ID NO: 2954691 - DNA, 17 bp, Homo sapiens
gcttctggccaggaagc

SEQ ID NO: 2954692 - DNA, 18 bp, Homo sapiens
gcttctggggtccccagg

SEQ ID NO: 2954693 - DNA, 20 bp, Homo sapiens
gcttctgtatttcactcttt

SEQ ID NO: 2954694 - DNA, 18 bp, Homo sapiens
gcttcttactgataattt

SEQ ID NO: 2954695 - DNA, 22 bp, Homo sapiens
gcttcttagacggtcttcactg

SEQ ID NO: 2954696 - DNA, 16 bp, Homo sapiens
gcttcttcagatcagt

SEQ ID NO: 2954697 - DNA, 19 bp, Homo sapiens
gcttcttcagatcagtgct

SEQ ID NO: 2954698 - DNA, 14 bp, Homo sapiens
gcttcttgtgaagg

SEQ ID NO: 2954699 - DNA, 14 bp, Homo sapiens
gcttgaatttgcat

SEQ ID NO: 2954700 - DNA, 15 bp, Homo sapiens
gcttgaatttgcatg

SEQ ID NO: 2954701 - DNA, 20 bp, Homo sapiens
gcttgagaaatatggacact

SEQ ID NO: 2954702 - DNA, 21 bp, Homo sapiens
gcttgagacaaatcctttctg

SEQ ID NO: 2954703 - DNA, 13 bp, Homo sapiens
gcttgagctcagg

SEQ ID NO: 2954704 - DNA, 16 bp, Homo sapiens
gcttgagttctgcact

SEQ ID NO: 2954705 - DNA, 19 bp, Homo sapiens
gcttgatatttattatatt

SEQ ID NO: 2954706 - DNA, 14 bp, Homo sapiens
gcttgatattttct

SEQ ID NO: 2954707 - DNA, 20 bp, Homo sapiens
gcttgatgggattctggaca

SEQ ID NO: 2954708 - DNA, 14 bp, Homo sapiens
gcttgattctgcag

SEQ ID NO: 2954709 - DNA, 16 bp, Homo sapiens
gcttgcaatgtagtca

SEQ ID NO: 2954710 - DNA, 17 bp, Homo sapiens
gcttgccaaagcagatt

SEQ ID NO: 2954711 - DNA, 22 bp, Homo sapiens
gcttgccccactctgcctgcct

SEQ ID NO: 2954712 - DNA, 17 bp, Homo sapiens
gcttgcctgcagggcca

SEQ ID NO: 2954713 - DNA, 14 bp, Homo sapiens
gcttgcctgggctg

SEQ ID NO: 2954714 - DNA, 20 bp, Homo sapiens
gcttgcctgggctgggcagc

SEQ ID NO: 2954715 - DNA, 22 bp, Homo sapiens
gcttgcctgggctgggcagcct

SEQ ID NO: 2954716 - DNA, 20 bp, Homo sapiens
gcttgggaagtcgaggctgc

SEQ ID NO: 2954717 - DNA, 15 bp, Homo sapiens
gcttgggctggtcag

SEQ ID NO: 2954718 - DNA, 15 bp, Homo sapiens
gcttggggcaacatt

SEQ ID NO: 2954719 - DNA, 20 bp, Homo sapiens
gcttggtcctagggtgggaa

SEQ ID NO: 2954720 - DNA, 20 bp, Homo sapiens
gcttggtgctggtttatttg

SEQ ID NO: 2954721 - DNA, 13 bp, Homo sapiens
gcttgtaaatatg

SEQ ID NO: 2954722 - DNA, 18 bp, Homo sapiens
gcttgtaaatatggggat

SEQ ID NO: 2954723 - DNA, 15 bp, Homo sapiens
gcttgtaactccacc

SEQ ID NO: 2954724 - DNA, 16 bp, Homo sapiens
gcttgtactaagccag

SEQ ID NO: 2954725 - DNA, 20 bp, Homo sapiens
gcttgtactaagccaggagg

SEQ ID NO: 2954726 - DNA, 22 bp, Homo sapiens
gcttgtactaagccaggaggct

SEQ ID NO: 2954727 - DNA, 19 bp, Homo sapiens
gcttgtcccctcctcactc

SEQ ID NO: 2954728 - DNA, 14 bp, Homo sapiens
gcttgtgcacaatt

SEQ ID NO: 2954729 - DNA, 22 bp, Homo sapiens
gcttgtgcctcccttcccagtg

SEQ ID NO: 2954730 - DNA, 16 bp, Homo sapiens
gcttgtgctcatgtgt

SEQ ID NO: 2954731 - DNA, 18 bp, Homo sapiens
gcttgtggcaagtgaatt

SEQ ID NO: 2954732 - DNA, 16 bp, Homo sapiens
gcttgttgtgctttta

SEQ ID NO: 2954733 - DNA, 19 bp, Homo sapiens
gcttgtttgctcacctggg

SEQ ID NO: 2954734 - DNA, 21 bp, Homo sapiens
gcttgtttgctcacctggggt

SEQ ID NO: 2954735 - DNA, 13 bp, Homo sapiens
gctttaaaaagaa

SEQ ID NO: 2954736 - DNA, 15 bp, Homo sapiens
gctttaaaaagaaaa

SEQ ID NO: 2954737 - DNA, 15 bp, Homo sapiens
gctttaaaagaaaaa

SEQ ID NO: 2954738 - DNA, 14 bp, Homo sapiens
gctttaaattaaaa

SEQ ID NO: 2954739 - DNA, 16 bp, Homo sapiens
gctttaaattaaaatt

SEQ ID NO: 2954740 - DNA, 13 bp, Homo sapiens
gctttaataatgt

SEQ ID NO: 2954741 - DNA, 21 bp, Homo sapiens
gctttacaggatcatgtaaat

SEQ ID NO: 2954742 - DNA, 17 bp, Homo sapiens
gctttaccaaacagcaa

SEQ ID NO: 2954743 - DNA, 16 bp, Homo sapiens
gctttactgtttgtta

SEQ ID NO: 2954744 - DNA, 15 bp, Homo sapiens
gctttagtgaattaa

SEQ ID NO: 2954745 - DNA, 16 bp, Homo sapiens
gctttcaattccgtag

SEQ ID NO: 2954746 - DNA, 14 bp, Homo sapiens
gctttcagagtttg

SEQ ID NO: 2954747 - DNA, 13 bp, Homo sapiens
gctttcagggagg

SEQ ID NO: 2954748 - DNA, 17 bp, Homo sapiens
gctttcagggcagcccc

SEQ ID NO: 2954749 - DNA, 20 bp, Homo sapiens
gctttcagggcagcccctgc

SEQ ID NO: 2954750 - DNA, 16 bp, Homo sapiens
gctttcatcctgtgtc

SEQ ID NO: 2954751 - DNA, 17 bp, Homo sapiens
gctttcatcctgtgtcc

SEQ ID NO: 2954752 - DNA, 12 bp, Homo sapiens
gctttcatgatt

SEQ ID NO: 2954753 - DNA, 12 bp, Homo sapiens
gctttcatgtaa

SEQ ID NO: 2954754 - DNA, 20 bp, Homo sapiens
gctttcatgtaaactgtgca

SEQ ID NO: 2954755 - DNA, 23 bp, Homo sapiens
gctttcctcaaaaagcagaagga

SEQ ID NO: 2954756 - DNA, 24 bp, Homo sapiens
gctttcctcaaaaagcagaaggag

SEQ ID NO: 2954757 - DNA, 17 bp, Homo sapiens
gctttcctcttactttc

SEQ ID NO: 2954758 - DNA, 21 bp, Homo sapiens
gctttcgtccacagcttcctg

SEQ ID NO: 2954759 - DNA, 21 bp, Homo sapiens
gctttctccccaatgagactt

SEQ ID NO: 2954760 - DNA, 21 bp, Homo sapiens
gctttctgctcagcttctcct

SEQ ID NO: 2954761 - DNA, 15 bp, Homo sapiens
gctttcttctttcct

SEQ ID NO: 2954762 - DNA, 17 bp, Homo sapiens
gctttcttgtttcttat

SEQ ID NO: 2954763 - DNA, 21 bp, Homo sapiens
gctttctttggtaggtaaatc

SEQ ID NO: 2954764 - DNA, 23 bp, Homo sapiens
gctttctttggtaggtaaatcta

SEQ ID NO: 2954765 - DNA, 22 bp, Homo sapiens
gctttgaaaaaaagtttctatt

SEQ ID NO: 2954766 - DNA, 15 bp, Homo sapiens
gctttgaaacagaaa

SEQ ID NO: 2954767 - DNA, 17 bp, Homo sapiens
gctttgacgggccaggc

SEQ ID NO: 2954768 - DNA, 21 bp, Homo sapiens
gctttgacgggccaggccctg

SEQ ID NO: 2954769 - DNA, 15 bp, Homo sapiens
gctttgaggccgaag

SEQ ID NO: 2954770 - DNA, 23 bp, Homo sapiens
gctttgaggccgaagctgctgtg

SEQ ID NO: 2954771 - DNA, 14 bp, Homo sapiens
gctttgatccctga

SEQ ID NO: 2954772 - DNA, 15 bp, Homo sapiens
gctttgatggaggag

SEQ ID NO: 2954773 - DNA, 23 bp, Homo sapiens
gctttgcattttgatattgctgt

SEQ ID NO: 2954774 - DNA, 20 bp, Homo sapiens
gctttgcctcgaaagtgtca

SEQ ID NO: 2954775 - DNA, 19 bp, Homo sapiens
gctttgctttctgctcagc

SEQ ID NO: 2954776 - DNA, 11 bp, Homo sapiens
gctttgctttg

SEQ ID NO: 2954777 - DNA, 15 bp, Homo sapiens
gctttggaatagatg

SEQ ID NO: 2954778 - DNA, 20 bp, Homo sapiens
gggccgcaagggcctggacg

SEQ ID NO: 2954779 - DNA, 14 bp, Homo sapiens
gggccgccagggag

SEQ ID NO: 2954780 - DNA, 15 bp, Homo sapiens
gggccgctgccaccc

SEQ ID NO: 2954781 - DNA, 16 bp, Homo sapiens
gggccggacctgagcc

SEQ ID NO: 2954782 - DNA, 19 bp, Homo sapiens
gggccggccctgtgtgcag

SEQ ID NO: 2954783 - DNA, 20 bp, Homo sapiens
gggccggggagggggcacgg

SEQ ID NO: 2954784 - DNA, 20 bp, Homo sapiens
gggccgtggcttgggctggt

SEQ ID NO: 2954785 - DNA, 15 bp, Homo sapiens
gggcctccttcttcc

SEQ ID NO: 2954786 - DNA, 14 bp, Homo sapiens
gggcctgacctcca

SEQ ID NO: 2954787 - DNA, 21 bp, Homo sapiens
gggcctgacctccagtcctgc

SEQ ID NO: 2954788 - DNA, 18 bp, Homo sapiens
gggcctgcaggacctgcc

SEQ ID NO: 2954789 - DNA, 14 bp, Homo sapiens
gggcctgctccaga

SEQ ID NO: 2954790 - DNA, 12 bp, Homo sapiens
gggcctgggcag

SEQ ID NO: 2954791 - DNA, 13 bp, Homo sapiens
gggcctgggcagg

SEQ ID NO: 2954792 - DNA, 16 bp, Homo sapiens
gggcctgggcaggagg

SEQ ID NO: 2954793 - DNA, 17 bp, Homo sapiens
gggcctgggcaggaggg

SEQ ID NO: 2954794 - DNA, 15 bp, Homo sapiens
gggcctgtacagtct

SEQ ID NO: 2954795 - DNA, 14 bp, Homo sapiens
gggccttctcagct

SEQ ID NO: 2954796 - DNA, 16 bp, Homo sapiens
gggccttctcagctct

SEQ ID NO: 2954797 - DNA, 19 bp, Homo sapiens
gggccttctcagctctcca

SEQ ID NO: 2954798 - DNA, 14 bp, Homo sapiens
gggccttgcccaga

SEQ ID NO: 2954799 - DNA, 15 bp, Homo sapiens
gggcgaggtcggcaa

SEQ ID NO: 2954800 - DNA, 15 bp, Homo sapiens
gggcgcccagcagcc

SEQ ID NO: 2954801 - DNA, 18 bp, Homo sapiens
gggcgcccagcagcctgc

SEQ ID NO: 2954802 - DNA, 19 bp, Homo sapiens
gggcgcccagcagcctgcc

SEQ ID NO: 2954803 - DNA, 13 bp, Homo sapiens
gggcgcctggaga

SEQ ID NO: 2954804 - DNA, 23 bp, Homo sapiens
gggcggacaaaagggccaggtgc

SEQ ID NO: 2954805 - DNA, 16 bp, Homo sapiens
gggcggagaggctgca

SEQ ID NO: 2954806 - DNA, 12 bp, Homo sapiens
gggcggcagggc

SEQ ID NO: 2954807 - DNA, 15 bp, Homo sapiens
gggcggctctgaagc

SEQ ID NO: 2954808 - DNA, 14 bp, Homo sapiens
gggcgggcagccag

SEQ ID NO: 2954809 - DNA, 23 bp, Homo sapiens
gggcgggcagtcgctgcagggag

SEQ ID NO: 2954810 - DNA, 13 bp, Homo sapiens
gggcggggactgc

SEQ ID NO: 2954811 - DNA, 15 bp, Homo sapiens
gggcggtgtcaggtc

SEQ ID NO: 2954812 - DNA, 15 bp, Homo sapiens
gggcgtcaggggtgc

SEQ ID NO: 2954813 - DNA, 14 bp, Homo sapiens
gggcgtctgactcc

SEQ ID NO: 2954814 - DNA, 17 bp, Homo sapiens
gggcgtctgactccctc

SEQ ID NO: 2954815 - DNA, 18 bp, Homo sapiens
gggcgtctgactccctcc

SEQ ID NO: 2954816 - DNA, 17 bp, Homo sapiens
gggcgtctgttccccct

SEQ ID NO: 2954817 - DNA, 20 bp, Homo sapiens
gggctacaaaggaggacaag

SEQ ID NO: 2954818 - DNA, 13 bp, Homo sapiens
gggctaccctgag

SEQ ID NO: 2954819 - DNA, 19 bp, Homo sapiens
gggctaccctgagctgagg

SEQ ID NO: 2954820 - DNA, 20 bp, Homo sapiens
gggctaccctgagctgaggc

SEQ ID NO: 2954821 - DNA, 16 bp, Homo sapiens
gggctagggaggacca

SEQ ID NO: 2954822 - DNA, 16 bp, Homo sapiens
gggctatattcctgac

SEQ ID NO: 2954823 - DNA, 21 bp, Homo sapiens
gggctcagagagtacactgtg

SEQ ID NO: 2954824 - DNA, 18 bp, Homo sapiens
gggctccccttgcccttc

SEQ ID NO: 2954825 - DNA, 20 bp, Homo sapiens
gggctcccctttcgcccaca

SEQ ID NO: 2954826 - DNA, 22 bp, Homo sapiens
gggctccgaaattccaaggccc

SEQ ID NO: 2954827 - DNA, 19 bp, Homo sapiens
gggctcctgtggcagctgc

SEQ ID NO: 2954828 - DNA, 17 bp, Homo sapiens
gggctctccacctcagc

SEQ ID NO: 2954829 - DNA, 17 bp, Homo sapiens
gggctctgggggcagat

SEQ ID NO: 2954830 - DNA, 13 bp, Homo sapiens
gggctgaggatgg

SEQ ID NO: 2954831 - DNA, 23 bp, Homo sapiens
gggctgagtgagttcaactacat

SEQ ID NO: 2954832 - DNA, 12 bp, Homo sapiens
gggctgcctttg

SEQ ID NO: 2954833 - DNA, 15 bp, Homo sapiens
gggctgctcctccag

SEQ ID NO: 2954834 - DNA, 16 bp, Homo sapiens
gggctgctcctccagg

SEQ ID NO: 2954835 - DNA, 19 bp, Homo sapiens
gggctgctcctccagggcc

SEQ ID NO: 2954836 - DNA, 17 bp, Homo sapiens
gggctgctgacctccac

SEQ ID NO: 2954837 - DNA, 11 bp, Homo sapiens
gggctgctggg

SEQ ID NO: 2954838 - DNA, 19 bp, Homo sapiens
gggctggaggcccaggctg

SEQ ID NO: 2954839 - DNA, 15 bp, Homo sapiens
gggctggccctgtgc

SEQ ID NO: 2954840 - DNA, 16 bp, Homo sapiens
gggctggccctgtgca

SEQ ID NO: 2954841 - DNA, 21 bp, Homo sapiens
gggctggccctgtgcagacct

SEQ ID NO: 2954842 - DNA, 19 bp, Homo sapiens
gggctggcggctactcagc

SEQ ID NO: 2954843 - DNA, 17 bp, Homo sapiens
gggctggctgcttgcag

SEQ ID NO: 2954844 - DNA, 20 bp, Homo sapiens
gggctggctgcttgcagcca

SEQ ID NO: 2954845 - DNA, 23 bp, Homo sapiens
gggctggctgcttgcagccagga

SEQ ID NO: 2954846 - DNA, 21 bp, Homo sapiens
gggctgggaaacactccttgc

SEQ ID NO: 2954847 - DNA, 19 bp, Homo sapiens
gggctgggtcacaggaagg

SEQ ID NO: 2954848 - DNA, 21 bp, Homo sapiens
gggctgggtcacaggaaggaa

SEQ ID NO: 2954849 - DNA, 18 bp, Homo sapiens
gggctggtattctctcta

SEQ ID NO: 2954850 - DNA, 23 bp, Homo sapiens
gggctggtgaggccggccctgcc

SEQ ID NO: 2954851 - DNA, 23 bp, Homo sapiens
gggctggttctgtaattgtgtgt

SEQ ID NO: 2954852 - DNA, 17 bp, Homo sapiens
gggctgtcatctgtgca

SEQ ID NO: 2954853 - DNA, 22 bp, Homo sapiens
gggctgtttaggggatctggaa

SEQ ID NO: 2954854 - DNA, 20 bp, Homo sapiens
gggctgttttagtgccaggc

SEQ ID NO: 2954855 - DNA, 18 bp, Homo sapiens
gggcttatttagaaaaaa

SEQ ID NO: 2954856 - DNA, 23 bp, Homo sapiens
gggcttctgcgtccaccaggcct

SEQ ID NO: 2954857 - DNA, 14 bp, Homo sapiens
gggcttgaatttgc

SEQ ID NO: 2954858 - DNA, 16 bp, Homo sapiens
gggcttgccccactct

SEQ ID NO: 2954859 - DNA, 15 bp, Homo sapiens
gggctttcggggagg

SEQ ID NO: 2954860 - DNA, 16 bp, Homo sapiens
gggctttcggggaggg

SEQ ID NO: 2954861 - DNA, 17 bp, Homo sapiens
gggctttcggggagggc

SEQ ID NO: 2954862 - DNA, 19 bp, Homo sapiens
gggctttcgtccacagctt

SEQ ID NO: 2954863 - DNA, 15 bp, Homo sapiens
gggcttttgttctga

SEQ ID NO: 2954864 - DNA, 18 bp, Homo sapiens
gggcttttgttctgaggg

SEQ ID NO: 2954865 - DNA, 20 bp, Homo sapiens
gggcttttgttctgaggggt

SEQ ID NO: 2954866 - DNA, 19 bp, Homo sapiens
ggggaaacgtctcccagat

SEQ ID NO: 2954867 - DNA, 13 bp, Homo sapiens
ggggaacggatgc

SEQ ID NO: 2954868 - DNA, 19 bp, Homo sapiens
ggggaagagatccaaagac

SEQ ID NO: 2954869 - DNA, 14 bp, Homo sapiens
ggggaagcctcctg

SEQ ID NO: 2954870 - DNA, 18 bp, Homo sapiens
ggggaatgggcaggtggc

SEQ ID NO: 2954871 - DNA, 13 bp, Homo sapiens
ggggacagccttc

SEQ ID NO: 2954872 - DNA, 13 bp, Homo sapiens
ggggacccagtgc

SEQ ID NO: 2954873 - DNA, 21 bp, Homo sapiens
ggggacccagtgcagaatgta

SEQ ID NO: 2954874 - DNA, 15 bp, Homo sapiens
ggggaccccacccct

SEQ ID NO: 2954875 - DNA, 17 bp, Homo sapiens
ggggacctgatggagag

SEQ ID NO: 2954876 - DNA, 21 bp, Homo sapiens
ggggacgcaggcccctctcct

SEQ ID NO: 2954877 - DNA, 14 bp, Homo sapiens
ggggacgggacaga

SEQ ID NO: 2954878 - DNA, 20 bp, Homo sapiens
ggggacgggcaagtgagagg

SEQ ID NO: 2954879 - DNA, 12 bp, Homo sapiens
ggggactgggcc

SEQ ID NO: 2954880 - DNA, 13 bp, Homo sapiens
ggggactgggcca

SEQ ID NO: 2954881 - DNA, 19 bp, Homo sapiens
ggggagaacttacattgtg

SEQ ID NO: 2954882 - DNA, 15 bp, Homo sapiens
ggggagaaggcctcc

SEQ ID NO: 2954883 - DNA, 18 bp, Homo sapiens
ggggagaatgcagcccac

SEQ ID NO: 2954884 - DNA, 18 bp, Homo sapiens
gtacatttttaaattctt

SEQ ID NO: 2954885 - DNA, 19 bp, Homo sapiens
gtacatttttcaactttga

SEQ ID NO: 2954886 - DNA, 22 bp, Homo sapiens
gtacatttttcaactttgaata

SEQ ID NO: 2954887 - DNA, 23 bp, Homo sapiens
gtacatttttcaactttgaataa

SEQ ID NO: 2954888 - DNA, 21 bp, Homo sapiens
gtaccaagaatcttggtttgc

SEQ ID NO: 2954889 - DNA, 22 bp, Homo sapiens
gtaccaagccaccgcagctgct

SEQ ID NO: 2954890 - DNA, 16 bp, Homo sapiens
gtaccacaccctgcct

SEQ ID NO: 2954891 - DNA, 17 bp, Homo sapiens
gtaccacaccctgcctg

SEQ ID NO: 2954892 - DNA, 18 bp, Homo sapiens
gtaccacagtttcttctg

SEQ ID NO: 2954893 - DNA, 17 bp, Homo sapiens
gtaccagatgcagctca

SEQ ID NO: 2954894 - DNA, 19 bp, Homo sapiens
gtaccagtgtaaattcagt

SEQ ID NO: 2954895 - DNA, 14 bp, Homo sapiens
gtacccgaggcctc

SEQ ID NO: 2954896 - DNA, 13 bp, Homo sapiens
gtacctcctctca

SEQ ID NO: 2954897 - DNA, 16 bp, Homo sapiens
gtacctcctctcagtg

SEQ ID NO: 2954898 - DNA, 18 bp, Homo sapiens
gtacctcctctcagtgtt

SEQ ID NO: 2954899 - DNA, 13 bp, Homo sapiens
gtacctgcaagca

SEQ ID NO: 2954900 - DNA, 18 bp, Homo sapiens
gtacctgcaagcagaact

SEQ ID NO: 2954901 - DNA, 15 bp, Homo sapiens
gtacctgttcctccc

SEQ ID NO: 2954902 - DNA, 17 bp, Homo sapiens
gtacctgttcctccccc

SEQ ID NO: 2954903 - DNA, 19 bp, Homo sapiens
gtaccttattgatctttgc

SEQ ID NO: 2954904 - DNA, 17 bp, Homo sapiens
gtacctttcagaactca

SEQ ID NO: 2954905 - DNA, 13 bp, Homo sapiens
gtacgcacagaca

SEQ ID NO: 2954906 - DNA, 13 bp, Homo sapiens
gtacgctagagca

SEQ ID NO: 2954907 - DNA, 20 bp, Homo sapiens
gtacgtagccacaggagccc

SEQ ID NO: 2954908 - DNA, 23 bp, Homo sapiens
gtacgtcccagcggcctcagggt

SEQ ID NO: 2954909 - DNA, 12 bp, Homo sapiens
gtacgtgaccct

SEQ ID NO: 2954910 - DNA, 17 bp, Homo sapiens
gtacgtttgtatgtgtg

SEQ ID NO: 2954911 - DNA, 13 bp, Homo sapiens
gtactaaagccaa

SEQ ID NO: 2954912 - DNA, 13 bp, Homo sapiens
gtactaagcattt

SEQ ID NO: 2954913 - DNA, 14 bp, Homo sapiens
gtactaagccagga

SEQ ID NO: 2954914 - DNA, 19 bp, Homo sapiens
gtactaaggtgactttctg

SEQ ID NO: 2954915 - DNA, 15 bp, Homo sapiens
gtactacattttctt

SEQ ID NO: 2954916 - DNA, 19 bp, Homo sapiens
gtactacttgtttcaaatg

SEQ ID NO: 2954917 - DNA, 22 bp, Homo sapiens
gtactagtgtccgcataagaaa

SEQ ID NO: 2954918 - DNA, 12 bp, Homo sapiens
gtactccagcct

SEQ ID NO: 2954919 - DNA, 15 bp, Homo sapiens
gtactccagcctggg

SEQ ID NO: 2954920 - DNA, 18 bp, Homo sapiens
gtactgagcagtattagc

SEQ ID NO: 2954921 - DNA, 21 bp, Homo sapiens
gtactgtgggcaatttagaaa

SEQ ID NO: 2954922 - DNA, 22 bp, Homo sapiens
gtactgtgggcaatttagaaaa

SEQ ID NO: 2954923 - DNA, 18 bp, Homo sapiens
gtactgttttctgggcca

SEQ ID NO: 2954924 - DNA, 18 bp, Homo sapiens
gtacttcaggggcacttc

SEQ ID NO: 2954925 - DNA, 23 bp, Homo sapiens
gtacttgaagtctaaaagcagaa

SEQ ID NO: 2954926 - DNA, 13 bp, Homo sapiens
gtacttggtccaa

SEQ ID NO: 2954927 - DNA, 22 bp, Homo sapiens
gtacttggtccaactgcaactc

SEQ ID NO: 2954928 - DNA, 17 bp, Homo sapiens
gtacttgtcaaagaagg

SEQ ID NO: 2954929 - DNA, 23 bp, Homo sapiens
gtactttattttctataatttaa

SEQ ID NO: 2954930 - DNA, 22 bp, Homo sapiens
gtactttgtttttccatgtgtt

SEQ ID NO: 2954931 - DNA, 11 bp, Homo sapiens
gtacttttaac

SEQ ID NO: 2954932 - DNA, 15 bp, Homo sapiens
gtacttttattgatg

SEQ ID NO: 2954933 - DNA, 17 bp, Homo sapiens
gtacttttcattctctt

SEQ ID NO: 2954934 - DNA, 21 bp, Homo sapiens
gtacttttcccatttgtaatt

SEQ ID NO: 2954935 - DNA, 20 bp, Homo sapiens
gtacttttttatttaaaaaa

SEQ ID NO: 2954936 - DNA, 17 bp, Homo sapiens
gtagaaaatgcaccaaa

SEQ ID NO: 2954937 - DNA, 14 bp, Homo sapiens
gtagaaacatttag

SEQ ID NO: 2954938 - DNA, 14 bp, Homo sapiens
gtagaaattcttaa

SEQ ID NO: 2954939 - DNA, 18 bp, Homo sapiens
gtagaagaagtgaacact

SEQ ID NO: 2954940 - DNA, 19 bp, Homo sapiens
gtagaagaagtgaacactt

SEQ ID NO: 2954941 - DNA, 22 bp, Homo sapiens
gtagaagccacccttccctgcc

SEQ ID NO: 2954942 - DNA, 15 bp, Homo sapiens
gtagaataaatgaag

SEQ ID NO: 2954943 - DNA, 16 bp, Homo sapiens
gtagaatgtaaagctt

SEQ ID NO: 2954944 - DNA, 17 bp, Homo sapiens
gtagaatgtaatatact

SEQ ID NO: 2954945 - DNA, 20 bp, Homo sapiens
gtagaatgtattgtaccttt

SEQ ID NO: 2954946 - DNA, 15 bp, Homo sapiens
gtagacattgtaaat

SEQ ID NO: 2954947 - DNA, 15 bp, Homo sapiens
gtagacctctttttc

SEQ ID NO: 2954948 - DNA, 13 bp, Homo sapiens
gtagagccaatta

SEQ ID NO: 2954949 - DNA, 15 bp, Homo sapiens
gtagagccagccttg

SEQ ID NO: 2954950 - DNA, 13 bp, Homo sapiens
gtagaggaagacg

SEQ ID NO: 2954951 - DNA, 16 bp, Homo sapiens
gtagagggtgctgccc

SEQ ID NO: 2954952 - DNA, 15 bp, Homo sapiens
gtagatctgctttct

SEQ ID NO: 2954953 - DNA, 17 bp, Homo sapiens
gtagatctgctttctgt

SEQ ID NO: 2954954 - DNA, 19 bp, Homo sapiens
gtagatctgctttctgttc

SEQ ID NO: 2954955 - DNA, 18 bp, Homo sapiens
gtagatcttcaatttgga

SEQ ID NO: 2954956 - DNA, 17 bp, Homo sapiens
gtagatgcagaaaaaga

SEQ ID NO: 2954957 - DNA, 19 bp, Homo sapiens
gtagatgcagaaaaagaaa

SEQ ID NO: 2954958 - DNA, 19 bp, Homo sapiens
gtagattctgtggaacaag

SEQ ID NO: 2954959 - DNA, 13 bp, Homo sapiens
gtagatttcctcc

SEQ ID NO: 2954960 - DNA, 17 bp, Homo sapiens
gtagatttcctcctccc

SEQ ID NO: 2954961 - DNA, 17 bp, Homo sapiens
gtagcactcaggctctc

SEQ ID NO: 2954962 - DNA, 23 bp, Homo sapiens
gtagcagaaaggaaaagattcct

SEQ ID NO: 2954963 - DNA, 18 bp, Homo sapiens
gtagcagacaacacacaa

SEQ ID NO: 2954964 - DNA, 20 bp, Homo sapiens
gtagcagcagcctactgagt

SEQ ID NO: 2954965 - DNA, 19 bp, Homo sapiens
gtagccagcacacagggca

SEQ ID NO: 2954966 - DNA, 18 bp, Homo sapiens
gtagccagttaaggaaag

SEQ ID NO: 2954967 - DNA, 20 bp, Homo sapiens
gtagccagttaaggaaagaa

SEQ ID NO: 2954968 - DNA, 17 bp, Homo sapiens
gtagccatcaagcactt

SEQ ID NO: 2954969 - DNA, 21 bp, Homo sapiens
gtagccatcaagcacttccca

SEQ ID NO: 2954970 - DNA, 16 bp, Homo sapiens
gtagcccactctgctc

SEQ ID NO: 2954971 - DNA, 19 bp, Homo sapiens
gtagccccctggcctctgt

SEQ ID NO: 2954972 - DNA, 23 bp, Homo sapiens
gtagccccctggcctctgtgcct

SEQ ID NO: 2954973 - DNA, 12 bp, Homo sapiens
gtagcctgtgca

SEQ ID NO: 2954974 - DNA, 15 bp, Homo sapiens
gtagctagaggaacc

SEQ ID NO: 2954975 - DNA, 13 bp, Homo sapiens
gtagctgacacag

SEQ ID NO: 2954976 - DNA, 12 bp, Homo sapiens
gtagctgcccct

SEQ ID NO: 2954977 - DNA, 17 bp, Homo sapiens
gtagctgctaccttctt

SEQ ID NO: 2954978 - DNA, 17 bp, Homo sapiens
gtagctggattacaggc

SEQ ID NO: 2954979 - DNA, 18 bp, Homo sapiens
gtagctgggattacaggc

SEQ ID NO: 2954980 - DNA, 21 bp, Homo sapiens
gtagctgggattacaggtgtg

SEQ ID NO: 2954981 - DNA, 14 bp, Homo sapiens
gtagctttcctgga

SEQ ID NO: 2954982 - DNA, 13 bp, Homo sapiens
gtaggaaatgtgg

SEQ ID NO: 2954983 - DNA, 22 bp, Homo sapiens
gtaggagctgccttggctcaga

SEQ ID NO: 2954984 - DNA, 23 bp, Homo sapiens
gtaggagctgccttggctcagac

SEQ ID NO: 2954985 - DNA, 15 bp, Homo sapiens
gtaggaggaggcatg

SEQ ID NO: 2954986 - DNA, 19 bp, Homo sapiens
gtaggaggaggcatggaaa

SEQ ID NO: 2954987 - DNA, 20 bp, Homo sapiens
gtaggatattttgtcaccag

SEQ ID NO: 2954988 - DNA, 15 bp, Homo sapiens
gtaggatcacctgag

SEQ ID NO: 2954989 - DNA, 20 bp, Homo sapiens
gtaggatcacctgaggtcag

SEQ ID NO: 2954990 - DNA, 15 bp, Homo sapiens
gtaggcagaggctgc

SEQ ID NO: 2954991 - DNA, 14 bp, Homo sapiens
gtaggcatttccta

SEQ ID NO: 2954992 - DNA, 21 bp, Homo sapiens
gtagggaaaaaaatgcttctt

SEQ ID NO: 2954993 - DNA, 22 bp, Homo sapiens
gtaggggagccacatttacata

SEQ ID NO: 2954994 - DNA, 19 bp, Homo sapiens
gtaggttatttaaaataaa

SEQ ID NO: 2954995 - DNA, 15 bp, Homo sapiens
gtaggttattttata

SEQ ID NO: 2954996 - DNA, 16 bp, Homo sapiens
gtagtaggcattttta

SEQ ID NO: 2954997 - DNA, 13 bp, Homo sapiens
gtagtatttttta

SEQ ID NO: 2954998 - DNA, 14 bp, Homo sapiens
gtagtcaataaaac

SEQ ID NO: 2954999 - DNA, 22 bp, Homo sapiens
gtagtccgtgctgacagctgct

SEQ ID NO: 2955000 - DNA, 16 bp, Homo sapiens
gtagtcttgatgacca

SEQ ID NO: 2955001 - DNA, 14 bp, Homo sapiens
gtagtgagatagca

SEQ ID NO: 2955002 - DNA, 22 bp, Homo sapiens
gtagtgagccaagatcgcacca

SEQ ID NO: 2955003 - DNA, 16 bp, Homo sapiens
gtagtgagcgagtgga

SEQ ID NO: 2955004 - DNA, 19 bp, Homo sapiens
gtagtgatttttatgccac

SEQ ID NO: 2955005 - DNA, 15 bp, Homo sapiens
gtagtgccgcagtgg

SEQ ID NO: 2955006 - DNA, 16 bp, Homo sapiens
gtagtgccgcagtggg

SEQ ID NO: 2955007 - DNA, 18 bp, Homo sapiens
gtagtgctttaagaatga

SEQ ID NO: 2955008 - DNA, 23 bp, Homo sapiens
gtagtgctttaagaatgaacaca

SEQ ID NO: 2955009 - DNA, 19 bp, Homo sapiens
gtagtgtaagctagaagaa

SEQ ID NO: 2955010 - DNA, 15 bp, Homo sapiens
gtagtgtcagtacta

SEQ ID NO: 2955011 - DNA, 19 bp, Homo sapiens
gtagtgttgtccaggaagt

SEQ ID NO: 2955012 - DNA, 14 bp, Homo sapiens
gtagttattttgca

SEQ ID NO: 2955013 - DNA, 22 bp, Homo sapiens
gtagtttgttatgtgtctggaa

SEQ ID NO: 2955014 - DNA, 14 bp, Homo sapiens
gtataaagtcagga

SEQ ID NO: 2955015 - DNA, 22 bp, Homo sapiens
gtataaatgacaaagtgttgaa

SEQ ID NO: 2955016 - DNA, 11 bp, Homo sapiens
gtataaatgtc

SEQ ID NO: 2955017 - DNA, 20 bp, Homo sapiens
gtataacaggttattttagt

SEQ ID NO: 2955018 - DNA, 15 bp, Homo sapiens
gtataacatcactgt

SEQ ID NO: 2955019 - DNA, 14 bp, Homo sapiens
gtataatgaacact

SEQ ID NO: 2955020 - DNA, 15 bp, Homo sapiens
gtataatgaacactc

SEQ ID NO: 2955021 - DNA, 17 bp, Homo sapiens
gtatttttaaaaaacaa

SEQ ID NO: 2955022 - DNA, 14 bp, Homo sapiens
gtatttttgattaa

SEQ ID NO: 2955023 - DNA, 16 bp, Homo sapiens
gtatttttgattaaca

SEQ ID NO: 2955024 - DNA, 21 bp, Homo sapiens
gtatttttgattaacaatgta

SEQ ID NO: 2955025 - DNA, 22 bp, Homo sapiens
gtatttttgattaacaatgtat

SEQ ID NO: 2955026 - DNA, 13 bp, Homo sapiens
gtattttttcata

SEQ ID NO: 2955027 - DNA, 14 bp, Homo sapiens
gtattttttccttt

SEQ ID NO: 2955028 - DNA, 15 bp, Homo sapiens
gtattttttcttgca

SEQ ID NO: 2955029 - DNA, 15 bp, Homo sapiens
gtcaaaacagattgt

SEQ ID NO: 2955030 - DNA, 20 bp, Homo sapiens
gtcaaaacagattgtttgca

SEQ ID NO: 2955031 - DNA, 12 bp, Homo sapiens
gtcaaaaggaac

SEQ ID NO: 2955032 - DNA, 13 bp, Homo sapiens
gtcaaaaggaaca

SEQ ID NO: 2955033 - DNA, 14 bp, Homo sapiens
gtcaaaaggtgcct

SEQ ID NO: 2955034 - DNA, 15 bp, Homo sapiens
gtcaaaaggtgcctg

SEQ ID NO: 2955035 - DNA, 18 bp, Homo sapiens
gtcaaaatatttttaaaa

SEQ ID NO: 2955036 - DNA, 15 bp, Homo sapiens
gtcaaacaaagccag

SEQ ID NO: 2955037 - DNA, 16 bp, Homo sapiens
gtcaaacaaagccaga

SEQ ID NO: 2955038 - DNA, 16 bp, Homo sapiens
gtcaaactgtagaaat

SEQ ID NO: 2955039 - DNA, 19 bp, Homo sapiens
gtcaaagtgaaagacattt

SEQ ID NO: 2955040 - DNA, 17 bp, Homo sapiens
gtcaaataaatgtttcc

SEQ ID NO: 2955041 - DNA, 17 bp, Homo sapiens
gtcaacagaatgaaaaa

SEQ ID NO: 2955042 - DNA, 20 bp, Homo sapiens
gtcaacagaatgaaaaatga

SEQ ID NO: 2955043 - DNA, 14 bp, Homo sapiens
gtcaacagttttcc

SEQ ID NO: 2955044 - DNA, 14 bp, Homo sapiens
gtcaaccagacaga

SEQ ID NO: 2955045 - DNA, 16 bp, Homo sapiens
gtcaaccagacagagg

SEQ ID NO: 2955046 - DNA, 17 bp, Homo sapiens
gtcaacccttctggaaa

SEQ ID NO: 2955047 - DNA, 16 bp, Homo sapiens
gtcaacctcctggaca

SEQ ID NO: 2955048 - DNA, 14 bp, Homo sapiens
gtcaacctgggcaa

SEQ ID NO: 2955049 - DNA, 19 bp, Homo sapiens
gtcaacctgggcaaagcct

SEQ ID NO: 2955050 - DNA, 16 bp, Homo sapiens
gtcaacgttgtactgt

SEQ ID NO: 2955051 - DNA, 17 bp, Homo sapiens
gtcaagagtagttatat

SEQ ID NO: 2955052 - DNA, 17 bp, Homo sapiens
gtcaagctcctcctccc

SEQ ID NO: 2955053 - DNA, 20 bp, Homo sapiens
gtcaagtcctgactgggctg

SEQ ID NO: 2955054 - DNA, 19 bp, Homo sapiens
gtcccctggggctggtgga

SEQ ID NO: 2955055 - DNA, 17 bp, Homo sapiens
gtcccggggccagcact

SEQ ID NO: 2955056 - DNA, 22 bp, Homo sapiens
gtcccggggccagcacttccat

SEQ ID NO: 2955057 - DNA, 22 bp, Homo sapiens
gtcccgtggatgctctttcaat

SEQ ID NO: 2955058 - DNA, 15 bp, Homo sapiens
gtccctagcagccca

SEQ ID NO: 2955059 - DNA, 20 bp, Homo sapiens
gtccctagcagcccaccctg

SEQ ID NO: 2955060 - DNA, 18 bp, Homo sapiens
gtccctcagaggccttgg

SEQ ID NO: 2955061 - DNA, 12 bp, Homo sapiens
gtccctcctggt

SEQ ID NO: 2955062 - DNA, 19 bp, Homo sapiens
gtccctcctggtgtcaccc

SEQ ID NO: 2955063 - DNA, 22 bp, Homo sapiens
gtccctctcagtgccttctctc

SEQ ID NO: 2955064 - DNA, 13 bp, Homo sapiens
gtccctgaagtct

SEQ ID NO: 2955065 - DNA, 23 bp, Homo sapiens
gtccctgaagtcttgcattgaat

SEQ ID NO: 2955066 - DNA, 19 bp, Homo sapiens
gtccctgagcagtctactt

SEQ ID NO: 2955067 - DNA, 17 bp, Homo sapiens
gtccctgcactgtgccc

SEQ ID NO: 2955068 - DNA, 15 bp, Homo sapiens
gtccctgctggggtc

SEQ ID NO: 2955069 - DNA, 21 bp, Homo sapiens
gtccctgctggggtctcaggt

SEQ ID NO: 2955070 - DNA, 23 bp, Homo sapiens
gtccctgggagcaagttgcagtc

SEQ ID NO: 2955071 - DNA, 17 bp, Homo sapiens
gtccctggggcactccc

SEQ ID NO: 2955072 - DNA, 15 bp, Homo sapiens
gtccctggggctagg

SEQ ID NO: 2955073 - DNA, 20 bp, Homo sapiens
gtccctgggggaagccctgg

SEQ ID NO: 2955074 - DNA, 21 bp, Homo sapiens
gtccctgggggaagccctgga

SEQ ID NO: 2955075 - DNA, 22 bp, Homo sapiens
gtccctgggggaagccctggat

SEQ ID NO: 2955076 - DNA, 16 bp, Homo sapiens
gtccctggttttcagt

SEQ ID NO: 2955077 - DNA, 17 bp, Homo sapiens
gtcccttcctgcttcct

SEQ ID NO: 2955078 - DNA, 23 bp, Homo sapiens
gtcccttcctgcttcctgttacc

SEQ ID NO: 2955079 - DNA, 15 bp, Homo sapiens
gtcccttgaaaaagt

SEQ ID NO: 2955080 - DNA, 21 bp, Homo sapiens
gtcccttgagacctcagccat

SEQ ID NO: 2955081 - DNA, 20 bp, Homo sapiens
gtcccttgtttccagctaga

SEQ ID NO: 2955082 - DNA, 20 bp, Homo sapiens
gtccctttttgcaggggact

SEQ ID NO: 2955083 - DNA, 18 bp, Homo sapiens
gtccgagaaggcggaaac

SEQ ID NO: 2955084 - DNA, 18 bp, Homo sapiens
gtccgcatccctgcttct

SEQ ID NO: 2955085 - DNA, 14 bp, Homo sapiens
gtccgcctgcgcct

SEQ ID NO: 2955086 - DNA, 16 bp, Homo sapiens
gtccgcctgcgcctcc

SEQ ID NO: 2955087 - DNA, 14 bp, Homo sapiens
gtccggaagggtga

SEQ ID NO: 2955088 - DNA, 15 bp, Homo sapiens
gtccggtgttctaag

SEQ ID NO: 2955089 - DNA, 17 bp, Homo sapiens
gtccggtgttctaagat

SEQ ID NO: 2955090 - DNA, 18 bp, Homo sapiens
gtccgtgggttgctaact

SEQ ID NO: 2955091 - DNA, 14 bp, Homo sapiens
gtccgtttactcca

SEQ ID NO: 2955092 - DNA, 17 bp, Homo sapiens
gtcctaaaagttctcaa

SEQ ID NO: 2955093 - DNA, 13 bp, Homo sapiens
gtcctagcccagt

SEQ ID NO: 2955094 - DNA, 24 bp, Homo sapiens
gtcctcacttctagatctcagcca

SEQ ID NO: 2955095 - DNA, 14 bp, Homo sapiens
gtcctcagccttgc

SEQ ID NO: 2955096 - DNA, 16 bp, Homo sapiens
gtcctcagccttgcca

SEQ ID NO: 2955097 - DNA, 20 bp, Homo sapiens
gtcctcagccttgccagaga

SEQ ID NO: 2955098 - DNA, 15 bp, Homo sapiens
gtcctcaggtggcca

SEQ ID NO: 2955099 - DNA, 16 bp, Homo sapiens
gtcctcaggtggccat

SEQ ID NO: 2955100 - DNA, 21 bp, Homo sapiens
gtcctccaacaccaagcacag

SEQ ID NO: 2955101 - DNA, 14 bp, Homo sapiens
gtcctccaagccag

SEQ ID NO: 2955102 - DNA, 18 bp, Homo sapiens
gtctcctactctgtgtaa

SEQ ID NO: 2955103 - DNA, 17 bp, Homo sapiens
gtctcctaggggcttgg

SEQ ID NO: 2955104 - DNA, 18 bp, Homo sapiens
gtctcctaggggcttggt

SEQ ID NO: 2955105 - DNA, 22 bp, Homo sapiens
gtctcctatatatttctattat

SEQ ID NO: 2955106 - DNA, 20 bp, Homo sapiens
gtctcctgactggtgctgca

SEQ ID NO: 2955107 - DNA, 20 bp, Homo sapiens
gtctcctttcaccccagggc

SEQ ID NO: 2955108 - DNA, 22 bp, Homo sapiens
gtctcgaactcctgacctcaag

SEQ ID NO: 2955109 - DNA, 15 bp, Homo sapiens
gtctcgatgctgctg

SEQ ID NO: 2955110 - DNA, 17 bp, Homo sapiens
gtctcgatgctgctggc

SEQ ID NO: 2955111 - DNA, 18 bp, Homo sapiens
gtctcgatgctgctggcc

SEQ ID NO: 2955112 - DNA, 17 bp, Homo sapiens
gtctcgccagaagactc

SEQ ID NO: 2955113 - DNA, 14 bp, Homo sapiens
gtctcgctgcatca

SEQ ID NO: 2955114 - DNA, 21 bp, Homo sapiens
gtctcgggggtccggaagggt

SEQ ID NO: 2955115 - DNA, 21 bp, Homo sapiens
gtctctaaaaagaagccacag

SEQ ID NO: 2955116 - DNA, 22 bp, Homo sapiens
gtctctaaaaagaagccacaga

SEQ ID NO: 2955117 - DNA, 19 bp, Homo sapiens
gtctctatcattaaagttc

SEQ ID NO: 2955118 - DNA, 12 bp, Homo sapiens
gtctctccagcc

SEQ ID NO: 2955119 - DNA, 18 bp, Homo sapiens
gtctctccagcctcacag

SEQ ID NO: 2955120 - DNA, 21 bp, Homo sapiens
gtctctcccaccccctcccca

SEQ ID NO: 2955121 - DNA, 16 bp, Homo sapiens
gtctctccccctctgt

SEQ ID NO: 2955122 - DNA, 17 bp, Homo sapiens
gtctctccccctctgtc

SEQ ID NO: 2955123 - DNA, 19 bp, Homo sapiens
gtctctccccctctgtctt

SEQ ID NO: 2955124 - DNA, 21 bp, Homo sapiens
gtctctccttcctcttggctg

SEQ ID NO: 2955125 - DNA, 16 bp, Homo sapiens
gtctctctgcctgctg

SEQ ID NO: 2955126 - DNA, 17 bp, Homo sapiens
gtctctctgcctgctgg

SEQ ID NO: 2955127 - DNA, 22 bp, Homo sapiens
gtctctctgcctgctgggctct

SEQ ID NO: 2955128 - DNA, 21 bp, Homo sapiens
gtctctgcatttttctgcaga

SEQ ID NO: 2955129 - DNA, 12 bp, Homo sapiens
gtctctgcctgg

SEQ ID NO: 2955130 - DNA, 16 bp, Homo sapiens
gtctctgcctggagca

SEQ ID NO: 2955131 - DNA, 22 bp, Homo sapiens
gtctctgcctggagcaggggtg

SEQ ID NO: 2955132 - DNA, 14 bp, Homo sapiens
gtctctgctccagc

SEQ ID NO: 2955133 - DNA, 18 bp, Homo sapiens
gtctctggctcagctgtg

SEQ ID NO: 2955134 - DNA, 23 bp, Homo sapiens
gtctctgggtttacaacaaacac

SEQ ID NO: 2955135 - DNA, 18 bp, Homo sapiens
gtctcttaaatctcttaa

SEQ ID NO: 2955136 - DNA, 23 bp, Homo sapiens
gtctcttcttggggcccagtgca

SEQ ID NO: 2955137 - DNA, 13 bp, Homo sapiens
gtctcttgtaatc

SEQ ID NO: 2955138 - DNA, 22 bp, Homo sapiens
gtctctttattcctagttggtg

SEQ ID NO: 2955139 - DNA, 11 bp, Homo sapiens
gtctctttcca

SEQ ID NO: 2955140 - DNA, 13 bp, Homo sapiens
gtctctttccact

SEQ ID NO: 2955141 - DNA, 14 bp, Homo sapiens
gtctctttccactt

SEQ ID NO: 2955142 - DNA, 17 bp, Homo sapiens
gtctgaacaaaaactgt

SEQ ID NO: 2955143 - DNA, 19 bp, Homo sapiens
gtctgactccctccccacc

SEQ ID NO: 2955144 - DNA, 20 bp, Homo sapiens
gtctgactccctccccaccc

SEQ ID NO: 2955145 - DNA, 21 bp, Homo sapiens
gtctgactccctccccaccca

SEQ ID NO: 2955146 - DNA, 23 bp, Homo sapiens
gtctgactccctccccacccaag

SEQ ID NO: 2955147 - DNA, 19 bp, Homo sapiens
gtctgagagcaaagtgacc

SEQ ID NO: 2955148 - DNA, 17 bp, Homo sapiens
gtctgagctgtcccaag

SEQ ID NO: 2955149 - DNA, 21 bp, Homo sapiens
gtctgatcgacgtggtgacgc

SEQ ID NO: 2955150 - DNA, 20 bp, Homo sapiens
gtctgcaagggcccagagtg

SEQ ID NO: 2955151 - DNA, 21 bp, Homo sapiens
gtctgcatttcggtggctagt

SEQ ID NO: 2955152 - DNA, 13 bp, Homo sapiens
gtctgccagggcc

SEQ ID NO: 2955153 - DNA, 14 bp, Homo sapiens
gtctgcgaagtcct

SEQ ID NO: 2955154 - DNA, 20 bp, Homo sapiens
gtctgctgatcaaaagcatt

SEQ ID NO: 2955155 - DNA, 10 bp, Homo sapiens
gtctggaaga

SEQ ID NO: 2955156 - DNA, 17 bp, Homo sapiens
gtctggagaagcagtga

SEQ ID NO: 2955157 - DNA, 18 bp, Homo sapiens
gtctggagcggctgctcg

SEQ ID NO: 2955158 - DNA, 17 bp, Homo sapiens
gtctggatccttcccaa

SEQ ID NO: 2955159 - DNA, 19 bp, Homo sapiens
gtctggcacagcctggctg

SEQ ID NO: 2955160 - DNA, 22 bp, Homo sapiens
gtctggcagcctcccatccagg

SEQ ID NO: 2955161 - DNA, 23 bp, Homo sapiens
gtctggccctggcgggtggctgc

SEQ ID NO: 2955162 - DNA, 17 bp, Homo sapiens
gtctggcgagcccttag

SEQ ID NO: 2955163 - DNA, 20 bp, Homo sapiens
gtctggcgagcccttagcct

SEQ ID NO: 2955164 - DNA, 20 bp, Homo sapiens
gtctgggaggaatggacaga

SEQ ID NO: 2955165 - DNA, 22 bp, Homo sapiens
gtctgggcagctgtcccttgct

SEQ ID NO: 2955166 - DNA, 20 bp, Homo sapiens
gtctggtcacacacaggtgt

SEQ ID NO: 2955167 - DNA, 15 bp, Homo sapiens
gtctggtggaggagc

SEQ ID NO: 2955168 - DNA, 16 bp, Homo sapiens
gtctgtcaccacatct

SEQ ID NO: 2955169 - DNA, 18 bp, Homo sapiens
gtctgtccaacccctccc

SEQ ID NO: 2955170 - DNA, 20 bp, Homo sapiens
gtctgtccaacccctccccc

SEQ ID NO: 2955171 - DNA, 21 bp, Homo sapiens
gtctgtccaacccctccccca

SEQ ID NO: 2955172 - DNA, 14 bp, Homo sapiens
gtctgtccatctgc

SEQ ID NO: 2955173 - DNA, 16 bp, Homo sapiens
gtctgtcctcacgccc

SEQ ID NO: 2955174 - DNA, 19 bp, Homo sapiens
gtctgtctctccccctctg

SEQ ID NO: 2955175 - DNA, 16 bp, Homo sapiens
gtctgtcttctgtata

SEQ ID NO: 2955176 - DNA, 21 bp, Homo sapiens
gtctgtgaattggaccatcct

SEQ ID NO: 2955177 - DNA, 16 bp, Homo sapiens
gtctgtgatgctccca

SEQ ID NO: 2955178 - DNA, 12 bp, Homo sapiens
gtctgtgtgggg

SEQ ID NO: 2955179 - DNA, 20 bp, Homo sapiens
gtctgtgtgtgacccctcct

SEQ ID NO: 2955180 - DNA, 23 bp, Homo sapiens
gtctgtgtgtgacccctcctggg

SEQ ID NO: 2955181 - DNA, 14 bp, Homo sapiens
gtctgttacactgg

SEQ ID NO: 2955182 - DNA, 17 bp, Homo sapiens
gtctgttcactgcattc

SEQ ID NO: 2955183 - DNA, 15 bp, Homo sapiens
gtctgttcttgaagc

SEQ ID NO: 2955184 - DNA, 18 bp, Homo sapiens
gtctgttgtgtgtcatgc

SEQ ID NO: 2955185 - DNA, 23 bp, Homo sapiens
gtcttaacaaaccaacatctttg

SEQ ID NO: 2955186 - DNA, 17 bp, Homo sapiens
gtcttaagaaatgtata

SEQ ID NO: 2955187 - DNA, 13 bp, Homo sapiens
gtcttaaggacaa

SEQ ID NO: 2955188 - DNA, 22 bp, Homo sapiens
gtcttacaaggcaggcctttcc

SEQ ID NO: 2955189 - DNA, 17 bp, Homo sapiens
gtcttacattgcctgac

SEQ ID NO: 2955190 - DNA, 13 bp, Homo sapiens
gtcttactttgtg

SEQ ID NO: 2955191 - DNA, 17 bp, Homo sapiens
gtcttactttgtgcaaa

SEQ ID NO: 2955192 - DNA, 20 bp, Homo sapiens
gtcttagaagtggaccagga

SEQ ID NO: 2955193 - DNA, 22 bp, Homo sapiens
gtcttagaagtggaccaggaca

SEQ ID NO: 2955194 - DNA, 16 bp, Homo sapiens
gtcttaggtcttcctg

SEQ ID NO: 2955195 - DNA, 18 bp, Homo sapiens
gtcttaggtcttcctgtg

SEQ ID NO: 2955196 - DNA, 20 bp, Homo sapiens
gtcttatctgagctgagcca

SEQ ID NO: 2955197 - DNA, 16 bp, Homo sapiens
gtcttcaaattaaagt

SEQ ID NO: 2955198 - DNA, 23 bp, Homo sapiens
gtcttcaaattaaagtgctgttt

SEQ ID NO: 2955199 - DNA, 13 bp, Homo sapiens
gtcttcaccaaca

SEQ ID NO: 2955200 - DNA, 15 bp, Homo sapiens
gtcttcactcttagg

SEQ ID NO: 2955201 - DNA, 15 bp, Homo sapiens
gtcttcagattatta

SEQ ID NO: 2955202 - DNA, 18 bp, Homo sapiens
gtcttcagattattaaaa

SEQ ID NO: 2955203 - DNA, 15 bp, Homo sapiens
gtcttcatctccctg

SEQ ID NO: 2955204 - DNA, 20 bp, Homo sapiens
gtcttcatctccctgccatc

SEQ ID NO: 2955205 - DNA, 21 bp, Homo sapiens
gtcttcatctccctgccatcc

SEQ ID NO: 2955206 - DNA, 11 bp, Homo sapiens
gtcttccacaa

SEQ ID NO: 2955207 - DNA, 15 bp, Homo sapiens
gtcttccatttgcaa

SEQ ID NO: 2955208 - DNA, 19 bp, Homo sapiens
gtcttccctcttccctcag

SEQ ID NO: 2955209 - DNA, 16 bp, Homo sapiens
gtcttcctcttagcct

SEQ ID NO: 2955210 - DNA, 14 bp, Homo sapiens
gtcttcctgtggct

SEQ ID NO: 2955211 - DNA, 17 bp, Homo sapiens
gtcttcctgtggctccc

SEQ ID NO: 2955212 - DNA, 23 bp, Homo sapiens
gtcttccttctcattgctgcccg

SEQ ID NO: 2955213 - DNA, 15 bp, Homo sapiens
gtcttcggaaacctt

SEQ ID NO: 2955214 - DNA, 17 bp, Homo sapiens
gtcttcggccgagctgg

SEQ ID NO: 2955215 - DNA, 17 bp, Homo sapiens
gtcttctccaccacgct

SEQ ID NO: 2955216 - DNA, 20 bp, Homo sapiens
gtcttctccaccacgctggg

SEQ ID NO: 2955217 - DNA, 13 bp, Homo sapiens
gtcttctctatcc

SEQ ID NO: 2955218 - DNA, 12 bp, Homo sapiens
gtcttctgtata

SEQ ID NO: 2955219 - DNA, 20 bp, Homo sapiens
gtcttctgtatataaatggg

SEQ ID NO: 2955220 - DNA, 16 bp, Homo sapiens
gtcttgaaaaaaaata

SEQ ID NO: 2955221 - DNA, 23 bp, Homo sapiens
gtcttgaaaaaaaatagatgttt

SEQ ID NO: 2955222 - DNA, 13 bp, Homo sapiens
gtcttgaagtcct

SEQ ID NO: 2955223 - DNA, 15 bp, Homo sapiens
gtcttgaatgtcttt

SEQ ID NO: 2955224 - DNA, 19 bp, Homo sapiens
gtcttgaatgtcttttgaa

SEQ ID NO: 2955225 - DNA, 15 bp, Homo sapiens
gtcttgatctcctga

SEQ ID NO: 2955226 - DNA, 19 bp, Homo sapiens
gtcttgctatattgcccag

SEQ ID NO: 2955227 - DNA, 22 bp, Homo sapiens
gtcttggcagcacctgtctcct

SEQ ID NO: 2955228 - DNA, 16 bp, Homo sapiens
gtcttggctttcatgt

SEQ ID NO: 2955229 - DNA, 15 bp, Homo sapiens
gtcttggggtcccac

SEQ ID NO: 2955230 - DNA, 21 bp, Homo sapiens
gtcttggggtcccactgctcg

SEQ ID NO: 2955231 - DNA, 16 bp, Homo sapiens
gtcttggttccagcct

SEQ ID NO: 2955232 - DNA, 22 bp, Homo sapiens
gtcttgtgtatttctctgtgaa

SEQ ID NO: 2955233 - DNA, 16 bp, Homo sapiens
gtctttaatcattggt

SEQ ID NO: 2955234 - DNA, 21 bp, Homo sapiens
gtctttaggtctttgtaagaa

SEQ ID NO: 2955235 - DNA, 22 bp, Homo sapiens
gtctttaggtctttgtaagaac

SEQ ID NO: 2955236 - DNA, 18 bp, Homo sapiens
gtctttccacggagccac

SEQ ID NO: 2955237 - DNA, 20 bp, Homo sapiens
gtctttccattggatctcat

SEQ ID NO: 2955238 - DNA, 13 bp, Homo sapiens
gtctttcccccag

SEQ ID NO: 2955239 - DNA, 17 bp, Homo sapiens
gtctttctttgctgctg

SEQ ID NO: 2955240 - DNA, 19 bp, Homo sapiens
gtctttctttgctgctgtg

SEQ ID NO: 2955241 - DNA, 17 bp, Homo sapiens
gtctttggttctaagga

SEQ ID NO: 2955242 - DNA, 22 bp, Homo sapiens
gtcttttcccctcattgcattt

SEQ ID NO: 2955243 - DNA, 16 bp, Homo sapiens
gtctttttagatgccc

SEQ ID NO: 2955244 - DNA, 15 bp, Homo sapiens
gtctttttccttcct

SEQ ID NO: 2955245 - DNA, 17 bp, Homo sapiens
gtctttttccttcctga

SEQ ID NO: 2955246 - DNA, 14 bp, Homo sapiens
gtctttttgtaagt

SEQ ID NO: 2955247 - DNA, 16 bp, Homo sapiens
gtcttttttttaatgt

SEQ ID NO: 2955248 - DNA, 19 bp, Homo sapiens
gtcttttttttaatgtgct

SEQ ID NO: 2955249 - DNA, 13 bp, Homo sapiens
gtgaaaatgaaga

SEQ ID NO: 2955250 - DNA, 17 bp, Homo sapiens
gtgaaaatggtccagga

SEQ ID NO: 2955251 - DNA, 15 bp, Homo sapiens
gtgaaatctgtcttt

SEQ ID NO: 2955252 - DNA, 19 bp, Homo sapiens
gtgaacaagcaaacccaga

SEQ ID NO: 2955253 - DNA, 21 bp, Homo sapiens
gtgaaccaacccccatctccc

SEQ ID NO: 2955254 - DNA, 15 bp, Homo sapiens
gtgaacctcaccccg

SEQ ID NO: 2955255 - DNA, 21 bp, Homo sapiens
gtgaacgtccacatgaaacct

SEQ ID NO: 2955256 - DNA, 22 bp, Homo sapiens
gtgaactaatttggtttttact

SEQ ID NO: 2955257 - DNA, 16 bp, Homo sapiens
gtgaactcagccaagc

SEQ ID NO: 2955258 - DNA, 19 bp, Homo sapiens
gtgaactcagccaagcaca

SEQ ID NO: 2955259 - DNA, 12 bp, Homo sapiens
gtgaactctccc

SEQ ID NO: 2955260 - DNA, 16 bp, Homo sapiens
gtgaactgacaggcag

SEQ ID NO: 2955261 - DNA, 12 bp, Homo sapiens
gtgaagaaagcc

SEQ ID NO: 2955262 - DNA, 17 bp, Homo sapiens
gtgaagaagccctgttc

SEQ ID NO: 2955263 - DNA, 23 bp, Homo sapiens
gtgaagaagccctgttctcgttg

SEQ ID NO: 2955264 - DNA, 13 bp, Homo sapiens
gtgaagacatttt

SEQ ID NO: 2955265 - DNA, 19 bp, Homo sapiens
gtgaagagggaagccagga

SEQ ID NO: 2955266 - DNA, 10 bp, Homo sapiens
gtgaagccaa

SEQ ID NO: 2955267 - DNA, 12 bp, Homo sapiens
gtgaaggaccct

SEQ ID NO: 2955268 - DNA, 12 bp, Homo sapiens
gtgaaggactta

SEQ ID NO: 2955269 - DNA, 16 bp, Homo sapiens
gtgaaggcccatgaag

SEQ ID NO: 2955270 - DNA, 22 bp, Homo sapiens
gtgaaggcccatgaaggaaatt

SEQ ID NO: 2955271 - DNA, 17 bp, Homo sapiens
gtgaaggcttctctctg

SEQ ID NO: 2955272 - DNA, 22 bp, Homo sapiens
gtgaaggcttctctctgtggga

SEQ ID NO: 2955273 - DNA, 17 bp, Homo sapiens
gtgaagtggcctcttgg

SEQ ID NO: 2955274 - DNA, 22 bp, Homo sapiens
gtgaagttaaaacacctttcct

SEQ ID NO: 2955275 - DNA, 14 bp, Homo sapiens
gtgaagttacatgc

SEQ ID NO: 2955276 - DNA, 14 bp, Homo sapiens
gtgaagttagaatt

SEQ ID NO: 2955277 - DNA, 23 bp, Homo sapiens
gtgaataataaaatcaaaaactt

SEQ ID NO: 2955278 - DNA, 20 bp, Homo sapiens
gtgaatccatgggtctggct

SEQ ID NO: 2955279 - DNA, 21 bp, Homo sapiens
gtgaatccatgggtctggcta

SEQ ID NO: 2955280 - DNA, 21 bp, Homo sapiens
gtgaatgccaaagccattctc

SEQ ID NO: 2955281 - DNA, 22 bp, Homo sapiens
gtgaatgccaaagccattctcc

SEQ ID NO: 2955282 - DNA, 18 bp, Homo sapiens
gtgaatgtgtgagaaaaa

SEQ ID NO: 2955283 - DNA, 19 bp, Homo sapiens
gtgaatgttccccaccgct

SEQ ID NO: 2955284 - DNA, 21 bp, Homo sapiens
gtgaattatactttgttgttt

SEQ ID NO: 2955285 - DNA, 15 bp, Homo sapiens
gtgaatttttgcaat

SEQ ID NO: 2955286 - DNA, 12 bp, Homo sapiens
gtgacaataaaa

SEQ ID NO: 2955287 - DNA, 21 bp, Homo sapiens
gtgacaatgactaagccaagc

SEQ ID NO: 2955288 - DNA, 16 bp, Homo sapiens
gtgacaattttgtaca

SEQ ID NO: 2955289 - DNA, 21 bp, Homo sapiens
gtgacacactacaccacacac

SEQ ID NO: 2955290 - DNA, 14 bp, Homo sapiens
gtgacacagactca

SEQ ID NO: 2955291 - DNA, 17 bp, Homo sapiens
gtgacactctccttgca

SEQ ID NO: 2955292 - DNA, 14 bp, Homo sapiens
gtgacactggacca

SEQ ID NO: 2955293 - DNA, 16 bp, Homo sapiens
gtgacagggaagctac

SEQ ID NO: 2955294 - DNA, 18 bp, Homo sapiens
gtgacagggaagctacag

SEQ ID NO: 2955295 - DNA, 14 bp, Homo sapiens
gtgacatcagaagt

SEQ ID NO: 2955296 - DNA, 17 bp, Homo sapiens
gtgacatgcccaaggcc

SEQ ID NO: 2955297 - DNA, 16 bp, Homo sapiens
gtgaccaatacatttg

SEQ ID NO: 2955298 - DNA, 19 bp, Homo sapiens
gtgaccaatacatttgtat

SEQ ID NO: 2955299 - DNA, 11 bp, Homo sapiens
gtgacccagct

SEQ ID NO: 2955300 - DNA, 12 bp, Homo sapiens
gtgacccagcta

SEQ ID NO: 2955301 - DNA, 23 bp, Homo sapiens
gtgacccagctactgaaccagcc

SEQ ID NO: 2955302 - DNA, 21 bp, Homo sapiens
gtgaccccatcactcgcagga

SEQ ID NO: 2955303 - DNA, 15 bp, Homo sapiens
gtgacccccagctcc

SEQ ID NO: 2955304 - DNA, 17 bp, Homo sapiens
gtgacccccagctccgg

SEQ ID NO: 2955305 - DNA, 21 bp, Homo sapiens
gtgacccctcctggggccagg

SEQ ID NO: 2955306 - DNA, 23 bp, Homo sapiens
gtgacccctcctggggccaggcc

SEQ ID NO: 2955307 - DNA, 16 bp, Homo sapiens
gtgacctgaggaagcg

SEQ ID NO: 2955308 - DNA, 15 bp, Homo sapiens
gtgaccttagtgttt

SEQ ID NO: 2955309 - DNA, 22 bp, Homo sapiens
gtgaccttagtgtttctgtgca

SEQ ID NO: 2955310 - DNA, 19 bp, Homo sapiens
gtgacgctgaataaatgtc

SEQ ID NO: 2955311 - DNA, 13 bp, Homo sapiens
gtgacggcggggt

SEQ ID NO: 2955312 - DNA, 18 bp, Homo sapiens
gtgactaattgtataaca

SEQ ID NO: 2955313 - DNA, 23 bp, Homo sapiens
gtgactaattgtataacaggtta

SEQ ID NO: 2955314 - DNA, 12 bp, Homo sapiens
gtgactataaag

SEQ ID NO: 2955315 - DNA, 16 bp, Homo sapiens
gtgactataaagctgt

SEQ ID NO: 2955316 - DNA, 15 bp, Homo sapiens
gtgactcagcagagg

SEQ ID NO: 2955317 - DNA, 18 bp, Homo sapiens
gtgactcagcagaggcag

SEQ ID NO: 2955318 - DNA, 18 bp, Homo sapiens
gtgactcctgaagggaag

SEQ ID NO: 2955319 - DNA, 15 bp, Homo sapiens
gtgactctagcaagg

SEQ ID NO: 2955320 - DNA, 14 bp, Homo sapiens
gtgactctgggcag

SEQ ID NO: 2955321 - DNA, 19 bp, Homo sapiens
gtgactgaaaccattttcc

SEQ ID NO: 2955322 - DNA, 12 bp, Homo sapiens
gtgactgtgtcc

SEQ ID NO: 2955323 - DNA, 11 bp, Homo sapiens
gtgagaaacct

SEQ ID NO: 2955324 - DNA, 17 bp, Homo sapiens
gtgagaaacctgtatct

SEQ ID NO: 2955325 - DNA, 20 bp, Homo sapiens
gtgagaaacctgtatctttc

SEQ ID NO: 2955326 - DNA, 22 bp, Homo sapiens
gtgagaaagaaagtaaaaaagg

SEQ ID NO: 2955327 - DNA, 17 bp, Homo sapiens
gtgagaataggcagccc

SEQ ID NO: 2955328 - DNA, 20 bp, Homo sapiens
gtgagacccagccctcatcc

SEQ ID NO: 2955329 - DNA, 14 bp, Homo sapiens
gtgagactccatct

SEQ ID NO: 2955330 - DNA, 23 bp, Homo sapiens
gtgagagtttggaaggtgtccaa

SEQ ID NO: 2955331 - DNA, 21 bp, Homo sapiens
gtgagatcaacaacactactt

SEQ ID NO: 2955332 - DNA, 15 bp, Homo sapiens
gtgagatgatttgta

SEQ ID NO: 2955333 - DNA, 16 bp, Homo sapiens
gtgagccaagaaacac

SEQ ID NO: 2955334 - DNA, 20 bp, Homo sapiens
gtgagcccagctgggtcagg

SEQ ID NO: 2955335 - DNA, 13 bp, Homo sapiens
gtgagccctctag

SEQ ID NO: 2955336 - DNA, 16 bp, Homo sapiens
gtgagccctctagggc

SEQ ID NO: 2955337 - DNA, 17 bp, Homo sapiens
gtgagccctctagggca

SEQ ID NO: 2955338 - DNA, 23 bp, Homo sapiens
gtgagccctctagggcagggtgg

SEQ ID NO: 2955339 - DNA, 18 bp, Homo sapiens
gtgagccgcatcttctcc

SEQ ID NO: 2955340 - DNA, 22 bp, Homo sapiens
gtgagctgtgactgctttgctg

SEQ ID NO: 2955341 - DNA, 17 bp, Homo sapiens
gtgaggagccccatctg

SEQ ID NO: 2955342 - DNA, 23 bp, Homo sapiens
gtgaggcaatgggagctgaggcc

SEQ ID NO: 2955343 - DNA, 12 bp, Homo sapiens
gtgaggcagggg

SEQ ID NO: 2955344 - DNA, 14 bp, Homo sapiens
gtgaggccagggca

SEQ ID NO: 2955345 - DNA, 23 bp, Homo sapiens
gtgaggccggccctgcccctccc

SEQ ID NO: 2955346 - DNA, 14 bp, Homo sapiens
gtgaggcctgtctg

SEQ ID NO: 2955347 - DNA, 19 bp, Homo sapiens
gtgaggcctgtctgtgacc

SEQ ID NO: 2955348 - DNA, 21 bp, Homo sapiens
gtgaggcctgtctgtgacctg

SEQ ID NO: 2955349 - DNA, 14 bp, Homo sapiens
gtgagggagagaac

SEQ ID NO: 2955350 - DNA, 12 bp, Homo sapiens
gtgagggcagca

SEQ ID NO: 2955351 - DNA, 13 bp, Homo sapiens
gtgaggggtccct

SEQ ID NO: 2955352 - DNA, 21 bp, Homo sapiens
gtgaggtggaattattttaaa

SEQ ID NO: 2955353 - DNA, 20 bp, Homo sapiens
gtgaggtttcccaatggtgt

SEQ ID NO: 2955354 - DNA, 23 bp, Homo sapiens
gtgagtctccccttgcagcctgg

SEQ ID NO: 2955355 - DNA, 22 bp, Homo sapiens
gtgagtctggtggaggagctga

SEQ ID NO: 2955356 - DNA, 20 bp, Homo sapiens
gtgagtgacatagcctcatg

SEQ ID NO: 2955357 - DNA, 17 bp, Homo sapiens
gtgagtgccttttgcag

SEQ ID NO: 2955358 - DNA, 14 bp, Homo sapiens
gtgagtggcatgtg

SEQ ID NO: 2955359 - DNA, 20 bp, Homo sapiens
gtgagtgtgagggcagcact

SEQ ID NO: 2955360 - DNA, 18 bp, Homo sapiens
gtgagtgtgtgtgcatgg

SEQ ID NO: 2955361 - DNA, 14 bp, Homo sapiens
gtgagttctcacta

SEQ ID NO: 2955362 - DNA, 13 bp, Homo sapiens
gtgataaactttg

SEQ ID NO: 2955363 - DNA, 21 bp, Homo sapiens
gtgatacagaactcttaaaaa

SEQ ID NO: 2955364 - DNA, 16 bp, Homo sapiens
gtgatagagcctttga

SEQ ID NO: 2955365 - DNA, 15 bp, Homo sapiens
gtgatatatgtatta

SEQ ID NO: 2955366 - DNA, 20 bp, Homo sapiens
gtgatatattcctaaactat

SEQ ID NO: 2955367 - DNA, 21 bp, Homo sapiens
gtgatatggtactaaggagaa

SEQ ID NO: 2955368 - DNA, 13 bp, Homo sapiens
gtgatattctaag

SEQ ID NO: 2955369 - DNA, 18 bp, Homo sapiens
gtgatatttgacagacat

SEQ ID NO: 2955370 - DNA, 18 bp, Homo sapiens
gtgatcccgttttcccca

SEQ ID NO: 2955371 - DNA, 16 bp, Homo sapiens
gtgatcctcacgcctt

SEQ ID NO: 2955372 - DNA, 21 bp, Homo sapiens
gtgatcctctcacctcagcct

SEQ ID NO: 2955373 - DNA, 12 bp, Homo sapiens
gtgatcttattt

SEQ ID NO: 2955374 - DNA, 16 bp, Homo sapiens
gtgatgaatctacatt

SEQ ID NO: 2955375 - DNA, 21 bp, Homo sapiens
gtgatgaggccgcggcctccc

SEQ ID NO: 2955376 - DNA, 23 bp, Homo sapiens
gtgatgaggccgcggcctccccg

SEQ ID NO: 2955377 - DNA, 12 bp, Homo sapiens
gtgatgcctgcc

SEQ ID NO: 2955378 - DNA, 18 bp, Homo sapiens
gtgatgctttcattatgt

SEQ ID NO: 2955379 - DNA, 19 bp, Homo sapiens
gtgatgggaaggtttttaa

SEQ ID NO: 2955380 - DNA, 16 bp, Homo sapiens
gtgatgggatctgtaa

SEQ ID NO: 2955381 - DNA, 18 bp, Homo sapiens
gtgatgtgcctgtaatct

SEQ ID NO: 2955382 - DNA, 12 bp, Homo sapiens
gtgatgttctaa

SEQ ID NO: 2955383 - DNA, 18 bp, Homo sapiens
gtgatgttctaaggctct

SEQ ID NO: 2955384 - DNA, 14 bp, Homo sapiens
gtgatgtttgtcct

SEQ ID NO: 2955385 - DNA, 18 bp, Homo sapiens
gtgattatttttctcctg

SEQ ID NO: 2955386 - DNA, 20 bp, Homo sapiens
gtgattcccaactcctttct

SEQ ID NO: 2955387 - DNA, 13 bp, Homo sapiens
gtgattctcctgc

SEQ ID NO: 2955388 - DNA, 17 bp, Homo sapiens
gtgattctttttttgtg

SEQ ID NO: 2955389 - DNA, 16 bp, Homo sapiens
gtgatttaatagtgtt

SEQ ID NO: 2955390 - DNA, 19 bp, Homo sapiens
gtgatttaatagtgttaat

SEQ ID NO: 2955391 - DNA, 16 bp, Homo sapiens
gtgattttaactctgt

SEQ ID NO: 2955392 - DNA, 19 bp, Homo sapiens
gtgattttaactctgtctt

SEQ ID NO: 2955393 - DNA, 21 bp, Homo sapiens
gtgattttatgatcagtgttg

SEQ ID NO: 2955394 - DNA, 18 bp, Homo sapiens
gtgattttatttttgcaa

SEQ ID NO: 2955395 - DNA, 20 bp, Homo sapiens
gtgatttttatgccacctga

SEQ ID NO: 2955396 - DNA, 21 bp, Homo sapiens
gtgatttttatgccacctgaa

SEQ ID NO: 2955397 - DNA, 21 bp, Homo sapiens
gtgattttttgttcttgttgt

SEQ ID NO: 2955398 - DNA, 16 bp, Homo sapiens
gtgcaaaaaggactgg

SEQ ID NO: 2955399 - DNA, 13 bp, Homo sapiens
gtgcaaaatgtct

SEQ ID NO: 2955400 - DNA, 17 bp, Homo sapiens
gtgcaacctctgcttcc

SEQ ID NO: 2955401 - DNA, 14 bp, Homo sapiens
gtgcaactcttgta

SEQ ID NO: 2955402 - DNA, 15 bp, Homo sapiens
gtgcaactcttgtat

SEQ ID NO: 2955403 - DNA, 23 bp, Homo sapiens
gtgcaacttagatctctcctgca

SEQ ID NO: 2955404 - DNA, 12 bp, Homo sapiens
gtgcaagagagg

SEQ ID NO: 2955405 - DNA, 21 bp, Homo sapiens
gtgcaataaatctgacccagt

SEQ ID NO: 2955406 - DNA, 22 bp, Homo sapiens
gtgcaataaatctgacccagtg

SEQ ID NO: 2955407 - DNA, 18 bp, Homo sapiens
gtgcaatttcaaggttct

SEQ ID NO: 2955408 - DNA, 19 bp, Homo sapiens
gtgcaatttcaaggttcta

SEQ ID NO: 2955409 - DNA, 20 bp, Homo sapiens
gtgcaatttcaaggttctaa

SEQ ID NO: 2955410 - DNA, 17 bp, Homo sapiens
gtgcacacatcaccagg

SEQ ID NO: 2955411 - DNA, 13 bp, Homo sapiens
gtgcacagccact

SEQ ID NO: 2955412 - DNA, 15 bp, Homo sapiens
gtgcacggttcaatg

SEQ ID NO: 2955413 - DNA, 12 bp, Homo sapiens
gtgcacgttgct

SEQ ID NO: 2955414 - DNA, 21 bp, Homo sapiens
gtgcactgcccatggacaggc

SEQ ID NO: 2955415 - DNA, 13 bp, Homo sapiens
gtgcactttgtaa

SEQ ID NO: 2955416 - DNA, 12 bp, Homo sapiens
gtgcagaatgta

SEQ ID NO: 2955417 - DNA, 22 bp, Homo sapiens
gtgcagaatgtaagtgggccca

SEQ ID NO: 2955418 - DNA, 23 bp, Homo sapiens
gtgcagaccttactcaggggatg

SEQ ID NO: 2955419 - DNA, 20 bp, Homo sapiens
gtgcagagggtttgtgccca

SEQ ID NO: 2955420 - DNA, 19 bp, Homo sapiens
gtgcagaggtaccctgggt

SEQ ID NO: 2955421 - DNA, 16 bp, Homo sapiens
gtgcagatcacttttt

SEQ ID NO: 2955422 - DNA, 19 bp, Homo sapiens
gtgcagatcatccgtctgt

SEQ ID NO: 2955423 - DNA, 14 bp, Homo sapiens
gtgcagcagattgg

SEQ ID NO: 2955424 - DNA, 13 bp, Homo sapiens
gtgcagccagagg

SEQ ID NO: 2955425 - DNA, 15 bp, Homo sapiens
gtgcagccatagttt

SEQ ID NO: 2955426 - DNA, 16 bp, Homo sapiens
gtgcagctaacatgag

SEQ ID NO: 2955427 - DNA, 13 bp, Homo sapiens
gtgcagctgcgtt

SEQ ID NO: 2955428 - DNA, 16 bp, Homo sapiens
gtgcagctgcgttctg

SEQ ID NO: 2955429 - DNA, 15 bp, Homo sapiens
gtgcaggacagctct

SEQ ID NO: 2955430 - DNA, 13 bp, Homo sapiens
gtgcaggctggcc

SEQ ID NO: 2955431 - DNA, 16 bp, Homo sapiens
gtgcaggctggccagc

SEQ ID NO: 2955432 - DNA, 13 bp, Homo sapiens
gtgcagggctggt

SEQ ID NO: 2955433 - DNA, 17 bp, Homo sapiens
gtgcaggggatggggtg

SEQ ID NO: 2955434 - DNA, 15 bp, Homo sapiens
gtgcaggtggggaga

SEQ ID NO: 2955435 - DNA, 16 bp, Homo sapiens
gtgcagtccatttcct

SEQ ID NO: 2955436 - DNA, 12 bp, Homo sapiens
gtgcagtctggg

SEQ ID NO: 2955437 - DNA, 23 bp, Homo sapiens
gtgcagtctttgagataatttgt

SEQ ID NO: 2955438 - DNA, 22 bp, Homo sapiens
gtgcagtgtgagtgtgatgggc

SEQ ID NO: 2955439 - DNA, 21 bp, Homo sapiens
gtgcatagcgtcctgccctgc

SEQ ID NO: 2955440 - DNA, 20 bp, Homo sapiens
gtgcatattgtacacttttt

SEQ ID NO: 2955441 - DNA, 13 bp, Homo sapiens
gtgcatgctctct

SEQ ID NO: 2955442 - DNA, 15 bp, Homo sapiens
gtgcatgctctctgc

SEQ ID NO: 2955443 - DNA, 19 bp, Homo sapiens
gtgcatgctctctgcagcc

SEQ ID NO: 2955444 - DNA, 14 bp, Homo sapiens
gtgcatggtggcac

SEQ ID NO: 2955445 - DNA, 17 bp, Homo sapiens
gtgcatgtgcgtggaag

SEQ ID NO: 2955446 - DNA, 17 bp, Homo sapiens
gtgcattgggattttag

SEQ ID NO: 2955447 - DNA, 19 bp, Homo sapiens
gtgcattgggattttagaa

SEQ ID NO: 2955448 - DNA, 15 bp, Homo sapiens
gtgcattgtttctgt

SEQ ID NO: 2955449 - DNA, 23 bp, Homo sapiens
gtgcatttgtgctagaaattttc

SEQ ID NO: 2955450 - DNA, 20 bp, Homo sapiens
gtgcatttttggatcatttt

SEQ ID NO: 2955451 - DNA, 21 bp, Homo sapiens
gtgccaaagaaagtggtctta

SEQ ID NO: 2955452 - DNA, 19 bp, Homo sapiens
gtgccaaccccacccagct

SEQ ID NO: 2955453 - DNA, 22 bp, Homo sapiens
gtgccaagtcctagctcctcct

SEQ ID NO: 2955454 - DNA, 12 bp, Homo sapiens
gtgccaattttg

SEQ ID NO: 2955455 - DNA, 19 bp, Homo sapiens
gtgccactgcactccaggc

SEQ ID NO: 2955456 - DNA, 12 bp, Homo sapiens
gtgccagcagcc

SEQ ID NO: 2955457 - DNA, 18 bp, Homo sapiens
gtgccagcagcccttgtt

SEQ ID NO: 2955458 - DNA, 20 bp, Homo sapiens
gtgccagcagcccttgttta

SEQ ID NO: 2955459 - DNA, 23 bp, Homo sapiens
gtgccagcagcctcgcacaggcc

SEQ ID NO: 2955460 - DNA, 15 bp, Homo sapiens
gtgccagcccctgct

SEQ ID NO: 2955461 - DNA, 19 bp, Homo sapiens
gtgccaggaaactcttgct

SEQ ID NO: 2955462 - DNA, 13 bp, Homo sapiens
gtgccaggaccag

SEQ ID NO: 2955463 - DNA, 16 bp, Homo sapiens
gtgccaggcttgcctg

SEQ ID NO: 2955464 - DNA, 22 bp, Homo sapiens
gtgccaggcttgcctgggctgg

SEQ ID NO: 2955465 - DNA, 22 bp, Homo sapiens
gtgccatacatgttattgtttt

SEQ ID NO: 2955466 - DNA, 17 bp, Homo sapiens
gtgccatggatttccac

SEQ ID NO: 2955467 - DNA, 19 bp, Homo sapiens
gtgccattgtactccagcc

SEQ ID NO: 2955468 - DNA, 22 bp, Homo sapiens
gtgccattgtactccagcctgg

SEQ ID NO: 2955469 - DNA, 23 bp, Homo sapiens
gtgcccagctatacctgtgcctc

SEQ ID NO: 2955470 - DNA, 15 bp, Homo sapiens
gtgcccaggccagct

SEQ ID NO: 2955471 - DNA, 22 bp, Homo sapiens
gtgcccatcatctctgcctttg

SEQ ID NO: 2955472 - DNA, 19 bp, Homo sapiens
gtgccccagactgagctct

SEQ ID NO: 2955473 - DNA, 20 bp, Homo sapiens
gtgccccagactgagctctc

SEQ ID NO: 2955474 - DNA, 12 bp, Homo sapiens
gtgccccaggac

SEQ ID NO: 2955475 - DNA, 21 bp, Homo sapiens
gtgccccaggaccagctcagg

SEQ ID NO: 2955476 - DNA, 13 bp, Homo sapiens
gtgcccccactga

SEQ ID NO: 2955477 - DNA, 18 bp, Homo sapiens
gtgcccccactgaccaga

SEQ ID NO: 2955478 - DNA, 22 bp, Homo sapiens
gtgccccgcgggctttgttgct

SEQ ID NO: 2955479 - DNA, 21 bp, Homo sapiens
gtgcccctctccttcttagct

SEQ ID NO: 2955480 - DNA, 21 bp, Homo sapiens
gtgccctcctgggagctcatg

SEQ ID NO: 2955481 - DNA, 12 bp, Homo sapiens
gtgccctgcccc

SEQ ID NO: 2955482 - DNA, 19 bp, Homo sapiens
gtgcccttttccagcctca

SEQ ID NO: 2955483 - DNA, 16 bp, Homo sapiens
gtgccgcactctggcg

SEQ ID NO: 2955484 - DNA, 15 bp, Homo sapiens
gtgccgggcccccac

SEQ ID NO: 2955485 - DNA, 18 bp, Homo sapiens
gtgccgttactctccaac

SEQ ID NO: 2955486 - DNA, 21 bp, Homo sapiens
gtgccgttactctccaacctg

SEQ ID NO: 2955487 - DNA, 22 bp, Homo sapiens
gtgccgttactctccaacctgg

SEQ ID NO: 2955488 - DNA, 15 bp, Homo sapiens
gtgcctcaagaggaa

SEQ ID NO: 2955489 - DNA, 17 bp, Homo sapiens
gtgcctcccgagaaatt

SEQ ID NO: 2955490 - DNA, 18 bp, Homo sapiens
gtgcctcctagccccttc

SEQ ID NO: 2955491 - DNA, 22 bp, Homo sapiens
gtgcctcggcttttctcagctg

SEQ ID NO: 2955492 - DNA, 13 bp, Homo sapiens
gtgcctctgtcct

SEQ ID NO: 2955493 - DNA, 15 bp, Homo sapiens
gtgcctctgtcctta

SEQ ID NO: 2955494 - DNA, 15 bp, Homo sapiens
gtgcctgaagacccc

SEQ ID NO: 2955495 - DNA, 18 bp, Homo sapiens
gtgcctgaagaccccaga

SEQ ID NO: 2955496 - DNA, 14 bp, Homo sapiens
gtgcctgagcccct

SEQ ID NO: 2955497 - DNA, 16 bp, Homo sapiens
gtgcctgagcccctca

SEQ ID NO: 2955498 - DNA, 19 bp, Homo sapiens
gtgcctgctttgacgggcc

SEQ ID NO: 2955499 - DNA, 21 bp, Homo sapiens
gtgcctgctttgacgggccag

SEQ ID NO: 2955500 - DNA, 12 bp, Homo sapiens
gtgcctggcctg

SEQ ID NO: 2955501 - DNA, 11 bp, Homo sapiens
gtgcctgggcc

SEQ ID NO: 2955502 - DNA, 19 bp, Homo sapiens
gtgcctgggcccctcccct

SEQ ID NO: 2955503 - DNA, 21 bp, Homo sapiens
gtgcctgggcccctcccctca

SEQ ID NO: 2955504 - DNA, 22 bp, Homo sapiens
gtgcctgggcccctcccctcag

SEQ ID NO: 2955505 - DNA, 16 bp, Homo sapiens
gtgcctgggggagaga

SEQ ID NO: 2955506 - DNA, 22 bp, Homo sapiens
gtgcctgggtggggctgctcct

SEQ ID NO: 2955507 - DNA, 14 bp, Homo sapiens
gtgcctgtgtgcgt

SEQ ID NO: 2955508 - DNA, 18 bp, Homo sapiens
gtgccttacctcctgccc

SEQ ID NO: 2955509 - DNA, 19 bp, Homo sapiens
gtgccttacctcctgccca

SEQ ID NO: 2955510 - DNA, 20 bp, Homo sapiens
gtgccttacctcctgcccag

SEQ ID NO: 2955511 - DNA, 16 bp, Homo sapiens
gtgccttctctcagct

SEQ ID NO: 2955512 - DNA, 21 bp, Homo sapiens
gtgccttctctcagctcccag

SEQ ID NO: 2955513 - DNA, 22 bp, Homo sapiens
gtgccttctctcagctcccagg

SEQ ID NO: 2955514 - DNA, 23 bp, Homo sapiens
gtgccttctctcagctcccaggc

SEQ ID NO: 2955515 - DNA, 15 bp, Homo sapiens
gtgccttctgggaag

SEQ ID NO: 2955516 - DNA, 23 bp, Homo sapiens
gtgccttcttattctcactccac

SEQ ID NO: 2955517 - DNA, 19 bp, Homo sapiens
gtgccttcttcagggcctg

SEQ ID NO: 2955518 - DNA, 17 bp, Homo sapiens
gtgccttggtctctcct

SEQ ID NO: 2955519 - DNA, 16 bp, Homo sapiens
gtgcctttatctcagc

SEQ ID NO: 2955520 - DNA, 20 bp, Homo sapiens
gtgcctttatctcagccatc

SEQ ID NO: 2955521 - DNA, 18 bp, Homo sapiens
gtgcctttcaaatttaga

SEQ ID NO: 2955522 - DNA, 14 bp, Homo sapiens
gtgcctttttcctt

SEQ ID NO: 2955523 - DNA, 20 bp, Homo sapiens
gtgcgcatcttgcctccagg

SEQ ID NO: 2955524 - DNA, 17 bp, Homo sapiens
gtgcgcgtggcgtggcc

SEQ ID NO: 2955525 - DNA, 13 bp, Homo sapiens
gtgcggcctgggg

SEQ ID NO: 2955526 - DNA, 17 bp, Homo sapiens
gtgcggcgtggagactg

SEQ ID NO: 2955527 - DNA, 23 bp, Homo sapiens
gtgcggcgtggagactggcaggc

SEQ ID NO: 2955528 - DNA, 22 bp, Homo sapiens
gtgcgtggaagtgttcctgtct

SEQ ID NO: 2955529 - DNA, 21 bp, Homo sapiens
gtgcgtggcttccctgtccca

SEQ ID NO: 2955530 - DNA, 16 bp, Homo sapiens
gtgcgtgtatatgtgc

SEQ ID NO: 2955531 - DNA, 14 bp, Homo sapiens
gtgcgtgtttgcac

SEQ ID NO: 2955532 - DNA, 14 bp, Homo sapiens
gtgctaaaaatggg

SEQ ID NO: 2955533 - DNA, 20 bp, Homo sapiens
gtgctaaagttttcttccca

SEQ ID NO: 2955534 - DNA, 13 bp, Homo sapiens
gtgctaaggttct

SEQ ID NO: 2955535 - DNA, 13 bp, Homo sapiens
gtgctaatatttt

SEQ ID NO: 2955536 - DNA, 21 bp, Homo sapiens
gtgctacacccttttccagct

SEQ ID NO: 2955537 - DNA, 16 bp, Homo sapiens
gtgctacagaaagcac

SEQ ID NO: 2955538 - DNA, 15 bp, Homo sapiens
gtgctacagagaaaa

SEQ ID NO: 2955539 - DNA, 18 bp, Homo sapiens
gtgctacgtgtgaaatct

SEQ ID NO: 2955540 - DNA, 23 bp, Homo sapiens
gtgctacgtgtgaaatctgtctt

SEQ ID NO: 2955541 - DNA, 21 bp, Homo sapiens
gtgctagtcactggcagcctg

SEQ ID NO: 2955542 - DNA, 22 bp, Homo sapiens
gtgctagtcactggcagcctgc

SEQ ID NO: 2955543 - DNA, 21 bp, Homo sapiens
gtgctatgacatggaggcact

SEQ ID NO: 2955544 - DNA, 19 bp, Homo sapiens
gtgctatggatggcttcta

SEQ ID NO: 2955545 - DNA, 14 bp, Homo sapiens
gtgctatttcagca

SEQ ID NO: 2955546 - DNA, 18 bp, Homo sapiens
gtgctcaagcagcaaaat

SEQ ID NO: 2955547 - DNA, 18 bp, Homo sapiens
gtgctcaggactcagaag

SEQ ID NO: 2955548 - DNA, 22 bp, Homo sapiens
gtgctcaggactcagaagcctc

SEQ ID NO: 2955549 - DNA, 9 bp, Homo sapiens
gtgctcagt

SEQ ID NO: 2955550 - DNA, 16 bp, Homo sapiens
gtgctcagtcgccctg

SEQ ID NO: 2955551 - DNA, 13 bp, Homo sapiens
gtgctcagttgta

SEQ ID NO: 2955552 - DNA, 14 bp, Homo sapiens
gtgctccaaatgat

SEQ ID NO: 2955553 - DNA, 20 bp, Homo sapiens
gtgctcccaaaacattttaa

SEQ ID NO: 2955554 - DNA, 23 bp, Homo sapiens
gtgctcccacggggaccactggg

SEQ ID NO: 2955555 - DNA, 15 bp, Homo sapiens
gtgctccctaccacc

SEQ ID NO: 2955556 - DNA, 14 bp, Homo sapiens
gtgctccctctgtc

SEQ ID NO: 2955557 - DNA, 14 bp, Homo sapiens
gtgctcctccttgg

SEQ ID NO: 2955558 - DNA, 14 bp, Homo sapiens
gtgctcgccctgcg

SEQ ID NO: 2955559 - DNA, 19 bp, Homo sapiens
gtgctcgggaagggagggg

SEQ ID NO: 2955560 - DNA, 22 bp, Homo sapiens
gtgctcgggaagggaggggaag

SEQ ID NO: 2955561 - DNA, 18 bp, Homo sapiens
gtgctctgcctctaactc

SEQ ID NO: 2955562 - DNA, 20 bp, Homo sapiens
gtgctgacaatactgctgcc

SEQ ID NO: 2955563 - DNA, 16 bp, Homo sapiens
gtgctgacagctgctc

SEQ ID NO: 2955564 - DNA, 16 bp, Homo sapiens
gtgctgacggccaggg

SEQ ID NO: 2955565 - DNA, 21 bp, Homo sapiens
gtgctgacggccagggagaag

SEQ ID NO: 2955566 - DNA, 22 bp, Homo sapiens
gtgctgcagcaccgaggggcct

SEQ ID NO: 2955567 - DNA, 14 bp, Homo sapiens
gtgctgcatgcgat

SEQ ID NO: 2955568 - DNA, 17 bp, Homo sapiens
gtgctgcttgtgcctcc

SEQ ID NO: 2955569 - DNA, 18 bp, Homo sapiens
gtgctgcttgtgcctccc

SEQ ID NO: 2955570 - DNA, 20 bp, Homo sapiens
gtgctggcccacccagtcca

SEQ ID NO: 2955571 - DNA, 15 bp, Homo sapiens
gtgctggcccagcat

SEQ ID NO: 2955572 - DNA, 17 bp, Homo sapiens
gtgctggcgacactcag

SEQ ID NO: 2955573 - DNA, 22 bp, Homo sapiens
gtgctgggaacctcagggtatt

SEQ ID NO: 2955574 - DNA, 20 bp, Homo sapiens
gtgctgggattacagccgtg

SEQ ID NO: 2955575 - DNA, 17 bp, Homo sapiens
gtgctgggtgagctctt

SEQ ID NO: 2955576 - DNA, 18 bp, Homo sapiens
gtgctggtagctgagggg

SEQ ID NO: 2955577 - DNA, 13 bp, Homo sapiens
gtgctgtgtaaag

SEQ ID NO: 2955578 - DNA, 15 bp, Homo sapiens
gtgctgtgtaaagtt

SEQ ID NO: 2955579 - DNA, 16 bp, Homo sapiens
gtgctgtgtaaagtta

SEQ ID NO: 2955580 - DNA, 17 bp, Homo sapiens
gtgcttcgggcccttcc

SEQ ID NO: 2955581 - DNA, 19 bp, Homo sapiens
gtgcttctccaacactgaa

SEQ ID NO: 2955582 - DNA, 15 bp, Homo sapiens
gtgcttcttgtaata

SEQ ID NO: 2955583 - DNA, 22 bp, Homo sapiens
gtgcttggcacatagtgggcct

SEQ ID NO: 2955584 - DNA, 23 bp, Homo sapiens
gtgcttggcacatagtgggcctt

SEQ ID NO: 2955585 - DNA, 20 bp, Homo sapiens
gtgcttgggggtttttgaag

SEQ ID NO: 2955586 - DNA, 13 bp, Homo sapiens
gtgctttatattt

SEQ ID NO: 2955587 - DNA, 22 bp, Homo sapiens
gtgctttccgtggcactgcata

SEQ ID NO: 2955588 - DNA, 19 bp, Homo sapiens
gtgctttccttttttaaaa

SEQ ID NO: 2955589 - DNA, 20 bp, Homo sapiens
gtgctttccttttttaaaaa

SEQ ID NO: 2955590 - DNA, 13 bp, Homo sapiens
gtgctttgaaaaa

SEQ ID NO: 2955591 - DNA, 15 bp, Homo sapiens
gtgcttttagtaaaa

SEQ ID NO: 2955592 - DNA, 13 bp, Homo sapiens
gtggaaaaaacat

SEQ ID NO: 2955593 - DNA, 17 bp, Homo sapiens
gtggaaaaaacatttta

SEQ ID NO: 2955594 - DNA, 23 bp, Homo sapiens
gtggaaaagccaagaggctgcag

SEQ ID NO: 2955595 - DNA, 15 bp, Homo sapiens
gtggaaagtgtaaag

SEQ ID NO: 2955596 - DNA, 14 bp, Homo sapiens
gtggaagccctcct

SEQ ID NO: 2955597 - DNA, 15 bp, Homo sapiens
gtggaagtgttcctg

SEQ ID NO: 2955598 - DNA, 19 bp, Homo sapiens
gtggaagtgttcctgtctc

SEQ ID NO: 2955599 - DNA, 13 bp, Homo sapiens
gtggaatataaag

SEQ ID NO: 2955600 - DNA, 18 bp, Homo sapiens
gtggaatataaggaaagc

SEQ ID NO: 2955601 - DNA, 16 bp, Homo sapiens
gtggaattattttaaa

SEQ ID NO: 2955602 - DNA, 18 bp, Homo sapiens
gtggacaggatgaggaca

SEQ ID NO: 2955603 - DNA, 20 bp, Homo sapiens
gtggacaggatgaggacaga

SEQ ID NO: 2955604 - DNA, 13 bp, Homo sapiens
gtggaccaggaca

SEQ ID NO: 2955605 - DNA, 18 bp, Homo sapiens
gtggaccaggacaggacc

SEQ ID NO: 2955606 - DNA, 13 bp, Homo sapiens
gtggacctggcag

SEQ ID NO: 2955607 - DNA, 18 bp, Homo sapiens
gtggacggcgctgcctca

SEQ ID NO: 2955608 - DNA, 14 bp, Homo sapiens
gtggactcagggca

SEQ ID NO: 2955609 - DNA, 15 bp, Homo sapiens
gtggactcagggcag

SEQ ID NO: 2955610 - DNA, 21 bp, Homo sapiens
gtggactcagggcagcgccag

SEQ ID NO: 2955611 - DNA, 20 bp, Homo sapiens
gtggactgaccttgtaaaag

SEQ ID NO: 2955612 - DNA, 21 bp, Homo sapiens
gtggactgagcgaggaaaaac

SEQ ID NO: 2955613 - DNA, 13 bp, Homo sapiens
gtggactggaagg

SEQ ID NO: 2955614 - DNA, 14 bp, Homo sapiens
gtggactgtggcac

SEQ ID NO: 2955615 - DNA, 20 bp, Homo sapiens
gtggagaagatcgcatggca

SEQ ID NO: 2955616 - DNA, 15 bp, Homo sapiens
gtggagaagcacact

SEQ ID NO: 2955617 - DNA, 12 bp, Homo sapiens
gtggagaagcca

SEQ ID NO: 2955618 - DNA, 12 bp, Homo sapiens
gtggagagacca

SEQ ID NO: 2955619 - DNA, 12 bp, Homo sapiens
gtggagccaggc

SEQ ID NO: 2955620 - DNA, 13 bp, Homo sapiens
gtggagccaggcg

SEQ ID NO: 2955621 - DNA, 21 bp, Homo sapiens
gtggagccttttaactgtgca

SEQ ID NO: 2955622 - DNA, 19 bp, Homo sapiens
gtggagctgagaagaggag

SEQ ID NO: 2955623 - DNA, 13 bp, Homo sapiens
gtggaggcctcag

SEQ ID NO: 2955624 - DNA, 23 bp, Homo sapiens
gtggagggacaagtggactcagg

SEQ ID NO: 2955625 - DNA, 12 bp, Homo sapiens
gtggagggaggc

SEQ ID NO: 2955626 - DNA, 15 bp, Homo sapiens
gtggagggaggcccc

SEQ ID NO: 2955627 - DNA, 22 bp, Homo sapiens
gtggaggttaaggctgaggaaa

SEQ ID NO: 2955628 - DNA, 18 bp, Homo sapiens
gtggaggttgagtgagcc

SEQ ID NO: 2955629 - DNA, 13 bp, Homo sapiens
gtggagtcccaga

SEQ ID NO: 2955630 - DNA, 15 bp, Homo sapiens
gtggagtcccagagc

SEQ ID NO: 2955631 - DNA, 14 bp, Homo sapiens
gtggagtgcagtgg

SEQ ID NO: 2955632 - DNA, 16 bp, Homo sapiens
gtggataacaaagata

SEQ ID NO: 2955633 - DNA, 15 bp, Homo sapiens
gtggatcacagaggc

SEQ ID NO: 2955634 - DNA, 16 bp, Homo sapiens
gtggatcacagaggct

SEQ ID NO: 2955635 - DNA, 15 bp, Homo sapiens
gtggatcacctgagg

SEQ ID NO: 2955636 - DNA, 14 bp, Homo sapiens
gtggatctggggac

SEQ ID NO: 2955637 - DNA, 15 bp, Homo sapiens
gtggatgggaatttg

SEQ ID NO: 2955638 - DNA, 23 bp, Homo sapiens
gtggatgggttttatgagatgga

SEQ ID NO: 2955639 - DNA, 17 bp, Homo sapiens
gtggatggtgacttttg

SEQ ID NO: 2955640 - DNA, 21 bp, Homo sapiens
gtggattaaacttatgaatgt

SEQ ID NO: 2955641 - DNA, 16 bp, Homo sapiens
gtggattctccctggg

SEQ ID NO: 2955642 - DNA, 13 bp, Homo sapiens
gtggcacatctgt

SEQ ID NO: 2955643 - DNA, 16 bp, Homo sapiens
gtggcacgcacctgta

SEQ ID NO: 2955644 - DNA, 20 bp, Homo sapiens
gtggcagacatatcacaaga

SEQ ID NO: 2955645 - DNA, 18 bp, Homo sapiens
gtggcagggcctagctgc

SEQ ID NO: 2955646 - DNA, 22 bp, Homo sapiens
gtggcagggcctagctgctaca

SEQ ID NO: 2955647 - DNA, 20 bp, Homo sapiens
gtggcaggtcactgtcactg

SEQ ID NO: 2955648 - DNA, 20 bp, Homo sapiens
gtggcatcaccttaggcagg

SEQ ID NO: 2955649 - DNA, 16 bp, Homo sapiens
gtggcatgcacctgca

SEQ ID NO: 2955650 - DNA, 14 bp, Homo sapiens
gtggccaagaagat

SEQ ID NO: 2955651 - DNA, 17 bp, Homo sapiens
gtggccaaggagctgct

SEQ ID NO: 2955652 - DNA, 18 bp, Homo sapiens
gtggccaaggagctgcta

SEQ ID NO: 2955653 - DNA, 18 bp, Homo sapiens
gtggccacagcgtgctgg

SEQ ID NO: 2955654 - DNA, 13 bp, Homo sapiens
gtggccaccagta

SEQ ID NO: 2955655 - DNA, 20 bp, Homo sapiens
gtggccaccgggggtggctc

SEQ ID NO: 2955656 - DNA, 19 bp, Homo sapiens
gtggccatcactcagcccc

SEQ ID NO: 2955657 - DNA, 20 bp, Homo sapiens
gtggccatcactcagcccct

SEQ ID NO: 2955658 - DNA, 21 bp, Homo sapiens
gtggccatcactcagccccta

SEQ ID NO: 2955659 - DNA, 12 bp, Homo sapiens
gtggccatggcc

SEQ ID NO: 2955660 - DNA, 13 bp, Homo sapiens
gtggcccaggacc

SEQ ID NO: 2955661 - DNA, 21 bp, Homo sapiens
gtggcccaggtggctattttg

SEQ ID NO: 2955662 - DNA, 21 bp, Homo sapiens
gtggcccccgccccctcccta

SEQ ID NO: 2955663 - DNA, 23 bp, Homo sapiens
gtggccctgactgtcagggaggg

SEQ ID NO: 2955664 - DNA, 16 bp, Homo sapiens
gtggccctggcctgct

SEQ ID NO: 2955665 - DNA, 14 bp, Homo sapiens
gtggccctgtcctg

SEQ ID NO: 2955666 - DNA, 16 bp, Homo sapiens
gtggccgcacgcctct

SEQ ID NO: 2955667 - DNA, 14 bp, Homo sapiens
gtggccgccatctg

SEQ ID NO: 2955668 - DNA, 17 bp, Homo sapiens
gtggccgcccaaggccc

SEQ ID NO: 2955669 - DNA, 15 bp, Homo sapiens
gtggccgcccctgag

SEQ ID NO: 2955670 - DNA, 14 bp, Homo sapiens
gtggccgggcacag

SEQ ID NO: 2955671 - DNA, 21 bp, Homo sapiens
gtggcctaacctgccgagagt

SEQ ID NO: 2955672 - DNA, 19 bp, Homo sapiens
gtggcctaccttgtgaggg

SEQ ID NO: 2955673 - DNA, 20 bp, Homo sapiens
gtggcctaccttgtgaggga

SEQ ID NO: 2955674 - DNA, 21 bp, Homo sapiens
gtggcctccttgcttgttaca

SEQ ID NO: 2955675 - DNA, 13 bp, Homo sapiens
gtggcctctttgt

SEQ ID NO: 2955676 - DNA, 19 bp, Homo sapiens
gtggcctctttgtctaaaa

SEQ ID NO: 2955677 - DNA, 18 bp, Homo sapiens
gtggcctggcatctgtgc

SEQ ID NO: 2955678 - DNA, 16 bp, Homo sapiens
gtggcctgggcttggc

SEQ ID NO: 2955679 - DNA, 18 bp, Homo sapiens
gtggcctgggcttggccc

SEQ ID NO: 2955680 - DNA, 15 bp, Homo sapiens
gtggcctggtccctg

SEQ ID NO: 2955681 - DNA, 14 bp, Homo sapiens
gtggcctggtgcac

SEQ ID NO: 2955682 - DNA, 15 bp, Homo sapiens
gtggcctgtgtggcc

SEQ ID NO: 2955683 - DNA, 14 bp, Homo sapiens
gtggcggggtgggg

SEQ ID NO: 2955684 - DNA, 16 bp, Homo sapiens
gtggcggggtggggtg

SEQ ID NO: 2955685 - DNA, 17 bp, Homo sapiens
gtggctaagggggacca

SEQ ID NO: 2955686 - DNA, 20 bp, Homo sapiens
gtggctagtcaagctcctcc

SEQ ID NO: 2955687 - DNA, 22 bp, Homo sapiens
gtggctagtcaagctcctcctc

SEQ ID NO: 2955688 - DNA, 23 bp, Homo sapiens
gtggctagtcaagctcctcctcc

SEQ ID NO: 2955689 - DNA, 19 bp, Homo sapiens
gtggctagtcagagagagt

SEQ ID NO: 2955690 - DNA, 15 bp, Homo sapiens
gtggctccagcacca

SEQ ID NO: 2955691 - DNA, 21 bp, Homo sapiens
gtggctccccctctgcttctc

SEQ ID NO: 2955692 - DNA, 16 bp, Homo sapiens
gtggctccctctctcc

SEQ ID NO: 2955693 - DNA, 18 bp, Homo sapiens
gtggctcgggaggcgaag

SEQ ID NO: 2955694 - DNA, 17 bp, Homo sapiens
gtggctgacccagtccc

SEQ ID NO: 2955695 - DNA, 19 bp, Homo sapiens
gtggctgacccagtccctg

SEQ ID NO: 2955696 - DNA, 17 bp, Homo sapiens
gtggctgagcccctgtc

SEQ ID NO: 2955697 - DNA, 16 bp, Homo sapiens
gtggctgcctcattta

SEQ ID NO: 2955698 - DNA, 15 bp, Homo sapiens
gtggctgcctggagc

SEQ ID NO: 2955699 - DNA, 16 bp, Homo sapiens
gtggctgcctggagcc

SEQ ID NO: 2955700 - DNA, 19 bp, Homo sapiens
gtggctgcgtgcccctgct

SEQ ID NO: 2955701 - DNA, 12 bp, Homo sapiens
gtggctgtctgg

SEQ ID NO: 2955702 - DNA, 14 bp, Homo sapiens
gtggcttctctgtc

SEQ ID NO: 2955703 - DNA, 22 bp, Homo sapiens
gtggcttctctgtctctgtgga

SEQ ID NO: 2955704 - DNA, 18 bp, Homo sapiens
gtggctttggcagtgttt

SEQ ID NO: 2955705 - DNA, 14 bp, Homo sapiens
gtgggaaaaaagaa

SEQ ID NO: 2955706 - DNA, 14 bp, Homo sapiens
gtgggaactggagg

SEQ ID NO: 2955707 - DNA, 13 bp, Homo sapiens
gtgggaaggccag

SEQ ID NO: 2955708 - DNA, 14 bp, Homo sapiens
gtgggaccccaggc

SEQ ID NO: 2955709 - DNA, 17 bp, Homo sapiens
gtgggaccccaggccca

SEQ ID NO: 2955710 - DNA, 12 bp, Homo sapiens
gtgggagatgaa

SEQ ID NO: 2955711 - DNA, 22 bp, Homo sapiens
gtgggaggaaagggcctggcca

SEQ ID NO: 2955712 - DNA, 15 bp, Homo sapiens
gtgggagggtaccag

SEQ ID NO: 2955713 - DNA, 16 bp, Homo sapiens
gtgggagggtaccagc

SEQ ID NO: 2955714 - DNA, 17 bp, Homo sapiens
gtgggaggttgtgcatg

SEQ ID NO: 2955715 - DNA, 16 bp, Homo sapiens
gtgggatggaggagaa

SEQ ID NO: 2955716 - DNA, 17 bp, Homo sapiens
gtgggatggaggagaag

SEQ ID NO: 2955717 - DNA, 20 bp, Homo sapiens
gtgggatgtggttttcttaa

SEQ ID NO: 2955718 - DNA, 15 bp, Homo sapiens
gtgggattcagagaa

SEQ ID NO: 2955719 - DNA, 18 bp, Homo sapiens
gtgggatttttcagaaaa

SEQ ID NO: 2955720 - DNA, 12 bp, Homo sapiens
gtgggcaggtgg

SEQ ID NO: 2955721 - DNA, 14 bp, Homo sapiens
gtgggcaggtggcc

SEQ ID NO: 2955722 - DNA, 21 bp, Homo sapiens
gtgggcaggtggccgcccctg

SEQ ID NO: 2955723 - DNA, 19 bp, Homo sapiens
gtgggcattttgacaacat

SEQ ID NO: 2955724 - DNA, 17 bp, Homo sapiens
gtgggccaacaaagaac

SEQ ID NO: 2955725 - DNA, 18 bp, Homo sapiens
gtgggccctgcaggctgc

SEQ ID NO: 2955726 - DNA, 13 bp, Homo sapiens
gtgggcctggcca

SEQ ID NO: 2955727 - DNA, 19 bp, Homo sapiens
gtgggcggatcacaaggtc

SEQ ID NO: 2955728 - DNA, 20 bp, Homo sapiens
gtgggcggatcacaaggtca

SEQ ID NO: 2955729 - DNA, 22 bp, Homo sapiens
gtgggcggatcacaaggtcagg

SEQ ID NO: 2955730 - DNA, 13 bp, Homo sapiens
gtgggctccctga

SEQ ID NO: 2955731 - DNA, 21 bp, Homo sapiens
gtgggctgcacgctcccctcc

SEQ ID NO: 2955732 - DNA, 23 bp, Homo sapiens
gtgggctgcacgctcccctccat

SEQ ID NO: 2955733 - DNA, 16 bp, Homo sapiens
gtgggcttcagggcag

SEQ ID NO: 2955734 - DNA, 14 bp, Homo sapiens
gtgggcttgattct

SEQ ID NO: 2955735 - DNA, 17 bp, Homo sapiens
gtggggagactgggctg

SEQ ID NO: 2955736 - DNA, 18 bp, Homo sapiens
gtggggaggctgcactgg

SEQ ID NO: 2955737 - DNA, 15 bp, Homo sapiens
gtggggctgagctgg

SEQ ID NO: 2955738 - DNA, 18 bp, Homo sapiens
gtggggctgagctgggga

SEQ ID NO: 2955739 - DNA, 12 bp, Homo sapiens
gtggggctgctc

SEQ ID NO: 2955740 - DNA, 14 bp, Homo sapiens
gtggggctgctcct

SEQ ID NO: 2955741 - DNA, 16 bp, Homo sapiens
gtggggctgctcctcc

SEQ ID NO: 2955742 - DNA, 15 bp, Homo sapiens
gtgggggccaggcct

SEQ ID NO: 2955743 - DNA, 15 bp, Homo sapiens
gtgggggctggaggt

SEQ ID NO: 2955744 - DNA, 21 bp, Homo sapiens
gtgggggggagaaggcctccc

SEQ ID NO: 2955745 - DNA, 15 bp, Homo sapiens
gtgggggtgggcagc

SEQ ID NO: 2955746 - DNA, 21 bp, Homo sapiens
gtggggtagaggaagacgaga

SEQ ID NO: 2955747 - DNA, 19 bp, Homo sapiens
gtggggtcatgccctcctc

SEQ ID NO: 2955748 - DNA, 21 bp, Homo sapiens
gtggggtcatgccctcctctc

SEQ ID NO: 2955749 - DNA, 21 bp, Homo sapiens
gtggggtctccctctcctgcc

SEQ ID NO: 2955750 - DNA, 22 bp, Homo sapiens
gtggggtctccctctcctgcct

SEQ ID NO: 2955751 - DNA, 20 bp, Homo sapiens
gtggggtgaacagctggtgc

SEQ ID NO: 2955752 - DNA, 19 bp, Homo sapiens
gtggggtgatggccagagg

SEQ ID NO: 2955753 - DNA, 18 bp, Homo sapiens
gtggggtttcgcagcctg

SEQ ID NO: 2955754 - DNA, 22 bp, Homo sapiens
gtggggtttcgcagcctgagtc

SEQ ID NO: 2955755 - DNA, 13 bp, Homo sapiens
gtgggtaaaatta

SEQ ID NO: 2955756 - DNA, 17 bp, Homo sapiens
gtgggtccgcatccctg

SEQ ID NO: 2955757 - DNA, 14 bp, Homo sapiens
gtgggtctctggaa

SEQ ID NO: 2955758 - DNA, 13 bp, Homo sapiens
gtgggtctgggag

SEQ ID NO: 2955759 - DNA, 13 bp, Homo sapiens
gtgggttgctaac

SEQ ID NO: 2955760 - DNA, 16 bp, Homo sapiens
gtgggttttcttccca

SEQ ID NO: 2955761 - DNA, 22 bp, Homo sapiens
gtggtaaatgccacacaccttt

SEQ ID NO: 2955762 - DNA, 23 bp, Homo sapiens
gtggtaggtactttttgtgaaga

SEQ ID NO: 2955763 - DNA, 20 bp, Homo sapiens
gtggtagtaaaacacagagg

SEQ ID NO: 2955764 - DNA, 15 bp, Homo sapiens
gtggtattctgtcat

SEQ ID NO: 2955765 - DNA, 18 bp, Homo sapiens
gtggtcagcggtatgtgc

SEQ ID NO: 2955766 - DNA, 24 bp, Homo sapiens
gtggtcccaacaggaggacaattc

SEQ ID NO: 2955767 - DNA, 18 bp, Homo sapiens
gtggtctcgatgctgctg

SEQ ID NO: 2955768 - DNA, 15 bp, Homo sapiens
gtggtctgcaggcag

SEQ ID NO: 2955769 - DNA, 16 bp, Homo sapiens
gtggtctgcaggcagg

SEQ ID NO: 2955770 - DNA, 23 bp, Homo sapiens
gtggtgccatcattgctgtctgc

SEQ ID NO: 2955771 - DNA, 22 bp, Homo sapiens
gtggtgccatccccagggggca

SEQ ID NO: 2955772 - DNA, 18 bp, Homo sapiens
gtggtgctcagttgtaga

SEQ ID NO: 2955773 - DNA, 17 bp, Homo sapiens
gtggtggcagggcctag

SEQ ID NO: 2955774 - DNA, 21 bp, Homo sapiens
gtggtggcagggcctagctgc

SEQ ID NO: 2955775 - DNA, 14 bp, Homo sapiens
gtggtgggcgctgg

SEQ ID NO: 2955776 - DNA, 19 bp, Homo sapiens
gtggtggtaaccctggtgg

SEQ ID NO: 2955777 - DNA, 20 bp, Homo sapiens
gtggtggtaaccctggtggt

SEQ ID NO: 2955778 - DNA, 11 bp, Homo sapiens
gtggtgtcact

SEQ ID NO: 2955779 - DNA, 23 bp, Homo sapiens
gtggtgtcactgtccctcctggt

SEQ ID NO: 2955780 - DNA, 17 bp, Homo sapiens
gtggtgtcatttttgaa

SEQ ID NO: 2955781 - DNA, 22 bp, Homo sapiens
gtggtgtctgcctgttgcgtga

SEQ ID NO: 2955782 - DNA, 23 bp, Homo sapiens
gtggttcactcttggagcctgca

SEQ ID NO: 2955783 - DNA, 22 bp, Homo sapiens
gtggttcatccatcatctgctg

SEQ ID NO: 2955784 - DNA, 17 bp, Homo sapiens
gtggttgggctgtgcct

SEQ ID NO: 2955785 - DNA, 21 bp, Homo sapiens
gtggtttgtgagccttgctgc

SEQ ID NO: 2955786 - DNA, 23 bp, Homo sapiens
gtggttttcttaaggtgaggcct

SEQ ID NO: 2955787 - DNA, 16 bp, Homo sapiens
gtgtaaaaaatggaaa

SEQ ID NO: 2955788 - DNA, 21 bp, Homo sapiens
gtgtaaaaaatggaaaaaaac

SEQ ID NO: 2955789 - DNA, 21 bp, Homo sapiens
gtgtaaagcattccaacaaag

SEQ ID NO: 2955790 - DNA, 13 bp, Homo sapiens
gtgtaaagttagt

SEQ ID NO: 2955791 - DNA, 19 bp, Homo sapiens
gtgtaaatagttactccag

SEQ ID NO: 2955792 - DNA, 14 bp, Homo sapiens
gtgtaaatgttagt

SEQ ID NO: 2955793 - DNA, 16 bp, Homo sapiens
gtgtaaccagctcagt

SEQ ID NO: 2955794 - DNA, 19 bp, Homo sapiens
gtgtaaccagctcagtgtt

SEQ ID NO: 2955795 - DNA, 14 bp, Homo sapiens
gtgtaatatgaaat

SEQ ID NO: 2955796 - DNA, 14 bp, Homo sapiens
gtgtaatcaataaa

SEQ ID NO: 2955797 - DNA, 15 bp, Homo sapiens
gtgtaatcaataaac

SEQ ID NO: 2955798 - DNA, 16 bp, Homo sapiens
gtgtaatcaataaacg

SEQ ID NO: 2955799 - DNA, 13 bp, Homo sapiens
gtgtaatttcttt

SEQ ID NO: 2955800 - DNA, 22 bp, Homo sapiens
gtgtacaagttgctttgttaca

SEQ ID NO: 2955801 - DNA, 22 bp, Homo sapiens
gtgtacagtaaacggtgtatat

SEQ ID NO: 2955802 - DNA, 19 bp, Homo sapiens
gtgtacagtttaacagagt

SEQ ID NO: 2955803 - DNA, 19 bp, Homo sapiens
gtgtacatcccatgtaaca

SEQ ID NO: 2955804 - DNA, 22 bp, Homo sapiens
gtgtacatcccatgtaacagaa

SEQ ID NO: 2955805 - DNA, 21 bp, Homo sapiens
gtgtacctcctctcagtgttt

SEQ ID NO: 2955806 - DNA, 16 bp, Homo sapiens
gtgtactggctcctct

SEQ ID NO: 2955807 - DNA, 22 bp, Homo sapiens
gtgtagccaggtccccctgcag

SEQ ID NO: 2955808 - DNA, 16 bp, Homo sapiens
gtgtagccgccctgag

SEQ ID NO: 2955809 - DNA, 20 bp, Homo sapiens
gtgtaggggagccacattta

SEQ ID NO: 2955810 - DNA, 13 bp, Homo sapiens
gtgtatatgtgct

SEQ ID NO: 2955811 - DNA, 20 bp, Homo sapiens
gtgtatgcgtgtccgtctgt

SEQ ID NO: 2955812 - DNA, 19 bp, Homo sapiens
gtgtatggcgttggtttgt

SEQ ID NO: 2955813 - DNA, 17 bp, Homo sapiens
gtgtatttaacagggag

SEQ ID NO: 2955814 - DNA, 18 bp, Homo sapiens
gtgtatttaacagggagg

SEQ ID NO: 2955815 - DNA, 17 bp, Homo sapiens
gtgtatttctctgtgaa

SEQ ID NO: 2955816 - DNA, 19 bp, Homo sapiens
gtgtatttcttatacgctt

SEQ ID NO: 2955817 - DNA, 17 bp, Homo sapiens
gtgtattttattcagta

SEQ ID NO: 2955818 - DNA, 18 bp, Homo sapiens
gtgtcaactttcatttga

SEQ ID NO: 2955819 - DNA, 22 bp, Homo sapiens
gtgtcaactttcatttgaaagt

SEQ ID NO: 2955820 - DNA, 14 bp, Homo sapiens
gtgtcaagtcctga

SEQ ID NO: 2955821 - DNA, 14 bp, Homo sapiens
gtgtcacactctgt

SEQ ID NO: 2955822 - DNA, 24 bp, Homo sapiens
gtgtcaccccagagccacacatgg

SEQ ID NO: 2955823 - DNA, 14 bp, Homo sapiens
gtgtcacctgtgct

SEQ ID NO: 2955824 - DNA, 22 bp, Homo sapiens
gtgtcactcaaggcggtgcttg

SEQ ID NO: 2955825 - DNA, 20 bp, Homo sapiens
gtgtcactgtccctcctggt

SEQ ID NO: 2955826 - DNA, 17 bp, Homo sapiens
gtgtcagagcccagccc

SEQ ID NO: 2955827 - DNA, 15 bp, Homo sapiens
gtgtcagagcccagg

SEQ ID NO: 2955828 - DNA, 12 bp, Homo sapiens
gtgtcaggcccg

SEQ ID NO: 2955829 - DNA, 13 bp, Homo sapiens
gtgtcaggcccgt

SEQ ID NO: 2955830 - DNA, 21 bp, Homo sapiens
gtgtcaggcccgtcggagctg

SEQ ID NO: 2955831 - DNA, 22 bp, Homo sapiens
gtgtcaggcccgtcggagctgc

SEQ ID NO: 2955832 - DNA, 15 bp, Homo sapiens
gtgtcaggccctctg

SEQ ID NO: 2955833 - DNA, 20 bp, Homo sapiens
gtgtcaggccctctgcctgc

SEQ ID NO: 2955834 - DNA, 21 bp, Homo sapiens
gtgtcaggccctctgcctgca

SEQ ID NO: 2955835 - DNA, 22 bp, Homo sapiens
gtgtcaggccctctgcctgcac

SEQ ID NO: 2955836 - DNA, 20 bp, Homo sapiens
gtgtcagtggggctctctga

SEQ ID NO: 2955837 - DNA, 23 bp, Homo sapiens
gtgtcatgtcaaagtgaaagaca

SEQ ID NO: 2955838 - DNA, 18 bp, Homo sapiens
gtgtcattattccatctt

SEQ ID NO: 2955839 - DNA, 14 bp, Homo sapiens
gtgtcatttttgaa

SEQ ID NO: 2955840 - DNA, 22 bp, Homo sapiens
gtgtccatcatattaaaaatat

SEQ ID NO: 2955841 - DNA, 13 bp, Homo sapiens
gtgtcccaggcag

SEQ ID NO: 2955842 - DNA, 18 bp, Homo sapiens
gtgtcccctgacctgtcc

SEQ ID NO: 2955843 - DNA, 21 bp, Homo sapiens
gtgtccctttttgcaggggac

SEQ ID NO: 2955844 - DNA, 14 bp, Homo sapiens
gtgtcctccctccc

SEQ ID NO: 2955845 - DNA, 18 bp, Homo sapiens
gtgtcctcttccctctct

SEQ ID NO: 2955846 - DNA, 21 bp, Homo sapiens
gtgtcctgaagctgctggagc

SEQ ID NO: 2955847 - DNA, 17 bp, Homo sapiens
gtgtccttgcacctgca

SEQ ID NO: 2955848 - DNA, 19 bp, Homo sapiens
gtgtccttgcacctgcatc

SEQ ID NO: 2955849 - DNA, 19 bp, Homo sapiens
gtgtctaagattctagatc

SEQ ID NO: 2955850 - DNA, 20 bp, Homo sapiens
gtgtctaagattctagatca

SEQ ID NO: 2955851 - DNA, 19 bp, Homo sapiens
gtgtctagtagaacaatgt

SEQ ID NO: 2955852 - DNA, 16 bp, Homo sapiens
gtgtctcgctgcatca

SEQ ID NO: 2955853 - DNA, 20 bp, Homo sapiens
gtgtctctgcctggagcagg

SEQ ID NO: 2955854 - DNA, 19 bp, Homo sapiens
gtgtctggaagaagcagcg

SEQ ID NO: 2955855 - DNA, 14 bp, Homo sapiens
gtgtctggagcggc

SEQ ID NO: 2955856 - DNA, 17 bp, Homo sapiens
gtgtctggagcggctgc

SEQ ID NO: 2955857 - DNA, 14 bp, Homo sapiens
gtgtctggcctgag

SEQ ID NO: 2955858 - DNA, 14 bp, Homo sapiens
gtgtctggctgcag

SEQ ID NO: 2955859 - DNA, 21 bp, Homo sapiens
gtgtctgtacacgtgtcctgt

SEQ ID NO: 2955860 - DNA, 22 bp, Homo sapiens
gtgtctgtcaccacatcttgtc

SEQ ID NO: 2955861 - DNA, 22 bp, Homo sapiens
gtgtctgtggttgcagtctttc

SEQ ID NO: 2955862 - DNA, 13 bp, Homo sapiens
gtgtgaaggtcct

SEQ ID NO: 2955863 - DNA, 17 bp, Homo sapiens
gtgtgaagttagaattc

SEQ ID NO: 2955864 - DNA, 15 bp, Homo sapiens
gtgtgaatgaacact

SEQ ID NO: 2955865 - DNA, 12 bp, Homo sapiens
gtgtgacccctc

SEQ ID NO: 2955866 - DNA, 23 bp, Homo sapiens
gtgtgacccctcctggggccagg

SEQ ID NO: 2955867 - DNA, 17 bp, Homo sapiens
gtgtgactctagcaagg

SEQ ID NO: 2955868 - DNA, 14 bp, Homo sapiens
gtgtgagtgtgatg

SEQ ID NO: 2955869 - DNA, 21 bp, Homo sapiens
gtgtgattgacagctttgctg

SEQ ID NO: 2955870 - DNA, 18 bp, Homo sapiens
gtgtgcaggctgtctcat

SEQ ID NO: 2955871 - DNA, 22 bp, Homo sapiens
gtgtgcatattgtacacttttt

SEQ ID NO: 2955872 - DNA, 20 bp, Homo sapiens
gtgtgcctgactgcccagca

SEQ ID NO: 2955873 - DNA, 13 bp, Homo sapiens
gtgtgcctgtctg

SEQ ID NO: 2955874 - DNA, 15 bp, Homo sapiens
gtgtgcgctgcctgg

SEQ ID NO: 2955875 - DNA, 18 bp, Homo sapiens
gtgtgcgctgcctggcca

SEQ ID NO: 2955876 - DNA, 18 bp, Homo sapiens
gtgtgcggagtctcctct

SEQ ID NO: 2955877 - DNA, 17 bp, Homo sapiens
gtgtgcgtggcgtggcc

SEQ ID NO: 2955878 - DNA, 14 bp, Homo sapiens
gtgtgctgaacaca

SEQ ID NO: 2955879 - DNA, 18 bp, Homo sapiens
gtgtggaaccacctgatg

SEQ ID NO: 2955880 - DNA, 16 bp, Homo sapiens
gtgtggaggcctcagg

SEQ ID NO: 2955881 - DNA, 18 bp, Homo sapiens
gtgtggaggcctcaggga

SEQ ID NO: 2955882 - DNA, 16 bp, Homo sapiens
gtgtggcagccacacg

SEQ ID NO: 2955883 - DNA, 13 bp, Homo sapiens
gtgtggccaggct

SEQ ID NO: 2955884 - DNA, 13 bp, Homo sapiens
gtgtggcgtggcc

SEQ ID NO: 2955885 - DNA, 13 bp, Homo sapiens
gtgtgggaaggga

SEQ ID NO: 2955886 - DNA, 19 bp, Homo sapiens
gtgtggggttctcagtgcc

SEQ ID NO: 2955887 - DNA, 17 bp, Homo sapiens
gtgtgggtacctgtatt

SEQ ID NO: 2955888 - DNA, 23 bp, Homo sapiens
gtgtgtaccacaccctgcctgct

SEQ ID NO: 2955889 - DNA, 13 bp, Homo sapiens
gtgtgtatatatt

SEQ ID NO: 2955890 - DNA, 19 bp, Homo sapiens
gtgtgtatctaaaggatgg

SEQ ID NO: 2955891 - DNA, 15 bp, Homo sapiens
gtgtgtattttttca

SEQ ID NO: 2955892 - DNA, 16 bp, Homo sapiens
gtgtgtcagagcccag

SEQ ID NO: 2955893 - DNA, 18 bp, Homo sapiens
gtgtgtcagagcccaggg

SEQ ID NO: 2955894 - DNA, 16 bp, Homo sapiens
gtgtgtcaggccctct

SEQ ID NO: 2955895 - DNA, 19 bp, Homo sapiens
gtgtgtccacgactgtctc

SEQ ID NO: 2955896 - DNA, 16 bp, Homo sapiens
gtgtgtccccctctgt

SEQ ID NO: 2955897 - DNA, 18 bp, Homo sapiens
gtgtgtccccctctgtcc

SEQ ID NO: 2955898 - DNA, 18 bp, Homo sapiens
gtgtgtcttttataaaaa

SEQ ID NO: 2955899 - DNA, 17 bp, Homo sapiens
gtgtgtgacaattctgt

SEQ ID NO: 2955900 - DNA, 10 bp, Homo sapiens
gtgtgtgcgt

SEQ ID NO: 2955901 - DNA, 21 bp, Homo sapiens
gtgtgtggcagccaggatgac

SEQ ID NO: 2955902 - DNA, 14 bp, Homo sapiens
gtgtgtgtgcgtgt

SEQ ID NO: 2955903 - DNA, 14 bp, Homo sapiens
gtgtgtgtgtgaaa

SEQ ID NO: 2955904 - DNA, 12 bp, Homo sapiens
gtgtgtgtgtgt

SEQ ID NO: 2955905 - DNA, 18 bp, Homo sapiens
gtgtgttatttccccagc

SEQ ID NO: 2955906 - DNA, 22 bp, Homo sapiens
gtgtgttatttccccagccaca

SEQ ID NO: 2955907 - DNA, 13 bp, Homo sapiens
gtgtgttggacag

SEQ ID NO: 2955908 - DNA, 16 bp, Homo sapiens
gtgtgttgtcttgaaa

SEQ ID NO: 2955909 - DNA, 19 bp, Homo sapiens
gtgttaatctgagtaactt

SEQ ID NO: 2955910 - DNA, 16 bp, Homo sapiens
gtgttaattataaaca

SEQ ID NO: 2955911 - DNA, 19 bp, Homo sapiens
gtgttactgtaattcctca

SEQ ID NO: 2955912 - DNA, 12 bp, Homo sapiens
gtgttacttgaa

SEQ ID NO: 2955913 - DNA, 19 bp, Homo sapiens
gtgttacttgaagtaacta

SEQ ID NO: 2955914 - DNA, 19 bp, Homo sapiens
gtgttatgtgaatttgagt

SEQ ID NO: 2955915 - DNA, 17 bp, Homo sapiens
gtgttatttccccagcc

SEQ ID NO: 2955916 - DNA, 21 bp, Homo sapiens
gtgttcacacttttcagcaaa

SEQ ID NO: 2955917 - DNA, 12 bp, Homo sapiens
gtgttcatacat

SEQ ID NO: 2955918 - DNA, 20 bp, Homo sapiens
tgcttcttgtgaaggccatg

SEQ ID NO: 2955919 - DNA, 15 bp, Homo sapiens
tgcttgacaacatct

SEQ ID NO: 2955920 - DNA, 18 bp, Homo sapiens
tgcttgatagaaatgcca

SEQ ID NO: 2955921 - DNA, 19 bp, Homo sapiens
tgcttgatgggattctgga

SEQ ID NO: 2955922 - DNA, 17 bp, Homo sapiens
tgcttgcagtagatttt

SEQ ID NO: 2955923 - DNA, 14 bp, Homo sapiens
tgcttggattcact

SEQ ID NO: 2955924 - DNA, 12 bp, Homo sapiens
tgcttggccaga

SEQ ID NO: 2955925 - DNA, 20 bp, Homo sapiens
tgcttgggtggagaagccat

SEQ ID NO: 2955926 - DNA, 21 bp, Homo sapiens
tgcttgggtggagaagccatt

SEQ ID NO: 2955927 - DNA, 13 bp, Homo sapiens
tgcttggtgctgg

SEQ ID NO: 2955928 - DNA, 15 bp, Homo sapiens
tgcttggtgctggtt

SEQ ID NO: 2955929 - DNA, 18 bp, Homo sapiens
tgcttggtgctggtttat

SEQ ID NO: 2955930 - DNA, 19 bp, Homo sapiens
tgcttggtgctggtttatt

SEQ ID NO: 2955931 - DNA, 13 bp, Homo sapiens
tgcttgtcatctg

SEQ ID NO: 2955932 - DNA, 21 bp, Homo sapiens
tgcttgtcatctgcatgtcta

SEQ ID NO: 2955933 - DNA, 14 bp, Homo sapiens
tgcttgtgcctccc

SEQ ID NO: 2955934 - DNA, 18 bp, Homo sapiens
tgcttgtgcctcccttcc

SEQ ID NO: 2955935 - DNA, 20 bp, Homo sapiens
tgcttgtgctcatgtgtgtg

SEQ ID NO: 2955936 - DNA, 17 bp, Homo sapiens
tgcttgttgtcaagtat

SEQ ID NO: 2955937 - DNA, 22 bp, Homo sapiens
tgcttgttgtcaagtataaagt

SEQ ID NO: 2955938 - DNA, 22 bp, Homo sapiens
tgcttgttgtttgttgacagct

SEQ ID NO: 2955939 - DNA, 13 bp, Homo sapiens
tgcttgtttatga

SEQ ID NO: 2955940 - DNA, 13 bp, Homo sapiens
tgcttgtttcttg

SEQ ID NO: 2955941 - DNA, 18 bp, Homo sapiens
tggacagaagcagctctt

SEQ ID NO: 2955942 - DNA, 16 bp, Homo sapiens
tggacagacagaggat

SEQ ID NO: 2955943 - DNA, 19 bp, Homo sapiens
tggacagatggacgcaggc

SEQ ID NO: 2955944 - DNA, 20 bp, Homo sapiens
tggacagatggacgcaggcc

SEQ ID NO: 2955945 - DNA, 16 bp, Homo sapiens
tggacagatttcagta

SEQ ID NO: 2955946 - DNA, 21 bp, Homo sapiens
tggacagatttcagtaatgtc

SEQ ID NO: 2955947 - DNA, 12 bp, Homo sapiens
tggacagcccca

SEQ ID NO: 2955948 - DNA, 13 bp, Homo sapiens
tggacagcttgtg

SEQ ID NO: 2955949 - DNA, 16 bp, Homo sapiens
tggacagtttgtttcc

SEQ ID NO: 2955950 - DNA, 18 bp, Homo sapiens
tggacagtttgtttcctg

SEQ ID NO: 2955951 - DNA, 23 bp, Homo sapiens
tggacatagagagggagaagaag

SEQ ID NO: 2955952 - DNA, 18 bp, Homo sapiens
tggacatcgatatgaaaa

SEQ ID NO: 2955953 - DNA, 19 bp, Homo sapiens
tggacatcgatatgaaaaa

SEQ ID NO: 2955954 - DNA, 15 bp, Homo sapiens
tggaccaaggagcat

SEQ ID NO: 2955955 - DNA, 23 bp, Homo sapiens
tggaccaccgttcagtcattttg

SEQ ID NO: 2955956 - DNA, 22 bp, Homo sapiens
tggaccactcctgaatgagact

SEQ ID NO: 2955957 - DNA, 19 bp, Homo sapiens
tggaccaggacaggaccag

SEQ ID NO: 2955958 - DNA, 19 bp, Homo sapiens
tggaccaggtcctgctccg

SEQ ID NO: 2955959 - DNA, 14 bp, Homo sapiens
tggacccaaggaaa

SEQ ID NO: 2955960 - DNA, 20 bp, Homo sapiens
tggacccaaggaaaactgca

SEQ ID NO: 2955961 - DNA, 13 bp, Homo sapiens
tggaccccagcat

SEQ ID NO: 2955962 - DNA, 13 bp, Homo sapiens
tggacctggcagt

SEQ ID NO: 2955963 - DNA, 15 bp, Homo sapiens
tggaccttaggcctt

SEQ ID NO: 2955964 - DNA, 21 bp, Homo sapiens
tggaccttgacagagcagcta

SEQ ID NO: 2955965 - DNA, 20 bp, Homo sapiens
tggacgaagagcaggccagc

SEQ ID NO: 2955966 - DNA, 14 bp, Homo sapiens
tggacgcaggccct

SEQ ID NO: 2955967 - DNA, 15 bp, Homo sapiens
tggacggctgggcac

SEQ ID NO: 2955968 - DNA, 14 bp, Homo sapiens
tggacgtagagttg

SEQ ID NO: 2955969 - DNA, 15 bp, Homo sapiens
tggactagggcctcg

SEQ ID NO: 2955970 - DNA, 17 bp, Homo sapiens
tggactagggcctcgga

SEQ ID NO: 2955971 - DNA, 15 bp, Homo sapiens
tggactcagctctgt

SEQ ID NO: 2955972 - DNA, 18 bp, Homo sapiens
tggactcagctctgtctg

SEQ ID NO: 2955973 - DNA, 20 bp, Homo sapiens
tggactcagctctgtctgct

SEQ ID NO: 2955974 - DNA, 22 bp, Homo sapiens
tggactctcagtctctgagcag

SEQ ID NO: 2955975 - DNA, 13 bp, Homo sapiens
tggactctgcaca

SEQ ID NO: 2955976 - DNA, 14 bp, Homo sapiens
tggactctgcacat

SEQ ID NO: 2955977 - DNA, 17 bp, Homo sapiens
tggactctgcacatgaa

SEQ ID NO: 2955978 - DNA, 22 bp, Homo sapiens
tggactctgcacatgtcttgta

SEQ ID NO: 2955979 - DNA, 17 bp, Homo sapiens
tggactgacctggtcca

SEQ ID NO: 2955980 - DNA, 17 bp, Homo sapiens
tggactgagcgaggaaa

SEQ ID NO: 2955981 - DNA, 21 bp, Homo sapiens
tggactgagcgaggaaaaaca

SEQ ID NO: 2955982 - DNA, 22 bp, Homo sapiens
tggactgctacctttcaaagct

SEQ ID NO: 2955983 - DNA, 16 bp, Homo sapiens
tggactggttatcttg

SEQ ID NO: 2955984 - DNA, 20 bp, Homo sapiens
tggactggttatcttgttat

SEQ ID NO: 2955985 - DNA, 22 bp, Homo sapiens
tggactgtggcacttgcctggg

SEQ ID NO: 2955986 - DNA, 16 bp, Homo sapiens
tggactgttccctgag

SEQ ID NO: 2955987 - DNA, 17 bp, Homo sapiens
tggactgttccctgagg

SEQ ID NO: 2955988 - DNA, 15 bp, Homo sapiens
tggacttgtcctcag

SEQ ID NO: 2955989 - DNA, 14 bp, Homo sapiens
tggacttgttttaa

SEQ ID NO: 2955990 - DNA, 14 bp, Homo sapiens
tggagaaaccctgt

SEQ ID NO: 2955991 - DNA, 14 bp, Homo sapiens
tggagaaatgaaaa

SEQ ID NO: 2955992 - DNA, 15 bp, Homo sapiens
tggagaaatgaaaag

SEQ ID NO: 2955993 - DNA, 15 bp, Homo sapiens
tggagaactcctagg

SEQ ID NO: 2955994 - DNA, 17 bp, Homo sapiens
tggagaactcctagggt

SEQ ID NO: 2955995 - DNA, 16 bp, Homo sapiens
tggagaagatcgcatg

SEQ ID NO: 2955996 - DNA, 22 bp, Homo sapiens
tggagaagcacactctggtctt

SEQ ID NO: 2955997 - DNA, 13 bp, Homo sapiens
tggagaagcagtg

SEQ ID NO: 2955998 - DNA, 13 bp, Homo sapiens
tggagaagccatt

SEQ ID NO: 2955999 - DNA, 12 bp, Homo sapiens
tggagaatactg

SEQ ID NO: 2956000 - DNA, 13 bp, Homo sapiens
tggagaatactgc

SEQ ID NO: 2956001 - DNA, 14 bp, Homo sapiens
tggagactggcagg

SEQ ID NO: 2956002 - DNA, 21 bp, Homo sapiens
tggagagaaggcctccctagc

SEQ ID NO: 2956003 - DNA, 20 bp, Homo sapiens
tggagagaccagcctttctt

SEQ ID NO: 2956004 - DNA, 22 bp, Homo sapiens
tggagagaccagcctttcttcc

SEQ ID NO: 2956005 - DNA, 16 bp, Homo sapiens
tggagaggccctctgg

SEQ ID NO: 2956006 - DNA, 18 bp, Homo sapiens
tggagaggccctctggag

SEQ ID NO: 2956007 - DNA, 15 bp, Homo sapiens
tggagagtttcctga

SEQ ID NO: 2956008 - DNA, 22 bp, Homo sapiens
tggagatattataagggagagc

SEQ ID NO: 2956009 - DNA, 19 bp, Homo sapiens
tggagatatttatgggggg

SEQ ID NO: 2956010 - DNA, 19 bp, Homo sapiens
tggagatctgaacccagct

SEQ ID NO: 2956011 - DNA, 16 bp, Homo sapiens
tggagatgcagccttc

SEQ ID NO: 2956012 - DNA, 20 bp, Homo sapiens
tggagattagcccttccttg

SEQ ID NO: 2956013 - DNA, 22 bp, Homo sapiens
tggagattctaatcccaacaag

SEQ ID NO: 2956014 - DNA, 18 bp, Homo sapiens
tggagcaacctactgtct

SEQ ID NO: 2956015 - DNA, 19 bp, Homo sapiens
tggagcaacctactgtcta

SEQ ID NO: 2956016 - DNA, 21 bp, Homo sapiens
tggagcaacctactgtctaag

SEQ ID NO: 2956017 - DNA, 16 bp, Homo sapiens
tggagcagaggggctg

SEQ ID NO: 2956018 - DNA, 17 bp, Homo sapiens
tggagcagaggggctga

SEQ ID NO: 2956019 - DNA, 14 bp, Homo sapiens
tggagcatggacag

SEQ ID NO: 2956020 - DNA, 12 bp, Homo sapiens
tggagccacagg

SEQ ID NO: 2956021 - DNA, 15 bp, Homo sapiens
tggagccacaggcag

SEQ ID NO: 2956022 - DNA, 22 bp, Homo sapiens
tggagccccactgcccttctca

SEQ ID NO: 2956023 - DNA, 15 bp, Homo sapiens
tggagccctccgcct

SEQ ID NO: 2956024 - DNA, 19 bp, Homo sapiens
tggagccctccgccttcac

SEQ ID NO: 2956025 - DNA, 22 bp, Homo sapiens
tggagcggctgctcgcccagga

SEQ ID NO: 2956026 - DNA, 23 bp, Homo sapiens
tggagcgtttgctgtgccaggag

SEQ ID NO: 2956027 - DNA, 22 bp, Homo sapiens
tggagctacactcattgaaatg

SEQ ID NO: 2956028 - DNA, 22 bp, Homo sapiens
tggagctctgtgggtctctgga

SEQ ID NO: 2956029 - DNA, 14 bp, Homo sapiens
tggagctgagaaga

SEQ ID NO: 2956030 - DNA, 15 bp, Homo sapiens
tggagctgagaagag

SEQ ID NO: 2956031 - DNA, 14 bp, Homo sapiens
tggagctttctgta

SEQ ID NO: 2956032 - DNA, 20 bp, Homo sapiens
tggagcttttttgcatagca

SEQ ID NO: 2956033 - DNA, 11 bp, Homo sapiens
tggaggacagt

SEQ ID NO: 2956034 - DNA, 21 bp, Homo sapiens
tggaggagaagaattttcaga

SEQ ID NO: 2956035 - DNA, 15 bp, Homo sapiens
tggaggagacaggaa

SEQ ID NO: 2956036 - DNA, 19 bp, Homo sapiens
tggaggagacaggaagcct

SEQ ID NO: 2956037 - DNA, 18 bp, Homo sapiens
tggaggagctgagggagg

SEQ ID NO: 2956038 - DNA, 15 bp, Homo sapiens
tggaggatttggtca

SEQ ID NO: 2956039 - DNA, 16 bp, Homo sapiens
tggaggcagatgtggg

SEQ ID NO: 2956040 - DNA, 14 bp, Homo sapiens
tggaggcagggcct

SEQ ID NO: 2956041 - DNA, 22 bp, Homo sapiens
tggaggcagggccttgcccaga

SEQ ID NO: 2956042 - DNA, 15 bp, Homo sapiens
tggaggcccagttca

SEQ ID NO: 2956043 - DNA, 15 bp, Homo sapiens
tggaggctcagccca

SEQ ID NO: 2956044 - DNA, 20 bp, Homo sapiens
tggagggcgcccagcagcct

SEQ ID NO: 2956045 - DNA, 13 bp, Homo sapiens
tggagggctcagg

SEQ ID NO: 2956046 - DNA, 13 bp, Homo sapiens
tggaggggccctc

SEQ ID NO: 2956047 - DNA, 22 bp, Homo sapiens
tggagggtgctaggcccctgtg

SEQ ID NO: 2956048 - DNA, 16 bp, Homo sapiens
tggaggtgctggtagc

SEQ ID NO: 2956049 - DNA, 18 bp, Homo sapiens
tggaggtgctggtagctg

SEQ ID NO: 2956050 - DNA, 19 bp, Homo sapiens
tggaggttaaggctgagga

SEQ ID NO: 2956051 - DNA, 22 bp, Homo sapiens
tggaggttaaggctgaggaaag

SEQ ID NO: 2956052 - DNA, 23 bp, Homo sapiens
tggaggttcctaggttttgagat

SEQ ID NO: 2956053 - DNA, 15 bp, Homo sapiens
tggaggttctaaggc

SEQ ID NO: 2956054 - DNA, 17 bp, Homo sapiens
tggagtatttggaagca

SEQ ID NO: 2956055 - DNA, 22 bp, Homo sapiens
tggagtcatggtccggtgtcct

SEQ ID NO: 2956056 - DNA, 17 bp, Homo sapiens
tggagtcatgtgcctct

SEQ ID NO: 2956057 - DNA, 14 bp, Homo sapiens
tggagtcccagagc

SEQ ID NO: 2956058 - DNA, 16 bp, Homo sapiens
tggagtgctgcttgtg

SEQ ID NO: 2956059 - DNA, 19 bp, Homo sapiens
tggagtggctcgccaggcc

SEQ ID NO: 2956060 - DNA, 17 bp, Homo sapiens
tggagtgtgtcagagcc

SEQ ID NO: 2956061 - DNA, 15 bp, Homo sapiens
tggagttccattctt

SEQ ID NO: 2956062 - DNA, 14 bp, Homo sapiens
tggagttcttgtgc

SEQ ID NO: 2956063 - DNA, 15 bp, Homo sapiens
tggagttgatctgga

SEQ ID NO: 2956064 - DNA, 20 bp, Homo sapiens
tggccaaagagcctttccaa

SEQ ID NO: 2956065 - DNA, 17 bp, Homo sapiens
tggcggcagggccaggc

SEQ ID NO: 2956066 - DNA, 18 bp, Homo sapiens
tggcggcagggccaggct

SEQ ID NO: 2956067 - DNA, 15 bp, Homo sapiens
tggcggctactcagc

SEQ ID NO: 2956068 - DNA, 21 bp, Homo sapiens
tggcggctactcagcagccct

SEQ ID NO: 2956069 - DNA, 20 bp, Homo sapiens
tggcgggggcacgtgtgggc

SEQ ID NO: 2956070 - DNA, 13 bp, Homo sapiens
tggcggtgcctgg

SEQ ID NO: 2956071 - DNA, 14 bp, Homo sapiens
tggcgttgttcata

SEQ ID NO: 2956072 - DNA, 16 bp, Homo sapiens
tggctaacagtctagt

SEQ ID NO: 2956073 - DNA, 20 bp, Homo sapiens
tggctaacagtctagtgcaa

SEQ ID NO: 2956074 - DNA, 12 bp, Homo sapiens
tggctaagaccc

SEQ ID NO: 2956075 - DNA, 20 bp, Homo sapiens
tgccctaattcatcttttaa

SEQ ID NO: 2956076 - DNA, 14 bp, Homo sapiens
tgccctcaggaaag

SEQ ID NO: 2956077 - DNA, 21 bp, Homo sapiens
tgccctcccgcaccttcctcc

SEQ ID NO: 2956078 - DNA, 23 bp, Homo sapiens
tgccctccctcagccgtcagcca

SEQ ID NO: 2956079 - DNA, 11 bp, Homo sapiens
tgccctcctct

SEQ ID NO: 2956080 - DNA, 12 bp, Homo sapiens
tgccctcctctc

SEQ ID NO: 2956081 - DNA, 14 bp, Homo sapiens
tgccctcctctccc

SEQ ID NO: 2956082 - DNA, 16 bp, Homo sapiens
tgccctcctctcccat

SEQ ID NO: 2956083 - DNA, 15 bp, Homo sapiens
tgccctcctctcccg

SEQ ID NO: 2956084 - DNA, 16 bp, Homo sapiens
tgccctctgctgctgc

SEQ ID NO: 2956085 - DNA, 16 bp, Homo sapiens
tgccctgaaagggccc

SEQ ID NO: 2956086 - DNA, 21 bp, Homo sapiens
tgccctgaaagggcccttccc

SEQ ID NO: 2956087 - DNA, 13 bp, Homo sapiens
tgccctgaggggc

SEQ ID NO: 2956088 - DNA, 16 bp, Homo sapiens
tgccctgcccaagtga

SEQ ID NO: 2956089 - DNA, 10 bp, Homo sapiens
tgccctgcta

SEQ ID NO: 2956090 - DNA, 12 bp, Homo sapiens
tgccctgctcct

SEQ ID NO: 2956091 - DNA, 14 bp, Homo sapiens
tgccctggctccat

SEQ ID NO: 2956092 - DNA, 18 bp, Homo sapiens
tgccctgggtcctgcctg

SEQ ID NO: 2956093 - DNA, 21 bp, Homo sapiens
tgccctgggtcctgcctgcag

SEQ ID NO: 2956094 - DNA, 13 bp, Homo sapiens
tgccctgtgccgc

SEQ ID NO: 2956095 - DNA, 13 bp, Homo sapiens
tgccctgtgggac

SEQ ID NO: 2956096 - DNA, 18 bp, Homo sapiens
tgccctgtgggaccccag

SEQ ID NO: 2956097 - DNA, 16 bp, Homo sapiens
tgcccttcctactcct

SEQ ID NO: 2956098 - DNA, 14 bp, Homo sapiens
tgcccttcctgacc

SEQ ID NO: 2956099 - DNA, 15 bp, Homo sapiens
tgcccttggtttctg

SEQ ID NO: 2956100 - DNA, 13 bp, Homo sapiens
tgccgacactgtt

SEQ ID NO: 2956101 - DNA, 23 bp, Homo sapiens
tgccgacatccctcccccagcag

SEQ ID NO: 2956102 - DNA, 18 bp, Homo sapiens
tgccgcaccccagagtgt

SEQ ID NO: 2956103 - DNA, 14 bp, Homo sapiens
tgccgccgcccgct

SEQ ID NO: 2956104 - DNA, 12 bp, Homo sapiens
tgccgcctcccg

SEQ ID NO: 2956105 - DNA, 16 bp, Homo sapiens
tgccgcctgcactcct

SEQ ID NO: 2956106 - DNA, 16 bp, Homo sapiens
tgccgcgtcgccctcc

SEQ ID NO: 2956107 - DNA, 16 bp, Homo sapiens
tgccggcaggatgcag

SEQ ID NO: 2956108 - DNA, 14 bp, Homo sapiens
tgccggccctgggg

SEQ ID NO: 2956109 - DNA, 16 bp, Homo sapiens
tgccggctctggctct

SEQ ID NO: 2956110 - DNA, 20 bp, Homo sapiens
tgccgggcccccaccgccgg

SEQ ID NO: 2956111 - DNA, 19 bp, Homo sapiens
tgccgttactctccaacct

SEQ ID NO: 2956112 - DNA, 22 bp, Homo sapiens
tgccgttactctccaacctgga

SEQ ID NO: 2956113 - DNA, 17 bp, Homo sapiens
tgcctaagtggctgctg

SEQ ID NO: 2956114 - DNA, 20 bp, Homo sapiens
tgcctataaaatgcccattt

SEQ ID NO: 2956115 - DNA, 21 bp, Homo sapiens
tgcctcaactccaccctctgc

SEQ ID NO: 2956116 - DNA, 15 bp, Homo sapiens
tgcctcaagaggaat

SEQ ID NO: 2956117 - DNA, 22 bp, Homo sapiens
tgcctcaatgtgaatcagaccc

SEQ ID NO: 2956118 - DNA, 15 bp, Homo sapiens
tgcctcactaatttt

SEQ ID NO: 2956119 - DNA, 15 bp, Homo sapiens
tgcctcagccctgac

SEQ ID NO: 2956120 - DNA, 16 bp, Homo sapiens
tgcctcaggcactctc

SEQ ID NO: 2956121 - DNA, 20 bp, Homo sapiens
tgcctcataaattaatgatt

SEQ ID NO: 2956122 - DNA, 23 bp, Homo sapiens
tgcctcataaattaatgattctg

SEQ ID NO: 2956123 - DNA, 15 bp, Homo sapiens
tgcctcatcctcctc

SEQ ID NO: 2956124 - DNA, 22 bp, Homo sapiens
tgcctcatttagagaggaaaag

SEQ ID NO: 2956125 - DNA, 11 bp, Homo sapiens
tgcctccaccg

SEQ ID NO: 2956126 - DNA, 17 bp, Homo sapiens
tgcctccaccgctgcct

SEQ ID NO: 2956127 - DNA, 18 bp, Homo sapiens
tgcctccaccgctgccta

SEQ ID NO: 2956128 - DNA, 20 bp, Homo sapiens
tgcctccaccgctgcctaag

SEQ ID NO: 2956129 - DNA, 14 bp, Homo sapiens
tgcctccaggtgca

SEQ ID NO: 2956130 - DNA, 17 bp, Homo sapiens
tgcctccaggtgcagag

SEQ ID NO: 2956131 - DNA, 15 bp, Homo sapiens
tgcctccccaatcca

SEQ ID NO: 2956132 - DNA, 15 bp, Homo sapiens
tgcctcccccgaatg

SEQ ID NO: 2956133 - DNA, 17 bp, Homo sapiens
tgcctcccctctccttc

SEQ ID NO: 2956134 - DNA, 12 bp, Homo sapiens
tgcctcccgaga

SEQ ID NO: 2956135 - DNA, 14 bp, Homo sapiens
tgcctccctctctt

SEQ ID NO: 2956136 - DNA, 20 bp, Homo sapiens
tgcctccctctcttccggga

SEQ ID NO: 2956137 - DNA, 20 bp, Homo sapiens
tgcctcccttcccagtgggc

SEQ ID NO: 2956138 - DNA, 21 bp, Homo sapiens
tgcctcctacaaccaggtctt

SEQ ID NO: 2956139 - DNA, 14 bp, Homo sapiens
tgcctcctctctcc

SEQ ID NO: 2956140 - DNA, 18 bp, Homo sapiens
tgcctcctctctccctgc

SEQ ID NO: 2956141 - DNA, 19 bp, Homo sapiens
tgcctcctggctcaggccc

SEQ ID NO: 2956142 - DNA, 21 bp, Homo sapiens
tgcctcctggctcaggcccag

SEQ ID NO: 2956143 - DNA, 17 bp, Homo sapiens
tgcctccttgccagccc

SEQ ID NO: 2956144 - DNA, 13 bp, Homo sapiens
tgcctcgaaacac

SEQ ID NO: 2956145 - DNA, 17 bp, Homo sapiens
tgcctcgaaacacagaa

SEQ ID NO: 2956146 - DNA, 21 bp, Homo sapiens
tgcctcgaaacacagaaacct

SEQ ID NO: 2956147 - DNA, 17 bp, Homo sapiens
tgcctcgagggccgcct

SEQ ID NO: 2956148 - DNA, 21 bp, Homo sapiens
tgcctcgagggccgcctgcct

SEQ ID NO: 2956149 - DNA, 23 bp, Homo sapiens
tgcctcgagggccgcctgcctta

SEQ ID NO: 2956150 - DNA, 17 bp, Homo sapiens
tgcctcgcccccacttt

SEQ ID NO: 2956151 - DNA, 13 bp, Homo sapiens
tgcctcgccttgt

SEQ ID NO: 2956152 - DNA, 19 bp, Homo sapiens
tgcctcgccttgtgttacg

SEQ ID NO: 2956153 - DNA, 20 bp, Homo sapiens
tgcctcggcttttctcagct

SEQ ID NO: 2956154 - DNA, 24 bp, Homo sapiens
tgcctcggcttttctcagctggat

SEQ ID NO: 2956155 - DNA, 15 bp, Homo sapiens
tgcctcggtggccct

SEQ ID NO: 2956156 - DNA, 17 bp, Homo sapiens
tgcctctaactccctcc

SEQ ID NO: 2956157 - DNA, 19 bp, Homo sapiens
tgcctctaactccctcctc

SEQ ID NO: 2956158 - DNA, 22 bp, Homo sapiens
tgcctctaactccctcctcaca

SEQ ID NO: 2956159 - DNA, 15 bp, Homo sapiens
tgcctctacctgaca

SEQ ID NO: 2956160 - DNA, 16 bp, Homo sapiens
tgcctctcctttgtat

SEQ ID NO: 2956161 - DNA, 17 bp, Homo sapiens
tgcctctcctttgtata

SEQ ID NO: 2956162 - DNA, 12 bp, Homo sapiens
tgcctctctagg

SEQ ID NO: 2956163 - DNA, 16 bp, Homo sapiens
tgcctctgagcttcta

SEQ ID NO: 2956164 - DNA, 13 bp, Homo sapiens
tgcctctgtcctt

SEQ ID NO: 2956165 - DNA, 17 bp, Homo sapiens
tgcctcttacggtagtt

SEQ ID NO: 2956166 - DNA, 15 bp, Homo sapiens
tgcctcttctgggag

SEQ ID NO: 2956167 - DNA, 19 bp, Homo sapiens
tgcctcttctgggagggca

SEQ ID NO: 2956168 - DNA, 21 bp, Homo sapiens
tgcctgaaacccatttactta

SEQ ID NO: 2956169 - DNA, 17 bp, Homo sapiens
tgcctgaagaccccaga

SEQ ID NO: 2956170 - DNA, 12 bp, Homo sapiens
tgcctgaataaa

SEQ ID NO: 2956171 - DNA, 17 bp, Homo sapiens
tgcctgaataaagagcc

SEQ ID NO: 2956172 - DNA, 18 bp, Homo sapiens
tgcctgacatttggagtg

SEQ ID NO: 2956173 - DNA, 16 bp, Homo sapiens
tgcctgactaaaatgt

SEQ ID NO: 2956174 - DNA, 15 bp, Homo sapiens
tgcctgagcccctca

SEQ ID NO: 2956175 - DNA, 16 bp, Homo sapiens
tgcctgagcccctcag

SEQ ID NO: 2956176 - DNA, 17 bp, Homo sapiens
tgcctgagcccctcaga

SEQ ID NO: 2956177 - DNA, 15 bp, Homo sapiens
tgcctgattttaaaa

SEQ ID NO: 2956178 - DNA, 20 bp, Homo sapiens
tgcctgcaaccttgcatcca

SEQ ID NO: 2956179 - DNA, 17 bp, Homo sapiens
tgcctgcactccctggc

SEQ ID NO: 2956180 - DNA, 13 bp, Homo sapiens
tgcctgcagcaca

SEQ ID NO: 2956181 - DNA, 17 bp, Homo sapiens
tgcctgcagcacatgcg

SEQ ID NO: 2956182 - DNA, 14 bp, Homo sapiens
tgcctgcagggcca

SEQ ID NO: 2956183 - DNA, 17 bp, Homo sapiens
tgcctgcagggccatgg

SEQ ID NO: 2956184 - DNA, 21 bp, Homo sapiens
tgcctgcccgcaccctggcct

SEQ ID NO: 2956185 - DNA, 22 bp, Homo sapiens
tgcctgcccgcaccctggcctg

SEQ ID NO: 2956186 - DNA, 16 bp, Homo sapiens
tgcctgccctctgtct

SEQ ID NO: 2956187 - DNA, 10 bp, Homo sapiens
tgcctgctga

SEQ ID NO: 2956188 - DNA, 12 bp, Homo sapiens
tgcctgctgggc

SEQ ID NO: 2956189 - DNA, 13 bp, Homo sapiens
tgcctgctgggct

SEQ ID NO: 2956190 - DNA, 15 bp, Homo sapiens
tgcctgctgggctct

SEQ ID NO: 2956191 - DNA, 20 bp, Homo sapiens
tgcctgctgttggtcctctc

SEQ ID NO: 2956192 - DNA, 17 bp, Homo sapiens
tgcctgctttctccaag

SEQ ID NO: 2956193 - DNA, 21 bp, Homo sapiens
tgcctgctttgacgggccagg

SEQ ID NO: 2956194 - DNA, 22 bp, Homo sapiens
tgcctgctttgacgggccaggc

SEQ ID NO: 2956195 - DNA, 23 bp, Homo sapiens
tgcctggaacaccagcagcactg

SEQ ID NO: 2956196 - DNA, 13 bp, Homo sapiens
tgcctggccatgc

SEQ ID NO: 2956197 - DNA, 13 bp, Homo sapiens
tgcctggccggcc

SEQ ID NO: 2956198 - DNA, 17 bp, Homo sapiens
tgcctggcctggcacac

SEQ ID NO: 2956199 - DNA, 20 bp, Homo sapiens
tgcctggcctggcacacatc

SEQ ID NO: 2956200 - DNA, 14 bp, Homo sapiens
tgcctggctctgat

SEQ ID NO: 2956201 - DNA, 14 bp, Homo sapiens
tgcctgggcccctc

SEQ ID NO: 2956202 - DNA, 16 bp, Homo sapiens
tgcctgggcccctccc

SEQ ID NO: 2956203 - DNA, 18 bp, Homo sapiens
tgcctgggcccctcccct

SEQ ID NO: 2956204 - DNA, 20 bp, Homo sapiens
tgcctgggcccctcccctca

SEQ ID NO: 2956205 - DNA, 14 bp, Homo sapiens
tgcctgggcctagc

SEQ ID NO: 2956206 - DNA, 18 bp, Homo sapiens
tgcctgggctgggcagcc

SEQ ID NO: 2956207 - DNA, 21 bp, Homo sapiens
tgcctgggctgggcagccttg

SEQ ID NO: 2956208 - DNA, 22 bp, Homo sapiens
tgcctgggctgggcagccttgg

SEQ ID NO: 2956209 - DNA, 19 bp, Homo sapiens
tgcctggggtgttagtggc

SEQ ID NO: 2956210 - DNA, 16 bp, Homo sapiens
tgcctgggtaggcccc

SEQ ID NO: 2956211 - DNA, 17 bp, Homo sapiens
tgcctgggtaggcccca

SEQ ID NO: 2956212 - DNA, 18 bp, Homo sapiens
tgcctgggtaggccccac

SEQ ID NO: 2956213 - DNA, 16 bp, Homo sapiens
tgctagtggtgggcag

SEQ ID NO: 2956214 - DNA, 18 bp, Homo sapiens
tgctataaattttttgaa

SEQ ID NO: 2956215 - DNA, 23 bp, Homo sapiens
tgctataaattttttgaaacaca

SEQ ID NO: 2956216 - DNA, 14 bp, Homo sapiens
tgctatagcctggg

SEQ ID NO: 2956217 - DNA, 13 bp, Homo sapiens
tgctatagtattt

SEQ ID NO: 2956218 - DNA, 15 bp, Homo sapiens
tgctatagtatttga

SEQ ID NO: 2956219 - DNA, 23 bp, Homo sapiens
tgctatcatgatggaatttcata

SEQ ID NO: 2956220 - DNA, 21 bp, Homo sapiens
tgctatctactaagtttcctt

SEQ ID NO: 2956221 - DNA, 19 bp, Homo sapiens
tgctatcttttttagtgtt

SEQ ID NO: 2956222 - DNA, 17 bp, Homo sapiens
tgctatgtaagggtctt

SEQ ID NO: 2956223 - DNA, 21 bp, Homo sapiens
tgctatgtgtttggtttataa

SEQ ID NO: 2956224 - DNA, 18 bp, Homo sapiens
tgctattatactgttatc

SEQ ID NO: 2956225 - DNA, 21 bp, Homo sapiens
tgctattatactgttatccat

SEQ ID NO: 2956226 - DNA, 16 bp, Homo sapiens
tgctattgtaaggtct

SEQ ID NO: 2956227 - DNA, 11 bp, Homo sapiens
tgctatttcag

SEQ ID NO: 2956228 - DNA, 21 bp, Homo sapiens
tgctatttcagccaatctgga

SEQ ID NO: 2956229 - DNA, 17 bp, Homo sapiens
tgctatttgaacaagtg

SEQ ID NO: 2956230 - DNA, 13 bp, Homo sapiens
tgctatttgaagt

SEQ ID NO: 2956231 - DNA, 14 bp, Homo sapiens
tgctatttgtcagt

SEQ ID NO: 2956232 - DNA, 18 bp, Homo sapiens
tgctatttgtcagtagcc

SEQ ID NO: 2956233 - DNA, 14 bp, Homo sapiens
tgctcaagaaacaa

SEQ ID NO: 2956234 - DNA, 17 bp, Homo sapiens
tgctcaagcagcaaaat

SEQ ID NO: 2956235 - DNA, 19 bp, Homo sapiens
tgctcaagcagcaaaatcc

SEQ ID NO: 2956236 - DNA, 22 bp, Homo sapiens
tgctcaagcagcaaaatcctta

SEQ ID NO: 2956237 - DNA, 18 bp, Homo sapiens
tgctcaatgccattgtgc

SEQ ID NO: 2956238 - DNA, 13 bp, Homo sapiens
tgctcaatttcag

SEQ ID NO: 2956239 - DNA, 16 bp, Homo sapiens
tgctcaatttcagcac

SEQ ID NO: 2956240 - DNA, 12 bp, Homo sapiens
tgctcacctggg

SEQ ID NO: 2956241 - DNA, 17 bp, Homo sapiens
tgctcagaccagctctt

SEQ ID NO: 2956242 - DNA, 17 bp, Homo sapiens
tgctcagctctgggcca

SEQ ID NO: 2956243 - DNA, 20 bp, Homo sapiens
tgctcagctctgggccattc

SEQ ID NO: 2956244 - DNA, 20 bp, Homo sapiens
tgctcagcttctcctgtgtg

SEQ ID NO: 2956245 - DNA, 17 bp, Homo sapiens
tgctcaggactcagaag

SEQ ID NO: 2956246 - DNA, 23 bp, Homo sapiens
tgctcaggactcagaagcctctg

SEQ ID NO: 2956247 - DNA, 19 bp, Homo sapiens
tgctcagggaaaagcagct

SEQ ID NO: 2956248 - DNA, 21 bp, Homo sapiens
tgctcagggaaaagcagctct

SEQ ID NO: 2956249 - DNA, 22 bp, Homo sapiens
tgctcagggaaaagcagctctc

SEQ ID NO: 2956250 - DNA, 15 bp, Homo sapiens
tgctcagtcgccctg

SEQ ID NO: 2956251 - DNA, 13 bp, Homo sapiens
tgctcagttgcta

SEQ ID NO: 2956252 - DNA, 14 bp, Homo sapiens
tgctcagttgctaa

SEQ ID NO: 2956253 - DNA, 13 bp, Homo sapiens
tgctcagttgtag

SEQ ID NO: 2956254 - DNA, 20 bp, Homo sapiens
tgctcagttgtagaatgtat

SEQ ID NO: 2956255 - DNA, 19 bp, Homo sapiens
tgctcatcattctctgtct

SEQ ID NO: 2956256 - DNA, 20 bp, Homo sapiens
tgctcatcattctctgtctc

SEQ ID NO: 2956257 - DNA, 16 bp, Homo sapiens
tgctcatgtgtgtggt

SEQ ID NO: 2956258 - DNA, 20 bp, Homo sapiens
tgctcatgtttggaaagctg

SEQ ID NO: 2956259 - DNA, 22 bp, Homo sapiens
tgctcatgtttggaaagctgaa

SEQ ID NO: 2956260 - DNA, 17 bp, Homo sapiens
tgctccaagatgttctc

SEQ ID NO: 2956261 - DNA, 19 bp, Homo sapiens
tgctccaagattctagatg

SEQ ID NO: 2956262 - DNA, 23 bp, Homo sapiens
tgctccaataaaggaacataaag

SEQ ID NO: 2956263 - DNA, 16 bp, Homo sapiens
tgctccagggtcaggc

SEQ ID NO: 2956264 - DNA, 17 bp, Homo sapiens
tgctccagggtcaggcg

SEQ ID NO: 2956265 - DNA, 19 bp, Homo sapiens
tgctccagggtcaggcgga

SEQ ID NO: 2956266 - DNA, 12 bp, Homo sapiens
tgctccatctcc

SEQ ID NO: 2956267 - DNA, 22 bp, Homo sapiens
tgctccatgtttccaccaaatg

SEQ ID NO: 2956268 - DNA, 14 bp, Homo sapiens
tgctccattttctt

SEQ ID NO: 2956269 - DNA, 21 bp, Homo sapiens
tgctcccacacttgtgccagc

SEQ ID NO: 2956270 - DNA, 17 bp, Homo sapiens
tgctcccacggggacca

SEQ ID NO: 2956271 - DNA, 18 bp, Homo sapiens
tgctccccacccctaccg

SEQ ID NO: 2956272 - DNA, 21 bp, Homo sapiens
tgctccctcccatcctccagc

SEQ ID NO: 2956273 - DNA, 19 bp, Homo sapiens
tgctcccttcgctctgctg

SEQ ID NO: 2956274 - DNA, 22 bp, Homo sapiens
tgctcccttttacattctgtgt

SEQ ID NO: 2956275 - DNA, 16 bp, Homo sapiens
tgctccgctgcctgga

SEQ ID NO: 2956276 - DNA, 17 bp, Homo sapiens
tgctccgctgcctggaa

SEQ ID NO: 2956277 - DNA, 13 bp, Homo sapiens
tgctccgtggact

SEQ ID NO: 2956278 - DNA, 19 bp, Homo sapiens
tgctccgtggactgcagtc

SEQ ID NO: 2956279 - DNA, 14 bp, Homo sapiens
tgctcctagaggga

SEQ ID NO: 2956280 - DNA, 15 bp, Homo sapiens
tgctcctcatctgcc

SEQ ID NO: 2956281 - DNA, 21 bp, Homo sapiens
tgctcctcatctgcctggaaa

SEQ ID NO: 2956282 - DNA, 16 bp, Homo sapiens
tgctcctccagggcca

SEQ ID NO: 2956283 - DNA, 17 bp, Homo sapiens
tgctcctgcccagccac

SEQ ID NO: 2956284 - DNA, 20 bp, Homo sapiens
tgctcctggggagaaagagg

SEQ ID NO: 2956285 - DNA, 19 bp, Homo sapiens
tgctccttccaacaggagc

SEQ ID NO: 2956286 - DNA, 12 bp, Homo sapiens
tgctccttgggc

SEQ ID NO: 2956287 - DNA, 21 bp, Homo sapiens
tgctccttgggccctttgagt

SEQ ID NO: 2956288 - DNA, 17 bp, Homo sapiens
tgctcgcccaggaaggc

SEQ ID NO: 2956289 - DNA, 23 bp, Homo sapiens
tgctcgcccaggaaggcctaggc

SEQ ID NO: 2956290 - DNA, 17 bp, Homo sapiens
tgctcgggaagggaggg

SEQ ID NO: 2956291 - DNA, 13 bp, Homo sapiens
tgctctactgtta

SEQ ID NO: 2956292 - DNA, 20 bp, Homo sapiens
tgctctactgttactaggct

SEQ ID NO: 2956293 - DNA, 20 bp, Homo sapiens
tgctctagatgagctgggcc

SEQ ID NO: 2956294 - DNA, 13 bp, Homo sapiens
tgctctaggaaga

SEQ ID NO: 2956295 - DNA, 16 bp, Homo sapiens
tgctctagtgccttct

SEQ ID NO: 2956296 - DNA, 15 bp, Homo sapiens
tgctctatatgtaat

SEQ ID NO: 2956297 - DNA, 21 bp, Homo sapiens
tgctctatcttgctctgtaat

SEQ ID NO: 2956298 - DNA, 14 bp, Homo sapiens
tgctctcactgttt

SEQ ID NO: 2956299 - DNA, 22 bp, Homo sapiens
tgctctcactgtttgtttttat

SEQ ID NO: 2956300 - DNA, 17 bp, Homo sapiens
tgctctccaagcccagt

SEQ ID NO: 2956301 - DNA, 21 bp, Homo sapiens
tgctctctgcagccagcccag

SEQ ID NO: 2956302 - DNA, 13 bp, Homo sapiens
tgctctctgtgtc

SEQ ID NO: 2956303 - DNA, 22 bp, Homo sapiens
tgctctcttgtgacgtgcactg

SEQ ID NO: 2956304 - DNA, 13 bp, Homo sapiens
tgctctgatccct

SEQ ID NO: 2956305 - DNA, 16 bp, Homo sapiens
tgctctgcttgacaac

SEQ ID NO: 2956306 - DNA, 14 bp, Homo sapiens
tgctcttacttccc

SEQ ID NO: 2956307 - DNA, 16 bp, Homo sapiens
tgctcttacttccccc

SEQ ID NO: 2956308 - DNA, 21 bp, Homo sapiens
tgctcttacttcccccaccct

SEQ ID NO: 2956309 - DNA, 22 bp, Homo sapiens
tgctcttacttcccccaccctg

SEQ ID NO: 2956310 - DNA, 17 bp, Homo sapiens
tgctcttatattttcat

SEQ ID NO: 2956311 - DNA, 13 bp, Homo sapiens
tgctcttcagtgg

SEQ ID NO: 2956312 - DNA, 13 bp, Homo sapiens
tgctcttctcctt

SEQ ID NO: 2956313 - DNA, 20 bp, Homo sapiens
tgctcttgaccttgtagaga

SEQ ID NO: 2956314 - DNA, 22 bp, Homo sapiens
tgctcttgtgatgtttgctcag

SEQ ID NO: 2956315 - DNA, 12 bp, Homo sapiens
tgctctttccca

SEQ ID NO: 2956316 - DNA, 16 bp, Homo sapiens
tgctctttcccaggac

SEQ ID NO: 2956317 - DNA, 13 bp, Homo sapiens
tgctcttttacta

SEQ ID NO: 2956318 - DNA, 15 bp, Homo sapiens
tgctgaaataaacta

SEQ ID NO: 2956319 - DNA, 22 bp, Homo sapiens
tgctgaagctgctgcagccctg

SEQ ID NO: 2956320 - DNA, 20 bp, Homo sapiens
tgctgaatgtcattatttga

SEQ ID NO: 2956321 - DNA, 18 bp, Homo sapiens
tgctgaatgttgggactg

SEQ ID NO: 2956322 - DNA, 14 bp, Homo sapiens
tgctgacagctgct

SEQ ID NO: 2956323 - DNA, 16 bp, Homo sapiens
tgctgacagctgctcc

SEQ ID NO: 2956324 - DNA, 18 bp, Homo sapiens
tgctgacattcacctgcc

SEQ ID NO: 2956325 - DNA, 15 bp, Homo sapiens
tgctgacctcacctg

SEQ ID NO: 2956326 - DNA, 16 bp, Homo sapiens
tgctgacctccacagc

SEQ ID NO: 2956327 - DNA, 15 bp, Homo sapiens
tgctgacggccaggg

SEQ ID NO: 2956328 - DNA, 23 bp, Homo sapiens
tgctgactctctgagctggggag

SEQ ID NO: 2956329 - DNA, 15 bp, Homo sapiens
tgctgagagacccaa

SEQ ID NO: 2956330 - DNA, 22 bp, Homo sapiens
tgctgagagacccaaggaggaa

SEQ ID NO: 2956331 - DNA, 18 bp, Homo sapiens
tgctgagatacatacaga

SEQ ID NO: 2956332 - DNA, 20 bp, Homo sapiens
tgctgagatacatacagaat

SEQ ID NO: 2956333 - DNA, 17 bp, Homo sapiens
tgctgagcctctgctcc

SEQ ID NO: 2956334 - DNA, 20 bp, Homo sapiens
tgctgagcctctgctcccca

SEQ ID NO: 2956335 - DNA, 24 bp, Homo sapiens
tgctgagtagatgcgcagccccat

SEQ ID NO: 2956336 - DNA, 20 bp, Homo sapiens
tgctgataccatatgaatga

SEQ ID NO: 2956337 - DNA, 21 bp, Homo sapiens
tgctgataccatatgaatgaa

SEQ ID NO: 2956338 - DNA, 17 bp, Homo sapiens
tgctgatcaatgaaatg

SEQ ID NO: 2956339 - DNA, 18 bp, Homo sapiens
tgctgatcaatgaaatgc

SEQ ID NO: 2956340 - DNA, 21 bp, Homo sapiens
tgctgatcatcgccagaggtg

SEQ ID NO: 2956341 - DNA, 21 bp, Homo sapiens
tgctgatcgccttatttatat

SEQ ID NO: 2956342 - DNA, 20 bp, Homo sapiens
tgctgatgaatcactgtttt

SEQ ID NO: 2956343 - DNA, 20 bp, Homo sapiens
tgctgatgacctcaagtagc

SEQ ID NO: 2956344 - DNA, 21 bp, Homo sapiens
tgctgatgttcagtgtaattt

SEQ ID NO: 2956345 - DNA, 21 bp, Homo sapiens
tgctgcaaatagccttcctga

SEQ ID NO: 2956346 - DNA, 14 bp, Homo sapiens
tgctgcacatagca

SEQ ID NO: 2956347 - DNA, 15 bp, Homo sapiens
tgctgcagccctgcc

SEQ ID NO: 2956348 - DNA, 20 bp, Homo sapiens
tgctgccaagtcctgccttt

SEQ ID NO: 2956349 - DNA, 23 bp, Homo sapiens
tgggagaatcagcagaacctgta

SEQ ID NO: 2956350 - DNA, 17 bp, Homo sapiens
tgggagaattgcttgag

SEQ ID NO: 2956351 - DNA, 19 bp, Homo sapiens
tgggagacacccaaagggt

SEQ ID NO: 2956352 - DNA, 22 bp, Homo sapiens
tgggagagtgtcaaccagacag

SEQ ID NO: 2956353 - DNA, 14 bp, Homo sapiens
tgggagatgttaga

SEQ ID NO: 2956354 - DNA, 15 bp, Homo sapiens
tgggagcaggatttt

SEQ ID NO: 2956355 - DNA, 23 bp, Homo sapiens
tgggagcttcccacacctgcctg

SEQ ID NO: 2956356 - DNA, 11 bp, Homo sapiens
tgggaggagac

SEQ ID NO: 2956357 - DNA, 16 bp, Homo sapiens
tgggaggagaccagcg

SEQ ID NO: 2956358 - DNA, 18 bp, Homo sapiens
tgggaggagggcaggcat

SEQ ID NO: 2956359 - DNA, 15 bp, Homo sapiens
tgggaggatcctgag

SEQ ID NO: 2956360 - DNA, 20 bp, Homo sapiens
tgggaggatcctgagctgct

SEQ ID NO: 2956361 - DNA, 12 bp, Homo sapiens
tgggaggcaggg

SEQ ID NO: 2956362 - DNA, 11 bp, Homo sapiens
tgggaggccaa

SEQ ID NO: 2956363 - DNA, 16 bp, Homo sapiens
tgggaggccaggcgag

SEQ ID NO: 2956364 - DNA, 16 bp, Homo sapiens
tgggaggccccactgg

SEQ ID NO: 2956365 - DNA, 18 bp, Homo sapiens
tgggaggccccactgggg

SEQ ID NO: 2956366 - DNA, 22 bp, Homo sapiens
tgggaggctcacccccttctcc

SEQ ID NO: 2956367 - DNA, 16 bp, Homo sapiens
tgggaggctgcagcca

SEQ ID NO: 2956368 - DNA, 19 bp, Homo sapiens
tgtaatgaattcctagaat

SEQ ID NO: 2956369 - DNA, 13 bp, Homo sapiens
tgtaatgatcttg

SEQ ID NO: 2956370 - DNA, 17 bp, Homo sapiens
tgtaatgcgattttatt

SEQ ID NO: 2956371 - DNA, 15 bp, Homo sapiens
tgtaatgcttatgtg

SEQ ID NO: 2956372 - DNA, 15 bp, Homo sapiens
tgtaattatgtaaat

SEQ ID NO: 2956373 - DNA, 21 bp, Homo sapiens
tgtaattgtgtaaaaaatgga

SEQ ID NO: 2956374 - DNA, 16 bp, Homo sapiens
tgtaattgttcctttt

SEQ ID NO: 2956375 - DNA, 19 bp, Homo sapiens
tgtaattgttccttttatt

SEQ ID NO: 2956376 - DNA, 18 bp, Homo sapiens
tgtaatttctttgcctgt

SEQ ID NO: 2956377 - DNA, 23 bp, Homo sapiens
tgtaatttctttgcctgttcagt

SEQ ID NO: 2956378 - DNA, 21 bp, Homo sapiens
tgtacaaaaattatgcaattc

SEQ ID NO: 2956379 - DNA, 14 bp, Homo sapiens
tgtacaaaatggtc

SEQ ID NO: 2956380 - DNA, 18 bp, Homo sapiens
tgtacaaggtatgtacag

SEQ ID NO: 2956381 - DNA, 14 bp, Homo sapiens
tgtacaagttgctt

SEQ ID NO: 2956382 - DNA, 12 bp, Homo sapiens
tgtacaataaaa

SEQ ID NO: 2956383 - DNA, 23 bp, Homo sapiens
tgtacacaaaggatttgatgctt

SEQ ID NO: 2956384 - DNA, 21 bp, Homo sapiens
tgtacacaacacctaaaacca

SEQ ID NO: 2956385 - DNA, 17 bp, Homo sapiens
tgtacacgtgtcctgta

SEQ ID NO: 2956386 - DNA, 17 bp, Homo sapiens
tgtacagaagaaactga

SEQ ID NO: 2956387 - DNA, 20 bp, Homo sapiens
tgtacagacatatttaactg

SEQ ID NO: 2956388 - DNA, 12 bp, Homo sapiens
tgtacagcccag

SEQ ID NO: 2956389 - DNA, 23 bp, Homo sapiens
tgtacagtatttttcagatataa

SEQ ID NO: 2956390 - DNA, 14 bp, Homo sapiens
tgtacagtctgtct

SEQ ID NO: 2956391 - DNA, 19 bp, Homo sapiens
tgtacagtctgtcttctgt

SEQ ID NO: 2956392 - DNA, 20 bp, Homo sapiens
tgtacagtctgtcttctgta

SEQ ID NO: 2956393 - DNA, 22 bp, Homo sapiens
tgtacagttatctaagttaatt

SEQ ID NO: 2956394 - DNA, 20 bp, Homo sapiens
tgtacagttttgtggactga

SEQ ID NO: 2956395 - DNA, 17 bp, Homo sapiens
tgtacatagtaaagtat

SEQ ID NO: 2956396 - DNA, 18 bp, Homo sapiens
tgtacatagtaaagtatt

SEQ ID NO: 2956397 - DNA, 17 bp, Homo sapiens
tgtacatcccatgtaac

SEQ ID NO: 2956398 - DNA, 23 bp, Homo sapiens
tgtacatcccatgtaacagaaag

SEQ ID NO: 2956399 - DNA, 18 bp, Homo sapiens
tgtacatctattttggat

SEQ ID NO: 2956400 - DNA, 21 bp, Homo sapiens
tgtacatctattttggattgt

SEQ ID NO: 2956401 - DNA, 23 bp, Homo sapiens
tgtacatctattttggattgtat

SEQ ID NO: 2956402 - DNA, 18 bp, Homo sapiens
tgtacatgaaatttttgt

SEQ ID NO: 2956403 - DNA, 19 bp, Homo sapiens
tgtacatgaaatttttgta

SEQ ID NO: 2956404 - DNA, 16 bp, Homo sapiens
tgtacatgagaaggaa

SEQ ID NO: 2956405 - DNA, 19 bp, Homo sapiens
tgtacatggcagagtttgt

SEQ ID NO: 2956406 - DNA, 15 bp, Homo sapiens
tgtacatgtacatag

SEQ ID NO: 2956407 - DNA, 20 bp, Homo sapiens
tgtacatgtacatagtaaag

SEQ ID NO: 2956408 - DNA, 11 bp, Homo sapiens
tgtacatgtgt

SEQ ID NO: 2956409 - DNA, 22 bp, Homo sapiens
tgtacattagtcattcaataaa

SEQ ID NO: 2956410 - DNA, 21 bp, Homo sapiens
tgtacatttctataaatagat

SEQ ID NO: 2956411 - DNA, 14 bp, Homo sapiens
tgtacattttggat

SEQ ID NO: 2956412 - DNA, 20 bp, Homo sapiens
tgtacattttggatttcttt

SEQ ID NO: 2956413 - DNA, 12 bp, Homo sapiens
tgtaccacaccc

SEQ ID NO: 2956414 - DNA, 16 bp, Homo sapiens
tgtaccacaccctgcc

SEQ ID NO: 2956415 - DNA, 19 bp, Homo sapiens
tgtaccacaccctgcctgc

SEQ ID NO: 2956416 - DNA, 21 bp, Homo sapiens
tgtaccacaccctgcctgctg

SEQ ID NO: 2956417 - DNA, 16 bp, Homo sapiens
tgtaccagtgaatttt

SEQ ID NO: 2956418 - DNA, 12 bp, Homo sapiens
tgtacccttaag

SEQ ID NO: 2956419 - DNA, 23 bp, Homo sapiens
tgtaccctttaagatatccatct

SEQ ID NO: 2956420 - DNA, 15 bp, Homo sapiens
tgtacctaaagcaat

SEQ ID NO: 2956421 - DNA, 15 bp, Homo sapiens
tgtacctcctctcag

SEQ ID NO: 2956422 - DNA, 17 bp, Homo sapiens
tgtacctgttccttaga

SEQ ID NO: 2956423 - DNA, 19 bp, Homo sapiens
tgtaccttattgatctttg

SEQ ID NO: 2956424 - DNA, 21 bp, Homo sapiens
tgtacgtagccacaggagccc

SEQ ID NO: 2956425 - DNA, 17 bp, Homo sapiens
tgtacgtccagcctgcc

SEQ ID NO: 2956426 - DNA, 16 bp, Homo sapiens
tgtacgtttgtatgtg

SEQ ID NO: 2956427 - DNA, 16 bp, Homo sapiens
tgtactaaagccaaac

SEQ ID NO: 2956428 - DNA, 18 bp, Homo sapiens
tgtactaaagccaaacat

SEQ ID NO: 2956429 - DNA, 15 bp, Homo sapiens
tgtactaagccagga

SEQ ID NO: 2956430 - DNA, 18 bp, Homo sapiens
tgtactaagccaggaggc

SEQ ID NO: 2956431 - DNA, 12 bp, Homo sapiens
tgtactccagcc

SEQ ID NO: 2956432 - DNA, 15 bp, Homo sapiens
tgtactccagcctgg

SEQ ID NO: 2956433 - DNA, 20 bp, Homo sapiens
tgtactccagcctgggcaac

SEQ ID NO: 2956434 - DNA, 18 bp, Homo sapiens
tgtactccagcctgggtg

SEQ ID NO: 2956435 - DNA, 19 bp, Homo sapiens
tgtactccagcctgggtga

SEQ ID NO: 2956436 - DNA, 18 bp, Homo sapiens
tgtactggagagtggcaa

SEQ ID NO: 2956437 - DNA, 18 bp, Homo sapiens
tgtactggtaattgtaca

SEQ ID NO: 2956438 - DNA, 24 bp, Homo sapiens
tgtactgtttaatgttctgtgata

SEQ ID NO: 2956439 - DNA, 23 bp, Homo sapiens
tgtacttgaagtctaaaagcaga

SEQ ID NO: 2956440 - DNA, 19 bp, Homo sapiens
tgtactttctaagagaaag

SEQ ID NO: 2956441 - DNA, 12 bp, Homo sapiens
tgtactttgttt

SEQ ID NO: 2956442 - DNA, 16 bp, Homo sapiens
tgtactttgtttttcc

SEQ ID NO: 2956443 - DNA, 17 bp, Homo sapiens
tgtactttgtttttcca

SEQ ID NO: 2956444 - DNA, 13 bp, Homo sapiens
tgtagaaacattt

SEQ ID NO: 2956445 - DNA, 21 bp, Homo sapiens
tgtagaaatgatgatgtggaa

SEQ ID NO: 2956446 - DNA, 21 bp, Homo sapiens
tgtagaaattcttaatttgga

SEQ ID NO: 2956447 - DNA, 19 bp, Homo sapiens
tgtagaactgattttacaa

SEQ ID NO: 2956448 - DNA, 15 bp, Homo sapiens
tgtagaataaatgaa

SEQ ID NO: 2956449 - DNA, 17 bp, Homo sapiens
tgtagacattgtaaata

SEQ ID NO: 2956450 - DNA, 20 bp, Homo sapiens
tgtagacattgtaaataaat

SEQ ID NO: 2956451 - DNA, 22 bp, Homo sapiens
tgtagactatggaatgtcagtg

SEQ ID NO: 2956452 - DNA, 13 bp, Homo sapiens
tgtagagaaaagg

SEQ ID NO: 2956453 - DNA, 13 bp, Homo sapiens
tgtagagccagcc

SEQ ID NO: 2956454 - DNA, 15 bp, Homo sapiens
tgtagataacagcaa

SEQ ID NO: 2956455 - DNA, 12 bp, Homo sapiens
tgtagcagcagc

SEQ ID NO: 2956456 - DNA, 16 bp, Homo sapiens
tgtagcccaggctgga

SEQ ID NO: 2956457 - DNA, 16 bp, Homo sapiens
tgtagccccctggcct

SEQ ID NO: 2956458 - DNA, 16 bp, Homo sapiens
tgtagcctgtgcatgt

SEQ ID NO: 2956459 - DNA, 21 bp, Homo sapiens
tgtagctgtccaaaataataa

SEQ ID NO: 2956460 - DNA, 12 bp, Homo sapiens
tgtagctttcct

SEQ ID NO: 2956461 - DNA, 15 bp, Homo sapiens
tgtagctttctggaa

SEQ ID NO: 2956462 - DNA, 16 bp, Homo sapiens
tgtagctttttattaa

SEQ ID NO: 2956463 - DNA, 20 bp, Homo sapiens
tgtaggacttttaaacaaaa

SEQ ID NO: 2956464 - DNA, 13 bp, Homo sapiens
tgtaggagaaact

SEQ ID NO: 2956465 - DNA, 15 bp, Homo sapiens
tgtaggagctgcctt

SEQ ID NO: 2956466 - DNA, 21 bp, Homo sapiens
tgtagggaaaaaaatgcttct

SEQ ID NO: 2956467 - DNA, 22 bp, Homo sapiens
tgtagggaaaaaaatgcttctt

SEQ ID NO: 2956468 - DNA, 22 bp, Homo sapiens
tgtaggggagccacatttacat

SEQ ID NO: 2956469 - DNA, 18 bp, Homo sapiens
tgtagggtaaggtgcctt

SEQ ID NO: 2956470 - DNA, 22 bp, Homo sapiens
tgtagtaaagccgttgtttact

SEQ ID NO: 2956471 - DNA, 14 bp, Homo sapiens
tgtagtaattgaca

SEQ ID NO: 2956472 - DNA, 19 bp, Homo sapiens
tgtagtaattgacatgtgc

SEQ ID NO: 2956473 - DNA, 14 bp, Homo sapiens
tgtagtatcaaata

SEQ ID NO: 2956474 - DNA, 18 bp, Homo sapiens
tgtagtatcaaatattag

SEQ ID NO: 2956475 - DNA, 21 bp, Homo sapiens
tgtagtatttagtatatgaaa

SEQ ID NO: 2956476 - DNA, 14 bp, Homo sapiens
tgtagtcccagcta

SEQ ID NO: 2956477 - DNA, 22 bp, Homo sapiens
tgtagtccgtgctgacagctgc

SEQ ID NO: 2956478 - DNA, 15 bp, Homo sapiens
tgtagtcttgtctta

SEQ ID NO: 2956479 - DNA, 21 bp, Homo sapiens
tgtagtcttgtcttagctctg

SEQ ID NO: 2956480 - DNA, 21 bp, Homo sapiens
tgtagtgagatagcattgtga

SEQ ID NO: 2956481 - DNA, 21 bp, Homo sapiens
tgtagtgagcgagtggatgct

SEQ ID NO: 2956482 - DNA, 21 bp, Homo sapiens
tgtagttctttgttcctgctt

SEQ ID NO: 2956483 - DNA, 20 bp, Homo sapiens
tgtagttgcgtggactctgc

SEQ ID NO: 2956484 - DNA, 13 bp, Homo sapiens
tgtataaatgtct

SEQ ID NO: 2956485 - DNA, 16 bp, Homo sapiens
tgtataaatgtctatt

SEQ ID NO: 2956486 - DNA, 18 bp, Homo sapiens
tgtataaatgtctattat

SEQ ID NO: 2956487 - DNA, 13 bp, Homo sapiens
tgtataaattact

SEQ ID NO: 2956488 - DNA, 17 bp, Homo sapiens
tgtataacaggttattt

SEQ ID NO: 2956489 - DNA, 18 bp, Homo sapiens
tgtataacatcactgtca

SEQ ID NO: 2956490 - DNA, 23 bp, Homo sapiens
tgtataagtagatctgctttctg

SEQ ID NO: 2956491 - DNA, 16 bp, Homo sapiens
tgtatacaaccctggc

SEQ ID NO: 2956492 - DNA, 18 bp, Homo sapiens
tgtatacacaaatatata

SEQ ID NO: 2956493 - DNA, 20 bp, Homo sapiens
tgtataccagcctactgtac

SEQ ID NO: 2956494 - DNA, 17 bp, Homo sapiens
tgtataccatgatgcat

SEQ ID NO: 2956495 - DNA, 22 bp, Homo sapiens
tgtataccatgatgcatggagt

SEQ ID NO: 2956496 - DNA, 19 bp, Homo sapiens
tgtatgtggatacagtcat

SEQ ID NO: 2956497 - DNA, 22 bp, Homo sapiens
tgtattaaacctttccatttta

SEQ ID NO: 2956498 - DNA, 15 bp, Homo sapiens
tgtattaaacttgaa

SEQ ID NO: 2956499 - DNA, 17 bp, Homo sapiens
tgtattaacttgtagat

SEQ ID NO: 2956500 - DNA, 14 bp, Homo sapiens
tgtattaagccact

SEQ ID NO: 2956501 - DNA, 19 bp, Homo sapiens
tgtattaagggatttagta

SEQ ID NO: 2956502 - DNA, 22 bp, Homo sapiens
tgtattaataaatagagcaatt

SEQ ID NO: 2956503 - DNA, 13 bp, Homo sapiens
tgtattacaaatc

SEQ ID NO: 2956504 - DNA, 22 bp, Homo sapiens
tgtattacaaatccaatgaaat

SEQ ID NO: 2956505 - DNA, 17 bp, Homo sapiens
tgtattagccagtcatt

SEQ ID NO: 2956506 - DNA, 20 bp, Homo sapiens
tgtattagccagtcattgta

SEQ ID NO: 2956507 - DNA, 21 bp, Homo sapiens
tgtattagccagtcattgtaa

SEQ ID NO: 2956508 - DNA, 18 bp, Homo sapiens
tgtattagtgatatttct

SEQ ID NO: 2956509 - DNA, 20 bp, Homo sapiens
tgtattatttcattatgtaa

SEQ ID NO: 2956510 - DNA, 14 bp, Homo sapiens
tgtattcagacaga

SEQ ID NO: 2956511 - DNA, 17 bp, Homo sapiens
tgtattcatgttcatgt

SEQ ID NO: 2956512 - DNA, 14 bp, Homo sapiens
tgtattctctgagc

SEQ ID NO: 2956513 - DNA, 20 bp, Homo sapiens
tgtattctctgagctgtgca

SEQ ID NO: 2956514 - DNA, 17 bp, Homo sapiens
tgtattctttgatgtta

SEQ ID NO: 2956515 - DNA, 16 bp, Homo sapiens
tgtattgaatcatgta

SEQ ID NO: 2956516 - DNA, 22 bp, Homo sapiens
tgtattgctccattttcttgtc

SEQ ID NO: 2956517 - DNA, 12 bp, Homo sapiens
tgtattggaatt

SEQ ID NO: 2956518 - DNA, 11 bp, Homo sapiens
tgtattgtacc

SEQ ID NO: 2956519 - DNA, 19 bp, Homo sapiens
tgtattgtaccttttaaca

SEQ ID NO: 2956520 - DNA, 16 bp, Homo sapiens
tgtatttaatgatttt

SEQ ID NO: 2956521 - DNA, 20 bp, Homo sapiens
tgtatttacgctttgattca

SEQ ID NO: 2956522 - DNA, 12 bp, Homo sapiens
tgtatttcctga

SEQ ID NO: 2956523 - DNA, 22 bp, Homo sapiens
tgtatttccttttctaaatcct

SEQ ID NO: 2956524 - DNA, 15 bp, Homo sapiens
tgtatttctcttgtc

SEQ ID NO: 2956525 - DNA, 20 bp, Homo sapiens
tgtatttgtgactaattgta

SEQ ID NO: 2956526 - DNA, 22 bp, Homo sapiens
tgtatttgtgactaattgtata

SEQ ID NO: 2956527 - DNA, 14 bp, Homo sapiens
tgtattttaaaata

SEQ ID NO: 2956528 - DNA, 17 bp, Homo sapiens
tgtattttccaagtgtg

SEQ ID NO: 2956529 - DNA, 15 bp, Homo sapiens
tgtattttctgtcac

SEQ ID NO: 2956530 - DNA, 15 bp, Homo sapiens
tgtattttgaaaaca

SEQ ID NO: 2956531 - DNA, 17 bp, Homo sapiens
tgtattttgaaaacact

SEQ ID NO: 2956532 - DNA, 15 bp, Homo sapiens
tgtattttgatgaga

SEQ ID NO: 2956533 - DNA, 18 bp, Homo sapiens
tgtattttgatgagatat

SEQ ID NO: 2956534 - DNA, 14 bp, Homo sapiens
tgtattttggaaga

SEQ ID NO: 2956535 - DNA, 17 bp, Homo sapiens
tgtattttggaagacat

SEQ ID NO: 2956536 - DNA, 14 bp, Homo sapiens
tgtattttgtattg

SEQ ID NO: 2956537 - DNA, 14 bp, Homo sapiens
tgtattttgtccaa

SEQ ID NO: 2956538 - DNA, 21 bp, Homo sapiens
tgtattttgtccaagttcaca

SEQ ID NO: 2956539 - DNA, 17 bp, Homo sapiens
tgtcaaacaaagccaga

SEQ ID NO: 2956540 - DNA, 22 bp, Homo sapiens
tgtcaaacaaagccagaagctg

SEQ ID NO: 2956541 - DNA, 13 bp, Homo sapiens
tgtcaaacaaata

SEQ ID NO: 2956542 - DNA, 21 bp, Homo sapiens
tgtcaaacaaatagtctatca

SEQ ID NO: 2956543 - DNA, 14 bp, Homo sapiens
tgtcaaagaaggtt

SEQ ID NO: 2956544 - DNA, 17 bp, Homo sapiens
tgtcaaagtgaaagaca

SEQ ID NO: 2956545 - DNA, 18 bp, Homo sapiens
tgtcaaagtgaaagacat

SEQ ID NO: 2956546 - DNA, 23 bp, Homo sapiens
tgtcaaagtgaaagacatttcaa

SEQ ID NO: 2956547 - DNA, 15 bp, Homo sapiens
tgtcaacattgtgat

SEQ ID NO: 2956548 - DNA, 17 bp, Homo sapiens
tgtcaaccagacagagg

SEQ ID NO: 2956549 - DNA, 15 bp, Homo sapiens
tgtcaactttcattt

SEQ ID NO: 2956550 - DNA, 16 bp, Homo sapiens
tgtcaactttcatttg

SEQ ID NO: 2956551 - DNA, 17 bp, Homo sapiens
tgtcaactttcatttga

SEQ ID NO: 2956552 - DNA, 18 bp, Homo sapiens
tgtcaactttcatttgaa

SEQ ID NO: 2956553 - DNA, 20 bp, Homo sapiens
tgtcaagaaattctgctgtt

SEQ ID NO: 2956554 - DNA, 17 bp, Homo sapiens
tgtcaagagtagttata

SEQ ID NO: 2956555 - DNA, 16 bp, Homo sapiens
tgtcaagcctgtgcaa

SEQ ID NO: 2956556 - DNA, 20 bp, Homo sapiens
tgtcaagcctgtgcaaaaaa

SEQ ID NO: 2956557 - DNA, 20 bp, Homo sapiens
tgtcaagtataaagtcagga

SEQ ID NO: 2956558 - DNA, 21 bp, Homo sapiens
tgtcaagtcctgactgggctg

SEQ ID NO: 2956559 - DNA, 20 bp, Homo sapiens
tgtcaagtgttttactatct

SEQ ID NO: 2956560 - DNA, 13 bp, Homo sapiens
tgtcacagctctt

SEQ ID NO: 2956561 - DNA, 18 bp, Homo sapiens
tgtcacagctcttgtttg

SEQ ID NO: 2956562 - DNA, 15 bp, Homo sapiens
tgtccaaaactgcct

SEQ ID NO: 2956563 - DNA, 13 bp, Homo sapiens
tgtccaaaattta

SEQ ID NO: 2956564 - DNA, 20 bp, Homo sapiens
tgtccaaacaggtgctggcc

SEQ ID NO: 2956565 - DNA, 24 bp, Homo sapiens
tgtccaaacaggtgctggcccagc

SEQ ID NO: 2956566 - DNA, 19 bp, Homo sapiens
tgtccaaaccagcaaactt

SEQ ID NO: 2956567 - DNA, 16 bp, Homo sapiens
tgtccaaatttaatgt

SEQ ID NO: 2956568 - DNA, 23 bp, Homo sapiens
tgtccaacatggtgaaaccccca

SEQ ID NO: 2956569 - DNA, 14 bp, Homo sapiens
tgtccaatcctatg

SEQ ID NO: 2956570 - DNA, 15 bp, Homo sapiens
tgtccacacccagct

SEQ ID NO: 2956571 - DNA, 18 bp, Homo sapiens
tgtccacacccagctcag

SEQ ID NO: 2956572 - DNA, 21 bp, Homo sapiens
tgtccacatccccagagccca

SEQ ID NO: 2956573 - DNA, 22 bp, Homo sapiens
tgtccacatccccagagcccag

SEQ ID NO: 2956574 - DNA, 13 bp, Homo sapiens
tgtccacctggcc

SEQ ID NO: 2956575 - DNA, 19 bp, Homo sapiens
tgtccacgactgtctccat

SEQ ID NO: 2956576 - DNA, 18 bp, Homo sapiens
tgtccacttgtgggtcct

SEQ ID NO: 2956577 - DNA, 22 bp, Homo sapiens
tgtccacttgtgggtcctgggg

SEQ ID NO: 2956578 - DNA, 15 bp, Homo sapiens
tgtccagcaccttgt

SEQ ID NO: 2956579 - DNA, 23 bp, Homo sapiens
tgtccagctccaacctgcaaaga

SEQ ID NO: 2956580 - DNA, 17 bp, Homo sapiens
tgtccagctcccgctgt

SEQ ID NO: 2956581 - DNA, 12 bp, Homo sapiens
tgtccaggaagt

SEQ ID NO: 2956582 - DNA, 14 bp, Homo sapiens
tgtccagggcccca

SEQ ID NO: 2956583 - DNA, 16 bp, Homo sapiens
tgtccaggtaggaaac

SEQ ID NO: 2956584 - DNA, 20 bp, Homo sapiens
tgtccatcatattaaaaata

SEQ ID NO: 2956585 - DNA, 17 bp, Homo sapiens
tgtccatcctcctctcc

SEQ ID NO: 2956586 - DNA, 19 bp, Homo sapiens
tgtccatcctcctctccat

SEQ ID NO: 2956587 - DNA, 14 bp, Homo sapiens
tgtccatcctgacc

SEQ ID NO: 2956588 - DNA, 14 bp, Homo sapiens
tgtccatctgcccg

SEQ ID NO: 2956589 - DNA, 13 bp, Homo sapiens
tgtccatgtcccc

SEQ ID NO: 2956590 - DNA, 14 bp, Homo sapiens
tgtccattgtccaa

SEQ ID NO: 2956591 - DNA, 16 bp, Homo sapiens
tgtccattttgtgaag

SEQ ID NO: 2956592 - DNA, 22 bp, Homo sapiens
tgtccattttgtgaagccctgt

SEQ ID NO: 2956593 - DNA, 16 bp, Homo sapiens
tgtcccaagctcccaa

SEQ ID NO: 2956594 - DNA, 22 bp, Homo sapiens
tgtcccaagctcccaagagctt

SEQ ID NO: 2956595 - DNA, 16 bp, Homo sapiens
tgtcccactatctggg

SEQ ID NO: 2956596 - DNA, 20 bp, Homo sapiens
tgtcccagaggctgccccac

SEQ ID NO: 2956597 - DNA, 18 bp, Homo sapiens
tgtcccaggactcaccct

SEQ ID NO: 2956598 - DNA, 14 bp, Homo sapiens
tgtcccaggcaggg

SEQ ID NO: 2956599 - DNA, 23 bp, Homo sapiens
tgtcccagtagccaaggcccggg

SEQ ID NO: 2956600 - DNA, 13 bp, Homo sapiens
tgtcccagtgaac

SEQ ID NO: 2956601 - DNA, 15 bp, Homo sapiens
tgtcccatccttccc

SEQ ID NO: 2956602 - DNA, 16 bp, Homo sapiens
tgtcccatccttccca

SEQ ID NO: 2956603 - DNA, 19 bp, Homo sapiens
tgtccccaaatccgaacct

SEQ ID NO: 2956604 - DNA, 21 bp, Homo sapiens
tgtccccaaatccgaacctcc

SEQ ID NO: 2956605 - DNA, 22 bp, Homo sapiens
tgtccccaaatccgaacctcct

SEQ ID NO: 2956606 - DNA, 19 bp, Homo sapiens
tgtccccagtttgcagaaa

SEQ ID NO: 2956607 - DNA, 20 bp, Homo sapiens
tgtccccctaatattaggga

SEQ ID NO: 2956608 - DNA, 18 bp, Homo sapiens
tgtccccctctgtccagg

SEQ ID NO: 2956609 - DNA, 16 bp, Homo sapiens
tgtccccgcagccctg

SEQ ID NO: 2956610 - DNA, 22 bp, Homo sapiens
tgtccccgccttccctcactct

SEQ ID NO: 2956611 - DNA, 23 bp, Homo sapiens
tgtccccgccttccctcactctt

SEQ ID NO: 2956612 - DNA, 18 bp, Homo sapiens
tgtccccggggcccaggg

SEQ ID NO: 2956613 - DNA, 14 bp, Homo sapiens
tgtcccctcacaga

SEQ ID NO: 2956614 - DNA, 14 bp, Homo sapiens
tgtcccctgacctg

SEQ ID NO: 2956615 - DNA, 18 bp, Homo sapiens
tgtcccctgacctgtcca

SEQ ID NO: 2956616 - DNA, 12 bp, Homo sapiens
tgtcccctgctt

SEQ ID NO: 2956617 - DNA, 14 bp, Homo sapiens
tgtcccctggggct

SEQ ID NO: 2956618 - DNA, 15 bp, Homo sapiens
tgtccccttcatcct

SEQ ID NO: 2956619 - DNA, 15 bp, Homo sapiens
tgtccctacaggagg

SEQ ID NO: 2956620 - DNA, 21 bp, Homo sapiens
tgtccctagtaaaaatacaaa

SEQ ID NO: 2956621 - DNA, 20 bp, Homo sapiens
tgtccctatttatgatttca

SEQ ID NO: 2956622 - DNA, 22 bp, Homo sapiens
tgtccctcctggtgtcacccca

SEQ ID NO: 2956623 - DNA, 19 bp, Homo sapiens
tgtccctctcagtgccttc

SEQ ID NO: 2956624 - DNA, 24 bp, Homo sapiens
tgtccctctcagtgccttctctca

SEQ ID NO: 2956625 - DNA, 18 bp, Homo sapiens
tgtccctgcactgtgccc

SEQ ID NO: 2956626 - DNA, 13 bp, Homo sapiens
tgtccctgccttc

SEQ ID NO: 2956627 - DNA, 13 bp, Homo sapiens
tgtccctgctggg

SEQ ID NO: 2956628 - DNA, 21 bp, Homo sapiens
tgtccctgctggggtctcagg

SEQ ID NO: 2956629 - DNA, 19 bp, Homo sapiens
tgtccctggcgctgtgcta

SEQ ID NO: 2956630 - DNA, 12 bp, Homo sapiens
tgtccctggggc

SEQ ID NO: 2956631 - DNA, 13 bp, Homo sapiens
tgtccctggggca

SEQ ID NO: 2956632 - DNA, 18 bp, Homo sapiens
tgtccctggggcactccc

SEQ ID NO: 2956633 - DNA, 22 bp, Homo sapiens
tgtccctggggcactcccccag

SEQ ID NO: 2956634 - DNA, 20 bp, Homo sapiens
tgtcccttctgtccctcaca

SEQ ID NO: 2956635 - DNA, 14 bp, Homo sapiens
tgtcccttgctgta

SEQ ID NO: 2956636 - DNA, 23 bp, Homo sapiens
tgtcccttgcttgcctgcagggc

SEQ ID NO: 2956637 - DNA, 17 bp, Homo sapiens
tgtccgcataagaaaaa

SEQ ID NO: 2956638 - DNA, 18 bp, Homo sapiens
tgtccgtccagagccggc

SEQ ID NO: 2956639 - DNA, 16 bp, Homo sapiens
tgtcctaattcttctg

SEQ ID NO: 2956640 - DNA, 15 bp, Homo sapiens
tgtcctagtctcctt

SEQ ID NO: 2956641 - DNA, 18 bp, Homo sapiens
tgtcctatggacaactta

SEQ ID NO: 2956642 - DNA, 13 bp, Homo sapiens
tgtcctcaaagaa

SEQ ID NO: 2956643 - DNA, 13 bp, Homo sapiens
tgtcctcagcccc

SEQ ID NO: 2956644 - DNA, 21 bp, Homo sapiens
tgtcctcagccccgcgtggaa

SEQ ID NO: 2956645 - DNA, 17 bp, Homo sapiens
tgtcctcagccttgcca

SEQ ID NO: 2956646 - DNA, 18 bp, Homo sapiens
tgtcctcaggtggccatg

SEQ ID NO: 2956647 - DNA, 17 bp, Homo sapiens
tgtcctcatttctccag

SEQ ID NO: 2956648 - DNA, 13 bp, Homo sapiens
tgtcctctgtagt

SEQ ID NO: 2956649 - DNA, 18 bp, Homo sapiens
tgtcctgaagctgctgga

SEQ ID NO: 2956650 - DNA, 22 bp, Homo sapiens
tgtcctgaatggctttgtcttg

SEQ ID NO: 2956651 - DNA, 19 bp, Homo sapiens
tgtcctgacagcactcctc

SEQ ID NO: 2956652 - DNA, 18 bp, Homo sapiens
tgtcctgatgcttttgtc

SEQ ID NO: 2956653 - DNA, 18 bp, Homo sapiens
tgtcctgcaccggggcct

SEQ ID NO: 2956654 - DNA, 15 bp, Homo sapiens
tgtcctgggcctgca

SEQ ID NO: 2956655 - DNA, 16 bp, Homo sapiens
tgtcctggtggctggg

SEQ ID NO: 2956656 - DNA, 18 bp, Homo sapiens
tgtcctggtggctgggcc

SEQ ID NO: 2956657 - DNA, 23 bp, Homo sapiens
tgtcctggtggctgggcccagca

SEQ ID NO: 2956658 - DNA, 20 bp, Homo sapiens
tgtcctgtgaggtttcccaa

SEQ ID NO: 2956659 - DNA, 21 bp, Homo sapiens
tgtcctgtggcatgcaaaaga

SEQ ID NO: 2956660 - DNA, 21 bp, Homo sapiens
tgtcctgttaggccaactgcc

SEQ ID NO: 2956661 - DNA, 15 bp, Homo sapiens
tgtccttactcagag

SEQ ID NO: 2956662 - DNA, 16 bp, Homo sapiens
tgtccttactcagagc

SEQ ID NO: 2956663 - DNA, 20 bp, Homo sapiens
tgtccttactcagagctgcg

SEQ ID NO: 2956664 - DNA, 13 bp, Homo sapiens
tgtccttcttcct

SEQ ID NO: 2956665 - DNA, 20 bp, Homo sapiens
tgtccttcttcctcaagtct

SEQ ID NO: 2956666 - DNA, 16 bp, Homo sapiens
tgtccttgcacctgca

SEQ ID NO: 2956667 - DNA, 19 bp, Homo sapiens
tgtcctttaaaaaagaaaa

SEQ ID NO: 2956668 - DNA, 16 bp, Homo sapiens
tgtcctttaatatttg

SEQ ID NO: 2956669 - DNA, 13 bp, Homo sapiens
tgtcctttctaga

SEQ ID NO: 2956670 - DNA, 22 bp, Homo sapiens
tgtcgcccaggctggagggcag

SEQ ID NO: 2956671 - DNA, 21 bp, Homo sapiens
tgtcgcgtctcattttgtcca

SEQ ID NO: 2956672 - DNA, 15 bp, Homo sapiens
tgtcgtctctcccac

SEQ ID NO: 2956673 - DNA, 20 bp, Homo sapiens
tgtcgtgttttcaaggaaga

SEQ ID NO: 2956674 - DNA, 19 bp, Homo sapiens
tgtcgtttcattcattttg

SEQ ID NO: 2956675 - DNA, 13 bp, Homo sapiens
tgtctaaaacaat

SEQ ID NO: 2956676 - DNA, 16 bp, Homo sapiens
tgtctaaacaatgctg

SEQ ID NO: 2956677 - DNA, 21 bp, Homo sapiens
tgtctaaagccttaactaaga

SEQ ID NO: 2956678 - DNA, 13 bp, Homo sapiens
tgtctaagattct

SEQ ID NO: 2956679 - DNA, 14 bp, Homo sapiens
tgtctaagattcta

SEQ ID NO: 2956680 - DNA, 16 bp, Homo sapiens
tgtctaagattctaga

SEQ ID NO: 2956681 - DNA, 24 bp, Homo sapiens
tgtctaagcagttttgtaaatgta

SEQ ID NO: 2956682 - DNA, 13 bp, Homo sapiens
tgtctaattaaaa

SEQ ID NO: 2956683 - DNA, 17 bp, Homo sapiens
tgtctaattcatttact

SEQ ID NO: 2956684 - DNA, 17 bp, Homo sapiens
tgtctacattaaatcac

SEQ ID NO: 2956685 - DNA, 14 bp, Homo sapiens
tgtctactgaccaa

SEQ ID NO: 2956686 - DNA, 16 bp, Homo sapiens
tgtctactttctcttg

SEQ ID NO: 2956687 - DNA, 15 bp, Homo sapiens
tgtctagactggcct

SEQ ID NO: 2956688 - DNA, 14 bp, Homo sapiens
tgtctagagaggga

SEQ ID NO: 2956689 - DNA, 13 bp, Homo sapiens
tgtctagagcaac

SEQ ID NO: 2956690 - DNA, 17 bp, Homo sapiens
tgtctagcatgccaaca

SEQ ID NO: 2956691 - DNA, 19 bp, Homo sapiens
tgtctagtagaacaatgta

SEQ ID NO: 2956692 - DNA, 15 bp, Homo sapiens
tgtctatctctaata

SEQ ID NO: 2956693 - DNA, 17 bp, Homo sapiens
tgtctattattatgaag

SEQ ID NO: 2956694 - DNA, 19 bp, Homo sapiens
tgtctcaaaaaaaaaaaga

SEQ ID NO: 2956695 - DNA, 16 bp, Homo sapiens
tgtctcacttttcatc

SEQ ID NO: 2956696 - DNA, 17 bp, Homo sapiens
tgtctcacttttcatct

SEQ ID NO: 2956697 - DNA, 11 bp, Homo sapiens
tgtctcagtga

SEQ ID NO: 2956698 - DNA, 13 bp, Homo sapiens
tgtctcagtgatt

SEQ ID NO: 2956699 - DNA, 21 bp, Homo sapiens
tgtgcaacggtctcctgactg

SEQ ID NO: 2956700 - DNA, 16 bp, Homo sapiens
tgtgcaactcttgtat

SEQ ID NO: 2956701 - DNA, 24 bp, Homo sapiens
tgtgcaactcttgtattgctccat

SEQ ID NO: 2956702 - DNA, 14 bp, Homo sapiens
tgtgcaagagaggg

SEQ ID NO: 2956703 - DNA, 18 bp, Homo sapiens
tgtgcaatagtcagagtg

SEQ ID NO: 2956704 - DNA, 18 bp, Homo sapiens
tgtgcaattactgcctgc

SEQ ID NO: 2956705 - DNA, 21 bp, Homo sapiens
tgtgcaattactgcctgcaga

SEQ ID NO: 2956706 - DNA, 18 bp, Homo sapiens
tgtgcaattcagtctgct

SEQ ID NO: 2956707 - DNA, 17 bp, Homo sapiens
tgtgcacatctgtgtct

SEQ ID NO: 2956708 - DNA, 17 bp, Homo sapiens
tgtgcactaaggggccc

SEQ ID NO: 2956709 - DNA, 15 bp, Homo sapiens
tgtgcactgtagcct

SEQ ID NO: 2956710 - DNA, 13 bp, Homo sapiens
tgtgcagaatctc

SEQ ID NO: 2956711 - DNA, 19 bp, Homo sapiens
tgtgcagccgctgagcgag

SEQ ID NO: 2956712 - DNA, 16 bp, Homo sapiens
tgtgcaggctgtctca

SEQ ID NO: 2956713 - DNA, 19 bp, Homo sapiens
tgtgcagggctggtttgtt

SEQ ID NO: 2956714 - DNA, 13 bp, Homo sapiens
tgtgcagttctag

SEQ ID NO: 2956715 - DNA, 22 bp, Homo sapiens
tgtgcagttctagtttgcattc

SEQ ID NO: 2956716 - DNA, 16 bp, Homo sapiens
tgtgcatagcgtcctg

SEQ ID NO: 2956717 - DNA, 23 bp, Homo sapiens
tgtgcatagcgtcctgccctgcc

SEQ ID NO: 2956718 - DNA, 15 bp, Homo sapiens
tgtgcatattgtaca

SEQ ID NO: 2956719 - DNA, 14 bp, Homo sapiens
tgtgcatctgtgtg

SEQ ID NO: 2956720 - DNA, 22 bp, Homo sapiens
tgtgccacagagtgtagccagg

SEQ ID NO: 2956721 - DNA, 15 bp, Homo sapiens
tgtgccacagatctt

SEQ ID NO: 2956722 - DNA, 15 bp, Homo sapiens
tgtgccaggcttgcc

SEQ ID NO: 2956723 - DNA, 19 bp, Homo sapiens
tgtgccaggcttgcctggg

SEQ ID NO: 2956724 - DNA, 18 bp, Homo sapiens
tgtgccagggcaatgatg

SEQ ID NO: 2956725 - DNA, 16 bp, Homo sapiens
tgtgccatagtcacat

SEQ ID NO: 2956726 - DNA, 21 bp, Homo sapiens
tgtgcccatcatctctgcctt

SEQ ID NO: 2956727 - DNA, 23 bp, Homo sapiens
tgtgccccttgacaactggcagg

SEQ ID NO: 2956728 - DNA, 15 bp, Homo sapiens
tgtgcctcccttccc

SEQ ID NO: 2956729 - DNA, 16 bp, Homo sapiens
tgtgcctcccttccca

SEQ ID NO: 2956730 - DNA, 17 bp, Homo sapiens
tgtgcctcccttcccag

SEQ ID NO: 2956731 - DNA, 22 bp, Homo sapiens
tgtgcctcccttcccagtgggc

SEQ ID NO: 2956732 - DNA, 14 bp, Homo sapiens
tgtgcctctgtcct

SEQ ID NO: 2956733 - DNA, 17 bp, Homo sapiens
tgtgcgctgcctggcca

SEQ ID NO: 2956734 - DNA, 23 bp, Homo sapiens
tgtgcgctgcctggccaggccct

SEQ ID NO: 2956735 - DNA, 16 bp, Homo sapiens
tgtgcggagcagcctt

SEQ ID NO: 2956736 - DNA, 15 bp, Homo sapiens
tgtgcgtggaaaaag

SEQ ID NO: 2956737 - DNA, 17 bp, Homo sapiens
tgtgcgtggaaaaagac

SEQ ID NO: 2956738 - DNA, 17 bp, Homo sapiens
tgtgcgtggaagtgttc

SEQ ID NO: 2956739 - DNA, 20 bp, Homo sapiens
tgtgcgtggaagtgttcctg

SEQ ID NO: 2956740 - DNA, 16 bp, Homo sapiens
tgtgcgtggtccgtgt

SEQ ID NO: 2956741 - DNA, 15 bp, Homo sapiens
tgtgcgtgttccttt

SEQ ID NO: 2956742 - DNA, 16 bp, Homo sapiens
tgtgcgttcccttcag

SEQ ID NO: 2956743 - DNA, 11 bp, Homo sapiens
tgtgctacaga

SEQ ID NO: 2956744 - DNA, 12 bp, Homo sapiens
tgtgctacagaa

SEQ ID NO: 2956745 - DNA, 19 bp, Homo sapiens
tgtgctacagagaaaatca

SEQ ID NO: 2956746 - DNA, 14 bp, Homo sapiens
tgtgctacgtgtga

SEQ ID NO: 2956747 - DNA, 20 bp, Homo sapiens
tgtgctacgtgtgaaatctg

SEQ ID NO: 2956748 - DNA, 20 bp, Homo sapiens
tgtgctagaaattttcaaga

SEQ ID NO: 2956749 - DNA, 19 bp, Homo sapiens
tgtgctagtcactggcagc

SEQ ID NO: 2956750 - DNA, 22 bp, Homo sapiens
tgtgctagtcactggcagcctg

SEQ ID NO: 2956751 - DNA, 21 bp, Homo sapiens
tgtgctataaaattaacagta

SEQ ID NO: 2956752 - DNA, 22 bp, Homo sapiens
tgtgctcagtcgccctgttctt

SEQ ID NO: 2956753 - DNA, 21 bp, Homo sapiens
tgtgctcatgtttggaaagct

SEQ ID NO: 2956754 - DNA, 22 bp, Homo sapiens
tgtgctccaacctgaaggtccc

SEQ ID NO: 2956755 - DNA, 11 bp, Homo sapiens
tgtgctcccac

SEQ ID NO: 2956756 - DNA, 16 bp, Homo sapiens
tgtgctcccacgggga

SEQ ID NO: 2956757 - DNA, 16 bp, Homo sapiens
tgtgctcctccttggt

SEQ ID NO: 2956758 - DNA, 18 bp, Homo sapiens
tgtgctctttcctgccct

SEQ ID NO: 2956759 - DNA, 13 bp, Homo sapiens
tgtgctgaacaca

SEQ ID NO: 2956760 - DNA, 23 bp, Homo sapiens
tgtgctgatgtagtgaccaagtg

SEQ ID NO: 2956761 - DNA, 17 bp, Homo sapiens
tgtgctgccctgaagaa

SEQ ID NO: 2956762 - DNA, 18 bp, Homo sapiens
tgtgctgctgtaagaaat

SEQ ID NO: 2956763 - DNA, 21 bp, Homo sapiens
tgtgctgggtgagctcttcca

SEQ ID NO: 2956764 - DNA, 19 bp, Homo sapiens
tgtgctgtgctatggtgct

SEQ ID NO: 2956765 - DNA, 23 bp, Homo sapiens
tgtgctgtgtaaagttagtctac

SEQ ID NO: 2956766 - DNA, 22 bp, Homo sapiens
tgtgctgtgtttaatcagggga

SEQ ID NO: 2956767 - DNA, 19 bp, Homo sapiens
tgtgcttttagtaaaaaca

SEQ ID NO: 2956768 - DNA, 13 bp, Homo sapiens
tgtggaaaggatt

SEQ ID NO: 2956769 - DNA, 21 bp, Homo sapiens
tgtggaaaggattctaaacag

SEQ ID NO: 2956770 - DNA, 15 bp, Homo sapiens
tgtggaaagtgtaaa

SEQ ID NO: 2956771 - DNA, 16 bp, Homo sapiens
tgtggaaagtgtaaag

SEQ ID NO: 2956772 - DNA, 11 bp, Homo sapiens
tgtggacagga

SEQ ID NO: 2956773 - DNA, 14 bp, Homo sapiens
tgtggaccgaggaa

SEQ ID NO: 2956774 - DNA, 15 bp, Homo sapiens
tgtggacctggacaa

SEQ ID NO: 2956775 - DNA, 12 bp, Homo sapiens
tgtggactctgg

SEQ ID NO: 2956776 - DNA, 22 bp, Homo sapiens
tgtggactctggtgcctccaga

SEQ ID NO: 2956777 - DNA, 18 bp, Homo sapiens
tgtggactgagcgaggaa

SEQ ID NO: 2956778 - DNA, 22 bp, Homo sapiens
tgtggagatgcccaggatttga

SEQ ID NO: 2956779 - DNA, 12 bp, Homo sapiens
tgtggagccagg

SEQ ID NO: 2956780 - DNA, 14 bp, Homo sapiens
tgtggagccaggcg

SEQ ID NO: 2956781 - DNA, 18 bp, Homo sapiens
tgtggagctctggggggc

SEQ ID NO: 2956782 - DNA, 15 bp, Homo sapiens
tgtggagtccagctc

SEQ ID NO: 2956783 - DNA, 15 bp, Homo sapiens
tgtggagtgtgctga

SEQ ID NO: 2956784 - DNA, 18 bp, Homo sapiens
tgtggagttcctgctccg

SEQ ID NO: 2956785 - DNA, 17 bp, Homo sapiens
tgtggataacaaagata

SEQ ID NO: 2956786 - DNA, 23 bp, Homo sapiens
tgtggatgagccctcagaaccct

SEQ ID NO: 2956787 - DNA, 16 bp, Homo sapiens
tgtggatgtgtaaatg

SEQ ID NO: 2956788 - DNA, 19 bp, Homo sapiens
tgtggatgttttaattcca

SEQ ID NO: 2956789 - DNA, 14 bp, Homo sapiens
tgtggcaagtgaat

SEQ ID NO: 2956790 - DNA, 16 bp, Homo sapiens
tgtggcacgcacctgt

SEQ ID NO: 2956791 - DNA, 16 bp, Homo sapiens
tgtggcacttgcctgg

SEQ ID NO: 2956792 - DNA, 18 bp, Homo sapiens
tgtggcacttgcctgggt

SEQ ID NO: 2956793 - DNA, 22 bp, Homo sapiens
tgtggcagcaggcatggcttcc

SEQ ID NO: 2956794 - DNA, 16 bp, Homo sapiens
tgtggcagctgcccct

SEQ ID NO: 2956795 - DNA, 15 bp, Homo sapiens
tgtggccaaggagct

SEQ ID NO: 2956796 - DNA, 15 bp, Homo sapiens
tgtgtaaccatttta

SEQ ID NO: 2956797 - DNA, 14 bp, Homo sapiens
tgtgtaataatgta

SEQ ID NO: 2956798 - DNA, 21 bp, Homo sapiens
tgtgtaataatgtaacatgat

SEQ ID NO: 2956799 - DNA, 17 bp, Homo sapiens
tgtgtaattgttccttt

SEQ ID NO: 2956800 - DNA, 23 bp, Homo sapiens
tgtgtacatcccatgtaacagaa

SEQ ID NO: 2956801 - DNA, 15 bp, Homo sapiens
tgtgtaccacaccct

SEQ ID NO: 2956802 - DNA, 20 bp, Homo sapiens
tgtgtaccacaccctgcctg

SEQ ID NO: 2956803 - DNA, 23 bp, Homo sapiens
tgtgtaccacaccctgcctgctg

SEQ ID NO: 2956804 - DNA, 14 bp, Homo sapiens
tgtgtagccgccct

SEQ ID NO: 2956805 - DNA, 20 bp, Homo sapiens
tgtgtagctgtccaaaataa

SEQ ID NO: 2956806 - DNA, 19 bp, Homo sapiens
tgtgtatatatttaaaaaa

SEQ ID NO: 2956807 - DNA, 21 bp, Homo sapiens
tgtgtatctaaaggatggaaa

SEQ ID NO: 2956808 - DNA, 13 bp, Homo sapiens
tgtgtatttctct

SEQ ID NO: 2956809 - DNA, 16 bp, Homo sapiens
tgtgtcacactctgtg

SEQ ID NO: 2956810 - DNA, 17 bp, Homo sapiens
tgtgtcactgtacagtt

SEQ ID NO: 2956811 - DNA, 15 bp, Homo sapiens
tgtgtcagagcccag

SEQ ID NO: 2956812 - DNA, 16 bp, Homo sapiens
tgtgtcagagcccagc

SEQ ID NO: 2956813 - DNA, 20 bp, Homo sapiens
tgtgtcagagcccagcccag

SEQ ID NO: 2956814 - DNA, 22 bp, Homo sapiens
tgtgtcagagcccagcccagga

SEQ ID NO: 2956815 - DNA, 13 bp, Homo sapiens
tgtgtcaggccct

SEQ ID NO: 2956816 - DNA, 21 bp, Homo sapiens
tgtgtcaggccctctgcctgc

SEQ ID NO: 2956817 - DNA, 21 bp, Homo sapiens
tgtgtcagtggggctctctga

SEQ ID NO: 2956818 - DNA, 14 bp, Homo sapiens
tgtgtcatgccagt

SEQ ID NO: 2956819 - DNA, 17 bp, Homo sapiens
tgtgtccacacatacat

SEQ ID NO: 2956820 - DNA, 18 bp, Homo sapiens
tgtgtccacgactgtctc

SEQ ID NO: 2956821 - DNA, 19 bp, Homo sapiens
tgtgtccacgactgtctcc

SEQ ID NO: 2956822 - DNA, 18 bp, Homo sapiens
tgtgtccccctctgtcca

SEQ ID NO: 2956823 - DNA, 16 bp, Homo sapiens
tgtgtcccctgacctg

SEQ ID NO: 2956824 - DNA, 21 bp, Homo sapiens
tgtgtccctggcgctgtgcta

SEQ ID NO: 2956825 - DNA, 22 bp, Homo sapiens
tgtgtcctcaagaagaaagtgt

SEQ ID NO: 2956826 - DNA, 19 bp, Homo sapiens
tgtgtccttgcacctgcat

SEQ ID NO: 2956827 - DNA, 20 bp, Homo sapiens
tgtgtctcaaaaataatata

SEQ ID NO: 2956828 - DNA, 16 bp, Homo sapiens
tgtgtctcgtctcctg

SEQ ID NO: 2956829 - DNA, 12 bp, Homo sapiens
tgtgtctctatg

SEQ ID NO: 2956830 - DNA, 14 bp, Homo sapiens
tgtgtctgtacacg

SEQ ID NO: 2956831 - DNA, 21 bp, Homo sapiens
tgtgtctgtacacgtgtcctg

SEQ ID NO: 2956832 - DNA, 13 bp, Homo sapiens
tgtgtctgtggtt

SEQ ID NO: 2956833 - DNA, 15 bp, Homo sapiens
tgtgtcttttataaa

SEQ ID NO: 2956834 - DNA, 18 bp, Homo sapiens
tgtgtgaaggtaactaag

SEQ ID NO: 2956835 - DNA, 12 bp, Homo sapiens
tgtgtgaagttt

SEQ ID NO: 2956836 - DNA, 18 bp, Homo sapiens
tgtgtgaatgaacactct

SEQ ID NO: 2956837 - DNA, 20 bp, Homo sapiens
tgtgtgacaattctgttttt

SEQ ID NO: 2956838 - DNA, 22 bp, Homo sapiens
tgtgtgacccctcctggggcca

SEQ ID NO: 2956839 - DNA, 18 bp, Homo sapiens
tgtgtgactctttagcaa

SEQ ID NO: 2956840 - DNA, 23 bp, Homo sapiens
tgtgtgagaaaaactaacttgat

SEQ ID NO: 2956841 - DNA, 18 bp, Homo sapiens
tgtgtgattgacagcttt

SEQ ID NO: 2956842 - DNA, 15 bp, Homo sapiens
tgtgtgcctagtgat

SEQ ID NO: 2956843 - DNA, 18 bp, Homo sapiens
tgtgtgcgtgtatatgtg

SEQ ID NO: 2956844 - DNA, 13 bp, Homo sapiens
tgtgtggaggggg

SEQ ID NO: 2956845 - DNA, 24 bp, Homo sapiens
tgtgtgtaccacaccctgcctgct

SEQ ID NO: 2956846 - DNA, 16 bp, Homo sapiens
tgtgtgtccaaaactg

SEQ ID NO: 2956847 - DNA, 15 bp, Homo sapiens
tgtgtgtcccaggca

SEQ ID NO: 2956848 - DNA, 16 bp, Homo sapiens
tgtgtgtcccaggcag

SEQ ID NO: 2956849 - DNA, 13 bp, Homo sapiens
tgtgtgtgcgtgt

SEQ ID NO: 2956850 - DNA, 14 bp, Homo sapiens
tgtgtgtgtgtgca

SEQ ID NO: 2956851 - DNA, 12 bp, Homo sapiens
tgtgtgtgtttt

SEQ ID NO: 2956852 - DNA, 12 bp, Homo sapiens
tgtgtgttgcac

SEQ ID NO: 2956853 - DNA, 18 bp, Homo sapiens
tgtgtgttgtcttgaaag

SEQ ID NO: 2956854 - DNA, 15 bp, Homo sapiens
tgtgtgttgtttcca

SEQ ID NO: 2956855 - DNA, 16 bp, Homo sapiens
tgtgtgttgtttccat

SEQ ID NO: 2956856 - DNA, 23 bp, Homo sapiens
tgtgttacctgaaaacactgtgc

SEQ ID NO: 2956857 - DNA, 13 bp, Homo sapiens
tgtgttacttgaa

SEQ ID NO: 2956858 - DNA, 22 bp, Homo sapiens
tgtgttcatccagctacttagc

SEQ ID NO: 2956859 - DNA, 14 bp, Homo sapiens
tgtgttccttctgt

SEQ ID NO: 2956860 - DNA, 19 bp, Homo sapiens
tgtgttccttctgtgaaga

SEQ ID NO: 2956861 - DNA, 22 bp, Homo sapiens
tgtgttccttctgtgaagaagc

SEQ ID NO: 2956862 - DNA, 18 bp, Homo sapiens
tgtgttgaccggctgccg

SEQ ID NO: 2956863 - DNA, 16 bp, Homo sapiens
tgtgttgactgctgct

SEQ ID NO: 2956864 - DNA, 14 bp, Homo sapiens
tgtgtttataaaat

SEQ ID NO: 2956865 - DNA, 12 bp, Homo sapiens
tgtgtttcccta

SEQ ID NO: 2956866 - DNA, 21 bp, Homo sapiens
tgtgtttccctagactctgta

SEQ ID NO: 2956867 - DNA, 20 bp, Homo sapiens
tgtgtttctatgtgacaatt

SEQ ID NO: 2956868 - DNA, 21 bp, Homo sapiens
tgtgtttctcctgagctagga

SEQ ID NO: 2956869 - DNA, 20 bp, Homo sapiens
tgtgtttctgtgctccaagt

SEQ ID NO: 2956870 - DNA, 16 bp, Homo sapiens
tgtgtttggctttcag

SEQ ID NO: 2956871 - DNA, 20 bp, Homo sapiens
tgtgttttagagtaagaaat

SEQ ID NO: 2956872 - DNA, 12 bp, Homo sapiens
tgtgttttataa

SEQ ID NO: 2956873 - DNA, 14 bp, Homo sapiens
tgtgtttttccctt

SEQ ID NO: 2956874 - DNA, 14 bp, Homo sapiens
tgtgtttttctttt

SEQ ID NO: 2956875 - DNA, 19 bp, Homo sapiens
tgtgtttttgcactgtctg

SEQ ID NO: 2956876 - DNA, 22 bp, Homo sapiens
tgttaaaaccaaactggttcac

SEQ ID NO: 2956877 - DNA, 21 bp, Homo sapiens
tgttaaagagataaagaataa

SEQ ID NO: 2956878 - DNA, 13 bp, Homo sapiens
tgttaaagtttaa

SEQ ID NO: 2956879 - DNA, 14 bp, Homo sapiens
tgttaacagagcaa

SEQ ID NO: 2956880 - DNA, 22 bp, Homo sapiens
tgttaacagagcaaatttgaat

SEQ ID NO: 2956881 - DNA, 16 bp, Homo sapiens
tgttaacaggtatttt

SEQ ID NO: 2956882 - DNA, 15 bp, Homo sapiens
tgttaaggttcaaga

SEQ ID NO: 2956883 - DNA, 13 bp, Homo sapiens
tgttaagtgtaaa

SEQ ID NO: 2956884 - DNA, 16 bp, Homo sapiens
tgttaatcaaacaagt

SEQ ID NO: 2956885 - DNA, 13 bp, Homo sapiens
tgttaatcaaaga

SEQ ID NO: 2956886 - DNA, 12 bp, Homo sapiens
tgttaatcaatt

SEQ ID NO: 2956887 - DNA, 20 bp, Homo sapiens
tgttaatcaatttaaaccca

SEQ ID NO: 2956888 - DNA, 22 bp, Homo sapiens
tgttaatcaatttaaacccatt

SEQ ID NO: 2956889 - DNA, 14 bp, Homo sapiens
tgttaattaaatat

SEQ ID NO: 2956890 - DNA, 17 bp, Homo sapiens
tgttaattataaacagc

SEQ ID NO: 2956891 - DNA, 18 bp, Homo sapiens
tgttaattataaacagca

SEQ ID NO: 2956892 - DNA, 20 bp, Homo sapiens
tgttaattataaacagcagg

SEQ ID NO: 2956893 - DNA, 19 bp, Homo sapiens
tgttaattttttggtacaa

SEQ ID NO: 2956894 - DNA, 16 bp, Homo sapiens
tgttacacaatggttt

SEQ ID NO: 2956895 - DNA, 19 bp, Homo sapiens
tgttaccaaatacacattt

SEQ ID NO: 2956896 - DNA, 21 bp, Homo sapiens
tgttacctgatcaatgacaga

SEQ ID NO: 2956897 - DNA, 20 bp, Homo sapiens
tgttactaaatccttttgtt

SEQ ID NO: 2956898 - DNA, 14 bp, Homo sapiens
tgttactgcagttg

SEQ ID NO: 2956899 - DNA, 12 bp, Homo sapiens
tgttactgtaat

SEQ ID NO: 2956900 - DNA, 15 bp, Homo sapiens
tgttactgtaattcc

SEQ ID NO: 2956901 - DNA, 15 bp, Homo sapiens
tgttgtcatgtgtat

SEQ ID NO: 2956902 - DNA, 13 bp, Homo sapiens
tgttgtcccttct

SEQ ID NO: 2956903 - DNA, 17 bp, Homo sapiens
tgttgtctgtttgttct

SEQ ID NO: 2956904 - DNA, 12 bp, Homo sapiens
tgttgtcttgaa

SEQ ID NO: 2956905 - DNA, 21 bp, Homo sapiens
tgttgtgggttctatgtttac

SEQ ID NO: 2956906 - DNA, 16 bp, Homo sapiens
tgttgtgtgttgcact

SEQ ID NO: 2956907 - DNA, 20 bp, Homo sapiens
tgttgttgcttcttgtgaag

SEQ ID NO: 2956908 - DNA, 13 bp, Homo sapiens
tgttgtttacaat

SEQ ID NO: 2956909 - DNA, 13 bp, Homo sapiens
tgttgtttcagtg

SEQ ID NO: 2956910 - DNA, 14 bp, Homo sapiens
tgttgtttcagtga

SEQ ID NO: 2956911 - DNA, 21 bp, Homo sapiens
tgttgtttcagtgaatatgcc

SEQ ID NO: 2956912 - DNA, 11 bp, Homo sapiens
tgttgtttcca

SEQ ID NO: 2956913 - DNA, 13 bp, Homo sapiens
tgttgtttccata

SEQ ID NO: 2956914 - DNA, 14 bp, Homo sapiens
tgttgtttccatag

SEQ ID NO: 2956915 - DNA, 18 bp, Homo sapiens
tgttgtttccatagctct

SEQ ID NO: 2956916 - DNA, 23 bp, Homo sapiens
tgttgtttccatagctcttcact

SEQ ID NO: 2956917 - DNA, 15 bp, Homo sapiens
tgttgtttgaagaac

SEQ ID NO: 2956918 - DNA, 21 bp, Homo sapiens
tgttgtttttaaaaagaaaat

SEQ ID NO: 2956919 - DNA, 18 bp, Homo sapiens
tgtttaaaaaaacaaata

SEQ ID NO: 2956920 - DNA, 18 bp, Homo sapiens
tgtttaaaaaaacattat

SEQ ID NO: 2956921 - DNA, 16 bp, Homo sapiens
tgtttaaaacatcatt

SEQ ID NO: 2956922 - DNA, 19 bp, Homo sapiens
tgtttaaactttgacaaaa

SEQ ID NO: 2956923 - DNA, 21 bp, Homo sapiens
tgtttaaataaagacctatgt

SEQ ID NO: 2956924 - DNA, 16 bp, Homo sapiens
tgtttaactgtgcatg

SEQ ID NO: 2956925 - DNA, 20 bp, Homo sapiens
tgtttaatattgagaaagaa

SEQ ID NO: 2956926 - DNA, 17 bp, Homo sapiens
tgtttaatgtgaactct

SEQ ID NO: 2956927 - DNA, 21 bp, Homo sapiens
tgtttaatgtgaactctcccc

SEQ ID NO: 2956928 - DNA, 19 bp, Homo sapiens
tgtttaatgttctgtgata

SEQ ID NO: 2956929 - DNA, 12 bp, Homo sapiens
tgtttacagtgt

SEQ ID NO: 2956930 - DNA, 17 bp, Homo sapiens
tgtttacatttgatgca

SEQ ID NO: 2956931 - DNA, 15 bp, Homo sapiens
tgtttactgcaaggt

SEQ ID NO: 2956932 - DNA, 15 bp, Homo sapiens
tgtttacttaaagat

SEQ ID NO: 2956933 - DNA, 16 bp, Homo sapiens
tgtttacttaaagatt

SEQ ID NO: 2956934 - DNA, 14 bp, Homo sapiens
tgtttagattgtat

SEQ ID NO: 2956935 - DNA, 18 bp, Homo sapiens
tgtttagcaatgtgtttc

SEQ ID NO: 2956936 - DNA, 15 bp, Homo sapiens
tgtttatacagagta

SEQ ID NO: 2956937 - DNA, 15 bp, Homo sapiens
tgtttatacagctca

SEQ ID NO: 2956938 - DNA, 21 bp, Homo sapiens
tgtttatatacagtacacaga

SEQ ID NO: 2956939 - DNA, 14 bp, Homo sapiens
tgtttatatcaaat

SEQ ID NO: 2956940 - DNA, 15 bp, Homo sapiens
tgtttatatgaaaac

SEQ ID NO: 2956941 - DNA, 16 bp, Homo sapiens
tgtttatatgaaaaca

SEQ ID NO: 2956942 - DNA, 14 bp, Homo sapiens
tgtttatatgccca

SEQ ID NO: 2956943 - DNA, 19 bp, Homo sapiens
tgtttatgatatttcttgc

SEQ ID NO: 2956944 - DNA, 23 bp, Homo sapiens
tgtttatgatatttcttgctttc

SEQ ID NO: 2956945 - DNA, 19 bp, Homo sapiens
tgtttatgggtttcttcca

SEQ ID NO: 2956946 - DNA, 22 bp, Homo sapiens
tgtttatgttcttatagaataa

SEQ ID NO: 2956947 - DNA, 17 bp, Homo sapiens
tgtttattcttctagag

SEQ ID NO: 2956948 - DNA, 14 bp, Homo sapiens
tgtttattgccatt

SEQ ID NO: 2956949 - DNA, 22 bp, Homo sapiens
tgtttattgccattatagcgcc

SEQ ID NO: 2956950 - DNA, 23 bp, Homo sapiens
tgtttattgccattatagcgcct

SEQ ID NO: 2956951 - DNA, 19 bp, Homo sapiens
tgtttcaaatgcagaaacc

SEQ ID NO: 2956952 - DNA, 15 bp, Homo sapiens
tgtttcaaggcactc

SEQ ID NO: 2956953 - DNA, 16 bp, Homo sapiens
tgtttcaattgcatct

SEQ ID NO: 2956954 - DNA, 13 bp, Homo sapiens
tgtttcacaaggt

SEQ ID NO: 2956955 - DNA, 21 bp, Homo sapiens
tgtttccaaatccctttcatg

SEQ ID NO: 2956956 - DNA, 20 bp, Homo sapiens
tgtttccagacttccttgag

SEQ ID NO: 2956957 - DNA, 14 bp, Homo sapiens
tgtttcccccactc

SEQ ID NO: 2956958 - DNA, 15 bp, Homo sapiens
tgtttcccccactcc

SEQ ID NO: 2956959 - DNA, 19 bp, Homo sapiens
tgtttccctagactctgta

SEQ ID NO: 2956960 - DNA, 17 bp, Homo sapiens
tgtttcctaatatcaaa

SEQ ID NO: 2956961 - DNA, 14 bp, Homo sapiens
tgtttcctgctgct

SEQ ID NO: 2956962 - DNA, 15 bp, Homo sapiens
tgtttcctgctgctt

SEQ ID NO: 2956963 - DNA, 14 bp, Homo sapiens
tgtttcctgtgccc

SEQ ID NO: 2956964 - DNA, 15 bp, Homo sapiens
tgtttccttcagtgc

SEQ ID NO: 2956965 - DNA, 20 bp, Homo sapiens
tgtttcgtgaagtatactgt

SEQ ID NO: 2956966 - DNA, 19 bp, Homo sapiens
tgtttctattgacttcaat

SEQ ID NO: 2956967 - DNA, 12 bp, Homo sapiens
tgtttctgaaaa

SEQ ID NO: 2956968 - DNA, 19 bp, Homo sapiens
tgtttctgaaaagaaataa

SEQ ID NO: 2956969 - DNA, 22 bp, Homo sapiens
tgtttctgaaaagaaataataa

SEQ ID NO: 2956970 - DNA, 13 bp, Homo sapiens
tgtttctgaatgt

SEQ ID NO: 2956971 - DNA, 17 bp, Homo sapiens
tgtttctgaatgtttgt

SEQ ID NO: 2956972 - DNA, 11 bp, Homo sapiens
tgtttctgtaa

SEQ ID NO: 2956973 - DNA, 19 bp, Homo sapiens
tgtttctgtgtcattaacc

SEQ ID NO: 2956974 - DNA, 17 bp, Homo sapiens
tgtttctgttcaccttc

SEQ ID NO: 2956975 - DNA, 19 bp, Homo sapiens
tgtttcttattctctgttt

SEQ ID NO: 2956976 - DNA, 12 bp, Homo sapiens
tgtttctttctg

SEQ ID NO: 2956977 - DNA, 13 bp, Homo sapiens
tgtttctttctga

SEQ ID NO: 2956978 - DNA, 18 bp, Homo sapiens
tgtttctttgtgtttgct

SEQ ID NO: 2956979 - DNA, 22 bp, Homo sapiens
tgtttgaagaaccgcattttga

SEQ ID NO: 2956980 - DNA, 21 bp, Homo sapiens
tgtttgacaaagaaacccaag

SEQ ID NO: 2956981 - DNA, 22 bp, Homo sapiens
tgtttgacaaagaaacccaagt

SEQ ID NO: 2956982 - DNA, 22 bp, Homo sapiens
tgtttgacaaagttactgattc

SEQ ID NO: 2956983 - DNA, 21 bp, Homo sapiens
tgtttgaccttcagagccagc

SEQ ID NO: 2956984 - DNA, 13 bp, Homo sapiens
tgtttgagctcag

SEQ ID NO: 2956985 - DNA, 23 bp, Homo sapiens
tgtttgagctcagacccccactc

SEQ ID NO: 2956986 - DNA, 12 bp, Homo sapiens
tgtttgattttt

SEQ ID NO: 2956987 - DNA, 18 bp, Homo sapiens
tgtttgcacctttctagt

SEQ ID NO: 2956988 - DNA, 23 bp, Homo sapiens
tgtttgcacctttctagttgaaa

SEQ ID NO: 2956989 - DNA, 22 bp, Homo sapiens
tgtttgcacgttatggtgtttc

SEQ ID NO: 2956990 - DNA, 18 bp, Homo sapiens
tgtttgccctttggccag

SEQ ID NO: 2956991 - DNA, 21 bp, Homo sapiens
tgtttggatttcctttatact

SEQ ID NO: 2956992 - DNA, 22 bp, Homo sapiens
tgtttggatttcctttatactg

SEQ ID NO: 2956993 - DNA, 20 bp, Homo sapiens
tgtttgggggacgtttctca

SEQ ID NO: 2956994 - DNA, 24 bp, Homo sapiens
tgtttgggggacgtttctcatttg

SEQ ID NO: 2956995 - DNA, 21 bp, Homo sapiens
tgtttgggtcttttatacatg

SEQ ID NO: 2956996 - DNA, 13 bp, Homo sapiens
tgtttggtataaa

SEQ ID NO: 2956997 - DNA, 15 bp, Homo sapiens
tgtttgtagctttcc

SEQ ID NO: 2956998 - DNA, 22 bp, Homo sapiens
tgtttgtagctttcctggaagt

SEQ ID NO: 2956999 - DNA, 13 bp, Homo sapiens
tgtttgtatgaaa

SEQ ID NO: 2957000 - DNA, 14 bp, Homo sapiens
tgtttgtatgaaat

SEQ ID NO: 2957001 - DNA, 15 bp, Homo sapiens
tgtttgtattcatgt

SEQ ID NO: 2957002 - DNA, 18 bp, Homo sapiens
tgtttgtcagcatctgac

SEQ ID NO: 2957003 - DNA, 17 bp, Homo sapiens
tgtttgtgtaataagat

SEQ ID NO: 2957004 - DNA, 16 bp, Homo sapiens
tgtttgtgtctgtggt

SEQ ID NO: 2957005 - DNA, 13 bp, Homo sapiens
tgtttgtgtgtgt

SEQ ID NO: 2957006 - DNA, 16 bp, Homo sapiens
tgtttgttcacactcc

SEQ ID NO: 2957007 - DNA, 12 bp, Homo sapiens
tgttttaaaaag

SEQ ID NO: 2957008 - DNA, 20 bp, Homo sapiens
tgttttaaaaagaaacaaga

SEQ ID NO: 2957009 - DNA, 18 bp, Homo sapiens
tgttttaaaaaggaactg

SEQ ID NO: 2957010 - DNA, 21 bp, Homo sapiens
tgttttaaaaaggaactgcag

SEQ ID NO: 2957011 - DNA, 19 bp, Homo sapiens
tgttttaaaacgtgtaaat

SEQ ID NO: 2957012 - DNA, 22 bp, Homo sapiens
tgttttaaaacgtgtaaatgaa

SEQ ID NO: 2957013 - DNA, 18 bp, Homo sapiens
tgttttaaaactggacct

SEQ ID NO: 2957014 - DNA, 14 bp, Homo sapiens
tgttttaacaaaaa

SEQ ID NO: 2957015 - DNA, 20 bp, Homo sapiens
tgttttaacacagtacctaa

SEQ ID NO: 2957016 - DNA, 13 bp, Homo sapiens
tgttttaacttat

SEQ ID NO: 2957017 - DNA, 21 bp, Homo sapiens
tgttttaacttatttatatga

SEQ ID NO: 2957018 - DNA, 14 bp, Homo sapiens
tgttttaattttag

SEQ ID NO: 2957019 - DNA, 15 bp, Homo sapiens
tgttttacactgtac

SEQ ID NO: 2957020 - DNA, 20 bp, Homo sapiens
tgttttacgcaaggaaggac

SEQ ID NO: 2957021 - DNA, 23 bp, Homo sapiens
tgttttagacaaatactcatgtg

SEQ ID NO: 2957022 - DNA, 24 bp, Homo sapiens
tgttttagacaaatactcatgtgt

SEQ ID NO: 2957023 - DNA, 20 bp, Homo sapiens
tgttttattcaccatcatgt

SEQ ID NO: 2957024 - DNA, 15 bp, Homo sapiens
tgagaactgaggagc

SEQ ID NO: 2957025 - DNA, 19 bp, Homo sapiens
tgagaactggttcttgcct

SEQ ID NO: 2957026 - DNA, 17 bp, Homo sapiens
tgagaagaaaacatcta

SEQ ID NO: 2957027 - DNA, 16 bp, Homo sapiens
tgagaagaggaggagg

SEQ ID NO: 2957028 - DNA, 19 bp, Homo sapiens
tgagaaggccaatagtttt

SEQ ID NO: 2957029 - DNA, 19 bp, Homo sapiens
tgagaagtactttgtgctg

SEQ ID NO: 2957030 - DNA, 17 bp, Homo sapiens
tgagaagtagccacagt

SEQ ID NO: 2957031 - DNA, 20 bp, Homo sapiens
tgagaatcagatcatttcaa

SEQ ID NO: 2957032 - DNA, 22 bp, Homo sapiens
tgagacaaatcctttctgcccc

SEQ ID NO: 2957033 - DNA, 17 bp, Homo sapiens
tgagacacggagcccag

SEQ ID NO: 2957034 - DNA, 21 bp, Homo sapiens
tgagacacggagcccagccct

SEQ ID NO: 2957035 - DNA, 14 bp, Homo sapiens
tgagacagtgcaca

SEQ ID NO: 2957036 - DNA, 16 bp, Homo sapiens
tgagacagtgcacatg

SEQ ID NO: 2957037 - DNA, 19 bp, Homo sapiens
tgagacagtgcacatgaac

SEQ ID NO: 2957038 - DNA, 18 bp, Homo sapiens
tgagacagtgggaaatat

SEQ ID NO: 2957039 - DNA, 13 bp, Homo sapiens
tgagaccagcctg

SEQ ID NO: 2957040 - DNA, 15 bp, Homo sapiens
tgagaccaggctggg

SEQ ID NO: 2957041 - DNA, 13 bp, Homo sapiens
tgagaccctgtct

SEQ ID NO: 2957042 - DNA, 22 bp, Homo sapiens
tgagacgaatgccattggaacc

SEQ ID NO: 2957043 - DNA, 15 bp, Homo sapiens
tgagactcagtgcag

SEQ ID NO: 2957044 - DNA, 16 bp, Homo sapiens
tgagactcagtgcaga

SEQ ID NO: 2957045 - DNA, 16 bp, Homo sapiens
tgagactccactcagg

SEQ ID NO: 2957046 - DNA, 19 bp, Homo sapiens
tgagactgatccctggcca

SEQ ID NO: 2957047 - DNA, 23 bp, Homo sapiens
tgagactggttgcataacagcag

SEQ ID NO: 2957048 - DNA, 15 bp, Homo sapiens
tgagacttgccttcc

SEQ ID NO: 2957049 - DNA, 19 bp, Homo sapiens
tgagacttgccttcctaag

SEQ ID NO: 2957050 - DNA, 21 bp, Homo sapiens
tgagagacggtgtcttgttct

SEQ ID NO: 2957051 - DNA, 20 bp, Homo sapiens
tgagagagaatagagctgcc

SEQ ID NO: 2957052 - DNA, 21 bp, Homo sapiens
tgagagagaatagagctgcca

SEQ ID NO: 2957053 - DNA, 22 bp, Homo sapiens
tgagagagaatagagctgccac

SEQ ID NO: 2957054 - DNA, 20 bp, Homo sapiens
tgagaggcaatgattgttaa

SEQ ID NO: 2957055 - DNA, 14 bp, Homo sapiens
tgagaggctgaggt

SEQ ID NO: 2957056 - DNA, 18 bp, Homo sapiens
tgagaggtgaaagcataa

SEQ ID NO: 2957057 - DNA, 21 bp, Homo sapiens
tgagaggtgaaagcataacat

SEQ ID NO: 2957058 - DNA, 16 bp, Homo sapiens
tgagagtctagattct

SEQ ID NO: 2957059 - DNA, 12 bp, Homo sapiens
tgagagtgtgac

SEQ ID NO: 2957060 - DNA, 13 bp, Homo sapiens
tgagagtgtgacc

SEQ ID NO: 2957061 - DNA, 21 bp, Homo sapiens
tgagagtgttcctgagacaga

SEQ ID NO: 2957062 - DNA, 18 bp, Homo sapiens
tgagagttttgtcttgaa

SEQ ID NO: 2957063 - DNA, 17 bp, Homo sapiens
tgagataatacattccg

SEQ ID NO: 2957064 - DNA, 20 bp, Homo sapiens
tgagataccagcgaggaggc

SEQ ID NO: 2957065 - DNA, 23 bp, Homo sapiens
tgagatagcattgtgaactgaca

SEQ ID NO: 2957066 - DNA, 16 bp, Homo sapiens
tgagatattaaattct

SEQ ID NO: 2957067 - DNA, 18 bp, Homo sapiens
tgagatccttccttttga

SEQ ID NO: 2957068 - DNA, 18 bp, Homo sapiens
tgagatcgtccactgtca

SEQ ID NO: 2957069 - DNA, 15 bp, Homo sapiens
tgagatgcagctgga

SEQ ID NO: 2957070 - DNA, 12 bp, Homo sapiens
tgagatgctggc

SEQ ID NO: 2957071 - DNA, 15 bp, Homo sapiens
tgagatgctggcttg

SEQ ID NO: 2957072 - DNA, 17 bp, Homo sapiens
tgagatgctggcttggg

SEQ ID NO: 2957073 - DNA, 18 bp, Homo sapiens
tgagattctgaagtatga

SEQ ID NO: 2957074 - DNA, 21 bp, Homo sapiens
tgagattctgaagtatgaagt

SEQ ID NO: 2957075 - DNA, 23 bp, Homo sapiens
tgagatttaagttcctgctgcct

SEQ ID NO: 2957076 - DNA, 17 bp, Homo sapiens
tgagatttcttaaatct

SEQ ID NO: 2957077 - DNA, 18 bp, Homo sapiens
tgagcaaactaacttgac

SEQ ID NO: 2957078 - DNA, 18 bp, Homo sapiens
tgagcaactcttgattat

SEQ ID NO: 2957079 - DNA, 13 bp, Homo sapiens
tgagcacaatctg

SEQ ID NO: 2957080 - DNA, 14 bp, Homo sapiens
tgagcacaatctgt

SEQ ID NO: 2957081 - DNA, 15 bp, Homo sapiens
tgagcacaatctgtt

SEQ ID NO: 2957082 - DNA, 16 bp, Homo sapiens
tgagcacaatctgttc

SEQ ID NO: 2957083 - DNA, 20 bp, Homo sapiens
tgagcacactttagtggccg

SEQ ID NO: 2957084 - DNA, 13 bp, Homo sapiens
tgagcacagagtg

SEQ ID NO: 2957085 - DNA, 14 bp, Homo sapiens
tgagcaccagggga

SEQ ID NO: 2957086 - DNA, 14 bp, Homo sapiens
tgagcagaatacaa

SEQ ID NO: 2957087 - DNA, 16 bp, Homo sapiens
tgagcatagagaacaa

SEQ ID NO: 2957088 - DNA, 13 bp, Homo sapiens
tgagcatcacaga

SEQ ID NO: 2957089 - DNA, 18 bp, Homo sapiens
tgagcatcacagaatgtg

SEQ ID NO: 2957090 - DNA, 19 bp, Homo sapiens
tgagcatctcaaatgtttt

SEQ ID NO: 2957091 - DNA, 21 bp, Homo sapiens
tgagcatctcaaatgttttct

SEQ ID NO: 2957092 - DNA, 11 bp, Homo sapiens
tgagcattcag

SEQ ID NO: 2957093 - DNA, 15 bp, Homo sapiens
tgagcattcaggcag

SEQ ID NO: 2957094 - DNA, 20 bp, Homo sapiens
tgagcattcaggcagcactg

SEQ ID NO: 2957095 - DNA, 22 bp, Homo sapiens
tgagcatttagaacgagcctgg

SEQ ID NO: 2957096 - DNA, 15 bp, Homo sapiens
tgagccaaagccaga

SEQ ID NO: 2957097 - DNA, 17 bp, Homo sapiens
tgagccactgtgcttgg

SEQ ID NO: 2957098 - DNA, 19 bp, Homo sapiens
tgagccactgtgcttggcc

SEQ ID NO: 2957099 - DNA, 15 bp, Homo sapiens
tgagccactgttccc

SEQ ID NO: 2957100 - DNA, 20 bp, Homo sapiens
tgagccagccaggccctgcc

SEQ ID NO: 2957101 - DNA, 16 bp, Homo sapiens
tgagccccatcttcac

SEQ ID NO: 2957102 - DNA, 15 bp, Homo sapiens
tgagccctctagggc

SEQ ID NO: 2957103 - DNA, 22 bp, Homo sapiens
tgagccctctagggcagggtgg

SEQ ID NO: 2957104 - DNA, 18 bp, Homo sapiens
tccgggctttcccccagg

SEQ ID NO: 2957105 - DNA, 20 bp, Homo sapiens
tccggggttcagcctcctgt

SEQ ID NO: 2957106 - DNA, 15 bp, Homo sapiens
tccggtccccacaga

SEQ ID NO: 2957107 - DNA, 23 bp, Homo sapiens
tccggtccccacagactgcccca

SEQ ID NO: 2957108 - DNA, 16 bp, Homo sapiens
tccgtcaaaacagatt

SEQ ID NO: 2957109 - DNA, 19 bp, Homo sapiens
tccgtccccccccaggccc

SEQ ID NO: 2957110 - DNA, 19 bp, Homo sapiens
tccgtcctgatgattttta

SEQ ID NO: 2957111 - DNA, 14 bp, Homo sapiens
tccgtctctgtcct

SEQ ID NO: 2957112 - DNA, 19 bp, Homo sapiens
tccgtgaggctgctgccat

SEQ ID NO: 2957113 - DNA, 22 bp, Homo sapiens
tccgtgaggctgctgccatcca

SEQ ID NO: 2957114 - DNA, 14 bp, Homo sapiens
tccgtgcccaggcc

SEQ ID NO: 2957115 - DNA, 15 bp, Homo sapiens
tccgtgcccaggccc

SEQ ID NO: 2957116 - DNA, 13 bp, Homo sapiens
tccgtgctgacag

SEQ ID NO: 2957117 - DNA, 12 bp, Homo sapiens
tccgtggcacat

SEQ ID NO: 2957118 - DNA, 19 bp, Homo sapiens
tccgtggccccgccctcag

SEQ ID NO: 2957119 - DNA, 16 bp, Homo sapiens
tccgtgggttgctaac

SEQ ID NO: 2957120 - DNA, 14 bp, Homo sapiens
tcctaaaaatctgg

SEQ ID NO: 2957121 - DNA, 15 bp, Homo sapiens
tcctaaaaatctgga

SEQ ID NO: 2957122 - DNA, 18 bp, Homo sapiens
tcctaaaagttctcaatg

SEQ ID NO: 2957123 - DNA, 20 bp, Homo sapiens
tcctaaaagttctcaatgta

SEQ ID NO: 2957124 - DNA, 18 bp, Homo sapiens
tcctaaagagttattcaa

SEQ ID NO: 2957125 - DNA, 23 bp, Homo sapiens
tcctaaatattttcaagaaaaga

SEQ ID NO: 2957126 - DNA, 19 bp, Homo sapiens
tcctaaggagttaaatctt

SEQ ID NO: 2957127 - DNA, 15 bp, Homo sapiens
tcctaaggccactgt

SEQ ID NO: 2957128 - DNA, 20 bp, Homo sapiens
tcctaagggtcgaaagctct

SEQ ID NO: 2957129 - DNA, 15 bp, Homo sapiens
tcctaatcatccaat

SEQ ID NO: 2957130 - DNA, 23 bp, Homo sapiens
tcctaatgatgacttgagccctg

SEQ ID NO: 2957131 - DNA, 15 bp, Homo sapiens
tcctaatgctctgaa

SEQ ID NO: 2957132 - DNA, 16 bp, Homo sapiens
tcctaatgctctgaaa

SEQ ID NO: 2957133 - DNA, 18 bp, Homo sapiens
tcctaattcttctgtcct

SEQ ID NO: 2957134 - DNA, 14 bp, Homo sapiens
tcctacaaccaggt

SEQ ID NO: 2957135 - DNA, 15 bp, Homo sapiens
tcctacccatccccg

SEQ ID NO: 2957136 - DNA, 20 bp, Homo sapiens
tcctaccctgcgcccagtcc

SEQ ID NO: 2957137 - DNA, 15 bp, Homo sapiens
tcctacctcagcctc

SEQ ID NO: 2957138 - DNA, 21 bp, Homo sapiens
tcctacctccactctctgccc

SEQ ID NO: 2957139 - DNA, 20 bp, Homo sapiens
tcctaccttttgataaaatg

SEQ ID NO: 2957140 - DNA, 21 bp, Homo sapiens
tcctaccttttgataaaatgt

SEQ ID NO: 2957141 - DNA, 21 bp, Homo sapiens
tcctactttctatttttatga

SEQ ID NO: 2957142 - DNA, 21 bp, Homo sapiens
tcctagccaccgcctcctaca

SEQ ID NO: 2957143 - DNA, 13 bp, Homo sapiens
tcctagcttatct

SEQ ID NO: 2957144 - DNA, 20 bp, Homo sapiens
tcctagcttatctccctgct

SEQ ID NO: 2957145 - DNA, 23 bp, Homo sapiens
tcctagcttatctccctgcttca

SEQ ID NO: 2957146 - DNA, 22 bp, Homo sapiens
tcctaggcccttggggtggcgc

SEQ ID NO: 2957147 - DNA, 19 bp, Homo sapiens
tcctagtaagcatctactt

SEQ ID NO: 2957148 - DNA, 22 bp, Homo sapiens
tcctagtcgggcagggcccctg

SEQ ID NO: 2957149 - DNA, 18 bp, Homo sapiens
tcctagtctccctcacag

SEQ ID NO: 2957150 - DNA, 13 bp, Homo sapiens
tcctagtgaacct

SEQ ID NO: 2957151 - DNA, 20 bp, Homo sapiens
tcctagtgaacctcaccccg

SEQ ID NO: 2957152 - DNA, 22 bp, Homo sapiens
tcctagtggtgtcatttttgaa

SEQ ID NO: 2957153 - DNA, 19 bp, Homo sapiens
tcctatacgcagcgtgctt

SEQ ID NO: 2957154 - DNA, 16 bp, Homo sapiens
tcctatatacctaata

SEQ ID NO: 2957155 - DNA, 20 bp, Homo sapiens
tcctatatatttctattatt

SEQ ID NO: 2957156 - DNA, 18 bp, Homo sapiens
tcctatcccgtgagtgga

SEQ ID NO: 2957157 - DNA, 18 bp, Homo sapiens
tcctatcttttatttcat

SEQ ID NO: 2957158 - DNA, 15 bp, Homo sapiens
tcctatgaatgcttt

SEQ ID NO: 2957159 - DNA, 18 bp, Homo sapiens
tcctatgaatgctttgca

SEQ ID NO: 2957160 - DNA, 21 bp, Homo sapiens
tcctatgctggggtacacagt

SEQ ID NO: 2957161 - DNA, 13 bp, Homo sapiens
tcctatgctttga

SEQ ID NO: 2957162 - DNA, 15 bp, Homo sapiens
tcctatttcttatag

SEQ ID NO: 2957163 - DNA, 17 bp, Homo sapiens
tcctatttttgtgaaga

SEQ ID NO: 2957164 - DNA, 20 bp, Homo sapiens
tcctcaaaaagcagaaggag

SEQ ID NO: 2957165 - DNA, 17 bp, Homo sapiens
tcctcaagaaataaaag

SEQ ID NO: 2957166 - DNA, 21 bp, Homo sapiens
tcctcaagaagaaagtgttca

SEQ ID NO: 2957167 - DNA, 12 bp, Homo sapiens
tcctcacactcc

SEQ ID NO: 2957168 - DNA, 14 bp, Homo sapiens
tcctcacactccag

SEQ ID NO: 2957169 - DNA, 15 bp, Homo sapiens
tcctcacacttactg

SEQ ID NO: 2957170 - DNA, 23 bp, Homo sapiens
tcctcacacttactgtaagacat

SEQ ID NO: 2957171 - DNA, 12 bp, Homo sapiens
tcctcacctggt

SEQ ID NO: 2957172 - DNA, 17 bp, Homo sapiens
tcctcacgccttggcct

SEQ ID NO: 2957173 - DNA, 20 bp, Homo sapiens
tcctcactccctaggcccaa

SEQ ID NO: 2957174 - DNA, 23 bp, Homo sapiens
tcctcactccctaggcccaagtc

SEQ ID NO: 2957175 - DNA, 19 bp, Homo sapiens
tcctcactcccttcccata

SEQ ID NO: 2957176 - DNA, 21 bp, Homo sapiens
tcctcactcccttcccataag

SEQ ID NO: 2957177 - DNA, 22 bp, Homo sapiens
tcctcactgtggtaaatgccac

SEQ ID NO: 2957178 - DNA, 20 bp, Homo sapiens
tcctcagccttgccagagat

SEQ ID NO: 2957179 - DNA, 15 bp, Homo sapiens
tcctcagctgctccc

SEQ ID NO: 2957180 - DNA, 16 bp, Homo sapiens
tcctcagctgctccca

SEQ ID NO: 2957181 - DNA, 16 bp, Homo sapiens
tcctcagctttgcttc

SEQ ID NO: 2957182 - DNA, 15 bp, Homo sapiens
tcctcaggaattcca

SEQ ID NO: 2957183 - DNA, 17 bp, Homo sapiens
tcctcaggcacacagct

SEQ ID NO: 2957184 - DNA, 16 bp, Homo sapiens
tcctcagggacagaga

SEQ ID NO: 2957185 - DNA, 24 bp, Homo sapiens
tcctcagggacagagacacctgca

SEQ ID NO: 2957186 - DNA, 23 bp, Homo sapiens
tcctcaggtggccatgcctcagc

SEQ ID NO: 2957187 - DNA, 17 bp, Homo sapiens
tcctcataaacatttga

SEQ ID NO: 2957188 - DNA, 17 bp, Homo sapiens
tcctcattaaattacct

SEQ ID NO: 2957189 - DNA, 15 bp, Homo sapiens
tcctcatttctccag

SEQ ID NO: 2957190 - DNA, 19 bp, Homo sapiens
tcctcatttggggtagcta

SEQ ID NO: 2957191 - DNA, 23 bp, Homo sapiens
tcctcatttggggtagctagagg

SEQ ID NO: 2957192 - DNA, 14 bp, Homo sapiens
tcctccaagccagc

SEQ ID NO: 2957193 - DNA, 12 bp, Homo sapiens
tcctccacgcct

SEQ ID NO: 2957194 - DNA, 14 bp, Homo sapiens
tcctccagaagcct

SEQ ID NO: 2957195 - DNA, 12 bp, Homo sapiens
tcctccagcagg

SEQ ID NO: 2957196 - DNA, 20 bp, Homo sapiens
tcctccagcagggaaaatgc

SEQ ID NO: 2957197 - DNA, 16 bp, Homo sapiens
tcctccagccctgccc

SEQ ID NO: 2957198 - DNA, 20 bp, Homo sapiens
tcctccagggccacgtgcca

SEQ ID NO: 2957199 - DNA, 18 bp, Homo sapiens
tcctccagtctgttctca

SEQ ID NO: 2957200 - DNA, 12 bp, Homo sapiens
tcctccatggga

SEQ ID NO: 2957201 - DNA, 15 bp, Homo sapiens
tcctccatttttgtt

SEQ ID NO: 2957202 - DNA, 20 bp, Homo sapiens
tcctcccaatttcagactcc

SEQ ID NO: 2957203 - DNA, 21 bp, Homo sapiens
tcctcccaatttcagactccc

SEQ ID NO: 2957204 - DNA, 19 bp, Homo sapiens
tcctcccagtgccttctgg

SEQ ID NO: 2957205 - DNA, 20 bp, Homo sapiens
tcctccccaccagagctgcc

SEQ ID NO: 2957206 - DNA, 19 bp, Homo sapiens
tcctccccaccctcctggc

SEQ ID NO: 2957207 - DNA, 21 bp, Homo sapiens
tcctcccccctcctctgaaac

SEQ ID NO: 2957208 - DNA, 13 bp, Homo sapiens
tcctcccccggct

SEQ ID NO: 2957209 - DNA, 13 bp, Homo sapiens
tcctccccctgcc

SEQ ID NO: 2957210 - DNA, 15 bp, Homo sapiens
tcctccccctgccag

SEQ ID NO: 2957211 - DNA, 18 bp, Homo sapiens
tcctttcaccccagggcc

SEQ ID NO: 2957212 - DNA, 19 bp, Homo sapiens
tcctttcaccccagggcct

SEQ ID NO: 2957213 - DNA, 17 bp, Homo sapiens
tcctttccaaggcttct

SEQ ID NO: 2957214 - DNA, 17 bp, Homo sapiens
tcggcttttctcagctg

SEQ ID NO: 2957215 - DNA, 16 bp, Homo sapiens
tctgtataaatgtcta

SEQ ID NO: 2957216 - DNA, 16 bp, Homo sapiens
tctgtatatgattctc

SEQ ID NO: 2957217 - DNA, 23 bp, Homo sapiens
tctgtatatgattctctgtggtt

SEQ ID NO: 2957218 - DNA, 19 bp, Homo sapiens
tctgtatatttatgaccag

SEQ ID NO: 2957219 - DNA, 14 bp, Homo sapiens
tctgtatgtattag

SEQ ID NO: 2957220 - DNA, 17 bp, Homo sapiens
tctgtatgtattagtga

SEQ ID NO: 2957221 - DNA, 12 bp, Homo sapiens
tctgtattttca

SEQ ID NO: 2957222 - DNA, 12 bp, Homo sapiens
tctgtattttcc

SEQ ID NO: 2957223 - DNA, 15 bp, Homo sapiens
tctgtattttccacc

SEQ ID NO: 2957224 - DNA, 23 bp, Homo sapiens
tctgtattttttcttgcattgac

SEQ ID NO: 2957225 - DNA, 17 bp, Homo sapiens
tctgtcaagagtagtta

SEQ ID NO: 2957226 - DNA, 20 bp, Homo sapiens
tctgtcaagagtagttatat

SEQ ID NO: 2957227 - DNA, 20 bp, Homo sapiens
tctgtcaagcatattggaaa

SEQ ID NO: 2957228 - DNA, 19 bp, Homo sapiens
tctgtcaccacatcttgtc

SEQ ID NO: 2957229 - DNA, 15 bp, Homo sapiens
tctgtcaccctggcc

SEQ ID NO: 2957230 - DNA, 13 bp, Homo sapiens
tctgtcagtcaca

SEQ ID NO: 2957231 - DNA, 17 bp, Homo sapiens
tctgtcagtcacagcca

SEQ ID NO: 2957232 - DNA, 15 bp, Homo sapiens
tctgtcatttacaca

SEQ ID NO: 2957233 - DNA, 19 bp, Homo sapiens
tctgtccaacccctccccc

SEQ ID NO: 2957234 - DNA, 14 bp, Homo sapiens
tctgtccacctcgg

SEQ ID NO: 2957235 - DNA, 17 bp, Homo sapiens
tctgtccacctcggcct

SEQ ID NO: 2957236 - DNA, 23 bp, Homo sapiens
tctgtccacctcggcctcccaga

SEQ ID NO: 2957237 - DNA, 13 bp, Homo sapiens
tctgtccacttgt

SEQ ID NO: 2957238 - DNA, 21 bp, Homo sapiens
tctgtccagctcccgctgtgg

SEQ ID NO: 2957239 - DNA, 14 bp, Homo sapiens
tctgtccatcctcc

SEQ ID NO: 2957240 - DNA, 13 bp, Homo sapiens
tctgtccatctgc

SEQ ID NO: 2957241 - DNA, 16 bp, Homo sapiens
tctgtccatctgcccg

SEQ ID NO: 2957242 - DNA, 14 bp, Homo sapiens
tctgtccccaggcc

SEQ ID NO: 2957243 - DNA, 22 bp, Homo sapiens
tctgtccctattatttgcccta

SEQ ID NO: 2957244 - DNA, 22 bp, Homo sapiens
tctgtcccttctgtccctcaca

SEQ ID NO: 2957245 - DNA, 23 bp, Homo sapiens
tctgtcccttctgtccctcacag

SEQ ID NO: 2957246 - DNA, 20 bp, Homo sapiens
tctgtccgtttactccaagg

SEQ ID NO: 2957247 - DNA, 14 bp, Homo sapiens
tctgtcctcacgcc

SEQ ID NO: 2957248 - DNA, 12 bp, Homo sapiens
tctgtcctctgt

SEQ ID NO: 2957249 - DNA, 22 bp, Homo sapiens
tctgtcctgtgaggtttcccaa

SEQ ID NO: 2957250 - DNA, 23 bp, Homo sapiens
tctgtctacttgctcaggtactt

SEQ ID NO: 2957251 - DNA, 13 bp, Homo sapiens
tctgtctactttc

SEQ ID NO: 2957252 - DNA, 20 bp, Homo sapiens
tctgtctactttctcttgtt

SEQ ID NO: 2957253 - DNA, 23 bp, Homo sapiens
tctgtctagcatgccaacaagaa

SEQ ID NO: 2957254 - DNA, 15 bp, Homo sapiens
tctgtctagtgtctg

SEQ ID NO: 2957255 - DNA, 17 bp, Homo sapiens
tctgtctcatccatcat

SEQ ID NO: 2957256 - DNA, 21 bp, Homo sapiens
tctgtctcatccatcatcatg

SEQ ID NO: 2957257 - DNA, 12 bp, Homo sapiens
tctgtctctctc

SEQ ID NO: 2957258 - DNA, 13 bp, Homo sapiens
tctgtctctgaag

SEQ ID NO: 2957259 - DNA, 13 bp, Homo sapiens
tctgtcttctcct

SEQ ID NO: 2957260 - DNA, 14 bp, Homo sapiens
tctgtcttctgtat

SEQ ID NO: 2957261 - DNA, 24 bp, Homo sapiens
tctgtctttgcggggcctgtctca

SEQ ID NO: 2957262 - DNA, 14 bp, Homo sapiens
tctgtctttttcct

SEQ ID NO: 2957263 - DNA, 20 bp, Homo sapiens
tctgtctttttccttcctga

SEQ ID NO: 2957264 - DNA, 23 bp, Homo sapiens
tctgtgaactatcccctgcgctt

SEQ ID NO: 2957265 - DNA, 17 bp, Homo sapiens
tctgtgaagaagccctg

SEQ ID NO: 2957266 - DNA, 18 bp, Homo sapiens
tctgtgaagaagccctgt

SEQ ID NO: 2957267 - DNA, 20 bp, Homo sapiens
tctgtgaagaggaacagtgt

SEQ ID NO: 2957268 - DNA, 22 bp, Homo sapiens
tctgtgaagaggaacagtgtgg

SEQ ID NO: 2957269 - DNA, 18 bp, Homo sapiens
tctgtgaatccatgggtc

SEQ ID NO: 2957270 - DNA, 19 bp, Homo sapiens
tctgtgaatccatgggtct

SEQ ID NO: 2957271 - DNA, 19 bp, Homo sapiens
tctgtgaatttcagaggtc

SEQ ID NO: 2957272 - DNA, 13 bp, Homo sapiens
tctgtgacccact

SEQ ID NO: 2957273 - DNA, 23 bp, Homo sapiens
tctgtgacccacttctcatcaca

SEQ ID NO: 2957274 - DNA, 20 bp, Homo sapiens
tctgtgactataaagctgtt

SEQ ID NO: 2957275 - DNA, 17 bp, Homo sapiens
tctgtgatacagaactc

SEQ ID NO: 2957276 - DNA, 16 bp, Homo sapiens
tctgtgcagggctggt

SEQ ID NO: 2957277 - DNA, 20 bp, Homo sapiens
tctgtgcagggctggtttgt

SEQ ID NO: 2957278 - DNA, 12 bp, Homo sapiens
tctgtgcattct

SEQ ID NO: 2957279 - DNA, 15 bp, Homo sapiens
tctgtgcctgtctgt

SEQ ID NO: 2957280 - DNA, 18 bp, Homo sapiens
tctgtgcctgtctgtcca

SEQ ID NO: 2957281 - DNA, 22 bp, Homo sapiens
tctgtgccttcttttgattatg

SEQ ID NO: 2957282 - DNA, 14 bp, Homo sapiens
tctgtgccttggtc

SEQ ID NO: 2957283 - DNA, 15 bp, Homo sapiens
tctgtgccttggtct

SEQ ID NO: 2957284 - DNA, 13 bp, Homo sapiens
tctgtgctcagga

SEQ ID NO: 2957285 - DNA, 13 bp, Homo sapiens
tctgtgctccaag

SEQ ID NO: 2957286 - DNA, 13 bp, Homo sapiens
tctgtgctgtgtg

SEQ ID NO: 2957287 - DNA, 19 bp, Homo sapiens
tctgtggaaaagccatctc

SEQ ID NO: 2957288 - DNA, 16 bp, Homo sapiens
tctgtggaaagtgtaa

SEQ ID NO: 2957289 - DNA, 22 bp, Homo sapiens
tctgtggacaccactgagctct

SEQ ID NO: 2957290 - DNA, 22 bp, Homo sapiens
tctgtggaccactgcatgagct

SEQ ID NO: 2957291 - DNA, 16 bp, Homo sapiens
tctgtggagatgccca

SEQ ID NO: 2957292 - DNA, 17 bp, Homo sapiens
tctgtggaggggccctc

SEQ ID NO: 2957293 - DNA, 18 bp, Homo sapiens
tctgtggatggtcattgc

SEQ ID NO: 2957294 - DNA, 18 bp, Homo sapiens
tctgtggccgccatctgc

SEQ ID NO: 2957295 - DNA, 22 bp, Homo sapiens
tctgtggccgccatctgcgcag

SEQ ID NO: 2957296 - DNA, 20 bp, Homo sapiens
tctgtgggaaaaaagaaaaa

SEQ ID NO: 2957297 - DNA, 19 bp, Homo sapiens
tctgtgggcgggcccagca

SEQ ID NO: 2957298 - DNA, 15 bp, Homo sapiens
tctgtgggtctctgg

SEQ ID NO: 2957299 - DNA, 17 bp, Homo sapiens
tctgtgggtctctggaa

SEQ ID NO: 2957300 - DNA, 20 bp, Homo sapiens
tctgtggtggttcattccac

SEQ ID NO: 2957301 - DNA, 21 bp, Homo sapiens
tctgtggtggttcattccaca

SEQ ID NO: 2957302 - DNA, 22 bp, Homo sapiens
tctgtggtggttcattccacag

SEQ ID NO: 2957303 - DNA, 16 bp, Homo sapiens
tctgtggtgtatgtat

SEQ ID NO: 2957304 - DNA, 17 bp, Homo sapiens
tctgtggtgtctgcctg

SEQ ID NO: 2957305 - DNA, 17 bp, Homo sapiens
tctgtggttttttttga

SEQ ID NO: 2957306 - DNA, 22 bp, Homo sapiens
tctgtgtaaccagctcagtgtt

SEQ ID NO: 2957307 - DNA, 19 bp, Homo sapiens
tctgtgtaaccattttata

SEQ ID NO: 2957308 - DNA, 15 bp, Homo sapiens
tctgtgtagccgccc

SEQ ID NO: 2957309 - DNA, 17 bp, Homo sapiens
tctgtgtagccgccctg

SEQ ID NO: 2957310 - DNA, 12 bp, Homo sapiens
tctgtgtcttgt

SEQ ID NO: 2957311 - DNA, 22 bp, Homo sapiens
tctgtgtgtgacccctcctggg

SEQ ID NO: 2957312 - DNA, 13 bp, Homo sapiens
tctgtgtgtgtgt

SEQ ID NO: 2957313 - DNA, 20 bp, Homo sapiens
tctgtgtgtgtgtgtgtgcg

SEQ ID NO: 2957314 - DNA, 17 bp, Homo sapiens
tctgtgttctaacttat

SEQ ID NO: 2957315 - DNA, 18 bp, Homo sapiens
tctgtgttctaacttatt

SEQ ID NO: 2957316 - DNA, 15 bp, Homo sapiens
tctgttacccaggct

SEQ ID NO: 2957317 - DNA, 21 bp, Homo sapiens
tctgttatcagctgggcagtg

SEQ ID NO: 2957318 - DNA, 23 bp, Homo sapiens
tctgttattcttcaaacacaagt

SEQ ID NO: 2957319 - DNA, 13 bp, Homo sapiens
tctgttcatctct

SEQ ID NO: 2957320 - DNA, 15 bp, Homo sapiens
tctgttcatctcttt

SEQ ID NO: 2957321 - DNA, 19 bp, Homo sapiens
tctgttcatctctttgtcc

SEQ ID NO: 2957322 - DNA, 18 bp, Homo sapiens
tctgttcccccttcacaa

SEQ ID NO: 2957323 - DNA, 20 bp, Homo sapiens
tctgttcccccttcacaaag

SEQ ID NO: 2957324 - DNA, 13 bp, Homo sapiens
tctgttccttcac

SEQ ID NO: 2957325 - DNA, 18 bp, Homo sapiens
tctgttctaaaactccaa

SEQ ID NO: 2957326 - DNA, 22 bp, Homo sapiens
tctgttctacttgatatttcct

SEQ ID NO: 2957327 - DNA, 13 bp, Homo sapiens
tctgttctcacat

SEQ ID NO: 2957328 - DNA, 16 bp, Homo sapiens
tctgttctgtggaaag

SEQ ID NO: 2957329 - DNA, 13 bp, Homo sapiens
tctgttcttgaag

SEQ ID NO: 2957330 - DNA, 17 bp, Homo sapiens
tctgttcttttgactta

SEQ ID NO: 2957331 - DNA, 16 bp, Homo sapiens
tctgttgcaagtgcaa

SEQ ID NO: 2957332 - DNA, 16 bp, Homo sapiens
tctgttgcccaggctg

SEQ ID NO: 2957333 - DNA, 14 bp, Homo sapiens
tctgttgcctcctc

SEQ ID NO: 2957334 - DNA, 22 bp, Homo sapiens
tctgttgcctcctctctccctg

SEQ ID NO: 2957335 - DNA, 13 bp, Homo sapiens
tctgttgtttgaa

SEQ ID NO: 2957336 - DNA, 20 bp, Homo sapiens
tctcctggacgcccccgccc

SEQ ID NO: 2957337 - DNA, 21 bp, Homo sapiens
tctcctggactggttatcttg

SEQ ID NO: 2957338 - DNA, 20 bp, Homo sapiens
tctcctggagggcgcccagc

SEQ ID NO: 2957339 - DNA, 19 bp, Homo sapiens
tctcctggagttgcattga

SEQ ID NO: 2957340 - DNA, 14 bp, Homo sapiens
tctcctgtccaacc

SEQ ID NO: 2957341 - DNA, 16 bp, Homo sapiens
tctcctgtccaaccta

SEQ ID NO: 2957342 - DNA, 14 bp, Homo sapiens
tctccttcctcttg

SEQ ID NO: 2957343 - DNA, 16 bp, Homo sapiens
tctccttcctcttggc

SEQ ID NO: 2957344 - DNA, 19 bp, Homo sapiens
tctccttcctcttggctga

SEQ ID NO: 2957345 - DNA, 16 bp, Homo sapiens
tctccttcctgtgtgt

SEQ ID NO: 2957346 - DNA, 13 bp, Homo sapiens
tctccttgcagtt

SEQ ID NO: 2957347 - DNA, 13 bp, Homo sapiens
tctccttggagga

SEQ ID NO: 2957348 - DNA, 15 bp, Homo sapiens
tctcctttctttcta

SEQ ID NO: 2957349 - DNA, 15 bp, Homo sapiens
tctcctttgaagtgg

SEQ ID NO: 2957350 - DNA, 19 bp, Homo sapiens
tctcctttggcatgtttaa

SEQ ID NO: 2957351 - DNA, 20 bp, Homo sapiens
tctcctttggcatgtttaat

SEQ ID NO: 2957352 - DNA, 20 bp, Homo sapiens
tctcctttgtactttgtgct

SEQ ID NO: 2957353 - DNA, 14 bp, Homo sapiens
tctcctttgtatat

SEQ ID NO: 2957354 - DNA, 20 bp, Homo sapiens
tctcgaactcctaacctcaa

SEQ ID NO: 2957355 - DNA, 13 bp, Homo sapiens
tctcgagcttggg

SEQ ID NO: 2957356 - DNA, 17 bp, Homo sapiens
tctcgatgcaatgaaca

SEQ ID NO: 2957357 - DNA, 14 bp, Homo sapiens
tctcgatgctgctg

SEQ ID NO: 2957358 - DNA, 15 bp, Homo sapiens
tctcgatgctgctgg

SEQ ID NO: 2957359 - DNA, 16 bp, Homo sapiens
tctcgcatcttcccaa

SEQ ID NO: 2957360 - DNA, 18 bp, Homo sapiens
tctcgcctaggatttcag

SEQ ID NO: 2957361 - DNA, 19 bp, Homo sapiens
tctcgccttcctgcagtct

SEQ ID NO: 2957362 - DNA, 18 bp, Homo sapiens
tctcgctccctcccagga

SEQ ID NO: 2957363 - DNA, 18 bp, Homo sapiens
tctcggagctggcccagg

SEQ ID NO: 2957364 - DNA, 23 bp, Homo sapiens
tctcggccagcccgtcctcctct

SEQ ID NO: 2957365 - DNA, 17 bp, Homo sapiens
tctcggccccatcgccc

SEQ ID NO: 2957366 - DNA, 18 bp, Homo sapiens
tctcggccccatcgcccc

SEQ ID NO: 2957367 - DNA, 23 bp, Homo sapiens
tctcggctcagtgcaacctctgc

SEQ ID NO: 2957368 - DNA, 20 bp, Homo sapiens
tctcgggggtccggaagggt

SEQ ID NO: 2957369 - DNA, 19 bp, Homo sapiens
tctcgggtgggggagccag

SEQ ID NO: 2957370 - DNA, 14 bp, Homo sapiens
tctcgtttagtgcc

SEQ ID NO: 2957371 - DNA, 15 bp, Homo sapiens
tctcgtttcaaaaac

SEQ ID NO: 2957372 - DNA, 19 bp, Homo sapiens
tctctaaagagtttatttt

SEQ ID NO: 2957373 - DNA, 15 bp, Homo sapiens
tctgaactggagcca

SEQ ID NO: 2957374 - DNA, 16 bp, Homo sapiens
tctgaactttgggaag

SEQ ID NO: 2957375 - DNA, 22 bp, Homo sapiens
tctgaagattgaaaaaaataaa

SEQ ID NO: 2957376 - DNA, 17 bp, Homo sapiens
tctgaagccctcccagg

SEQ ID NO: 2957377 - DNA, 20 bp, Homo sapiens
tctgaagtgtgtccatcctg

SEQ ID NO: 2957378 - DNA, 19 bp, Homo sapiens
tctgaatattaagaaacaa

SEQ ID NO: 2957379 - DNA, 21 bp, Homo sapiens
tctgaatattaagaaacaatt

SEQ ID NO: 2957380 - DNA, 17 bp, Homo sapiens
tctgaatgaaaataact

SEQ ID NO: 2957381 - DNA, 18 bp, Homo sapiens
tctgaatgaaaataactg

SEQ ID NO: 2957382 - DNA, 16 bp, Homo sapiens
tctgaatgtttgtgtc

SEQ ID NO: 2957383 - DNA, 17 bp, Homo sapiens
tctgaatgtttgtgtct

SEQ ID NO: 2957384 - DNA, 19 bp, Homo sapiens
tctgaatgtttgtgtctgt

SEQ ID NO: 2957385 - DNA, 20 bp, Homo sapiens
tctgaatgtttgtgtctgtg

SEQ ID NO: 2957386 - DNA, 21 bp, Homo sapiens
tctgaatgtttgtgtctgtgg

SEQ ID NO: 2957387 - DNA, 23 bp, Homo sapiens
tctgaatgtttgtgtctgtggtt

SEQ ID NO: 2957388 - DNA, 13 bp, Homo sapiens
tctgaatttgcaa

SEQ ID NO: 2957389 - DNA, 20 bp, Homo sapiens
tctgaatttgcaaagtactg

SEQ ID NO: 2957390 - DNA, 22 bp, Homo sapiens
tctgaatttgcaaagtactgta

SEQ ID NO: 2957391 - DNA, 17 bp, Homo sapiens
tctgaatttgccctggg

SEQ ID NO: 2957392 - DNA, 19 bp, Homo sapiens
tctgaatttgccctgggaa

SEQ ID NO: 2957393 - DNA, 20 bp, Homo sapiens
tctgaatttgccctgggaaa

SEQ ID NO: 2957394 - DNA, 14 bp, Homo sapiens
tctgacagcagcct

SEQ ID NO: 2957395 - DNA, 20 bp, Homo sapiens
tctgacagtttttctgtttt

SEQ ID NO: 2957396 - DNA, 19 bp, Homo sapiens
tctgacataatccagtaaa

SEQ ID NO: 2957397 - DNA, 13 bp, Homo sapiens
tctgacattctca

SEQ ID NO: 2957398 - DNA, 16 bp, Homo sapiens
tctgaccagcagcgcc

SEQ ID NO: 2957399 - DNA, 17 bp, Homo sapiens
tctgaccagcagcgcct

SEQ ID NO: 2957400 - DNA, 13 bp, Homo sapiens
tctgaccatctgt

SEQ ID NO: 2957401 - DNA, 15 bp, Homo sapiens
tctgaccatctgtga

SEQ ID NO: 2957402 - DNA, 13 bp, Homo sapiens
tctgacccacagc

SEQ ID NO: 2957403 - DNA, 16 bp, Homo sapiens
tctgacccacagcctc

SEQ ID NO: 2957404 - DNA, 14 bp, Homo sapiens
tctgacccagtgcc

SEQ ID NO: 2957405 - DNA, 19 bp, Homo sapiens
tctgacccagtgcccccac

SEQ ID NO: 2957406 - DNA, 22 bp, Homo sapiens
tctgacccagtgcccccactga

SEQ ID NO: 2957407 - DNA, 15 bp, Homo sapiens
tctgactcagggctc

SEQ ID NO: 2957408 - DNA, 20 bp, Homo sapiens
tctgactcagggctcctggg

SEQ ID NO: 2957409 - DNA, 15 bp, Homo sapiens
tctgactccctcccc

SEQ ID NO: 2957410 - DNA, 23 bp, Homo sapiens
tctgacttccccgcattccaggc

SEQ ID NO: 2957411 - DNA, 22 bp, Homo sapiens
tctgagacaaaagaaaaaatat

SEQ ID NO: 2957412 - DNA, 12 bp, Homo sapiens
tctgagagctgt

SEQ ID NO: 2957413 - DNA, 14 bp, Homo sapiens
tctgagagtctaga

SEQ ID NO: 2957414 - DNA, 15 bp, Homo sapiens
tctgagagtctagat

SEQ ID NO: 2957415 - DNA, 16 bp, Homo sapiens
tctgagagtctagatt

SEQ ID NO: 2957416 - DNA, 22 bp, Homo sapiens
tctgagagtctagattctctgg

SEQ ID NO: 2957417 - DNA, 23 bp, Homo sapiens
tctgagcattcgctgtacccttt

SEQ ID NO: 2957418 - DNA, 14 bp, Homo sapiens
tctgagctgccagt

SEQ ID NO: 2957419 - DNA, 15 bp, Homo sapiens
tctgagctggggagg

SEQ ID NO: 2957420 - DNA, 16 bp, Homo sapiens
tctgagctgtcccaag

SEQ ID NO: 2957421 - DNA, 17 bp, Homo sapiens
tctgagctgtcccaagt

SEQ ID NO: 2957422 - DNA, 18 bp, Homo sapiens
tctgagcttctaaactga

SEQ ID NO: 2957423 - DNA, 19 bp, Homo sapiens
tctgagggaaaccagagtc

SEQ ID NO: 2957424 - DNA, 18 bp, Homo sapiens
tctgagtatctcctcgca

SEQ ID NO: 2957425 - DNA, 16 bp, Homo sapiens
tctgagtgtctctgcc

SEQ ID NO: 2957426 - DNA, 20 bp, Homo sapiens
tctgataatgtattgcagtg

SEQ ID NO: 2957427 - DNA, 23 bp, Homo sapiens
tctgatagaaatggtttcctctg

SEQ ID NO: 2957428 - DNA, 17 bp, Homo sapiens
tctgatcccctttggtt

SEQ ID NO: 2957429 - DNA, 18 bp, Homo sapiens
tctgatcccctttggttt

SEQ ID NO: 2957430 - DNA, 21 bp, Homo sapiens
tctgatcgtgacgctgaataa

SEQ ID NO: 2957431 - DNA, 22 bp, Homo sapiens
tctgatcgtgacgctgaataaa

SEQ ID NO: 2957432 - DNA, 18 bp, Homo sapiens
tctgatgctaggttgttt

SEQ ID NO: 2957433 - DNA, 14 bp, Homo sapiens
tctgattgaggata

SEQ ID NO: 2957434 - DNA, 14 bp, Homo sapiens
tctgatttatacca

SEQ ID NO: 2957435 - DNA, 12 bp, Homo sapiens
tctgatttgcag

SEQ ID NO: 2957436 - DNA, 20 bp, Homo sapiens
tctgatttgtccctatgcat

SEQ ID NO: 2957437 - DNA, 13 bp, Homo sapiens
tctgattttagga

SEQ ID NO: 2957438 - DNA, 22 bp, Homo sapiens
tctgattttaggagctaaggct

SEQ ID NO: 2957439 - DNA, 13 bp, Homo sapiens
tctgcaacatgga

SEQ ID NO: 2957440 - DNA, 22 bp, Homo sapiens
tctgcaacatggattccaaagc

SEQ ID NO: 2957441 - DNA, 19 bp, Homo sapiens
tctgcaactgaaattacat

SEQ ID NO: 2957442 - DNA, 13 bp, Homo sapiens
tctgcaactgaat

SEQ ID NO: 2957443 - DNA, 22 bp, Homo sapiens
tctgcaactgctcagctctggt

SEQ ID NO: 2957444 - DNA, 16 bp, Homo sapiens
tctgcaagggcccaga

SEQ ID NO: 2957445 - DNA, 22 bp, Homo sapiens
tctgcaagtatactagggagcc

SEQ ID NO: 2957446 - DNA, 20 bp, Homo sapiens
tctgcaatggaaacttttat

SEQ ID NO: 2957447 - DNA, 18 bp, Homo sapiens
tctgcaatgtttttgtgt

SEQ ID NO: 2957448 - DNA, 16 bp, Homo sapiens
tctgcacaggtctctg

SEQ ID NO: 2957449 - DNA, 14 bp, Homo sapiens
tctgcacagtcaga

SEQ ID NO: 2957450 - DNA, 18 bp, Homo sapiens
tctgcacagtcagaagga

SEQ ID NO: 2957451 - DNA, 12 bp, Homo sapiens
tctgcacatgtc

SEQ ID NO: 2957452 - DNA, 15 bp, Homo sapiens
tctgcacatgtcttg

SEQ ID NO: 2957453 - DNA, 16 bp, Homo sapiens
tctgcacatgtcttgt

SEQ ID NO: 2957454 - DNA, 22 bp, Homo sapiens
tctgcacatgtcttgtacatgt

SEQ ID NO: 2957455 - DNA, 16 bp, Homo sapiens
tctgcacccccctggg

SEQ ID NO: 2957456 - DNA, 18 bp, Homo sapiens
tctgcacccccctgggct

SEQ ID NO: 2957457 - DNA, 15 bp, Homo sapiens
tctgcagaaacagaa

SEQ ID NO: 2957458 - DNA, 16 bp, Homo sapiens
tctgcagacttcccag

SEQ ID NO: 2957459 - DNA, 18 bp, Homo sapiens
tctgcagacttcccagct

SEQ ID NO: 2957460 - DNA, 15 bp, Homo sapiens
tctgcagagtatttg

SEQ ID NO: 2957461 - DNA, 13 bp, Homo sapiens
tctgcagccttga

SEQ ID NO: 2957462 - DNA, 13 bp, Homo sapiens
tctgcaggcaggg

SEQ ID NO: 2957463 - DNA, 14 bp, Homo sapiens
tctgcaggcttaat

SEQ ID NO: 2957464 - DNA, 15 bp, Homo sapiens
tctgcagtaaatctt

SEQ ID NO: 2957465 - DNA, 23 bp, Homo sapiens
tctgcagtcgcttgccaaagcag

SEQ ID NO: 2957466 - DNA, 16 bp, Homo sapiens
tctgcatatgttgaat

SEQ ID NO: 2957467 - DNA, 21 bp, Homo sapiens
tctgcatatgttgaatacttt

SEQ ID NO: 2957468 - DNA, 22 bp, Homo sapiens
tctgcatcagttcactgctgca

SEQ ID NO: 2957469 - DNA, 17 bp, Homo sapiens
tctgcatcttggggaca

SEQ ID NO: 2957470 - DNA, 17 bp, Homo sapiens
tctgcatgtaaaatctt

SEQ ID NO: 2957471 - DNA, 20 bp, Homo sapiens
tctgcatgtaaaatcttcag

SEQ ID NO: 2957472 - DNA, 22 bp, Homo sapiens
tctgcattcctgtaacttttaa

SEQ ID NO: 2957473 - DNA, 14 bp, Homo sapiens
tctgcattgcccag

SEQ ID NO: 2957474 - DNA, 14 bp, Homo sapiens
tctgccacctcccc

SEQ ID NO: 2957475 - DNA, 23 bp, Homo sapiens
tctgccaggcccccaccacacat

SEQ ID NO: 2957476 - DNA, 12 bp, Homo sapiens
tctgcccaaccc

SEQ ID NO: 2957477 - DNA, 20 bp, Homo sapiens
tctgcccaactttcattggt

SEQ ID NO: 2957478 - DNA, 16 bp, Homo sapiens
tctgcccagggatttg

SEQ ID NO: 2957479 - DNA, 15 bp, Homo sapiens
tctgccccatcctcc

SEQ ID NO: 2957480 - DNA, 18 bp, Homo sapiens
tctgccccatcctccagc

SEQ ID NO: 2957481 - DNA, 22 bp, Homo sapiens
tctttccaggcttccctgactt

SEQ ID NO: 2957482 - DNA, 18 bp, Homo sapiens
tctttccccaaaaattga

SEQ ID NO: 2957483 - DNA, 16 bp, Homo sapiens
tctttcccccaggaaa

SEQ ID NO: 2957484 - DNA, 12 bp, Homo sapiens
tctttcccctcc

SEQ ID NO: 2957485 - DNA, 13 bp, Homo sapiens
tctttcccctcct

SEQ ID NO: 2957486 - DNA, 17 bp, Homo sapiens
tctttcctaagacctgg

SEQ ID NO: 2957487 - DNA, 14 bp, Homo sapiens
tctttcctgccctt

SEQ ID NO: 2957488 - DNA, 20 bp, Homo sapiens
tctttcctttactcctggct

SEQ ID NO: 2957489 - DNA, 20 bp, Homo sapiens
tctttcgttggttgtttctc

SEQ ID NO: 2957490 - DNA, 21 bp, Homo sapiens
tctttcgttggttgtttctct

SEQ ID NO: 2957491 - DNA, 21 bp, Homo sapiens
tctttctagcctggggcttga

SEQ ID NO: 2957492 - DNA, 22 bp, Homo sapiens
tctttctagttcagctgcccca

SEQ ID NO: 2957493 - DNA, 13 bp, Homo sapiens
tctttctagtttg

SEQ ID NO: 2957494 - DNA, 18 bp, Homo sapiens
tctttctgagcacacttt

SEQ ID NO: 2957495 - DNA, 21 bp, Homo sapiens
tctttctgcagaaacagaaag

SEQ ID NO: 2957496 - DNA, 23 bp, Homo sapiens
tctttctgcccggctacatcagc

SEQ ID NO: 2957497 - DNA, 12 bp, Homo sapiens
tctttcttcctc

SEQ ID NO: 2957498 - DNA, 12 bp, Homo sapiens
tctttcttctcg

SEQ ID NO: 2957499 - DNA, 14 bp, Homo sapiens
tctttcttctcgcc

SEQ ID NO: 2957500 - DNA, 21 bp, Homo sapiens
tctttcttctcgcctaggatt

SEQ ID NO: 2957501 - DNA, 15 bp, Homo sapiens
tctttcttgctttga

SEQ ID NO: 2957502 - DNA, 17 bp, Homo sapiens
tctttcttggtgcattc

SEQ ID NO: 2957503 - DNA, 15 bp, Homo sapiens
tctttcttgtttgtc

SEQ ID NO: 2957504 - DNA, 14 bp, Homo sapiens
tctttctttgctgc

SEQ ID NO: 2957505 - DNA, 15 bp, Homo sapiens
tctttctttgctgct

SEQ ID NO: 2957506 - DNA, 19 bp, Homo sapiens
tctttctttggggaaaaat

SEQ ID NO: 2957507 - DNA, 19 bp, Homo sapiens
tctttgactgtcagcaaga

SEQ ID NO: 2957508 - DNA, 19 bp, Homo sapiens
tctttgatcgtatatttct

SEQ ID NO: 2957509 - DNA, 21 bp, Homo sapiens
tctttgatcgtatatttctca

SEQ ID NO: 2957510 - DNA, 22 bp, Homo sapiens
tctttgatcgtatatttctcat

SEQ ID NO: 2957511 - DNA, 21 bp, Homo sapiens
tctttgcaaagtattgtaaat

SEQ ID NO: 2957512 - DNA, 13 bp, Homo sapiens
tctttgcagagcc

SEQ ID NO: 2957513 - DNA, 15 bp, Homo sapiens
tctttgcagagcctt

SEQ ID NO: 2957514 - DNA, 12 bp, Homo sapiens
tctttgccaagt

SEQ ID NO: 2957515 - DNA, 20 bp, Homo sapiens
tctttgccagagacctattt

SEQ ID NO: 2957516 - DNA, 15 bp, Homo sapiens
tctttgcctgttcag

SEQ ID NO: 2957517 - DNA, 21 bp, Homo sapiens
tctttgcggggcctgtctcag

SEQ ID NO: 2957518 - DNA, 23 bp, Homo sapiens
tctttgctgctgtggaaaggatt

SEQ ID NO: 2957519 - DNA, 19 bp, Homo sapiens
tctttgctgtaagatgtct

SEQ ID NO: 2957520 - DNA, 21 bp, Homo sapiens
tctttggacaacaggaagtga

SEQ ID NO: 2957521 - DNA, 17 bp, Homo sapiens
tctttggacttctgaag

SEQ ID NO: 2957522 - DNA, 17 bp, Homo sapiens
tctttggagaggatttg

SEQ ID NO: 2957523 - DNA, 18 bp, Homo sapiens
tctttggctctattggat

SEQ ID NO: 2957524 - DNA, 15 bp, Homo sapiens
tctttgggccagaca

SEQ ID NO: 2957525 - DNA, 20 bp, Homo sapiens
tctttgggccagacatgcca

SEQ ID NO: 2957526 - DNA, 17 bp, Homo sapiens
tctttggggaaaaattc

SEQ ID NO: 2957527 - DNA, 16 bp, Homo sapiens
tctttggggtgcccct

SEQ ID NO: 2957528 - DNA, 12 bp, Homo sapiens
tctttggttcta

SEQ ID NO: 2957529 - DNA, 17 bp, Homo sapiens
tctttgtaaaatcttgc

SEQ ID NO: 2957530 - DNA, 14 bp, Homo sapiens
tctttgtaataaaa

SEQ ID NO: 2957531 - DNA, 22 bp, Homo sapiens
tctttgtaccacagtttcttct

SEQ ID NO: 2957532 - DNA, 23 bp, Homo sapiens
tctttgtaccacagtttcttctg

SEQ ID NO: 2957533 - DNA, 23 bp, Homo sapiens
tctttgtcctgaatggctttgtc

SEQ ID NO: 2957534 - DNA, 13 bp, Homo sapiens
tctttgtctaaaa

SEQ ID NO: 2957535 - DNA, 14 bp, Homo sapiens
tctttgtggccaag

SEQ ID NO: 2957536 - DNA, 23 bp, Homo sapiens
tctttgtggccaaggagctgcta

SEQ ID NO: 2957537 - DNA, 21 bp, Homo sapiens
tcttttaatcatgagcctgtt

SEQ ID NO: 2957538 - DNA, 21 bp, Homo sapiens
tcttttaatgaggaccaatgt

SEQ ID NO: 2957539 - DNA, 18 bp, Homo sapiens
tcttttacatacagtgat

SEQ ID NO: 2957540 - DNA, 20 bp, Homo sapiens
tcttttacatacagtgatat

SEQ ID NO: 2957541 - DNA, 12 bp, Homo sapiens
tcttttataata

SEQ ID NO: 2957542 - DNA, 20 bp, Homo sapiens
tcttttatttcattcatatc

SEQ ID NO: 2957543 - DNA, 22 bp, Homo sapiens
tcttttcacatagctgtctaga

SEQ ID NO: 2957544 - DNA, 13 bp, Homo sapiens
tcttttcacattc

SEQ ID NO: 2957545 - DNA, 17 bp, Homo sapiens
tcttttcacattcttat

SEQ ID NO: 2957546 - DNA, 18 bp, Homo sapiens
tcttttcacattcttata

SEQ ID NO: 2957547 - DNA, 21 bp, Homo sapiens
tcttttcatatctcttgccct

SEQ ID NO: 2957548 - DNA, 15 bp, Homo sapiens
tcttttccagaaaga

SEQ ID NO: 2957549 - DNA, 22 bp, Homo sapiens
tcttttcctcgcagatgataaa

SEQ ID NO: 2957550 - DNA, 13 bp, Homo sapiens
tcttttcctctct

SEQ ID NO: 2957551 - DNA, 18 bp, Homo sapiens
tcttttcctctctgtctg

SEQ ID NO: 2957552 - DNA, 19 bp, Homo sapiens
tcttttctaaatgttatta

SEQ ID NO: 2957553 - DNA, 23 bp, Homo sapiens
tcttttctaaatgttattacttg

SEQ ID NO: 2957554 - DNA, 14 bp, Homo sapiens
tcttttgaaacaat

SEQ ID NO: 2957555 - DNA, 13 bp, Homo sapiens
tcttttgcaattg

SEQ ID NO: 2957556 - DNA, 22 bp, Homo sapiens
tcttttggtaaagactggcttt

SEQ ID NO: 2957557 - DNA, 19 bp, Homo sapiens
tcttttgtaataaactatt

SEQ ID NO: 2957558 - DNA, 21 bp, Homo sapiens
tcttttgtaattgtgtaaaaa

SEQ ID NO: 2957559 - DNA, 11 bp, Homo sapiens
tcttttgtagt

SEQ ID NO: 2957560 - DNA, 12 bp, Homo sapiens
tcttttgtttca

SEQ ID NO: 2957561 - DNA, 18 bp, Homo sapiens
tcttttgtttcattaagt

SEQ ID NO: 2957562 - DNA, 12 bp, Homo sapiens
tctttttcatta

SEQ ID NO: 2957563 - DNA, 12 bp, Homo sapiens
tctttttctacc

SEQ ID NO: 2957564 - DNA, 11 bp, Homo sapiens
tctttttctcc

SEQ ID NO: 2957565 - DNA, 15 bp, Homo sapiens
tctttttctccaccc

SEQ ID NO: 2957566 - DNA, 18 bp, Homo sapiens
tctttttctctgtatatt

SEQ ID NO: 2957567 - DNA, 23 bp, Homo sapiens
tctttttcttaccagtctcctcc

SEQ ID NO: 2957568 - DNA, 13 bp, Homo sapiens
tctttttgtttca

SEQ ID NO: 2957569 - DNA, 20 bp, Homo sapiens
tcttttttagcataaaattt

SEQ ID NO: 2957570 - DNA, 17 bp, Homo sapiens
tcttttttagtgttaaa

SEQ ID NO: 2957571 - DNA, 18 bp, Homo sapiens
tcttttttagtgttaaag

SEQ ID NO: 2957572 - DNA, 16 bp, Homo sapiens
tcttttttattaccag

SEQ ID NO: 2957573 - DNA, 14 bp, Homo sapiens
tcttttttcacaaa

SEQ ID NO: 2957574 - DNA, 15 bp, Homo sapiens
tcttttttgtacagt

SEQ ID NO: 2957575 - DNA, 16 bp, Homo sapiens
tctttttttccttcca

SEQ ID NO: 2957576 - DNA, 22 bp, Homo sapiens
tcttttttttaatgtgctgtgt

SEQ ID NO: 2957577 - DNA, 23 bp, Homo sapiens
tctttttttttttttaaagacag

SEQ ID NO: 2957578 - DNA, 18 bp, Homo sapiens
tgaaaaaaaatagatgtt

SEQ ID NO: 2957579 - DNA, 14 bp, Homo sapiens
tgaaaaaactatat

SEQ ID NO: 2957580 - DNA, 18 bp, Homo sapiens
tgaaaaaatgtatatgca

SEQ ID NO: 2957581 - DNA, 22 bp, Homo sapiens
tgaaaaaattaaaatctttctt

SEQ ID NO: 2957582 - DNA, 21 bp, Homo sapiens
tgaaaaacttacctactgggg

SEQ ID NO: 2957583 - DNA, 18 bp, Homo sapiens
tgaaaaaggaataaattg

SEQ ID NO: 2957584 - DNA, 20 bp, Homo sapiens
tgaaaaaggaataaattgtt

SEQ ID NO: 2957585 - DNA, 22 bp, Homo sapiens
tgaaaaagtatcctgcttctga

SEQ ID NO: 2957586 - DNA, 13 bp, Homo sapiens
tgaaaaataaata

SEQ ID NO: 2957587 - DNA, 17 bp, Homo sapiens
tgaaaaatatctttgca

SEQ ID NO: 2957588 - DNA, 16 bp, Homo sapiens
tgaaaaatgaaagatg

SEQ ID NO: 2957589 - DNA, 14 bp, Homo sapiens
tgaaaaatgaatgt

SEQ ID NO: 2957590 - DNA, 20 bp, Homo sapiens
tgaaaacaaacaaatcaaac

SEQ ID NO: 2957591 - DNA, 15 bp, Homo sapiens
tgaaaacattgatga

SEQ ID NO: 2957592 - DNA, 16 bp, Homo sapiens
tgaaaacattgatgaa

SEQ ID NO: 2957593 - DNA, 22 bp, Homo sapiens
tgaaaaccagtggcttccatca

SEQ ID NO: 2957594 - DNA, 17 bp, Homo sapiens
tgaaaacccctggctga

SEQ ID NO: 2957595 - DNA, 22 bp, Homo sapiens
tgaaaagaacaaccctgaagca

SEQ ID NO: 2957596 - DNA, 18 bp, Homo sapiens
tgaaaagagagcagagaa

SEQ ID NO: 2957597 - DNA, 19 bp, Homo sapiens
tgaaaagagagcagagaat

SEQ ID NO: 2957598 - DNA, 15 bp, Homo sapiens
tgaaaagattctgaa

SEQ ID NO: 2957599 - DNA, 22 bp, Homo sapiens
tgaaaaggatattatctacctg

SEQ ID NO: 2957600 - DNA, 23 bp, Homo sapiens
tgaaaagggatgatgtggttttt

SEQ ID NO: 2957601 - DNA, 12 bp, Homo sapiens
tgaaaagttatt

SEQ ID NO: 2957602 - DNA, 18 bp, Homo sapiens
tgaaacatgggctgtgat

SEQ ID NO: 2957603 - DNA, 14 bp, Homo sapiens
tgaaacatgttcat

SEQ ID NO: 2957604 - DNA, 14 bp, Homo sapiens
tgaaaccattttcc

SEQ ID NO: 2957605 - DNA, 18 bp, Homo sapiens
tgaaacccatttacttag

SEQ ID NO: 2957606 - DNA, 16 bp, Homo sapiens
tgaaacctacacactg

SEQ ID NO: 2957607 - DNA, 20 bp, Homo sapiens
tgaaacctacacactgtcat

SEQ ID NO: 2957608 - DNA, 13 bp, Homo sapiens
tgaaacctgtata

SEQ ID NO: 2957609 - DNA, 12 bp, Homo sapiens
tgaaacgatttc

SEQ ID NO: 2957610 - DNA, 14 bp, Homo sapiens
tgaaactaaagcaa

SEQ ID NO: 2957611 - DNA, 20 bp, Homo sapiens
tgaaactaaagcaatagaaa

SEQ ID NO: 2957612 - DNA, 22 bp, Homo sapiens
tgaaactaaagcaatagaaaca

SEQ ID NO: 2957613 - DNA, 19 bp, Homo sapiens
tgaaactagaaatctgtcc

SEQ ID NO: 2957614 - DNA, 20 bp, Homo sapiens
tgaaactagaaatctgtcct

SEQ ID NO: 2957615 - DNA, 17 bp, Homo sapiens
tgaaactcccttgtgtt

SEQ ID NO: 2957616 - DNA, 16 bp, Homo sapiens
tgaaactctacattta

SEQ ID NO: 2957617 - DNA, 21 bp, Homo sapiens
tgaaactgcttgagcatcagg

SEQ ID NO: 2957618 - DNA, 19 bp, Homo sapiens
tgaaacttacctgagaacc

SEQ ID NO: 2957619 - DNA, 20 bp, Homo sapiens
tgaaacttcccaacttccct

SEQ ID NO: 2957620 - DNA, 23 bp, Homo sapiens
tgaaacttctcagtccagcagtt

SEQ ID NO: 2957621 - DNA, 16 bp, Homo sapiens
tgaaagaaaggactct

SEQ ID NO: 2957622 - DNA, 13 bp, Homo sapiens
tgaaagaagaaca

SEQ ID NO: 2957623 - DNA, 22 bp, Homo sapiens
tgaaagaagaatgtgtttcaaa

SEQ ID NO: 2957624 - DNA, 22 bp, Homo sapiens
tgaaagattatttaaatgcttt

SEQ ID NO: 2957625 - DNA, 16 bp, Homo sapiens
tgaaagcataacatgg

SEQ ID NO: 2957626 - DNA, 13 bp, Homo sapiens
tgaaagcctgtct

SEQ ID NO: 2957627 - DNA, 14 bp, Homo sapiens
tgaaagcctgtctc

SEQ ID NO: 2957628 - DNA, 16 bp, Homo sapiens
tgaaagcctgtctctt

SEQ ID NO: 2957629 - DNA, 15 bp, Homo sapiens
tgaaagctttaatgt

SEQ ID NO: 2957630 - DNA, 13 bp, Homo sapiens
tgaaaggaaagtg

SEQ ID NO: 2957631 - DNA, 14 bp, Homo sapiens
tgaaaggaaagtgc

SEQ ID NO: 2957632 - DNA, 17 bp, Homo sapiens
tgaaaggaacatttttt

SEQ ID NO: 2957633 - DNA, 20 bp, Homo sapiens
tgaaagggcccttcccctcc

SEQ ID NO: 2957634 - DNA, 16 bp, Homo sapiens
tgaaagtcaattcagt

SEQ ID NO: 2957635 - DNA, 20 bp, Homo sapiens
tgaaagtcagctgaaggatg

SEQ ID NO: 2957636 - DNA, 20 bp, Homo sapiens
tgaaagtgggtttcaattta

SEQ ID NO: 2957637 - DNA, 14 bp, Homo sapiens
tgaaagttgtacat

SEQ ID NO: 2957638 - DNA, 19 bp, Homo sapiens
tgaaagttgtacatgaaat

SEQ ID NO: 2957639 - DNA, 13 bp, Homo sapiens
tgaaataaatgtt

SEQ ID NO: 2957640 - DNA, 17 bp, Homo sapiens
tgaaataaatgtttcaa

SEQ ID NO: 2957641 - DNA, 21 bp, Homo sapiens
tgaaataaatttttaaaaaga

SEQ ID NO: 2957642 - DNA, 16 bp, Homo sapiens
tgaaatacctttgtag

SEQ ID NO: 2957643 - DNA, 17 bp, Homo sapiens
tgaaatacctttgtagt

SEQ ID NO: 2957644 - DNA, 22 bp, Homo sapiens
tgaaatagccgaactccaggct

SEQ ID NO: 2957645 - DNA, 15 bp, Homo sapiens
tgaaataggaaacaa

SEQ ID NO: 2957646 - DNA, 18 bp, Homo sapiens
tgaaataggaaacaagtg

SEQ ID NO: 2957647 - DNA, 15 bp, Homo sapiens
tgaaatatgctcttt

SEQ ID NO: 2957648 - DNA, 18 bp, Homo sapiens
tgaaatatgctcttttgt

SEQ ID NO: 2957649 - DNA, 13 bp, Homo sapiens
tgaaatattgctg

SEQ ID NO: 2957650 - DNA, 15 bp, Homo sapiens
tgaaatattgtaaat

SEQ ID NO: 2957651 - DNA, 16 bp, Homo sapiens
tgaaatattgtaaatg

SEQ ID NO: 2957652 - DNA, 14 bp, Homo sapiens
tgaaatattttgaa

SEQ ID NO: 2957653 - DNA, 13 bp, Homo sapiens
tgaaatctgtctt

SEQ ID NO: 2957654 - DNA, 20 bp, Homo sapiens
tgaaatcttgtaagtattta

SEQ ID NO: 2957655 - DNA, 21 bp, Homo sapiens
tgaaatgatagatttgacctc

SEQ ID NO: 2957656 - DNA, 17 bp, Homo sapiens
tgaaatgtaatttcagt

SEQ ID NO: 2957657 - DNA, 18 bp, Homo sapiens
tgaaattaaatgccactt

SEQ ID NO: 2957658 - DNA, 23 bp, Homo sapiens
tgaaattagggcccaattaataa

SEQ ID NO: 2957659 - DNA, 14 bp, Homo sapiens
tgaaattccaaagt

SEQ ID NO: 2957660 - DNA, 19 bp, Homo sapiens
tgaaattccaaagtctcta

SEQ ID NO: 2957661 - DNA, 13 bp, Homo sapiens
tgaaattctgaat

SEQ ID NO: 2957662 - DNA, 14 bp, Homo sapiens
tgaaattctgaatt

SEQ ID NO: 2957663 - DNA, 15 bp, Homo sapiens
tgaaattctgaattt

SEQ ID NO: 2957664 - DNA, 18 bp, Homo sapiens
tgaaattctgaatttgca

SEQ ID NO: 2957665 - DNA, 20 bp, Homo sapiens
tgaaattctgaatttgcaaa

SEQ ID NO: 2957666 - DNA, 12 bp, Homo sapiens
tgaaattgcctg

SEQ ID NO: 2957667 - DNA, 20 bp, Homo sapiens
tgaaattttatttattttaa

SEQ ID NO: 2957668 - DNA, 14 bp, Homo sapiens
tgaaatttttccac

SEQ ID NO: 2957669 - DNA, 21 bp, Homo sapiens
tgaaatttttccacactatgt

SEQ ID NO: 2957670 - DNA, 23 bp, Homo sapiens
tgaaatttttccacactatgtgt

SEQ ID NO: 2957671 - DNA, 16 bp, Homo sapiens
tgaacaaagcagccac

SEQ ID NO: 2957672 - DNA, 17 bp, Homo sapiens
tgaacaaagcagccacg

SEQ ID NO: 2957673 - DNA, 19 bp, Homo sapiens
tgaacaataagtaaatcca

SEQ ID NO: 2957674 - DNA, 14 bp, Homo sapiens
tgaacacagcagac

SEQ ID NO: 2957675 - DNA, 20 bp, Homo sapiens
tgaacacttacctggaggct

SEQ ID NO: 2957676 - DNA, 22 bp, Homo sapiens
tgaacagatgaaaaggagcctg

SEQ ID NO: 2957677 - DNA, 17 bp, Homo sapiens
tgaacagatgtaaatcg

SEQ ID NO: 2957678 - DNA, 20 bp, Homo sapiens
tgaacagcatggcactccct

SEQ ID NO: 2957679 - DNA, 15 bp, Homo sapiens
tgaacagctggtgcc

SEQ ID NO: 2957680 - DNA, 18 bp, Homo sapiens
tgaacagcttgccaggga

SEQ ID NO: 2957681 - DNA, 21 bp, Homo sapiens
tgaacagggcccaggcctgga

SEQ ID NO: 2957682 - DNA, 22 bp, Homo sapiens
tgaacagtttggatgtcctcaa

SEQ ID NO: 2957683 - DNA, 16 bp, Homo sapiens
tgaacataacttctca

SEQ ID NO: 2957684 - DNA, 17 bp, Homo sapiens
tgaacataacttctcat

SEQ ID NO: 2957685 - DNA, 20 bp, Homo sapiens
tgaacataacttctcatgta

SEQ ID NO: 2957686 - DNA, 16 bp, Homo sapiens
tgaacatctggcccaa

SEQ ID NO: 2957687 - DNA, 20 bp, Homo sapiens
tgaacatctggcccaagtga

SEQ ID NO: 2957688 - DNA, 14 bp, Homo sapiens
tgaacatttgtgat

SEQ ID NO: 2957689 - DNA, 18 bp, Homo sapiens
tgaacattttatttttga

SEQ ID NO: 2957690 - DNA, 21 bp, Homo sapiens
tgaaccaaattgcactgaagt

SEQ ID NO: 2957691 - DNA, 22 bp, Homo sapiens
tgaaccaaattgcactgaagtt

SEQ ID NO: 2957692 - DNA, 19 bp, Homo sapiens
tgaaccaacccccatctcc

SEQ ID NO: 2957693 - DNA, 13 bp, Homo sapiens
tgaaccagccacg

SEQ ID NO: 2957694 - DNA, 23 bp, Homo sapiens
tgaaccagccacgaacagcccgc

SEQ ID NO: 2957695 - DNA, 14 bp, Homo sapiens
tgaacccaggaggt

SEQ ID NO: 2957696 - DNA, 13 bp, Homo sapiens
tgaaccccagagg

SEQ ID NO: 2957697 - DNA, 17 bp, Homo sapiens
tgaaccccagaggcaga

SEQ ID NO: 2957698 - DNA, 22 bp, Homo sapiens
tgaacctcaccccgaggccctg

SEQ ID NO: 2957699 - DNA, 15 bp, Homo sapiens
tgaaccttgagcaaa

SEQ ID NO: 2957700 - DNA, 15 bp, Homo sapiens
tgaacggggagaaaa

SEQ ID NO: 2957701 - DNA, 16 bp, Homo sapiens
tgaacggggagaaaag

SEQ ID NO: 2957702 - DNA, 16 bp, Homo sapiens
tgaacgtccacatgaa

SEQ ID NO: 2957703 - DNA, 14 bp, Homo sapiens
tgaacgtgccagca

SEQ ID NO: 2957704 - DNA, 15 bp, Homo sapiens
tgaacgtgccagcag

SEQ ID NO: 2957705 - DNA, 16 bp, Homo sapiens
tgaactaagttttgtg

SEQ ID NO: 2957706 - DNA, 23 bp, Homo sapiens
tgaactaagttttgtgtgtatat

SEQ ID NO: 2957707 - DNA, 20 bp, Homo sapiens
tgaactaccttggttccccc

SEQ ID NO: 2957708 - DNA, 19 bp, Homo sapiens
tgaactatcccctgcgctt

SEQ ID NO: 2957709 - DNA, 23 bp, Homo sapiens
tgaactattccccagcagggtct

SEQ ID NO: 2957710 - DNA, 18 bp, Homo sapiens
tgaactcactttcctcct

SEQ ID NO: 2957711 - DNA, 13 bp, Homo sapiens
tgaactcagccaa

SEQ ID NO: 2957712 - DNA, 20 bp, Homo sapiens
tgaactcagccaagcacagt

SEQ ID NO: 2957713 - DNA, 15 bp, Homo sapiens
tgaactctcccctcc

SEQ ID NO: 2957714 - DNA, 21 bp, Homo sapiens
tgaactctcccctccccatct

SEQ ID NO: 2957715 - DNA, 14 bp, Homo sapiens
tgaatctaaggata

SEQ ID NO: 2957716 - DNA, 15 bp, Homo sapiens
tgaatctacatttgt

SEQ ID NO: 2957717 - DNA, 16 bp, Homo sapiens
tgaatctacatttgtt

SEQ ID NO: 2957718 - DNA, 14 bp, Homo sapiens
tgaatctatttaag

SEQ ID NO: 2957719 - DNA, 16 bp, Homo sapiens
tgaatctgctcacttt

SEQ ID NO: 2957720 - DNA, 21 bp, Homo sapiens
tgaatcttgagagtgttcctg

SEQ ID NO: 2957721 - DNA, 16 bp, Homo sapiens
tgaatgaaaataactg

SEQ ID NO: 2957722 - DNA, 19 bp, Homo sapiens
tgaatgaaaataactgaac

SEQ ID NO: 2957723 - DNA, 19 bp, Homo sapiens
tgaatgaaacccccacaca

SEQ ID NO: 2957724 - DNA, 16 bp, Homo sapiens
tgaatgatcctgtctc

SEQ ID NO: 2957725 - DNA, 19 bp, Homo sapiens
tgaatgatttccaaagaga

SEQ ID NO: 2957726 - DNA, 17 bp, Homo sapiens
tgaatgcagcactgctg

SEQ ID NO: 2957727 - DNA, 20 bp, Homo sapiens
tgaatgcagcactgctgcct

SEQ ID NO: 2957728 - DNA, 21 bp, Homo sapiens
tgaatgcagcactgctgcctc

SEQ ID NO: 2957729 - DNA, 14 bp, Homo sapiens
tgaatgccaaagcc

SEQ ID NO: 2957730 - DNA, 19 bp, Homo sapiens
tgaatgcccccagctggcc

SEQ ID NO: 2957731 - DNA, 18 bp, Homo sapiens
tgaatggctttgtcttga

SEQ ID NO: 2957732 - DNA, 19 bp, Homo sapiens
tgaatggctttgtcttgaa

SEQ ID NO: 2957733 - DNA, 20 bp, Homo sapiens
tgaatggctttgtcttgaaa

SEQ ID NO: 2957734 - DNA, 16 bp, Homo sapiens
tgaatggtctctgtca

SEQ ID NO: 2957735 - DNA, 21 bp, Homo sapiens
tgaatgtaaaagacactggtg

SEQ ID NO: 2957736 - DNA, 20 bp, Homo sapiens
tgaatgtatgcttcatacag

SEQ ID NO: 2957737 - DNA, 11 bp, Homo sapiens
tgaatgtattt

SEQ ID NO: 2957738 - DNA, 14 bp, Homo sapiens
tgaatgtccaaaat

SEQ ID NO: 2957739 - DNA, 14 bp, Homo sapiens
tgaatgtcttcctt

SEQ ID NO: 2957740 - DNA, 23 bp, Homo sapiens
tgaatgtcttttgaatattccca

SEQ ID NO: 2957741 - DNA, 14 bp, Homo sapiens
tgaatgtgtgagaa

SEQ ID NO: 2957742 - DNA, 16 bp, Homo sapiens
tgaatgtgtgatgtga

SEQ ID NO: 2957743 - DNA, 16 bp, Homo sapiens
tgaatgttaatttttt

SEQ ID NO: 2957744 - DNA, 21 bp, Homo sapiens
tgaatgttgtctgtttgttct

SEQ ID NO: 2957745 - DNA, 18 bp, Homo sapiens
tgaatgtttgtgtctgtg

SEQ ID NO: 2957746 - DNA, 16 bp, Homo sapiens
tgaattatactttgtt

SEQ ID NO: 2957747 - DNA, 11 bp, Homo sapiens
tgacagtggct

SEQ ID NO: 2957748 - DNA, 16 bp, Homo sapiens
tgacagtttttctgtt

SEQ ID NO: 2957749 - DNA, 15 bp, Homo sapiens
tgacagtttttgaca

SEQ ID NO: 2957750 - DNA, 23 bp, Homo sapiens
tgacagtttttgacatttatatt

SEQ ID NO: 2957751 - DNA, 17 bp, Homo sapiens
tgacataaaatttacat

SEQ ID NO: 2957752 - DNA, 22 bp, Homo sapiens
tgacataaaatttacatttaat

SEQ ID NO: 2957753 - DNA, 13 bp, Homo sapiens
tgacatagcctca

SEQ ID NO: 2957754 - DNA, 15 bp, Homo sapiens
tgacatagcctcatg

SEQ ID NO: 2957755 - DNA, 12 bp, Homo sapiens
tgacatatttaa

SEQ ID NO: 2957756 - DNA, 15 bp, Homo sapiens
tgacatatttaatgt

SEQ ID NO: 2957757 - DNA, 17 bp, Homo sapiens
tgacatatttaatgttt

SEQ ID NO: 2957758 - DNA, 22 bp, Homo sapiens
tgacatatttaatgttttaaat

SEQ ID NO: 2957759 - DNA, 21 bp, Homo sapiens
tgacatcagaagtaactccca

SEQ ID NO: 2957760 - DNA, 12 bp, Homo sapiens
tgacatgaaaag

SEQ ID NO: 2957761 - DNA, 17 bp, Homo sapiens
tgacatgaaaagttatt

SEQ ID NO: 2957762 - DNA, 13 bp, Homo sapiens
tgacatgaccctc

SEQ ID NO: 2957763 - DNA, 19 bp, Homo sapiens
tgacatggaggcactgaag

SEQ ID NO: 2957764 - DNA, 21 bp, Homo sapiens
tgacatggaggcactgaagcc

SEQ ID NO: 2957765 - DNA, 18 bp, Homo sapiens
tgacatgggtattttata

SEQ ID NO: 2957766 - DNA, 22 bp, Homo sapiens
tgacatggttaacgaggaagac

SEQ ID NO: 2957767 - DNA, 22 bp, Homo sapiens
tgacatgtaccccctttccctt

SEQ ID NO: 2957768 - DNA, 15 bp, Homo sapiens
tgacattatagacat

SEQ ID NO: 2957769 - DNA, 12 bp, Homo sapiens
tgacattctcta

SEQ ID NO: 2957770 - DNA, 13 bp, Homo sapiens
tgacattctctat

SEQ ID NO: 2957771 - DNA, 19 bp, Homo sapiens
tgacattctctattgtaat

SEQ ID NO: 2957772 - DNA, 23 bp, Homo sapiens
tgacattctctattgtaattttg

SEQ ID NO: 2957773 - DNA, 15 bp, Homo sapiens
tgacattgcgtttga

SEQ ID NO: 2957774 - DNA, 16 bp, Homo sapiens
tgacattgctaagatg

SEQ ID NO: 2957775 - DNA, 12 bp, Homo sapiens
tgacatttcttt

SEQ ID NO: 2957776 - DNA, 13 bp, Homo sapiens
tgacatttctttg

SEQ ID NO: 2957777 - DNA, 14 bp, Homo sapiens
tgacatttctttgt

SEQ ID NO: 2957778 - DNA, 12 bp, Homo sapiens
tgacattttatt

SEQ ID NO: 2957779 - DNA, 16 bp, Homo sapiens
tgacattttatttttt

SEQ ID NO: 2957780 - DNA, 15 bp, Homo sapiens
tgacatttttcctct

SEQ ID NO: 2957781 - DNA, 18 bp, Homo sapiens
tgacatttttcctctctg

SEQ ID NO: 2957782 - DNA, 20 bp, Homo sapiens
tgacatttttcctctctgca

SEQ ID NO: 2957783 - DNA, 15 bp, Homo sapiens
tgaccaaaagttaca

SEQ ID NO: 2957784 - DNA, 16 bp, Homo sapiens
tgaccaaagtcctttt

SEQ ID NO: 2957785 - DNA, 18 bp, Homo sapiens
tgaccaacatggagaaac

SEQ ID NO: 2957786 - DNA, 15 bp, Homo sapiens
tgaccaagcaggaag

SEQ ID NO: 2957787 - DNA, 17 bp, Homo sapiens
tgaccaagcaggaagct

SEQ ID NO: 2957788 - DNA, 12 bp, Homo sapiens
tgttttcagtct

SEQ ID NO: 2957789 - DNA, 13 bp, Homo sapiens
tgttttcatcatt

SEQ ID NO: 2957790 - DNA, 17 bp, Homo sapiens
tgttttcatcatttcag

SEQ ID NO: 2957791 - DNA, 15 bp, Homo sapiens
tgttttccactgtgc

SEQ ID NO: 2957792 - DNA, 18 bp, Homo sapiens
tgttttccattgtttgaa

SEQ ID NO: 2957793 - DNA, 16 bp, Homo sapiens
tgttttccgtgaaaac

SEQ ID NO: 2957794 - DNA, 14 bp, Homo sapiens
tgttttcctccctt

SEQ ID NO: 2957795 - DNA, 21 bp, Homo sapiens
tgttttctctggagtattcta

SEQ ID NO: 2957796 - DNA, 12 bp, Homo sapiens
tgttttctgctt

SEQ ID NO: 2957797 - DNA, 12 bp, Homo sapiens
tgttttgaaact

SEQ ID NO: 2957798 - DNA, 20 bp, Homo sapiens
tgttttgataaagtagtaaa

SEQ ID NO: 2957799 - DNA, 19 bp, Homo sapiens
tgttttggactccatctct

SEQ ID NO: 2957800 - DNA, 15 bp, Homo sapiens
tgttttggtggaaaa

SEQ ID NO: 2957801 - DNA, 13 bp, Homo sapiens
tgttttgtaccag

SEQ ID NO: 2957802 - DNA, 14 bp, Homo sapiens
tgttttgtaccagt

SEQ ID NO: 2957803 - DNA, 15 bp, Homo sapiens
tgttttgtaccagtg

SEQ ID NO: 2957804 - DNA, 15 bp, Homo sapiens
tgtttttaaaaagaa

SEQ ID NO: 2957805 - DNA, 19 bp, Homo sapiens
tgtttttaatgctatttga

SEQ ID NO: 2957806 - DNA, 17 bp, Homo sapiens
tgtttttagacaccttc

SEQ ID NO: 2957807 - DNA, 21 bp, Homo sapiens
tgtttttatacaaaataagaa

SEQ ID NO: 2957808 - DNA, 13 bp, Homo sapiens
tgtttttcacatt

SEQ ID NO: 2957809 - DNA, 19 bp, Homo sapiens
tgtttttctttttccacaa

SEQ ID NO: 2957810 - DNA, 13 bp, Homo sapiens
tgtttttgaaata

SEQ ID NO: 2957811 - DNA, 14 bp, Homo sapiens
tgtttttgcactgt

SEQ ID NO: 2957812 - DNA, 13 bp, Homo sapiens
tgtttttgccaaa

SEQ ID NO: 2957813 - DNA, 16 bp, Homo sapiens
tgtttttggtttctta

SEQ ID NO: 2957814 - DNA, 15 bp, Homo sapiens
tgtttttgtaaagtg

SEQ ID NO: 2957815 - DNA, 19 bp, Homo sapiens
tgtttttgtatgaagtact

SEQ ID NO: 2957816 - DNA, 14 bp, Homo sapiens
tgtttttgtgtaga

SEQ ID NO: 2957817 - DNA, 13 bp, Homo sapiens
tgttttttcaaaa

SEQ ID NO: 2957818 - DNA, 14 bp, Homo sapiens
tgttttttcaaaat

SEQ ID NO: 2957819 - DNA, 13 bp, Homo sapiens
tgttttttcatgt

SEQ ID NO: 2957820 - DNA, 14 bp, Homo sapiens
tgttttttcatgtg

SEQ ID NO: 2957821 - DNA, 21 bp, Homo sapiens
tgttttttttttttttttaat

SEQ ID NO: 2957822 - DNA, 19 bp, Homo sapiens
ttaaaaaaaatgtgaaatt

SEQ ID NO: 2957823 - DNA, 15 bp, Homo sapiens
ttaaaaaaacaaata

SEQ ID NO: 2957824 - DNA, 12 bp, Homo sapiens
ttaaaaaaagaa

SEQ ID NO: 2957825 - DNA, 19 bp, Homo sapiens
ttaaaaaaaggcattgttt

SEQ ID NO: 2957826 - DNA, 12 bp, Homo sapiens
ttaaaaaaatgc

SEQ ID NO: 2957827 - DNA, 23 bp, Homo sapiens
ttaaaaaacaattggttgtatat

SEQ ID NO: 2957828 - DNA, 20 bp, Homo sapiens
ttaaaaaagaaattatcttt

SEQ ID NO: 2957829 - DNA, 15 bp, Homo sapiens
ttaaaaaggaactgc

SEQ ID NO: 2957830 - DNA, 20 bp, Homo sapiens
ttaaaaagggagaaagaaaa

SEQ ID NO: 2957831 - DNA, 16 bp, Homo sapiens
ttaaaaataaatccca

SEQ ID NO: 2957832 - DNA, 19 bp, Homo sapiens
ttaaaaatgagtgtgaagg

SEQ ID NO: 2957833 - DNA, 23 bp, Homo sapiens
ttaaaaatgcacacctcatgagt

SEQ ID NO: 2957834 - DNA, 18 bp, Homo sapiens
ttaaaaatggtggcttca

SEQ ID NO: 2957835 - DNA, 20 bp, Homo sapiens
ttaaaaatttttttaaggaa

SEQ ID NO: 2957836 - DNA, 20 bp, Homo sapiens
ttaaaacaaaaggaaagaaa

SEQ ID NO: 2957837 - DNA, 17 bp, Homo sapiens
ttaaaacacttctgtcc

SEQ ID NO: 2957838 - DNA, 20 bp, Homo sapiens
ttaaaacatgctgtttatga

SEQ ID NO: 2957839 - DNA, 14 bp, Homo sapiens
ttaaaactgtattt

SEQ ID NO: 2957840 - DNA, 15 bp, Homo sapiens
ttaaaacttgtaatt

SEQ ID NO: 2957841 - DNA, 14 bp, Homo sapiens
ttaaaagaaaaaaa

SEQ ID NO: 2957842 - DNA, 13 bp, Homo sapiens
ttaaaagaatggg

SEQ ID NO: 2957843 - DNA, 14 bp, Homo sapiens
ttaaaagacaaaca

SEQ ID NO: 2957844 - DNA, 15 bp, Homo sapiens
ttaaaagacaaacac

SEQ ID NO: 2957845 - DNA, 13 bp, Homo sapiens
ttaaaagtgtaca

SEQ ID NO: 2957846 - DNA, 14 bp, Homo sapiens
ttaaaagtgtattt

SEQ ID NO: 2957847 - DNA, 16 bp, Homo sapiens
ttaaaagtttgtcctt

SEQ ID NO: 2957848 - DNA, 15 bp, Homo sapiens
ttaaaataaaccaaa

SEQ ID NO: 2957849 - DNA, 16 bp, Homo sapiens
ttaaaataaaccaaat

SEQ ID NO: 2957850 - DNA, 21 bp, Homo sapiens
ttaaaataactatcaggcaga

SEQ ID NO: 2957851 - DNA, 12 bp, Homo sapiens
ttaaaatattta

SEQ ID NO: 2957852 - DNA, 13 bp, Homo sapiens
ttaaaatcctcaa

SEQ ID NO: 2957853 - DNA, 18 bp, Homo sapiens
ttaaaatgcaaaataatg

SEQ ID NO: 2957854 - DNA, 21 bp, Homo sapiens
ttaaaatggtttgtcctgatg

SEQ ID NO: 2957855 - DNA, 19 bp, Homo sapiens
ttaaaatgtaaactcttca

SEQ ID NO: 2957856 - DNA, 17 bp, Homo sapiens
ttaaaatgtttactgta

SEQ ID NO: 2957857 - DNA, 22 bp, Homo sapiens
ttaaaatgtttactgtaaattt

SEQ ID NO: 2957858 - DNA, 19 bp, Homo sapiens
ttaaaattaagtagaacaa

SEQ ID NO: 2957859 - DNA, 13 bp, Homo sapiens
ttaaaattatata

SEQ ID NO: 2957860 - DNA, 16 bp, Homo sapiens
ttaaaattatatagca

SEQ ID NO: 2957861 - DNA, 19 bp, Homo sapiens
ttaaaattggccttttacc

SEQ ID NO: 2957862 - DNA, 14 bp, Homo sapiens
ttaaaatttattct

SEQ ID NO: 2957863 - DNA, 14 bp, Homo sapiens
ttaaaatttgtaga

SEQ ID NO: 2957864 - DNA, 21 bp, Homo sapiens
ttaaacaaaagtgtacctgta

SEQ ID NO: 2957865 - DNA, 15 bp, Homo sapiens
ttaaacaaatgagta

SEQ ID NO: 2957866 - DNA, 23 bp, Homo sapiens
ttaaacagggtctcactctgttg

SEQ ID NO: 2957867 - DNA, 15 bp, Homo sapiens
ttaaacattgaagta

SEQ ID NO: 2957868 - DNA, 16 bp, Homo sapiens
ttaaaccatgtgacta

SEQ ID NO: 2957869 - DNA, 21 bp, Homo sapiens
ttaaacccacaagctgcctct

SEQ ID NO: 2957870 - DNA, 23 bp, Homo sapiens
ttaaacccacaagctgcctctga

SEQ ID NO: 2957871 - DNA, 20 bp, Homo sapiens
ttaaaccctggatcagtcct

SEQ ID NO: 2957872 - DNA, 13 bp, Homo sapiens
ttaaacctttcca

SEQ ID NO: 2957873 - DNA, 15 bp, Homo sapiens
ttaaacgtaaatgtt

SEQ ID NO: 2957874 - DNA, 18 bp, Homo sapiens
ttaaacgtatgcatgtga

SEQ ID NO: 2957875 - DNA, 18 bp, Homo sapiens
ttaaactaaccttttatc

SEQ ID NO: 2957876 - DNA, 15 bp, Homo sapiens
ttaaactacaggtag

SEQ ID NO: 2957877 - DNA, 23 bp, Homo sapiens
ttaaactagatgacctcattaac

SEQ ID NO: 2957878 - DNA, 20 bp, Homo sapiens
ttaaagaaatttaatgtttc

SEQ ID NO: 2957879 - DNA, 11 bp, Homo sapiens
ttaaagacaga

SEQ ID NO: 2957880 - DNA, 17 bp, Homo sapiens
ttaaagacagggtcttg

SEQ ID NO: 2957881 - DNA, 19 bp, Homo sapiens
ttaaagagtctagattcaa

SEQ ID NO: 2957882 - DNA, 19 bp, Homo sapiens
ttaaagatgattgttcttt

SEQ ID NO: 2957883 - DNA, 21 bp, Homo sapiens
ttaaagatgattgttcttttg

SEQ ID NO: 2957884 - DNA, 21 bp, Homo sapiens
ttaaagatttatcaaatcagt

SEQ ID NO: 2957885 - DNA, 17 bp, Homo sapiens
ttaaaggacaaacagtg

SEQ ID NO: 2957886 - DNA, 17 bp, Homo sapiens
ttaaaggatgttggtgt

SEQ ID NO: 2957887 - DNA, 15 bp, Homo sapiens
ttaaaggcagtccag

SEQ ID NO: 2957888 - DNA, 18 bp, Homo sapiens
ttaaaggcagtccagagc

SEQ ID NO: 2957889 - DNA, 21 bp, Homo sapiens
ttaaagtgctaaggttctaag

SEQ ID NO: 2957890 - DNA, 20 bp, Homo sapiens
ttaaagtgctgtttagattt

SEQ ID NO: 2957891 - DNA, 15 bp, Homo sapiens
ttaaagttctgtaaa

SEQ ID NO: 2957892 - DNA, 15 bp, Homo sapiens
ttaaagttgtttgtg

SEQ ID NO: 2957893 - DNA, 19 bp, Homo sapiens
ttaaagtttaagtgtgcag

SEQ ID NO: 2957894 - DNA, 20 bp, Homo sapiens
ttaaataaataaataagaat

SEQ ID NO: 2957895 - DNA, 13 bp, Homo sapiens
ttaaataagattc

SEQ ID NO: 2957896 - DNA, 17 bp, Homo sapiens
ttaaataagattctaac

SEQ ID NO: 2957897 - DNA, 13 bp, Homo sapiens
ttaaatacagtct

SEQ ID NO: 2957898 - DNA, 16 bp, Homo sapiens
ttaaatatttcttaag

SEQ ID NO: 2957899 - DNA, 18 bp, Homo sapiens
ttaaatattttctatttt

SEQ ID NO: 2957900 - DNA, 14 bp, Homo sapiens
ttaaatcaaagata

SEQ ID NO: 2957901 - DNA, 17 bp, Homo sapiens
ttaaatcgtttaatgtt

SEQ ID NO: 2957902 - DNA, 18 bp, Homo sapiens
ttaaatcgtttaatgttt

SEQ ID NO: 2957903 - DNA, 21 bp, Homo sapiens
ttaaatcgtttaatgtttata

SEQ ID NO: 2957904 - DNA, 12 bp, Homo sapiens
ttaaatctctta

SEQ ID NO: 2957905 - DNA, 13 bp, Homo sapiens
ttaaatctgaatt

SEQ ID NO: 2957906 - DNA, 22 bp, Homo sapiens
ttaaatctgaattttaaaacat

SEQ ID NO: 2957907 - DNA, 15 bp, Homo sapiens
ttaaatcttaaaagt

SEQ ID NO: 2957908 - DNA, 17 bp, Homo sapiens
ttaaatctttcttcaaa

SEQ ID NO: 2957909 - DNA, 23 bp, Homo sapiens
ttaaatgaaaggagtttaaaaac

SEQ ID NO: 2957910 - DNA, 16 bp, Homo sapiens
ttaaatgtacagacat

SEQ ID NO: 2957911 - DNA, 21 bp, Homo sapiens
ttaaatgtacagacatattta

SEQ ID NO: 2957912 - DNA, 12 bp, Homo sapiens
ttaaatgtactt

SEQ ID NO: 2957913 - DNA, 17 bp, Homo sapiens
ttaaatgtatcacattg

SEQ ID NO: 2957914 - DNA, 21 bp, Homo sapiens
ttaaatgtatcacattgaaga

SEQ ID NO: 2957915 - DNA, 11 bp, Homo sapiens
ttaaatgttta

SEQ ID NO: 2957916 - DNA, 15 bp, Homo sapiens
ttaaatgtttactat

SEQ ID NO: 2957917 - DNA, 14 bp, Homo sapiens
ttaaatgtttgttg

SEQ ID NO: 2957918 - DNA, 14 bp, Homo sapiens
ttaaattaaaattt

SEQ ID NO: 2957919 - DNA, 18 bp, Homo sapiens
ttaaattctctctaacat

SEQ ID NO: 2957920 - DNA, 16 bp, Homo sapiens
ttaaattcttactctg

SEQ ID NO: 2957921 - DNA, 16 bp, Homo sapiens
ttaaattctttttcaa

SEQ ID NO: 2957922 - DNA, 20 bp, Homo sapiens
ttagttccaacaaagaaagg

SEQ ID NO: 2957923 - DNA, 22 bp, Homo sapiens
ttagttctagctctatttactt

SEQ ID NO: 2957924 - DNA, 15 bp, Homo sapiens
ttagttgaattccaa

SEQ ID NO: 2957925 - DNA, 21 bp, Homo sapiens
ttagtttagtgtgtgtgcaga

SEQ ID NO: 2957926 - DNA, 17 bp, Homo sapiens
ttagtttcccttagact

SEQ ID NO: 2957927 - DNA, 14 bp, Homo sapiens
ttagtttggattct

SEQ ID NO: 2957928 - DNA, 18 bp, Homo sapiens
ttagtttggattcttatg

SEQ ID NO: 2957929 - DNA, 19 bp, Homo sapiens
ttagttttaaggacttcat

SEQ ID NO: 2957930 - DNA, 13 bp, Homo sapiens
ttagttttcttgt

SEQ ID NO: 2957931 - DNA, 12 bp, Homo sapiens
ttataaaaagtt

SEQ ID NO: 2957932 - DNA, 13 bp, Homo sapiens
ttataaaatataa

SEQ ID NO: 2957933 - DNA, 23 bp, Homo sapiens
ttataaaatattgttaatgccta

SEQ ID NO: 2957934 - DNA, 16 bp, Homo sapiens
ttataaaatcaagttt

SEQ ID NO: 2957935 - DNA, 19 bp, Homo sapiens
ttataaacagacaatatgt

SEQ ID NO: 2957936 - DNA, 18 bp, Homo sapiens
ttataaactaaagttgta

SEQ ID NO: 2957937 - DNA, 17 bp, Homo sapiens
ttataaagagtgctaca

SEQ ID NO: 2957938 - DNA, 21 bp, Homo sapiens
ttataaatatgaagctcacct

SEQ ID NO: 2957939 - DNA, 16 bp, Homo sapiens
ttataactattcagtt

SEQ ID NO: 2957940 - DNA, 21 bp, Homo sapiens
ttataagagggcatatacagt

SEQ ID NO: 2957941 - DNA, 20 bp, Homo sapiens
ttataaggtgttttctgtgt

SEQ ID NO: 2957942 - DNA, 21 bp, Homo sapiens
ttataaggtgttttctgtgta

SEQ ID NO: 2957943 - DNA, 16 bp, Homo sapiens
ttataagttgctttcc

SEQ ID NO: 2957944 - DNA, 16 bp, Homo sapiens
ttataatgccagaata

SEQ ID NO: 2957945 - DNA, 20 bp, Homo sapiens
ttataatgttgtatttaatt

SEQ ID NO: 2957946 - DNA, 12 bp, Homo sapiens
ttatacaaagac

SEQ ID NO: 2957947 - DNA, 12 bp, Homo sapiens
ttatacaacagt

SEQ ID NO: 2957948 - DNA, 13 bp, Homo sapiens
ttatacagagtaa

SEQ ID NO: 2957949 - DNA, 18 bp, Homo sapiens
ttatacatcaatatgtat

SEQ ID NO: 2957950 - DNA, 19 bp, Homo sapiens
ttatacatcaatatgtata

SEQ ID NO: 2957951 - DNA, 12 bp, Homo sapiens
ttatacatcact

SEQ ID NO: 2957952 - DNA, 22 bp, Homo sapiens
ttatacccaaccccagatgccc

SEQ ID NO: 2957953 - DNA, 22 bp, Homo sapiens
ttatacgctggcaacacagagg

SEQ ID NO: 2957954 - DNA, 14 bp, Homo sapiens
ttatactgcacttt

SEQ ID NO: 2957955 - DNA, 15 bp, Homo sapiens
ttatactgtacaata

SEQ ID NO: 2957956 - DNA, 17 bp, Homo sapiens
ttatactgtacaataaa

SEQ ID NO: 2957957 - DNA, 14 bp, Homo sapiens
ttatacttaaacag

SEQ ID NO: 2957958 - DNA, 14 bp, Homo sapiens
ttatagaaagttca

SEQ ID NO: 2957959 - DNA, 13 bp, Homo sapiens
ttatagaagaaat

SEQ ID NO: 2957960 - DNA, 21 bp, Homo sapiens
ttatagatgggaatgaagctt

SEQ ID NO: 2957961 - DNA, 19 bp, Homo sapiens
ttatagattctaaagattc

SEQ ID NO: 2957962 - DNA, 20 bp, Homo sapiens
ttatagattctaaagattct

SEQ ID NO: 2957963 - DNA, 19 bp, Homo sapiens
ttatagattttttaaaaaa

SEQ ID NO: 2957964 - DNA, 18 bp, Homo sapiens
ttatagcaatgtgatttt

SEQ ID NO: 2957965 - DNA, 20 bp, Homo sapiens
ttatagcctggactgctacc

SEQ ID NO: 2957966 - DNA, 16 bp, Homo sapiens
ttatagcgcctgtata

SEQ ID NO: 2957967 - DNA, 21 bp, Homo sapiens
ttatagtgatgtaatcttgaa

SEQ ID NO: 2957968 - DNA, 20 bp, Homo sapiens
ttatagttgtgggtgggaga

SEQ ID NO: 2957969 - DNA, 13 bp, Homo sapiens
ttatagtttctga

SEQ ID NO: 2957970 - DNA, 14 bp, Homo sapiens
ttatatacaataat

SEQ ID NO: 2957971 - DNA, 19 bp, Homo sapiens
ttatatacaataatggaaa

SEQ ID NO: 2957972 - DNA, 23 bp, Homo sapiens
ttatatacagtacacagatacct

SEQ ID NO: 2957973 - DNA, 16 bp, Homo sapiens
ttatatagcaaagata

SEQ ID NO: 2957974 - DNA, 18 bp, Homo sapiens
ttatatagcaaagatata

SEQ ID NO: 2957975 - DNA, 21 bp, Homo sapiens
ttatataggttttgtttgcta

SEQ ID NO: 2957976 - DNA, 16 bp, Homo sapiens
ttatatatatgctact

SEQ ID NO: 2957977 - DNA, 19 bp, Homo sapiens
ttatatattgtctgtaaaa

SEQ ID NO: 2957978 - DNA, 15 bp, Homo sapiens
ttatatcaaagtatt

SEQ ID NO: 2957979 - DNA, 14 bp, Homo sapiens
ttatatcaaatgag

SEQ ID NO: 2957980 - DNA, 19 bp, Homo sapiens
ttatatcagtcctctttca

SEQ ID NO: 2957981 - DNA, 15 bp, Homo sapiens
ttatatcatatgtat

SEQ ID NO: 2957982 - DNA, 13 bp, Homo sapiens
ttatatgaaaaca

SEQ ID NO: 2957983 - DNA, 20 bp, Homo sapiens
ttatatgaagcaagctgtgt

SEQ ID NO: 2957984 - DNA, 22 bp, Homo sapiens
ttatatgaagcaagctgtgtta

SEQ ID NO: 2957985 - DNA, 16 bp, Homo sapiens
ttatatgtacatgaga

SEQ ID NO: 2957986 - DNA, 17 bp, Homo sapiens
ttatattaagaaaaata

SEQ ID NO: 2957987 - DNA, 19 bp, Homo sapiens
ttatattactgtcttttct

SEQ ID NO: 2957988 - DNA, 16 bp, Homo sapiens
ttatattatttacatt

SEQ ID NO: 2957989 - DNA, 12 bp, Homo sapiens
ttatattgaaaa

SEQ ID NO: 2957990 - DNA, 14 bp, Homo sapiens
ttatattgaaaaaa

SEQ ID NO: 2957991 - DNA, 23 bp, Homo sapiens
ttatattggtgcgtttttacagt

SEQ ID NO: 2957992 - DNA, 15 bp, Homo sapiens
ttatatttcaataaa

SEQ ID NO: 2957993 - DNA, 15 bp, Homo sapiens
ttatatttcagatgt

SEQ ID NO: 2957994 - DNA, 14 bp, Homo sapiens
ttatatttgaaaaa

SEQ ID NO: 2957995 - DNA, 15 bp, Homo sapiens
ttatatttgtaggag

SEQ ID NO: 2957996 - DNA, 18 bp, Homo sapiens
ttatatttgtgctatagt

SEQ ID NO: 2957997 - DNA, 18 bp, Homo sapiens
ttatattttcagcaaaga

SEQ ID NO: 2957998 - DNA, 19 bp, Homo sapiens
ttatattttttgtctgttt

SEQ ID NO: 2957999 - DNA, 17 bp, Homo sapiens
ttatatttttttaactg

SEQ ID NO: 2958000 - DNA, 20 bp, Homo sapiens
ttatatttttttaactgtga

SEQ ID NO: 2958001 - DNA, 23 bp, Homo sapiens
ttatatttttttaactgtgataa

SEQ ID NO: 2958002 - DNA, 18 bp, Homo sapiens
ttatcaaaaagtataaat

SEQ ID NO: 2958003 - DNA, 15 bp, Homo sapiens
ttatcaacttcctaa

SEQ ID NO: 2958004 - DNA, 18 bp, Homo sapiens
ttatcaccaggatttata

SEQ ID NO: 2958005 - DNA, 19 bp, Homo sapiens
ttatcaccaggatttatac

SEQ ID NO: 2958006 - DNA, 21 bp, Homo sapiens
ttatcaccgtgggctccctga

SEQ ID NO: 2958007 - DNA, 12 bp, Homo sapiens
ttatcacctcat

SEQ ID NO: 2958008 - DNA, 18 bp, Homo sapiens
ttatcacctcattctgaa

SEQ ID NO: 2958009 - DNA, 18 bp, Homo sapiens
ttatcacctggcttgttt

SEQ ID NO: 2958010 - DNA, 19 bp, Homo sapiens
ttatcacctggcttgttta

SEQ ID NO: 2958011 - DNA, 21 bp, Homo sapiens
ttatcagtaatgctaaatgtg

SEQ ID NO: 2958012 - DNA, 20 bp, Homo sapiens
ttatcagtgtattgatgtta

SEQ ID NO: 2958013 - DNA, 16 bp, Homo sapiens
ttatcatccacattgt

SEQ ID NO: 2958014 - DNA, 22 bp, Homo sapiens
ttatcatgtggcttttaattga

SEQ ID NO: 2958015 - DNA, 13 bp, Homo sapiens
ttatcatgtgtaa

SEQ ID NO: 2958016 - DNA, 14 bp, Homo sapiens
ttatcatgtgtaat

SEQ ID NO: 2958017 - DNA, 21 bp, Homo sapiens
ttatcatgtgtaatcaataaa

SEQ ID NO: 2958018 - DNA, 16 bp, Homo sapiens
ttatcattcctttcca

SEQ ID NO: 2958019 - DNA, 12 bp, Homo sapiens
ttatcatttcta

SEQ ID NO: 2958020 - DNA, 21 bp, Homo sapiens
ttatccaaaatgtgtatttct

SEQ ID NO: 2958021 - DNA, 23 bp, Homo sapiens
ttatccagaagtattgtttacat

SEQ ID NO: 2958022 - DNA, 12 bp, Homo sapiens
ttatccatatta

SEQ ID NO: 2958023 - DNA, 17 bp, Homo sapiens
ttatcccttcctgtctg

SEQ ID NO: 2958024 - DNA, 13 bp, Homo sapiens
ttatcctaaagat

SEQ ID NO: 2958025 - DNA, 20 bp, Homo sapiens
ttatcctagattatatcaaa

SEQ ID NO: 2958026 - DNA, 18 bp, Homo sapiens
ttatcctagcacatgctt

SEQ ID NO: 2958027 - DNA, 21 bp, Homo sapiens
ttatcctagcacatgcttcaa

SEQ ID NO: 2958028 - DNA, 17 bp, Homo sapiens
ttatccttgtttcctta

SEQ ID NO: 2958029 - DNA, 23 bp, Homo sapiens
ttatcgagcatgttgttttttca

SEQ ID NO: 2958030 - DNA, 17 bp, Homo sapiens
ttatcgtcttctaagag

SEQ ID NO: 2958031 - DNA, 19 bp, Homo sapiens
ttatctaagaatacagctt

SEQ ID NO: 2958032 - DNA, 21 bp, Homo sapiens
ttatctaagttaatttaaagt

SEQ ID NO: 2958033 - DNA, 20 bp, Homo sapiens
ttatctaatacctctgtgtg

SEQ ID NO: 2958034 - DNA, 21 bp, Homo sapiens
ttatctacctgttctgtagct

SEQ ID NO: 2958035 - DNA, 20 bp, Homo sapiens
ttatctattctgagaaaaca

SEQ ID NO: 2958036 - DNA, 16 bp, Homo sapiens
ttatctccaagtggca

SEQ ID NO: 2958037 - DNA, 20 bp, Homo sapiens
ttatctccatactttggatg

SEQ ID NO: 2958038 - DNA, 22 bp, Homo sapiens
ttatctccctgcttcatatctc

SEQ ID NO: 2958039 - DNA, 15 bp, Homo sapiens
ttatctgaaacttcc

SEQ ID NO: 2958040 - DNA, 18 bp, Homo sapiens
ttatctgagctgagccag

SEQ ID NO: 2958041 - DNA, 17 bp, Homo sapiens
ttatctgtggagttcct

SEQ ID NO: 2958042 - DNA, 22 bp, Homo sapiens
ttatcttatactgtacaataaa

SEQ ID NO: 2958043 - DNA, 19 bp, Homo sapiens
ttatcttctcaagttctaa

SEQ ID NO: 2958044 - DNA, 22 bp, Homo sapiens
ttatcttctcaagttctaagat

SEQ ID NO: 2958045 - DNA, 23 bp, Homo sapiens
ttatctttagttgaattccaagt

SEQ ID NO: 2958046 - DNA, 14 bp, Homo sapiens
ttatgaatattaaa

SEQ ID NO: 2958047 - DNA, 14 bp, Homo sapiens
ttatgaatctttcc

SEQ ID NO: 2958048 - DNA, 19 bp, Homo sapiens
ttatgacacaatgacacat

SEQ ID NO: 2958049 - DNA, 16 bp, Homo sapiens
ttatgaccagagcaaa

SEQ ID NO: 2958050 - DNA, 20 bp, Homo sapiens
ttatgaccagagcaaaaatg

SEQ ID NO: 2958051 - DNA, 12 bp, Homo sapiens
ttatgagaaatg

SEQ ID NO: 2958052 - DNA, 17 bp, Homo sapiens
ttatgaggggaaaaaaa

SEQ ID NO: 2958053 - DNA, 21 bp, Homo sapiens
ttatgagtataatgaacactc

SEQ ID NO: 2958054 - DNA, 16 bp, Homo sapiens
ttatgataatagattc

SEQ ID NO: 2958055 - DNA, 18 bp, Homo sapiens
ttatgatagtggtatgac

SEQ ID NO: 2958056 - DNA, 19 bp, Homo sapiens
ttatgatcaccatgtattt

SEQ ID NO: 2958057 - DNA, 18 bp, Homo sapiens
ttatgatgggctccccag

SEQ ID NO: 2958058 - DNA, 16 bp, Homo sapiens
ttatgcaaaacttttt

SEQ ID NO: 2958059 - DNA, 22 bp, Homo sapiens
ttatgcatgaagataatgtaaa

SEQ ID NO: 2958060 - DNA, 19 bp, Homo sapiens
ttatggacatcgatatgaa

SEQ ID NO: 2958061 - DNA, 16 bp, Homo sapiens
ttatggcagaagggaa

SEQ ID NO: 2958062 - DNA, 17 bp, Homo sapiens
ttatggccacagcccat

SEQ ID NO: 2958063 - DNA, 16 bp, Homo sapiens
ttatggtacactccag

SEQ ID NO: 2958064 - DNA, 13 bp, Homo sapiens
ttatgtacaacat

SEQ ID NO: 2958065 - DNA, 22 bp, Homo sapiens
ttatgtacatctgtttgtagcc

SEQ ID NO: 2958066 - DNA, 18 bp, Homo sapiens
ttatgtagacattgtaaa

SEQ ID NO: 2958067 - DNA, 16 bp, Homo sapiens
ttatgtagtaattgac

SEQ ID NO: 2958068 - DNA, 11 bp, Homo sapiens
ttatgtatttc

SEQ ID NO: 2958069 - DNA, 19 bp, Homo sapiens
ttatgtatttcctggatgt

SEQ ID NO: 2958070 - DNA, 18 bp, Homo sapiens
ttatgtctaaaatcctgc

SEQ ID NO: 2958071 - DNA, 17 bp, Homo sapiens
ttatgtgggtggcttct

SEQ ID NO: 2958072 - DNA, 15 bp, Homo sapiens
ttatgtgtaaataca

SEQ ID NO: 2958073 - DNA, 20 bp, Homo sapiens
ttatgtgtctggaagaagca

SEQ ID NO: 2958074 - DNA, 23 bp, Homo sapiens
ttatgtgtctggaagaagcagcg

SEQ ID NO: 2958075 - DNA, 17 bp, Homo sapiens
ttatgttcttatagaat

SEQ ID NO: 2958076 - DNA, 20 bp, Homo sapiens
ttatgttcttatagaataaa

SEQ ID NO: 2958077 - DNA, 23 bp, Homo sapiens
ttatgttcttatagaataaaagc

SEQ ID NO: 2958078 - DNA, 16 bp, Homo sapiens
ttatgttgttagagaa

SEQ ID NO: 2958079 - DNA, 18 bp, Homo sapiens
ttatgtttttcagtttaa

SEQ ID NO: 2958080 - DNA, 22 bp, Homo sapiens
ttattaaaacagaaattaatct

SEQ ID NO: 2958081 - DNA, 20 bp, Homo sapiens
ttattaaacgtatgcatgtg

SEQ ID NO: 2958082 - DNA, 16 bp, Homo sapiens
ttattaaatcgtttaa

SEQ ID NO: 2958083 - DNA, 16 bp, Homo sapiens
ttattaacaattaggc

SEQ ID NO: 2958084 - DNA, 18 bp, Homo sapiens
ttattaacataggtgaaa

SEQ ID NO: 2958085 - DNA, 22 bp, Homo sapiens
ttattaagccaggaaacatgaa

SEQ ID NO: 2958086 - DNA, 22 bp, Homo sapiens
ttattaagttcgaacatgtttc

SEQ ID NO: 2958087 - DNA, 15 bp, Homo sapiens
ttattaattgctttg

SEQ ID NO: 2958088 - DNA, 23 bp, Homo sapiens
ttattacataactgatctattta

SEQ ID NO: 2958089 - DNA, 20 bp, Homo sapiens
ttattaccccctccttcaga

SEQ ID NO: 2958090 - DNA, 11 bp, Homo sapiens
ttattagatga

SEQ ID NO: 2958091 - DNA, 13 bp, Homo sapiens
ttattagatgaat

SEQ ID NO: 2958092 - DNA, 20 bp, Homo sapiens
ttattagtaagaaaacatca

SEQ ID NO: 2958093 - DNA, 18 bp, Homo sapiens
ttattagtttacatcatt

SEQ ID NO: 2958094 - DNA, 21 bp, Homo sapiens
ttattataaatgttagttcta

SEQ ID NO: 2958095 - DNA, 21 bp, Homo sapiens
ttattataaattctactaagt

SEQ ID NO: 2958096 - DNA, 15 bp, Homo sapiens
ttattatatttacaa

SEQ ID NO: 2958097 - DNA, 22 bp, Homo sapiens
ttattatatttgacatgggtat

SEQ ID NO: 2958098 - DNA, 15 bp, Homo sapiens
ttattatgaagaatt

SEQ ID NO: 2958099 - DNA, 13 bp, Homo sapiens
ttattattattat

SEQ ID NO: 2958100 - DNA, 16 bp, Homo sapiens
ttattcaaacttttat

SEQ ID NO: 2958101 - DNA, 15 bp, Homo sapiens
ttattcaaatgaagg

SEQ ID NO: 2958102 - DNA, 11 bp, Homo sapiens
ttattcacttt

SEQ ID NO: 2958103 - DNA, 18 bp, Homo sapiens
ttattcagtagtttgagg

SEQ ID NO: 2958104 - DNA, 22 bp, Homo sapiens
ttattccagaatgctgtacatc

SEQ ID NO: 2958105 - DNA, 14 bp, Homo sapiens
ttattcctagttgg

SEQ ID NO: 2958106 - DNA, 13 bp, Homo sapiens
ttattcctgtatg

SEQ ID NO: 2958107 - DNA, 18 bp, Homo sapiens
ttattctacttttaaata

SEQ ID NO: 2958108 - DNA, 22 bp, Homo sapiens
ttattctagggtttcttaaata

SEQ ID NO: 2958109 - DNA, 17 bp, Homo sapiens
ttattctcactccacca

SEQ ID NO: 2958110 - DNA, 22 bp, Homo sapiens
ttattctctgtttgcttttgaa

SEQ ID NO: 2958111 - DNA, 20 bp, Homo sapiens
ttattctgtagattctgtgg

SEQ ID NO: 2958112 - DNA, 12 bp, Homo sapiens
ttattcttttcc

SEQ ID NO: 2958113 - DNA, 14 bp, Homo sapiens
ttattgaaagaatt

SEQ ID NO: 2958114 - DNA, 19 bp, Homo sapiens
ttattgaatatttatacta

SEQ ID NO: 2958115 - DNA, 23 bp, Homo sapiens
ttattgacacagaaaatgttgag

SEQ ID NO: 2958116 - DNA, 17 bp, Homo sapiens
ttattgacgaactggct

SEQ ID NO: 2958117 - DNA, 21 bp, Homo sapiens
ttattgcagtttatcattcaa

SEQ ID NO: 2958118 - DNA, 22 bp, Homo sapiens
ttattgccattatagcgcctgt

SEQ ID NO: 2958119 - DNA, 14 bp, Homo sapiens
ttattgccttctca

SEQ ID NO: 2958120 - DNA, 12 bp, Homo sapiens
ttattgctgttg

SEQ ID NO: 2958121 - DNA, 17 bp, Homo sapiens
ttattggatgatacagt

SEQ ID NO: 2958122 - DNA, 19 bp, Homo sapiens
ttattggatgatacagtgt

SEQ ID NO: 2958123 - DNA, 16 bp, Homo sapiens
ttattgtattttgatg

SEQ ID NO: 2958124 - DNA, 14 bp, Homo sapiens
ttattgtggataac

SEQ ID NO: 2958125 - DNA, 18 bp, Homo sapiens
ttattgtgtgcgctgcct

SEQ ID NO: 2958126 - DNA, 18 bp, Homo sapiens
ttatttaaaaaaaaacat

SEQ ID NO: 2958127 - DNA, 13 bp, Homo sapiens
ttatttaaaagat

SEQ ID NO: 2958128 - DNA, 17 bp, Homo sapiens
ttatttaaaagattcat

SEQ ID NO: 2958129 - DNA, 18 bp, Homo sapiens
ttatttaaaagattcatt

SEQ ID NO: 2958130 - DNA, 13 bp, Homo sapiens
ttatttaaagcac

SEQ ID NO: 2958131 - DNA, 13 bp, Homo sapiens
ttatttaaatgta

SEQ ID NO: 2958132 - DNA, 16 bp, Homo sapiens
ttatttaactcttaac

SEQ ID NO: 2958133 - DNA, 15 bp, Homo sapiens
ttatttaacttttct

SEQ ID NO: 2958134 - DNA, 14 bp, Homo sapiens
ttatttacttgaaa

SEQ ID NO: 2958135 - DNA, 16 bp, Homo sapiens
ttatttataaaaagat

SEQ ID NO: 2958136 - DNA, 16 bp, Homo sapiens
ttatttatatgaagca

SEQ ID NO: 2958137 - DNA, 22 bp, Homo sapiens
ttatttatatgaagcaagctgt

SEQ ID NO: 2958138 - DNA, 14 bp, Homo sapiens
ttatttatatgtac

SEQ ID NO: 2958139 - DNA, 17 bp, Homo sapiens
ttatttatatgtactgt

SEQ ID NO: 2958140 - DNA, 13 bp, Homo sapiens
ttatttatgtact

SEQ ID NO: 2958141 - DNA, 12 bp, Homo sapiens
ttatttcaatat

SEQ ID NO: 2958142 - DNA, 16 bp, Homo sapiens
ttatttcattcatatc

SEQ ID NO: 2958143 - DNA, 13 bp, Homo sapiens
ttatttccccagc

SEQ ID NO: 2958144 - DNA, 17 bp, Homo sapiens
ttatttccccagccaca

SEQ ID NO: 2958145 - DNA, 20 bp, Homo sapiens
ttatttctgagcaaagcatc

SEQ ID NO: 2958146 - DNA, 22 bp, Homo sapiens
ttatttctgcatatgttgaata

SEQ ID NO: 2958147 - DNA, 13 bp, Homo sapiens
ttatttcttttgt

SEQ ID NO: 2958148 - DNA, 19 bp, Homo sapiens
ttatttgaatgaacactat

SEQ ID NO: 2958149 - DNA, 12 bp, Homo sapiens
ttatttgagttt

SEQ ID NO: 2958150 - DNA, 16 bp, Homo sapiens
ttatttgataacattt

SEQ ID NO: 2958151 - DNA, 12 bp, Homo sapiens
ttatttgttgag

SEQ ID NO: 2958152 - DNA, 16 bp, Homo sapiens
ttatttgttgttttct

SEQ ID NO: 2958153 - DNA, 18 bp, Homo sapiens
ttatttgttgttttctgg

SEQ ID NO: 2958154 - DNA, 14 bp, Homo sapiens
ttattttaaaatat

SEQ ID NO: 2958155 - DNA, 17 bp, Homo sapiens
ttattttacacagaaac

SEQ ID NO: 2958156 - DNA, 19 bp, Homo sapiens
ttattttacacagcaattt

SEQ ID NO: 2958157 - DNA, 14 bp, Homo sapiens
ttattttagacttt

SEQ ID NO: 2958158 - DNA, 12 bp, Homo sapiens
ttattttatgag

SEQ ID NO: 2958159 - DNA, 16 bp, Homo sapiens
ttattttatgagaaat

SEQ ID NO: 2958160 - DNA, 18 bp, Homo sapiens
ttattttatgagaaatgt

SEQ ID NO: 2958161 - DNA, 20 bp, Homo sapiens
ttattttatgagaaatgtaa

SEQ ID NO: 2958162 - DNA, 15 bp, Homo sapiens
ttattttcaccctct

SEQ ID NO: 2958163 - DNA, 12 bp, Homo sapiens
ttattttgcaac

SEQ ID NO: 2958164 - DNA, 12 bp, Homo sapiens
ttattttgctct

SEQ ID NO: 2958165 - DNA, 20 bp, Homo sapiens
ttattttgggttcaggcctg

SEQ ID NO: 2958166 - DNA, 17 bp, Homo sapiens
ttatttttaaattttct

SEQ ID NO: 2958167 - DNA, 18 bp, Homo sapiens
ttatttttaatatgttga

SEQ ID NO: 2958168 - DNA, 20 bp, Homo sapiens
ttatttttaatatgttgact

SEQ ID NO: 2958169 - DNA, 13 bp, Homo sapiens
ttatttttctaaa

SEQ ID NO: 2958170 - DNA, 14 bp, Homo sapiens
ttatttttctgtga

SEQ ID NO: 2958171 - DNA, 14 bp, Homo sapiens
ttatttttctttaa

SEQ ID NO: 2958172 - DNA, 21 bp, Homo sapiens
ttatttttctttaaagccagt

SEQ ID NO: 2958173 - DNA, 15 bp, Homo sapiens
ttatttttgtatttt

SEQ ID NO: 2958174 - DNA, 20 bp, Homo sapiens
ttattttttcttttgtaatt

SEQ ID NO: 2958175 - DNA, 24 bp, Homo sapiens
ttatttttttctacataattgtga

SEQ ID NO: 2958176 - DNA, 22 bp, Homo sapiens
ttatttttttgatggctaagat

SEQ ID NO: 2958177 - DNA, 21 bp, Homo sapiens
ttcaaaaagtctacgctctcc

SEQ ID NO: 2958178 - DNA, 16 bp, Homo sapiens
ttcaaaacagttactt

SEQ ID NO: 2958179 - DNA, 17 bp, Homo sapiens
ttcaaaaccttttgaaa

SEQ ID NO: 2958180 - DNA, 20 bp, Homo sapiens
ttcaaaagtattttcctgta

SEQ ID NO: 2958181 - DNA, 11 bp, Homo sapiens
ttcaaaagtgg

SEQ ID NO: 2958182 - DNA, 15 bp, Homo sapiens
ttcaaaagttccaag

SEQ ID NO: 2958183 - DNA, 16 bp, Homo sapiens
ttcaaaagttccaaga

SEQ ID NO: 2958184 - DNA, 16 bp, Homo sapiens
ttcaaaagttgaaatt

SEQ ID NO: 2958185 - DNA, 17 bp, Homo sapiens
ttcaaaagttgaaatta

SEQ ID NO: 2958186 - DNA, 20 bp, Homo sapiens
ttcaaaatgctttttattat

SEQ ID NO: 2958187 - DNA, 23 bp, Homo sapiens
ttcaaaatgttatcttctcaagt

SEQ ID NO: 2958188 - DNA, 20 bp, Homo sapiens
ttcaaactacctatattcct

SEQ ID NO: 2958189 - DNA, 21 bp, Homo sapiens
ttcaaactgtaaaccaatttt

SEQ ID NO: 2958190 - DNA, 12 bp, Homo sapiens
ttcaaagatgct

SEQ ID NO: 2958191 - DNA, 13 bp, Homo sapiens
ttcaaagccagcg

SEQ ID NO: 2958192 - DNA, 23 bp, Homo sapiens
ttcaaagccagcgtcctcctctg

SEQ ID NO: 2958193 - DNA, 21 bp, Homo sapiens
ttcaaatcatgttttttctgc

SEQ ID NO: 2958194 - DNA, 13 bp, Homo sapiens
ttcaaatctgtaa

SEQ ID NO: 2958195 - DNA, 12 bp, Homo sapiens
ttcaaatgaagg

SEQ ID NO: 2958196 - DNA, 12 bp, Homo sapiens
ttcaaattaaaa

SEQ ID NO: 2958197 - DNA, 13 bp, Homo sapiens
ttcaaattaaaaa

SEQ ID NO: 2958198 - DNA, 20 bp, Homo sapiens
ttcaaattaggcaaatcttt

SEQ ID NO: 2958199 - DNA, 22 bp, Homo sapiens
ttcaaatttactgtcttaaatc

SEQ ID NO: 2958200 - DNA, 23 bp, Homo sapiens
ttcaaatttactgtcttaaatca

SEQ ID NO: 2958201 - DNA, 19 bp, Homo sapiens
ttcaacactgaaaaaatac

SEQ ID NO: 2958202 - DNA, 17 bp, Homo sapiens
ttcaacctagaaacctt

SEQ ID NO: 2958203 - DNA, 20 bp, Homo sapiens
ttcaacctagaaacctttat

SEQ ID NO: 2958204 - DNA, 11 bp, Homo sapiens
ttcaactattt

SEQ ID NO: 2958205 - DNA, 17 bp, Homo sapiens
ttcaactattttattat

SEQ ID NO: 2958206 - DNA, 13 bp, Homo sapiens
ttcaagacttgat

SEQ ID NO: 2958207 - DNA, 17 bp, Homo sapiens
ttcaagcgattctcctg

SEQ ID NO: 2958208 - DNA, 13 bp, Homo sapiens
ttcaaggaagaaa

SEQ ID NO: 2958209 - DNA, 16 bp, Homo sapiens
ttcaaggagaatatga

SEQ ID NO: 2958210 - DNA, 18 bp, Homo sapiens
ttcaaggatctcctgttt

SEQ ID NO: 2958211 - DNA, 20 bp, Homo sapiens
ttcaaggcatcatgcagagt

SEQ ID NO: 2958212 - DNA, 17 bp, Homo sapiens
ttcaaggccatccttcc

SEQ ID NO: 2958213 - DNA, 12 bp, Homo sapiens
ttcaaggcttca

SEQ ID NO: 2958214 - DNA, 15 bp, Homo sapiens
ttcaagggaattaaa

SEQ ID NO: 2958215 - DNA, 20 bp, Homo sapiens
ttcaagtagctgggatttta

SEQ ID NO: 2958216 - DNA, 17 bp, Homo sapiens
ttcaagtgactctcctg

SEQ ID NO: 2958217 - DNA, 21 bp, Homo sapiens
ttcaagtgactctcctgcctc

SEQ ID NO: 2958218 - DNA, 22 bp, Homo sapiens
ttcaagtgcatgctctctgcag

SEQ ID NO: 2958219 - DNA, 18 bp, Homo sapiens
ttcaataaatgtctgttg

SEQ ID NO: 2958220 - DNA, 22 bp, Homo sapiens
ttcaatactgtcccacttctca

SEQ ID NO: 2958221 - DNA, 15 bp, Homo sapiens
ttcaatatcctttgc

SEQ ID NO: 2958222 - DNA, 20 bp, Homo sapiens
ttcaatctcgtttagtgcca

SEQ ID NO: 2958223 - DNA, 22 bp, Homo sapiens
ttcaatctcgtttagtgccaat

SEQ ID NO: 2958224 - DNA, 21 bp, Homo sapiens
ttcaattacaaagcagttact

SEQ ID NO: 2958225 - DNA, 15 bp, Homo sapiens
ttcaattatattgtt

SEQ ID NO: 2958226 - DNA, 19 bp, Homo sapiens
ttcaattcagtgctgtact

SEQ ID NO: 2958227 - DNA, 16 bp, Homo sapiens
ttcaattcctggccct

SEQ ID NO: 2958228 - DNA, 19 bp, Homo sapiens
ttcaattgcatctcccaga

SEQ ID NO: 2958229 - DNA, 20 bp, Homo sapiens
ttcaatttactttttaaaca

SEQ ID NO: 2958230 - DNA, 20 bp, Homo sapiens
ttcaatttggatatttggag

SEQ ID NO: 2958231 - DNA, 20 bp, Homo sapiens
ttcaatttgttaacagagca

SEQ ID NO: 2958232 - DNA, 16 bp, Homo sapiens
ttcacaaggtataata

SEQ ID NO: 2958233 - DNA, 23 bp, Homo sapiens
ttcacacatctgggtgccctgaa

SEQ ID NO: 2958234 - DNA, 15 bp, Homo sapiens
ttcacagaaaaagca

SEQ ID NO: 2958235 - DNA, 19 bp, Homo sapiens
ttcacagatgctgtgtaac

SEQ ID NO: 2958236 - DNA, 20 bp, Homo sapiens
ttcacagatgctgtgtaaca

SEQ ID NO: 2958237 - DNA, 16 bp, Homo sapiens
ttcacagcttttatca

SEQ ID NO: 2958238 - DNA, 19 bp, Homo sapiens
ttcacatatgattctctta

SEQ ID NO: 2958239 - DNA, 19 bp, Homo sapiens
ttcacatcctgtgtttcta

SEQ ID NO: 2958240 - DNA, 21 bp, Homo sapiens
ttcacatcctgtgtttctagg

SEQ ID NO: 2958241 - DNA, 18 bp, Homo sapiens
ttcacatctaacctcatc

SEQ ID NO: 2958242 - DNA, 13 bp, Homo sapiens
ttcacatctcatt

SEQ ID NO: 2958243 - DNA, 14 bp, Homo sapiens
ttcacatgccttgc

SEQ ID NO: 2958244 - DNA, 12 bp, Homo sapiens
ttcacattctta

SEQ ID NO: 2958245 - DNA, 19 bp, Homo sapiens
ttcacattcttataaatat

SEQ ID NO: 2958246 - DNA, 15 bp, Homo sapiens
ttcacattcttggct

SEQ ID NO: 2958247 - DNA, 15 bp, Homo sapiens
ttcaccatcatgtac

SEQ ID NO: 2958248 - DNA, 17 bp, Homo sapiens
ttcaccatggccccctc

SEQ ID NO: 2958249 - DNA, 24 bp, Homo sapiens
ttcaccatttggcaatgccatcat

SEQ ID NO: 2958250 - DNA, 20 bp, Homo sapiens
ttcaccccagggcctgagcc

SEQ ID NO: 2958251 - DNA, 16 bp, Homo sapiens
ttcacctaagagattc

SEQ ID NO: 2958252 - DNA, 19 bp, Homo sapiens
ttcacctaagagattctga

SEQ ID NO: 2958253 - DNA, 20 bp, Homo sapiens
ttcacctaagagattctgat

SEQ ID NO: 2958254 - DNA, 18 bp, Homo sapiens
ttcacctaccgagttcaa

SEQ ID NO: 2958255 - DNA, 19 bp, Homo sapiens
ttcacctcactgaaaacat

SEQ ID NO: 2958256 - DNA, 21 bp, Homo sapiens
ttcacctgggcgccaactgct

SEQ ID NO: 2958257 - DNA, 23 bp, Homo sapiens
ttcaccttcgtttactatgcctg

SEQ ID NO: 2958258 - DNA, 14 bp, Homo sapiens
ttcacgagtgttcc

SEQ ID NO: 2958259 - DNA, 18 bp, Homo sapiens
ttcacgccattctcctgc

SEQ ID NO: 2958260 - DNA, 19 bp, Homo sapiens
ttcacgccattctcctgcc

SEQ ID NO: 2958261 - DNA, 13 bp, Homo sapiens
ttcacgggcccca

SEQ ID NO: 2958262 - DNA, 14 bp, Homo sapiens
ttcactaaaaaggg

SEQ ID NO: 2958263 - DNA, 19 bp, Homo sapiens
ttcactctcctatgccttt

SEQ ID NO: 2958264 - DNA, 13 bp, Homo sapiens
ttcactgcaattt

SEQ ID NO: 2958265 - DNA, 22 bp, Homo sapiens
ttcactgctgctcctctttccc

SEQ ID NO: 2958266 - DNA, 21 bp, Homo sapiens
ttcactggcgaggtgcggcca

SEQ ID NO: 2958267 - DNA, 13 bp, Homo sapiens
ttcactggcgcct

SEQ ID NO: 2958268 - DNA, 18 bp, Homo sapiens
ttcactggcgccttctcg

SEQ ID NO: 2958269 - DNA, 21 bp, Homo sapiens
ttcactgtttcacttgctctt

SEQ ID NO: 2958270 - DNA, 22 bp, Homo sapiens
ttcacttaaaagctggctttca

SEQ ID NO: 2958271 - DNA, 13 bp, Homo sapiens
ttcacttcctcca

SEQ ID NO: 2958272 - DNA, 20 bp, Homo sapiens
ttcacttcctccagaagcct

SEQ ID NO: 2958273 - DNA, 21 bp, Homo sapiens
ttcacttcgaaattctgagtt

SEQ ID NO: 2958274 - DNA, 17 bp, Homo sapiens
ttcacttctttgcagag

SEQ ID NO: 2958275 - DNA, 20 bp, Homo sapiens
ttcacttctttgcagagcct

SEQ ID NO: 2958276 - DNA, 14 bp, Homo sapiens
ttcactttcatttt

SEQ ID NO: 2958277 - DNA, 17 bp, Homo sapiens
ttcacttttgacaaagg

SEQ ID NO: 2958278 - DNA, 16 bp, Homo sapiens
ttcagaaccatccata

SEQ ID NO: 2958279 - DNA, 13 bp, Homo sapiens
ttcagaaggagaa

SEQ ID NO: 2958280 - DNA, 18 bp, Homo sapiens
ttcagaaggagaaggaaa

SEQ ID NO: 2958281 - DNA, 22 bp, Homo sapiens
ttcagaatcaaacctttttata

SEQ ID NO: 2958282 - DNA, 10 bp, Homo sapiens
ttcagacccc

SEQ ID NO: 2958283 - DNA, 20 bp, Homo sapiens
ttcagactcccattcctgaa

SEQ ID NO: 2958284 - DNA, 16 bp, Homo sapiens
ttcagagttttctggg

SEQ ID NO: 2958285 - DNA, 19 bp, Homo sapiens
ttcagatatcaaaattcta

SEQ ID NO: 2958286 - DNA, 17 bp, Homo sapiens
ttcagatcagtgcttga

SEQ ID NO: 2958287 - DNA, 13 bp, Homo sapiens
ttcagatgtaatg

SEQ ID NO: 2958288 - DNA, 14 bp, Homo sapiens
ttcagatgtaatgt

SEQ ID NO: 2958289 - DNA, 16 bp, Homo sapiens
ttcagatgtgaaccat

SEQ ID NO: 2958290 - DNA, 18 bp, Homo sapiens
ttcagatgtgaaccatta

SEQ ID NO: 2958291 - DNA, 17 bp, Homo sapiens
ttcagatgtggagccag

SEQ ID NO: 2958292 - DNA, 19 bp, Homo sapiens
ttcagatgtggagccaggc

SEQ ID NO: 2958293 - DNA, 16 bp, Homo sapiens
ttcagattttcagagg

SEQ ID NO: 2958294 - DNA, 16 bp, Homo sapiens
ttcagcaaattccaga

SEQ ID NO: 2958295 - DNA, 19 bp, Homo sapiens
ttcagcatccgcaggtgct

SEQ ID NO: 2958296 - DNA, 22 bp, Homo sapiens
ttcagccaaacagtatgatgga

SEQ ID NO: 2958297 - DNA, 23 bp, Homo sapiens
ttcagccaaacagtatgatggaa

SEQ ID NO: 2958298 - DNA, 16 bp, Homo sapiens
ttcagccaaagtccta

SEQ ID NO: 2958299 - DNA, 18 bp, Homo sapiens
ttcagccaatctggacac

SEQ ID NO: 2958300 - DNA, 22 bp, Homo sapiens
ttcagccaatctggacacttct

SEQ ID NO: 2958301 - DNA, 19 bp, Homo sapiens
ttcagccaatttgtctcct

SEQ ID NO: 2958302 - DNA, 11 bp, Homo sapiens
ttcagccacat

SEQ ID NO: 2958303 - DNA, 15 bp, Homo sapiens
ttcagccacatgccc

SEQ ID NO: 2958304 - DNA, 23 bp, Homo sapiens
ttcagccacatgccccaggctct

SEQ ID NO: 2958305 - DNA, 16 bp, Homo sapiens
ttcagccatgtacaga

SEQ ID NO: 2958306 - DNA, 13 bp, Homo sapiens
ttcagcccctcct

SEQ ID NO: 2958307 - DNA, 15 bp, Homo sapiens
ttcagcctctttctg

SEQ ID NO: 2958308 - DNA, 12 bp, Homo sapiens
ttcagcctgtct

SEQ ID NO: 2958309 - DNA, 20 bp, Homo sapiens
ttcagcgcccccaggcctgc

SEQ ID NO: 2958310 - DNA, 21 bp, Homo sapiens
ttcagcgcccccaggcctgcc

SEQ ID NO: 2958311 - DNA, 21 bp, Homo sapiens
ttcagctccagcccctttcca

SEQ ID NO: 2958312 - DNA, 23 bp, Homo sapiens
ttcagctccagcccctttccaaa

SEQ ID NO: 2958313 - DNA, 11 bp, Homo sapiens
ttcagctggtg

SEQ ID NO: 2958314 - DNA, 19 bp, Homo sapiens
ttcagctggtggatggtga

SEQ ID NO: 2958315 - DNA, 21 bp, Homo sapiens
ttcagctggtggatggtgact

SEQ ID NO: 2958316 - DNA, 14 bp, Homo sapiens
ttcagcttctgttg

SEQ ID NO: 2958317 - DNA, 16 bp, Homo sapiens
ttcaggaacaccccca

SEQ ID NO: 2958318 - DNA, 19 bp, Homo sapiens
ttcaggaatgtgtggcctg

SEQ ID NO: 2958319 - DNA, 14 bp, Homo sapiens
ttcaggaatttaaa

SEQ ID NO: 2958320 - DNA, 22 bp, Homo sapiens
ttcaggatgcacggtttctgtt

SEQ ID NO: 2958321 - DNA, 17 bp, Homo sapiens
ttcaggcaattctcctg

SEQ ID NO: 2958322 - DNA, 12 bp, Homo sapiens
ttcaggcactga

SEQ ID NO: 2958323 - DNA, 17 bp, Homo sapiens
ttcaggcagcactgaca

SEQ ID NO: 2958324 - DNA, 18 bp, Homo sapiens
ttcaggccctcagctgtc

SEQ ID NO: 2958325 - DNA, 15 bp, Homo sapiens
ttcagggcagcccct

SEQ ID NO: 2958326 - DNA, 17 bp, Homo sapiens
ttcaggggaagggcagg

SEQ ID NO: 2958327 - DNA, 15 bp, Homo sapiens
ttcagggtgatgcca

SEQ ID NO: 2958328 - DNA, 16 bp, Homo sapiens
ttcagggtgatgccag

SEQ ID NO: 2958329 - DNA, 18 bp, Homo sapiens
ttcaggtcaactctgaag

SEQ ID NO: 2958330 - DNA, 23 bp, Homo sapiens
ttcaggtcaactctgaagagtat

SEQ ID NO: 2958331 - DNA, 18 bp, Homo sapiens
ttcaggtcctagggcctc

SEQ ID NO: 2958332 - DNA, 18 bp, Homo sapiens
ttcaggtggagagcacta

SEQ ID NO: 2958333 - DNA, 20 bp, Homo sapiens
ttcaggtggagagcactaga

SEQ ID NO: 2958334 - DNA, 23 bp, Homo sapiens
ttcaggtgtaaccatttgttaac

SEQ ID NO: 2958335 - DNA, 15 bp, Homo sapiens
ttcaggttgttggtg

SEQ ID NO: 2958336 - DNA, 21 bp, Homo sapiens
ttcagtacttttttaaatatt

SEQ ID NO: 2958337 - DNA, 22 bp, Homo sapiens
ttcagtattaaactctcctttg

SEQ ID NO: 2958338 - DNA, 21 bp, Homo sapiens
ttcagtccctgagcagtctac

SEQ ID NO: 2958339 - DNA, 22 bp, Homo sapiens
ttcagtccctgagcagtctact

SEQ ID NO: 2958340 - DNA, 21 bp, Homo sapiens
ttcagtcctggtctgctcagg

SEQ ID NO: 2958341 - DNA, 13 bp, Homo sapiens
ttcagtctagaag

SEQ ID NO: 2958342 - DNA, 22 bp, Homo sapiens
ttcagtctgtgcctacatgttc

SEQ ID NO: 2958343 - DNA, 13 bp, Homo sapiens
ttcagtgatggca

SEQ ID NO: 2958344 - DNA, 14 bp, Homo sapiens
ttcagtgcccacca

SEQ ID NO: 2958345 - DNA, 14 bp, Homo sapiens
ttcagtgggagaaa

SEQ ID NO: 2958346 - DNA, 13 bp, Homo sapiens
ttcagtgtaaata

SEQ ID NO: 2958347 - DNA, 21 bp, Homo sapiens
ttcagtgtaatgtgacttcat

SEQ ID NO: 2958348 - DNA, 17 bp, Homo sapiens
ttcagtgtaatttcttt

SEQ ID NO: 2958349 - DNA, 20 bp, Homo sapiens
ttcagtgtaatttctttgcc

SEQ ID NO: 2958350 - DNA, 12 bp, Homo sapiens
ttcagtgtcctt

SEQ ID NO: 2958351 - DNA, 22 bp, Homo sapiens
ttcagtgttaaatgtgatgaat

SEQ ID NO: 2958352 - DNA, 11 bp, Homo sapiens
ttcagttacag

SEQ ID NO: 2958353 - DNA, 15 bp, Homo sapiens
ttcagttacagaaag

SEQ ID NO: 2958354 - DNA, 18 bp, Homo sapiens
ttcagttctttctttttc

SEQ ID NO: 2958355 - DNA, 20 bp, Homo sapiens
ttcagttgtgtttgttgctg

SEQ ID NO: 2958356 - DNA, 17 bp, Homo sapiens
ttcagtttcttctgcgc

SEQ ID NO: 2958357 - DNA, 13 bp, Homo sapiens
ttcagttttccca

SEQ ID NO: 2958358 - DNA, 18 bp, Homo sapiens
ttcataaaagtttgcatg

SEQ ID NO: 2958359 - DNA, 20 bp, Homo sapiens
ttcataaaagtttgcatgtg

SEQ ID NO: 2958360 - DNA, 14 bp, Homo sapiens
ttcataaagattca

SEQ ID NO: 2958361 - DNA, 23 bp, Homo sapiens
ttcataactaatgaattgaaatt

SEQ ID NO: 2958362 - DNA, 17 bp, Homo sapiens
ttcataagtatttcaaa

SEQ ID NO: 2958363 - DNA, 15 bp, Homo sapiens
ttcataatgcagaag

SEQ ID NO: 2958364 - DNA, 21 bp, Homo sapiens
ttcatacagggatggtgttca

SEQ ID NO: 2958365 - DNA, 12 bp, Homo sapiens
ttcataccgcct

SEQ ID NO: 2958366 - DNA, 23 bp, Homo sapiens
ttcatactccttttaagcagtga

SEQ ID NO: 2958367 - DNA, 22 bp, Homo sapiens
ttcatactctgttgcctcctct

SEQ ID NO: 2958368 - DNA, 17 bp, Homo sapiens
ttcatagtaacttctta

SEQ ID NO: 2958369 - DNA, 16 bp, Homo sapiens
ttcatatattattccg

SEQ ID NO: 2958370 - DNA, 14 bp, Homo sapiens
ttcatattctttta

SEQ ID NO: 2958371 - DNA, 14 bp, Homo sapiens
ttcatattgtaatc

SEQ ID NO: 2958372 - DNA, 10 bp, Homo sapiens
ttcatatttt

SEQ ID NO: 2958373 - DNA, 20 bp, Homo sapiens
ttcatcaggctctgttcctc

SEQ ID NO: 2958374 - DNA, 17 bp, Homo sapiens
ttcatcatccctccctg

SEQ ID NO: 2958375 - DNA, 12 bp, Homo sapiens
ttcatcatttca

SEQ ID NO: 2958376 - DNA, 20 bp, Homo sapiens
ttcatccatcatctgctgca

SEQ ID NO: 2958377 - DNA, 22 bp, Homo sapiens
ttcatcctgtgtcccctgacct

SEQ ID NO: 2958378 - DNA, 22 bp, Homo sapiens
ttcatcctgttggctgctgcca

SEQ ID NO: 2958379 - DNA, 23 bp, Homo sapiens
ttcatctccctgccatccccctc

SEQ ID NO: 2958380 - DNA, 13 bp, Homo sapiens
ttcatctctttgt

SEQ ID NO: 2958381 - DNA, 22 bp, Homo sapiens
ttcatctggaagtattttcctc

SEQ ID NO: 2958382 - DNA, 18 bp, Homo sapiens
ttcatctgggaaagacat

SEQ ID NO: 2958383 - DNA, 22 bp, Homo sapiens
ttcatctgtgtagctgctcttt

SEQ ID NO: 2958384 - DNA, 21 bp, Homo sapiens
ttcatgaaggtcctagcttta

SEQ ID NO: 2958385 - DNA, 12 bp, Homo sapiens
ttcatgaagtga

SEQ ID NO: 2958386 - DNA, 16 bp, Homo sapiens
ttcatgaatcttgaga

SEQ ID NO: 2958387 - DNA, 15 bp, Homo sapiens
ttcatgcctgatgaa

SEQ ID NO: 2958388 - DNA, 19 bp, Homo sapiens
ttcatggaaaagccttctt

SEQ ID NO: 2958389 - DNA, 23 bp, Homo sapiens
ttcatgggcccacagggtaccag

SEQ ID NO: 2958390 - DNA, 15 bp, Homo sapiens
ttcatgggctgtgtg

SEQ ID NO: 2958391 - DNA, 18 bp, Homo sapiens
ttcatgtaaactgtgcac

SEQ ID NO: 2958392 - DNA, 19 bp, Homo sapiens
ttcatgtaaactgtgcacc

SEQ ID NO: 2958393 - DNA, 18 bp, Homo sapiens
ttcatgtaatcctcaaga

SEQ ID NO: 2958394 - DNA, 17 bp, Homo sapiens
ttcatgtacaagatgaa

SEQ ID NO: 2958395 - DNA, 22 bp, Homo sapiens
ttcatgtacaaggcccctctgc

SEQ ID NO: 2958396 - DNA, 22 bp, Homo sapiens
ttcatgttgcacacccactcag

SEQ ID NO: 2958397 - DNA, 14 bp, Homo sapiens
ttcattaaacttga

SEQ ID NO: 2958398 - DNA, 15 bp, Homo sapiens
ttcattaaacttgaa

SEQ ID NO: 2958399 - DNA, 19 bp, Homo sapiens
ttcattaagttgtaaaatg

SEQ ID NO: 2958400 - DNA, 22 bp, Homo sapiens
ttcattaagttgtaaaatgtca

SEQ ID NO: 2958401 - DNA, 24 bp, Homo sapiens
ttcattcaatcaacctgcacttca

SEQ ID NO: 2958402 - DNA, 16 bp, Homo sapiens
ttcattcatatcctcc

SEQ ID NO: 2958403 - DNA, 11 bp, Homo sapiens
ttcattccaca

SEQ ID NO: 2958404 - DNA, 16 bp, Homo sapiens
ttcattcctaaagaaa

SEQ ID NO: 2958405 - DNA, 23 bp, Homo sapiens
ttcattcgtcttgttgttattga

SEQ ID NO: 2958406 - DNA, 23 bp, Homo sapiens
ttcattctcctcctcctccctcc

SEQ ID NO: 2958407 - DNA, 17 bp, Homo sapiens
ttcattgagagttttgt

SEQ ID NO: 2958408 - DNA, 20 bp, Homo sapiens
ttcattgatttcctgtgtca

SEQ ID NO: 2958409 - DNA, 13 bp, Homo sapiens
ttcattgcaaagt

SEQ ID NO: 2958410 - DNA, 19 bp, Homo sapiens
ttcattggctatataaaat

SEQ ID NO: 2958411 - DNA, 17 bp, Homo sapiens
ttcattggttaattttt

SEQ ID NO: 2958412 - DNA, 14 bp, Homo sapiens
ttcatttaatatat

SEQ ID NO: 2958413 - DNA, 21 bp, Homo sapiens
ttcatttagctaaacggattc

SEQ ID NO: 2958414 - DNA, 14 bp, Homo sapiens
ttcatttcatgtat

SEQ ID NO: 2958415 - DNA, 18 bp, Homo sapiens
ttcatttttccatgacat

SEQ ID NO: 2958416 - DNA, 20 bp, Homo sapiens
ttcatttttccatgacattt

SEQ ID NO: 2958417 - DNA, 17 bp, Homo sapiens
ttcatttttctctccct

SEQ ID NO: 2958418 - DNA, 13 bp, Homo sapiens
ttccaaaaaaata

SEQ ID NO: 2958419 - DNA, 17 bp, Homo sapiens
ttccaaaagtggcctct

SEQ ID NO: 2958420 - DNA, 22 bp, Homo sapiens
ttccaaaagtggcctctttgtc

SEQ ID NO: 2958421 - DNA, 15 bp, Homo sapiens
ttccaaacttttgca

SEQ ID NO: 2958422 - DNA, 20 bp, Homo sapiens
ttccaaagaatgttagagca

SEQ ID NO: 2958423 - DNA, 21 bp, Homo sapiens
ttccaaagagtagaattgcat

SEQ ID NO: 2958424 - DNA, 15 bp, Homo sapiens
ttccaaagcattttc

SEQ ID NO: 2958425 - DNA, 20 bp, Homo sapiens
ttccaaagcattttcagcat

SEQ ID NO: 2958426 - DNA, 14 bp, Homo sapiens
ttccaaagtctcta

SEQ ID NO: 2958427 - DNA, 15 bp, Homo sapiens
ttccaacaaagaaag

SEQ ID NO: 2958428 - DNA, 15 bp, Homo sapiens
ttccaacaaagggtt

SEQ ID NO: 2958429 - DNA, 16 bp, Homo sapiens
ttccaacaaagggttt

SEQ ID NO: 2958430 - DNA, 23 bp, Homo sapiens
ttccaacaaagggttttaatgta

SEQ ID NO: 2958431 - DNA, 14 bp, Homo sapiens
ttccaagagcctga

SEQ ID NO: 2958432 - DNA, 22 bp, Homo sapiens
ttccaagagcctgagagtgagg

SEQ ID NO: 2958433 - DNA, 14 bp, Homo sapiens
ttccaagagtctaa

SEQ ID NO: 2958434 - DNA, 17 bp, Homo sapiens
ttccaagtcatttttgt

SEQ ID NO: 2958435 - DNA, 19 bp, Homo sapiens
ttccaagtctctgtgtaac

SEQ ID NO: 2958436 - DNA, 14 bp, Homo sapiens
ttccaagtgtattt

SEQ ID NO: 2958437 - DNA, 20 bp, Homo sapiens
ttccaagtgtgcatattgta

SEQ ID NO: 2958438 - DNA, 15 bp, Homo sapiens
ttccaatgaaaaaat

SEQ ID NO: 2958439 - DNA, 12 bp, Homo sapiens
ttccaatgtgaa

SEQ ID NO: 2958440 - DNA, 18 bp, Homo sapiens
ttccacaccaagcagcaa

SEQ ID NO: 2958441 - DNA, 22 bp, Homo sapiens
ttccacaccttttattgacaca

SEQ ID NO: 2958442 - DNA, 23 bp, Homo sapiens
ttccacactatgtgtgttgtttc

SEQ ID NO: 2958443 - DNA, 18 bp, Homo sapiens
ttccacagattgtttcta

SEQ ID NO: 2958444 - DNA, 19 bp, Homo sapiens
ttccacagattgtttctat

SEQ ID NO: 2958445 - DNA, 11 bp, Homo sapiens
ttccacaggat

SEQ ID NO: 2958446 - DNA, 14 bp, Homo sapiens
ttccaccagagcag

SEQ ID NO: 2958447 - DNA, 22 bp, Homo sapiens
ttccaccagagcaggggctgct

SEQ ID NO: 2958448 - DNA, 15 bp, Homo sapiens
ttccacctcacaact

SEQ ID NO: 2958449 - DNA, 18 bp, Homo sapiens
ttccacctcacaactcct

SEQ ID NO: 2958450 - DNA, 15 bp, Homo sapiens
ttccactactgctac

SEQ ID NO: 2958451 - DNA, 16 bp, Homo sapiens
ttccactccattgtcg

SEQ ID NO: 2958452 - DNA, 18 bp, Homo sapiens
ttccactcctcctagcca

SEQ ID NO: 2958453 - DNA, 13 bp, Homo sapiens
ttccactgcttct

SEQ ID NO: 2958454 - DNA, 22 bp, Homo sapiens
ttccactttgttggcccttcca

SEQ ID NO: 2958455 - DNA, 22 bp, Homo sapiens
ttccagaaagaaaatgaatttg

SEQ ID NO: 2958456 - DNA, 21 bp, Homo sapiens
ttccagaagtgtgattgggaa

SEQ ID NO: 2958457 - DNA, 11 bp, Homo sapiens
ttccagaatcc

SEQ ID NO: 2958458 - DNA, 14 bp, Homo sapiens
ttccagaatgctgt

SEQ ID NO: 2958459 - DNA, 20 bp, Homo sapiens
ttccagacttccttgagaca

SEQ ID NO: 2958460 - DNA, 18 bp, Homo sapiens
ttccagcaaaatccaaac

SEQ ID NO: 2958461 - DNA, 23 bp, Homo sapiens
ttccagcaaaatccaaactgctg

SEQ ID NO: 2958462 - DNA, 23 bp, Homo sapiens
ttccagcccagacccccagtgta

SEQ ID NO: 2958463 - DNA, 12 bp, Homo sapiens
ttccagcctgcc

SEQ ID NO: 2958464 - DNA, 14 bp, Homo sapiens
ttccagcctgccac

SEQ ID NO: 2958465 - DNA, 13 bp, Homo sapiens
ttccagctacttt

SEQ ID NO: 2958466 - DNA, 21 bp, Homo sapiens
ttccaggagccaccttgccac

SEQ ID NO: 2958467 - DNA, 15 bp, Homo sapiens
ttccagggaggggcc

SEQ ID NO: 2958468 - DNA, 14 bp, Homo sapiens
ttccagtcctaaca

SEQ ID NO: 2958469 - DNA, 11 bp, Homo sapiens
ttccagtctgg

SEQ ID NO: 2958470 - DNA, 13 bp, Homo sapiens
ttccagtgcagag

SEQ ID NO: 2958471 - DNA, 14 bp, Homo sapiens
ttccagtgcagaga

SEQ ID NO: 2958472 - DNA, 15 bp, Homo sapiens
ttccagttccaggac

SEQ ID NO: 2958473 - DNA, 21 bp, Homo sapiens
ttccagtttctgtaaggtctt

SEQ ID NO: 2958474 - DNA, 16 bp, Homo sapiens
ttccatgaaggcagag

SEQ ID NO: 2958475 - DNA, 15 bp, Homo sapiens
ttccatgaatcgctt

SEQ ID NO: 2958476 - DNA, 17 bp, Homo sapiens
ttccatggcaggaaggc

SEQ ID NO: 2958477 - DNA, 19 bp, Homo sapiens
ttccatggcaggaaggctt

SEQ ID NO: 2958478 - DNA, 17 bp, Homo sapiens
ttccatggccctcatta

SEQ ID NO: 2958479 - DNA, 16 bp, Homo sapiens
ttccatggcttcctga

SEQ ID NO: 2958480 - DNA, 12 bp, Homo sapiens
ttccatgggaat

SEQ ID NO: 2958481 - DNA, 21 bp, Homo sapiens
ttccatggtgtgatcgtctga

SEQ ID NO: 2958482 - DNA, 20 bp, Homo sapiens
ttccatgtcccctcccagag

SEQ ID NO: 2958483 - DNA, 20 bp, Homo sapiens
ttccatgtgttttgctttta

SEQ ID NO: 2958484 - DNA, 14 bp, Homo sapiens
ttccattagaatgc

SEQ ID NO: 2958485 - DNA, 15 bp, Homo sapiens
ttccattagaatgct

SEQ ID NO: 2958486 - DNA, 21 bp, Homo sapiens
ttccattagaatgctacaagt

SEQ ID NO: 2958487 - DNA, 17 bp, Homo sapiens
ttccattggtccaagat

SEQ ID NO: 2958488 - DNA, 17 bp, Homo sapiens
ttccatttgcaagggaa

SEQ ID NO: 2958489 - DNA, 16 bp, Homo sapiens
ttcccaaacgcctccc

SEQ ID NO: 2958490 - DNA, 18 bp, Homo sapiens
ttcccaactctagctggg

SEQ ID NO: 2958491 - DNA, 20 bp, Homo sapiens
ttcccaagtaagaggctgga

SEQ ID NO: 2958492 - DNA, 13 bp, Homo sapiens
ttcccacaagcct

SEQ ID NO: 2958493 - DNA, 17 bp, Homo sapiens
ttcccacacctgcctgc

SEQ ID NO: 2958494 - DNA, 15 bp, Homo sapiens
ttcccacatctttcc

SEQ ID NO: 2958495 - DNA, 18 bp, Homo sapiens
ttcccacatctttcctca

SEQ ID NO: 2958496 - DNA, 18 bp, Homo sapiens
ttcccacgacaaaaacaa

SEQ ID NO: 2958497 - DNA, 19 bp, Homo sapiens
ttcccactgcactccagcc

SEQ ID NO: 2958498 - DNA, 20 bp, Homo sapiens
ttcccactgcactccagcct

SEQ ID NO: 2958499 - DNA, 18 bp, Homo sapiens
ttcccactggcctcaagt

SEQ ID NO: 2958500 - DNA, 18 bp, Homo sapiens
ttcccacttcccaccctg

SEQ ID NO: 2958501 - DNA, 18 bp, Homo sapiens
ttcccactttcccacccc

SEQ ID NO: 2958502 - DNA, 20 bp, Homo sapiens
ttcccactttcccaccccac

SEQ ID NO: 2958503 - DNA, 21 bp, Homo sapiens
ttcccagctacacctttctcc

SEQ ID NO: 2958504 - DNA, 14 bp, Homo sapiens
ttcccagctctccc

SEQ ID NO: 2958505 - DNA, 20 bp, Homo sapiens
ttcccagctctccctctggc

SEQ ID NO: 2958506 - DNA, 13 bp, Homo sapiens
ttcccaggaccct

SEQ ID NO: 2958507 - DNA, 22 bp, Homo sapiens
ttcccaggccagggctgggtca

SEQ ID NO: 2958508 - DNA, 12 bp, Homo sapiens
ttcccaggtgct

SEQ ID NO: 2958509 - DNA, 13 bp, Homo sapiens
ttcccatctgtgg

SEQ ID NO: 2958510 - DNA, 18 bp, Homo sapiens
ttcccatttgttgctgct

SEQ ID NO: 2958511 - DNA, 19 bp, Homo sapiens
ttccccaacagtgtgaagt

SEQ ID NO: 2958512 - DNA, 21 bp, Homo sapiens
ttccccaacccctcagatttt

SEQ ID NO: 2958513 - DNA, 16 bp, Homo sapiens
ttccccagacttgcac

SEQ ID NO: 2958514 - DNA, 16 bp, Homo sapiens
ttccccagcaactctg

SEQ ID NO: 2958515 - DNA, 22 bp, Homo sapiens
ttccccagcagggtcttttcat

SEQ ID NO: 2958516 - DNA, 13 bp, Homo sapiens
ttccccagccaca

SEQ ID NO: 2958517 - DNA, 18 bp, Homo sapiens
ttccccagccacaggcca

SEQ ID NO: 2958518 - DNA, 13 bp, Homo sapiens
ttccccagcctct

SEQ ID NO: 2958519 - DNA, 14 bp, Homo sapiens
ttccccagcctctc

SEQ ID NO: 2958520 - DNA, 16 bp, Homo sapiens
ttccccatatttgtgt

SEQ ID NO: 2958521 - DNA, 18 bp, Homo sapiens
ttccccatcttctaaacc

SEQ ID NO: 2958522 - DNA, 18 bp, Homo sapiens
ttccccattcctacccac

SEQ ID NO: 2958523 - DNA, 18 bp, Homo sapiens
ttcccccaccagctaagg

SEQ ID NO: 2958524 - DNA, 15 bp, Homo sapiens
ttcccccactgatca

SEQ ID NO: 2958525 - DNA, 19 bp, Homo sapiens
ttccccgcattccaggctc

SEQ ID NO: 2958526 - DNA, 18 bp, Homo sapiens
ttcccctcctttgtcttt

SEQ ID NO: 2958527 - DNA, 15 bp, Homo sapiens
ttccccttccactga

SEQ ID NO: 2958528 - DNA, 23 bp, Homo sapiens
ttcccgaaccccaaggagggaga

SEQ ID NO: 2958529 - DNA, 14 bp, Homo sapiens
ttcccgagcgctgg

SEQ ID NO: 2958530 - DNA, 23 bp, Homo sapiens
ttccctacctaagaatttcactg

SEQ ID NO: 2958531 - DNA, 22 bp, Homo sapiens
ttccctagaaacttccaaatcc

SEQ ID NO: 2958532 - DNA, 16 bp, Homo sapiens
ttccctagactctgta

SEQ ID NO: 2958533 - DNA, 21 bp, Homo sapiens
ttccctatgaaagattccaca

SEQ ID NO: 2958534 - DNA, 20 bp, Homo sapiens
ttccctcacaccctgcctcg

SEQ ID NO: 2958535 - DNA, 21 bp, Homo sapiens
ttccctcaccttggcaccaga

SEQ ID NO: 2958536 - DNA, 18 bp, Homo sapiens
ttccctcactcttcctca

SEQ ID NO: 2958537 - DNA, 11 bp, Homo sapiens
ttccctcaggc

SEQ ID NO: 2958538 - DNA, 19 bp, Homo sapiens
ttccctgagtcaccaggaa

SEQ ID NO: 2958539 - DNA, 21 bp, Homo sapiens
ttccctgcctccagctgtcag

SEQ ID NO: 2958540 - DNA, 23 bp, Homo sapiens
ttccctggcttgtaactccacca

SEQ ID NO: 2958541 - DNA, 16 bp, Homo sapiens
ttcccttgtaaacaga

SEQ ID NO: 2958542 - DNA, 14 bp, Homo sapiens
ttccctttgcttgt

SEQ ID NO: 2958543 - DNA, 19 bp, Homo sapiens
ttcccttttaatcaactgt

SEQ ID NO: 2958544 - DNA, 19 bp, Homo sapiens
ttcccttttacatactgct

SEQ ID NO: 2958545 - DNA, 15 bp, Homo sapiens
ttccgaagaattcca

SEQ ID NO: 2958546 - DNA, 18 bp, Homo sapiens
ttccgtagccagctgctc

SEQ ID NO: 2958547 - DNA, 16 bp, Homo sapiens
ttccgtattacatttt

SEQ ID NO: 2958548 - DNA, 19 bp, Homo sapiens
ttccgtcaacgttgtactg

SEQ ID NO: 2958549 - DNA, 21 bp, Homo sapiens
ttccgtcaccacgactggcca

SEQ ID NO: 2958550 - DNA, 13 bp, Homo sapiens
ttccgtccccccc

SEQ ID NO: 2958551 - DNA, 16 bp, Homo sapiens
ttccgtccccccccag

SEQ ID NO: 2958552 - DNA, 17 bp, Homo sapiens
ttccgtgaaaacggagc

SEQ ID NO: 2958553 - DNA, 14 bp, Homo sapiens
ttcctaacttttca

SEQ ID NO: 2958554 - DNA, 22 bp, Homo sapiens
ttcctaacttttcaatgacatt

SEQ ID NO: 2958555 - DNA, 20 bp, Homo sapiens
ttcctaagactgctgctgaa

SEQ ID NO: 2958556 - DNA, 19 bp, Homo sapiens
ttcctaataaagttctgta

SEQ ID NO: 2958557 - DNA, 15 bp, Homo sapiens
ttcctaatgcattag

SEQ ID NO: 2958558 - DNA, 13 bp, Homo sapiens
ttcctacaactta

SEQ ID NO: 2958559 - DNA, 20 bp, Homo sapiens
ttcctacaacttaatggaaa

SEQ ID NO: 2958560 - DNA, 14 bp, Homo sapiens
ttcctactcctcat

SEQ ID NO: 2958561 - DNA, 15 bp, Homo sapiens
ttcctagccaccgcc

SEQ ID NO: 2958562 - DNA, 18 bp, Homo sapiens
ttcctagcttatctccct

SEQ ID NO: 2958563 - DNA, 20 bp, Homo sapiens
ttcctagtggtgtcattttt

SEQ ID NO: 2958564 - DNA, 23 bp, Homo sapiens
ttcctagtggtgtcatttttgaa

SEQ ID NO: 2958565 - DNA, 13 bp, Homo sapiens
ttcctagttggtg

SEQ ID NO: 2958566 - DNA, 19 bp, Homo sapiens
ttcctatacgcagcgtgct

SEQ ID NO: 2958567 - DNA, 15 bp, Homo sapiens
ttcctatagtacttt

SEQ ID NO: 2958568 - DNA, 16 bp, Homo sapiens
ttcctatttttaaata

SEQ ID NO: 2958569 - DNA, 17 bp, Homo sapiens
ttcctatttttaaataa

SEQ ID NO: 2958570 - DNA, 17 bp, Homo sapiens
ttcctcaaatgttgaca

SEQ ID NO: 2958571 - DNA, 23 bp, Homo sapiens
ttcctcaagtatcttctattttt

SEQ ID NO: 2958572 - DNA, 23 bp, Homo sapiens
ttcctcacgtgcaggacagctct

SEQ ID NO: 2958573 - DNA, 22 bp, Homo sapiens
ttcctcagcaggttggcttttt

SEQ ID NO: 2958574 - DNA, 14 bp, Homo sapiens
ttcctcatcctgct

SEQ ID NO: 2958575 - DNA, 13 bp, Homo sapiens
ttcctcatctgtg

SEQ ID NO: 2958576 - DNA, 16 bp, Homo sapiens
ttcctcatctgtgcct

SEQ ID NO: 2958577 - DNA, 18 bp, Homo sapiens
ttcctcatctgtgcctgt

SEQ ID NO: 2958578 - DNA, 17 bp, Homo sapiens
ttcctcattaaattacc

SEQ ID NO: 2958579 - DNA, 15 bp, Homo sapiens
ttcctccagaggagg

SEQ ID NO: 2958580 - DNA, 12 bp, Homo sapiens
ttcctccagtct

SEQ ID NO: 2958581 - DNA, 21 bp, Homo sapiens
ttcctccagtctgttctcaca

SEQ ID NO: 2958582 - DNA, 16 bp, Homo sapiens
ttcctcctccccgctc

SEQ ID NO: 2958583 - DNA, 15 bp, Homo sapiens
ttcctcctgggccct

SEQ ID NO: 2958584 - DNA, 21 bp, Homo sapiens
ttcctcctgggccctctctgc

SEQ ID NO: 2958585 - DNA, 15 bp, Homo sapiens
ttcctcctttctctg

SEQ ID NO: 2958586 - DNA, 21 bp, Homo sapiens
ttcctcctttctctgtatatt

SEQ ID NO: 2958587 - DNA, 14 bp, Homo sapiens
ttcctctccacagg

SEQ ID NO: 2958588 - DNA, 17 bp, Homo sapiens
ttcctctccacaggagc

SEQ ID NO: 2958589 - DNA, 19 bp, Homo sapiens
ttcctctccacaggagcct

SEQ ID NO: 2958590 - DNA, 16 bp, Homo sapiens
ttcctctcccttccct

SEQ ID NO: 2958591 - DNA, 23 bp, Homo sapiens
ttcctctcccttcccttccctca

SEQ ID NO: 2958592 - DNA, 13 bp, Homo sapiens
ttcctctctccca

SEQ ID NO: 2958593 - DNA, 15 bp, Homo sapiens
ttcctctctctccct

SEQ ID NO: 2958594 - DNA, 21 bp, Homo sapiens
ttcctctgaatattaagaaac

SEQ ID NO: 2958595 - DNA, 11 bp, Homo sapiens
ttcctctggat

SEQ ID NO: 2958596 - DNA, 19 bp, Homo sapiens
ttcctcttactttcagttt

SEQ ID NO: 2958597 - DNA, 18 bp, Homo sapiens
ttcctgaaataaatgttt

SEQ ID NO: 2958598 - DNA, 19 bp, Homo sapiens
ttcctgaagaaccagtccc

SEQ ID NO: 2958599 - DNA, 14 bp, Homo sapiens
ttcctgaagctgag

SEQ ID NO: 2958600 - DNA, 13 bp, Homo sapiens
ttcctgacaaaag

SEQ ID NO: 2958601 - DNA, 19 bp, Homo sapiens
ttcctgcccagcctggggc

SEQ ID NO: 2958602 - DNA, 11 bp, Homo sapiens
ttcctgctccg

SEQ ID NO: 2958603 - DNA, 12 bp, Homo sapiens
ttcctgctgcct

SEQ ID NO: 2958604 - DNA, 14 bp, Homo sapiens
ttcctgctgcctgg

SEQ ID NO: 2958605 - DNA, 16 bp, Homo sapiens
ttcctgctgtcctggt

SEQ ID NO: 2958606 - DNA, 21 bp, Homo sapiens
ttcctgctgtcctggtggctg

SEQ ID NO: 2958607 - DNA, 11 bp, Homo sapiens
ttcctgctttc

SEQ ID NO: 2958608 - DNA, 15 bp, Homo sapiens
ttcctgctttctctt

SEQ ID NO: 2958609 - DNA, 17 bp, Homo sapiens
ttcctgctttctctttc

SEQ ID NO: 2958610 - DNA, 18 bp, Homo sapiens
ttcctgctttctctttca

SEQ ID NO: 2958611 - DNA, 13 bp, Homo sapiens
ttcctggatgtct

SEQ ID NO: 2958612 - DNA, 13 bp, Homo sapiens
ttcctggcccagg

SEQ ID NO: 2958613 - DNA, 14 bp, Homo sapiens
ttcctgggccttct

SEQ ID NO: 2958614 - DNA, 16 bp, Homo sapiens
ttcctgggccttctca

SEQ ID NO: 2958615 - DNA, 21 bp, Homo sapiens
ttcctgtaaaaaaaaaaaagt

SEQ ID NO: 2958616 - DNA, 22 bp, Homo sapiens
ttcctgtagccttctgtaggaa

SEQ ID NO: 2958617 - DNA, 16 bp, Homo sapiens
ttcctgtatgttgtcc

SEQ ID NO: 2958618 - DNA, 15 bp, Homo sapiens
ttcctgtccagctcc

SEQ ID NO: 2958619 - DNA, 13 bp, Homo sapiens
ttcctgtctattt

SEQ ID NO: 2958620 - DNA, 18 bp, Homo sapiens
ttcctgtctcaatagctc

SEQ ID NO: 2958621 - DNA, 20 bp, Homo sapiens
ttcctgtctcaatagctcca

SEQ ID NO: 2958622 - DNA, 22 bp, Homo sapiens
ttcctgtgcccatcatctctgc

SEQ ID NO: 2958623 - DNA, 18 bp, Homo sapiens
ttcctgtgtgaagaaagc

SEQ ID NO: 2958624 - DNA, 21 bp, Homo sapiens
ttcctgtgtgtccaaaactgc

SEQ ID NO: 2958625 - DNA, 17 bp, Homo sapiens
ttcctgttacctgtctt

SEQ ID NO: 2958626 - DNA, 14 bp, Homo sapiens
ttcctgttcagtaa

SEQ ID NO: 2958627 - DNA, 19 bp, Homo sapiens
ttcctgttcagtaataaaa

SEQ ID NO: 2958628 - DNA, 19 bp, Homo sapiens
ttcctgttggatttgttta

SEQ ID NO: 2958629 - DNA, 14 bp, Homo sapiens
ttcctgtttgtaca

SEQ ID NO: 2958630 - DNA, 15 bp, Homo sapiens
ttcctgttttaagca

SEQ ID NO: 2958631 - DNA, 19 bp, Homo sapiens
ttccttaagtcagaacagc

SEQ ID NO: 2958632 - DNA, 23 bp, Homo sapiens
ttccttcaccacctcatgtcatt

SEQ ID NO: 2958633 - DNA, 15 bp, Homo sapiens
ttccttcagcttcca

SEQ ID NO: 2958634 - DNA, 14 bp, Homo sapiens
ttccttccctggct

SEQ ID NO: 2958635 - DNA, 15 bp, Homo sapiens
ttccttcctctgtaa

SEQ ID NO: 2958636 - DNA, 15 bp, Homo sapiens
ttccttctgtgaaga

SEQ ID NO: 2958637 - DNA, 12 bp, Homo sapiens
ttccttgccagt

SEQ ID NO: 2958638 - DNA, 11 bp, Homo sapiens
ttccttgcctg

SEQ ID NO: 2958639 - DNA, 13 bp, Homo sapiens
ttccttgggcaga

SEQ ID NO: 2958640 - DNA, 15 bp, Homo sapiens
ttccttggggcaggc

SEQ ID NO: 2958641 - DNA, 22 bp, Homo sapiens
ttcctttaaatactcccttttt

SEQ ID NO: 2958642 - DNA, 15 bp, Homo sapiens
ttcctttatactgtg

SEQ ID NO: 2958643 - DNA, 18 bp, Homo sapiens
ttcctttatactgtgaag

SEQ ID NO: 2958644 - DNA, 16 bp, Homo sapiens
ttcctttatgttctca

SEQ ID NO: 2958645 - DNA, 22 bp, Homo sapiens
ttcctttcagccctgtctactg

SEQ ID NO: 2958646 - DNA, 23 bp, Homo sapiens
ttcctttccaacgtttggaagat

SEQ ID NO: 2958647 - DNA, 18 bp, Homo sapiens
ttcctttgtgtttctatt

SEQ ID NO: 2958648 - DNA, 16 bp, Homo sapiens
ttccttttattcacat

SEQ ID NO: 2958649 - DNA, 18 bp, Homo sapiens
ttcctttttaaatgtgaa

SEQ ID NO: 2958650 - DNA, 20 bp, Homo sapiens
ttcctttttttaaattttct

SEQ ID NO: 2958651 - DNA, 13 bp, Homo sapiens
ttcgaacatgttt

SEQ ID NO: 2958652 - DNA, 19 bp, Homo sapiens
ttcgaactgtgctcccacg

SEQ ID NO: 2958653 - DNA, 14 bp, Homo sapiens
ttcgaagtcattaa

SEQ ID NO: 2958654 - DNA, 15 bp, Homo sapiens
ttcgaagttcatttt

SEQ ID NO: 2958655 - DNA, 15 bp, Homo sapiens
ttcgaatgacactgt

SEQ ID NO: 2958656 - DNA, 14 bp, Homo sapiens
ttcgacatgctgcc

SEQ ID NO: 2958657 - DNA, 17 bp, Homo sapiens
ttcgacatgctgccagg

SEQ ID NO: 2958658 - DNA, 14 bp, Homo sapiens
ttcgagaccagcct

SEQ ID NO: 2958659 - DNA, 19 bp, Homo sapiens
ttcgagaccagcctggcca

SEQ ID NO: 2958660 - DNA, 23 bp, Homo sapiens
ttcgatggtacgtgaccctctgc

SEQ ID NO: 2958661 - DNA, 23 bp, Homo sapiens
ttcgatgtacagtctcaattttg

SEQ ID NO: 2958662 - DNA, 14 bp, Homo sapiens
ttcgcatcaaaaga

SEQ ID NO: 2958663 - DNA, 19 bp, Homo sapiens
ttcgcatcaaaagacaatt

SEQ ID NO: 2958664 - DNA, 21 bp, Homo sapiens
ttcgcatcaaaagacaattct

SEQ ID NO: 2958665 - DNA, 22 bp, Homo sapiens
ttcgcatcaaaagacaattctt

SEQ ID NO: 2958666 - DNA, 16 bp, Homo sapiens
ttcgcatggtcacaca

SEQ ID NO: 2958667 - DNA, 21 bp, Homo sapiens
ttcgcatgtttaatgtgaact

SEQ ID NO: 2958668 - DNA, 22 bp, Homo sapiens
ttcgccgtctggcgagccctta

SEQ ID NO: 2958669 - DNA, 14 bp, Homo sapiens
ttcgcctggagccc

SEQ ID NO: 2958670 - DNA, 15 bp, Homo sapiens
ttcgcctggagccct

SEQ ID NO: 2958671 - DNA, 15 bp, Homo sapiens
ttcgctgtcccctca

SEQ ID NO: 2958672 - DNA, 18 bp, Homo sapiens
ttcgctgtcccctcagcg

SEQ ID NO: 2958673 - DNA, 14 bp, Homo sapiens
ttcggaaacactga

SEQ ID NO: 2958674 - DNA, 15 bp, Homo sapiens
ttcggagaaattctc

SEQ ID NO: 2958675 - DNA, 13 bp, Homo sapiens
ttcggagctcttc

SEQ ID NO: 2958676 - DNA, 22 bp, Homo sapiens
ttcggctgcttttatgtagttt

SEQ ID NO: 2958677 - DNA, 14 bp, Homo sapiens
ttcgggctggccat

SEQ ID NO: 2958678 - DNA, 13 bp, Homo sapiens
ttcgggctgtgcc

SEQ ID NO: 2958679 - DNA, 14 bp, Homo sapiens
ttcgggctgtgccc

SEQ ID NO: 2958680 - DNA, 18 bp, Homo sapiens
ttcggtgagctacaaatg

SEQ ID NO: 2958681 - DNA, 18 bp, Homo sapiens
ttcggttgagaatggaaa

SEQ ID NO: 2958682 - DNA, 20 bp, Homo sapiens
ttcggtttttttcctgtttc

SEQ ID NO: 2958683 - DNA, 16 bp, Homo sapiens
ttcgtaatagctcaga

SEQ ID NO: 2958684 - DNA, 15 bp, Homo sapiens
ttcgtagatattgga

SEQ ID NO: 2958685 - DNA, 23 bp, Homo sapiens
ttcgtgagccccatcttcaccca

SEQ ID NO: 2958686 - DNA, 20 bp, Homo sapiens
ttcgtgcggaatcagcttct

SEQ ID NO: 2958687 - DNA, 16 bp, Homo sapiens
ttcgttcaaaagtgga

SEQ ID NO: 2958688 - DNA, 12 bp, Homo sapiens
ttcgttctgtgg

SEQ ID NO: 2958689 - DNA, 20 bp, Homo sapiens
ttcgttggtgaccagtttct

SEQ ID NO: 2958690 - DNA, 22 bp, Homo sapiens
ttcgttggtgaccagtttctta

SEQ ID NO: 2958691 - DNA, 20 bp, Homo sapiens
ttcgttggttgtttctctga

SEQ ID NO: 2958692 - DNA, 14 bp, Homo sapiens
ttcgtttctgtata

SEQ ID NO: 2958693 - DNA, 22 bp, Homo sapiens
ttcgtttggtcttaggtcttcc

SEQ ID NO: 2958694 - DNA, 17 bp, Homo sapiens
ttcgttttttacctgtt

SEQ ID NO: 2958695 - DNA, 21 bp, Homo sapiens
ttctaaaatcttatagttcta

SEQ ID NO: 2958696 - DNA, 19 bp, Homo sapiens
ttctaaaatgtgatgttct

SEQ ID NO: 2958697 - DNA, 18 bp, Homo sapiens
ttctaaacccaatccaaa

SEQ ID NO: 2958698 - DNA, 15 bp, Homo sapiens
ttctaaagatggaaa

SEQ ID NO: 2958699 - DNA, 12 bp, Homo sapiens
ttctaaagattc

SEQ ID NO: 2958700 - DNA, 17 bp, Homo sapiens
ttctaaagctctgacat

SEQ ID NO: 2958701 - DNA, 14 bp, Homo sapiens
ttctaaaggagcag

SEQ ID NO: 2958702 - DNA, 13 bp, Homo sapiens
ttctaaaggtcca

SEQ ID NO: 2958703 - DNA, 16 bp, Homo sapiens
ttctaaaggtccacag

SEQ ID NO: 2958704 - DNA, 20 bp, Homo sapiens
ttctaaaggtgttgtccctt

SEQ ID NO: 2958705 - DNA, 16 bp, Homo sapiens
ttctaaagttctaaga

SEQ ID NO: 2958706 - DNA, 18 bp, Homo sapiens
ttctaaagttctaagatt

SEQ ID NO: 2958707 - DNA, 18 bp, Homo sapiens
ttctaaatgttattactt

SEQ ID NO: 2958708 - DNA, 22 bp, Homo sapiens
ttctaaccaaagagtctctggc

SEQ ID NO: 2958709 - DNA, 23 bp, Homo sapiens
ttctaacttatttataaaaagat

SEQ ID NO: 2958710 - DNA, 12 bp, Homo sapiens
ttctaagactca

SEQ ID NO: 2958711 - DNA, 16 bp, Homo sapiens
ttctaagactcaaatg

SEQ ID NO: 2958712 - DNA, 22 bp, Homo sapiens
ttctaagactcaaatgttctaa

SEQ ID NO: 2958713 - DNA, 21 bp, Homo sapiens
ttctaagacttactctaagat

SEQ ID NO: 2958714 - DNA, 19 bp, Homo sapiens
ttctaagatgtgatattct

SEQ ID NO: 2958715 - DNA, 22 bp, Homo sapiens
ttctaagatgtgatattctaag

SEQ ID NO: 2958716 - DNA, 16 bp, Homo sapiens
ttctaagattctaaag

SEQ ID NO: 2958717 - DNA, 16 bp, Homo sapiens
ttctaagattctaatg

SEQ ID NO: 2958718 - DNA, 13 bp, Homo sapiens
ttctaaggaagac

SEQ ID NO: 2958719 - DNA, 21 bp, Homo sapiens
ttctaaggacctgaaattcca

SEQ ID NO: 2958720 - DNA, 23 bp, Homo sapiens
ttctaaggacctgaaattccaaa

SEQ ID NO: 2958721 - DNA, 21 bp, Homo sapiens
ttctaaggactttttcttagg

SEQ ID NO: 2958722 - DNA, 20 bp, Homo sapiens
ttctaaggccctttttccta

SEQ ID NO: 2958723 - DNA, 19 bp, Homo sapiens
ttctaaggcctaggattct

SEQ ID NO: 2958724 - DNA, 12 bp, Homo sapiens
ttctaaggctct

SEQ ID NO: 2958725 - DNA, 16 bp, Homo sapiens
ttctaaggctctgaga

SEQ ID NO: 2958726 - DNA, 17 bp, Homo sapiens
ttctaaggctctgagag

SEQ ID NO: 2958727 - DNA, 17 bp, Homo sapiens
ttctaagtggcgtgtgc

SEQ ID NO: 2958728 - DNA, 16 bp, Homo sapiens
ttctaagtttctaaga

SEQ ID NO: 2958729 - DNA, 18 bp, Homo sapiens
ttctaagtttctaagatt

SEQ ID NO: 2958730 - DNA, 19 bp, Homo sapiens
ttctaataaatcaatgtga

SEQ ID NO: 2958731 - DNA, 22 bp, Homo sapiens
ttctaatatccaacacaactat

SEQ ID NO: 2958732 - DNA, 16 bp, Homo sapiens
ttctaatcttaaatca

SEQ ID NO: 2958733 - DNA, 21 bp, Homo sapiens
ttctaatcttaaatcagaata

SEQ ID NO: 2958734 - DNA, 23 bp, Homo sapiens
ttctaatcttaaatcagaataaa

SEQ ID NO: 2958735 - DNA, 21 bp, Homo sapiens
ttctaatgaggagagaaaata

SEQ ID NO: 2958736 - DNA, 23 bp, Homo sapiens
ttctaatgaggagagaaaatata

SEQ ID NO: 2958737 - DNA, 13 bp, Homo sapiens
ttctaattttgtg

SEQ ID NO: 2958738 - DNA, 12 bp, Homo sapiens
ttctacacctgg

SEQ ID NO: 2958739 - DNA, 19 bp, Homo sapiens
ttctaccaaccccagataa

SEQ ID NO: 2958740 - DNA, 17 bp, Homo sapiens
ttctaccaggcaaattc

SEQ ID NO: 2958741 - DNA, 22 bp, Homo sapiens
ttctaccatgaacagaaaacat

SEQ ID NO: 2958742 - DNA, 19 bp, Homo sapiens
ttctactaagttattttat

SEQ ID NO: 2958743 - DNA, 24 bp, Homo sapiens
ttctactcttaatgatgttatctt

SEQ ID NO: 2958744 - DNA, 16 bp, Homo sapiens
ttctacttgatatttc

SEQ ID NO: 2958745 - DNA, 21 bp, Homo sapiens
ttctacttgcttattacattt

SEQ ID NO: 2958746 - DNA, 16 bp, Homo sapiens
ttctactttgtttatt

SEQ ID NO: 2958747 - DNA, 13 bp, Homo sapiens
ttctacttttaaa

SEQ ID NO: 2958748 - DNA, 16 bp, Homo sapiens
ttctacttttaaataa

SEQ ID NO: 2958749 - DNA, 23 bp, Homo sapiens
ttctagacatggaggttctaagg

SEQ ID NO: 2958750 - DNA, 16 bp, Homo sapiens
ttctagatcagatgct

SEQ ID NO: 2958751 - DNA, 24 bp, Homo sapiens
ttctagatcagatgctccaagatt

SEQ ID NO: 2958752 - DNA, 14 bp, Homo sapiens
ttctagctgtatga

SEQ ID NO: 2958753 - DNA, 22 bp, Homo sapiens
ttctagcttttttcctcctttc

SEQ ID NO: 2958754 - DNA, 19 bp, Homo sapiens
ttctaggaagaattttaaa

SEQ ID NO: 2958755 - DNA, 15 bp, Homo sapiens
ttctagggaaatgaa

SEQ ID NO: 2958756 - DNA, 16 bp, Homo sapiens
ttctagggctgggaaa

SEQ ID NO: 2958757 - DNA, 23 bp, Homo sapiens
ttctagggctgggaaacactcct

SEQ ID NO: 2958758 - DNA, 13 bp, Homo sapiens
ttctaggtttcaa

SEQ ID NO: 2958759 - DNA, 21 bp, Homo sapiens
ttctaggtttcaaagatgctg

SEQ ID NO: 2958760 - DNA, 22 bp, Homo sapiens
ttctagtacataattgattaaa

SEQ ID NO: 2958761 - DNA, 23 bp, Homo sapiens
ttctagtacataattgattaaaa

SEQ ID NO: 2958762 - DNA, 19 bp, Homo sapiens
ttctagttaactttttcca

SEQ ID NO: 2958763 - DNA, 15 bp, Homo sapiens
ttctagttctgccag

SEQ ID NO: 2958764 - DNA, 16 bp, Homo sapiens
ttctagttctgccagg

SEQ ID NO: 2958765 - DNA, 14 bp, Homo sapiens
ttctagtttcctgc

SEQ ID NO: 2958766 - DNA, 13 bp, Homo sapiens
ttctagtttgttt

SEQ ID NO: 2958767 - DNA, 23 bp, Homo sapiens
ttctataaggccataaaacaggt

SEQ ID NO: 2958768 - DNA, 21 bp, Homo sapiens
ttctataagttttatgttaaa

SEQ ID NO: 2958769 - DNA, 14 bp, Homo sapiens
ttctatactgttga

SEQ ID NO: 2958770 - DNA, 16 bp, Homo sapiens
ttctatagttattaag

SEQ ID NO: 2958771 - DNA, 14 bp, Homo sapiens
ttctatagttctag

SEQ ID NO: 2958772 - DNA, 16 bp, Homo sapiens
ttctatagttctagac

SEQ ID NO: 2958773 - DNA, 15 bp, Homo sapiens
ttctatattttaata

SEQ ID NO: 2958774 - DNA, 15 bp, Homo sapiens
ttctatcctctgtaa

SEQ ID NO: 2958775 - DNA, 19 bp, Homo sapiens
ttctatgagtggaaaaagc

SEQ ID NO: 2958776 - DNA, 14 bp, Homo sapiens
ttctatgcagtggc

SEQ ID NO: 2958777 - DNA, 20 bp, Homo sapiens
ttctatgccatttttagttt

SEQ ID NO: 2958778 - DNA, 23 bp, Homo sapiens
ttctatgctgcttttatatctgt

SEQ ID NO: 2958779 - DNA, 13 bp, Homo sapiens
ttctatgtatgtg

SEQ ID NO: 2958780 - DNA, 22 bp, Homo sapiens
ttctatgtatgtgccaattttg

SEQ ID NO: 2958781 - DNA, 20 bp, Homo sapiens
ttctattacccctcatttaa

SEQ ID NO: 2958782 - DNA, 23 bp, Homo sapiens
ttctattagtcacctaaccctct

SEQ ID NO: 2958783 - DNA, 18 bp, Homo sapiens
ttctatttatatgtacat

SEQ ID NO: 2958784 - DNA, 19 bp, Homo sapiens
ttctatttatatgtacatg

SEQ ID NO: 2958785 - DNA, 17 bp, Homo sapiens
ttctatttattatgctt

SEQ ID NO: 2958786 - DNA, 13 bp, Homo sapiens
ttctatttgtctt

SEQ ID NO: 2958787 - DNA, 14 bp, Homo sapiens
ttctatttgtcttc

SEQ ID NO: 2958788 - DNA, 20 bp, Homo sapiens
ttctattttgcaaacactgt

SEQ ID NO: 2958789 - DNA, 14 bp, Homo sapiens
ttctatttttatca

SEQ ID NO: 2958790 - DNA, 18 bp, Homo sapiens
ttctcaaagatctgaatt

SEQ ID NO: 2958791 - DNA, 19 bp, Homo sapiens
ttctcaaagatctgaatta

SEQ ID NO: 2958792 - DNA, 19 bp, Homo sapiens
ttctcaaagttttattata

SEQ ID NO: 2958793 - DNA, 23 bp, Homo sapiens
ttctcaagctggtggcctctgca

SEQ ID NO: 2958794 - DNA, 14 bp, Homo sapiens
ttctcaagttctaa

SEQ ID NO: 2958795 - DNA, 16 bp, Homo sapiens
ttctcaagttctaaga

SEQ ID NO: 2958796 - DNA, 23 bp, Homo sapiens
ttctcaagttctaagattctaat

SEQ ID NO: 2958797 - DNA, 12 bp, Homo sapiens
ttctcaccagct

SEQ ID NO: 2958798 - DNA, 14 bp, Homo sapiens
ttctcaccagctgc

SEQ ID NO: 2958799 - DNA, 15 bp, Homo sapiens
ttctcaccagctgca

SEQ ID NO: 2958800 - DNA, 17 bp, Homo sapiens
ttctcaccagctgcaaa

SEQ ID NO: 2958801 - DNA, 21 bp, Homo sapiens
ttctcaccagctgcaaagtgt

SEQ ID NO: 2958802 - DNA, 17 bp, Homo sapiens
ttctcactatgtttctc

SEQ ID NO: 2958803 - DNA, 18 bp, Homo sapiens
ttctcactatgtttctca

SEQ ID NO: 2958804 - DNA, 14 bp, Homo sapiens
ttctcactccacca

SEQ ID NO: 2958805 - DNA, 16 bp, Homo sapiens
ttctcactccaccacc

SEQ ID NO: 2958806 - DNA, 15 bp, Homo sapiens
ttctcagatccttgt

SEQ ID NO: 2958807 - DNA, 21 bp, Homo sapiens
ttctcagatggattgataatt

SEQ ID NO: 2958808 - DNA, 21 bp, Homo sapiens
ttctcagtccagcagtttcca

SEQ ID NO: 2958809 - DNA, 19 bp, Homo sapiens
ttctcagtgccaactgtgg

SEQ ID NO: 2958810 - DNA, 12 bp, Homo sapiens
ttctcagtgccg

SEQ ID NO: 2958811 - DNA, 15 bp, Homo sapiens
ttctcatcacacaca

SEQ ID NO: 2958812 - DNA, 13 bp, Homo sapiens
ttctcattgctgc

SEQ ID NO: 2958813 - DNA, 19 bp, Homo sapiens
ttctcatttgtttttctca

SEQ ID NO: 2958814 - DNA, 17 bp, Homo sapiens
ttctccacaacactgtg

SEQ ID NO: 2958815 - DNA, 22 bp, Homo sapiens
ttctccacagcaaccccaggct

SEQ ID NO: 2958816 - DNA, 14 bp, Homo sapiens
ttctccattgtaaa

SEQ ID NO: 2958817 - DNA, 19 bp, Homo sapiens
ttctgcgtccaccaggcct

SEQ ID NO: 2958818 - DNA, 19 bp, Homo sapiens
ttctgctagagcagacagg

SEQ ID NO: 2958819 - DNA, 14 bp, Homo sapiens
ttctgctcagctct

SEQ ID NO: 2958820 - DNA, 15 bp, Homo sapiens
ttctgctcagctctg

SEQ ID NO: 2958821 - DNA, 19 bp, Homo sapiens
ttctgctgttgactcttcc

SEQ ID NO: 2958822 - DNA, 19 bp, Homo sapiens
ttctgctttaaattaaaat

SEQ ID NO: 2958823 - DNA, 14 bp, Homo sapiens
ttctgctttctccc

SEQ ID NO: 2958824 - DNA, 22 bp, Homo sapiens
ttctgctttctccccaatgaga

SEQ ID NO: 2958825 - DNA, 19 bp, Homo sapiens
ttctgcttttgaaatctgt

SEQ ID NO: 2958826 - DNA, 20 bp, Homo sapiens
ttctggaatttacctcccct

SEQ ID NO: 2958827 - DNA, 21 bp, Homo sapiens
ttctggattccccatctcagg

SEQ ID NO: 2958828 - DNA, 15 bp, Homo sapiens
ttctggccaggaagc

SEQ ID NO: 2958829 - DNA, 20 bp, Homo sapiens
ttctggctgtagataaataa

SEQ ID NO: 2958830 - DNA, 14 bp, Homo sapiens
ttctggctttgttc

SEQ ID NO: 2958831 - DNA, 16 bp, Homo sapiens
ttctggctttgttctt

SEQ ID NO: 2958832 - DNA, 14 bp, Homo sapiens
ttctgggagggcag

SEQ ID NO: 2958833 - DNA, 21 bp, Homo sapiens
ttctgggagggcagcagggct

SEQ ID NO: 2958834 - DNA, 11 bp, Homo sapiens
ttctgggcaga

SEQ ID NO: 2958835 - DNA, 13 bp, Homo sapiens
ttctgggcagagc

SEQ ID NO: 2958836 - DNA, 16 bp, Homo sapiens
ttctgggcagagcctg

SEQ ID NO: 2958837 - DNA, 17 bp, Homo sapiens
ttctgggcagagcctgt

SEQ ID NO: 2958838 - DNA, 20 bp, Homo sapiens
ttctgggcagagcctgtccc

SEQ ID NO: 2958839 - DNA, 18 bp, Homo sapiens
ttctgggccagtgagcca

SEQ ID NO: 2958840 - DNA, 22 bp, Homo sapiens
ttctggggaaagacactgcctg

SEQ ID NO: 2958841 - DNA, 23 bp, Homo sapiens
ttctggggaaagacactgcctgg

SEQ ID NO: 2958842 - DNA, 19 bp, Homo sapiens
ttctggggggacccagtgc

SEQ ID NO: 2958843 - DNA, 14 bp, Homo sapiens
ttctggggtcccca

SEQ ID NO: 2958844 - DNA, 15 bp, Homo sapiens
ttctggggtccccag

SEQ ID NO: 2958845 - DNA, 16 bp, Homo sapiens
ttctgggtgatttcta

SEQ ID NO: 2958846 - DNA, 13 bp, Homo sapiens
ttctggtcctgtt

SEQ ID NO: 2958847 - DNA, 14 bp, Homo sapiens
ttctggtgtctgct

SEQ ID NO: 2958848 - DNA, 14 bp, Homo sapiens
ttctggttctaaca

SEQ ID NO: 2958849 - DNA, 18 bp, Homo sapiens
ttctgtaaacagaataaa

SEQ ID NO: 2958850 - DNA, 13 bp, Homo sapiens
ttctgtaaatgaa

SEQ ID NO: 2958851 - DNA, 18 bp, Homo sapiens
ttctgtactcaaatgtag

SEQ ID NO: 2958852 - DNA, 15 bp, Homo sapiens
ttctgtactgttact

SEQ ID NO: 2958853 - DNA, 21 bp, Homo sapiens
ttctgtactgttactgggccc

SEQ ID NO: 2958854 - DNA, 14 bp, Homo sapiens
ttctgtagctttct

SEQ ID NO: 2958855 - DNA, 24 bp, Homo sapiens
ttctgtatacaaccctggcattat

SEQ ID NO: 2958856 - DNA, 19 bp, Homo sapiens
ttctgtatataaatgggaa

SEQ ID NO: 2958857 - DNA, 15 bp, Homo sapiens
ttctgtattttcaaa

SEQ ID NO: 2958858 - DNA, 16 bp, Homo sapiens
ttctgtcactcaggct

SEQ ID NO: 2958859 - DNA, 16 bp, Homo sapiens
ttctgtcatttacaca

SEQ ID NO: 2958860 - DNA, 13 bp, Homo sapiens
ttctttgccagag

SEQ ID NO: 2958861 - DNA, 15 bp, Homo sapiens
ttctttgctgtaaga

SEQ ID NO: 2958862 - DNA, 16 bp, Homo sapiens
ttctttgctgtaagat

SEQ ID NO: 2958863 - DNA, 18 bp, Homo sapiens
ttctttggacttctgaag

SEQ ID NO: 2958864 - DNA, 13 bp, Homo sapiens
ttctttggctcta

SEQ ID NO: 2958865 - DNA, 23 bp, Homo sapiens
ttctttgtggtctttttcctgaa

SEQ ID NO: 2958866 - DNA, 13 bp, Homo sapiens
ttctttgttcctg

SEQ ID NO: 2958867 - DNA, 14 bp, Homo sapiens
ttctttgttcctgc

SEQ ID NO: 2958868 - DNA, 15 bp, Homo sapiens
ttctttgttcctgct

SEQ ID NO: 2958869 - DNA, 12 bp, Homo sapiens
ttcttttcacat

SEQ ID NO: 2958870 - DNA, 15 bp, Homo sapiens
ttcttttgaattgtt

SEQ ID NO: 2958871 - DNA, 14 bp, Homo sapiens
ttcttttgcaattg

SEQ ID NO: 2958872 - DNA, 23 bp, Homo sapiens
ttcttttggtaaagactggcttt

SEQ ID NO: 2958873 - DNA, 18 bp, Homo sapiens
ttcttttttgtacagtat

SEQ ID NO: 2958874 - DNA, 12 bp, Homo sapiens
ttgaaaaaaata

SEQ ID NO: 2958875 - DNA, 14 bp, Homo sapiens
ttgaaaacacttat

SEQ ID NO: 2958876 - DNA, 17 bp, Homo sapiens
ttgaaaaccatatttta

SEQ ID NO: 2958877 - DNA, 14 bp, Homo sapiens
ttgaaaacccctgg

SEQ ID NO: 2958878 - DNA, 16 bp, Homo sapiens
ttgaaaacccctggct

SEQ ID NO: 2958879 - DNA, 17 bp, Homo sapiens
ttgaaaacttttctcag

SEQ ID NO: 2958880 - DNA, 18 bp, Homo sapiens
ttgaaaagattctgaaac

SEQ ID NO: 2958881 - DNA, 13 bp, Homo sapiens
ttgaaaagtgttc

SEQ ID NO: 2958882 - DNA, 15 bp, Homo sapiens
ttgaaacaatactca

SEQ ID NO: 2958883 - DNA, 19 bp, Homo sapiens
ttgaaacacttttttgggg

SEQ ID NO: 2958884 - DNA, 18 bp, Homo sapiens
ttgaaactagaaatctgt

SEQ ID NO: 2958885 - DNA, 23 bp, Homo sapiens
ttgaaactagaaatctgtcctgt

SEQ ID NO: 2958886 - DNA, 16 bp, Homo sapiens
ttgaaagaattatcct

SEQ ID NO: 2958887 - DNA, 20 bp, Homo sapiens
ttgaaagattttattgtata

SEQ ID NO: 2958888 - DNA, 22 bp, Homo sapiens
ttgaaagattttattgtataaa

SEQ ID NO: 2958889 - DNA, 13 bp, Homo sapiens
ttgaaagcaaaaa

SEQ ID NO: 2958890 - DNA, 14 bp, Homo sapiens
ttgaaagcaaaaat

SEQ ID NO: 2958891 - DNA, 19 bp, Homo sapiens
ttgaaaggcattctctgaa

SEQ ID NO: 2958892 - DNA, 17 bp, Homo sapiens
ttgaaagggcaatatga

SEQ ID NO: 2958893 - DNA, 16 bp, Homo sapiens
ttgaaataactggaac

SEQ ID NO: 2958894 - DNA, 17 bp, Homo sapiens
ttgagatactattttca

SEQ ID NO: 2958895 - DNA, 23 bp, Homo sapiens
ttgagatggagtttctctcttgt

SEQ ID NO: 2958896 - DNA, 14 bp, Homo sapiens
ttgagcaactaact

SEQ ID NO: 2958897 - DNA, 21 bp, Homo sapiens
ttgagcacaaaacctgtccta

SEQ ID NO: 2958898 - DNA, 15 bp, Homo sapiens
ttgagccctccccag

SEQ ID NO: 2958899 - DNA, 18 bp, Homo sapiens
ttgagctctctcattgtc

SEQ ID NO: 2958900 - DNA, 18 bp, Homo sapiens
ttgaggataaaaaggaag

SEQ ID NO: 2958901 - DNA, 21 bp, Homo sapiens
ttgaggataaaaaggaaggag

SEQ ID NO: 2958902 - DNA, 20 bp, Homo sapiens
ttgaggggcctgtgtggagg

SEQ ID NO: 2958903 - DNA, 16 bp, Homo sapiens
ttgagtaattttctga

SEQ ID NO: 2958904 - DNA, 22 bp, Homo sapiens
ttgagtcattatccttgctatg

SEQ ID NO: 2958905 - DNA, 13 bp, Homo sapiens
ttgagtctcaagg

SEQ ID NO: 2958906 - DNA, 23 bp, Homo sapiens
ttgagtgttcctttttaaatgtg

SEQ ID NO: 2958907 - DNA, 16 bp, Homo sapiens
ttgagttcaggtagct

SEQ ID NO: 2958908 - DNA, 16 bp, Homo sapiens
ttgagtttcagctgga

SEQ ID NO: 2958909 - DNA, 18 bp, Homo sapiens
ttgagtttcagctggaaa

SEQ ID NO: 2958910 - DNA, 19 bp, Homo sapiens
ttgagtttcagctggaaac

SEQ ID NO: 2958911 - DNA, 21 bp, Homo sapiens
ttgagtttgctgttttaaatt

SEQ ID NO: 2958912 - DNA, 19 bp, Homo sapiens
ttgagtttggtccctaaat

SEQ ID NO: 2958913 - DNA, 21 bp, Homo sapiens
ttgagttttgttttaaaatta

SEQ ID NO: 2958914 - DNA, 23 bp, Homo sapiens
ttgataaaatgttccttttgaca

SEQ ID NO: 2958915 - DNA, 13 bp, Homo sapiens
ttgataaagtttc

SEQ ID NO: 2958916 - DNA, 14 bp, Homo sapiens
ttgataactttgct

SEQ ID NO: 2958917 - DNA, 21 bp, Homo sapiens
ttgataattcttattttgtgg

SEQ ID NO: 2958918 - DNA, 21 bp, Homo sapiens
ttgtaaaaacagcattgcttt

SEQ ID NO: 2958919 - DNA, 23 bp, Homo sapiens
ttgtaaaaacagcattgctttct

SEQ ID NO: 2958920 - DNA, 16 bp, Homo sapiens
ttgtaaaggaatttaa

SEQ ID NO: 2958921 - DNA, 15 bp, Homo sapiens
ttgtaaataaatttt

SEQ ID NO: 2958922 - DNA, 14 bp, Homo sapiens
ttgtaaatacacat

SEQ ID NO: 2958923 - DNA, 14 bp, Homo sapiens
ttgtaaatattgtg

SEQ ID NO: 2958924 - DNA, 16 bp, Homo sapiens
ttgtaaatgctattat

SEQ ID NO: 2958925 - DNA, 20 bp, Homo sapiens
ttgtaaatgctattatactg

SEQ ID NO: 2958926 - DNA, 21 bp, Homo sapiens
ttgtaaatgctattatactgt

SEQ ID NO: 2958927 - DNA, 15 bp, Homo sapiens
ttgtaaattatattt

SEQ ID NO: 2958928 - DNA, 16 bp, Homo sapiens
ttgtaaattatatttg

SEQ ID NO: 2958929 - DNA, 17 bp, Homo sapiens
ttgtaaattatatttgt

SEQ ID NO: 2958930 - DNA, 23 bp, Homo sapiens
ttgtaaattattaatttatgcag

SEQ ID NO: 2958931 - DNA, 15 bp, Homo sapiens
ttgtaaatttggatt

SEQ ID NO: 2958932 - DNA, 20 bp, Homo sapiens
ttgtaaatttggatttacga

SEQ ID NO: 2958933 - DNA, 13 bp, Homo sapiens
ttgtaagccctct

SEQ ID NO: 2958934 - DNA, 14 bp, Homo sapiens
ttgtaaggtctttg

SEQ ID NO: 2958935 - DNA, 16 bp, Homo sapiens
ttgtaaggtctttgta

SEQ ID NO: 2958936 - DNA, 17 bp, Homo sapiens
ttgtaaggtctttgtaa

SEQ ID NO: 2958937 - DNA, 18 bp, Homo sapiens
ttgtaaggtctttgtaaa

SEQ ID NO: 2958938 - DNA, 17 bp, Homo sapiens
ttgtaattatgtaaata

SEQ ID NO: 2958939 - DNA, 23 bp, Homo sapiens
ttgtaattgtgtaaaaaatggaa

SEQ ID NO: 2958940 - DNA, 22 bp, Homo sapiens
ttgtaattttgttcctgtttat

SEQ ID NO: 2958941 - DNA, 11 bp, Homo sapiens
ttgtacacttt

SEQ ID NO: 2958942 - DNA, 22 bp, Homo sapiens
ttgtacatgaaatttttgtaaa

SEQ ID NO: 2958943 - DNA, 21 bp, Homo sapiens
ttgtacatgtgtagcctgtgc

SEQ ID NO: 2958944 - DNA, 15 bp, Homo sapiens
ttgtaccaactttta

SEQ ID NO: 2958945 - DNA, 22 bp, Homo sapiens
ttgtaccagtgaatttttgcaa

SEQ ID NO: 2958946 - DNA, 15 bp, Homo sapiens
ttgtactccagcctg

SEQ ID NO: 2958947 - DNA, 17 bp, Homo sapiens
ttgtactccagcctggg

SEQ ID NO: 2958948 - DNA, 17 bp, Homo sapiens
ttgtagaatgtattgta

SEQ ID NO: 2958949 - DNA, 20 bp, Homo sapiens
ttgtagaatgtattgtacct

SEQ ID NO: 2958950 - DNA, 22 bp, Homo sapiens
ttgtagaatgtattgtaccttt

SEQ ID NO: 2958951 - DNA, 14 bp, Homo sapiens
ttgtagattcagtg

SEQ ID NO: 2958952 - DNA, 19 bp, Homo sapiens
ttgtagcaggtttcactat

SEQ ID NO: 2958953 - DNA, 17 bp, Homo sapiens
ttgtagcccaggctgga

SEQ ID NO: 2958954 - DNA, 15 bp, Homo sapiens
ttgtagctttcctgg

SEQ ID NO: 2958955 - DNA, 17 bp, Homo sapiens
ttgtagctttcctggaa

SEQ ID NO: 2958956 - DNA, 16 bp, Homo sapiens
ttgtaggaatctgcct

SEQ ID NO: 2958957 - DNA, 22 bp, Homo sapiens
ttgtaggttattttatatttga

SEQ ID NO: 2958958 - DNA, 18 bp, Homo sapiens
ttgtagtatttagtatat

SEQ ID NO: 2958959 - DNA, 11 bp, Homo sapiens
ttgtataaatt

SEQ ID NO: 2958960 - DNA, 15 bp, Homo sapiens
ttgtataaattactt

SEQ ID NO: 2958961 - DNA, 13 bp, Homo sapiens
ttgtataacaggt

SEQ ID NO: 2958962 - DNA, 14 bp, Homo sapiens
ttgtataacaggtt

SEQ ID NO: 2958963 - DNA, 17 bp, Homo sapiens
ttgtataacaggttatt

SEQ ID NO: 2958964 - DNA, 13 bp, Homo sapiens
ttgtataattgta

SEQ ID NO: 2958965 - DNA, 16 bp, Homo sapiens
ttgtataattgtatcg

SEQ ID NO: 2958966 - DNA, 15 bp, Homo sapiens
ttgtatataaagttt

SEQ ID NO: 2958967 - DNA, 17 bp, Homo sapiens
ttgtatattgtatttat

SEQ ID NO: 2958968 - DNA, 15 bp, Homo sapiens
ttgtatattgtgttt

SEQ ID NO: 2958969 - DNA, 18 bp, Homo sapiens
ttgtatcgtatagctgta

SEQ ID NO: 2958970 - DNA, 14 bp, Homo sapiens
ttgtatctcttaaa

SEQ ID NO: 2958971 - DNA, 17 bp, Homo sapiens
ttgtatctcttaaagtg

SEQ ID NO: 2958972 - DNA, 21 bp, Homo sapiens
ttgtatctttttgaaaatgtt

SEQ ID NO: 2958973 - DNA, 18 bp, Homo sapiens
ttgtatgaagtactttta

SEQ ID NO: 2958974 - DNA, 17 bp, Homo sapiens
ttgtattatttttgtag

SEQ ID NO: 2958975 - DNA, 14 bp, Homo sapiens
ttgtattctctgag

SEQ ID NO: 2958976 - DNA, 16 bp, Homo sapiens
ttgtattggtgaaaga

SEQ ID NO: 2958977 - DNA, 15 bp, Homo sapiens
ttgtatttctcttgt

SEQ ID NO: 2958978 - DNA, 19 bp, Homo sapiens
ttgtatttctcttgtcctt

SEQ ID NO: 2958979 - DNA, 12 bp, Homo sapiens
ttgtattttcca

SEQ ID NO: 2958980 - DNA, 21 bp, Homo sapiens
ttgtattttccaagtgtgcat

SEQ ID NO: 2958981 - DNA, 17 bp, Homo sapiens
ttgtcaatggaagaaac

SEQ ID NO: 2958982 - DNA, 16 bp, Homo sapiens
ttgtcacatcaagcat

SEQ ID NO: 2958983 - DNA, 13 bp, Homo sapiens
ttgtcacgccaga

SEQ ID NO: 2958984 - DNA, 16 bp, Homo sapiens
ttgtcacttgcatgtc

SEQ ID NO: 2958985 - DNA, 19 bp, Homo sapiens
ttgtcagcatctgaccatc

SEQ ID NO: 2958986 - DNA, 17 bp, Homo sapiens
ttgtcatcgttccccac

SEQ ID NO: 2958987 - DNA, 21 bp, Homo sapiens
ttgtcatggggatcaattttc

SEQ ID NO: 2958988 - DNA, 16 bp, Homo sapiens
ttgtcatgtttattct

SEQ ID NO: 2958989 - DNA, 15 bp, Homo sapiens
ttgtcattaaaattg

SEQ ID NO: 2958990 - DNA, 15 bp, Homo sapiens
ttgtccaaacaggtg

SEQ ID NO: 2958991 - DNA, 19 bp, Homo sapiens
ttgtccaattgttgacagt

SEQ ID NO: 2958992 - DNA, 13 bp, Homo sapiens
ttgtccagcgcct

SEQ ID NO: 2958993 - DNA, 14 bp, Homo sapiens
ttgtccatgtcccc

SEQ ID NO: 2958994 - DNA, 13 bp, Homo sapiens
ttgtccattgtcc

SEQ ID NO: 2958995 - DNA, 21 bp, Homo sapiens
ttgtcccagaggctgccccac

SEQ ID NO: 2958996 - DNA, 12 bp, Homo sapiens
ttgtcccctgct

SEQ ID NO: 2958997 - DNA, 13 bp, Homo sapiens
ttgtcccctgctt

SEQ ID NO: 2958998 - DNA, 15 bp, Homo sapiens
ttgtccctctgcccc

SEQ ID NO: 2958999 - DNA, 17 bp, Homo sapiens
ttgtccctggggcactc

SEQ ID NO: 2959000 - DNA, 23 bp, Homo sapiens
ttgtcctagagtgagagtttgga

SEQ ID NO: 2959001 - DNA, 15 bp, Homo sapiens
ttgtcctcatttctc

SEQ ID NO: 2959002 - DNA, 16 bp, Homo sapiens
ttgtcctttaatattt

SEQ ID NO: 2959003 - DNA, 18 bp, Homo sapiens
ttgtctacattaaatcac

SEQ ID NO: 2959004 - DNA, 19 bp, Homo sapiens
ttgtctagagctcatcagt

SEQ ID NO: 2959005 - DNA, 12 bp, Homo sapiens
ttgtctcacttt

SEQ ID NO: 2959006 - DNA, 13 bp, Homo sapiens
ttgtctcactttt

SEQ ID NO: 2959007 - DNA, 16 bp, Homo sapiens
ttgtctcctactctgt

SEQ ID NO: 2959008 - DNA, 15 bp, Homo sapiens
ttgtctggaagaaag

SEQ ID NO: 2959009 - DNA, 18 bp, Homo sapiens
ttgtcttgaaaaaaaata

SEQ ID NO: 2959010 - DNA, 21 bp, Homo sapiens
ttgtcttgaaaaaaaatagat

SEQ ID NO: 2959011 - DNA, 13 bp, Homo sapiens
ttgtcttgaaaga

SEQ ID NO: 2959012 - DNA, 18 bp, Homo sapiens
ttgtcttgccttattaaa

SEQ ID NO: 2959013 - DNA, 11 bp, Homo sapiens
ttgtctttatg

SEQ ID NO: 2959014 - DNA, 11 bp, Homo sapiens
ttgtctttctt

SEQ ID NO: 2959015 - DNA, 16 bp, Homo sapiens
ttgtctttctttgctg

SEQ ID NO: 2959016 - DNA, 23 bp, Homo sapiens
ttgtctttgtaatgtcaccacct

SEQ ID NO: 2959017 - DNA, 22 bp, Homo sapiens
ttgtgaactcagccaagcacag

SEQ ID NO: 2959018 - DNA, 22 bp, Homo sapiens
ttgtgaagaactattttattct

SEQ ID NO: 2959019 - DNA, 13 bp, Homo sapiens
ttgtgaagccctg

SEQ ID NO: 2959020 - DNA, 14 bp, Homo sapiens
ttgtgaagccctgt

SEQ ID NO: 2959021 - DNA, 14 bp, Homo sapiens
ttgtgaaggccatg

SEQ ID NO: 2959022 - DNA, 18 bp, Homo sapiens
ttgtgaattatactttgt

SEQ ID NO: 2959023 - DNA, 23 bp, Homo sapiens
ttgtgacagctctttttgtgaag

SEQ ID NO: 2959024 - DNA, 21 bp, Homo sapiens
ttgtgaccaatacatttgtat

SEQ ID NO: 2959025 - DNA, 20 bp, Homo sapiens
ttgtgacctgaagttcacca

SEQ ID NO: 2959026 - DNA, 23 bp, Homo sapiens
ttgtgactaattgtataacaggt

SEQ ID NO: 2959027 - DNA, 19 bp, Homo sapiens
ttgtgactagaaattctta

SEQ ID NO: 2959028 - DNA, 17 bp, Homo sapiens
ttgtgactcagcagagg

SEQ ID NO: 2959029 - DNA, 16 bp, Homo sapiens
ttgtgagccctctagg

SEQ ID NO: 2959030 - DNA, 17 bp, Homo sapiens
ttgtgagccctctaggg

SEQ ID NO: 2959031 - DNA, 13 bp, Homo sapiens
ttgtgagccttgc

SEQ ID NO: 2959032 - DNA, 18 bp, Homo sapiens
ttgtgagccttgctgcca

SEQ ID NO: 2959033 - DNA, 21 bp, Homo sapiens
ttgtgagccttgctgccaagt

SEQ ID NO: 2959034 - DNA, 18 bp, Homo sapiens
ttgtgaggtgaatgtctt

SEQ ID NO: 2959035 - DNA, 22 bp, Homo sapiens
ttgtgaggtgaatgtcttcctt

SEQ ID NO: 2959036 - DNA, 20 bp, Homo sapiens
ttgtgagtaaatcagatgtt

SEQ ID NO: 2959037 - DNA, 20 bp, Homo sapiens
ttgtgatattgaccatgtga

SEQ ID NO: 2959038 - DNA, 23 bp, Homo sapiens
ttgtgatgaatctacatttgttt

SEQ ID NO: 2959039 - DNA, 18 bp, Homo sapiens
ttgtgatgtttgctcaga

SEQ ID NO: 2959040 - DNA, 21 bp, Homo sapiens
ttgtgcaaaaaggactggaaa

SEQ ID NO: 2959041 - DNA, 14 bp, Homo sapiens
ttgtgcagaatctc

SEQ ID NO: 2959042 - DNA, 22 bp, Homo sapiens
ttgtgccatagtcacatggcct

SEQ ID NO: 2959043 - DNA, 17 bp, Homo sapiens
ttgtgcctcccttccca

SEQ ID NO: 2959044 - DNA, 16 bp, Homo sapiens
ttgtgctagaaatttt

SEQ ID NO: 2959045 - DNA, 18 bp, Homo sapiens
ttgtgctagaaattttca

SEQ ID NO: 2959046 - DNA, 19 bp, Homo sapiens
ttgtgctatagtatttgat

SEQ ID NO: 2959047 - DNA, 11 bp, Homo sapiens
ttgtgctcagt

SEQ ID NO: 2959048 - DNA, 13 bp, Homo sapiens
ttgtgctcagtcg

SEQ ID NO: 2959049 - DNA, 15 bp, Homo sapiens
ttgtgctcagtcgcc

SEQ ID NO: 2959050 - DNA, 16 bp, Homo sapiens
ttgtgctcatgtgtgt

SEQ ID NO: 2959051 - DNA, 13 bp, Homo sapiens
ttgtgctctttcc

SEQ ID NO: 2959052 - DNA, 14 bp, Homo sapiens
ttgtgctctttcct

SEQ ID NO: 2959053 - DNA, 13 bp, Homo sapiens
ttgtgctttgaaa

SEQ ID NO: 2959054 - DNA, 20 bp, Homo sapiens
ttgtgcttttagtaaaaaca

SEQ ID NO: 2959055 - DNA, 13 bp, Homo sapiens
tttaaataaatta

SEQ ID NO: 2959056 - DNA, 11 bp, Homo sapiens
tttaaatacat

SEQ ID NO: 2959057 - DNA, 19 bp, Homo sapiens
tttaaatcagatttgtaat

SEQ ID NO: 2959058 - DNA, 14 bp, Homo sapiens
tttaaatgaaagga

SEQ ID NO: 2959059 - DNA, 14 bp, Homo sapiens
tttaaatgctttta

SEQ ID NO: 2959060 - DNA, 13 bp, Homo sapiens
tttaaattacaat

SEQ ID NO: 2959061 - DNA, 17 bp, Homo sapiens
tttaaattctttttcaa

SEQ ID NO: 2959062 - DNA, 19 bp, Homo sapiens
tttaaattctttttcaaaa

SEQ ID NO: 2959063 - DNA, 19 bp, Homo sapiens
tttaaattgttataacttc

SEQ ID NO: 2959064 - DNA, 13 bp, Homo sapiens
tttaaattttctc

SEQ ID NO: 2959065 - DNA, 18 bp, Homo sapiens
tttaaattttctttttgt

SEQ ID NO: 2959066 - DNA, 24 bp, Homo sapiens
tttaaattttctttttgtttcact

SEQ ID NO: 2959067 - DNA, 15 bp, Homo sapiens
tttaacaaaaaccaa

SEQ ID NO: 2959068 - DNA, 13 bp, Homo sapiens
tttaacaagaaga

SEQ ID NO: 2959069 - DNA, 24 bp, Homo sapiens
tttaacaggttttcttctaatcat

SEQ ID NO: 2959070 - DNA, 21 bp, Homo sapiens
tttaaccaagttgtttattcc

SEQ ID NO: 2959071 - DNA, 20 bp, Homo sapiens
tttaaccatggcagggtgct

SEQ ID NO: 2959072 - DNA, 20 bp, Homo sapiens
tttaaccgtttttcaagaaa

SEQ ID NO: 2959073 - DNA, 21 bp, Homo sapiens
tttaacgttgatgtaatgaaa

SEQ ID NO: 2959074 - DNA, 19 bp, Homo sapiens
tttaactactgtattccca

SEQ ID NO: 2959075 - DNA, 19 bp, Homo sapiens
tttaactctataatgtgtt

SEQ ID NO: 2959076 - DNA, 13 bp, Homo sapiens
tttaactgtgata

SEQ ID NO: 2959077 - DNA, 16 bp, Homo sapiens
tttaactgtgcatgtg

SEQ ID NO: 2959078 - DNA, 20 bp, Homo sapiens
tttaagacaccaaatataac

SEQ ID NO: 2959079 - DNA, 22 bp, Homo sapiens
tttaagacaccaaatataacaa

SEQ ID NO: 2959080 - DNA, 21 bp, Homo sapiens
tttaagacttagttatttctg

SEQ ID NO: 2959081 - DNA, 22 bp, Homo sapiens
tttaagacttagttatttctgc

SEQ ID NO: 2959082 - DNA, 11 bp, Homo sapiens
tttaagagact

SEQ ID NO: 2959083 - DNA, 18 bp, Homo sapiens
tttaagatatccatcttt

SEQ ID NO: 2959084 - DNA, 22 bp, Homo sapiens
tttaagatatccatctttttct

SEQ ID NO: 2959085 - DNA, 19 bp, Homo sapiens
tttaagatgacacttttaa

SEQ ID NO: 2959086 - DNA, 15 bp, Homo sapiens
tttaagcagctctaa

SEQ ID NO: 2959087 - DNA, 22 bp, Homo sapiens
tttaagcatgagtggccttaat

SEQ ID NO: 2959088 - DNA, 16 bp, Homo sapiens
tttaagctccagcttt

SEQ ID NO: 2959089 - DNA, 12 bp, Homo sapiens
tttaaggaaaca

SEQ ID NO: 2959090 - DNA, 17 bp, Homo sapiens
tttaaggctctgtgcct

SEQ ID NO: 2959091 - DNA, 23 bp, Homo sapiens
tttaagggccggggatggatctt

SEQ ID NO: 2959092 - DNA, 14 bp, Homo sapiens
tttaagtctacaaa

SEQ ID NO: 2959093 - DNA, 19 bp, Homo sapiens
tttaagttcctgctgcctg

SEQ ID NO: 2959094 - DNA, 22 bp, Homo sapiens
tttaagttttgtttgttcacac

SEQ ID NO: 2959095 - DNA, 20 bp, Homo sapiens
tttaataaaaaggcacctat

SEQ ID NO: 2959096 - DNA, 16 bp, Homo sapiens
tttaataacatatcta

SEQ ID NO: 2959097 - DNA, 15 bp, Homo sapiens
tttaatagaaataaa

SEQ ID NO: 2959098 - DNA, 12 bp, Homo sapiens
tttaatagtgtt

SEQ ID NO: 2959099 - DNA, 19 bp, Homo sapiens
tttaatatgttgactttat

SEQ ID NO: 2959100 - DNA, 15 bp, Homo sapiens
tttaatattgagaaa

SEQ ID NO: 2959101 - DNA, 22 bp, Homo sapiens
tttaatattgagaaagaaacta

SEQ ID NO: 2959102 - DNA, 14 bp, Homo sapiens
tttaatattttgca

SEQ ID NO: 2959103 - DNA, 21 bp, Homo sapiens
tttaatcaatgtgacatgttg

SEQ ID NO: 2959104 - DNA, 14 bp, Homo sapiens
tttaatcatgaaat

SEQ ID NO: 2959105 - DNA, 20 bp, Homo sapiens
tttaatcatgagcctgttta

SEQ ID NO: 2959106 - DNA, 21 bp, Homo sapiens
tttaatcatgagcctgtttat

SEQ ID NO: 2959107 - DNA, 22 bp, Homo sapiens
tttaatccctatgtttgtctca

SEQ ID NO: 2959108 - DNA, 17 bp, Homo sapiens
tttaatctgttgtttga

SEQ ID NO: 2959109 - DNA, 22 bp, Homo sapiens
tttaatgatttttgtgtatcca

SEQ ID NO: 2959110 - DNA, 13 bp, Homo sapiens
tttaatgctgtct

SEQ ID NO: 2959111 - DNA, 19 bp, Homo sapiens
tttaatgctgtctttgtgg

SEQ ID NO: 2959112 - DNA, 20 bp, Homo sapiens
tttaatggccggctggaaat

SEQ ID NO: 2959113 - DNA, 12 bp, Homo sapiens
tttaatgtgaac

SEQ ID NO: 2959114 - DNA, 20 bp, Homo sapiens
tttaatgtgaactctcccct

SEQ ID NO: 2959115 - DNA, 15 bp, Homo sapiens
tttaatgttctgtga

SEQ ID NO: 2959116 - DNA, 12 bp, Homo sapiens
tttaatgtttat

SEQ ID NO: 2959117 - DNA, 18 bp, Homo sapiens
tttaattaaaaactagta

SEQ ID NO: 2959118 - DNA, 15 bp, Homo sapiens
tttaattatttaaat

SEQ ID NO: 2959119 - DNA, 17 bp, Homo sapiens
tttaattattttaaaat

SEQ ID NO: 2959120 - DNA, 20 bp, Homo sapiens
tttaattattttaaaatatt

SEQ ID NO: 2959121 - DNA, 12 bp, Homo sapiens
tttaattcatat

SEQ ID NO: 2959122 - DNA, 22 bp, Homo sapiens
tttaattccatgaatcgcttct

SEQ ID NO: 2959123 - DNA, 13 bp, Homo sapiens
tttaattctcttg

SEQ ID NO: 2959124 - DNA, 16 bp, Homo sapiens
tttaattgcatttaaa

SEQ ID NO: 2959125 - DNA, 19 bp, Homo sapiens
tttaatttagtaaatgtta

SEQ ID NO: 2959126 - DNA, 13 bp, Homo sapiens
tttaattttagag

SEQ ID NO: 2959127 - DNA, 19 bp, Homo sapiens
tttaattttagagaaactt

SEQ ID NO: 2959128 - DNA, 11 bp, Homo sapiens
tttaattttgt

SEQ ID NO: 2959129 - DNA, 19 bp, Homo sapiens
tttaatttttaaaagactt

SEQ ID NO: 2959130 - DNA, 15 bp, Homo sapiens
tttacaaaaatataa

SEQ ID NO: 2959131 - DNA, 21 bp, Homo sapiens
tttacaagcccccccttccac

SEQ ID NO: 2959132 - DNA, 22 bp, Homo sapiens
tttacacacgtcgttctaatta

SEQ ID NO: 2959133 - DNA, 12 bp, Homo sapiens
tttacacagaaa

SEQ ID NO: 2959134 - DNA, 19 bp, Homo sapiens
tttacaccacactttcaaa

SEQ ID NO: 2959135 - DNA, 11 bp, Homo sapiens
tttacagaaaa

SEQ ID NO: 2959136 - DNA, 13 bp, Homo sapiens
tttacagaatttt

SEQ ID NO: 2959137 - DNA, 22 bp, Homo sapiens
tttacagccagtgggagatgtt

SEQ ID NO: 2959138 - DNA, 23 bp, Homo sapiens
tttacagccagtgggagatgtta

SEQ ID NO: 2959139 - DNA, 22 bp, Homo sapiens
tttacagctctgactttacact

SEQ ID NO: 2959140 - DNA, 23 bp, Homo sapiens
tttacagctttcatgattagcaa

SEQ ID NO: 2959141 - DNA, 13 bp, Homo sapiens
tttacagggtata

SEQ ID NO: 2959142 - DNA, 22 bp, Homo sapiens
tttacagttagggttttgcaat

SEQ ID NO: 2959143 - DNA, 23 bp, Homo sapiens
tttacattaaagaaatttaatgt

SEQ ID NO: 2959144 - DNA, 19 bp, Homo sapiens
tttacatttaatacagata

SEQ ID NO: 2959145 - DNA, 16 bp, Homo sapiens
tttaccaaacagcaaa

SEQ ID NO: 2959146 - DNA, 19 bp, Homo sapiens
tttaccaacatgtatctgt

SEQ ID NO: 2959147 - DNA, 15 bp, Homo sapiens
tttaccctcctctat

SEQ ID NO: 2959148 - DNA, 21 bp, Homo sapiens
tttacccttgagccctcccca

SEQ ID NO: 2959149 - DNA, 14 bp, Homo sapiens
tttacctggtgctc

SEQ ID NO: 2959150 - DNA, 16 bp, Homo sapiens
tttaccttcatttcat

SEQ ID NO: 2959151 - DNA, 16 bp, Homo sapiens
tttacgactgaagaag

SEQ ID NO: 2959152 - DNA, 13 bp, Homo sapiens
tttacgctttgat

SEQ ID NO: 2959153 - DNA, 18 bp, Homo sapiens
tttacgctttgattcata

SEQ ID NO: 2959154 - DNA, 21 bp, Homo sapiens
tttactaagatgacattgcta

SEQ ID NO: 2959155 - DNA, 12 bp, Homo sapiens
tttactagaaat

SEQ ID NO: 2959156 - DNA, 18 bp, Homo sapiens
tttactagggatccctca

SEQ ID NO: 2959157 - DNA, 21 bp, Homo sapiens
tttactcaaaatctgtcataa

SEQ ID NO: 2959158 - DNA, 21 bp, Homo sapiens
tttactcctcacacttactgt

SEQ ID NO: 2959159 - DNA, 14 bp, Homo sapiens
tttactgaagcctt

SEQ ID NO: 2959160 - DNA, 12 bp, Homo sapiens
tttactgtgttt

SEQ ID NO: 2959161 - DNA, 17 bp, Homo sapiens
tttactgttatttaatt

SEQ ID NO: 2959162 - DNA, 14 bp, Homo sapiens
tttactgtttgtta

SEQ ID NO: 2959163 - DNA, 14 bp, Homo sapiens
tttacttaaagatt

SEQ ID NO: 2959164 - DNA, 17 bp, Homo sapiens
tttacttctaatcttaa

SEQ ID NO: 2959165 - DNA, 12 bp, Homo sapiens
tttacttgaaag

SEQ ID NO: 2959166 - DNA, 23 bp, Homo sapiens
tttacttgttcatttctgtctcc

SEQ ID NO: 2959167 - DNA, 12 bp, Homo sapiens
tttactttggcc

SEQ ID NO: 2959168 - DNA, 19 bp, Homo sapiens
tttagaaaaagaacatgca

SEQ ID NO: 2959169 - DNA, 22 bp, Homo sapiens
tttagaaaaagaacatgcagtt

SEQ ID NO: 2959170 - DNA, 15 bp, Homo sapiens
tttagaaagaatatt

SEQ ID NO: 2959171 - DNA, 18 bp, Homo sapiens
tttagcaatgctgtgaat

SEQ ID NO: 2959172 - DNA, 19 bp, Homo sapiens
tttagcaatgctgtgaata

SEQ ID NO: 2959173 - DNA, 23 bp, Homo sapiens
tttagcaatttaatattttgcac

SEQ ID NO: 2959174 - DNA, 12 bp, Homo sapiens
tttagcagaaat

SEQ ID NO: 2959175 - DNA, 16 bp, Homo sapiens
tttagcataaaatttt

SEQ ID NO: 2959176 - DNA, 23 bp, Homo sapiens
tttagctgatgaacttattctgt

SEQ ID NO: 2959177 - DNA, 14 bp, Homo sapiens
tttaggaaaagcat

SEQ ID NO: 2959178 - DNA, 13 bp, Homo sapiens
tttaggagcagtg

SEQ ID NO: 2959179 - DNA, 23 bp, Homo sapiens
tttaggagctaaggctctatgag

SEQ ID NO: 2959180 - DNA, 18 bp, Homo sapiens
tttaggctggtggcccag

SEQ ID NO: 2959181 - DNA, 16 bp, Homo sapiens
tttaggttctaaagtt

SEQ ID NO: 2959182 - DNA, 18 bp, Homo sapiens
tttaggttctaaagttct

SEQ ID NO: 2959183 - DNA, 14 bp, Homo sapiens
tttagtaaatacat

SEQ ID NO: 2959184 - DNA, 18 bp, Homo sapiens
tttagtaaatacatcact

SEQ ID NO: 2959185 - DNA, 17 bp, Homo sapiens
tttagtaacatcatttt

SEQ ID NO: 2959186 - DNA, 15 bp, Homo sapiens
tttagtaatttcttt

SEQ ID NO: 2959187 - DNA, 12 bp, Homo sapiens
tttagtcacttt

SEQ ID NO: 2959188 - DNA, 13 bp, Homo sapiens
tttagtcattatt

SEQ ID NO: 2959189 - DNA, 15 bp, Homo sapiens
tttagtgattgcttt

SEQ ID NO: 2959190 - DNA, 17 bp, Homo sapiens
tttagtgattgctttta

SEQ ID NO: 2959191 - DNA, 17 bp, Homo sapiens
tttagtgccaatgttgt

SEQ ID NO: 2959192 - DNA, 18 bp, Homo sapiens
tttagtgccaatgttgtg

SEQ ID NO: 2959193 - DNA, 19 bp, Homo sapiens
tttagtgtgtgtgcagagt

SEQ ID NO: 2959194 - DNA, 17 bp, Homo sapiens
tttagttatttaagaag

SEQ ID NO: 2959195 - DNA, 15 bp, Homo sapiens
tttagtttaaaatct

SEQ ID NO: 2959196 - DNA, 16 bp, Homo sapiens
tttagtttaaaatctt

SEQ ID NO: 2959197 - DNA, 21 bp, Homo sapiens
tttataaaatagagtgtagtt

SEQ ID NO: 2959198 - DNA, 12 bp, Homo sapiens
tttataaacaga

SEQ ID NO: 2959199 - DNA, 13 bp, Homo sapiens
tttataaggtttt

SEQ ID NO: 2959200 - DNA, 12 bp, Homo sapiens
tttatacaaaat

SEQ ID NO: 2959201 - DNA, 13 bp, Homo sapiens
tttatacaaaata

SEQ ID NO: 2959202 - DNA, 17 bp, Homo sapiens
tttatacaacagtgcta

SEQ ID NO: 2959203 - DNA, 16 bp, Homo sapiens
tttatacagagtaatt

SEQ ID NO: 2959204 - DNA, 19 bp, Homo sapiens
tttatacagtgtacatgta

SEQ ID NO: 2959205 - DNA, 14 bp, Homo sapiens
tttatactctcttc

SEQ ID NO: 2959206 - DNA, 18 bp, Homo sapiens
tttatactctttctgtat

SEQ ID NO: 2959207 - DNA, 20 bp, Homo sapiens
tttatactctttctgtatat

SEQ ID NO: 2959208 - DNA, 21 bp, Homo sapiens
tttatactgcactttagtgta

SEQ ID NO: 2959209 - DNA, 16 bp, Homo sapiens
tttatactgtttactg

SEQ ID NO: 2959210 - DNA, 14 bp, Homo sapiens
tttatacttaaaca

SEQ ID NO: 2959211 - DNA, 14 bp, Homo sapiens
tttatagaagaaat

SEQ ID NO: 2959212 - DNA, 20 bp, Homo sapiens
tttatatacaataatggaaa

SEQ ID NO: 2959213 - DNA, 17 bp, Homo sapiens
tttatatcaaatgagca

SEQ ID NO: 2959214 - DNA, 15 bp, Homo sapiens
tttatatcacatgtt

SEQ ID NO: 2959215 - DNA, 12 bp, Homo sapiens
tttatatgaaaa

SEQ ID NO: 2959216 - DNA, 14 bp, Homo sapiens
tttatatgaaaaca

SEQ ID NO: 2959217 - DNA, 15 bp, Homo sapiens
tttatatgaagcaag

SEQ ID NO: 2959218 - DNA, 17 bp, Homo sapiens
tttatatgaagcaagct

SEQ ID NO: 2959219 - DNA, 20 bp, Homo sapiens
tttatatgaagcaagctgtg

SEQ ID NO: 2959220 - DNA, 12 bp, Homo sapiens
tttatatgtact

SEQ ID NO: 2959221 - DNA, 14 bp, Homo sapiens
tttatcagcaaaaa

SEQ ID NO: 2959222 - DNA, 21 bp, Homo sapiens
tttatcatgaattccctttta

SEQ ID NO: 2959223 - DNA, 15 bp, Homo sapiens
tttatcattcaagtg

SEQ ID NO: 2959224 - DNA, 22 bp, Homo sapiens
tttatcccttcctgtctgaaca

SEQ ID NO: 2959225 - DNA, 17 bp, Homo sapiens
tttatcctaaaaatctg

SEQ ID NO: 2959226 - DNA, 22 bp, Homo sapiens
tttatctccaagtggcagtttt

SEQ ID NO: 2959227 - DNA, 20 bp, Homo sapiens
tttatctccatactttggat

SEQ ID NO: 2959228 - DNA, 13 bp, Homo sapiens
tttatctgattaa

SEQ ID NO: 2959229 - DNA, 15 bp, Homo sapiens
tttatcttgagtgtt

SEQ ID NO: 2959230 - DNA, 14 bp, Homo sapiens
tttatgaatataat

SEQ ID NO: 2959231 - DNA, 22 bp, Homo sapiens
tttatgacacaatgacacattt

SEQ ID NO: 2959232 - DNA, 21 bp, Homo sapiens
tttatgacatgaaaagttatt

SEQ ID NO: 2959233 - DNA, 17 bp, Homo sapiens
tttatgaccagagcaaa

SEQ ID NO: 2959234 - DNA, 22 bp, Homo sapiens
tttatgacgagacctcagatgt

SEQ ID NO: 2959235 - DNA, 17 bp, Homo sapiens
tttatgactgttgcata

SEQ ID NO: 2959236 - DNA, 23 bp, Homo sapiens
tttatgagaactggttcttgcct

SEQ ID NO: 2959237 - DNA, 15 bp, Homo sapiens
tttatgatcagtgtt

SEQ ID NO: 2959238 - DNA, 21 bp, Homo sapiens
tttatgatcagtgttgttgct

SEQ ID NO: 2959239 - DNA, 19 bp, Homo sapiens
tttatgctacctagtctcc

SEQ ID NO: 2959240 - DNA, 21 bp, Homo sapiens
tttatgctataaattttttga

SEQ ID NO: 2959241 - DNA, 18 bp, Homo sapiens
tttatgtagagaaaagga

SEQ ID NO: 2959242 - DNA, 12 bp, Homo sapiens
tttatgtatctt

SEQ ID NO: 2959243 - DNA, 14 bp, Homo sapiens
tttatgtatcttga

SEQ ID NO: 2959244 - DNA, 18 bp, Homo sapiens
tttatgtattttaaaata

SEQ ID NO: 2959245 - DNA, 18 bp, Homo sapiens
tttatgttcttatagaat

SEQ ID NO: 2959246 - DNA, 18 bp, Homo sapiens
tttattaaaaactgagtg

SEQ ID NO: 2959247 - DNA, 13 bp, Homo sapiens
tttattaaattta

SEQ ID NO: 2959248 - DNA, 23 bp, Homo sapiens
tttattaagattattttattatg

SEQ ID NO: 2959249 - DNA, 23 bp, Homo sapiens
tttattacaaattttcactgctg

SEQ ID NO: 2959250 - DNA, 13 bp, Homo sapiens
tttattacattag

SEQ ID NO: 2959251 - DNA, 13 bp, Homo sapiens
tttattagatgaa

SEQ ID NO: 2959252 - DNA, 14 bp, Homo sapiens
tttattagatgaat

SEQ ID NO: 2959253 - DNA, 17 bp, Homo sapiens
tttattcaaacttttat

SEQ ID NO: 2959254 - DNA, 16 bp, Homo sapiens
tttattcacaaaacat

SEQ ID NO: 2959255 - DNA, 17 bp, Homo sapiens
tttattcatctgtgaaa

SEQ ID NO: 2959256 - DNA, 22 bp, Homo sapiens
tttattccagaatgctgtacat

SEQ ID NO: 2959257 - DNA, 14 bp, Homo sapiens
tttattgacacaga

SEQ ID NO: 2959258 - DNA, 14 bp, Homo sapiens
tttattgccattat

SEQ ID NO: 2959259 - DNA, 17 bp, Homo sapiens
tttattgccattatagc

SEQ ID NO: 2959260 - DNA, 22 bp, Homo sapiens
tttattgccattatagcgcctg

SEQ ID NO: 2959261 - DNA, 14 bp, Homo sapiens
tttatttaaaagat

SEQ ID NO: 2959262 - DNA, 19 bp, Homo sapiens
tttatttatatgtactgtt

SEQ ID NO: 2959263 - DNA, 14 bp, Homo sapiens
tttatttatgtact

SEQ ID NO: 2959264 - DNA, 13 bp, Homo sapiens
tttatttcattca

SEQ ID NO: 2959265 - DNA, 17 bp, Homo sapiens
tttatttcattggttaa

SEQ ID NO: 2959266 - DNA, 16 bp, Homo sapiens
tttatttctgcatatg

SEQ ID NO: 2959267 - DNA, 18 bp, Homo sapiens
tttattttacacagaaac

SEQ ID NO: 2959268 - DNA, 15 bp, Homo sapiens
tttattttatgagaa

SEQ ID NO: 2959269 - DNA, 20 bp, Homo sapiens
tttattttatgagaaatgta

SEQ ID NO: 2959270 - DNA, 21 bp, Homo sapiens
tttattttgtctctgagattt

SEQ ID NO: 2959271 - DNA, 17 bp, Homo sapiens
tttatttttcatttagt

SEQ ID NO: 2959272 - DNA, 13 bp, Homo sapiens
tttatttttgcaa

SEQ ID NO: 2959273 - DNA, 22 bp, Homo sapiens
tttatttttttgatggctaaga

SEQ ID NO: 2959274 - DNA, 19 bp, Homo sapiens
tttcaaaatagaaaagtta

SEQ ID NO: 2959275 - DNA, 20 bp, Homo sapiens
tttcaaaatagaaaagttat

SEQ ID NO: 2959276 - DNA, 18 bp, Homo sapiens
tttcaaaatccaaaaaga

SEQ ID NO: 2959277 - DNA, 19 bp, Homo sapiens
tttcaaaatccaaaaagaa

SEQ ID NO: 2959278 - DNA, 21 bp, Homo sapiens
tttcaaaatccaaaaagaaat

SEQ ID NO: 2959279 - DNA, 12 bp, Homo sapiens
tttcaaaatgct

SEQ ID NO: 2959280 - DNA, 16 bp, Homo sapiens
tttcactattcctatg

SEQ ID NO: 2959281 - DNA, 22 bp, Homo sapiens
tttcactgtcttttaaaaaaca

SEQ ID NO: 2959282 - DNA, 18 bp, Homo sapiens
tttcacttcctctccaca

SEQ ID NO: 2959283 - DNA, 23 bp, Homo sapiens
tttcacttcctctccacaggagc

SEQ ID NO: 2959284 - DNA, 18 bp, Homo sapiens
tttcacttgaaagatttt

SEQ ID NO: 2959285 - DNA, 19 bp, Homo sapiens
tttcacttgtcttgctctt

SEQ ID NO: 2959286 - DNA, 14 bp, Homo sapiens
tttcagaactcaca

SEQ ID NO: 2959287 - DNA, 14 bp, Homo sapiens
tttcagaccccagc

SEQ ID NO: 2959288 - DNA, 11 bp, Homo sapiens
tttcagactcc

SEQ ID NO: 2959289 - DNA, 15 bp, Homo sapiens
tttcagatatcaaaa

SEQ ID NO: 2959290 - DNA, 12 bp, Homo sapiens
tttcagatgctt

SEQ ID NO: 2959291 - DNA, 14 bp, Homo sapiens
tttcagatgcttct

SEQ ID NO: 2959292 - DNA, 16 bp, Homo sapiens
tttcagatgcttctgg

SEQ ID NO: 2959293 - DNA, 11 bp, Homo sapiens
tttcagatgtg

SEQ ID NO: 2959294 - DNA, 18 bp, Homo sapiens
tttcagatgtgaaccatt

SEQ ID NO: 2959295 - DNA, 14 bp, Homo sapiens
tttcagcataaatg

SEQ ID NO: 2959296 - DNA, 17 bp, Homo sapiens
tttcagccaaagtccta

SEQ ID NO: 2959297 - DNA, 22 bp, Homo sapiens
tttcagccaatctggacacttc

SEQ ID NO: 2959298 - DNA, 23 bp, Homo sapiens
tttcagccatgcgcgcgctctct

SEQ ID NO: 2959299 - DNA, 22 bp, Homo sapiens
tttcagcgcccccaggcctgcc

SEQ ID NO: 2959300 - DNA, 21 bp, Homo sapiens
tttcagctatttagtgatata

SEQ ID NO: 2959301 - DNA, 15 bp, Homo sapiens
tttcagctttcttca

SEQ ID NO: 2959302 - DNA, 15 bp, Homo sapiens
tttcaggaatttaaa

SEQ ID NO: 2959303 - DNA, 15 bp, Homo sapiens
tttcaggccctcagc

SEQ ID NO: 2959304 - DNA, 17 bp, Homo sapiens
tttcagggaaattaatc

SEQ ID NO: 2959305 - DNA, 19 bp, Homo sapiens
tttcagggaaattaatcaa

SEQ ID NO: 2959306 - DNA, 17 bp, Homo sapiens
tttcaggtgtaaccatt

SEQ ID NO: 2959307 - DNA, 20 bp, Homo sapiens
tttcaggtgtaaccatttgt

SEQ ID NO: 2959308 - DNA, 15 bp, Homo sapiens
tttcagtttaattct

SEQ ID NO: 2959309 - DNA, 18 bp, Homo sapiens
tttcataagtatttcaaa

SEQ ID NO: 2959310 - DNA, 22 bp, Homo sapiens
tttcatagtgcctttttcctta

SEQ ID NO: 2959311 - DNA, 16 bp, Homo sapiens
tttcatattctttcaa

SEQ ID NO: 2959312 - DNA, 18 bp, Homo sapiens
tttcatattctttcaatt

SEQ ID NO: 2959313 - DNA, 13 bp, Homo sapiens
tttcatattgtaa

SEQ ID NO: 2959314 - DNA, 18 bp, Homo sapiens
tttcatcactaaaagaaa

SEQ ID NO: 2959315 - DNA, 14 bp, Homo sapiens
tttcatcatgagga

SEQ ID NO: 2959316 - DNA, 13 bp, Homo sapiens
tttcatcatttca

SEQ ID NO: 2959317 - DNA, 22 bp, Homo sapiens
tttcatcccatactcaaaatac

SEQ ID NO: 2959318 - DNA, 12 bp, Homo sapiens
tttcatcctgtg

SEQ ID NO: 2959319 - DNA, 14 bp, Homo sapiens
tttcatcctgtgtc

SEQ ID NO: 2959320 - DNA, 16 bp, Homo sapiens
tttcatcctgtgtccc

SEQ ID NO: 2959321 - DNA, 23 bp, Homo sapiens
tttcatccttttttctcttctgt

SEQ ID NO: 2959322 - DNA, 14 bp, Homo sapiens
tttcatctgggaaa

SEQ ID NO: 2959323 - DNA, 18 bp, Homo sapiens
tttcatctgggaaagaca

SEQ ID NO: 2959324 - DNA, 18 bp, Homo sapiens
tttcatgtacaagatgaa

SEQ ID NO: 2959325 - DNA, 23 bp, Homo sapiens
tttcatgtgcggggatcatctgc

SEQ ID NO: 2959326 - DNA, 20 bp, Homo sapiens
tttcatgtgctatagacatt

SEQ ID NO: 2959327 - DNA, 23 bp, Homo sapiens
tttcatgttgcacacccactcag

SEQ ID NO: 2959328 - DNA, 16 bp, Homo sapiens
tttcattaagttgtaa

SEQ ID NO: 2959329 - DNA, 18 bp, Homo sapiens
tttcattatgtaaaatgt

SEQ ID NO: 2959330 - DNA, 14 bp, Homo sapiens
tttcattattctca

SEQ ID NO: 2959331 - DNA, 23 bp, Homo sapiens
tttcattgctgtgtcacactctg

SEQ ID NO: 2959332 - DNA, 20 bp, Homo sapiens
tttcatttttttctctctgg

SEQ ID NO: 2959333 - DNA, 17 bp, Homo sapiens
tttccaaaaaaatactg

SEQ ID NO: 2959334 - DNA, 18 bp, Homo sapiens
tttccaaaagtggcctct

SEQ ID NO: 2959335 - DNA, 19 bp, Homo sapiens
tttccaaaataaaacaaag

SEQ ID NO: 2959336 - DNA, 21 bp, Homo sapiens
tttccaagtcctttaactcgt

SEQ ID NO: 2959337 - DNA, 20 bp, Homo sapiens
tttccacaagattcccagag

SEQ ID NO: 2959338 - DNA, 22 bp, Homo sapiens
tttccacaagattcccagagac

SEQ ID NO: 2959339 - DNA, 14 bp, Homo sapiens
tttccaccttttgt

SEQ ID NO: 2959340 - DNA, 13 bp, Homo sapiens
tttccactactgc

SEQ ID NO: 2959341 - DNA, 12 bp, Homo sapiens
tttccactgaag

SEQ ID NO: 2959342 - DNA, 21 bp, Homo sapiens
tttccagaaagaaaatgaatt

SEQ ID NO: 2959343 - DNA, 14 bp, Homo sapiens
tttccagtctcttg

SEQ ID NO: 2959344 - DNA, 14 bp, Homo sapiens
tttccagttccctt

SEQ ID NO: 2959345 - DNA, 22 bp, Homo sapiens
tttccatagctcttcacttcct

SEQ ID NO: 2959346 - DNA, 12 bp, Homo sapiens
tttccatcttta

SEQ ID NO: 2959347 - DNA, 17 bp, Homo sapiens
tttccatgacatttttc

SEQ ID NO: 2959348 - DNA, 12 bp, Homo sapiens
tttcccaattca

SEQ ID NO: 2959349 - DNA, 15 bp, Homo sapiens
tttcccaattcacat

SEQ ID NO: 2959350 - DNA, 23 bp, Homo sapiens
tttcccacttcccaccctgcccc

SEQ ID NO: 2959351 - DNA, 20 bp, Homo sapiens
tttcccagctacacctttct

SEQ ID NO: 2959352 - DNA, 18 bp, Homo sapiens
tttcccaggaccctgaag

SEQ ID NO: 2959353 - DNA, 17 bp, Homo sapiens
tttcccatcatcctttg

SEQ ID NO: 2959354 - DNA, 17 bp, Homo sapiens
tttcccatttcgtgtaa

SEQ ID NO: 2959355 - DNA, 11 bp, Homo sapiens
tttccccagcc

SEQ ID NO: 2959356 - DNA, 14 bp, Homo sapiens
tttccccagcctct

SEQ ID NO: 2959357 - DNA, 18 bp, Homo sapiens
tttccctagactctgtaa

SEQ ID NO: 2959358 - DNA, 13 bp, Homo sapiens
tttccctcttgtg

SEQ ID NO: 2959359 - DNA, 22 bp, Homo sapiens
tttccctggctaacagtctagt

SEQ ID NO: 2959360 - DNA, 15 bp, Homo sapiens
tttccctttgccttc

SEQ ID NO: 2959361 - DNA, 13 bp, Homo sapiens
tttcctaaatgtt

SEQ ID NO: 2959362 - DNA, 21 bp, Homo sapiens
tttcctaataaagttctgtac

SEQ ID NO: 2959363 - DNA, 15 bp, Homo sapiens
tttcctaatatcaaa

SEQ ID NO: 2959364 - DNA, 20 bp, Homo sapiens
tttcctaatgagatatatct

SEQ ID NO: 2959365 - DNA, 21 bp, Homo sapiens
tttcctcaagtatcttctatt

SEQ ID NO: 2959366 - DNA, 19 bp, Homo sapiens
tttcctcagcttatctctt

SEQ ID NO: 2959367 - DNA, 12 bp, Homo sapiens
tttcctcccttc

SEQ ID NO: 2959368 - DNA, 17 bp, Homo sapiens
tttcctcccttctgcta

SEQ ID NO: 2959369 - DNA, 19 bp, Homo sapiens
tttcctcccttctgctact

SEQ ID NO: 2959370 - DNA, 19 bp, Homo sapiens
tttcctcctttctctgtat

SEQ ID NO: 2959371 - DNA, 14 bp, Homo sapiens
tttcctctctgtct

SEQ ID NO: 2959372 - DNA, 20 bp, Homo sapiens
tttcctctctgtctgtctct

SEQ ID NO: 2959373 - DNA, 21 bp, Homo sapiens
tttcctgaaacaacttggaaa

SEQ ID NO: 2959374 - DNA, 15 bp, Homo sapiens
tttcctgaaatcaag

SEQ ID NO: 2959375 - DNA, 13 bp, Homo sapiens
tttcctgaatcta

SEQ ID NO: 2959376 - DNA, 14 bp, Homo sapiens
tttcctgcccagcc

SEQ ID NO: 2959377 - DNA, 12 bp, Homo sapiens
tttcctggaagc

SEQ ID NO: 2959378 - DNA, 17 bp, Homo sapiens
tttcctgggccttctca

SEQ ID NO: 2959379 - DNA, 22 bp, Homo sapiens
tttcctgtgcccatcatctctg

SEQ ID NO: 2959380 - DNA, 23 bp, Homo sapiens
tttcctgtgcccatcatctctgc

SEQ ID NO: 2959381 - DNA, 18 bp, Homo sapiens
tttcctgtgtgaagaaag

SEQ ID NO: 2959382 - DNA, 16 bp, Homo sapiens
tttcctgtttctgaaa

SEQ ID NO: 2959383 - DNA, 17 bp, Homo sapiens
tttcctgtttctgaaaa

SEQ ID NO: 2959384 - DNA, 20 bp, Homo sapiens
tttcctgtttctgaaaagaa

SEQ ID NO: 2959385 - DNA, 13 bp, Homo sapiens
tttccttaccttt

SEQ ID NO: 2959386 - DNA, 13 bp, Homo sapiens
tttccttcagtgc

SEQ ID NO: 2959387 - DNA, 15 bp, Homo sapiens
tttccttccagccca

SEQ ID NO: 2959388 - DNA, 14 bp, Homo sapiens
tttccttccttcct

SEQ ID NO: 2959389 - DNA, 16 bp, Homo sapiens
tttccttctaacatgt

SEQ ID NO: 2959390 - DNA, 19 bp, Homo sapiens
tttccttctctgtaaccag

SEQ ID NO: 2959391 - DNA, 19 bp, Homo sapiens
tttccttggggcaggcagt

SEQ ID NO: 2959392 - DNA, 15 bp, Homo sapiens
tttcctttactcctg

SEQ ID NO: 2959393 - DNA, 14 bp, Homo sapiens
tttcctttgtcctt

SEQ ID NO: 2959394 - DNA, 20 bp, Homo sapiens
tttcgaagtcattaaactgg

SEQ ID NO: 2959395 - DNA, 14 bp, Homo sapiens
tttcggggagggcg

SEQ ID NO: 2959396 - DNA, 14 bp, Homo sapiens
tttcgtaccttccc

SEQ ID NO: 2959397 - DNA, 19 bp, Homo sapiens
tttcgtccacagcttcctg

SEQ ID NO: 2959398 - DNA, 23 bp, Homo sapiens
tttcgtccacagcttcctgtccc

SEQ ID NO: 2959399 - DNA, 14 bp, Homo sapiens
tttcgtttctgtat

SEQ ID NO: 2959400 - DNA, 17 bp, Homo sapiens
tttctaaacctgtgcct

SEQ ID NO: 2959401 - DNA, 21 bp, Homo sapiens
tttctaaacctgtgcctccct

SEQ ID NO: 2959402 - DNA, 22 bp, Homo sapiens
tttctaaacgtaagcactgttt

SEQ ID NO: 2959403 - DNA, 13 bp, Homo sapiens
tttctaaagaaat

SEQ ID NO: 2959404 - DNA, 13 bp, Homo sapiens
tttctaagattct

SEQ ID NO: 2959405 - DNA, 17 bp, Homo sapiens
tttctaagattctaaag

SEQ ID NO: 2959406 - DNA, 18 bp, Homo sapiens
tttctaagattctaaagg

SEQ ID NO: 2959407 - DNA, 19 bp, Homo sapiens
tttctaatgaggagagaaa

SEQ ID NO: 2959408 - DNA, 19 bp, Homo sapiens
tttctacaaggtgttcatt

SEQ ID NO: 2959409 - DNA, 16 bp, Homo sapiens
tttctacggtgacagt

SEQ ID NO: 2959410 - DNA, 19 bp, Homo sapiens
tttctagaaaagcttccta

SEQ ID NO: 2959411 - DNA, 20 bp, Homo sapiens
tttctagaacatccctgcca

SEQ ID NO: 2959412 - DNA, 22 bp, Homo sapiens
tttctagaacatccctgccagc

SEQ ID NO: 2959413 - DNA, 20 bp, Homo sapiens
tttctagcctggggcttgaa

SEQ ID NO: 2959414 - DNA, 21 bp, Homo sapiens
tttctaggaagaattttaaaa

SEQ ID NO: 2959415 - DNA, 18 bp, Homo sapiens
tttctagggaaatgaaag

SEQ ID NO: 2959416 - DNA, 17 bp, Homo sapiens
tttctaggtaggaaatg

SEQ ID NO: 2959417 - DNA, 13 bp, Homo sapiens
tttgaaattctga

SEQ ID NO: 2959418 - DNA, 16 bp, Homo sapiens
tttgaaattctgaatt

SEQ ID NO: 2959419 - DNA, 18 bp, Homo sapiens
tttgaaattctgaatttg

SEQ ID NO: 2959420 - DNA, 22 bp, Homo sapiens
tttgaaattctgaatttgcaaa

SEQ ID NO: 2959421 - DNA, 22 bp, Homo sapiens
tttgaacgtgccagcagccctt

SEQ ID NO: 2959422 - DNA, 11 bp, Homo sapiens
tttgaactttg

SEQ ID NO: 2959423 - DNA, 23 bp, Homo sapiens
tttgaagacccgctacaaaacgc

SEQ ID NO: 2959424 - DNA, 19 bp, Homo sapiens
tttgaagcagctctgcctt

SEQ ID NO: 2959425 - DNA, 20 bp, Homo sapiens
tttgaagcagtcttgctctg

SEQ ID NO: 2959426 - DNA, 17 bp, Homo sapiens
tttgaagtgggaaagca

SEQ ID NO: 2959427 - DNA, 11 bp, Homo sapiens
tttgaagtgtt

SEQ ID NO: 2959428 - DNA, 18 bp, Homo sapiens
tttgaatcatcaagtctt

SEQ ID NO: 2959429 - DNA, 17 bp, Homo sapiens
tttgaatgtatgcttca

SEQ ID NO: 2959430 - DNA, 23 bp, Homo sapiens
tttgaatgtccaaaatttatatt

SEQ ID NO: 2959431 - DNA, 16 bp, Homo sapiens
tttgaatgttaatttt

SEQ ID NO: 2959432 - DNA, 19 bp, Homo sapiens
tttgaatgttaattttttg

SEQ ID NO: 2959433 - DNA, 22 bp, Homo sapiens
tttgaattatccacatgaaaat

SEQ ID NO: 2959434 - DNA, 16 bp, Homo sapiens
tttgaattggcctgaa

SEQ ID NO: 2959435 - DNA, 23 bp, Homo sapiens
tttgaattggcctgaacagatgt

SEQ ID NO: 2959436 - DNA, 14 bp, Homo sapiens
tttgaattttgttt

SEQ ID NO: 2959437 - DNA, 17 bp, Homo sapiens
tttgaattttgttttta

SEQ ID NO: 2959438 - DNA, 17 bp, Homo sapiens
tttgacaacatggcttc

SEQ ID NO: 2959439 - DNA, 22 bp, Homo sapiens
tttgacaacatggcttctcctt

SEQ ID NO: 2959440 - DNA, 17 bp, Homo sapiens
tttgacaggttttccaa

SEQ ID NO: 2959441 - DNA, 19 bp, Homo sapiens
tttgacatcagccagctgc

SEQ ID NO: 2959442 - DNA, 16 bp, Homo sapiens
tttgaccaggaaagca

SEQ ID NO: 2959443 - DNA, 17 bp, Homo sapiens
tttgacctcctccctgt

SEQ ID NO: 2959444 - DNA, 16 bp, Homo sapiens
tttgacgaagaaacaa

SEQ ID NO: 2959445 - DNA, 19 bp, Homo sapiens
tttgacgggaaacaaaact

SEQ ID NO: 2959446 - DNA, 21 bp, Homo sapiens
tttgactaattttacatgttt

SEQ ID NO: 2959447 - DNA, 15 bp, Homo sapiens
tttgactgtcagcaa

SEQ ID NO: 2959448 - DNA, 18 bp, Homo sapiens
tttgacttagtaactttt

SEQ ID NO: 2959449 - DNA, 12 bp, Homo sapiens
tttgactttaaa

SEQ ID NO: 2959450 - DNA, 15 bp, Homo sapiens
tttgactttaattta

SEQ ID NO: 2959451 - DNA, 15 bp, Homo sapiens
tttgactttcttctg

SEQ ID NO: 2959452 - DNA, 17 bp, Homo sapiens
tttgactttcttctgaa

SEQ ID NO: 2959453 - DNA, 22 bp, Homo sapiens
tttgactttcttctgaatattt

SEQ ID NO: 2959454 - DNA, 21 bp, Homo sapiens
tttgagaaacaacaatttcta

SEQ ID NO: 2959455 - DNA, 16 bp, Homo sapiens
tttgagaccaggctgg

SEQ ID NO: 2959456 - DNA, 10 bp, Homo sapiens
tttgagagca

SEQ ID NO: 2959457 - DNA, 18 bp, Homo sapiens
tttgagattaagaatgcc

SEQ ID NO: 2959458 - DNA, 22 bp, Homo sapiens
tttgaggccgaagctgctgtga

SEQ ID NO: 2959459 - DNA, 16 bp, Homo sapiens
tttgagtaattttctg

SEQ ID NO: 2959460 - DNA, 13 bp, Homo sapiens
tttgagtacagat

SEQ ID NO: 2959461 - DNA, 20 bp, Homo sapiens
tttgagtacagatactgtga

SEQ ID NO: 2959462 - DNA, 22 bp, Homo sapiens
tttgggaagtgaagactggaag

SEQ ID NO: 2959463 - DNA, 22 bp, Homo sapiens
tttgggataggaaaaatgagta

SEQ ID NO: 2959464 - DNA, 23 bp, Homo sapiens
tttgggcaggagtcaccatgcaa

SEQ ID NO: 2959465 - DNA, 13 bp, Homo sapiens
tttgggccctgca

SEQ ID NO: 2959466 - DNA, 14 bp, Homo sapiens
tttgggctaacatt

SEQ ID NO: 2959467 - DNA, 15 bp, Homo sapiens
tttgggcttcagcct

SEQ ID NO: 2959468 - DNA, 15 bp, Homo sapiens
tttgggttacagtat

SEQ ID NO: 2959469 - DNA, 16 bp, Homo sapiens
tttgggttctgcctgc

SEQ ID NO: 2959470 - DNA, 23 bp, Homo sapiens
tttgggtttttaactcatcttta

SEQ ID NO: 2959471 - DNA, 18 bp, Homo sapiens
tttggtagatcttcaatt

SEQ ID NO: 2959472 - DNA, 23 bp, Homo sapiens
tttggtatttgtttgtagctttc

SEQ ID NO: 2959473 - DNA, 15 bp, Homo sapiens
tttggtgtacagact

SEQ ID NO: 2959474 - DNA, 13 bp, Homo sapiens
tttggtgtgcatc

SEQ ID NO: 2959475 - DNA, 21 bp, Homo sapiens
tttggtgtgcatctgtgtgtg

SEQ ID NO: 2959476 - DNA, 15 bp, Homo sapiens
tttggtttactttca

SEQ ID NO: 2959477 - DNA, 14 bp, Homo sapiens
tttggttttggaaa

SEQ ID NO: 2959478 - DNA, 14 bp, Homo sapiens
tttgtaaaatcaaa

SEQ ID NO: 2959479 - DNA, 17 bp, Homo sapiens
tttgtaaaatcttgcag

SEQ ID NO: 2959480 - DNA, 19 bp, Homo sapiens
tttgtaaaatcttgcagtt

SEQ ID NO: 2959481 - DNA, 12 bp, Homo sapiens
tttgtaaagtgt

SEQ ID NO: 2959482 - DNA, 15 bp, Homo sapiens
tttgtaaatcacatc

SEQ ID NO: 2959483 - DNA, 11 bp, Homo sapiens
tttgtaaattc

SEQ ID NO: 2959484 - DNA, 23 bp, Homo sapiens
tttgtaacaaaaagaccttcata

SEQ ID NO: 2959485 - DNA, 19 bp, Homo sapiens
tttgtaagcaacttgcttc

SEQ ID NO: 2959486 - DNA, 21 bp, Homo sapiens
tttgtaagcaacttgcttcta

SEQ ID NO: 2959487 - DNA, 21 bp, Homo sapiens
tttgtaataaaatggtacatt

SEQ ID NO: 2959488 - DNA, 23 bp, Homo sapiens
tttgtaatgtcaccaccttccca

SEQ ID NO: 2959489 - DNA, 16 bp, Homo sapiens
tttgtaattgtgtaaa

SEQ ID NO: 2959490 - DNA, 24 bp, Homo sapiens
tttgtacacaacacctaaaaccag

SEQ ID NO: 2959491 - DNA, 23 bp, Homo sapiens
tttgtaccagtgaatttttgcaa

SEQ ID NO: 2959492 - DNA, 14 bp, Homo sapiens
tttgtactgtttaa

SEQ ID NO: 2959493 - DNA, 18 bp, Homo sapiens
tttgtactgtttaatgtt

SEQ ID NO: 2959494 - DNA, 20 bp, Homo sapiens
tttgtagctttcctggaagt

SEQ ID NO: 2959495 - DNA, 23 bp, Homo sapiens
tttgtagtgagcgagtggatgct

SEQ ID NO: 2959496 - DNA, 14 bp, Homo sapiens
tttgtagtttgtat

SEQ ID NO: 2959497 - DNA, 20 bp, Homo sapiens
tttgtataaatgacaaagtg

SEQ ID NO: 2959498 - DNA, 17 bp, Homo sapiens
tttgtataattgtatcg

SEQ ID NO: 2959499 - DNA, 18 bp, Homo sapiens
tttgtatatgactgcatt

SEQ ID NO: 2959500 - DNA, 16 bp, Homo sapiens
tttgtatattatttct

SEQ ID NO: 2959501 - DNA, 18 bp, Homo sapiens
tttgtatgaaattataat

SEQ ID NO: 2959502 - DNA, 18 bp, Homo sapiens
tttgtatgaagtactttt

SEQ ID NO: 2959503 - DNA, 13 bp, Homo sapiens
tttgtatgtgtgt

SEQ ID NO: 2959504 - DNA, 16 bp, Homo sapiens
tttgtattaaacttga

SEQ ID NO: 2959505 - DNA, 13 bp, Homo sapiens
tttgtattaccat

SEQ ID NO: 2959506 - DNA, 14 bp, Homo sapiens
tttgtattctctga

SEQ ID NO: 2959507 - DNA, 21 bp, Homo sapiens
tttgtattgtttcaattgcat

SEQ ID NO: 2959508 - DNA, 23 bp, Homo sapiens
tttgtatttaatgatttttgtgt

SEQ ID NO: 2959509 - DNA, 15 bp, Homo sapiens
tttgtattttccaag

SEQ ID NO: 2959510 - DNA, 14 bp, Homo sapiens
tttgtatttttagt

SEQ ID NO: 2959511 - DNA, 23 bp, Homo sapiens
tttgtcaaactgtagaaatgatg

SEQ ID NO: 2959512 - DNA, 23 bp, Homo sapiens
tttgtcacaagctgtagataaca

SEQ ID NO: 2959513 - DNA, 19 bp, Homo sapiens
tttgtcaccctaacttcgt

SEQ ID NO: 2959514 - DNA, 17 bp, Homo sapiens
ttttcatcatttcagcc

SEQ ID NO: 2959515 - DNA, 19 bp, Homo sapiens
ttttcatcatttcagccaa

SEQ ID NO: 2959516 - DNA, 13 bp, Homo sapiens
ttttcatcccctt

SEQ ID NO: 2959517 - DNA, 22 bp, Homo sapiens
ttttcatccttttttctcttct

SEQ ID NO: 2959518 - DNA, 14 bp, Homo sapiens
ttttcatctgggaa

SEQ ID NO: 2959519 - DNA, 21 bp, Homo sapiens
ttttcatcttctctggcgaca

SEQ ID NO: 2959520 - DNA, 16 bp, Homo sapiens
ttttcatgttttaaca

SEQ ID NO: 2959521 - DNA, 19 bp, Homo sapiens
ttttcatgttttaacaaaa

SEQ ID NO: 2959522 - DNA, 20 bp, Homo sapiens
ttttcatgttttaacaaaaa

SEQ ID NO: 2959523 - DNA, 14 bp, Homo sapiens
ttttcattaaactt

SEQ ID NO: 2959524 - DNA, 13 bp, Homo sapiens
ttttcattattgt

SEQ ID NO: 2959525 - DNA, 14 bp, Homo sapiens
ttttcattctcctc

SEQ ID NO: 2959526 - DNA, 15 bp, Homo sapiens
ttttccaaaaaaata

SEQ ID NO: 2959527 - DNA, 21 bp, Homo sapiens
ttttccaacttggctgcagga

SEQ ID NO: 2959528 - DNA, 18 bp, Homo sapiens
ttttccaagtgtgcatat

SEQ ID NO: 2959529 - DNA, 22 bp, Homo sapiens
ttttccacactatgtgtgttgt

SEQ ID NO: 2959530 - DNA, 15 bp, Homo sapiens
ttttccactactgct

SEQ ID NO: 2959531 - DNA, 18 bp, Homo sapiens
ttttccactgtgctatta

SEQ ID NO: 2959532 - DNA, 15 bp, Homo sapiens
ttttccacttagtat

SEQ ID NO: 2959533 - DNA, 20 bp, Homo sapiens
ttttccagctggatgagaat

SEQ ID NO: 2959534 - DNA, 22 bp, Homo sapiens
ttttccatgtgttttgctttta

SEQ ID NO: 2959535 - DNA, 20 bp, Homo sapiens
ttttcccctaccaatattag

SEQ ID NO: 2959536 - DNA, 23 bp, Homo sapiens
ttttccctacctaagaatttcac

SEQ ID NO: 2959537 - DNA, 13 bp, Homo sapiens
ttttccctcttgt

SEQ ID NO: 2959538 - DNA, 14 bp, Homo sapiens
ttttcctcccttct

SEQ ID NO: 2959539 - DNA, 17 bp, Homo sapiens
ttttcctcccttctgct

SEQ ID NO: 2959540 - DNA, 12 bp, Homo sapiens
ttttcctgcttc

SEQ ID NO: 2959541 - DNA, 20 bp, Homo sapiens
ttttcctgggccttctcagc

SEQ ID NO: 2959542 - DNA, 15 bp, Homo sapiens
ttttccttatttcaa

SEQ ID NO: 2959543 - DNA, 14 bp, Homo sapiens
ttttccttcctgag

SEQ ID NO: 2959544 - DNA, 21 bp, Homo sapiens
ttttcgaactgtgctcccacg

SEQ ID NO: 2959545 - DNA, 21 bp, Homo sapiens
ttttcgtcatcttccctgccc

SEQ ID NO: 2959546 - DNA, 19 bp, Homo sapiens
ttttctaaaaaaaaaaact

SEQ ID NO: 2959547 - DNA, 18 bp, Homo sapiens
ttttctaaacctgtgcct

SEQ ID NO: 2959548 - DNA, 20 bp, Homo sapiens
ttttctaaacctgtgcctcc

SEQ ID NO: 2959549 - DNA, 22 bp, Homo sapiens
ttttctaaacgtaagcactgtt

SEQ ID NO: 2959550 - DNA, 14 bp, Homo sapiens
ttttctaaatcctt

SEQ ID NO: 2959551 - DNA, 22 bp, Homo sapiens
ttttctacataattgtgaccaa

SEQ ID NO: 2959552 - DNA, 22 bp, Homo sapiens
ttttctagcattttcagaaact

SEQ ID NO: 2959553 - DNA, 17 bp, Homo sapiens
ttttctatttctctgtg

SEQ ID NO: 2959554 - DNA, 20 bp, Homo sapiens
ttttctatttctctgtgtat

SEQ ID NO: 2959555 - DNA, 17 bp, Homo sapiens
ttttctcactccttttg

SEQ ID NO: 2959556 - DNA, 18 bp, Homo sapiens
ttttctccacccaaaccc

SEQ ID NO: 2959557 - DNA, 19 bp, Homo sapiens
ttttctcctgcatgtgtat

SEQ ID NO: 2959558 - DNA, 20 bp, Homo sapiens
ttttctcctgcatgtgtata

SEQ ID NO: 2959559 - DNA, 21 bp, Homo sapiens
ttttctcgctgtcctttctag

SEQ ID NO: 2959560 - DNA, 12 bp, Homo sapiens
ttttctcttctg

SEQ ID NO: 2959561 - DNA, 23 bp, Homo sapiens
ttttctgatgggaggaaagtagc

SEQ ID NO: 2959562 - DNA, 21 bp, Homo sapiens
ttttctgggggaaaaagccat

SEQ ID NO: 2959563 - DNA, 15 bp, Homo sapiens
ttttctgtgtaacca

SEQ ID NO: 2959564 - DNA, 17 bp, Homo sapiens
ttttctgttcatagata

SEQ ID NO: 2959565 - DNA, 17 bp, Homo sapiens
ttttcttaaccagttgt

SEQ ID NO: 2959566 - DNA, 15 bp, Homo sapiens
ttttcttctcagtct

SEQ ID NO: 2959567 - DNA, 15 bp, Homo sapiens
ttttcttctttgtgg

SEQ ID NO: 2959568 - DNA, 17 bp, Homo sapiens
ttttcttcttttaaaaa

SEQ ID NO: 2959569 - DNA, 14 bp, Homo sapiens
ttttcttgcattga

SEQ ID NO: 2959570 - DNA, 20 bp, Homo sapiens
ttttcttgcttaccttgact

SEQ ID NO: 2959571 - DNA, 12 bp, Homo sapiens
ttttctttaaaa

SEQ ID NO: 2959572 - DNA, 12 bp, Homo sapiens
ttttctttaata

SEQ ID NO: 2959573 - DNA, 15 bp, Homo sapiens
ttttctttagagaac

SEQ ID NO: 2959574 - DNA, 11 bp, Homo sapiens
ttttctttcac

SEQ ID NO: 2959575 - DNA, 15 bp, Homo sapiens
ttttctttgcaaagt

SEQ ID NO: 2959576 - DNA, 15 bp, Homo sapiens
ttttcttttccatta

SEQ ID NO: 2959577 - DNA, 13 bp, Homo sapiens
ttttcttttgtaa

SEQ ID NO: 2959578 - DNA, 22 bp, Homo sapiens
ttttgaaatgtggttttcctga

SEQ ID NO: 2959579 - DNA, 12 bp, Homo sapiens
ttttgaagctgt

SEQ ID NO: 2959580 - DNA, 18 bp, Homo sapiens
ttttgaagtgttttagtc

SEQ ID NO: 2959581 - DNA, 22 bp, Homo sapiens
ttttgaatgcctcataaattaa

SEQ ID NO: 2959582 - DNA, 15 bp, Homo sapiens
ttttgaattgttaca

SEQ ID NO: 2959583 - DNA, 21 bp, Homo sapiens
ttttgacaacatggcttctcc

SEQ ID NO: 2959584 - DNA, 13 bp, Homo sapiens
ttttttgtaccaa

SEQ ID NO: 2959585 - DNA, 13 bp, Homo sapiens
tttttttgtttgt

SEQ ID NO: 2959586 - DNA, 13 bp, Homo sapiens
ttttgtttgctat

SEQ ID NO: 2959587 - DNA, 18 bp, Homo sapiens
ttttgtttggcaaggaaa

SEQ ID NO: 2959588 - DNA, 19 bp, Homo sapiens
ttttgtttggcaaggaaag

SEQ ID NO: 2959589 - DNA, 16 bp, Homo sapiens
ttttgttttaaaactg

SEQ ID NO: 2959590 - DNA, 16 bp, Homo sapiens
ttttgttttaaggaaa

SEQ ID NO: 2959591 - DNA, 21 bp, Homo sapiens
tttttaaaaaacaattggttg

SEQ ID NO: 2959592 - DNA, 19 bp, Homo sapiens
tttttaaaaaatattttct

SEQ ID NO: 2959593 - DNA, 18 bp, Homo sapiens
tttttaaaaactaaaaaa

SEQ ID NO: 2959594 - DNA, 14 bp, Homo sapiens
tttttaaaacacat

SEQ ID NO: 2959595 - DNA, 12 bp, Homo sapiens
tttttaaaagaa

SEQ ID NO: 2959596 - DNA, 14 bp, Homo sapiens
tttttaaaagactt

SEQ ID NO: 2959597 - DNA, 22 bp, Homo sapiens
tttttaaaagttgttaccaaat

SEQ ID NO: 2959598 - DNA, 21 bp, Homo sapiens
tttttaaagaaaatgtgtctg

SEQ ID NO: 2959599 - DNA, 18 bp, Homo sapiens
tttttaaaggacaaacag

SEQ ID NO: 2959600 - DNA, 18 bp, Homo sapiens
tttttaaagttactttgt

SEQ ID NO: 2959601 - DNA, 17 bp, Homo sapiens
tttttaactactgtatt

SEQ ID NO: 2959602 - DNA, 20 bp, Homo sapiens
tttttaaggctctgtgcctt

SEQ ID NO: 2959603 - DNA, 21 bp, Homo sapiens
tttttaaggtgagttctcact

SEQ ID NO: 2959604 - DNA, 18 bp, Homo sapiens
tttttaagttaatagatt

SEQ ID NO: 2959605 - DNA, 17 bp, Homo sapiens
tttttaagttcactttt

SEQ ID NO: 2959606 - DNA, 19 bp, Homo sapiens
tttttaatgtgctgtgtaa

SEQ ID NO: 2959607 - DNA, 20 bp, Homo sapiens
tttttaatgtgctgtgtaaa

SEQ ID NO: 2959608 - DNA, 16 bp, Homo sapiens
tttttaattttaacat

SEQ ID NO: 2959609 - DNA, 16 bp, Homo sapiens
tttttacatggagaaa

SEQ ID NO: 2959610 - DNA, 13 bp, Homo sapiens
tttttagaaggaa

SEQ ID NO: 2959611 - DNA, 14 bp, Homo sapiens
tttttagagcatta

SEQ ID NO: 2959612 - DNA, 15 bp, Homo sapiens
tttttagagcattaa

SEQ ID NO: 2959613 - DNA, 19 bp, Homo sapiens
tttttagattggttctgtt

SEQ ID NO: 2959614 - DNA, 12 bp, Homo sapiens
tttttaggaaaa

SEQ ID NO: 2959615 - DNA, 12 bp, Homo sapiens
tttttagtttgt

SEQ ID NO: 2959616 - DNA, 18 bp, Homo sapiens
tttttataaaatggctgt

SEQ ID NO: 2959617 - DNA, 18 bp, Homo sapiens
tttttatcatttctactg

SEQ ID NO: 2959618 - DNA, 13 bp, Homo sapiens
tttttatttaaat

SEQ ID NO: 2959619 - DNA, 12 bp, Homo sapiens
tttttatttctg

SEQ ID NO: 2959620 - DNA, 21 bp, Homo sapiens
tttttatttcttttgtgcaga

SEQ ID NO: 2959621 - DNA, 19 bp, Homo sapiens
tttttcaaaaattacacta

SEQ ID NO: 2959622 - DNA, 15 bp, Homo sapiens
tttttcaaaatagaa

SEQ ID NO: 2959623 - DNA, 21 bp, Homo sapiens
tttttcaaaatccaaaaagaa

SEQ ID NO: 2959624 - DNA, 15 bp, Homo sapiens
tttttcaagaaaact

SEQ ID NO: 2959625 - DNA, 14 bp, Homo sapiens
tttttcaagagaaa

SEQ ID NO: 2959626 - DNA, 15 bp, Homo sapiens
tttttcagaggtgaa

SEQ ID NO: 2959627 - DNA, 20 bp, Homo sapiens
tttttcagaggtgaattaat

SEQ ID NO: 2959628 - DNA, 16 bp, Homo sapiens
tttttcatagtgcctt

SEQ ID NO: 2959629 - DNA, 17 bp, Homo sapiens
tttttcatagtgccttt

SEQ ID NO: 2959630 - DNA, 12 bp, Homo sapiens
tttttcattttt

SEQ ID NO: 2959631 - DNA, 13 bp, Homo sapiens
tttttccaaaaaa

SEQ ID NO: 2959632 - DNA, 20 bp, Homo sapiens
tttttccatagttttgatga

SEQ ID NO: 2959633 - DNA, 19 bp, Homo sapiens
tttttcctcctttctctgt

SEQ ID NO: 2959634 - DNA, 22 bp, Homo sapiens
tttttccttatagggaaaaatg

SEQ ID NO: 2959635 - DNA, 20 bp, Homo sapiens
tttttctaaacctgtgcctc

SEQ ID NO: 2959636 - DNA, 22 bp, Homo sapiens
tttttctcttctgtccatcagt

SEQ ID NO: 2959637 - DNA, 14 bp, Homo sapiens
tttttctgcttttg

SEQ ID NO: 2959638 - DNA, 14 bp, Homo sapiens
tttttcttaggttt

SEQ ID NO: 2959639 - DNA, 23 bp, Homo sapiens
tttttcttgtaaatgtgttggac

SEQ ID NO: 2959640 - DNA, 20 bp, Homo sapiens
tttttgagacagagtctcgc

SEQ ID NO: 2959641 - DNA, 21 bp, Homo sapiens
tttttgagatactattttcat

SEQ ID NO: 2959642 - DNA, 15 bp, Homo sapiens
tttttgatgtataaa

SEQ ID NO: 2959643 - DNA, 11 bp, Homo sapiens
tttttgcaaaa

SEQ ID NO: 2959644 - DNA, 11 bp, Homo sapiens
tttttgcaata

SEQ ID NO: 2959645 - DNA, 22 bp, Homo sapiens
tttttgcaataatgcagtatgg

SEQ ID NO: 2959646 - DNA, 19 bp, Homo sapiens
tttttgcaccccatgctgt

SEQ ID NO: 2959647 - DNA, 20 bp, Homo sapiens
tttttgcaccccatgctgtt

SEQ ID NO: 2959648 - DNA, 23 bp, Homo sapiens
tttttgcaccccatgctgttgat

SEQ ID NO: 2959649 - DNA, 16 bp, Homo sapiens
tttttgcaggggactg

SEQ ID NO: 2959650 - DNA, 14 bp, Homo sapiens
tttttgccttcatt

SEQ ID NO: 2959651 - DNA, 18 bp, Homo sapiens
tttttgctttctgaaatt

SEQ ID NO: 2959652 - DNA, 24 bp, Homo sapiens
tttttggaccaccgttcagtcatt

SEQ ID NO: 2959653 - DNA, 20 bp, Homo sapiens
tttttggtttcttattcaaa

SEQ ID NO: 2959654 - DNA, 16 bp, Homo sapiens
tttttgtaaagtgtgg

SEQ ID NO: 2959655 - DNA, 19 bp, Homo sapiens
tttttgtgaaaagctccat

SEQ ID NO: 2959656 - DNA, 19 bp, Homo sapiens
tttttgttaggctgtaaag

SEQ ID NO: 2959657 - DNA, 22 bp, Homo sapiens
tttttgtttctttgtgtttgct

SEQ ID NO: 2959658 - DNA, 14 bp, Homo sapiens
ttttttaaagaaaa

SEQ ID NO: 2959659 - DNA, 15 bp, Homo sapiens
ttttttaatgtgctg

SEQ ID NO: 2959660 - DNA, 13 bp, Homo sapiens
ttttttacctgtt

SEQ ID NO: 2959661 - DNA, 18 bp, Homo sapiens
ttttttcaaaatagaaaa

SEQ ID NO: 2959662 - DNA, 20 bp, Homo sapiens
ttttttcatgttttaacaaa

SEQ ID NO: 2959663 - DNA, 12 bp, Homo sapiens
ttttttctcttc

SEQ ID NO: 2959664 - DNA, 18 bp, Homo sapiens
ttttttggttgtttgctg

SEQ ID NO: 2959665 - DNA, 20 bp, Homo sapiens
tttgaaagtcagctgaagga

SEQ ID NO: 2959666 - DNA, 19 bp, Homo sapiens
tttgaaatacctttgtagt

SEQ ID NO: 2959667 - DNA, 15 bp, Homo sapiens
tttgaaatcagcata

SEQ ID NO: 2959668 - DNA, 17 bp, Homo sapiens
tttgaaattctgaattt

SEQ ID NO: 2959669 - DNA, 20 bp, Homo sapiens
tttgaaattctgaatttgca

SEQ ID NO: 2959670 - DNA, 21 bp, Homo sapiens
tttgaaattctgaatttgcaa

SEQ ID NO: 2959671 - DNA, 13 bp, Homo sapiens
tttgaacgtatgt

SEQ ID NO: 2959672 - DNA, 18 bp, Homo sapiens
tttgaacgtgccagcagc

SEQ ID NO: 2959673 - DNA, 15 bp, Homo sapiens
tttgaactttggaac

SEQ ID NO: 2959674 - DNA, 19 bp, Homo sapiens
tttgaagatctgatttata

SEQ ID NO: 2959675 - DNA, 16 bp, Homo sapiens
tttgaagctactgtgt

SEQ ID NO: 2959676 - DNA, 20 bp, Homo sapiens
tttgaaggaaacagttaata

SEQ ID NO: 2959677 - DNA, 23 bp, Homo sapiens
tttgaaggaaatgagtggccagc

SEQ ID NO: 2959678 - DNA, 12 bp, Homo sapiens
tttgaaggcaaa

SEQ ID NO: 2959679 - DNA, 13 bp, Homo sapiens
tttgaaggcaaaa

SEQ ID NO: 2959680 - DNA, 22 bp, Homo sapiens
tttgaagtcataccaatgaaaa

SEQ ID NO: 2959681 - DNA, 13 bp, Homo sapiens
tttgaagtgtaat

SEQ ID NO: 2959682 - DNA, 14 bp, Homo sapiens
tttgaataaagaat

SEQ ID NO: 2959683 - DNA, 16 bp, Homo sapiens
tttgaataaagaatac

SEQ ID NO: 2959684 - DNA, 18 bp, Homo sapiens
tttgaataaagaatactt

SEQ ID NO: 2959685 - DNA, 20 bp, Homo sapiens
tttgaataaagaatacttga

SEQ ID NO: 2959686 - DNA, 19 bp, Homo sapiens
tttgaatcaataatatatt

SEQ ID NO: 2959687 - DNA, 23 bp, Homo sapiens
tttgaatgcctcataaattaatg

SEQ ID NO: 2959688 - DNA, 15 bp, Homo sapiens
tttgaattggcctga

SEQ ID NO: 2959689 - DNA, 11 bp, Homo sapiens
tttgaatttct

SEQ ID NO: 2959690 - DNA, 17 bp, Homo sapiens
tttgacatgggtatttt

SEQ ID NO: 2959691 - DNA, 14 bp, Homo sapiens
tttgaccagtttct

SEQ ID NO: 2959692 - DNA, 20 bp, Homo sapiens
tttgaccatggaaagaaata

SEQ ID NO: 2959693 - DNA, 10 bp, Homo sapiens
tttgacctcc

SEQ ID NO: 2959694 - DNA, 13 bp, Homo sapiens
tttgaccttttat

SEQ ID NO: 2959695 - DNA, 19 bp, Homo sapiens
tttgacgaagaaacaaaaa

SEQ ID NO: 2959696 - DNA, 14 bp, Homo sapiens
tttgactttaattt

SEQ ID NO: 2959697 - DNA, 18 bp, Homo sapiens
tttgagaacaaagatgac

SEQ ID NO: 2959698 - DNA, 18 bp, Homo sapiens
tttgagaacgtaaagaac

SEQ ID NO: 2959699 - DNA, 21 bp, Homo sapiens
tttgagaactccagctggtgc

SEQ ID NO: 2959700 - DNA, 14 bp, Homo sapiens
tttgagaagaaaac

SEQ ID NO: 2959701 - DNA, 19 bp, Homo sapiens
tttgagagagagaaccttt

SEQ ID NO: 2959702 - DNA, 21 bp, Homo sapiens
tttgagcaactaactaaccac

SEQ ID NO: 2959703 - DNA, 13 bp, Homo sapiens
tttgagcacaatc

SEQ ID NO: 2959704 - DNA, 14 bp, Homo sapiens
tttgagcacaatct

SEQ ID NO: 2959705 - DNA, 12 bp, Homo sapiens
tttgaggtcttt

SEQ ID NO: 2959706 - DNA, 19 bp, Homo sapiens
tttgagtttcctttaaata

SEQ ID NO: 2959707 - DNA, 15 bp, Homo sapiens
tttgagtttgacatt

SEQ ID NO: 2959708 - DNA, 15 bp, Homo sapiens
tttgataaagtttct

SEQ ID NO: 2959709 - DNA, 19 bp, Homo sapiens
tttgataaagtttctcaga

SEQ ID NO: 2959710 - DNA, 22 bp, Homo sapiens
tttgatacagtcaacaagcctg

SEQ ID NO: 2959711 - DNA, 19 bp, Homo sapiens
tttgatacatatgtgaata

SEQ ID NO: 2959712 - DNA, 13 bp, Homo sapiens
tttgatagatgtt

SEQ ID NO: 2959713 - DNA, 13 bp, Homo sapiens
tttgatagtgctt

SEQ ID NO: 2959714 - DNA, 16 bp, Homo sapiens
tttgatagtgcttctt

SEQ ID NO: 2959715 - DNA, 12 bp, Homo sapiens
tttgatcttcag

SEQ ID NO: 2959716 - DNA, 19 bp, Homo sapiens
tttgatgactggcatttta

SEQ ID NO: 2959717 - DNA, 22 bp, Homo sapiens
tttgatgcatgtcttttaaaat

SEQ ID NO: 2959718 - DNA, 16 bp, Homo sapiens
tttgatgcttttctct

SEQ ID NO: 2959719 - DNA, 18 bp, Homo sapiens
tttgatgcttttctctca

SEQ ID NO: 2959720 - DNA, 15 bp, Homo sapiens
tttgatgtgtttttg

SEQ ID NO: 2959721 - DNA, 20 bp, Homo sapiens
tttgatgtgtttttgtatga

SEQ ID NO: 2959722 - DNA, 13 bp, Homo sapiens
tttgattaacaat

SEQ ID NO: 2959723 - DNA, 15 bp, Homo sapiens
tttgattaacatttg

SEQ ID NO: 2959724 - DNA, 23 bp, Homo sapiens
tttgattagtataatatttctta

SEQ ID NO: 2959725 - DNA, 20 bp, Homo sapiens
tttgattcatagtaacttct

SEQ ID NO: 2959726 - DNA, 13 bp, Homo sapiens
tttgattccattt

SEQ ID NO: 2959727 - DNA, 15 bp, Homo sapiens
tttgattgatttgaa

SEQ ID NO: 2959728 - DNA, 13 bp, Homo sapiens
tttgcaaaataag

SEQ ID NO: 2959729 - DNA, 21 bp, Homo sapiens
tttgcaaaggagacttaattt

SEQ ID NO: 2959730 - DNA, 11 bp, Homo sapiens
tttgcaaagta

SEQ ID NO: 2959731 - DNA, 14 bp, Homo sapiens
tttgcaaagtactg

SEQ ID NO: 2959732 - DNA, 23 bp, Homo sapiens
tttgcaaagtactgtaagaataa

SEQ ID NO: 2959733 - DNA, 22 bp, Homo sapiens
tttgcaaagtattgtaaattat

SEQ ID NO: 2959734 - DNA, 20 bp, Homo sapiens
tttgcaataacttctatatt

SEQ ID NO: 2959735 - DNA, 14 bp, Homo sapiens
tttgcaataatgca

SEQ ID NO: 2959736 - DNA, 22 bp, Homo sapiens
tttgcaataatgcagtatggta

SEQ ID NO: 2959737 - DNA, 20 bp, Homo sapiens
ttaaaggacaaacagtgaat

SEQ ID NO: 2959738 - DNA, 20 bp, Homo sapiens
ttaaaggatatgaaactcta

SEQ ID NO: 2959739 - DNA, 20 bp, Homo sapiens
ttaaagggagatggtaagaa

SEQ ID NO: 2959740 - DNA, 13 bp, Homo sapiens
ttaaagtgaattg

SEQ ID NO: 2959741 - DNA, 20 bp, Homo sapiens
ttaaagtgactaatggcatg

SEQ ID NO: 2959742 - DNA, 17 bp, Homo sapiens
ttaaagtgagtactgtt

SEQ ID NO: 2959743 - DNA, 19 bp, Homo sapiens
ttaaagtgctaaggttcta

SEQ ID NO: 2959744 - DNA, 17 bp, Homo sapiens
ttaaagtgctgtttaga

SEQ ID NO: 2959745 - DNA, 12 bp, Homo sapiens
ttaaagttaata

SEQ ID NO: 2959746 - DNA, 14 bp, Homo sapiens
ttaaataaattatg

SEQ ID NO: 2959747 - DNA, 18 bp, Homo sapiens
ttaaataagattctaacg

SEQ ID NO: 2959748 - DNA, 15 bp, Homo sapiens
ttaaatacataaata

SEQ ID NO: 2959749 - DNA, 18 bp, Homo sapiens
ttaaatagagtttgctat

SEQ ID NO: 2959750 - DNA, 16 bp, Homo sapiens
ttaaatattctgtaca

SEQ ID NO: 2959751 - DNA, 19 bp, Homo sapiens
ttaaatattgtcattacaa

SEQ ID NO: 2959752 - DNA, 22 bp, Homo sapiens
ttaaatattttctattttaaga

SEQ ID NO: 2959753 - DNA, 16 bp, Homo sapiens
ttaaatcagaataaat

SEQ ID NO: 2959754 - DNA, 19 bp, Homo sapiens
ttaaatcagatttgtaatg

SEQ ID NO: 2959755 - DNA, 19 bp, Homo sapiens
ttaaatcgccttgaacaaa

SEQ ID NO: 2959756 - DNA, 12 bp, Homo sapiens
ttaaatgaaagg

SEQ ID NO: 2959757 - DNA, 16 bp, Homo sapiens
ttaaatgacttagaaa

SEQ ID NO: 2959758 - DNA, 11 bp, Homo sapiens
ttaaatgattg

SEQ ID NO: 2959759 - DNA, 16 bp, Homo sapiens
ttaaatgattgagagt

SEQ ID NO: 2959760 - DNA, 15 bp, Homo sapiens
ttaaatgctactgaa

SEQ ID NO: 2959761 - DNA, 16 bp, Homo sapiens
ttaaatgctactgaaa

SEQ ID NO: 2959762 - DNA, 20 bp, Homo sapiens
ttaaatggaaaaaatgatgt

SEQ ID NO: 2959763 - DNA, 19 bp, Homo sapiens
ttaaatgtacagacatatt

SEQ ID NO: 2959764 - DNA, 16 bp, Homo sapiens
ttaaatgtttgttgaa

SEQ ID NO: 2959765 - DNA, 12 bp, Homo sapiens
ttaaattacaat

SEQ ID NO: 2959766 - DNA, 17 bp, Homo sapiens
ttaaattctcaaagttt

SEQ ID NO: 2959767 - DNA, 14 bp, Homo sapiens
ttaaattctctcta

SEQ ID NO: 2959768 - DNA, 16 bp, Homo sapiens
ttaaattgcatttcta

SEQ ID NO: 2959769 - DNA, 17 bp, Homo sapiens
ttaaattgttataactt

SEQ ID NO: 2959770 - DNA, 20 bp, Homo sapiens
ttaaattttctccagtccct

SEQ ID NO: 2959771 - DNA, 21 bp, Homo sapiens
ttaaattttctccagtccctg

SEQ ID NO: 2959772 - DNA, 16 bp, Homo sapiens
ttaaattttgtaatga

SEQ ID NO: 2959773 - DNA, 19 bp, Homo sapiens
ttaacaaaccaacatcttt

SEQ ID NO: 2959774 - DNA, 20 bp, Homo sapiens
ttaacaactgactaaccatt

SEQ ID NO: 2959775 - DNA, 17 bp, Homo sapiens
ttaacaattaggcagac

SEQ ID NO: 2959776 - DNA, 16 bp, Homo sapiens
ttaacacaatgtgaat

SEQ ID NO: 2959777 - DNA, 14 bp, Homo sapiens
ttaacacattttgt

SEQ ID NO: 2959778 - DNA, 15 bp, Homo sapiens
ttaacacctgatgtg

SEQ ID NO: 2959779 - DNA, 16 bp, Homo sapiens
ttaacacctgatgtgt

SEQ ID NO: 2959780 - DNA, 19 bp, Homo sapiens
ttaacacctgatgtgtaca

SEQ ID NO: 2959781 - DNA, 17 bp, Homo sapiens
ttaattttttggtacaa

SEQ ID NO: 2959782 - DNA, 18 bp, Homo sapiens
ttaattttttggtacaaa

SEQ ID NO: 2959783 - DNA, 18 bp, Homo sapiens
ttacaaaactacatgaga

SEQ ID NO: 2959784 - DNA, 20 bp, Homo sapiens
ttacaaaactacatgagaac

SEQ ID NO: 2959785 - DNA, 17 bp, Homo sapiens
ttacaaattaatatttg

SEQ ID NO: 2959786 - DNA, 18 bp, Homo sapiens
ttacaaattaatatttgt

SEQ ID NO: 2959787 - DNA, 15 bp, Homo sapiens
ttacaacaaacactg

SEQ ID NO: 2959788 - DNA, 16 bp, Homo sapiens
ttacaacaaacactgt

SEQ ID NO: 2959789 - DNA, 17 bp, Homo sapiens
ttacaacagatttgtga

SEQ ID NO: 2959790 - DNA, 18 bp, Homo sapiens
ttacaacagatttgtgaa

SEQ ID NO: 2959791 - DNA, 19 bp, Homo sapiens
ttacaacagatttgtgaac

SEQ ID NO: 2959792 - DNA, 22 bp, Homo sapiens
ttacaactgcctcgaaacacag

SEQ ID NO: 2959793 - DNA, 17 bp, Homo sapiens
ttacaagcccccccttc

SEQ ID NO: 2959794 - DNA, 18 bp, Homo sapiens
ttacaataaaactaaatg

SEQ ID NO: 2959795 - DNA, 14 bp, Homo sapiens
ttacaataaacata

SEQ ID NO: 2959796 - DNA, 17 bp, Homo sapiens
ttacaatcagtgtgaat

SEQ ID NO: 2959797 - DNA, 14 bp, Homo sapiens
ttacaattgaaatg

SEQ ID NO: 2959798 - DNA, 16 bp, Homo sapiens
ttacacaagagctgga

SEQ ID NO: 2959799 - DNA, 22 bp, Homo sapiens
ttacacaatggtttttaaattt

SEQ ID NO: 2959800 - DNA, 13 bp, Homo sapiens
ttacacagaaaca

SEQ ID NO: 2959801 - DNA, 16 bp, Homo sapiens
ttacacagaaacactg

SEQ ID NO: 2959802 - DNA, 20 bp, Homo sapiens
ttacacagaaacactgcctt

SEQ ID NO: 2959803 - DNA, 17 bp, Homo sapiens
ttacacagcaattttgt

SEQ ID NO: 2959804 - DNA, 15 bp, Homo sapiens
ttacactacaagttt

SEQ ID NO: 2959805 - DNA, 14 bp, Homo sapiens
ttacagaaagtggt

SEQ ID NO: 2959806 - DNA, 19 bp, Homo sapiens
ttacagaaagtggtgctca

SEQ ID NO: 2959807 - DNA, 22 bp, Homo sapiens
ttacagaaagtggtgctcagtt

SEQ ID NO: 2959808 - DNA, 20 bp, Homo sapiens
ttacagatgaatgtatttat

SEQ ID NO: 2959809 - DNA, 15 bp, Homo sapiens
ttacagcacaaaatg

SEQ ID NO: 2959810 - DNA, 17 bp, Homo sapiens
ttacagctctgacttta

SEQ ID NO: 2959811 - DNA, 18 bp, Homo sapiens
ttacaggaaagatgcatt

SEQ ID NO: 2959812 - DNA, 11 bp, Homo sapiens
ttacagggtat

SEQ ID NO: 2959813 - DNA, 13 bp, Homo sapiens
ttacagtaaatga

SEQ ID NO: 2959814 - DNA, 17 bp, Homo sapiens
ttacagtaggagcccag

SEQ ID NO: 2959815 - DNA, 17 bp, Homo sapiens
ttacagtatgcttgctc

SEQ ID NO: 2959816 - DNA, 18 bp, Homo sapiens
ttacagtatttttctgtg

SEQ ID NO: 2959817 - DNA, 21 bp, Homo sapiens
ttacagttagggttttgcaat

SEQ ID NO: 2959818 - DNA, 16 bp, Homo sapiens
ttacagttatcctgca

SEQ ID NO: 2959819 - DNA, 17 bp, Homo sapiens
ttacagttatcctgcaa

SEQ ID NO: 2959820 - DNA, 19 bp, Homo sapiens
ttacataactgatctattt

SEQ ID NO: 2959821 - DNA, 14 bp, Homo sapiens
ttacatacagtgat

SEQ ID NO: 2959822 - DNA, 22 bp, Homo sapiens
ttacatacagtgatatggtact

SEQ ID NO: 2959823 - DNA, 16 bp, Homo sapiens
ttacatagtaaatggt

SEQ ID NO: 2959824 - DNA, 15 bp, Homo sapiens
ttacatctttcacat

SEQ ID NO: 2959825 - DNA, 13 bp, Homo sapiens
ttacatgcataaa

SEQ ID NO: 2959826 - DNA, 14 bp, Homo sapiens
ttacatgcataaaa

SEQ ID NO: 2959827 - DNA, 12 bp, Homo sapiens
ttacatgcatac

SEQ ID NO: 2959828 - DNA, 21 bp, Homo sapiens
ttacatgcatacttcaaaagt

SEQ ID NO: 2959829 - DNA, 13 bp, Homo sapiens
ttacatgtttgca

SEQ ID NO: 2959830 - DNA, 14 bp, Homo sapiens
ttacatgtttgcac

SEQ ID NO: 2959831 - DNA, 11 bp, Homo sapiens
ttacattaaaa

SEQ ID NO: 2959832 - DNA, 16 bp, Homo sapiens
ttacattaaaaagcct

SEQ ID NO: 2959833 - DNA, 22 bp, Homo sapiens
ttacattaatgcccagccagcc

SEQ ID NO: 2959834 - DNA, 16 bp, Homo sapiens
ttacattctctaataa

SEQ ID NO: 2959835 - DNA, 19 bp, Homo sapiens
ttacatttaatacagataa

SEQ ID NO: 2959836 - DNA, 14 bp, Homo sapiens
ttaccaaacagcaa

SEQ ID NO: 2959837 - DNA, 19 bp, Homo sapiens
ttaccaaacagcaaaccaa

SEQ ID NO: 2959838 - DNA, 23 bp, Homo sapiens
ttaccaaagtgtcttttgacatt

SEQ ID NO: 2959839 - DNA, 22 bp, Homo sapiens
ttaccaaatacacatttcacat

SEQ ID NO: 2959840 - DNA, 21 bp, Homo sapiens
ttaccaacatgtatctgtcta

SEQ ID NO: 2959841 - DNA, 14 bp, Homo sapiens
ttaccaagaagcct

SEQ ID NO: 2959842 - DNA, 20 bp, Homo sapiens
ttaccacagagttttttaaa

SEQ ID NO: 2959843 - DNA, 17 bp, Homo sapiens
ttaccacgccttgacct

SEQ ID NO: 2959844 - DNA, 20 bp, Homo sapiens
ttaccagcatatatagtatt

SEQ ID NO: 2959845 - DNA, 16 bp, Homo sapiens
ttaccaggttcactta

SEQ ID NO: 2959846 - DNA, 19 bp, Homo sapiens
ttaccatggagttaacatc

SEQ ID NO: 2959847 - DNA, 12 bp, Homo sapiens
ttacccaagcaa

SEQ ID NO: 2959848 - DNA, 20 bp, Homo sapiens
ttacccaagcaaaatcatgg

SEQ ID NO: 2959849 - DNA, 21 bp, Homo sapiens
ttacccagagatatctatgaa

SEQ ID NO: 2959850 - DNA, 21 bp, Homo sapiens
ttacccatcttgcttccaaga

SEQ ID NO: 2959851 - DNA, 21 bp, Homo sapiens
ttaccccatggctgcacagtt

SEQ ID NO: 2959852 - DNA, 17 bp, Homo sapiens
ttacccctgcacagttt

SEQ ID NO: 2959853 - DNA, 23 bp, Homo sapiens
ttacccttcctcatctgtgcctg

SEQ ID NO: 2959854 - DNA, 19 bp, Homo sapiens
ttacctcctgagaaaaaag

SEQ ID NO: 2959855 - DNA, 20 bp, Homo sapiens
ttacctgacttatgaaactt

SEQ ID NO: 2959856 - DNA, 18 bp, Homo sapiens
ttacctgatcaatgacag

SEQ ID NO: 2959857 - DNA, 20 bp, Homo sapiens
ttacctggatataaattaat

SEQ ID NO: 2959858 - DNA, 23 bp, Homo sapiens
ttacctggcagcaaactgctgcc

SEQ ID NO: 2959859 - DNA, 20 bp, Homo sapiens
ttacctgtaacctaccttat

SEQ ID NO: 2959860 - DNA, 18 bp, Homo sapiens
ttaccttgactgttgatg

SEQ ID NO: 2959861 - DNA, 19 bp, Homo sapiens
ttaccttgactgttgatgt

SEQ ID NO: 2959862 - DNA, 15 bp, Homo sapiens
ttaccttgttattta

SEQ ID NO: 2959863 - DNA, 15 bp, Homo sapiens
ttaccttttttgata

SEQ ID NO: 2959864 - DNA, 17 bp, Homo sapiens
ttaccttttttgataaa

SEQ ID NO: 2959865 - DNA, 21 bp, Homo sapiens
ttacgaatgcccctgttcatg

SEQ ID NO: 2959866 - DNA, 13 bp, Homo sapiens
ttacgactgaaga

SEQ ID NO: 2959867 - DNA, 14 bp, Homo sapiens
ttacgatctgtttc

SEQ ID NO: 2959868 - DNA, 19 bp, Homo sapiens
ttactaagacatagtctct

SEQ ID NO: 2959869 - DNA, 22 bp, Homo sapiens
ttactaccctcaccctttacct

SEQ ID NO: 2959870 - DNA, 20 bp, Homo sapiens
ttactagcacctgccaggga

SEQ ID NO: 2959871 - DNA, 21 bp, Homo sapiens
ttactaggtgcccagaatgag

SEQ ID NO: 2959872 - DNA, 23 bp, Homo sapiens
ttactataagaactttgagctac

SEQ ID NO: 2959873 - DNA, 20 bp, Homo sapiens
ttactattcccactttcatt

SEQ ID NO: 2959874 - DNA, 15 bp, Homo sapiens
ttactcaaaatctgt

SEQ ID NO: 2959875 - DNA, 18 bp, Homo sapiens
ttactcaccatatttgaa

SEQ ID NO: 2959876 - DNA, 14 bp, Homo sapiens
ttactcagagctgc

SEQ ID NO: 2959877 - DNA, 15 bp, Homo sapiens
ttactcagcagcaga

SEQ ID NO: 2959878 - DNA, 14 bp, Homo sapiens
ttactcagccctgg

SEQ ID NO: 2959879 - DNA, 22 bp, Homo sapiens
ttactcagccctgggccccacc

SEQ ID NO: 2959880 - DNA, 14 bp, Homo sapiens
ttactcaggaagaa

SEQ ID NO: 2959881 - DNA, 13 bp, Homo sapiens
ttactcaggggat

SEQ ID NO: 2959882 - DNA, 19 bp, Homo sapiens
ttactcaggggatgtttac

SEQ ID NO: 2959883 - DNA, 19 bp, Homo sapiens
ttactcatcgggcccaggg

SEQ ID NO: 2959884 - DNA, 12 bp, Homo sapiens
ttactccaaaaa

SEQ ID NO: 2959885 - DNA, 19 bp, Homo sapiens
ttactccaaaaagacaagt

SEQ ID NO: 2959886 - DNA, 18 bp, Homo sapiens
ttactccctacactgatg

SEQ ID NO: 2959887 - DNA, 21 bp, Homo sapiens
ttactcctcacacttactgta

SEQ ID NO: 2959888 - DNA, 12 bp, Homo sapiens
ttactcctggct

SEQ ID NO: 2959889 - DNA, 12 bp, Homo sapiens
ttactctaagat

SEQ ID NO: 2959890 - DNA, 22 bp, Homo sapiens
ttactctaagatcttagattct

SEQ ID NO: 2959891 - DNA, 19 bp, Homo sapiens
ttactctccaacctggaca

SEQ ID NO: 2959892 - DNA, 22 bp, Homo sapiens
ttactctgaagggcatcatgca

SEQ ID NO: 2959893 - DNA, 23 bp, Homo sapiens
ttactctggagcaacctactgtc

SEQ ID NO: 2959894 - DNA, 13 bp, Homo sapiens
ttactctgttgaa

SEQ ID NO: 2959895 - DNA, 16 bp, Homo sapiens
ttactctttgctttgt

SEQ ID NO: 2959896 - DNA, 18 bp, Homo sapiens
ttactgaaggtaaaattg

SEQ ID NO: 2959897 - DNA, 20 bp, Homo sapiens
ttactgaaggtaaaattgaa

SEQ ID NO: 2959898 - DNA, 19 bp, Homo sapiens
ttactgaccctggggctgg

SEQ ID NO: 2959899 - DNA, 20 bp, Homo sapiens
ttactgcaacttaacttaaa

SEQ ID NO: 2959900 - DNA, 16 bp, Homo sapiens
ttactgcaatcactgt

SEQ ID NO: 2959901 - DNA, 12 bp, Homo sapiens
ttactgcagttg

SEQ ID NO: 2959902 - DNA, 20 bp, Homo sapiens
ttactgcttaattcaaataa

SEQ ID NO: 2959903 - DNA, 16 bp, Homo sapiens
ttactggcgtggatta

SEQ ID NO: 2959904 - DNA, 22 bp, Homo sapiens
ttactggcgtggattaaactta

SEQ ID NO: 2959905 - DNA, 16 bp, Homo sapiens
ttactggcttctcttg

SEQ ID NO: 2959906 - DNA, 21 bp, Homo sapiens
ttactgggttggaagaaatat

SEQ ID NO: 2959907 - DNA, 15 bp, Homo sapiens
ttactgtaattcctc

SEQ ID NO: 2959908 - DNA, 15 bp, Homo sapiens
ttactgtggctgtct

SEQ ID NO: 2959909 - DNA, 20 bp, Homo sapiens
ttactgtgttttataaaata

SEQ ID NO: 2959910 - DNA, 20 bp, Homo sapiens
ttacttaaagatttatcaaa

SEQ ID NO: 2959911 - DNA, 18 bp, Homo sapiens
ttacttaagattcagttt

SEQ ID NO: 2959912 - DNA, 16 bp, Homo sapiens
ttacttactgctatct

SEQ ID NO: 2959913 - DNA, 19 bp, Homo sapiens
ttagtttctgttctgtgga

SEQ ID NO: 2959914 - DNA, 14 bp, Homo sapiens
ttagttttcttgtt

SEQ ID NO: 2959915 - DNA, 18 bp, Homo sapiens
ttataaaatataaacaaa

SEQ ID NO: 2959916 - DNA, 20 bp, Homo sapiens
ttataaaatataaacaaaga

SEQ ID NO: 2959917 - DNA, 18 bp, Homo sapiens
ttataaaatattgttaat

SEQ ID NO: 2959918 - DNA, 20 bp, Homo sapiens
ttataaaatggctgtaatca

SEQ ID NO: 2959919 - DNA, 13 bp, Homo sapiens
ttataaacagcag

SEQ ID NO: 2959920 - DNA, 15 bp, Homo sapiens
ttataaacagcaggg

SEQ ID NO: 2959921 - DNA, 11 bp, Homo sapiens
ttataaacagt

SEQ ID NO: 2959922 - DNA, 15 bp, Homo sapiens
ttataaacagtttta

SEQ ID NO: 2959923 - DNA, 23 bp, Homo sapiens
ttataaactaaagttgtaccttt

SEQ ID NO: 2959924 - DNA, 16 bp, Homo sapiens
ttataaagccaagaat

SEQ ID NO: 2959925 - DNA, 17 bp, Homo sapiens
ttataaagccaagaatt

SEQ ID NO: 2959926 - DNA, 19 bp, Homo sapiens
ttataaataaactgttgct

SEQ ID NO: 2959927 - DNA, 18 bp, Homo sapiens
ttataaatgttagttcta

SEQ ID NO: 2959928 - DNA, 18 bp, Homo sapiens
ttataactgaaggagaag

SEQ ID NO: 2959929 - DNA, 12 bp, Homo sapiens
ttataagaaaca

SEQ ID NO: 2959930 - DNA, 21 bp, Homo sapiens
ttataagcccaaatggctctg

SEQ ID NO: 2959931 - DNA, 23 bp, Homo sapiens
ttataaggtgttttctgtgtaac

SEQ ID NO: 2959932 - DNA, 17 bp, Homo sapiens
ttataatgccagaatat

SEQ ID NO: 2959933 - DNA, 23 bp, Homo sapiens
ttataatgccagaatataatgtg

SEQ ID NO: 2959934 - DNA, 13 bp, Homo sapiens
ttataatgggtaa

SEQ ID NO: 2959935 - DNA, 16 bp, Homo sapiens
ttatacaacagtgcta

SEQ ID NO: 2959936 - DNA, 21 bp, Homo sapiens
ttatacagagtaattatagga

SEQ ID NO: 2959937 - DNA, 20 bp, Homo sapiens
ttatacagtgtacatgtaca

SEQ ID NO: 2959938 - DNA, 14 bp, Homo sapiens
ttatacatcaatat

SEQ ID NO: 2959939 - DNA, 22 bp, Homo sapiens
ttataccagcaaagagaatgta

SEQ ID NO: 2959940 - DNA, 21 bp, Homo sapiens
ttatacgctggcaacacagag

SEQ ID NO: 2959941 - DNA, 17 bp, Homo sapiens
ttatactctcttccctt

SEQ ID NO: 2959942 - DNA, 16 bp, Homo sapiens
ttatactgcactttag

SEQ ID NO: 2959943 - DNA, 20 bp, Homo sapiens
ttatacttaaacagcttttt

SEQ ID NO: 2959944 - DNA, 18 bp, Homo sapiens
ttatactttgtaaagaca

SEQ ID NO: 2959945 - DNA, 19 bp, Homo sapiens
ttatactttgttgttttta

SEQ ID NO: 2959946 - DNA, 20 bp, Homo sapiens
ttatagaataaaagctgtgg

SEQ ID NO: 2959947 - DNA, 17 bp, Homo sapiens
ttatagacaccctggca

SEQ ID NO: 2959948 - DNA, 14 bp, Homo sapiens
ttatagattctaaa

SEQ ID NO: 2959949 - DNA, 18 bp, Homo sapiens
ttatataatatctaaagt

SEQ ID NO: 2959950 - DNA, 21 bp, Homo sapiens
ttatataatatctaaagttat

SEQ ID NO: 2959951 - DNA, 17 bp, Homo sapiens
ttatatacaataatgga

SEQ ID NO: 2959952 - DNA, 22 bp, Homo sapiens
ttatatacaataatggaaaaaa

SEQ ID NO: 2959953 - DNA, 23 bp, Homo sapiens
ttatatagcaaagatatatattc

SEQ ID NO: 2959954 - DNA, 15 bp, Homo sapiens
ttatatatagaaaag

SEQ ID NO: 2959955 - DNA, 16 bp, Homo sapiens
ttatatattgtctgta

SEQ ID NO: 2959956 - DNA, 12 bp, Homo sapiens
ttatatcaaagt

SEQ ID NO: 2959957 - DNA, 15 bp, Homo sapiens
ttatatctgaagatt

SEQ ID NO: 2959958 - DNA, 14 bp, Homo sapiens
ttatatggaaattc

SEQ ID NO: 2959959 - DNA, 14 bp, Homo sapiens
ttatatgtactgtt

SEQ ID NO: 2959960 - DNA, 16 bp, Homo sapiens
ttatatttcaataaat

SEQ ID NO: 2959961 - DNA, 11 bp, Homo sapiens
ttatatttcag

SEQ ID NO: 2959962 - DNA, 16 bp, Homo sapiens
ttatatttgaaaaaat

SEQ ID NO: 2959963 - DNA, 16 bp, Homo sapiens
ttatattttagaaata

SEQ ID NO: 2959964 - DNA, 22 bp, Homo sapiens
ttatattttagaaataataaaa

SEQ ID NO: 2959965 - DNA, 14 bp, Homo sapiens
ttatattttatact

SEQ ID NO: 2959966 - DNA, 15 bp, Homo sapiens
ttatattttatactg

SEQ ID NO: 2959967 - DNA, 24 bp, Homo sapiens
ttatattttctatttctctgtgta

SEQ ID NO: 2959968 - DNA, 18 bp, Homo sapiens
ttatatttttttaactgt

SEQ ID NO: 2959969 - DNA, 19 bp, Homo sapiens
ttatatttttttaactgtg

SEQ ID NO: 2959970 - DNA, 13 bp, Homo sapiens
ttatcaaatcagt

SEQ ID NO: 2959971 - DNA, 16 bp, Homo sapiens
ttatcaactcaagaat

SEQ ID NO: 2959972 - DNA, 21 bp, Homo sapiens
ttatcaacttcctaaatatta

SEQ ID NO: 2959973 - DNA, 15 bp, Homo sapiens
ttatcaataaagcac

SEQ ID NO: 2959974 - DNA, 18 bp, Homo sapiens
ttatcactgacacaaaaa

SEQ ID NO: 2959975 - DNA, 15 bp, Homo sapiens
ttatcagtcaatatt

SEQ ID NO: 2959976 - DNA, 20 bp, Homo sapiens
ttatcatccacattgtttta

SEQ ID NO: 2959977 - DNA, 11 bp, Homo sapiens
ttatcatgcaa

SEQ ID NO: 2959978 - DNA, 16 bp, Homo sapiens
ttatcatgtaaatgta

SEQ ID NO: 2959979 - DNA, 15 bp, Homo sapiens
ttatcatgtgtaatc

SEQ ID NO: 2959980 - DNA, 11 bp, Homo sapiens
ttatcatttct

SEQ ID NO: 2959981 - DNA, 20 bp, Homo sapiens
ttatcatttctactgaagtt

SEQ ID NO: 2959982 - DNA, 22 bp, Homo sapiens
ttatccaaaagtggaagtgaca

SEQ ID NO: 2959983 - DNA, 17 bp, Homo sapiens
ttatccaaaatgtgtat

SEQ ID NO: 2959984 - DNA, 18 bp, Homo sapiens
ttatccacatgaaaataa

SEQ ID NO: 2959985 - DNA, 14 bp, Homo sapiens
ttatccagaagtat

SEQ ID NO: 2959986 - DNA, 19 bp, Homo sapiens
ttatccatattgagtcaaa

SEQ ID NO: 2959987 - DNA, 23 bp, Homo sapiens
ttatccctctggggggtggggac

SEQ ID NO: 2959988 - DNA, 18 bp, Homo sapiens
ttatccctgcttatctga

SEQ ID NO: 2959989 - DNA, 20 bp, Homo sapiens
ttatcctagcacatgcttca

SEQ ID NO: 2959990 - DNA, 13 bp, Homo sapiens
ttatcctgcaagg

SEQ ID NO: 2959991 - DNA, 12 bp, Homo sapiens
ttatcctgtgct

SEQ ID NO: 2959992 - DNA, 15 bp, Homo sapiens
ttatcctgtgctaca

SEQ ID NO: 2959993 - DNA, 14 bp, Homo sapiens
ttatctaaaagaat

SEQ ID NO: 2959994 - DNA, 14 bp, Homo sapiens
ttatctacccagtc

SEQ ID NO: 2959995 - DNA, 14 bp, Homo sapiens
ttatctatagcaac

SEQ ID NO: 2959996 - DNA, 16 bp, Homo sapiens
ttatctccatactttg

SEQ ID NO: 2959997 - DNA, 20 bp, Homo sapiens
ttatctccctgcttcatatc

SEQ ID NO: 2959998 - DNA, 13 bp, Homo sapiens
ttatctgaaactt

SEQ ID NO: 2959999 - DNA, 22 bp, Homo sapiens
ttatctggaagatctgcaaaca

SEQ ID NO: 2960000 - DNA, 16 bp, Homo sapiens
ttatctgttaaccaaa

SEQ ID NO: 2960001 - DNA, 22 bp, Homo sapiens
ttatctgtttcctgacattgtc

SEQ ID NO: 2960002 - DNA, 16 bp, Homo sapiens
ttatcttaacactgaa

SEQ ID NO: 2960003 - DNA, 20 bp, Homo sapiens
ttatcttaacactgaaattg

SEQ ID NO: 2960004 - DNA, 18 bp, Homo sapiens
ttatcttatactgtacaa

SEQ ID NO: 2960005 - DNA, 20 bp, Homo sapiens
ttatcttatactgtacaata

SEQ ID NO: 2960006 - DNA, 21 bp, Homo sapiens
ttatcttatactgtacaataa

SEQ ID NO: 2960007 - DNA, 15 bp, Homo sapiens
ttatcttgctttgga

SEQ ID NO: 2960008 - DNA, 20 bp, Homo sapiens
ttatcttgttattattgtta

SEQ ID NO: 2960009 - DNA, 16 bp, Homo sapiens
ttatctttagttgaat

SEQ ID NO: 2960010 - DNA, 19 bp, Homo sapiens
ttatgaacacttaaattat

SEQ ID NO: 2960011 - DNA, 23 bp, Homo sapiens
ttatgaagaattgccaatcttgt

SEQ ID NO: 2960012 - DNA, 16 bp, Homo sapiens
ttatgaatattaaagg

SEQ ID NO: 2960013 - DNA, 13 bp, Homo sapiens
ttatgaatgtttc

SEQ ID NO: 2960014 - DNA, 22 bp, Homo sapiens
ttatgacatgaaaagttattta

SEQ ID NO: 2960015 - DNA, 15 bp, Homo sapiens
ttatgagaaagcctt

SEQ ID NO: 2960016 - DNA, 13 bp, Homo sapiens
ttatgagaaatgt

SEQ ID NO: 2960017 - DNA, 14 bp, Homo sapiens
ttatgagaaatgta

SEQ ID NO: 2960018 - DNA, 13 bp, Homo sapiens
ttatgagaacatg

SEQ ID NO: 2960019 - DNA, 19 bp, Homo sapiens
ttatgagatggatcacata

SEQ ID NO: 2960020 - DNA, 17 bp, Homo sapiens
ttatgaggagctgcaga

SEQ ID NO: 2960021 - DNA, 19 bp, Homo sapiens
ttatgaggttgatatcggt

SEQ ID NO: 2960022 - DNA, 19 bp, Homo sapiens
tgtggaccactgcatgagc

SEQ ID NO: 2960023 - DNA, 22 bp, Homo sapiens
tgtggacggcgctgcctcaggc

SEQ ID NO: 2960024 - DNA, 23 bp, Homo sapiens
tgtggactctggtgcctccagag

SEQ ID NO: 2960025 - DNA, 12 bp, Homo sapiens
tgtggactgagc

SEQ ID NO: 2960026 - DNA, 19 bp, Homo sapiens
tgtggactgagcgaggaaa

SEQ ID NO: 2960027 - DNA, 23 bp, Homo sapiens
tgtggactgtggcacttgcctgg

SEQ ID NO: 2960028 - DNA, 18 bp, Homo sapiens
tgtggagacaatgtctgc

SEQ ID NO: 2960029 - DNA, 24 bp, Homo sapiens
tgtggagacaatgtctgcagccct

SEQ ID NO: 2960030 - DNA, 11 bp, Homo sapiens
tgtggagccag

SEQ ID NO: 2960031 - DNA, 13 bp, Homo sapiens
tgtggagccaggc

SEQ ID NO: 2960032 - DNA, 15 bp, Homo sapiens
tgtggagccaggcgt

SEQ ID NO: 2960033 - DNA, 19 bp, Homo sapiens
tgtggaggcagtgtcattt

SEQ ID NO: 2960034 - DNA, 17 bp, Homo sapiens
tgtggagtccagctcta

SEQ ID NO: 2960035 - DNA, 14 bp, Homo sapiens
tgtggagttcctgc

SEQ ID NO: 2960036 - DNA, 22 bp, Homo sapiens
tgtggagttcctgctccgtgga

SEQ ID NO: 2960037 - DNA, 14 bp, Homo sapiens
tgtggataacaaag

SEQ ID NO: 2960038 - DNA, 19 bp, Homo sapiens
tgtggataacaaagatatc

SEQ ID NO: 2960039 - DNA, 22 bp, Homo sapiens
tgtggatgggaggggtccccaa

SEQ ID NO: 2960040 - DNA, 15 bp, Homo sapiens
tgtggattcagcttc

SEQ ID NO: 2960041 - DNA, 14 bp, Homo sapiens
tgtggatttcagtt

SEQ ID NO: 2960042 - DNA, 15 bp, Homo sapiens
tgtggcaagtgaatt

SEQ ID NO: 2960043 - DNA, 15 bp, Homo sapiens
tgtggcacttgcctg

SEQ ID NO: 2960044 - DNA, 13 bp, Homo sapiens
tgtggcagctgcc

SEQ ID NO: 2960045 - DNA, 14 bp, Homo sapiens
tgtggcagctgccc

SEQ ID NO: 2960046 - DNA, 19 bp, Homo sapiens
tgtggcagctgcccctggc

SEQ ID NO: 2960047 - DNA, 19 bp, Homo sapiens
tgtggcagtcccttataat

SEQ ID NO: 2960048 - DNA, 23 bp, Homo sapiens
tgtggcagtttggcaaactctcc

SEQ ID NO: 2960049 - DNA, 14 bp, Homo sapiens
tgtggccaagaaga

SEQ ID NO: 2960050 - DNA, 21 bp, Homo sapiens
tgtggccaaggagctgctata

SEQ ID NO: 2960051 - DNA, 16 bp, Homo sapiens
tgtggccacttctgtc

SEQ ID NO: 2960052 - DNA, 22 bp, Homo sapiens
tgtggccatcactcagccccta

SEQ ID NO: 2960053 - DNA, 17 bp, Homo sapiens
tgtggccatggcctctg

SEQ ID NO: 2960054 - DNA, 18 bp, Homo sapiens
tgtggcccccgccccctc

SEQ ID NO: 2960055 - DNA, 14 bp, Homo sapiens
tgtggccctggcct

SEQ ID NO: 2960056 - DNA, 16 bp, Homo sapiens
tgtggccctgtctgga

SEQ ID NO: 2960057 - DNA, 16 bp, Homo sapiens
tgtggccgccatctgc

SEQ ID NO: 2960058 - DNA, 15 bp, Homo sapiens
tgtggcctaacctgc

SEQ ID NO: 2960059 - DNA, 11 bp, Homo sapiens
tgtggcctgca

SEQ ID NO: 2960060 - DNA, 13 bp, Homo sapiens
tgtggcggtgcct

SEQ ID NO: 2960061 - DNA, 15 bp, Homo sapiens
tgtggctccctctct

SEQ ID NO: 2960062 - DNA, 17 bp, Homo sapiens
tgtggctccctctctcc

SEQ ID NO: 2960063 - DNA, 21 bp, Homo sapiens
tgtggctccctctctcctgga

SEQ ID NO: 2960064 - DNA, 23 bp, Homo sapiens
tgtggcttctctgtctctgtgga

SEQ ID NO: 2960065 - DNA, 15 bp, Homo sapiens
tgtgggaaggccagc

SEQ ID NO: 2960066 - DNA, 21 bp, Homo sapiens
tgtgggaccaggtctgtggaa

SEQ ID NO: 2960067 - DNA, 12 bp, Homo sapiens
tgtgggacccca

SEQ ID NO: 2960068 - DNA, 17 bp, Homo sapiens
tgtgggcgggcccagca

SEQ ID NO: 2960069 - DNA, 17 bp, Homo sapiens
tgtggggctgagctggg

SEQ ID NO: 2960070 - DNA, 14 bp, Homo sapiens
tgtgggtctctgga

SEQ ID NO: 2960071 - DNA, 14 bp, Homo sapiens
tgtgggtctttttc

SEQ ID NO: 2960072 - DNA, 14 bp, Homo sapiens
tgtggtcccaccca

SEQ ID NO: 2960073 - DNA, 19 bp, Homo sapiens
tgtggtcccacccaggaag

SEQ ID NO: 2960074 - DNA, 16 bp, Homo sapiens
tgtggtctttttcctg

SEQ ID NO: 2960075 - DNA, 15 bp, Homo sapiens
tgtggtgaatgtgtg

SEQ ID NO: 2960076 - DNA, 18 bp, Homo sapiens
tgtggtgatgtgcctgta

SEQ ID NO: 2960077 - DNA, 22 bp, Homo sapiens
tgtggtggctccccctctgctt

SEQ ID NO: 2960078 - DNA, 23 bp, Homo sapiens
tgtggttatggggagagggcata

SEQ ID NO: 2960079 - DNA, 14 bp, Homo sapiens
tgtggttgcagtct

SEQ ID NO: 2960080 - DNA, 19 bp, Homo sapiens
tgtggttgcagtctttccc

SEQ ID NO: 2960081 - DNA, 10 bp, Homo sapiens
tgtggttttt

SEQ ID NO: 2960082 - DNA, 15 bp, Homo sapiens
tgtgtaaaaaatgga

SEQ ID NO: 2960083 - DNA, 23 bp, Homo sapiens
tgtgtaaaaaatggaaaaaaaca

SEQ ID NO: 2960084 - DNA, 17 bp, Homo sapiens
tgtgtaaagttagtcta

SEQ ID NO: 2960085 - DNA, 19 bp, Homo sapiens
tgtgtaaatatttttccct

SEQ ID NO: 2960086 - DNA, 14 bp, Homo sapiens
tgtgtaaatttctc

SEQ ID NO: 2960087 - DNA, 14 bp, Homo sapiens
tgtgtaatatgaaa

SEQ ID NO: 2960088 - DNA, 14 bp, Homo sapiens
tgtgtacaaagaaa

SEQ ID NO: 2960089 - DNA, 24 bp, Homo sapiens
tgtgtacatcccatgtaacagaaa

SEQ ID NO: 2960090 - DNA, 15 bp, Homo sapiens
tgttatcttaacact

SEQ ID NO: 2960091 - DNA, 15 bp, Homo sapiens
tgttatcttctcaag

SEQ ID NO: 2960092 - DNA, 20 bp, Homo sapiens
tgttatcttctcaagttcta

SEQ ID NO: 2960093 - DNA, 23 bp, Homo sapiens
tgttattagagattacctcctga

SEQ ID NO: 2960094 - DNA, 19 bp, Homo sapiens
tgttattatatttgacatg

SEQ ID NO: 2960095 - DNA, 13 bp, Homo sapiens
tgttattcttgtt

SEQ ID NO: 2960096 - DNA, 18 bp, Homo sapiens
tgttattgcctaatcact

SEQ ID NO: 2960097 - DNA, 19 bp, Homo sapiens
tgttatttaacccatttgt

SEQ ID NO: 2960098 - DNA, 16 bp, Homo sapiens
tgttattttcagtgat

SEQ ID NO: 2960099 - DNA, 18 bp, Homo sapiens
tgttatttttgtattttt

SEQ ID NO: 2960100 - DNA, 21 bp, Homo sapiens
tgttcaaagccagcgtcctcc

SEQ ID NO: 2960101 - DNA, 22 bp, Homo sapiens
tgttcaaagccagcgtcctcct

SEQ ID NO: 2960102 - DNA, 21 bp, Homo sapiens
tgttcacatatgattctctta

SEQ ID NO: 2960103 - DNA, 17 bp, Homo sapiens
tgttcactgaagacgcc

SEQ ID NO: 2960104 - DNA, 13 bp, Homo sapiens
tgttcactgtccc

SEQ ID NO: 2960105 - DNA, 13 bp, Homo sapiens
tgttcagtaataa

SEQ ID NO: 2960106 - DNA, 17 bp, Homo sapiens
tgttcagtgtaatttct

SEQ ID NO: 2960107 - DNA, 21 bp, Homo sapiens
tgttcagtgtaatttctttgc

SEQ ID NO: 2960108 - DNA, 22 bp, Homo sapiens
tgttcagtgtaatttctttgcc

SEQ ID NO: 2960109 - DNA, 15 bp, Homo sapiens
tgttcagttacagaa

SEQ ID NO: 2960110 - DNA, 16 bp, Homo sapiens
tgttcagttacagaaa

SEQ ID NO: 2960111 - DNA, 23 bp, Homo sapiens
tgttcatacaagccaactggtat

SEQ ID NO: 2960112 - DNA, 12 bp, Homo sapiens
tgttcatacatt

SEQ ID NO: 2960113 - DNA, 14 bp, Homo sapiens
tgttcatttctgtc

SEQ ID NO: 2960114 - DNA, 15 bp, Homo sapiens
tgttcatttctgtct

SEQ ID NO: 2960115 - DNA, 18 bp, Homo sapiens
tgttcatttttctctccc

SEQ ID NO: 2960116 - DNA, 16 bp, Homo sapiens
tgttccaaggccaggg

SEQ ID NO: 2960117 - DNA, 14 bp, Homo sapiens
tgttccaagtctct

SEQ ID NO: 2960118 - DNA, 20 bp, Homo sapiens
tgttccaagtctctgtgtaa

SEQ ID NO: 2960119 - DNA, 18 bp, Homo sapiens
tgttccaggcatccatct

SEQ ID NO: 2960120 - DNA, 18 bp, Homo sapiens
tgttccatgacttcagag

SEQ ID NO: 2960121 - DNA, 17 bp, Homo sapiens
tgttcccacctgctgga

SEQ ID NO: 2960122 - DNA, 20 bp, Homo sapiens
tgttcccatgtagccccctg

SEQ ID NO: 2960123 - DNA, 13 bp, Homo sapiens
tgttccccaccgc

SEQ ID NO: 2960124 - DNA, 14 bp, Homo sapiens
tgttccccttccac

SEQ ID NO: 2960125 - DNA, 17 bp, Homo sapiens
tgttccccttccactga

SEQ ID NO: 2960126 - DNA, 20 bp, Homo sapiens
tgttccccttccactgaggg

SEQ ID NO: 2960127 - DNA, 15 bp, Homo sapiens
tgttcctgagacaga

SEQ ID NO: 2960128 - DNA, 17 bp, Homo sapiens
tgttcctgctttctctt

SEQ ID NO: 2960129 - DNA, 14 bp, Homo sapiens
tgttcctgtgctta

SEQ ID NO: 2960130 - DNA, 19 bp, Homo sapiens
tgttccttagaccttccat

SEQ ID NO: 2960131 - DNA, 15 bp, Homo sapiens
tgttccttctgtgaa

SEQ ID NO: 2960132 - DNA, 17 bp, Homo sapiens
tgttcctttttaaatgt

SEQ ID NO: 2960133 - DNA, 20 bp, Homo sapiens
tgttcgcatggtcacacact

SEQ ID NO: 2960134 - DNA, 23 bp, Homo sapiens
tgttcgcatggtcacacactgat

SEQ ID NO: 2960135 - DNA, 21 bp, Homo sapiens
tgttcggtttttttcctgttt

SEQ ID NO: 2960136 - DNA, 19 bp, Homo sapiens
tgttcgttggttatacaag

SEQ ID NO: 2960137 - DNA, 21 bp, Homo sapiens
tgttcgtttcatcaggctctg

SEQ ID NO: 2960138 - DNA, 14 bp, Homo sapiens
tgttctaaaatgaa

SEQ ID NO: 2960139 - DNA, 16 bp, Homo sapiens
tgttctaaagctctga

SEQ ID NO: 2960140 - DNA, 15 bp, Homo sapiens
tgttctaaggctctg

SEQ ID NO: 2960141 - DNA, 16 bp, Homo sapiens
tgttctaaggctctga

SEQ ID NO: 2960142 - DNA, 23 bp, Homo sapiens
tgttctaaggctctgagagtcta

SEQ ID NO: 2960143 - DNA, 14 bp, Homo sapiens
tgttctaagtttct

SEQ ID NO: 2960144 - DNA, 21 bp, Homo sapiens
tgttctattaatcacctctct

SEQ ID NO: 2960145 - DNA, 18 bp, Homo sapiens
tgttctcacagtgacacc

SEQ ID NO: 2960146 - DNA, 20 bp, Homo sapiens
tgttctcacataacagagta

SEQ ID NO: 2960147 - DNA, 22 bp, Homo sapiens
tgttctcagagcactgtgttca

SEQ ID NO: 2960148 - DNA, 23 bp, Homo sapiens
tgttctcattcctgttctttctt

SEQ ID NO: 2960149 - DNA, 17 bp, Homo sapiens
tgttctcccttcggtgg

SEQ ID NO: 2960150 - DNA, 19 bp, Homo sapiens
tgttctcctaatgctctga

SEQ ID NO: 2960151 - DNA, 22 bp, Homo sapiens
tgttctcctaatgctctgaaag

SEQ ID NO: 2960152 - DNA, 20 bp, Homo sapiens
tgttctcgttgccctaattc

SEQ ID NO: 2960153 - DNA, 15 bp, Homo sapiens
tgttctgaaacctta

SEQ ID NO: 2960154 - DNA, 15 bp, Homo sapiens
tgttctgacagttgt

SEQ ID NO: 2960155 - DNA, 22 bp, Homo sapiens
tgttctggggggacccagtgca

SEQ ID NO: 2960156 - DNA, 17 bp, Homo sapiens
tgttctgtagctttctg

SEQ ID NO: 2960157 - DNA, 20 bp, Homo sapiens
tgttctgtagctttctggaa

SEQ ID NO: 2960158 - DNA, 22 bp, Homo sapiens
tgttctgtgatacagaactctt

SEQ ID NO: 2960159 - DNA, 17 bp, Homo sapiens
tgttcttatagaataaa

SEQ ID NO: 2960160 - DNA, 21 bp, Homo sapiens
tgttcttatagaataaaagct

SEQ ID NO: 2960161 - DNA, 12 bp, Homo sapiens
tgttcttcagtg

SEQ ID NO: 2960162 - DNA, 13 bp, Homo sapiens
tgttcttcagtgt

SEQ ID NO: 2960163 - DNA, 19 bp, Homo sapiens
tgttcttcatctgctatta

SEQ ID NO: 2960164 - DNA, 13 bp, Homo sapiens
tgttgggagaaag

SEQ ID NO: 2960165 - DNA, 20 bp, Homo sapiens
tgttggtcaggctggtctca

SEQ ID NO: 2960166 - DNA, 18 bp, Homo sapiens
tgttggtcctctctctgt

SEQ ID NO: 2960167 - DNA, 11 bp, Homo sapiens
tgttggtgcaa

SEQ ID NO: 2960168 - DNA, 13 bp, Homo sapiens
tgttgtaaagcaa

SEQ ID NO: 2960169 - DNA, 14 bp, Homo sapiens
tgttgtcaagtata

SEQ ID NO: 2960170 - DNA, 21 bp, Homo sapiens
tgttgtctcatagaactgcct

SEQ ID NO: 2960171 - DNA, 14 bp, Homo sapiens
tgttgtgtttctgt

SEQ ID NO: 2960172 - DNA, 15 bp, Homo sapiens
tgttgtttccatagc

SEQ ID NO: 2960173 - DNA, 21 bp, Homo sapiens
tgttgtttccatagctcttca

SEQ ID NO: 2960174 - DNA, 14 bp, Homo sapiens
tgtttaaaaaaaga

SEQ ID NO: 2960175 - DNA, 12 bp, Homo sapiens
tgtttaaaacat

SEQ ID NO: 2960176 - DNA, 12 bp, Homo sapiens
tgtttaaaattc

SEQ ID NO: 2960177 - DNA, 20 bp, Homo sapiens
tgtttaaagaaatatttgga

SEQ ID NO: 2960178 - DNA, 16 bp, Homo sapiens
tgtttaaataaagacc

SEQ ID NO: 2960179 - DNA, 18 bp, Homo sapiens
tgtttaaataaagaccta

SEQ ID NO: 2960180 - DNA, 15 bp, Homo sapiens
tgtttaattgtgata

SEQ ID NO: 2960181 - DNA, 17 bp, Homo sapiens
tgtttactatagaccaa

SEQ ID NO: 2960182 - DNA, 12 bp, Homo sapiens
tgtttactgaaa

SEQ ID NO: 2960183 - DNA, 17 bp, Homo sapiens
tgtttacttaaagattt

SEQ ID NO: 2960184 - DNA, 18 bp, Homo sapiens
tgtttacttaaagattta

SEQ ID NO: 2960185 - DNA, 19 bp, Homo sapiens
tgtttacttaaagatttat

SEQ ID NO: 2960186 - DNA, 23 bp, Homo sapiens
tgtttacttaaagatttatcaaa

SEQ ID NO: 2960187 - DNA, 14 bp, Homo sapiens
tgtttagaagccta

SEQ ID NO: 2960188 - DNA, 23 bp, Homo sapiens
tgtttagattgtattaactatct

SEQ ID NO: 2960189 - DNA, 20 bp, Homo sapiens
tgtttagtaaatacatcact

SEQ ID NO: 2960190 - DNA, 23 bp, Homo sapiens
tgtttagtaaatacatcactgta

SEQ ID NO: 2960191 - DNA, 23 bp, Homo sapiens
tgtttataaaatataaacaaaga

SEQ ID NO: 2960192 - DNA, 22 bp, Homo sapiens
tgtttataactattcagttgtg

SEQ ID NO: 2960193 - DNA, 14 bp, Homo sapiens
tgtttatacagagt

SEQ ID NO: 2960194 - DNA, 18 bp, Homo sapiens
tgtttatgttcttataga

SEQ ID NO: 2960195 - DNA, 22 bp, Homo sapiens
tgtttattaatagaatgataaa

SEQ ID NO: 2960196 - DNA, 16 bp, Homo sapiens
tgtttattcttctaga

SEQ ID NO: 2960197 - DNA, 12 bp, Homo sapiens
tgtttattgcca

SEQ ID NO: 2960198 - DNA, 13 bp, Homo sapiens
tgtttattgccat

SEQ ID NO: 2960199 - DNA, 18 bp, Homo sapiens
tgtttatttttaaatttt

SEQ ID NO: 2960200 - DNA, 16 bp, Homo sapiens
tgtttcaaaataaaaa

SEQ ID NO: 2960201 - DNA, 17 bp, Homo sapiens
tgtttcaaacacaaatg

SEQ ID NO: 2960202 - DNA, 18 bp, Homo sapiens
tgtttcaaacacaaatgc

SEQ ID NO: 2960203 - DNA, 19 bp, Homo sapiens
tgtttcaaacacaaatgca

SEQ ID NO: 2960204 - DNA, 21 bp, Homo sapiens
tgtttcaaggcactctagatt

SEQ ID NO: 2960205 - DNA, 15 bp, Homo sapiens
tgtttcaatcactgt

SEQ ID NO: 2960206 - DNA, 22 bp, Homo sapiens
tgtttcactgaaatgtttggat

SEQ ID NO: 2960207 - DNA, 10 bp, Homo sapiens
tgtttcagtg

SEQ ID NO: 2960208 - DNA, 21 bp, Homo sapiens
tgtttcagtgaatatgcctgt

SEQ ID NO: 2960209 - DNA, 15 bp, Homo sapiens
tgtttccaccaaatg

SEQ ID NO: 2960210 - DNA, 23 bp, Homo sapiens
tgtttccagacttccttgagaca

SEQ ID NO: 2960211 - DNA, 18 bp, Homo sapiens
tgtttccatagctcttca

SEQ ID NO: 2960212 - DNA, 12 bp, Homo sapiens
tgtttcccccac

SEQ ID NO: 2960213 - DNA, 21 bp, Homo sapiens
tgtttcctaatatcaaatgca

SEQ ID NO: 2960214 - DNA, 21 bp, Homo sapiens
tgtttcctgacattgtctcct

SEQ ID NO: 2960215 - DNA, 14 bp, Homo sapiens
tgtttcctggaagc

SEQ ID NO: 2960216 - DNA, 19 bp, Homo sapiens
tgtttcctggaagcagagc

SEQ ID NO: 2960217 - DNA, 14 bp, Homo sapiens
tgtttcctgtctga

SEQ ID NO: 2960218 - DNA, 12 bp, Homo sapiens
tgtttccttcag

SEQ ID NO: 2960219 - DNA, 23 bp, Homo sapiens
tgtttccttttggcctcctgcaa

SEQ ID NO: 2960220 - DNA, 15 bp, Homo sapiens
tgtttcgtgaagtat

SEQ ID NO: 2960221 - DNA, 17 bp, Homo sapiens
tgtttctactttgatat

SEQ ID NO: 2960222 - DNA, 14 bp, Homo sapiens
tgtttctctgagct

SEQ ID NO: 2960223 - DNA, 24 bp, Homo sapiens
tgtttctctgagctttgttactga

SEQ ID NO: 2960224 - DNA, 14 bp, Homo sapiens
tgtttctgaaaaga

SEQ ID NO: 2960225 - DNA, 16 bp, Homo sapiens
tgtttctgaaaagaaa

SEQ ID NO: 2960226 - DNA, 15 bp, Homo sapiens
tgtttctgaatgttt

SEQ ID NO: 2960227 - DNA, 14 bp, Homo sapiens
tgtttctgtgggcg

SEQ ID NO: 2960228 - DNA, 13 bp, Homo sapiens
tgtttctgtgtca

SEQ ID NO: 2960229 - DNA, 18 bp, Homo sapiens
tgtttcttattctctgtt

SEQ ID NO: 2960230 - DNA, 16 bp, Homo sapiens
tgtttgaaatcatcgg

SEQ ID NO: 2960231 - DNA, 21 bp, Homo sapiens
tgtttgacaataatctcacaa

SEQ ID NO: 2960232 - DNA, 21 bp, Homo sapiens
tgtttgacgggaaacaaaact

SEQ ID NO: 2960233 - DNA, 14 bp, Homo sapiens
tgtttgattttcat

SEQ ID NO: 2960234 - DNA, 22 bp, Homo sapiens
tgtttgcacctttctagttgaa

SEQ ID NO: 2960235 - DNA, 23 bp, Homo sapiens
tgtttgcacgttatggtgtttct

SEQ ID NO: 2960236 - DNA, 12 bp, Homo sapiens
tgtttgccaaat

SEQ ID NO: 2960237 - DNA, 15 bp, Homo sapiens
tgtttgccaaataaa

SEQ ID NO: 2960238 - DNA, 20 bp, Homo sapiens
tgtttgccaaataaaaaaca

SEQ ID NO: 2960239 - DNA, 15 bp, Homo sapiens
tgtttgccatacttt

SEQ ID NO: 2960240 - DNA, 22 bp, Homo sapiens
tgtttgccatactttgtctgaa

SEQ ID NO: 2960241 - DNA, 16 bp, Homo sapiens
tgtttgcttcaccgtg

SEQ ID NO: 2960242 - DNA, 13 bp, Homo sapiens
tgtttggctttca

SEQ ID NO: 2960243 - DNA, 14 bp, Homo sapiens
tgtttggctttcag

SEQ ID NO: 2960244 - DNA, 19 bp, Homo sapiens
tgtttgggggacgtttctc

SEQ ID NO: 2960245 - DNA, 21 bp, Homo sapiens
tgtttgggggacgtttctcat

SEQ ID NO: 2960246 - DNA, 16 bp, Homo sapiens
ttgagaggctgaggtg

SEQ ID NO: 2960247 - DNA, 17 bp, Homo sapiens
ttgagagtgttcctgag

SEQ ID NO: 2960248 - DNA, 23 bp, Homo sapiens
ttgagagttcgtgaagagggaag

SEQ ID NO: 2960249 - DNA, 20 bp, Homo sapiens
ttgagatactattttcattt

SEQ ID NO: 2960250 - DNA, 21 bp, Homo sapiens
ttgagatactattttcatttt

SEQ ID NO: 2960251 - DNA, 21 bp, Homo sapiens
ttgagatggagtttctctctt

SEQ ID NO: 2960252 - DNA, 23 bp, Homo sapiens
ttgagcactggtctctcttggaa

SEQ ID NO: 2960253 - DNA, 15 bp, Homo sapiens
ttgagcatcacagaa

SEQ ID NO: 2960254 - DNA, 15 bp, Homo sapiens
ttgagccatgagtgg

SEQ ID NO: 2960255 - DNA, 22 bp, Homo sapiens
ttgagccctccccaggaatttg

SEQ ID NO: 2960256 - DNA, 18 bp, Homo sapiens
ttgagcctgtgaccttgg

SEQ ID NO: 2960257 - DNA, 23 bp, Homo sapiens
ttgaggaaaacaagcattcacaa

SEQ ID NO: 2960258 - DNA, 18 bp, Homo sapiens
ttgaggaaacaacagctt

SEQ ID NO: 2960259 - DNA, 15 bp, Homo sapiens
ttgagggaatgacac

SEQ ID NO: 2960260 - DNA, 20 bp, Homo sapiens
ttgagggatttttttataaa

SEQ ID NO: 2960261 - DNA, 18 bp, Homo sapiens
ttgaggtcttttacatac

SEQ ID NO: 2960262 - DNA, 14 bp, Homo sapiens
ttgagtaggccctg

SEQ ID NO: 2960263 - DNA, 14 bp, Homo sapiens
ttgagtctattttt

SEQ ID NO: 2960264 - DNA, 22 bp, Homo sapiens
ttgagtctcaagggtggcaggt

SEQ ID NO: 2960265 - DNA, 19 bp, Homo sapiens
ttgagtggatgatgtttcg

SEQ ID NO: 2960266 - DNA, 13 bp, Homo sapiens
ttgagttacatta

SEQ ID NO: 2960267 - DNA, 20 bp, Homo sapiens
ttgagtttcagctggaaact

SEQ ID NO: 2960268 - DNA, 16 bp, Homo sapiens
ttgagtttgacattta

SEQ ID NO: 2960269 - DNA, 12 bp, Homo sapiens
ttgataaagttt

SEQ ID NO: 2960270 - DNA, 12 bp, Homo sapiens
ttgataaatgga

SEQ ID NO: 2960271 - DNA, 15 bp, Homo sapiens
ttgataacattttgt

SEQ ID NO: 2960272 - DNA, 15 bp, Homo sapiens
ttgataatttcaggg

SEQ ID NO: 2960273 - DNA, 16 bp, Homo sapiens
ttgatactgcaataaa

SEQ ID NO: 2960274 - DNA, 18 bp, Homo sapiens
ttgatagatgtttgactt

SEQ ID NO: 2960275 - DNA, 23 bp, Homo sapiens
ttgatagggtctaccaatacaaa

SEQ ID NO: 2960276 - DNA, 17 bp, Homo sapiens
ttgatagtgcttcttgt

SEQ ID NO: 2960277 - DNA, 21 bp, Homo sapiens
ttgatatgttttatttcattg

SEQ ID NO: 2960278 - DNA, 17 bp, Homo sapiens
ttgatattgtgaacatt

SEQ ID NO: 2960279 - DNA, 13 bp, Homo sapiens
ttgatcagacagc

SEQ ID NO: 2960280 - DNA, 15 bp, Homo sapiens
ttgatcatgtacttt

SEQ ID NO: 2960281 - DNA, 18 bp, Homo sapiens
ttgatccatccagcttgc

SEQ ID NO: 2960282 - DNA, 19 bp, Homo sapiens
ttgatctcctgacctcatg

SEQ ID NO: 2960283 - DNA, 14 bp, Homo sapiens
ttgatctggaaccc

SEQ ID NO: 2960284 - DNA, 14 bp, Homo sapiens
ttgatcttaaagat

SEQ ID NO: 2960285 - DNA, 20 bp, Homo sapiens
ttgatgaccaaagtcctttt

SEQ ID NO: 2960286 - DNA, 16 bp, Homo sapiens
ttgatgactggcattt

SEQ ID NO: 2960287 - DNA, 14 bp, Homo sapiens
ttgatgattcactg

SEQ ID NO: 2960288 - DNA, 15 bp, Homo sapiens
ttgatgcttttctct

SEQ ID NO: 2960289 - DNA, 16 bp, Homo sapiens
ttgatggagtgtgagc

SEQ ID NO: 2960290 - DNA, 21 bp, Homo sapiens
ttgatggagtgtgagccacct

SEQ ID NO: 2960291 - DNA, 16 bp, Homo sapiens
ttgatgttaacacatt

SEQ ID NO: 2960292 - DNA, 12 bp, Homo sapiens
ttgatgttttct

SEQ ID NO: 2960293 - DNA, 15 bp, Homo sapiens
ttgattaaaatctct

SEQ ID NO: 2960294 - DNA, 22 bp, Homo sapiens
ttgattaagatctcagtggtta

SEQ ID NO: 2960295 - DNA, 17 bp, Homo sapiens
ttgattacagtgcagtg

SEQ ID NO: 2960296 - DNA, 14 bp, Homo sapiens
ttgattagtataat

SEQ ID NO: 2960297 - DNA, 17 bp, Homo sapiens
ttgattattcagtgtca

SEQ ID NO: 2960298 - DNA, 15 bp, Homo sapiens
ttgattcaaaatatt

SEQ ID NO: 2960299 - DNA, 22 bp, Homo sapiens
ttgattcaaaatatttaaaaat

SEQ ID NO: 2960300 - DNA, 15 bp, Homo sapiens
ttgattcatgttcat

SEQ ID NO: 2960301 - DNA, 22 bp, Homo sapiens
ttgattcgtctgcgattttatc

SEQ ID NO: 2960302 - DNA, 18 bp, Homo sapiens
ttgattctgcttgagaat

SEQ ID NO: 2960303 - DNA, 13 bp, Homo sapiens
ttgattgtgcatg

SEQ ID NO: 2960304 - DNA, 14 bp, Homo sapiens
ttgatttaaaagtg

SEQ ID NO: 2960305 - DNA, 17 bp, Homo sapiens
ttgatttcgatgtacag

SEQ ID NO: 2960306 - DNA, 15 bp, Homo sapiens
ttgatttgcattgaa

SEQ ID NO: 2960307 - DNA, 13 bp, Homo sapiens
ttgattttacaat

SEQ ID NO: 2960308 - DNA, 12 bp, Homo sapiens
ttgatttttatc

SEQ ID NO: 2960309 - DNA, 15 bp, Homo sapiens
ttgcaaaaactacaa

SEQ ID NO: 2960310 - DNA, 20 bp, Homo sapiens
ttgcaaaaactacaaccaat

SEQ ID NO: 2960311 - DNA, 13 bp, Homo sapiens
ttgcaaagtactg

SEQ ID NO: 2960312 - DNA, 17 bp, Homo sapiens
ttgcaaagtattgtaaa

SEQ ID NO: 2960313 - DNA, 20 bp, Homo sapiens
ttgcaaagtattgtaaatta

SEQ ID NO: 2960314 - DNA, 21 bp, Homo sapiens
ttgcaaagtattgtaaattat

SEQ ID NO: 2960315 - DNA, 17 bp, Homo sapiens
ttgcaaatcttgaaatt

SEQ ID NO: 2960316 - DNA, 13 bp, Homo sapiens
ttgcaagggaaaa

SEQ ID NO: 2960317 - DNA, 15 bp, Homo sapiens
ttgcaaggttccaca

SEQ ID NO: 2960318 - DNA, 23 bp, Homo sapiens
ttgcaataacttctatattttaa

SEQ ID NO: 2960319 - DNA, 15 bp, Homo sapiens
ttgcaataatgcagt

SEQ ID NO: 2960320 - DNA, 21 bp, Homo sapiens
ttgcaataatgcagtatggta

SEQ ID NO: 2960321 - DNA, 13 bp, Homo sapiens
ttgcaatgcagag

SEQ ID NO: 2960322 - DNA, 20 bp, Homo sapiens
ttgcaatgcagaggttgaga

SEQ ID NO: 2960323 - DNA, 20 bp, Homo sapiens
ttgcacagagggcgctcctg

SEQ ID NO: 2960324 - DNA, 16 bp, Homo sapiens
ttgcacagttagcaaa

SEQ ID NO: 2960325 - DNA, 14 bp, Homo sapiens
ttgcacattgttca

SEQ ID NO: 2960326 - DNA, 21 bp, Homo sapiens
ttgcaccaattaagtgttgaa

SEQ ID NO: 2960327 - DNA, 23 bp, Homo sapiens
ttgcaccattctttcttggtgca

SEQ ID NO: 2960328 - DNA, 19 bp, Homo sapiens
ttgcaccgcctgccctccc

SEQ ID NO: 2960329 - DNA, 16 bp, Homo sapiens
ttgcacctatctcagc

SEQ ID NO: 2960330 - DNA, 21 bp, Homo sapiens
ttgcacctatctcagccatag

SEQ ID NO: 2960331 - DNA, 18 bp, Homo sapiens
ttgcactcaagttgttta

SEQ ID NO: 2960332 - DNA, 14 bp, Homo sapiens
ttgcactgaaaacc

SEQ ID NO: 2960333 - DNA, 11 bp, Homo sapiens
ttgcactgaag

SEQ ID NO: 2960334 - DNA, 12 bp, Homo sapiens
ttgcactgaagt

SEQ ID NO: 2960335 - DNA, 17 bp, Homo sapiens
ttgcactggagttctat

SEQ ID NO: 2960336 - DNA, 11 bp, Homo sapiens
ttgcactgtct

SEQ ID NO: 2960337 - DNA, 22 bp, Homo sapiens
ttgcacttttgaatgtccaaaa

SEQ ID NO: 2960338 - DNA, 19 bp, Homo sapiens
ttgcagaactaaactcatt

SEQ ID NO: 2960339 - DNA, 13 bp, Homo sapiens
ttgcagaagaggg

SEQ ID NO: 2960340 - DNA, 15 bp, Homo sapiens
ttgcagacaggaatc

SEQ ID NO: 2960341 - DNA, 21 bp, Homo sapiens
ttgcagacagtgttttgcaca

SEQ ID NO: 2960342 - DNA, 12 bp, Homo sapiens
ttgcagaggagc

SEQ ID NO: 2960343 - DNA, 19 bp, Homo sapiens
ttgcagaggagcccagtgg

SEQ ID NO: 2960344 - DNA, 19 bp, Homo sapiens
ttgcagaggtccaaatgat

SEQ ID NO: 2960345 - DNA, 13 bp, Homo sapiens
ttgcagatggaaa

SEQ ID NO: 2960346 - DNA, 13 bp, Homo sapiens
ttgcagccaggag

SEQ ID NO: 2960347 - DNA, 23 bp, Homo sapiens
ttgcagccatgaagggatgctag

SEQ ID NO: 2960348 - DNA, 21 bp, Homo sapiens
ttgcagcccttgtgatgtgat

SEQ ID NO: 2960349 - DNA, 21 bp, Homo sapiens
ttgcaggaaggagccagactt

SEQ ID NO: 2960350 - DNA, 19 bp, Homo sapiens
ttgcaggagacattttcat

SEQ ID NO: 2960351 - DNA, 20 bp, Homo sapiens
ttgcaggagcgtgaaggact

SEQ ID NO: 2960352 - DNA, 22 bp, Homo sapiens
ttgcaggcggccctcagtgcat

SEQ ID NO: 2960353 - DNA, 21 bp, Homo sapiens
ttgcaggctggctttggaata

SEQ ID NO: 2960354 - DNA, 16 bp, Homo sapiens
ttgcagggcacagatg

SEQ ID NO: 2960355 - DNA, 18 bp, Homo sapiens
ttgcaggggactgggcca

SEQ ID NO: 2960356 - DNA, 17 bp, Homo sapiens
ttgcagggtcctcttct

SEQ ID NO: 2960357 - DNA, 23 bp, Homo sapiens
ttgcagtccttttactacagcta

SEQ ID NO: 2960358 - DNA, 16 bp, Homo sapiens
ttgcagtctttccccc

SEQ ID NO: 2960359 - DNA, 16 bp, Homo sapiens
ttgcagttctgattca

SEQ ID NO: 2960360 - DNA, 21 bp, Homo sapiens
ttgcagtttaagatgacactt

SEQ ID NO: 2960361 - DNA, 20 bp, Homo sapiens
ttgcagtttatatatatgct

SEQ ID NO: 2960362 - DNA, 18 bp, Homo sapiens
ttgcagtttatcattcaa

SEQ ID NO: 2960363 - DNA, 23 bp, Homo sapiens
ttgcagtttatcattcaagtgta

SEQ ID NO: 2960364 - DNA, 17 bp, Homo sapiens
ttgcatagcagctgcta

SEQ ID NO: 2960365 - DNA, 19 bp, Homo sapiens
ttgcatcgtcccctccccc

SEQ ID NO: 2960366 - DNA, 18 bp, Homo sapiens
ttgcatgggctaatgaag

SEQ ID NO: 2960367 - DNA, 21 bp, Homo sapiens
ttgcatgtctaattcatttac

SEQ ID NO: 2960368 - DNA, 20 bp, Homo sapiens
ttgcatgtgaaaatcaaata

SEQ ID NO: 2960369 - DNA, 17 bp, Homo sapiens
ttgcattacgataaaca

SEQ ID NO: 2960370 - DNA, 18 bp, Homo sapiens
ttgcattacgataaacat

SEQ ID NO: 2960371 - DNA, 14 bp, Homo sapiens
ttgcattgaacaca

SEQ ID NO: 2960372 - DNA, 18 bp, Homo sapiens
ttgcattgaacacaaact

SEQ ID NO: 2960373 - DNA, 23 bp, Homo sapiens
ttgcattgaatttagtcattatt

SEQ ID NO: 2960374 - DNA, 21 bp, Homo sapiens
ttgcattgaccgcgactaatt

SEQ ID NO: 2960375 - DNA, 20 bp, Homo sapiens
ttgcatttattgcagtttat

SEQ ID NO: 2960376 - DNA, 13 bp, Homo sapiens
ttgcatttgtacc

SEQ ID NO: 2960377 - DNA, 15 bp, Homo sapiens
ttgccaaaaaggata

SEQ ID NO: 2960378 - DNA, 16 bp, Homo sapiens
ttatgatagtgcaagg

SEQ ID NO: 2960379 - DNA, 16 bp, Homo sapiens
ttatgcacttataagg

SEQ ID NO: 2960380 - DNA, 19 bp, Homo sapiens
ttatgcacttataaggtgt

SEQ ID NO: 2960381 - DNA, 17 bp, Homo sapiens
ttatgcatttggaatta

SEQ ID NO: 2960382 - DNA, 16 bp, Homo sapiens
ttatgccacctgaata

SEQ ID NO: 2960383 - DNA, 20 bp, Homo sapiens
ttatgccccagttcagaaat

SEQ ID NO: 2960384 - DNA, 17 bp, Homo sapiens
ttatgccttttttgatc

SEQ ID NO: 2960385 - DNA, 21 bp, Homo sapiens
ttatgctataaattttttgaa

SEQ ID NO: 2960386 - DNA, 16 bp, Homo sapiens
ttatgcttaaattcaa

SEQ ID NO: 2960387 - DNA, 14 bp, Homo sapiens
ttatggaacaggga

SEQ ID NO: 2960388 - DNA, 19 bp, Homo sapiens
ttatggaattgatttgcat

SEQ ID NO: 2960389 - DNA, 20 bp, Homo sapiens
ttatggaattgatttgcatt

SEQ ID NO: 2960390 - DNA, 16 bp, Homo sapiens
ttatgggtttcttcca

SEQ ID NO: 2960391 - DNA, 16 bp, Homo sapiens
ttatggttctgcagtc

SEQ ID NO: 2960392 - DNA, 20 bp, Homo sapiens
ttatgtaaaatgttttagca

SEQ ID NO: 2960393 - DNA, 14 bp, Homo sapiens
ttatgtagacattg

SEQ ID NO: 2960394 - DNA, 15 bp, Homo sapiens
ttatgtagacattgt

SEQ ID NO: 2960395 - DNA, 16 bp, Homo sapiens
ttatgtagacattgta

SEQ ID NO: 2960396 - DNA, 23 bp, Homo sapiens
ttatgtagacattgtaaataaat

SEQ ID NO: 2960397 - DNA, 15 bp, Homo sapiens
ttatgtagtaattga

SEQ ID NO: 2960398 - DNA, 19 bp, Homo sapiens
ttatgtagtaattgacatg

SEQ ID NO: 2960399 - DNA, 16 bp, Homo sapiens
ttccagaatgctgtac

SEQ ID NO: 2960400 - DNA, 18 bp, Homo sapiens
ttccagaatgctgtacat

SEQ ID NO: 2960401 - DNA, 19 bp, Homo sapiens
ttccagaatgctgtacatc

SEQ ID NO: 2960402 - DNA, 15 bp, Homo sapiens
ttccagagctgcttc

SEQ ID NO: 2960403 - DNA, 21 bp, Homo sapiens
ttccagagctgcttctgtctg

SEQ ID NO: 2960404 - DNA, 17 bp, Homo sapiens
ttccagatgtaggcatt

SEQ ID NO: 2960405 - DNA, 12 bp, Homo sapiens
ttccagcaaaat

SEQ ID NO: 2960406 - DNA, 21 bp, Homo sapiens
ttccagcaaaatccaaactgc

SEQ ID NO: 2960407 - DNA, 22 bp, Homo sapiens
ttccagcaattctcctgcctca

SEQ ID NO: 2960408 - DNA, 21 bp, Homo sapiens
ttccagcatttagctggccac

SEQ ID NO: 2960409 - DNA, 14 bp, Homo sapiens
ttccagctactttt

SEQ ID NO: 2960410 - DNA, 18 bp, Homo sapiens
ttccagctggatgagaat

SEQ ID NO: 2960411 - DNA, 13 bp, Homo sapiens
ttccagcttttgt

SEQ ID NO: 2960412 - DNA, 22 bp, Homo sapiens
ttccaggactctctgcttggat

SEQ ID NO: 2960413 - DNA, 23 bp, Homo sapiens
ttccaggcttccctgacttgctt

SEQ ID NO: 2960414 - DNA, 20 bp, Homo sapiens
ttccagtcctaacaaatgct

SEQ ID NO: 2960415 - DNA, 13 bp, Homo sapiens
ttccatagctctt

SEQ ID NO: 2960416 - DNA, 20 bp, Homo sapiens
ttccatatccttctggctgt

SEQ ID NO: 2960417 - DNA, 18 bp, Homo sapiens
ttccatccttgactgaag

SEQ ID NO: 2960418 - DNA, 13 bp, Homo sapiens
ttccatctttaca

SEQ ID NO: 2960419 - DNA, 14 bp, Homo sapiens
ttccatgacatttt

SEQ ID NO: 2960420 - DNA, 15 bp, Homo sapiens
ttccatgctcccaac

SEQ ID NO: 2960421 - DNA, 18 bp, Homo sapiens
ttccatgctcccaactcc

SEQ ID NO: 2960422 - DNA, 16 bp, Homo sapiens
ttccatggccctcatt

SEQ ID NO: 2960423 - DNA, 18 bp, Homo sapiens
ttccatggcttcctgaga

SEQ ID NO: 2960424 - DNA, 17 bp, Homo sapiens
ttccatgtgttttgctt

SEQ ID NO: 2960425 - DNA, 16 bp, Homo sapiens
ttccatgttttaaaat

SEQ ID NO: 2960426 - DNA, 18 bp, Homo sapiens
ttccattctttcttcctc

SEQ ID NO: 2960427 - DNA, 16 bp, Homo sapiens
ttccattggatctcat

SEQ ID NO: 2960428 - DNA, 17 bp, Homo sapiens
ttccattggatctcatt

SEQ ID NO: 2960429 - DNA, 19 bp, Homo sapiens
ttccattggtccaagattc

SEQ ID NO: 2960430 - DNA, 20 bp, Homo sapiens
ttccattggtccaagattcc

SEQ ID NO: 2960431 - DNA, 22 bp, Homo sapiens
ttccattgtttgaaacaaagaa

SEQ ID NO: 2960432 - DNA, 13 bp, Homo sapiens
ttccatttgcaag

SEQ ID NO: 2960433 - DNA, 14 bp, Homo sapiens
ttccattttaagtg

SEQ ID NO: 2960434 - DNA, 21 bp, Homo sapiens
ttccattttctataagaaaaa

SEQ ID NO: 2960435 - DNA, 23 bp, Homo sapiens
ttcccaatagcaacgtagcttct

SEQ ID NO: 2960436 - DNA, 19 bp, Homo sapiens
ttcccaatggtgtttttct

SEQ ID NO: 2960437 - DNA, 21 bp, Homo sapiens
ttcccaatggtgtttttcttg

SEQ ID NO: 2960438 - DNA, 17 bp, Homo sapiens
ttcccacaagcctgcct

SEQ ID NO: 2960439 - DNA, 22 bp, Homo sapiens
ttcccacatctttcctcaagta

SEQ ID NO: 2960440 - DNA, 15 bp, Homo sapiens
ttcccacgacaaaaa

SEQ ID NO: 2960441 - DNA, 14 bp, Homo sapiens
ttcccacgaggaat

SEQ ID NO: 2960442 - DNA, 13 bp, Homo sapiens
ttcccactcacct

SEQ ID NO: 2960443 - DNA, 11 bp, Homo sapiens
ttcccactgca

SEQ ID NO: 2960444 - DNA, 16 bp, Homo sapiens
ttcccactttcattca

SEQ ID NO: 2960445 - DNA, 16 bp, Homo sapiens
ttcccactttttggta

SEQ ID NO: 2960446 - DNA, 15 bp, Homo sapiens
ttcccagagacagga

SEQ ID NO: 2960447 - DNA, 19 bp, Homo sapiens
ttcccagctctccctctgg

SEQ ID NO: 2960448 - DNA, 23 bp, Homo sapiens
ttcccagctctccctctggccct

SEQ ID NO: 2960449 - DNA, 12 bp, Homo sapiens
ttcccaggaccc

SEQ ID NO: 2960450 - DNA, 15 bp, Homo sapiens
ttcccaggagaccat

SEQ ID NO: 2960451 - DNA, 16 bp, Homo sapiens
ttcccaggagaccatt

SEQ ID NO: 2960452 - DNA, 21 bp, Homo sapiens
ttcccaggatctgctccaaca

SEQ ID NO: 2960453 - DNA, 14 bp, Homo sapiens
ttcccaggccaggg

SEQ ID NO: 2960454 - DNA, 17 bp, Homo sapiens
ttcccaggccagggctg

SEQ ID NO: 2960455 - DNA, 18 bp, Homo sapiens
ttcccaggccagggctgg

SEQ ID NO: 2960456 - DNA, 21 bp, Homo sapiens
ttcccaggccagggctgggtc

SEQ ID NO: 2960457 - DNA, 13 bp, Homo sapiens
ttcccatagattt

SEQ ID NO: 2960458 - DNA, 23 bp, Homo sapiens
ttcccatcactggagcaccaggc

SEQ ID NO: 2960459 - DNA, 17 bp, Homo sapiens
ttcccattggatgcatt

SEQ ID NO: 2960460 - DNA, 21 bp, Homo sapiens
ttcccattggatgcatttcta

SEQ ID NO: 2960461 - DNA, 13 bp, Homo sapiens
ttccccaacagtg

SEQ ID NO: 2960462 - DNA, 13 bp, Homo sapiens
ttccccagacttg

SEQ ID NO: 2960463 - DNA, 14 bp, Homo sapiens
ttccccagacttgc

SEQ ID NO: 2960464 - DNA, 12 bp, Homo sapiens
ttccccagccac

SEQ ID NO: 2960465 - DNA, 20 bp, Homo sapiens
ttccccatatttgtgttcag

SEQ ID NO: 2960466 - DNA, 16 bp, Homo sapiens
ttccccggtcccttga

SEQ ID NO: 2960467 - DNA, 16 bp, Homo sapiens
ttcccctcccccactc

SEQ ID NO: 2960468 - DNA, 21 bp, Homo sapiens
ttcccctggggacccacgtgg

SEQ ID NO: 2960469 - DNA, 14 bp, Homo sapiens
ttccccttccactg

SEQ ID NO: 2960470 - DNA, 14 bp, Homo sapiens
ttccccttccctca

SEQ ID NO: 2960471 - DNA, 17 bp, Homo sapiens
ttccccttccttttaag

SEQ ID NO: 2960472 - DNA, 16 bp, Homo sapiens
ttccccttttgccaat

SEQ ID NO: 2960473 - DNA, 14 bp, Homo sapiens
ttcccgcctcagcc

SEQ ID NO: 2960474 - DNA, 13 bp, Homo sapiens
ttcccgttcttaa

SEQ ID NO: 2960475 - DNA, 15 bp, Homo sapiens
ttccctagactctgt

SEQ ID NO: 2960476 - DNA, 17 bp, Homo sapiens
ttccctcactcttcctc

SEQ ID NO: 2960477 - DNA, 16 bp, Homo sapiens
ttccctccgggcaggg

SEQ ID NO: 2960478 - DNA, 15 bp, Homo sapiens
ttccctcctgctact

SEQ ID NO: 2960479 - DNA, 16 bp, Homo sapiens
ttccctcttgtgctca

SEQ ID NO: 2960480 - DNA, 17 bp, Homo sapiens
ttccctcttgtgctcag

SEQ ID NO: 2960481 - DNA, 23 bp, Homo sapiens
ttccctcttgtgctcagtcgccc

SEQ ID NO: 2960482 - DNA, 16 bp, Homo sapiens
ttccctgaaggaacca

SEQ ID NO: 2960483 - DNA, 16 bp, Homo sapiens
ttccctgagtcaccag

SEQ ID NO: 2960484 - DNA, 15 bp, Homo sapiens
ttccctgcccctgtg

SEQ ID NO: 2960485 - DNA, 18 bp, Homo sapiens
ttccctgcctccagctgt

SEQ ID NO: 2960486 - DNA, 20 bp, Homo sapiens
ttccctgcctccagctgtca

SEQ ID NO: 2960487 - DNA, 20 bp, Homo sapiens
ttccctggggaaaacttgca

SEQ ID NO: 2960488 - DNA, 20 bp, Homo sapiens
ttccctgttctttaagactt

SEQ ID NO: 2960489 - DNA, 13 bp, Homo sapiens
ttcccttcagtac

SEQ ID NO: 2960490 - DNA, 20 bp, Homo sapiens
ttcccttgaccattggctgc

SEQ ID NO: 2960491 - DNA, 19 bp, Homo sapiens
ttccctttgcttgtcttct

SEQ ID NO: 2960492 - DNA, 17 bp, Homo sapiens
ttccctttggagatgct

SEQ ID NO: 2960493 - DNA, 18 bp, Homo sapiens
ttcccttttacatactgc

SEQ ID NO: 2960494 - DNA, 20 bp, Homo sapiens
ttcccttttggggcaagaca

SEQ ID NO: 2960495 - DNA, 21 bp, Homo sapiens
ttccgcgcggagacctcctga

SEQ ID NO: 2960496 - DNA, 13 bp, Homo sapiens
ttccgggagctgg

SEQ ID NO: 2960497 - DNA, 23 bp, Homo sapiens
ttccgtcacccttggtagagttt

SEQ ID NO: 2960498 - DNA, 15 bp, Homo sapiens
ttccgtcccccccca

SEQ ID NO: 2960499 - DNA, 22 bp, Homo sapiens
ttccgtgagctatgataagatt

SEQ ID NO: 2960500 - DNA, 15 bp, Homo sapiens
ttccgtttgcttttg

SEQ ID NO: 2960501 - DNA, 16 bp, Homo sapiens
ttcctaaatattatga

SEQ ID NO: 2960502 - DNA, 13 bp, Homo sapiens
ttcctaacttatt

SEQ ID NO: 2960503 - DNA, 19 bp, Homo sapiens
ttcctaagcctgtggctgt

SEQ ID NO: 2960504 - DNA, 20 bp, Homo sapiens
ttcctaaggccactgtttta

SEQ ID NO: 2960505 - DNA, 23 bp, Homo sapiens
ttcctacccacttaggctttgta

SEQ ID NO: 2960506 - DNA, 14 bp, Homo sapiens
ttcctagaggagac

SEQ ID NO: 2960507 - DNA, 22 bp, Homo sapiens
ttcctagccaccgcctcctaca

SEQ ID NO: 2960508 - DNA, 19 bp, Homo sapiens
ttcctagcttatctccctg

SEQ ID NO: 2960509 - DNA, 23 bp, Homo sapiens
ttcctagcttatctccctgcttc

SEQ ID NO: 2960510 - DNA, 15 bp, Homo sapiens
ttcctagtggtgtca

SEQ ID NO: 2960511 - DNA, 13 bp, Homo sapiens
ttcctatacgcag

SEQ ID NO: 2960512 - DNA, 12 bp, Homo sapiens
ttcctatatgca

SEQ ID NO: 2960513 - DNA, 16 bp, Homo sapiens
ttcctatgctttgaaa

SEQ ID NO: 2960514 - DNA, 15 bp, Homo sapiens
ttcctcaaaaagcag

SEQ ID NO: 2960515 - DNA, 19 bp, Homo sapiens
ttcctcaaaaagcagaagg

SEQ ID NO: 2960516 - DNA, 15 bp, Homo sapiens
ttcctcaaatgttga

SEQ ID NO: 2960517 - DNA, 12 bp, Homo sapiens
ttcctcagctta

SEQ ID NO: 2960518 - DNA, 20 bp, Homo sapiens
ttcctcatcctgcttctctt

SEQ ID NO: 2960519 - DNA, 15 bp, Homo sapiens
ttcctcatctgtcca

SEQ ID NO: 2960520 - DNA, 16 bp, Homo sapiens
ttcctcatctttaaaa

SEQ ID NO: 2960521 - DNA, 14 bp, Homo sapiens
ttcctccagtctgt

SEQ ID NO: 2960522 - DNA, 17 bp, Homo sapiens
ttcctccagtctgttct

SEQ ID NO: 2960523 - DNA, 18 bp, Homo sapiens
ttcctccagtctgttctc

SEQ ID NO: 2960524 - DNA, 14 bp, Homo sapiens
ttcctcccttctgc

SEQ ID NO: 2960525 - DNA, 15 bp, Homo sapiens
ttcctcccttctgct

SEQ ID NO: 2960526 - DNA, 16 bp, Homo sapiens
ttcctcccttctgcta

SEQ ID NO: 2960527 - DNA, 13 bp, Homo sapiens
ttcctcctcaggc

SEQ ID NO: 2960528 - DNA, 20 bp, Homo sapiens
ttcctcctcaggcacacagc

SEQ ID NO: 2960529 - DNA, 11 bp, Homo sapiens
ttcctcctccc

SEQ ID NO: 2960530 - DNA, 18 bp, Homo sapiens
ttcctcctcccagtgcct

SEQ ID NO: 2960531 - DNA, 11 bp, Homo sapiens
ttcctcctggg

SEQ ID NO: 2960532 - DNA, 13 bp, Homo sapiens
ttctgagaaaaca

SEQ ID NO: 2960533 - DNA, 13 bp, Homo sapiens
ttctgagaccaaa

SEQ ID NO: 2960534 - DNA, 15 bp, Homo sapiens
ttctgagcaaagcat

SEQ ID NO: 2960535 - DNA, 14 bp, Homo sapiens
ttctgagcatttaa

SEQ ID NO: 2960536 - DNA, 14 bp, Homo sapiens
ttctgagcctgcct

SEQ ID NO: 2960537 - DNA, 18 bp, Homo sapiens
ttctgagccttctactta

SEQ ID NO: 2960538 - DNA, 15 bp, Homo sapiens
ttctgagctgccagt

SEQ ID NO: 2960539 - DNA, 13 bp, Homo sapiens
tttgttctctgtc

SEQ ID NO: 2960540 - DNA, 18 bp, Homo sapiens
tttgttcttcagagatca

SEQ ID NO: 2960541 - DNA, 19 bp, Homo sapiens
tttgttgctgctgctgctc

SEQ ID NO: 2960542 - DNA, 22 bp, Homo sapiens
tttgttggcccttccagtggga

SEQ ID NO: 2960543 - DNA, 15 bp, Homo sapiens
tttgttgtcatgtgt

SEQ ID NO: 2960544 - DNA, 13 bp, Homo sapiens
tttgttgtctaca

SEQ ID NO: 2960545 - DNA, 15 bp, Homo sapiens
tttgttgtctacatt

SEQ ID NO: 2960546 - DNA, 18 bp, Homo sapiens
tttgttgttttctggggg

SEQ ID NO: 2960547 - DNA, 14 bp, Homo sapiens
tttgtttaaaagga

SEQ ID NO: 2960548 - DNA, 19 bp, Homo sapiens
tttgtttaatggacacttt

SEQ ID NO: 2960549 - DNA, 17 bp, Homo sapiens
tttgtttattaaatagt

SEQ ID NO: 2960550 - DNA, 18 bp, Homo sapiens
tttgtttattagatgaat

SEQ ID NO: 2960551 - DNA, 13 bp, Homo sapiens
tttgtttcactgg

SEQ ID NO: 2960552 - DNA, 11 bp, Homo sapiens
tttgtttcctg

SEQ ID NO: 2960553 - DNA, 12 bp, Homo sapiens
tttgtttctgta

SEQ ID NO: 2960554 - DNA, 13 bp, Homo sapiens
tttgtttgtagct

SEQ ID NO: 2960555 - DNA, 18 bp, Homo sapiens
tttgtttttatttaaatt

SEQ ID NO: 2960556 - DNA, 12 bp, Homo sapiens
tttgtttttcat

SEQ ID NO: 2960557 - DNA, 14 bp, Homo sapiens
tttgtttttctcac

SEQ ID NO: 2960558 - DNA, 15 bp, Homo sapiens
tttgttttttaaaaa

SEQ ID NO: 2960559 - DNA, 23 bp, Homo sapiens
tttgttttttttttaaaaaagac

SEQ ID NO: 2960560 - DNA, 15 bp, Homo sapiens
ttttaaaaaaaatgt

SEQ ID NO: 2960561 - DNA, 19 bp, Homo sapiens
ttttaaaaaaaatgtgaaa

SEQ ID NO: 2960562 - DNA, 21 bp, Homo sapiens
ttttaaaaaaaatgtgaaatt

SEQ ID NO: 2960563 - DNA, 14 bp, Homo sapiens
ttttaaaaaagaaa

SEQ ID NO: 2960564 - DNA, 16 bp, Homo sapiens
ttttaaaaacaactta

SEQ ID NO: 2960565 - DNA, 21 bp, Homo sapiens
ttttaaaaagaaaatcagttg

SEQ ID NO: 2960566 - DNA, 23 bp, Homo sapiens
ttttaaaaatacaattattgtat

SEQ ID NO: 2960567 - DNA, 12 bp, Homo sapiens
ttttaaaaatga

SEQ ID NO: 2960568 - DNA, 15 bp, Homo sapiens
ttttaaaaatgaatc

SEQ ID NO: 2960569 - DNA, 12 bp, Homo sapiens
ttttaaaaccac

SEQ ID NO: 2960570 - DNA, 14 bp, Homo sapiens
ttttaaaacgtgta

SEQ ID NO: 2960571 - DNA, 19 bp, Homo sapiens
ttttaaaacgtgtaaatga

SEQ ID NO: 2960572 - DNA, 15 bp, Homo sapiens
ttttaaaactggacc

SEQ ID NO: 2960573 - DNA, 13 bp, Homo sapiens
ttttaaaagactt

SEQ ID NO: 2960574 - DNA, 20 bp, Homo sapiens
ttttaaaagactttgatgtg

SEQ ID NO: 2960575 - DNA, 23 bp, Homo sapiens
ttttaaaatagaggctttgagca

SEQ ID NO: 2960576 - DNA, 23 bp, Homo sapiens
ttttaaaatgaatcttatgcaaa

SEQ ID NO: 2960577 - DNA, 14 bp, Homo sapiens
ttttaaacaaatga

SEQ ID NO: 2960578 - DNA, 19 bp, Homo sapiens
ttttaaactacaggtagtt

SEQ ID NO: 2960579 - DNA, 13 bp, Homo sapiens
ttttaaactagat

SEQ ID NO: 2960580 - DNA, 17 bp, Homo sapiens
ttttaaagaaaatgtgt

SEQ ID NO: 2960581 - DNA, 11 bp, Homo sapiens
ttttaaagaat

SEQ ID NO: 2960582 - DNA, 19 bp, Homo sapiens
ttttaaaggacaaacagtg

SEQ ID NO: 2960583 - DNA, 16 bp, Homo sapiens
ttttaaaggtggattt

SEQ ID NO: 2960584 - DNA, 18 bp, Homo sapiens
ttttaaaggtggattttg

SEQ ID NO: 2960585 - DNA, 20 bp, Homo sapiens
ttttaaatctgcagcacatt

SEQ ID NO: 2960586 - DNA, 15 bp, Homo sapiens
ttttaaatgtacaga

SEQ ID NO: 2960587 - DNA, 22 bp, Homo sapiens
ttttaaatgtacagacatattt

SEQ ID NO: 2960588 - DNA, 12 bp, Homo sapiens
ttttaaattatg

SEQ ID NO: 2960589 - DNA, 16 bp, Homo sapiens
ttttaaattttgtaat

SEQ ID NO: 2960590 - DNA, 17 bp, Homo sapiens
ttttaacacctgatgtg

SEQ ID NO: 2960591 - DNA, 20 bp, Homo sapiens
ttttaacacctgatgtgtac

SEQ ID NO: 2960592 - DNA, 19 bp, Homo sapiens
ttttaactcccctgtttca

SEQ ID NO: 2960593 - DNA, 14 bp, Homo sapiens
ttttaactctgtct

SEQ ID NO: 2960594 - DNA, 16 bp, Homo sapiens
ttttaagaattgttta

SEQ ID NO: 2960595 - DNA, 16 bp, Homo sapiens
ttttattataaattct

SEQ ID NO: 2960596 - DNA, 21 bp, Homo sapiens
ttttattcaaactacctatat

SEQ ID NO: 2960597 - DNA, 15 bp, Homo sapiens
ttttattcctgtatg

SEQ ID NO: 2960598 - DNA, 24 bp, Homo sapiens
ttttattgccttctcaccagctgc

SEQ ID NO: 2960599 - DNA, 14 bp, Homo sapiens
ttttattttcaaga

SEQ ID NO: 2960600 - DNA, 22 bp, Homo sapiens
ttttcaaaacatacaagcaaca

SEQ ID NO: 2960601 - DNA, 19 bp, Homo sapiens
ttttcaaaatagaaaagtt

SEQ ID NO: 2960602 - DNA, 18 bp, Homo sapiens
ttttcaacagtgaagaca

SEQ ID NO: 2960603 - DNA, 15 bp, Homo sapiens
ttttcaacttggaaa

SEQ ID NO: 2960604 - DNA, 13 bp, Homo sapiens
ttttcaactttga

SEQ ID NO: 2960605 - DNA, 16 bp, Homo sapiens
ttttcaactttgaata

SEQ ID NO: 2960606 - DNA, 18 bp, Homo sapiens
ttttcaaggaagaaaacg

SEQ ID NO: 2960607 - DNA, 19 bp, Homo sapiens
ttttcaaggaagaaaacgg

SEQ ID NO: 2960608 - DNA, 15 bp, Homo sapiens
ttttcacataaatgc

SEQ ID NO: 2960609 - DNA, 18 bp, Homo sapiens
ttttcacattcttataaa

SEQ ID NO: 2960610 - DNA, 17 bp, Homo sapiens
ttttcacctccttcaat

SEQ ID NO: 2960611 - DNA, 14 bp, Homo sapiens
ttttcactaaaagt

SEQ ID NO: 2960612 - DNA, 11 bp, Homo sapiens
ttttcactgct

SEQ ID NO: 2960613 - DNA, 20 bp, Homo sapiens
ttttcacttcctctccacag

SEQ ID NO: 2960614 - DNA, 13 bp, Homo sapiens
ttttcacttgtct

SEQ ID NO: 2960615 - DNA, 16 bp, Homo sapiens
ttttcagacaaattac

SEQ ID NO: 2960616 - DNA, 16 bp, Homo sapiens
ttttcagacttgtcaa

SEQ ID NO: 2960617 - DNA, 12 bp, Homo sapiens
ttttcagatata

SEQ ID NO: 2960618 - DNA, 11 bp, Homo sapiens
ttttcagatgt

SEQ ID NO: 2960619 - DNA, 22 bp, Homo sapiens
ttttcagtttatttgaaccaat

SEQ ID NO: 2960620 - DNA, 20 bp, Homo sapiens
ttttcagtttcaattcagtg

SEQ ID NO: 2960621 - DNA, 23 bp, Homo sapiens
ttttcatagtaagtgcgaagact

SEQ ID NO: 2960622 - DNA, 15 bp, Homo sapiens
ttttcatatctcttg

SEQ ID NO: 2960623 - DNA, 15 bp, Homo sapiens
ttttcatctgggaaa

SEQ ID NO: 2960624 - DNA, 17 bp, Homo sapiens
ttttccaaaagtaaaga

SEQ ID NO: 2960625 - DNA, 22 bp, Homo sapiens
ttttccacaagattcccagaga

SEQ ID NO: 2960626 - DNA, 13 bp, Homo sapiens
ttttccactactg

SEQ ID NO: 2960627 - DNA, 18 bp, Homo sapiens
ttttccactccattgtcg

SEQ ID NO: 2960628 - DNA, 21 bp, Homo sapiens
ttttccatggcaggaaggctt

SEQ ID NO: 2960629 - DNA, 19 bp, Homo sapiens
ttttcccagctacaccttt

SEQ ID NO: 2960630 - DNA, 17 bp, Homo sapiens
ttttcccatcatccttt

SEQ ID NO: 2960631 - DNA, 16 bp, Homo sapiens
ttttcccatgtattga

SEQ ID NO: 2960632 - DNA, 15 bp, Homo sapiens
ttttcccatttgtaa

SEQ ID NO: 2960633 - DNA, 19 bp, Homo sapiens
ttttccccggtcccttgag

SEQ ID NO: 2960634 - DNA, 20 bp, Homo sapiens
ttttccctacctaagaattt

SEQ ID NO: 2960635 - DNA, 20 bp, Homo sapiens
ttttcctaataaagttctgt

SEQ ID NO: 2960636 - DNA, 16 bp, Homo sapiens
ttttcctcctttctct

SEQ ID NO: 2960637 - DNA, 20 bp, Homo sapiens
ttttcctcctttctctgtat

SEQ ID NO: 2960638 - DNA, 21 bp, Homo sapiens
ttttcctctctgtctgtctct

SEQ ID NO: 2960639 - DNA, 16 bp, Homo sapiens
ttttcctgtttctgaa

SEQ ID NO: 2960640 - DNA, 12 bp, Homo sapiens
ttttccttcaaa

SEQ ID NO: 2960641 - DNA, 13 bp, Homo sapiens
ttttccttccatg

SEQ ID NO: 2960642 - DNA, 23 bp, Homo sapiens
ttttccttccatgctcccaactc

SEQ ID NO: 2960643 - DNA, 24 bp, Homo sapiens
ttttccttcctctgtaagatatcc

SEQ ID NO: 2960644 - DNA, 13 bp, Homo sapiens
ttttccttcctga

SEQ ID NO: 2960645 - DNA, 22 bp, Homo sapiens
ttttcggaaacactgacttagg

SEQ ID NO: 2960646 - DNA, 17 bp, Homo sapiens
ttttcgtaccttcccac

SEQ ID NO: 2960647 - DNA, 19 bp, Homo sapiens
ttttctaaacctgtgcctc

SEQ ID NO: 2960648 - DNA, 21 bp, Homo sapiens
ttttctaaacctgtgcctccc

SEQ ID NO: 2960649 - DNA, 18 bp, Homo sapiens
ttttctaaacgtaagcac

SEQ ID NO: 2960650 - DNA, 20 bp, Homo sapiens
ttttctaaacgtaagcactg

SEQ ID NO: 2960651 - DNA, 15 bp, Homo sapiens
ttttctaaatgttat

SEQ ID NO: 2960652 - DNA, 12 bp, Homo sapiens
ttttctaactgg

SEQ ID NO: 2960653 - DNA, 23 bp, Homo sapiens
ttttctagttttatacaaagaca

SEQ ID NO: 2960654 - DNA, 13 bp, Homo sapiens
ttttctatgttgc

SEQ ID NO: 2960655 - DNA, 12 bp, Homo sapiens
ttttctcagctg

SEQ ID NO: 2960656 - DNA, 17 bp, Homo sapiens
ttttctctttaaaagaa

SEQ ID NO: 2960657 - DNA, 16 bp, Homo sapiens
ttttctgcaatgactg

SEQ ID NO: 2960658 - DNA, 16 bp, Homo sapiens
ttttctgcttttgaaa

SEQ ID NO: 2960659 - DNA, 21 bp, Homo sapiens
ttttctggaggttgataactt

SEQ ID NO: 2960660 - DNA, 18 bp, Homo sapiens
ttttctgggggaaaaagc

SEQ ID NO: 2960661 - DNA, 14 bp, Homo sapiens
ttttctggttctaa

SEQ ID NO: 2960662 - DNA, 15 bp, Homo sapiens
ttttctggttctaac

SEQ ID NO: 2960663 - DNA, 22 bp, Homo sapiens
ttttctgtgaagccctttgcct

SEQ ID NO: 2960664 - DNA, 13 bp, Homo sapiens
ttttcttaggttt

SEQ ID NO: 2960665 - DNA, 15 bp, Homo sapiens
ttttcttcactgtcc

SEQ ID NO: 2960666 - DNA, 20 bp, Homo sapiens
ttttcttcatgcctgatgaa

SEQ ID NO: 2960667 - DNA, 15 bp, Homo sapiens
ttttcttcttttaaa

SEQ ID NO: 2960668 - DNA, 17 bp, Homo sapiens
ttttcttgaaaggggaa

SEQ ID NO: 2960669 - DNA, 16 bp, Homo sapiens
ttttctttaaaagaat

SEQ ID NO: 2960670 - DNA, 17 bp, Homo sapiens
ttttctttagagaactg

SEQ ID NO: 2960671 - DNA, 18 bp, Homo sapiens
ttttctttagagaactga

SEQ ID NO: 2960672 - DNA, 17 bp, Homo sapiens
ttttctttctagtttgt

SEQ ID NO: 2960673 - DNA, 22 bp, Homo sapiens
ttttctttgttaaaaccaaact

SEQ ID NO: 2960674 - DNA, 15 bp, Homo sapiens
ttttcttttttatta

SEQ ID NO: 2960675 - DNA, 15 bp, Homo sapiens
ttttgaaaacactta

SEQ ID NO: 2960676 - DNA, 23 bp, Homo sapiens
ttttgaaagtcagctgaaggatg

SEQ ID NO: 2960677 - DNA, 13 bp, Homo sapiens
ttttgaaatacct

SEQ ID NO: 2960678 - DNA, 17 bp, Homo sapiens
ttttgaaatgaactttg

SEQ ID NO: 2960679 - DNA, 17 bp, Homo sapiens
ttttgaaattaacctct

SEQ ID NO: 2960680 - DNA, 14 bp, Homo sapiens
ttttgaacttgtca

SEQ ID NO: 2960681 - DNA, 16 bp, Homo sapiens
ttttgaacttgtcacg

SEQ ID NO: 2960682 - DNA, 21 bp, Homo sapiens
ttttgaagcagtcttgctctg

SEQ ID NO: 2960683 - DNA, 16 bp, Homo sapiens
ttttgaattgttacat

SEQ ID NO: 2960684 - DNA, 20 bp, Homo sapiens
ttttgaccttcatttcatgt

SEQ ID NO: 2960685 - DNA, 22 bp, Homo sapiens
ttttgagaactccagctggtgc

SEQ ID NO: 2960686 - DNA, 20 bp, Homo sapiens
ttttgagtaattttctgatg

SEQ ID NO: 2960687 - DNA, 21 bp, Homo sapiens
ttttgagtttcagctggaaac

SEQ ID NO: 2960688 - DNA, 18 bp, Homo sapiens
ttttgataaagtagtaaa

SEQ ID NO: 2960689 - DNA, 23 bp, Homo sapiens
ttttgataaagtagtaaaaatta

SEQ ID NO: 2960690 - DNA, 20 bp, Homo sapiens
ttttgataaagtttctcaga

SEQ ID NO: 2960691 - DNA, 24 bp, Homo sapiens
ttttgatgagatattaaattctca

SEQ ID NO: 2960692 - DNA, 17 bp, Homo sapiens
ttttgcaaggttccaca

SEQ ID NO: 2960693 - DNA, 19 bp, Homo sapiens
ttttgcaataacttctata

SEQ ID NO: 2960694 - DNA, 10 bp, Homo sapiens
ttttgcacag

SEQ ID NO: 2960695 - DNA, 17 bp, Homo sapiens
ttttgcaccccatgctg

SEQ ID NO: 2960696 - DNA, 19 bp, Homo sapiens
ttttgcaccccatgctgtt

SEQ ID NO: 2960697 - DNA, 14 bp, Homo sapiens
ttttgcactgtctg

SEQ ID NO: 2960698 - DNA, 18 bp, Homo sapiens
ttttgcagaaaaaacaaa

SEQ ID NO: 2960699 - DNA, 17 bp, Homo sapiens
ttttgcaggctggcttt

SEQ ID NO: 2960700 - DNA, 22 bp, Homo sapiens
ttttgcaggggactgggccatg

SEQ ID NO: 2960701 - DNA, 20 bp, Homo sapiens
ttttgcccatataaaatgct

SEQ ID NO: 2960702 - DNA, 23 bp, Homo sapiens
ttttgctggaattcctaactttt

SEQ ID NO: 2960703 - DNA, 17 bp, Homo sapiens
ttttgcttttatccact

SEQ ID NO: 2960704 - DNA, 13 bp, Homo sapiens
ttttgcttttcct

SEQ ID NO: 2960705 - DNA, 9 bp, Homo sapiens
ttttggaaa

SEQ ID NO: 2960706 - DNA, 16 bp, Homo sapiens
ttttggaagacatata

SEQ ID NO: 2960707 - DNA, 17 bp, Homo sapiens
ttttggagtgttatgta

SEQ ID NO: 2960708 - DNA, 23 bp, Homo sapiens
ttttggatcataaactggaaata

SEQ ID NO: 2960709 - DNA, 18 bp, Homo sapiens
ttttggatttctttatat

SEQ ID NO: 2960710 - DNA, 18 bp, Homo sapiens
ttttggcatctgcaaagg

SEQ ID NO: 2960711 - DNA, 18 bp, Homo sapiens
ttttggggaagtgaggaa

SEQ ID NO: 2960712 - DNA, 18 bp, Homo sapiens
ttttggggatatgcttag

SEQ ID NO: 2960713 - DNA, 18 bp, Homo sapiens
ttttgggggtgggtctgg

SEQ ID NO: 2960714 - DNA, 19 bp, Homo sapiens
ttttggggttgtgttgtca

SEQ ID NO: 2960715 - DNA, 14 bp, Homo sapiens
ttttggtctttttg

SEQ ID NO: 2960716 - DNA, 20 bp, Homo sapiens
ttttggttgtattctttgat

SEQ ID NO: 2960717 - DNA, 22 bp, Homo sapiens
ttttggtttttcaacactgaaa

SEQ ID NO: 2960718 - DNA, 15 bp, Homo sapiens
ttttgtaaatgtact

SEQ ID NO: 2960719 - DNA, 17 bp, Homo sapiens
ttttgtaagacatttcc

SEQ ID NO: 2960720 - DNA, 11 bp, Homo sapiens
ttttgtaccag

SEQ ID NO: 2960721 - DNA, 19 bp, Homo sapiens
ttttgtaccctgaagtgtt

SEQ ID NO: 2960722 - DNA, 15 bp, Homo sapiens
ttttgtataattgta

SEQ ID NO: 2960723 - DNA, 16 bp, Homo sapiens
ttttgtatattgtatt

SEQ ID NO: 2960724 - DNA, 15 bp, Homo sapiens
ttttgtatttttagt

SEQ ID NO: 2960725 - DNA, 13 bp, Homo sapiens
ttttgtgtacagt

SEQ ID NO: 2960726 - DNA, 20 bp, Homo sapiens
ttttgtgtatccagtatgca

SEQ ID NO: 2960727 - DNA, 14 bp, Homo sapiens
ttttgtgtgtatat

SEQ ID NO: 2960728 - DNA, 16 bp, Homo sapiens
ttttgttgtttcagtg

SEQ ID NO: 2960729 - DNA, 16 bp, Homo sapiens
ttttgtttaccagaga

SEQ ID NO: 2960730 - DNA, 16 bp, Homo sapiens
ttttgtttatttcatt

SEQ ID NO: 2960731 - DNA, 12 bp, Homo sapiens
ttttgtttcact

SEQ ID NO: 2960732 - DNA, 13 bp, Homo sapiens
tttttattgcctt

SEQ ID NO: 2960733 - DNA, 13 bp, Homo sapiens
tttttcaaaaatt

SEQ ID NO: 2960734 - DNA, 20 bp, Homo sapiens
tttttcaaaatagaaaagtt

SEQ ID NO: 2960735 - DNA, 22 bp, Homo sapiens
tttttcaaccccaccctgtttg

SEQ ID NO: 2960736 - DNA, 22 bp, Homo sapiens
tttttcacataaagggaacaaa

SEQ ID NO: 2960737 - DNA, 14 bp, Homo sapiens
tttttcagaaaaat

SEQ ID NO: 2960738 - DNA, 12 bp, Homo sapiens
tttttcatcccc

SEQ ID NO: 2960739 - DNA, 11 bp, Homo sapiens
tttttcatgtt

SEQ ID NO: 2960740 - DNA, 15 bp, Homo sapiens
tttttcattattgtg

SEQ ID NO: 2960741 - DNA, 16 bp, Homo sapiens
tttttccaaaaaaata

SEQ ID NO: 2960742 - DNA, 21 bp, Homo sapiens
tttttccacaaggaataaatg

SEQ ID NO: 2960743 - DNA, 15 bp, Homo sapiens
tttttccagttccag

SEQ ID NO: 2960744 - DNA, 14 bp, Homo sapiens
tttttccatagttt

SEQ ID NO: 2960745 - DNA, 19 bp, Homo sapiens
tttttcccagctacacctt

SEQ ID NO: 2960746 - DNA, 19 bp, Homo sapiens
tttttccctccataagttt

SEQ ID NO: 2960747 - DNA, 18 bp, Homo sapiens
tttttcctcctttctctg

SEQ ID NO: 2960748 - DNA, 11 bp, Homo sapiens
tttttctttcc

SEQ ID NO: 2960749 - DNA, 13 bp, Homo sapiens
tttttcttttgta

SEQ ID NO: 2960750 - DNA, 22 bp, Homo sapiens
tttttgaatgcctcataaatta

SEQ ID NO: 2960751 - DNA, 18 bp, Homo sapiens
tttttgaccagtttcttt

SEQ ID NO: 2960752 - DNA, 22 bp, Homo sapiens
tttttgagacggtgtctcgctg

SEQ ID NO: 2960753 - DNA, 18 bp, Homo sapiens
tttttgagtaattttctg

SEQ ID NO: 2960754 - DNA, 20 bp, Homo sapiens
tttttgagttttcttatata

SEQ ID NO: 2960755 - DNA, 22 bp, Homo sapiens
tttttgatacgcactttgcagg

SEQ ID NO: 2960756 - DNA, 17 bp, Homo sapiens
tttttgatgtataaaac

SEQ ID NO: 2960757 - DNA, 11 bp, Homo sapiens
tttttgcaaat

SEQ ID NO: 2960758 - DNA, 12 bp, Homo sapiens
tttttgcaataa

SEQ ID NO: 2960759 - DNA, 22 bp, Homo sapiens
tttttgcagctaaattaccata

SEQ ID NO: 2960760 - DNA, 11 bp, Homo sapiens
tttttgctata

SEQ ID NO: 2960761 - DNA, 18 bp, Homo sapiens
tttttgctataatcatta

SEQ ID NO: 2960762 - DNA, 17 bp, Homo sapiens
tttttgctttctgaaat

SEQ ID NO: 2960763 - DNA, 16 bp, Homo sapiens
tttttggggatatgct

SEQ ID NO: 2960764 - DNA, 12 bp, Homo sapiens
tttttggtacaa

SEQ ID NO: 2960765 - DNA, 19 bp, Homo sapiens
tttttggttgtttgctgtt

SEQ ID NO: 2960766 - DNA, 10 bp, Homo sapiens
tttttgtaaa

SEQ ID NO: 2960767 - DNA, 12 bp, Homo sapiens
tttttgtaccaa

SEQ ID NO: 2960768 - DNA, 22 bp, Homo sapiens
tttttgtgttttgttctttaaa

SEQ ID NO: 2960769 - DNA, 16 bp, Homo sapiens
tttttgtttggtataa

SEQ ID NO: 2960770 - DNA, 12 bp, Homo sapiens
ttttttaaaaaa

SEQ ID NO: 2960771 - DNA, 23 bp, Homo sapiens
ttttttaaagaaaatgtgtctgc

SEQ ID NO: 2960772 - DNA, 16 bp, Homo sapiens
ttttttaatgtgctgt

SEQ ID NO: 2960773 - DNA, 12 bp, Homo sapiens
ttttttaatttt

SEQ ID NO: 2960774 - DNA, 16 bp, Homo sapiens
ttttttataagtatgt

SEQ ID NO: 2960775 - DNA, 12 bp, Homo sapiens
ttttttcacttc

SEQ ID NO: 2960776 - DNA, 12 bp, Homo sapiens
ttttttcatagt

SEQ ID NO: 2960777 - DNA, 19 bp, Homo sapiens
ttttttcattttgttctgt

SEQ ID NO: 2960778 - DNA, 13 bp, Homo sapiens
ttttttccatctt

SEQ ID NO: 2960779 - DNA, 14 bp, Homo sapiens
ttttttcttttgta

SEQ ID NO: 2960780 - DNA, 12 bp, Homo sapiens
ttttttgataaa

SEQ ID NO: 2960781 - DNA, 16 bp, Homo sapiens
ttttttgatggctaag

SEQ ID NO: 2960782 - DNA, 13 bp, Homo sapiens
ttttttggtacaa

SEQ ID NO: 2960783 - DNA, 16 bp, Homo sapiens
ttttttggtacaaaaa

SEQ ID NO: 2960784 - DNA, 12 bp, Homo sapiens
ttttttgtacaa

SEQ ID NO: 2960785 - DNA, 13 bp, Homo sapiens
ttttttgtttgtt

SEQ ID NO: 2960786 - DNA, 14 bp, Homo sapiens
tttttttaactgtg

SEQ ID NO: 2960787 - DNA, 13 bp, Homo sapiens
tttttttaatgtg

SEQ ID NO: 2960788 - DNA, 10 bp, Homo sapiens
tttttttccc

SEQ ID NO: 2960789 - DNA, 10 bp, Homo sapiens
tttttttcct

SEQ ID NO: 2960790 - DNA, 12 bp, Homo sapiens
tttttttcttta

SEQ ID NO: 2960791 - DNA, 24 bp, Homo sapiens
tttcctaataaagttctgtactca

SEQ ID NO: 2960792 - DNA, 15 bp, Homo sapiens
tttcctcaaatgttg

SEQ ID NO: 2960793 - DNA, 19 bp, Homo sapiens
tttcctcagggtgtcctga

SEQ ID NO: 2960794 - DNA, 14 bp, Homo sapiens
tttcctcatctgtc

SEQ ID NO: 2960795 - DNA, 11 bp, Homo sapiens
tttcctccctt

SEQ ID NO: 2960796 - DNA, 13 bp, Homo sapiens
tttcctcccttct

SEQ ID NO: 2960797 - DNA, 21 bp, Homo sapiens
tttcctcctgaggctttggat

SEQ ID NO: 2960798 - DNA, 12 bp, Homo sapiens
tttcctcctttc

SEQ ID NO: 2960799 - DNA, 15 bp, Homo sapiens
tttcctcctttctct

SEQ ID NO: 2960800 - DNA, 14 bp, Homo sapiens
tttcctctctctcc

SEQ ID NO: 2960801 - DNA, 20 bp, Homo sapiens
tttcctcttactttcagttt

SEQ ID NO: 2960802 - DNA, 23 bp, Homo sapiens
tttcctgaaagttggggcccagt

SEQ ID NO: 2960803 - DNA, 12 bp, Homo sapiens
tttcctgcccag

SEQ ID NO: 2960804 - DNA, 21 bp, Homo sapiens
tttcctgcccagcctggggca

SEQ ID NO: 2960805 - DNA, 17 bp, Homo sapiens
tttcctgccttcagagt

SEQ ID NO: 2960806 - DNA, 14 bp, Homo sapiens
tttcctggaagcag

SEQ ID NO: 2960807 - DNA, 18 bp, Homo sapiens
tttcctggaagcagagca

SEQ ID NO: 2960808 - DNA, 19 bp, Homo sapiens
tttcctgtgtgaagaaagc

SEQ ID NO: 2960809 - DNA, 19 bp, Homo sapiens
tttccttaaattatctaaa

SEQ ID NO: 2960810 - DNA, 20 bp, Homo sapiens
tttccttccatgctcccaac

SEQ ID NO: 2960811 - DNA, 21 bp, Homo sapiens
tttccttccatgctcccaact

SEQ ID NO: 2960812 - DNA, 16 bp, Homo sapiens
tttccttccttccctg

SEQ ID NO: 2960813 - DNA, 18 bp, Homo sapiens
tttccttccttccctggc

SEQ ID NO: 2960814 - DNA, 18 bp, Homo sapiens
tttccttctcatctgtga

SEQ ID NO: 2960815 - DNA, 18 bp, Homo sapiens
tttccttggggcaggcag

SEQ ID NO: 2960816 - DNA, 18 bp, Homo sapiens
tttcctttatactgtgaa

SEQ ID NO: 2960817 - DNA, 19 bp, Homo sapiens
tttcctttgttgtctacat

SEQ ID NO: 2960818 - DNA, 15 bp, Homo sapiens
tttccttttaattct

SEQ ID NO: 2960819 - DNA, 15 bp, Homo sapiens
tttccttttttaaaa

SEQ ID NO: 2960820 - DNA, 22 bp, Homo sapiens
tttcgattcgttaagagagcaa

SEQ ID NO: 2960821 - DNA, 17 bp, Homo sapiens
tttcgtaatagctcaga

SEQ ID NO: 2960822 - DNA, 16 bp, Homo sapiens
tttcgtcatcttccct

SEQ ID NO: 2960823 - DNA, 20 bp, Homo sapiens
tttcgtccacagcttcctgt

SEQ ID NO: 2960824 - DNA, 15 bp, Homo sapiens
tttcgtgagccccat

SEQ ID NO: 2960825 - DNA, 20 bp, Homo sapiens
tttcgtgtaatattctctga

SEQ ID NO: 2960826 - DNA, 20 bp, Homo sapiens
tttcgttggttgtttctctg

SEQ ID NO: 2960827 - DNA, 21 bp, Homo sapiens
tttcgttggttgtttctctga

SEQ ID NO: 2960828 - DNA, 17 bp, Homo sapiens
tttctaaaaaaaaaaac

SEQ ID NO: 2960829 - DNA, 12 bp, Homo sapiens
tttctaaaatct

SEQ ID NO: 2960830 - DNA, 21 bp, Homo sapiens
tttctaaaatcttatagttct

SEQ ID NO: 2960831 - DNA, 15 bp, Homo sapiens
tttctaaacctgtgc

SEQ ID NO: 2960832 - DNA, 16 bp, Homo sapiens
tttctaaacctgtgcc

SEQ ID NO: 2960833 - DNA, 14 bp, Homo sapiens
tttctaaactccct

SEQ ID NO: 2960834 - DNA, 14 bp, Homo sapiens
tttctaagattcta

SEQ ID NO: 2960835 - DNA, 15 bp, Homo sapiens
tttctaagattctaa

SEQ ID NO: 2960836 - DNA, 14 bp, Homo sapiens
tttctaagcagata

SEQ ID NO: 2960837 - DNA, 18 bp, Homo sapiens
tttctaagtggcgtgtgc

SEQ ID NO: 2960838 - DNA, 17 bp, Homo sapiens
tttctaccttaaaggga

SEQ ID NO: 2960839 - DNA, 17 bp, Homo sapiens
tttctactttgtttatt

SEQ ID NO: 2960840 - DNA, 17 bp, Homo sapiens
tttctagaaaagcttcc

SEQ ID NO: 2960841 - DNA, 16 bp, Homo sapiens
tttctagaatggtttt

SEQ ID NO: 2960842 - DNA, 16 bp, Homo sapiens
tttctagagcactgcc

SEQ ID NO: 2960843 - DNA, 15 bp, Homo sapiens
tttctagggaaatga

SEQ ID NO: 2960844 - DNA, 15 bp, Homo sapiens
tttctagtttttaat

SEQ ID NO: 2960845 - DNA, 15 bp, Homo sapiens
tttctattaatcatt

SEQ ID NO: 2960846 - DNA, 17 bp, Homo sapiens
tttctatttagacacta

SEQ ID NO: 2960847 - DNA, 15 bp, Homo sapiens
tttctattttaagac

SEQ ID NO: 2960848 - DNA, 13 bp, Homo sapiens
tttctattttgca

SEQ ID NO: 2960849 - DNA, 17 bp, Homo sapiens
tttctcagatccttgtt

SEQ ID NO: 2960850 - DNA, 20 bp, Homo sapiens
tttctcagatccttgtttca

SEQ ID NO: 2960851 - DNA, 20 bp, Homo sapiens
tttctcataatgtgaaatat

SEQ ID NO: 2960852 - DNA, 15 bp, Homo sapiens
tttctcatcacatca

SEQ ID NO: 2960853 - DNA, 10 bp, Homo sapiens
tttctccatg

SEQ ID NO: 2960854 - DNA, 23 bp, Homo sapiens
tttctccccaatgagacttgcct

SEQ ID NO: 2960855 - DNA, 20 bp, Homo sapiens
tttctccctctcactgtctg

SEQ ID NO: 2960856 - DNA, 20 bp, Homo sapiens
tttctctagaagctgtctgc

SEQ ID NO: 2960857 - DNA, 19 bp, Homo sapiens
tttcaaagccctgcctctg

SEQ ID NO: 2960858 - DNA, 21 bp, Homo sapiens
tttcaaatctcttccttccct

SEQ ID NO: 2960859 - DNA, 14 bp, Homo sapiens
tttcaacaattaga

SEQ ID NO: 2960860 - DNA, 14 bp, Homo sapiens
tttcaacactgaaa

SEQ ID NO: 2960861 - DNA, 17 bp, Homo sapiens
tttcaacagtgaagaca

SEQ ID NO: 2960862 - DNA, 16 bp, Homo sapiens
tttcaacatggataca

SEQ ID NO: 2960863 - DNA, 16 bp, Homo sapiens
tttcaactgccaaaat

SEQ ID NO: 2960864 - DNA, 13 bp, Homo sapiens
tttcaactttgaa

SEQ ID NO: 2960865 - DNA, 16 bp, Homo sapiens
tttcaagacttgatac

SEQ ID NO: 2960866 - DNA, 21 bp, Homo sapiens
tttcaagagtctaatagtctt

SEQ ID NO: 2960867 - DNA, 17 bp, Homo sapiens
tttcaaggaagaaaacg

SEQ ID NO: 2960868 - DNA, 15 bp, Homo sapiens
tttcaaggcactcta

SEQ ID NO: 2960869 - DNA, 17 bp, Homo sapiens
tttcaaggcactctaga

SEQ ID NO: 2960870 - DNA, 20 bp, Homo sapiens
tttcaaggcactctagattc

SEQ ID NO: 2960871 - DNA, 15 bp, Homo sapiens
tttcaagggttgctt

SEQ ID NO: 2960872 - DNA, 13 bp, Homo sapiens
tttcaaggttcta

SEQ ID NO: 2960873 - DNA, 14 bp, Homo sapiens
tttcaaggttctaa

SEQ ID NO: 2960874 - DNA, 13 bp, Homo sapiens
tttcaataaatga

SEQ ID NO: 2960875 - DNA, 17 bp, Homo sapiens
tttcaatactgtcccac

SEQ ID NO: 2960876 - DNA, 21 bp, Homo sapiens
tttcaatcactgtcctccaca

SEQ ID NO: 2960877 - DNA, 14 bp, Homo sapiens
tttcaatgacattt

SEQ ID NO: 2960878 - DNA, 16 bp, Homo sapiens
tttcaattctgtaggt

SEQ ID NO: 2960879 - DNA, 18 bp, Homo sapiens
tttcaattgcatctccca

SEQ ID NO: 2960880 - DNA, 17 bp, Homo sapiens
tttcacaaggtctttaa

SEQ ID NO: 2960881 - DNA, 17 bp, Homo sapiens
tttcacaggtcaataaa

SEQ ID NO: 2960882 - DNA, 21 bp, Homo sapiens
tttcacataaatgcagcccat

SEQ ID NO: 2960883 - DNA, 16 bp, Homo sapiens
tttcacatagctgtct

SEQ ID NO: 2960884 - DNA, 17 bp, Homo sapiens
tttcacattagaagaca

SEQ ID NO: 2960885 - DNA, 21 bp, Homo sapiens
tttcaccatgatggccaggct

SEQ ID NO: 2960886 - DNA, 18 bp, Homo sapiens
tttcacctggaagcattt

SEQ ID NO: 2960887 - DNA, 14 bp, Homo sapiens
tttcacctttactt

SEQ ID NO: 2960888 - DNA, 21 bp, Homo sapiens
tttcacgagtgttcctgtgct

SEQ ID NO: 2960889 - DNA, 20 bp, Homo sapiens
tttcactctcctatgccttt

SEQ ID NO: 2960890 - DNA, 10 bp, Homo sapiens
tttcactgct

SEQ ID NO: 2960891 - DNA, 15 bp, Homo sapiens
tttcactgctgctcc

SEQ ID NO: 2960892 - DNA, 21 bp, Homo sapiens
tttcacttcctctccacagga

SEQ ID NO: 2960893 - DNA, 23 bp, Homo sapiens
tttcacttgaaagattttattgt

SEQ ID NO: 2960894 - DNA, 16 bp, Homo sapiens
tttcacttgctctttg

SEQ ID NO: 2960895 - DNA, 21 bp, Homo sapiens
tttcagactcccattcctgaa

SEQ ID NO: 2960896 - DNA, 16 bp, Homo sapiens
tttcagagaccattgc

SEQ ID NO: 2960897 - DNA, 23 bp, Homo sapiens
tttcagagtgacacccaagaggg

SEQ ID NO: 2960898 - DNA, 17 bp, Homo sapiens
tttcagatatcaaaatt

SEQ ID NO: 2960899 - DNA, 18 bp, Homo sapiens
tttcagatatcaaaattc

SEQ ID NO: 2960900 - DNA, 22 bp, Homo sapiens
tttcagatatcaaaattctagc

SEQ ID NO: 2960901 - DNA, 20 bp, Homo sapiens
tttcagatgcttctgggaga

SEQ ID NO: 2960902 - DNA, 18 bp, Homo sapiens
tttcagatgtaatgtttt

SEQ ID NO: 2960903 - DNA, 15 bp, Homo sapiens
tttcagcagctgcag

SEQ ID NO: 2960904 - DNA, 20 bp, Homo sapiens
tttcagcataaatgggaact

SEQ ID NO: 2960905 - DNA, 17 bp, Homo sapiens
tttcagcatcaaacatg

SEQ ID NO: 2960906 - DNA, 21 bp, Homo sapiens
tttcagccaatctggacactt

SEQ ID NO: 2960907 - DNA, 20 bp, Homo sapiens
tttcagccaatttgtctcct

SEQ ID NO: 2960908 - DNA, 23 bp, Homo sapiens
tttcagccaatttgtctcctact

SEQ ID NO: 2960909 - DNA, 12 bp, Homo sapiens
tttcagccacat

SEQ ID NO: 2960910 - DNA, 22 bp, Homo sapiens
tttcagccacatgccccaggct

SEQ ID NO: 2960911 - DNA, 19 bp, Homo sapiens
tttcagcgcccccaggcct

SEQ ID NO: 2960912 - DNA, 21 bp, Homo sapiens
tttcagctggaaacttctgta

SEQ ID NO: 2960913 - DNA, 14 bp, Homo sapiens
tttcagcttacaca

SEQ ID NO: 2960914 - DNA, 22 bp, Homo sapiens
ttgttcacatatgattctctta

SEQ ID NO: 2960915 - DNA, 13 bp, Homo sapiens
ttgttccagagct

SEQ ID NO: 2960916 - DNA, 18 bp, Homo sapiens
ttgttccctatgaaagat

SEQ ID NO: 2960917 - DNA, 15 bp, Homo sapiens
ttgttcctgtttatt

SEQ ID NO: 2960918 - DNA, 16 bp, Homo sapiens
ttgttcctgtttattt

SEQ ID NO: 2960919 - DNA, 23 bp, Homo sapiens
ttgttcctgtttatttttaaatt

SEQ ID NO: 2960920 - DNA, 23 bp, Homo sapiens
ttgttccttgcttttatagttgt

SEQ ID NO: 2960921 - DNA, 17 bp, Homo sapiens
ttgttctcttctgcgta

SEQ ID NO: 2960922 - DNA, 16 bp, Homo sapiens
ttgttctgactttttg

SEQ ID NO: 2960923 - DNA, 13 bp, Homo sapiens
ttgttctgggtga

SEQ ID NO: 2960924 - DNA, 13 bp, Homo sapiens
ttgttctgttcct

SEQ ID NO: 2960925 - DNA, 22 bp, Homo sapiens
ttgttcttgttgtacccttgtt

SEQ ID NO: 2960926 - DNA, 14 bp, Homo sapiens
ttgttctttaaagt

SEQ ID NO: 2960927 - DNA, 17 bp, Homo sapiens
ttgttgaacaggtgttt

SEQ ID NO: 2960928 - DNA, 17 bp, Homo sapiens
ttgttgacagcttggaa

SEQ ID NO: 2960929 - DNA, 18 bp, Homo sapiens
ttgttgacagttctgaag

SEQ ID NO: 2960930 - DNA, 20 bp, Homo sapiens
ttgttgagaattagatccca

SEQ ID NO: 2960931 - DNA, 21 bp, Homo sapiens
ttgttgcaccaattaagtgtt

SEQ ID NO: 2960932 - DNA, 13 bp, Homo sapiens
ttgttgctgctgc

SEQ ID NO: 2960933 - DNA, 14 bp, Homo sapiens
ttgttgctgctgct

SEQ ID NO: 2960934 - DNA, 21 bp, Homo sapiens
ttgttggcccttccagtggga

SEQ ID NO: 2960935 - DNA, 14 bp, Homo sapiens
ttgttggtcacatg

SEQ ID NO: 2960936 - DNA, 16 bp, Homo sapiens
ttgttggtcacatgga

SEQ ID NO: 2960937 - DNA, 21 bp, Homo sapiens
ttgttgtaaaacaaaatttga

SEQ ID NO: 2960938 - DNA, 21 bp, Homo sapiens
ttgttgtacaactcataaata

SEQ ID NO: 2960939 - DNA, 19 bp, Homo sapiens
ttgttgtgactttgacgct

SEQ ID NO: 2960940 - DNA, 17 bp, Homo sapiens
ttgttgtgtacagactt

SEQ ID NO: 2960941 - DNA, 23 bp, Homo sapiens
ttgttgttccccttccctcacac

SEQ ID NO: 2960942 - DNA, 15 bp, Homo sapiens
ttgttgttctgcctg

SEQ ID NO: 2960943 - DNA, 21 bp, Homo sapiens
ttgttgtttgccatactttgt

SEQ ID NO: 2960944 - DNA, 21 bp, Homo sapiens
ttgttgtttttaaaaagaaaa

SEQ ID NO: 2960945 - DNA, 13 bp, Homo sapiens
ttgtttaaagcat

SEQ ID NO: 2960946 - DNA, 18 bp, Homo sapiens
ttgtttacttaaagattt

SEQ ID NO: 2960947 - DNA, 17 bp, Homo sapiens
ttgtttatatgaaaaca

SEQ ID NO: 2960948 - DNA, 20 bp, Homo sapiens
ttgtttatgtaaatgtttgt

SEQ ID NO: 2960949 - DNA, 24 bp, Homo sapiens
ttgtttattagatgaattatccta

SEQ ID NO: 2960950 - DNA, 13 bp, Homo sapiens
ttgtttatttcat

SEQ ID NO: 2960951 - DNA, 13 bp, Homo sapiens
ttgtttcaaaaaa

SEQ ID NO: 2960952 - DNA, 22 bp, Homo sapiens
ttgtttcagtgaatatgcctgt

SEQ ID NO: 2960953 - DNA, 12 bp, Homo sapiens
ttgtttcctgtg

SEQ ID NO: 2960954 - DNA, 23 bp, Homo sapiens
ttgtttcctgtgcccatcatctc

SEQ ID NO: 2960955 - DNA, 13 bp, Homo sapiens
ttgtttctctgag

SEQ ID NO: 2960956 - DNA, 13 bp, Homo sapiens
ttgtttctgcatc

SEQ ID NO: 2960957 - DNA, 14 bp, Homo sapiens
ttgtttctgtttag

SEQ ID NO: 2960958 - DNA, 13 bp, Homo sapiens
ttgtttctttctg

SEQ ID NO: 2960959 - DNA, 14 bp, Homo sapiens
ttgtttgcacagag

SEQ ID NO: 2960960 - DNA, 12 bp, Homo sapiens
ttgtttgctatc

SEQ ID NO: 2960961 - DNA, 19 bp, Homo sapiens
ttgtttgctcacctggggt

SEQ ID NO: 2960962 - DNA, 16 bp, Homo sapiens
ttgtttggcaaggaaa

SEQ ID NO: 2960963 - DNA, 19 bp, Homo sapiens
ttgtttgtagctttcctgg

SEQ ID NO: 2960964 - DNA, 12 bp, Homo sapiens
ttgtttgtattc

SEQ ID NO: 2960965 - DNA, 17 bp, Homo sapiens
ttgtttgtcagcatctg

SEQ ID NO: 2960966 - DNA, 10 bp, Homo sapiens
ttgtttgttt

SEQ ID NO: 2960967 - DNA, 15 bp, Homo sapiens
ttgttttaaggaaaa

SEQ ID NO: 2960968 - DNA, 14 bp, Homo sapiens
ttgttttccactgt

SEQ ID NO: 2960969 - DNA, 18 bp, Homo sapiens
ttgttttccactgtgcta

SEQ ID NO: 2960970 - DNA, 14 bp, Homo sapiens
ttgttttgcaaaag

SEQ ID NO: 2960971 - DNA, 19 bp, Homo sapiens
ttgttttggcgataggtct

SEQ ID NO: 2960972 - DNA, 17 bp, Homo sapiens
ttgtttttaaaaagcaa

SEQ ID NO: 2960973 - DNA, 15 bp, Homo sapiens
ttgtttttccatgtg

SEQ ID NO: 2960974 - DNA, 17 bp, Homo sapiens
ttgtttttccatgtgtt

SEQ ID NO: 2960975 - DNA, 17 bp, Homo sapiens
ttgttttttcaaaatag

SEQ ID NO: 2960976 - DNA, 14 bp, Homo sapiens
tttaaaaaaaatgt

SEQ ID NO: 2960977 - DNA, 20 bp, Homo sapiens
tttaaaaaaaatgtgaaatt

SEQ ID NO: 2960978 - DNA, 21 bp, Homo sapiens
tttaaaaaaaatgtgaaattt

SEQ ID NO: 2960979 - DNA, 16 bp, Homo sapiens
tttaaaaaaacaaata

SEQ ID NO: 2960980 - DNA, 17 bp, Homo sapiens
tttaaaaaaacaaataa

SEQ ID NO: 2960981 - DNA, 20 bp, Homo sapiens
tttaaaaaaatttttgcaaa

SEQ ID NO: 2960982 - DNA, 16 bp, Homo sapiens
tttaaaaaacaaaaag

SEQ ID NO: 2960983 - DNA, 14 bp, Homo sapiens
tttaaaaacaaaca

SEQ ID NO: 2960984 - DNA, 13 bp, Homo sapiens
tttaaaaagaaaa

SEQ ID NO: 2960985 - DNA, 18 bp, Homo sapiens
tttaaaaagcaaatcttt

SEQ ID NO: 2960986 - DNA, 17 bp, Homo sapiens
tttaaaaatatttcaga

SEQ ID NO: 2960987 - DNA, 14 bp, Homo sapiens
tttaaaaatgtctt

SEQ ID NO: 2960988 - DNA, 15 bp, Homo sapiens
tttaaaacatgtaat

SEQ ID NO: 2960989 - DNA, 17 bp, Homo sapiens
tttaaaacgtgtaaatg

SEQ ID NO: 2960990 - DNA, 22 bp, Homo sapiens
tttaaaacgtgtaaatgaagat

SEQ ID NO: 2960991 - DNA, 16 bp, Homo sapiens
tttaaaactggacctg

SEQ ID NO: 2960992 - DNA, 23 bp, Homo sapiens
tttaaaagaatgggcagttacat

SEQ ID NO: 2960993 - DNA, 12 bp, Homo sapiens
tttaaaagacaa

SEQ ID NO: 2960994 - DNA, 13 bp, Homo sapiens
tttaaaagacaaa

SEQ ID NO: 2960995 - DNA, 16 bp, Homo sapiens
tttaaaagatcttcaa

SEQ ID NO: 2960996 - DNA, 18 bp, Homo sapiens
tttaaaagatgcaatgta

SEQ ID NO: 2960997 - DNA, 20 bp, Homo sapiens
tttaaaaggatttttatctt

SEQ ID NO: 2960998 - DNA, 18 bp, Homo sapiens
tttaaaaggttgactcaa

SEQ ID NO: 2960999 - DNA, 17 bp, Homo sapiens
tttaaaataagttaaag

SEQ ID NO: 2961000 - DNA, 13 bp, Homo sapiens
tttaaaataatat

SEQ ID NO: 2961001 - DNA, 17 bp, Homo sapiens
tttaaaatagaggcttt

SEQ ID NO: 2961002 - DNA, 15 bp, Homo sapiens
tttaaaatctgtcac

SEQ ID NO: 2961003 - DNA, 20 bp, Homo sapiens
tttaaaatgaatcttatgca

SEQ ID NO: 2961004 - DNA, 20 bp, Homo sapiens
tttaaaatgtaaactcttca

SEQ ID NO: 2961005 - DNA, 15 bp, Homo sapiens
tttagactttaaaat

SEQ ID NO: 2961006 - DNA, 14 bp, Homo sapiens
tttagagaactgaa

SEQ ID NO: 2961007 - DNA, 18 bp, Homo sapiens
tttagagaactgtggccg

SEQ ID NO: 2961008 - DNA, 15 bp, Homo sapiens
tttagagcattaaaa

SEQ ID NO: 2961009 - DNA, 18 bp, Homo sapiens
tttagagcattaaaataa

SEQ ID NO: 2961010 - DNA, 21 bp, Homo sapiens
tttagagcattaaaataacta

SEQ ID NO: 2961011 - DNA, 15 bp, Homo sapiens
tttagaggcattgtt

SEQ ID NO: 2961012 - DNA, 15 bp, Homo sapiens
tttagaggtgagttt

SEQ ID NO: 2961013 - DNA, 14 bp, Homo sapiens
tttagattatttta

SEQ ID NO: 2961014 - DNA, 15 bp, Homo sapiens
tttagattattttat

SEQ ID NO: 2961015 - DNA, 19 bp, Homo sapiens
tttagattgaaaacttttc

SEQ ID NO: 2961016 - DNA, 18 bp, Homo sapiens
tttagattggttctgttt

SEQ ID NO: 2961017 - DNA, 15 bp, Homo sapiens
tttagcccttctagg

SEQ ID NO: 2961018 - DNA, 20 bp, Homo sapiens
tttagctaggatttgaacac

SEQ ID NO: 2961019 - DNA, 21 bp, Homo sapiens
tttagctgatgaacttattct

SEQ ID NO: 2961020 - DNA, 13 bp, Homo sapiens
tttagctggccac

SEQ ID NO: 2961021 - DNA, 21 bp, Homo sapiens
tttaggacacatttagatgca

SEQ ID NO: 2961022 - DNA, 14 bp, Homo sapiens
tttaggagaagttg

SEQ ID NO: 2961023 - DNA, 21 bp, Homo sapiens
tttaggcacccctttccccag

SEQ ID NO: 2961024 - DNA, 14 bp, Homo sapiens
tttaggtctttgta

SEQ ID NO: 2961025 - DNA, 14 bp, Homo sapiens
tttaggttctaaag

SEQ ID NO: 2961026 - DNA, 15 bp, Homo sapiens
tttaggttctaaagt

SEQ ID NO: 2961027 - DNA, 21 bp, Homo sapiens
tttagtacctgaaaagtaact

SEQ ID NO: 2961028 - DNA, 22 bp, Homo sapiens
tttagtatatgaaatattttga

SEQ ID NO: 2961029 - DNA, 23 bp, Homo sapiens
tttagtatatgaaatattttgaa

SEQ ID NO: 2961030 - DNA, 13 bp, Homo sapiens
tttagtctcttta

SEQ ID NO: 2961031 - DNA, 16 bp, Homo sapiens
tttagtgaacttgaaa

SEQ ID NO: 2961032 - DNA, 15 bp, Homo sapiens
tttagtgatatattt

SEQ ID NO: 2961033 - DNA, 13 bp, Homo sapiens
tttagtgattgct

SEQ ID NO: 2961034 - DNA, 13 bp, Homo sapiens
tttagtgccaggc

SEQ ID NO: 2961035 - DNA, 21 bp, Homo sapiens
tttagtgtattttctgtcact

SEQ ID NO: 2961036 - DNA, 13 bp, Homo sapiens
tttagttaataaa

SEQ ID NO: 2961037 - DNA, 17 bp, Homo sapiens
tttagtttgatcagaca

SEQ ID NO: 2961038 - DNA, 12 bp, Homo sapiens
tttagtttgttt

SEQ ID NO: 2961039 - DNA, 23 bp, Homo sapiens
tttataaaaagatgatcgctgta

SEQ ID NO: 2961040 - DNA, 17 bp, Homo sapiens
tttataaaatataaaca

SEQ ID NO: 2961041 - DNA, 22 bp, Homo sapiens
tttataaacagacaatatgtga

SEQ ID NO: 2961042 - DNA, 23 bp, Homo sapiens
tttataaacagacaatatgtgag

SEQ ID NO: 2961043 - DNA, 18 bp, Homo sapiens
tttataaatttaagcatt

SEQ ID NO: 2961044 - DNA, 21 bp, Homo sapiens
tttataactattcagttgtgt

SEQ ID NO: 2961045 - DNA, 22 bp, Homo sapiens
tttataagcccaaatggctctg

SEQ ID NO: 2961046 - DNA, 15 bp, Homo sapiens
tttataatactacta

SEQ ID NO: 2961047 - DNA, 18 bp, Homo sapiens
tttataattcagtatgtt

SEQ ID NO: 2961048 - DNA, 22 bp, Homo sapiens
tttatacaaagacagccacttt

SEQ ID NO: 2961049 - DNA, 19 bp, Homo sapiens
tttatacaacagtgctaaa

SEQ ID NO: 2961050 - DNA, 13 bp, Homo sapiens
tttatacagtgta

SEQ ID NO: 2961051 - DNA, 16 bp, Homo sapiens
tttataccccatttga

SEQ ID NO: 2961052 - DNA, 13 bp, Homo sapiens
tttatactataaa

SEQ ID NO: 2961053 - DNA, 17 bp, Homo sapiens
tttatactctcttccct

SEQ ID NO: 2961054 - DNA, 16 bp, Homo sapiens
tttatactctttctgt

SEQ ID NO: 2961055 - DNA, 13 bp, Homo sapiens
tttatagtaatga

SEQ ID NO: 2961056 - DNA, 23 bp, Homo sapiens
ttgcccacacacactccttcccc

SEQ ID NO: 2961057 - DNA, 14 bp, Homo sapiens
ttgcccacaggtgc

SEQ ID NO: 2961058 - DNA, 17 bp, Homo sapiens
ttgcccagagatgcctc

SEQ ID NO: 2961059 - DNA, 15 bp, Homo sapiens
ttgcccatataaaat

SEQ ID NO: 2961060 - DNA, 12 bp, Homo sapiens
ttgcccatcctc

SEQ ID NO: 2961061 - DNA, 17 bp, Homo sapiens
ttgcccgtcgtgtgctg

SEQ ID NO: 2961062 - DNA, 20 bp, Homo sapiens
ttgccctaattcatctttta

SEQ ID NO: 2961063 - DNA, 23 bp, Homo sapiens
ttgccctaattcatcttttaatc

SEQ ID NO: 2961064 - DNA, 18 bp, Homo sapiens
ttgccctgtttcctgctg

SEQ ID NO: 2961065 - DNA, 20 bp, Homo sapiens
ttgccctgtttcctgctgct

SEQ ID NO: 2961066 - DNA, 15 bp, Homo sapiens
ttgcccttcctgacc

SEQ ID NO: 2961067 - DNA, 18 bp, Homo sapiens
ttgccgcgtcgccctccc

SEQ ID NO: 2961068 - DNA, 21 bp, Homo sapiens
ttgccgcgtcgccctcccagg

SEQ ID NO: 2961069 - DNA, 22 bp, Homo sapiens
ttgccgcgtcgccctcccaggc

SEQ ID NO: 2961070 - DNA, 19 bp, Homo sapiens
ttgcctcctctctccctgc

SEQ ID NO: 2961071 - DNA, 22 bp, Homo sapiens
ttgcctcctctctccctgcctc

SEQ ID NO: 2961072 - DNA, 15 bp, Homo sapiens
ttgcctccttttttc

SEQ ID NO: 2961073 - DNA, 20 bp, Homo sapiens
ttgcctgaaacccatttact

SEQ ID NO: 2961074 - DNA, 23 bp, Homo sapiens
ttgcctgcaacagagagaaaaag

SEQ ID NO: 2961075 - DNA, 17 bp, Homo sapiens
ttgcctgggcagtgccc

SEQ ID NO: 2961076 - DNA, 17 bp, Homo sapiens
ttgcctgggctgggcag

SEQ ID NO: 2961077 - DNA, 19 bp, Homo sapiens
ttgcctgtaacaagccaga

SEQ ID NO: 2961078 - DNA, 22 bp, Homo sapiens
ttgcctgtctaaagccttaact

SEQ ID NO: 2961079 - DNA, 16 bp, Homo sapiens
ttgcctgttcagttac

SEQ ID NO: 2961080 - DNA, 22 bp, Homo sapiens
ttgccttccagaaaacaaaact

SEQ ID NO: 2961081 - DNA, 20 bp, Homo sapiens
ttgccttccatttcccctct

SEQ ID NO: 2961082 - DNA, 14 bp, Homo sapiens
ttgccttctcacca

SEQ ID NO: 2961083 - DNA, 17 bp, Homo sapiens
ttgccttctcaccagct

SEQ ID NO: 2961084 - DNA, 14 bp, Homo sapiens
ttgccttttttatc

SEQ ID NO: 2961085 - DNA, 24 bp, Homo sapiens
ttgccttttttatcatttctactg

SEQ ID NO: 2961086 - DNA, 22 bp, Homo sapiens
ttgcgcacttaccgccctgcgg

SEQ ID NO: 2961087 - DNA, 18 bp, Homo sapiens
ttgcgtggactctgcaca

SEQ ID NO: 2961088 - DNA, 14 bp, Homo sapiens
ttgctaaacactgc

SEQ ID NO: 2961089 - DNA, 15 bp, Homo sapiens
ttgctaaatgtaaca

SEQ ID NO: 2961090 - DNA, 21 bp, Homo sapiens
ttgctaactgaactttgaaga

SEQ ID NO: 2961091 - DNA, 23 bp, Homo sapiens
ttgctaactttgcccttcactgt

SEQ ID NO: 2961092 - DNA, 16 bp, Homo sapiens
ttgctaagatgctcta

SEQ ID NO: 2961093 - DNA, 20 bp, Homo sapiens
ttgctaagatgctctatctt

SEQ ID NO: 2961094 - DNA, 18 bp, Homo sapiens
ttgctaatatttccagaa

SEQ ID NO: 2961095 - DNA, 15 bp, Homo sapiens
ttgctacgtgcctcc

SEQ ID NO: 2961096 - DNA, 18 bp, Homo sapiens
ttgctacgtgcctcccga

SEQ ID NO: 2961097 - DNA, 20 bp, Homo sapiens
ttgctagtctagtttccttt

SEQ ID NO: 2961098 - DNA, 16 bp, Homo sapiens
ttgctatcttaatttt

SEQ ID NO: 2961099 - DNA, 20 bp, Homo sapiens
ttgctattgtaaggtctttg

SEQ ID NO: 2961100 - DNA, 23 bp, Homo sapiens
ttgctcagagaaggaaaagactg

SEQ ID NO: 2961101 - DNA, 17 bp, Homo sapiens
ttgctccaataaaggaa

SEQ ID NO: 2961102 - DNA, 14 bp, Homo sapiens
ttgctcctggcctt

SEQ ID NO: 2961103 - DNA, 17 bp, Homo sapiens
ttgctctatatgtaata

SEQ ID NO: 2961104 - DNA, 20 bp, Homo sapiens
ttgctctgttacccaggctg

SEQ ID NO: 2961105 - DNA, 15 bp, Homo sapiens
ttgctcttgtagccc

SEQ ID NO: 2961106 - DNA, 14 bp, Homo sapiens
ttgctgagcctctg

SEQ ID NO: 2961107 - DNA, 12 bp, Homo sapiens
ttgctgccaagt

SEQ ID NO: 2961108 - DNA, 19 bp, Homo sapiens
ttgctgccccatcagtgct

SEQ ID NO: 2961109 - DNA, 16 bp, Homo sapiens
ttgctgcctcagagca

SEQ ID NO: 2961110 - DNA, 21 bp, Homo sapiens
ttgctgctccttagctgccaa

SEQ ID NO: 2961111 - DNA, 18 bp, Homo sapiens
ttgctgctgtgcgtggaa

SEQ ID NO: 2961112 - DNA, 22 bp, Homo sapiens
ttgctgctgtgcgtggaaaaag

SEQ ID NO: 2961113 - DNA, 23 bp, Homo sapiens
ttgctgcttttccttggggcagg

SEQ ID NO: 2961114 - DNA, 23 bp, Homo sapiens
ttgctggaaaatctgtaaaaaag

SEQ ID NO: 2961115 - DNA, 19 bp, Homo sapiens
ttgctggagggaagatctt

SEQ ID NO: 2961116 - DNA, 19 bp, Homo sapiens
ttgctgtaagatgtctgtt

SEQ ID NO: 2961117 - DNA, 21 bp, Homo sapiens
ttgctgtaccagcccagatgt

SEQ ID NO: 2961118 - DNA, 19 bp, Homo sapiens
ttgctgtaggatctaaggc

SEQ ID NO: 2961119 - DNA, 17 bp, Homo sapiens
ttgctgtgtcacactct

SEQ ID NO: 2961120 - DNA, 23 bp, Homo sapiens
ttgctgttattatatttgacatg

SEQ ID NO: 2961121 - DNA, 13 bp, Homo sapiens
ttgctgttccaca

SEQ ID NO: 2961122 - DNA, 15 bp, Homo sapiens
ttgctgttgaaagca

SEQ ID NO: 2961123 - DNA, 22 bp, Homo sapiens
ttgctgttgaaagcaaaaatgc

SEQ ID NO: 2961124 - DNA, 23 bp, Homo sapiens
ttgctgttgaaagcaaaaatgct

SEQ ID NO: 2961125 - DNA, 12 bp, Homo sapiens
ttgctgttgaca

SEQ ID NO: 2961126 - DNA, 18 bp, Homo sapiens
ttgctgtttagcttcctc

SEQ ID NO: 2961127 - DNA, 16 bp, Homo sapiens
ttgctgttttaaattg

SEQ ID NO: 2961128 - DNA, 18 bp, Homo sapiens
ttgctgttttcctccctt

SEQ ID NO: 2961129 - DNA, 22 bp, Homo sapiens
ttgctgttttcctcccttctgc

SEQ ID NO: 2961130 - DNA, 13 bp, Homo sapiens
ttgcttacaattt

SEQ ID NO: 2961131 - DNA, 22 bp, Homo sapiens
ttgcttacaatttttttaattt

SEQ ID NO: 2961132 - DNA, 23 bp, Homo sapiens
ttgcttacaatttttttaatttt

SEQ ID NO: 2961133 - DNA, 17 bp, Homo sapiens
ttgcttaccttgactgt

SEQ ID NO: 2961134 - DNA, 13 bp, Homo sapiens
ttgcttaccttgt

SEQ ID NO: 2961135 - DNA, 14 bp, Homo sapiens
ttgcttcaattaaa

SEQ ID NO: 2961136 - DNA, 15 bp, Homo sapiens
ttgcttcaattaaaa

SEQ ID NO: 2961137 - DNA, 13 bp, Homo sapiens
ttgcttcatgttc

SEQ ID NO: 2961138 - DNA, 15 bp, Homo sapiens
ttgcttccaagacca

SEQ ID NO: 2961139 - DNA, 17 bp, Homo sapiens
ttgcttccccttttgcc

SEQ ID NO: 2961140 - DNA, 20 bp, Homo sapiens
ttgcttccccttttgccaat

SEQ ID NO: 2961141 - DNA, 17 bp, Homo sapiens
ttgcttcctcctcccca

SEQ ID NO: 2961142 - DNA, 23 bp, Homo sapiens
ttgcttctggctttgttcttgtc

SEQ ID NO: 2961143 - DNA, 14 bp, Homo sapiens
ttgcttgagcttgg

SEQ ID NO: 2961144 - DNA, 16 bp, Homo sapiens
ttgcttgcctgcaggg

SEQ ID NO: 2961145 - DNA, 13 bp, Homo sapiens
ttgcttgttacat

SEQ ID NO: 2961146 - DNA, 12 bp, Homo sapiens
ttgctttcaatt

SEQ ID NO: 2961147 - DNA, 13 bp, Homo sapiens
ttgctttcactct

SEQ ID NO: 2961148 - DNA, 13 bp, Homo sapiens
ttgctttctgaaa

SEQ ID NO: 2961149 - DNA, 15 bp, Homo sapiens
ttgctttctgaaatt

SEQ ID NO: 2961150 - DNA, 15 bp, Homo sapiens
ttgctttctgctcag

SEQ ID NO: 2961151 - DNA, 14 bp, Homo sapiens
ttgctttgttgcac

SEQ ID NO: 2961152 - DNA, 13 bp, Homo sapiens
ttgcttttatcca

SEQ ID NO: 2961153 - DNA, 19 bp, Homo sapiens
ttgcttttcactggcataa

SEQ ID NO: 2961154 - DNA, 13 bp, Homo sapiens
ttggaaaagaaat

SEQ ID NO: 2961155 - DNA, 21 bp, Homo sapiens
ttggaaaagaaatcaattttt

SEQ ID NO: 2961156 - DNA, 19 bp, Homo sapiens
ttggaaagggaagatctta

SEQ ID NO: 2961157 - DNA, 17 bp, Homo sapiens
ttggaaaggtttcaaga

SEQ ID NO: 2961158 - DNA, 15 bp, Homo sapiens
ttggaaataaaccat

SEQ ID NO: 2961159 - DNA, 16 bp, Homo sapiens
ttggaaataaaccatt

SEQ ID NO: 2961160 - DNA, 20 bp, Homo sapiens
ttggaaataaaccattggac

SEQ ID NO: 2961161 - DNA, 15 bp, Homo sapiens
tgtacgtagccacag

SEQ ID NO: 2961162 - DNA, 16 bp, Homo sapiens
tgtacgtagccacagg

SEQ ID NO: 2961163 - DNA, 20 bp, Homo sapiens
tgtactaaagccaaacatat

SEQ ID NO: 2961164 - DNA, 17 bp, Homo sapiens
tgtactaagccaggagg

SEQ ID NO: 2961165 - DNA, 16 bp, Homo sapiens
tgtactccagcctggg

SEQ ID NO: 2961166 - DNA, 19 bp, Homo sapiens
tgtactccagcctgggcaa

SEQ ID NO: 2961167 - DNA, 20 bp, Homo sapiens
tgtactggctcctctgtggt

SEQ ID NO: 2961168 - DNA, 17 bp, Homo sapiens
tgtactgtatgtgatga

SEQ ID NO: 2961169 - DNA, 19 bp, Homo sapiens
tgtactgtttaatgttctg

SEQ ID NO: 2961170 - DNA, 22 bp, Homo sapiens
tgtacttccctcttgaaacctg

SEQ ID NO: 2961171 - DNA, 17 bp, Homo sapiens
tgtacttggtccaactg

SEQ ID NO: 2961172 - DNA, 15 bp, Homo sapiens
tgtacttgtcaaaga

SEQ ID NO: 2961173 - DNA, 18 bp, Homo sapiens
tgtacttttcattctctt

SEQ ID NO: 2961174 - DNA, 22 bp, Homo sapiens
tgtacttttcattctcttttaa

SEQ ID NO: 2961175 - DNA, 15 bp, Homo sapiens
tgtactttttccaga

SEQ ID NO: 2961176 - DNA, 15 bp, Homo sapiens
tgtagaaattcttaa

SEQ ID NO: 2961177 - DNA, 16 bp, Homo sapiens
tgtagaactgatttta

SEQ ID NO: 2961178 - DNA, 19 bp, Homo sapiens
tgtagaatgtattgtacct

SEQ ID NO: 2961179 - DNA, 13 bp, Homo sapiens
tgtagacattgta

SEQ ID NO: 2961180 - DNA, 14 bp, Homo sapiens
tgtagacattgtaa

SEQ ID NO: 2961181 - DNA, 21 bp, Homo sapiens
tgtagactatggaatgtcagt

SEQ ID NO: 2961182 - DNA, 11 bp, Homo sapiens
tgtagagactt

SEQ ID NO: 2961183 - DNA, 19 bp, Homo sapiens
tgtagaggcataaacctgt

SEQ ID NO: 2961184 - DNA, 15 bp, Homo sapiens
tgtagatgatgtatt

SEQ ID NO: 2961185 - DNA, 14 bp, Homo sapiens
tgtagatgcagaaa

SEQ ID NO: 2961186 - DNA, 19 bp, Homo sapiens
tgtagatgcagaaaaagaa

SEQ ID NO: 2961187 - DNA, 23 bp, Homo sapiens
tgtagatggaaaaacttgtgcta

SEQ ID NO: 2961188 - DNA, 19 bp, Homo sapiens
tgtagcaccttttctcctc

SEQ ID NO: 2961189 - DNA, 13 bp, Homo sapiens
tgtagcagcagcc

SEQ ID NO: 2961190 - DNA, 17 bp, Homo sapiens
tgtagccacaccaggat

SEQ ID NO: 2961191 - DNA, 21 bp, Homo sapiens
tgtagccaggtccccctgcag

SEQ ID NO: 2961192 - DNA, 17 bp, Homo sapiens
tgtagcccactctgctc

SEQ ID NO: 2961193 - DNA, 23 bp, Homo sapiens
tgtagcccatccttccctttgga

SEQ ID NO: 2961194 - DNA, 16 bp, Homo sapiens
tgtagccccagtcaga

SEQ ID NO: 2961195 - DNA, 18 bp, Homo sapiens
tgtagccccagtcagaag

SEQ ID NO: 2961196 - DNA, 20 bp, Homo sapiens
tgtagccccctggcctctgt

SEQ ID NO: 2961197 - DNA, 21 bp, Homo sapiens
tgtagccctcccactttgctg

SEQ ID NO: 2961198 - DNA, 23 bp, Homo sapiens
tgtagccttagtgtcacctttct

SEQ ID NO: 2961199 - DNA, 15 bp, Homo sapiens
tggggtggagtccca

SEQ ID NO: 2961200 - DNA, 19 bp, Homo sapiens
tggggtggcgcgcctgcct

SEQ ID NO: 2961201 - DNA, 20 bp, Homo sapiens
tggggtgggggtgggcagca

SEQ ID NO: 2961202 - DNA, 23 bp, Homo sapiens
tggggtgggggtgggcagcagca

SEQ ID NO: 2961203 - DNA, 15 bp, Homo sapiens
tggggttcagcccct

SEQ ID NO: 2961204 - DNA, 22 bp, Homo sapiens
tggggttcagcccctcctctgc

SEQ ID NO: 2961205 - DNA, 22 bp, Homo sapiens
tggggttgggggacagccttca

SEQ ID NO: 2961206 - DNA, 15 bp, Homo sapiens
tggggtttcctgcat

SEQ ID NO: 2961207 - DNA, 21 bp, Homo sapiens
tggggtttcctgcatggacag

SEQ ID NO: 2961208 - DNA, 22 bp, Homo sapiens
tggggtttcctgcatggacagt

SEQ ID NO: 2961209 - DNA, 19 bp, Homo sapiens
tgggtaaaattagatgcat

SEQ ID NO: 2961210 - DNA, 24 bp, Homo sapiens
tgggtaaaattagatgcatgttga

SEQ ID NO: 2961211 - DNA, 21 bp, Homo sapiens
tgggtacctgcaagcagaact

SEQ ID NO: 2961212 - DNA, 16 bp, Homo sapiens
tgggtacttcttgaag

SEQ ID NO: 2961213 - DNA, 15 bp, Homo sapiens
tgggtaggccccaca

SEQ ID NO: 2961214 - DNA, 22 bp, Homo sapiens
tgggtaggccccacaaggcctg

SEQ ID NO: 2961215 - DNA, 18 bp, Homo sapiens
tgggtatcaagacatagc

SEQ ID NO: 2961216 - DNA, 22 bp, Homo sapiens
tgggtatccttaatagaggagc

SEQ ID NO: 2961217 - DNA, 14 bp, Homo sapiens
tgggtatgtgtagg

SEQ ID NO: 2961218 - DNA, 17 bp, Homo sapiens
tgggtatgtgtaggcag

SEQ ID NO: 2961219 - DNA, 18 bp, Homo sapiens
tgggtattttataatgtt

SEQ ID NO: 2961220 - DNA, 19 bp, Homo sapiens
tgggtcaatggaataataa

SEQ ID NO: 2961221 - DNA, 16 bp, Homo sapiens
tgggtcacaggaagga

SEQ ID NO: 2961222 - DNA, 14 bp, Homo sapiens
tgggtcagagaaaa

SEQ ID NO: 2961223 - DNA, 16 bp, Homo sapiens
tgggtcatagaaattc

SEQ ID NO: 2961224 - DNA, 15 bp, Homo sapiens
tgggtccaggggatg

SEQ ID NO: 2961225 - DNA, 16 bp, Homo sapiens
tgggtcctcggcccat

SEQ ID NO: 2961226 - DNA, 14 bp, Homo sapiens
tgggtcctgcctgc

SEQ ID NO: 2961227 - DNA, 16 bp, Homo sapiens
tgggtcctgcctgcag

SEQ ID NO: 2961228 - DNA, 18 bp, Homo sapiens
tgggtcctgggcaggtgg

SEQ ID NO: 2961229 - DNA, 21 bp, Homo sapiens
tgggtcgggagaggggacgca

SEQ ID NO: 2961230 - DNA, 23 bp, Homo sapiens
tgggtctaaggggttggttgagg

SEQ ID NO: 2961231 - DNA, 15 bp, Homo sapiens
tgggtctattccagc

SEQ ID NO: 2961232 - DNA, 17 bp, Homo sapiens
tgggtctattccagctc

SEQ ID NO: 2961233 - DNA, 20 bp, Homo sapiens
tgggtctattccagctcatt

SEQ ID NO: 2961234 - DNA, 15 bp, Homo sapiens
tgggtctgacctggt

SEQ ID NO: 2961235 - DNA, 17 bp, Homo sapiens
tgggtctgacctggtgg

SEQ ID NO: 2961236 - DNA, 13 bp, Homo sapiens
tgggtctggctag

SEQ ID NO: 2961237 - DNA, 21 bp, Homo sapiens
tgggtctggctagagggccca

SEQ ID NO: 2961238 - DNA, 16 bp, Homo sapiens
tgggtgaaggctggca

SEQ ID NO: 2961239 - DNA, 17 bp, Homo sapiens
tgggtgacagagcgaga

SEQ ID NO: 2961240 - DNA, 23 bp, Homo sapiens
tgggtggagaagccattgtcttc

SEQ ID NO: 2961241 - DNA, 16 bp, Homo sapiens
tgggtggatgtgagca

SEQ ID NO: 2961242 - DNA, 21 bp, Homo sapiens
tgggtggcccctgctgtctct

SEQ ID NO: 2961243 - DNA, 12 bp, Homo sapiens
tgggtggggctg

SEQ ID NO: 2961244 - DNA, 16 bp, Homo sapiens
tgggtggggggcttca

SEQ ID NO: 2961245 - DNA, 18 bp, Homo sapiens
tgggtggggggcttcata

SEQ ID NO: 2961246 - DNA, 14 bp, Homo sapiens
tgggtgtgtgactc

SEQ ID NO: 2961247 - DNA, 16 bp, Homo sapiens
tgggtgttcataactg

SEQ ID NO: 2961248 - DNA, 16 bp, Homo sapiens
tgggtgttgaccactc

SEQ ID NO: 2961249 - DNA, 17 bp, Homo sapiens
tgggttaattcatttgg

SEQ ID NO: 2961250 - DNA, 14 bp, Homo sapiens
tgggttcaggcctg

SEQ ID NO: 2961251 - DNA, 16 bp, Homo sapiens
tgggttctatgtttac

SEQ ID NO: 2961252 - DNA, 16 bp, Homo sapiens
tgggttctgcctgcca

SEQ ID NO: 2961253 - DNA, 21 bp, Homo sapiens
tgggttctttttcttgtcatt

SEQ ID NO: 2961254 - DNA, 13 bp, Homo sapiens
tgggtttcaattt

SEQ ID NO: 2961255 - DNA, 14 bp, Homo sapiens
tgggtttcaattta

SEQ ID NO: 2961256 - DNA, 22 bp, Homo sapiens
tgggtttcacaagtgaaaaaca

SEQ ID NO: 2961257 - DNA, 11 bp, Homo sapiens
tgggtttcttt

SEQ ID NO: 2961258 - DNA, 17 bp, Homo sapiens
tgggtttggatctccaa

SEQ ID NO: 2961259 - DNA, 19 bp, Homo sapiens
tgggtttgttggtcacatg

SEQ ID NO: 2961260 - DNA, 19 bp, Homo sapiens
tgggtttttaactcatctt

SEQ ID NO: 2961261 - DNA, 16 bp, Homo sapiens
tggtaaagactggctt

SEQ ID NO: 2961262 - DNA, 16 bp, Homo sapiens
tggtaaatttccccaa

SEQ ID NO: 2961263 - DNA, 22 bp, Homo sapiens
tggtaactttgcaggcggccct

SEQ ID NO: 2961264 - DNA, 21 bp, Homo sapiens
tggtaatgatgttgataattt

SEQ ID NO: 2961265 - DNA, 17 bp, Homo sapiens
tggtaatgtgttttaga

SEQ ID NO: 2961266 - DNA, 13 bp, Homo sapiens
tggtaattgtaca

SEQ ID NO: 2961267 - DNA, 14 bp, Homo sapiens
tggtacaaaaataa

SEQ ID NO: 2961268 - DNA, 18 bp, Homo sapiens
tggtacaaaaataaattt

SEQ ID NO: 2961269 - DNA, 16 bp, Homo sapiens
tggtacaacggaggcc

SEQ ID NO: 2961270 - DNA, 20 bp, Homo sapiens
tggtacaacggaggcctgcg

SEQ ID NO: 2961271 - DNA, 19 bp, Homo sapiens
tggtacagttgcaggagcg

SEQ ID NO: 2961272 - DNA, 15 bp, Homo sapiens
tggtacgtgaccctc

SEQ ID NO: 2961273 - DNA, 22 bp, Homo sapiens
tggtactccctctcaggatcca

SEQ ID NO: 2961274 - DNA, 22 bp, Homo sapiens
tggtagaaaatgcaccaaatag

SEQ ID NO: 2961275 - DNA, 21 bp, Homo sapiens
tggtagatcttcaatttggat

SEQ ID NO: 2961276 - DNA, 14 bp, Homo sapiens
tggtagctgagggg

SEQ ID NO: 2961277 - DNA, 15 bp, Homo sapiens
tggtagctgagggga

SEQ ID NO: 2961278 - DNA, 14 bp, Homo sapiens
tggtaggaggaggc

SEQ ID NO: 2961279 - DNA, 13 bp, Homo sapiens
tggtaggattgct

SEQ ID NO: 2961280 - DNA, 17 bp, Homo sapiens
tggtaggattgctgggg

SEQ ID NO: 2961281 - DNA, 19 bp, Homo sapiens
tggtagggggaaaatgtgt

SEQ ID NO: 2961282 - DNA, 20 bp, Homo sapiens
tggtaggtactttttgtgaa

SEQ ID NO: 2961283 - DNA, 15 bp, Homo sapiens
tggtagtaaaacaca

SEQ ID NO: 2961284 - DNA, 14 bp, Homo sapiens
tggtataaattaat

SEQ ID NO: 2961285 - DNA, 16 bp, Homo sapiens
tggtatcttaaagtgt

SEQ ID NO: 2961286 - DNA, 17 bp, Homo sapiens
tggtatgaataattgca

SEQ ID NO: 2961287 - DNA, 18 bp, Homo sapiens
tggtatgaataattgcat

SEQ ID NO: 2961288 - DNA, 14 bp, Homo sapiens
tggtattctctcta

SEQ ID NO: 2961289 - DNA, 18 bp, Homo sapiens
tggtatttgctgtcacat

SEQ ID NO: 2961290 - DNA, 20 bp, Homo sapiens
tggtatttgtttgtagcttt

SEQ ID NO: 2961291 - DNA, 21 bp, Homo sapiens
tggtcaaacaaactctctgaa

SEQ ID NO: 2961292 - DNA, 22 bp, Homo sapiens
tggtcaaacaaactctctgaac

SEQ ID NO: 2961293 - DNA, 14 bp, Homo sapiens
tggtcaacctcctg

SEQ ID NO: 2961294 - DNA, 18 bp, Homo sapiens
tggtcaacctcctggaca

SEQ ID NO: 2961295 - DNA, 15 bp, Homo sapiens
tggtcaatcaacact

SEQ ID NO: 2961296 - DNA, 15 bp, Homo sapiens
tggtcagcttttgtt

SEQ ID NO: 2961297 - DNA, 22 bp, Homo sapiens
tggtcatccttggtgctcttgc

SEQ ID NO: 2961298 - DNA, 22 bp, Homo sapiens
tggtcatgaattcatactctgt

SEQ ID NO: 2961299 - DNA, 15 bp, Homo sapiens
tggtccaactgcaac

SEQ ID NO: 2961300 - DNA, 16 bp, Homo sapiens
tggtccaactgcaact

SEQ ID NO: 2961301 - DNA, 13 bp, Homo sapiens
tggtccacagggc

SEQ ID NO: 2961302 - DNA, 15 bp, Homo sapiens
tggtccacagggcac

SEQ ID NO: 2961303 - DNA, 22 bp, Homo sapiens
tggtccagcttgctcttcagtg

SEQ ID NO: 2961304 - DNA, 12 bp, Homo sapiens
tggtccaggaga

SEQ ID NO: 2961305 - DNA, 19 bp, Homo sapiens
tggtccaggccctgtggca

SEQ ID NO: 2961306 - DNA, 22 bp, Homo sapiens
tggtccatgggccatatgaaaa

SEQ ID NO: 2961307 - DNA, 21 bp, Homo sapiens
tggtcccaacaggaggacaat

SEQ ID NO: 2961308 - DNA, 21 bp, Homo sapiens
tggttggacctattgccagga

SEQ ID NO: 2961309 - DNA, 16 bp, Homo sapiens
tggttgggctgtgcct

SEQ ID NO: 2961310 - DNA, 12 bp, Homo sapiens
tggttggggtgg

SEQ ID NO: 2961311 - DNA, 11 bp, Homo sapiens
tggttgtgatt

SEQ ID NO: 2961312 - DNA, 12 bp, Homo sapiens
tggttgtttctc

SEQ ID NO: 2961313 - DNA, 17 bp, Homo sapiens
tggttgtttgctgtttt

SEQ ID NO: 2961314 - DNA, 19 bp, Homo sapiens
tggtttaaatacataaata

SEQ ID NO: 2961315 - DNA, 22 bp, Homo sapiens
tggtttatatgccctcaagtaa

SEQ ID NO: 2961316 - DNA, 18 bp, Homo sapiens
tggtttatcagcaaaaaa

SEQ ID NO: 2961317 - DNA, 22 bp, Homo sapiens
tggtttcataacttcctgtact

SEQ ID NO: 2961318 - DNA, 17 bp, Homo sapiens
tggtttcccccttctac

SEQ ID NO: 2961319 - DNA, 14 bp, Homo sapiens
tggtttcctctgga

SEQ ID NO: 2961320 - DNA, 15 bp, Homo sapiens
tggtttctgggggct

SEQ ID NO: 2961321 - DNA, 13 bp, Homo sapiens
tggtttggttttg

SEQ ID NO: 2961322 - DNA, 15 bp, Homo sapiens
tggtttggttttgga

SEQ ID NO: 2961323 - DNA, 13 bp, Homo sapiens
tggtttgtcctga

SEQ ID NO: 2961324 - DNA, 21 bp, Homo sapiens
tggtttgtgagccttgctgcc

SEQ ID NO: 2961325 - DNA, 13 bp, Homo sapiens
tggtttgttattc

SEQ ID NO: 2961326 - DNA, 16 bp, Homo sapiens
tggttttacttacaaa

SEQ ID NO: 2961327 - DNA, 13 bp, Homo sapiens
tggttttcaaatc

SEQ ID NO: 2961328 - DNA, 20 bp, Homo sapiens
tgtaaaaaaaaaaaagttat

SEQ ID NO: 2961329 - DNA, 22 bp, Homo sapiens
tgtaaaaaaaaaaaagttatat

SEQ ID NO: 2961330 - DNA, 14 bp, Homo sapiens
tgtaaaaaacaaaa

SEQ ID NO: 2961331 - DNA, 17 bp, Homo sapiens
tgtaaaaaacaaaaaaa

SEQ ID NO: 2961332 - DNA, 21 bp, Homo sapiens
tgtaaaaaacaaaaaaaacaa

SEQ ID NO: 2961333 - DNA, 15 bp, Homo sapiens
tgtaaaaaatggaaa

SEQ ID NO: 2961334 - DNA, 23 bp, Homo sapiens
tgtaaaaatatactgattttgaa

SEQ ID NO: 2961335 - DNA, 20 bp, Homo sapiens
tgtaaaatattttgaatcaa

SEQ ID NO: 2961336 - DNA, 15 bp, Homo sapiens
tgtaaacacagtgtg

SEQ ID NO: 2961337 - DNA, 17 bp, Homo sapiens
tgtaaacagtgcctgct

SEQ ID NO: 2961338 - DNA, 19 bp, Homo sapiens
tgtaaacataccaacatgt

SEQ ID NO: 2961339 - DNA, 14 bp, Homo sapiens
tgtaaaccgctttg

SEQ ID NO: 2961340 - DNA, 17 bp, Homo sapiens
tgtaaagaaagagagaa

SEQ ID NO: 2961341 - DNA, 18 bp, Homo sapiens
tgtaaagaaagagagaaa

SEQ ID NO: 2961342 - DNA, 15 bp, Homo sapiens
tggaccccctgcccg

SEQ ID NO: 2961343 - DNA, 18 bp, Homo sapiens
tggacctctcttgtgagc

SEQ ID NO: 2961344 - DNA, 18 bp, Homo sapiens
tggacctgaattctactg

SEQ ID NO: 2961345 - DNA, 16 bp, Homo sapiens
tggacctggcagtggt

SEQ ID NO: 2961346 - DNA, 22 bp, Homo sapiens
tggaccttacgatcaggcacag

SEQ ID NO: 2961347 - DNA, 19 bp, Homo sapiens
tggaccttaggccttcctc

SEQ ID NO: 2961348 - DNA, 15 bp, Homo sapiens
tggacgcaggccctg

SEQ ID NO: 2961349 - DNA, 18 bp, Homo sapiens
tggacgcaggccctgtcc

SEQ ID NO: 2961350 - DNA, 21 bp, Homo sapiens
tggctcctctgtggtgtctgc

SEQ ID NO: 2961351 - DNA, 23 bp, Homo sapiens
tggctcctctgtggtgtctgcct

SEQ ID NO: 2961352 - DNA, 22 bp, Homo sapiens
tggctctattggatttgtccaa

SEQ ID NO: 2961353 - DNA, 23 bp, Homo sapiens
tggctctattggatttgtccaaa

SEQ ID NO: 2961354 - DNA, 19 bp, Homo sapiens
tggctctgaccgaaacagc

SEQ ID NO: 2961355 - DNA, 22 bp, Homo sapiens
tggctctgggtacctgcaagca

SEQ ID NO: 2961356 - DNA, 13 bp, Homo sapiens
tggctctgtgaaa

SEQ ID NO: 2961357 - DNA, 23 bp, Homo sapiens
tgctggcgacactcagggcagct

SEQ ID NO: 2961358 - DNA, 23 bp, Homo sapiens
tgctggctggtgcctgagcccct

SEQ ID NO: 2961359 - DNA, 21 bp, Homo sapiens
tgctgggaacctcagggtatt

SEQ ID NO: 2961360 - DNA, 23 bp, Homo sapiens
tgctgggatggtgggcttcaggg

SEQ ID NO: 2961361 - DNA, 14 bp, Homo sapiens
tgctgggctctcca

SEQ ID NO: 2961362 - DNA, 16 bp, Homo sapiens
tgctgggctctccacc

SEQ ID NO: 2961363 - DNA, 23 bp, Homo sapiens
tgctgggctctccacctcagcct

SEQ ID NO: 2961364 - DNA, 21 bp, Homo sapiens
tgctgggctgacggtgcagtc

SEQ ID NO: 2961365 - DNA, 19 bp, Homo sapiens
tgctgggggcaactggcca

SEQ ID NO: 2961366 - DNA, 12 bp, Homo sapiens
tgctgggggctc

SEQ ID NO: 2961367 - DNA, 14 bp, Homo sapiens
tgctgggggctccc

SEQ ID NO: 2961368 - DNA, 19 bp, Homo sapiens
tgctggtcccggggccagc

SEQ ID NO: 2961369 - DNA, 15 bp, Homo sapiens
tgctggtctctggct

SEQ ID NO: 2961370 - DNA, 19 bp, Homo sapiens
tgctggtctctggctctac

SEQ ID NO: 2961371 - DNA, 16 bp, Homo sapiens
tgctggtggctcttca

SEQ ID NO: 2961372 - DNA, 22 bp, Homo sapiens
tgctggtttatttgttgttttc

SEQ ID NO: 2961373 - DNA, 22 bp, Homo sapiens
tgctgtaactaaaggaatctga

SEQ ID NO: 2961374 - DNA, 12 bp, Homo sapiens
tgctgtaactgg

SEQ ID NO: 2961375 - DNA, 17 bp, Homo sapiens
tgctgtacatctatttt

SEQ ID NO: 2961376 - DNA, 21 bp, Homo sapiens
tgggcagggtctctgctccag

SEQ ID NO: 2961377 - DNA, 20 bp, Homo sapiens
tgggcaggtggcctctgctg

SEQ ID NO: 2961378 - DNA, 22 bp, Homo sapiens
tgggcaggtggcctctgctggt

SEQ ID NO: 2961379 - DNA, 24 bp, Homo sapiens
tgggcaggtggcctctgctggtct

SEQ ID NO: 2961380 - DNA, 16 bp, Homo sapiens
tgggcaggtgggagct

SEQ ID NO: 2961381 - DNA, 19 bp, Homo sapiens
tgggcaggtgggagctgaa

SEQ ID NO: 2961382 - DNA, 17 bp, Homo sapiens
tgggcatgtgggcttca

SEQ ID NO: 2961383 - DNA, 17 bp, Homo sapiens
tgggcattgatggggaa

SEQ ID NO: 2961384 - DNA, 18 bp, Homo sapiens
tgggcattgatggggaag

SEQ ID NO: 2961385 - DNA, 23 bp, Homo sapiens
tgggcattgatggggaaggaggc

SEQ ID NO: 2961386 - DNA, 12 bp, Homo sapiens
tgggcattgctt

SEQ ID NO: 2961387 - DNA, 23 bp, Homo sapiens
tgggccaacaaagaacactaact

SEQ ID NO: 2961388 - DNA, 20 bp, Homo sapiens
tgggccaccaggatcagcca

SEQ ID NO: 2961389 - DNA, 19 bp, Homo sapiens
tgggccagacatgccacaa

SEQ ID NO: 2961390 - DNA, 14 bp, Homo sapiens
tgggccaggacagg

SEQ ID NO: 2961391 - DNA, 20 bp, Homo sapiens
tgggccaggttggaaaagaa

SEQ ID NO: 2961392 - DNA, 21 bp, Homo sapiens
tgggccatgggtcctcggccc

SEQ ID NO: 2961393 - DNA, 13 bp, Homo sapiens
tgggcccacagcc

SEQ ID NO: 2961394 - DNA, 16 bp, Homo sapiens
tgggcccacagccccc

SEQ ID NO: 2961395 - DNA, 13 bp, Homo sapiens
tgggcccaggcag

SEQ ID NO: 2961396 - DNA, 14 bp, Homo sapiens
tgggcccctcaggg

SEQ ID NO: 2961397 - DNA, 14 bp, Homo sapiens
tgggcccctcccct

SEQ ID NO: 2961398 - DNA, 15 bp, Homo sapiens
tgggcccctcccctc

SEQ ID NO: 2961399 - DNA, 16 bp, Homo sapiens
tgggcccctcccctca

SEQ ID NO: 2961400 - DNA, 18 bp, Homo sapiens
tgggcccctcccctcaga

SEQ ID NO: 2961401 - DNA, 15 bp, Homo sapiens
tgggcccctgccaga

SEQ ID NO: 2961402 - DNA, 14 bp, Homo sapiens
tgggcccctggccc

SEQ ID NO: 2961403 - DNA, 15 bp, Homo sapiens
tgggcccctggcccc

SEQ ID NO: 2961404 - DNA, 23 bp, Homo sapiens
tgggcccctggccccgcctgcct

SEQ ID NO: 2961405 - DNA, 13 bp, Homo sapiens
tgggccctctctg

SEQ ID NO: 2961406 - DNA, 16 bp, Homo sapiens
tgggccctctctgctc

SEQ ID NO: 2961407 - DNA, 18 bp, Homo sapiens
tgggccctctctgctctg

SEQ ID NO: 2961408 - DNA, 21 bp, Homo sapiens
tgggccctgagtctgggcagc

SEQ ID NO: 2961409 - DNA, 14 bp, Homo sapiens
tgggccctgcaggc

SEQ ID NO: 2961410 - DNA, 22 bp, Homo sapiens
tgggccctgcaggctgcaggag

SEQ ID NO: 2961411 - DNA, 19 bp, Homo sapiens
tgggccgcaagggcctgga

SEQ ID NO: 2961412 - DNA, 20 bp, Homo sapiens
tgggccgcaagggcctggac

SEQ ID NO: 2961413 - DNA, 21 bp, Homo sapiens
tgggccgcaagggcctggacg

SEQ ID NO: 2961414 - DNA, 20 bp, Homo sapiens
tgggccgcgtgccgggcccc

SEQ ID NO: 2961415 - DNA, 21 bp, Homo sapiens
tgggccgcgtgccgggccccc

SEQ ID NO: 2961416 - DNA, 15 bp, Homo sapiens
tgggccgggcctggg

SEQ ID NO: 2961417 - DNA, 19 bp, Homo sapiens
tgggccgggcctggggctc

SEQ ID NO: 2961418 - DNA, 19 bp, Homo sapiens
tgggcctcagtgtgcccat

SEQ ID NO: 2961419 - DNA, 19 bp, Homo sapiens
tgggcctcggcccctccca

SEQ ID NO: 2961420 - DNA, 18 bp, Homo sapiens
tgggcctgctccagacct

SEQ ID NO: 2961421 - DNA, 20 bp, Homo sapiens
tgggcctgctccagacctga

SEQ ID NO: 2961422 - DNA, 13 bp, Homo sapiens
tgggcctggccag

SEQ ID NO: 2961423 - DNA, 15 bp, Homo sapiens
tgggcctggccagtc

SEQ ID NO: 2961424 - DNA, 13 bp, Homo sapiens
tgggccttcatta

SEQ ID NO: 2961425 - DNA, 17 bp, Homo sapiens
tgggccttctcagctct

SEQ ID NO: 2961426 - DNA, 14 bp, Homo sapiens
tgggcctttcagtc

SEQ ID NO: 2961427 - DNA, 20 bp, Homo sapiens
tgggcggacaaaagggccag

SEQ ID NO: 2961428 - DNA, 12 bp, Homo sapiens
tgggcgggcagt

SEQ ID NO: 2961429 - DNA, 17 bp, Homo sapiens
tgggcgtacgctggtgc

SEQ ID NO: 2961430 - DNA, 18 bp, Homo sapiens
tgggcgtacgctggtgct

SEQ ID NO: 2961431 - DNA, 21 bp, Homo sapiens
tgggcgtacgctggtgctgag

SEQ ID NO: 2961432 - DNA, 23 bp, Homo sapiens
tgggctaaggaagtatcagcact

SEQ ID NO: 2961433 - DNA, 20 bp, Homo sapiens
tgggctcaaggcaccgcagc

SEQ ID NO: 2961434 - DNA, 12 bp, Homo sapiens
tgggctcagaga

SEQ ID NO: 2961435 - DNA, 13 bp, Homo sapiens
tgggctccccagg

SEQ ID NO: 2961436 - DNA, 19 bp, Homo sapiens
tgggctcccgtgttttgta

SEQ ID NO: 2961437 - DNA, 11 bp, Homo sapiens
tgggctccctg

SEQ ID NO: 2961438 - DNA, 15 bp, Homo sapiens
tgggctctccacctc

SEQ ID NO: 2961439 - DNA, 16 bp, Homo sapiens
tgggctctccacctca

SEQ ID NO: 2961440 - DNA, 19 bp, Homo sapiens
tgggctctccacctcagcc

SEQ ID NO: 2961441 - DNA, 21 bp, Homo sapiens
tgggctctccacctcagcctt

SEQ ID NO: 2961442 - DNA, 14 bp, Homo sapiens
tgggctgggcagcc

SEQ ID NO: 2961443 - DNA, 15 bp, Homo sapiens
tgggctgggcagcct

SEQ ID NO: 2961444 - DNA, 19 bp, Homo sapiens
tgggcttatttagaaaaaa

SEQ ID NO: 2961445 - DNA, 13 bp, Homo sapiens
tgggcttcagcct

SEQ ID NO: 2961446 - DNA, 13 bp, Homo sapiens
tgggcttgattct

SEQ ID NO: 2961447 - DNA, 18 bp, Homo sapiens
tgggcttggcccgcggcc

SEQ ID NO: 2961448 - DNA, 20 bp, Homo sapiens
tgggcttggcccgcggcctg

SEQ ID NO: 2961449 - DNA, 19 bp, Homo sapiens
tgggctttcacgggcccca

SEQ ID NO: 2961450 - DNA, 17 bp, Homo sapiens
tggggaaaaattcttgg

SEQ ID NO: 2961451 - DNA, 14 bp, Homo sapiens
tggggaaggcaaga

SEQ ID NO: 2961452 - DNA, 23 bp, Homo sapiens
tggggaagtacgtcccagcggcc

SEQ ID NO: 2961453 - DNA, 16 bp, Homo sapiens
tggggaagtgaggaag

SEQ ID NO: 2961454 - DNA, 18 bp, Homo sapiens
tggggacatctctttgaa

SEQ ID NO: 2961455 - DNA, 19 bp, Homo sapiens
tggggaccccacccctcat

SEQ ID NO: 2961456 - DNA, 19 bp, Homo sapiens
tggggaccggttcccacaa

SEQ ID NO: 2961457 - DNA, 18 bp, Homo sapiens
tggggacctcagcctgca

SEQ ID NO: 2961458 - DNA, 21 bp, Homo sapiens
tggggagaagaaacaagaaaa

SEQ ID NO: 2961459 - DNA, 16 bp, Homo sapiens
tggggagacagttgag

SEQ ID NO: 2961460 - DNA, 14 bp, Homo sapiens
tggggagatttgcc

SEQ ID NO: 2961461 - DNA, 21 bp, Homo sapiens
tggggagggatgaagggcgag

SEQ ID NO: 2961462 - DNA, 20 bp, Homo sapiens
tggggaggtggcactaggga

SEQ ID NO: 2961463 - DNA, 21 bp, Homo sapiens
tggggaggtgggaggccaggc

SEQ ID NO: 2961464 - DNA, 23 bp, Homo sapiens
tggggaggtgttcactgaagacg

SEQ ID NO: 2961465 - DNA, 16 bp, Homo sapiens
tggggagttaagacct

SEQ ID NO: 2961466 - DNA, 20 bp, Homo sapiens
tggggagttaagacctggca

SEQ ID NO: 2961467 - DNA, 13 bp, Homo sapiens
tggggatagtctg

SEQ ID NO: 2961468 - DNA, 14 bp, Homo sapiens
tggggatagtctgg

SEQ ID NO: 2961469 - DNA, 18 bp, Homo sapiens
tggggatcaaagttctgc

SEQ ID NO: 2961470 - DNA, 15 bp, Homo sapiens
tggggcaagtcatgt

SEQ ID NO: 2961471 - DNA, 22 bp, Homo sapiens
tggggcagatggcagggctgag

SEQ ID NO: 2961472 - DNA, 14 bp, Homo sapiens
tggggcaggcagtg

SEQ ID NO: 2961473 - DNA, 12 bp, Homo sapiens
tggggcagggag

SEQ ID NO: 2961474 - DNA, 13 bp, Homo sapiens
tggggcagggagc

SEQ ID NO: 2961475 - DNA, 19 bp, Homo sapiens
tggggcaggggcaggaggg

SEQ ID NO: 2961476 - DNA, 16 bp, Homo sapiens
tggggccagatccagc

SEQ ID NO: 2961477 - DNA, 20 bp, Homo sapiens
tggggccagatccagcctgg

SEQ ID NO: 2961478 - DNA, 22 bp, Homo sapiens
tggggccaggccgggcctgtac

SEQ ID NO: 2961479 - DNA, 16 bp, Homo sapiens
tggggcccagtccttg

SEQ ID NO: 2961480 - DNA, 12 bp, Homo sapiens
tggggcccagtg

SEQ ID NO: 2961481 - DNA, 19 bp, Homo sapiens
tggggcccagtgcatggtg

SEQ ID NO: 2961482 - DNA, 21 bp, Homo sapiens
tggggcccatggaggagacag

SEQ ID NO: 2961483 - DNA, 15 bp, Homo sapiens
tggggccggggctga

SEQ ID NO: 2961484 - DNA, 18 bp, Homo sapiens
tggggcctacagctttga

SEQ ID NO: 2961485 - DNA, 20 bp, Homo sapiens
tggggcgggcagccaggctg

SEQ ID NO: 2961486 - DNA, 22 bp, Homo sapiens
tggggctccttctccaccccag

SEQ ID NO: 2961487 - DNA, 15 bp, Homo sapiens
tggggctgctcctcc

SEQ ID NO: 2961488 - DNA, 17 bp, Homo sapiens
tggggctgctcctccag

SEQ ID NO: 2961489 - DNA, 19 bp, Homo sapiens
tggggctgctcctccaggg

SEQ ID NO: 2961490 - DNA, 16 bp, Homo sapiens
tggggctggtgaggcc

SEQ ID NO: 2961491 - DNA, 11 bp, Homo sapiens
tgctttgaaaa

SEQ ID NO: 2961492 - DNA, 12 bp, Homo sapiens
tgctttgaaaaa

SEQ ID NO: 2961493 - DNA, 16 bp, Homo sapiens
tgctttgacgggccag

SEQ ID NO: 2961494 - DNA, 13 bp, Homo sapiens
tgctttgctttct

SEQ ID NO: 2961495 - DNA, 19 bp, Homo sapiens
tgctttgtaggtgtctcat

SEQ ID NO: 2961496 - DNA, 21 bp, Homo sapiens
tgctttgtagtttgctttgct

SEQ ID NO: 2961497 - DNA, 18 bp, Homo sapiens
tgctttgttacaataaaa

SEQ ID NO: 2961498 - DNA, 13 bp, Homo sapiens
tgctttgttgcac

SEQ ID NO: 2961499 - DNA, 15 bp, Homo sapiens
tgctttgttgttctg

SEQ ID NO: 2961500 - DNA, 13 bp, Homo sapiens
tgcttttaagttt

SEQ ID NO: 2961501 - DNA, 17 bp, Homo sapiens
tgcttttagtaaaaaca

SEQ ID NO: 2961502 - DNA, 24 bp, Homo sapiens
tgcttttagtattttagtgaactt

SEQ ID NO: 2961503 - DNA, 12 bp, Homo sapiens
tgcttttatatc

SEQ ID NO: 2961504 - DNA, 20 bp, Homo sapiens
tgcttttatatctgtatgta

SEQ ID NO: 2961505 - DNA, 15 bp, Homo sapiens
tgcttttcactggca

SEQ ID NO: 2961506 - DNA, 22 bp, Homo sapiens
tgcttttccttggggcaggcag

SEQ ID NO: 2961507 - DNA, 15 bp, Homo sapiens
tgcttttgaacgtat

SEQ ID NO: 2961508 - DNA, 16 bp, Homo sapiens
tgcttttgcttgcaat

SEQ ID NO: 2961509 - DNA, 23 bp, Homo sapiens
tgcttttgttccaatgtcaatgt

SEQ ID NO: 2961510 - DNA, 19 bp, Homo sapiens
tgctttttatttctgcata

SEQ ID NO: 2961511 - DNA, 13 bp, Homo sapiens
tggaaaaaaaaaa

SEQ ID NO: 2961512 - DNA, 18 bp, Homo sapiens
tggaaaaaaacataaaaa

SEQ ID NO: 2961513 - DNA, 20 bp, Homo sapiens
tggaaaaaaacataaaaagc

SEQ ID NO: 2961514 - DNA, 21 bp, Homo sapiens
tggaaaaaaacataaaaagca

SEQ ID NO: 2961515 - DNA, 13 bp, Homo sapiens
tggaaaaaacatt

SEQ ID NO: 2961516 - DNA, 21 bp, Homo sapiens
tggaaaaaagattctgtctta

SEQ ID NO: 2961517 - DNA, 22 bp, Homo sapiens
tggaaaaaatgatgttcattta

SEQ ID NO: 2961518 - DNA, 16 bp, Homo sapiens
tggaaaaagaaagaaa

SEQ ID NO: 2961519 - DNA, 11 bp, Homo sapiens
tggaaaaagac

SEQ ID NO: 2961520 - DNA, 17 bp, Homo sapiens
tggaaaaatgaactgta

SEQ ID NO: 2961521 - DNA, 22 bp, Homo sapiens
tggaaaaatgaactgtattatt

SEQ ID NO: 2961522 - DNA, 19 bp, Homo sapiens
tggaaaagaaatcaatttt

SEQ ID NO: 2961523 - DNA, 21 bp, Homo sapiens
tggaaaagggtcttgggaaat

SEQ ID NO: 2961524 - DNA, 16 bp, Homo sapiens
tggaaacagaggtaaa

SEQ ID NO: 2961525 - DNA, 18 bp, Homo sapiens
tggaaacattcaggagct

SEQ ID NO: 2961526 - DNA, 23 bp, Homo sapiens
tggaaactaccagtgggcatgta

SEQ ID NO: 2961527 - DNA, 21 bp, Homo sapiens
tggaaacttctgtaaggggca

SEQ ID NO: 2961528 - DNA, 16 bp, Homo sapiens
tggaaagacaggaaga

SEQ ID NO: 2961529 - DNA, 18 bp, Homo sapiens
tggaaagataactaggaa

SEQ ID NO: 2961530 - DNA, 18 bp, Homo sapiens
tggaaagatagagattgt

SEQ ID NO: 2961531 - DNA, 23 bp, Homo sapiens
tggaaagccagttagttagaatt

SEQ ID NO: 2961532 - DNA, 17 bp, Homo sapiens
tggaaaggaaagatgat

SEQ ID NO: 2961533 - DNA, 22 bp, Homo sapiens
tggaaaggtttcaagacttgat

SEQ ID NO: 2961534 - DNA, 13 bp, Homo sapiens
tggaaagtgtaaa

SEQ ID NO: 2961535 - DNA, 16 bp, Homo sapiens
tggaaagtgtaaagca

SEQ ID NO: 2961536 - DNA, 20 bp, Homo sapiens
tggaaatctggattttcagc

SEQ ID NO: 2961537 - DNA, 15 bp, Homo sapiens
tggaaatgctgggct

SEQ ID NO: 2961538 - DNA, 16 bp, Homo sapiens
tggaaattggaagagc

SEQ ID NO: 2961539 - DNA, 17 bp, Homo sapiens
tggaaattggaagagca

SEQ ID NO: 2961540 - DNA, 18 bp, Homo sapiens
tggaacaagacagccttc

SEQ ID NO: 2961541 - DNA, 22 bp, Homo sapiens
tggaacaagacagccttcactt

SEQ ID NO: 2961542 - DNA, 19 bp, Homo sapiens
tggaacacaaacacattgt

SEQ ID NO: 2961543 - DNA, 15 bp, Homo sapiens
tggaacaccagcagc

SEQ ID NO: 2961544 - DNA, 17 bp, Homo sapiens
tggaacacggccacatc

SEQ ID NO: 2961545 - DNA, 19 bp, Homo sapiens
tggaaccaaagtctaaact

SEQ ID NO: 2961546 - DNA, 15 bp, Homo sapiens
tggaacccagactca

SEQ ID NO: 2961547 - DNA, 22 bp, Homo sapiens
tggaacccagactcagacattg

SEQ ID NO: 2961548 - DNA, 16 bp, Homo sapiens
tggaaccgcaggaagc

SEQ ID NO: 2961549 - DNA, 18 bp, Homo sapiens
tggaaccgttgccaaccg

SEQ ID NO: 2961550 - DNA, 15 bp, Homo sapiens
tggaacctcagcctg

SEQ ID NO: 2961551 - DNA, 16 bp, Homo sapiens
tggaactaaaatgtta

SEQ ID NO: 2961552 - DNA, 17 bp, Homo sapiens
tggaactgtcccagcta

SEQ ID NO: 2961553 - DNA, 18 bp, Homo sapiens
tggaactttagggggtgg

SEQ ID NO: 2961554 - DNA, 23 bp, Homo sapiens
tggaactttagggggtgggaggg

SEQ ID NO: 2961555 - DNA, 18 bp, Homo sapiens
tggaagaaaatggaatta

SEQ ID NO: 2961556 - DNA, 12 bp, Homo sapiens
tggaagaaccac

SEQ ID NO: 2961557 - DNA, 15 bp, Homo sapiens
tggaagaaccactgt

SEQ ID NO: 2961558 - DNA, 15 bp, Homo sapiens
tggaagaggaaaagg

SEQ ID NO: 2961559 - DNA, 19 bp, Homo sapiens
tggaagatctgcaaacatt

SEQ ID NO: 2961560 - DNA, 17 bp, Homo sapiens
tggaagatgcagaagca

SEQ ID NO: 2961561 - DNA, 22 bp, Homo sapiens
tggaagatgcagaagcaataat

SEQ ID NO: 2961562 - DNA, 17 bp, Homo sapiens
tggaagcaacgtgttaa

SEQ ID NO: 2961563 - DNA, 20 bp, Homo sapiens
tggaagcactttttctgcat

SEQ ID NO: 2961564 - DNA, 14 bp, Homo sapiens
tggaagcagagcaa

SEQ ID NO: 2961565 - DNA, 21 bp, Homo sapiens
tggaagcatgtttattctgtt

SEQ ID NO: 2961566 - DNA, 23 bp, Homo sapiens
tggaagcatgtttattctgttcc

SEQ ID NO: 2961567 - DNA, 15 bp, Homo sapiens
tggaagctgtgtcct

SEQ ID NO: 2961568 - DNA, 20 bp, Homo sapiens
tggaagcttctggtgacctt

SEQ ID NO: 2961569 - DNA, 17 bp, Homo sapiens
tggaagctttgtcccct

SEQ ID NO: 2961570 - DNA, 16 bp, Homo sapiens
tggaaggagacacaga

SEQ ID NO: 2961571 - DNA, 21 bp, Homo sapiens
tggaaggagacacagatgttc

SEQ ID NO: 2961572 - DNA, 12 bp, Homo sapiens
tggaaggtgcca

SEQ ID NO: 2961573 - DNA, 13 bp, Homo sapiens
tggaagtatttga

SEQ ID NO: 2961574 - DNA, 17 bp, Homo sapiens
tggaagtatttgagaga

SEQ ID NO: 2961575 - DNA, 17 bp, Homo sapiens
tggaagtccctcagagg

SEQ ID NO: 2961576 - DNA, 12 bp, Homo sapiens
tggaagtctcaa

SEQ ID NO: 2961577 - DNA, 20 bp, Homo sapiens
tggaagtgttcctgtctcaa

SEQ ID NO: 2961578 - DNA, 21 bp, Homo sapiens
tggaagttggggcactgggcg

SEQ ID NO: 2961579 - DNA, 23 bp, Homo sapiens
tggaagttggggcactgggcgtc

SEQ ID NO: 2961580 - DNA, 18 bp, Homo sapiens
tggaatactttttgttat

SEQ ID NO: 2961581 - DNA, 13 bp, Homo sapiens
tggaatataaaga

SEQ ID NO: 2961582 - DNA, 23 bp, Homo sapiens
tggaatcccactaatgcaaactg

SEQ ID NO: 2961583 - DNA, 18 bp, Homo sapiens
tggaatcccactgtatga

SEQ ID NO: 2961584 - DNA, 14 bp, Homo sapiens
tggaatctgatgaa

SEQ ID NO: 2961585 - DNA, 15 bp, Homo sapiens
tggaatctgatgaaa

SEQ ID NO: 2961586 - DNA, 23 bp, Homo sapiens
tggaatgcacacagcggctgcct

SEQ ID NO: 2961587 - DNA, 14 bp, Homo sapiens
tggaatggttgagt

SEQ ID NO: 2961588 - DNA, 19 bp, Homo sapiens
tggaatgtcagtgttcagc

SEQ ID NO: 2961589 - DNA, 13 bp, Homo sapiens
tggaattactcca

SEQ ID NO: 2961590 - DNA, 23 bp, Homo sapiens
tggaattactccaaaaagacaag

SEQ ID NO: 2961591 - DNA, 22 bp, Homo sapiens
tggaattagcttggggccaggg

SEQ ID NO: 2961592 - DNA, 20 bp, Homo sapiens
tggaattattttaaaagata

SEQ ID NO: 2961593 - DNA, 19 bp, Homo sapiens
tggaattccatttgaggat

SEQ ID NO: 2961594 - DNA, 17 bp, Homo sapiens
tggaattgatttgcatt

SEQ ID NO: 2961595 - DNA, 19 bp, Homo sapiens
tggaattgcaatacattgt

SEQ ID NO: 2961596 - DNA, 23 bp, Homo sapiens
tggaatttacctccccttttcta

SEQ ID NO: 2961597 - DNA, 18 bp, Homo sapiens
tggaatttataattcagt

SEQ ID NO: 2961598 - DNA, 20 bp, Homo sapiens
tggaatttataattcagtat

SEQ ID NO: 2961599 - DNA, 17 bp, Homo sapiens
tggaatttatatacaac

SEQ ID NO: 2961600 - DNA, 19 bp, Homo sapiens
tggaatttttgcttgactt

SEQ ID NO: 2961601 - DNA, 13 bp, Homo sapiens
tggacaaatgtga

SEQ ID NO: 2961602 - DNA, 19 bp, Homo sapiens
tggacaaatgtgaagatgc

SEQ ID NO: 2961603 - DNA, 16 bp, Homo sapiens
tggacaacttatttaa

SEQ ID NO: 2961604 - DNA, 22 bp, Homo sapiens
tggacaacttatttaaaaatat

SEQ ID NO: 2961605 - DNA, 15 bp, Homo sapiens
tggacaagtcatgga

SEQ ID NO: 2961606 - DNA, 15 bp, Homo sapiens
tggacaccctcacca

SEQ ID NO: 2961607 - DNA, 16 bp, Homo sapiens
tggacagaagcagctc

SEQ ID NO: 2961608 - DNA, 22 bp, Homo sapiens
tggacagacagaggatgagctc

SEQ ID NO: 2961609 - DNA, 22 bp, Homo sapiens
tggacagatggacgcaggccct

SEQ ID NO: 2961610 - DNA, 16 bp, Homo sapiens
tggacagattaatatt

SEQ ID NO: 2961611 - DNA, 20 bp, Homo sapiens
tggacaggatgaggacagag

SEQ ID NO: 2961612 - DNA, 14 bp, Homo sapiens
tggacaggctggct

SEQ ID NO: 2961613 - DNA, 23 bp, Homo sapiens
tggacagtttgtttcctgtctga

SEQ ID NO: 2961614 - DNA, 14 bp, Homo sapiens
tggacatagagagg

SEQ ID NO: 2961615 - DNA, 19 bp, Homo sapiens
tggacatagagagggagaa

SEQ ID NO: 2961616 - DNA, 18 bp, Homo sapiens
tggacatgaagattcttt

SEQ ID NO: 2961617 - DNA, 21 bp, Homo sapiens
tggacatgaagattctttccc

SEQ ID NO: 2961618 - DNA, 17 bp, Homo sapiens
tggacattttttcagtc

SEQ ID NO: 2961619 - DNA, 23 bp, Homo sapiens
tggaccaaacccttagcagccca

SEQ ID NO: 2961620 - DNA, 16 bp, Homo sapiens
tggaccacttggaaat

SEQ ID NO: 2961621 - DNA, 13 bp, Homo sapiens
tggaccaggacag

SEQ ID NO: 2961622 - DNA, 14 bp, Homo sapiens
tggaccaggacagg

SEQ ID NO: 2961623 - DNA, 18 bp, Homo sapiens
tggaccaggacaggacca

SEQ ID NO: 2961624 - DNA, 12 bp, Homo sapiens
tggaccaggtcc

SEQ ID NO: 2961625 - DNA, 18 bp, Homo sapiens
tggaccagtggtctcaca

SEQ ID NO: 2961626 - DNA, 16 bp, Homo sapiens
tggacccagggaacag

SEQ ID NO: 2961627 - DNA, 16 bp, Homo sapiens
tgctatttcagccaat

SEQ ID NO: 2961628 - DNA, 17 bp, Homo sapiens
tgctatttcaggccctc

SEQ ID NO: 2961629 - DNA, 15 bp, Homo sapiens
tgctcaaaaaatgag

SEQ ID NO: 2961630 - DNA, 15 bp, Homo sapiens
tgctcaatgccattg

SEQ ID NO: 2961631 - DNA, 16 bp, Homo sapiens
tgctcaatgccattgt

SEQ ID NO: 2961632 - DNA, 14 bp, Homo sapiens
tgctcaatttcagc

SEQ ID NO: 2961633 - DNA, 22 bp, Homo sapiens
tgctcacctggggtgtgggagg

SEQ ID NO: 2961634 - DNA, 14 bp, Homo sapiens
tgctcagagaagga

SEQ ID NO: 2961635 - DNA, 20 bp, Homo sapiens
tgctcagagacctgaagtgt

SEQ ID NO: 2961636 - DNA, 12 bp, Homo sapiens
tgctcagcttct

SEQ ID NO: 2961637 - DNA, 15 bp, Homo sapiens
tgctcagcttctcct

SEQ ID NO: 2961638 - DNA, 17 bp, Homo sapiens
tgctcaggtaaatctta

SEQ ID NO: 2961639 - DNA, 19 bp, Homo sapiens
tgctcagtacctgtgttga

SEQ ID NO: 2961640 - DNA, 21 bp, Homo sapiens
tgctcagtgggtaaaattaga

SEQ ID NO: 2961641 - DNA, 20 bp, Homo sapiens
tgctcagttgctaaacactg

SEQ ID NO: 2961642 - DNA, 17 bp, Homo sapiens
tgctcagttgtagaatg

SEQ ID NO: 2961643 - DNA, 19 bp, Homo sapiens
tgctcagttgtagaatgta

SEQ ID NO: 2961644 - DNA, 23 bp, Homo sapiens
tgctcatcattctctgtctcatc

SEQ ID NO: 2961645 - DNA, 19 bp, Homo sapiens
tgctcatgtgtgtggtcag

SEQ ID NO: 2961646 - DNA, 21 bp, Homo sapiens
tgctccaagatgttctcctga

SEQ ID NO: 2961647 - DNA, 16 bp, Homo sapiens
tgctccaagattctag

SEQ ID NO: 2961648 - DNA, 17 bp, Homo sapiens
tgctccaagattctaga

SEQ ID NO: 2961649 - DNA, 23 bp, Homo sapiens
tgctccaagttgagactcggccg

SEQ ID NO: 2961650 - DNA, 14 bp, Homo sapiens
tgctccagacctga

SEQ ID NO: 2961651 - DNA, 15 bp, Homo sapiens
tgctccagcaacaca

SEQ ID NO: 2961652 - DNA, 18 bp, Homo sapiens
tgcctagtgatgtagaaa

SEQ ID NO: 2961653 - DNA, 14 bp, Homo sapiens
tgcctataaattta

SEQ ID NO: 2961654 - DNA, 18 bp, Homo sapiens
tgcctcaagaggaatgaa

SEQ ID NO: 2961655 - DNA, 18 bp, Homo sapiens
tgcctcactaatttttgt

SEQ ID NO: 2961656 - DNA, 22 bp, Homo sapiens
tgcctcactaatttttgtatta

SEQ ID NO: 2961657 - DNA, 16 bp, Homo sapiens
tgcctcagccctgacc

SEQ ID NO: 2961658 - DNA, 15 bp, Homo sapiens
tgcctcagccttcca

SEQ ID NO: 2961659 - DNA, 17 bp, Homo sapiens
tgcctcagctcagcttc

SEQ ID NO: 2961660 - DNA, 21 bp, Homo sapiens
tgcctcagctcagcttcgtgc

SEQ ID NO: 2961661 - DNA, 20 bp, Homo sapiens
tgcctcagctgcatctgata

SEQ ID NO: 2961662 - DNA, 20 bp, Homo sapiens
tgcctcaggcactctcctgt

SEQ ID NO: 2961663 - DNA, 23 bp, Homo sapiens
tgcctcatcctcctcctcattca

SEQ ID NO: 2961664 - DNA, 16 bp, Homo sapiens
tgcctccacccacagt

SEQ ID NO: 2961665 - DNA, 13 bp, Homo sapiens
tgcctccaccgct

SEQ ID NO: 2961666 - DNA, 14 bp, Homo sapiens
tgcctccaggaacc

SEQ ID NO: 2961667 - DNA, 16 bp, Homo sapiens
tgcctccaggtgcaga

SEQ ID NO: 2961668 - DNA, 13 bp, Homo sapiens
tgcctccccaatc

SEQ ID NO: 2961669 - DNA, 18 bp, Homo sapiens
tgcctcccctctccttcc

SEQ ID NO: 2961670 - DNA, 15 bp, Homo sapiens
tgcctcccttcccag

SEQ ID NO: 2961671 - DNA, 16 bp, Homo sapiens
tgcctcctccctggct

SEQ ID NO: 2961672 - DNA, 15 bp, Homo sapiens
tgcctcctctctccc

SEQ ID NO: 2961673 - DNA, 21 bp, Homo sapiens
tgcctcctctctccctgcctc

SEQ ID NO: 2961674 - DNA, 15 bp, Homo sapiens
tgcctcctgatgttt

SEQ ID NO: 2961675 - DNA, 13 bp, Homo sapiens
tgcctcctggctc

SEQ ID NO: 2961676 - DNA, 14 bp, Homo sapiens
tgcctcctggctca

SEQ ID NO: 2961677 - DNA, 18 bp, Homo sapiens
tgcctccttgccagcccc

SEQ ID NO: 2961678 - DNA, 23 bp, Homo sapiens
tgcctcgaaacacagaaaccttt

SEQ ID NO: 2961679 - DNA, 17 bp, Homo sapiens
tgcctcgaaagtgtcat

SEQ ID NO: 2961680 - DNA, 20 bp, Homo sapiens
tgcctcgagggccgcctgcc

SEQ ID NO: 2961681 - DNA, 21 bp, Homo sapiens
tgcctcgcccccacttttcta

SEQ ID NO: 2961682 - DNA, 15 bp, Homo sapiens
tgcctcgccttgtgt

SEQ ID NO: 2961683 - DNA, 21 bp, Homo sapiens
tgcctcggcttttctcagctg

SEQ ID NO: 2961684 - DNA, 22 bp, Homo sapiens
tgcctcggtggccctgactgtc

SEQ ID NO: 2961685 - DNA, 20 bp, Homo sapiens
tgcctcggttgattgtgcat

SEQ ID NO: 2961686 - DNA, 20 bp, Homo sapiens
tgcctctactttgattctga

SEQ ID NO: 2961687 - DNA, 13 bp, Homo sapiens
tgcctctctttga

SEQ ID NO: 2961688 - DNA, 16 bp, Homo sapiens
tgcctctgacagcagc

SEQ ID NO: 2961689 - DNA, 21 bp, Homo sapiens
tgcctctgacagcagcctgtg

SEQ ID NO: 2961690 - DNA, 21 bp, Homo sapiens
tgcctctgtctagcatgccaa

SEQ ID NO: 2961691 - DNA, 16 bp, Homo sapiens
tgcctctgtcttctgg

SEQ ID NO: 2961692 - DNA, 22 bp, Homo sapiens
tgcctctgtgtagccgccctga

SEQ ID NO: 2961693 - DNA, 23 bp, Homo sapiens
tgcctctgtgtagccgccctgag

SEQ ID NO: 2961694 - DNA, 20 bp, Homo sapiens
tgcctgaaacccatttactt

SEQ ID NO: 2961695 - DNA, 13 bp, Homo sapiens
tgcctgaataaag

SEQ ID NO: 2961696 - DNA, 16 bp, Homo sapiens
tgcctgactaattttt

SEQ ID NO: 2961697 - DNA, 15 bp, Homo sapiens
tgcctgcactccctg

SEQ ID NO: 2961698 - DNA, 16 bp, Homo sapiens
tgcctgcactccctgg

SEQ ID NO: 2961699 - DNA, 20 bp, Homo sapiens
tgcctgcactccctggcctt

SEQ ID NO: 2961700 - DNA, 13 bp, Homo sapiens
tgcctgcagagat

SEQ ID NO: 2961701 - DNA, 15 bp, Homo sapiens
tgcctgcagcacatg

SEQ ID NO: 2961702 - DNA, 20 bp, Homo sapiens
tgcctgcagcacatgcgggc

SEQ ID NO: 2961703 - DNA, 23 bp, Homo sapiens
tgcctgccaacccatcggaaagg

SEQ ID NO: 2961704 - DNA, 17 bp, Homo sapiens
tgcctgcccgcaccctg

SEQ ID NO: 2961705 - DNA, 18 bp, Homo sapiens
tgcctgcccgcaccctgg

SEQ ID NO: 2961706 - DNA, 19 bp, Homo sapiens
tgcctgcccgcaccctggc

SEQ ID NO: 2961707 - DNA, 20 bp, Homo sapiens
tgcctgcccgcaccctggcc

SEQ ID NO: 2961708 - DNA, 17 bp, Homo sapiens
tgcctgctatttgaagt

SEQ ID NO: 2961709 - DNA, 23 bp, Homo sapiens
tgcctgctgaatgatttccaaag

SEQ ID NO: 2961710 - DNA, 15 bp, Homo sapiens
tgcctgctttctcca

SEQ ID NO: 2961711 - DNA, 19 bp, Homo sapiens
tgcctgctttgacgggcca

SEQ ID NO: 2961712 - DNA, 20 bp, Homo sapiens
tgcctgctttgacgggccag

SEQ ID NO: 2961713 - DNA, 18 bp, Homo sapiens
tgcctggaaagtcctcct

SEQ ID NO: 2961714 - DNA, 14 bp, Homo sapiens
tgcctggagtgctg

SEQ ID NO: 2961715 - DNA, 17 bp, Homo sapiens
tgcctggagtgctgtgc

SEQ ID NO: 2961716 - DNA, 17 bp, Homo sapiens
tgcctggccaggccctg

SEQ ID NO: 2961717 - DNA, 15 bp, Homo sapiens
tgcctggccatgctg

SEQ ID NO: 2961718 - DNA, 18 bp, Homo sapiens
tgcctggccatgctgtcc

SEQ ID NO: 2961719 - DNA, 15 bp, Homo sapiens
tgcctggccggccag

SEQ ID NO: 2961720 - DNA, 23 bp, Homo sapiens
tgcctggccggccagccagccac

SEQ ID NO: 2961721 - DNA, 19 bp, Homo sapiens
tgcctggcctgccagacac

SEQ ID NO: 2961722 - DNA, 16 bp, Homo sapiens
tgcctggcctggcaca

SEQ ID NO: 2961723 - DNA, 19 bp, Homo sapiens
tgcctgggtaggccccaca

SEQ ID NO: 2961724 - DNA, 17 bp, Homo sapiens
tgcctgggtggggctgc

SEQ ID NO: 2961725 - DNA, 23 bp, Homo sapiens
tgcctgggtggggctgctcctcc

SEQ ID NO: 2961726 - DNA, 24 bp, Homo sapiens
tgcctgggtggggctgctcctcca

SEQ ID NO: 2961727 - DNA, 15 bp, Homo sapiens
tgcctgtaacttgag

SEQ ID NO: 2961728 - DNA, 15 bp, Homo sapiens
tgcctgtagagccag

SEQ ID NO: 2961729 - DNA, 19 bp, Homo sapiens
tgcctgtagagccagcctt

SEQ ID NO: 2961730 - DNA, 18 bp, Homo sapiens
tgcctgtagcccactctg

SEQ ID NO: 2961731 - DNA, 17 bp, Homo sapiens
tgcctgtagtctcagct

SEQ ID NO: 2961732 - DNA, 22 bp, Homo sapiens
tgcctgtctaaagccttaacta

SEQ ID NO: 2961733 - DNA, 14 bp, Homo sapiens
tgcctgtctgtcca

SEQ ID NO: 2961734 - DNA, 15 bp, Homo sapiens
tgcctgtctgtccaa

SEQ ID NO: 2961735 - DNA, 20 bp, Homo sapiens
tgcctgtctgtccaacccct

SEQ ID NO: 2961736 - DNA, 17 bp, Homo sapiens
tgcctgtgactgtaaag

SEQ ID NO: 2961737 - DNA, 14 bp, Homo sapiens
tgcctgtgaggcag

SEQ ID NO: 2961738 - DNA, 16 bp, Homo sapiens
tgcctgtgaggcaggg

SEQ ID NO: 2961739 - DNA, 14 bp, Homo sapiens
tgcctgtgtcttct

SEQ ID NO: 2961740 - DNA, 17 bp, Homo sapiens
tgcctgttcagttacag

SEQ ID NO: 2961741 - DNA, 20 bp, Homo sapiens
tgcctgttcagttacagaaa

SEQ ID NO: 2961742 - DNA, 19 bp, Homo sapiens
tgccttacctcctgcccag

SEQ ID NO: 2961743 - DNA, 22 bp, Homo sapiens
tgccttagaaacacataaatta

SEQ ID NO: 2961744 - DNA, 13 bp, Homo sapiens
tgccttagcttca

SEQ ID NO: 2961745 - DNA, 14 bp, Homo sapiens
tgccttagcttcag

SEQ ID NO: 2961746 - DNA, 16 bp, Homo sapiens
tgccttagcttcagga

SEQ ID NO: 2961747 - DNA, 21 bp, Homo sapiens
tgccttaggaatactgtttta

SEQ ID NO: 2961748 - DNA, 14 bp, Homo sapiens
tgccttcctaagcc

SEQ ID NO: 2961749 - DNA, 19 bp, Homo sapiens
tgccttcctaagcctgtgg

SEQ ID NO: 2961750 - DNA, 20 bp, Homo sapiens
tgccttcctaagcctgtggc

SEQ ID NO: 2961751 - DNA, 23 bp, Homo sapiens
tgccttcctaagcctgtggctgt

SEQ ID NO: 2961752 - DNA, 15 bp, Homo sapiens
tgccttcctcctggg

SEQ ID NO: 2961753 - DNA, 16 bp, Homo sapiens
tgccttcctcctgggc

SEQ ID NO: 2961754 - DNA, 15 bp, Homo sapiens
tgccttctaaaggtg

SEQ ID NO: 2961755 - DNA, 17 bp, Homo sapiens
tgccttctcaccagctg

SEQ ID NO: 2961756 - DNA, 19 bp, Homo sapiens
tgccttctcaccagctgca

SEQ ID NO: 2961757 - DNA, 15 bp, Homo sapiens
tgccttctctcagct

SEQ ID NO: 2961758 - DNA, 16 bp, Homo sapiens
tgccttctctcagctc

SEQ ID NO: 2961759 - DNA, 19 bp, Homo sapiens
tgccttctctcagctccca

SEQ ID NO: 2961760 - DNA, 20 bp, Homo sapiens
tgccttctctcagctcccag

SEQ ID NO: 2961761 - DNA, 23 bp, Homo sapiens
tgccttctctcagctcccaggcc

SEQ ID NO: 2961762 - DNA, 14 bp, Homo sapiens
tgccttctgggaag

SEQ ID NO: 2961763 - DNA, 14 bp, Homo sapiens
tgccttcttcaggg

SEQ ID NO: 2961764 - DNA, 15 bp, Homo sapiens
tgccttcttcagggc

SEQ ID NO: 2961765 - DNA, 20 bp, Homo sapiens
tgccttcttcagggcctggt

SEQ ID NO: 2961766 - DNA, 16 bp, Homo sapiens
tgccttcttttgatta

SEQ ID NO: 2961767 - DNA, 15 bp, Homo sapiens
tgccttgaaatacct

SEQ ID NO: 2961768 - DNA, 19 bp, Homo sapiens
tgccttgcatttgtacctt

SEQ ID NO: 2961769 - DNA, 13 bp, Homo sapiens
tgccttgcccaca

SEQ ID NO: 2961770 - DNA, 14 bp, Homo sapiens
tgccttgcccacag

SEQ ID NO: 2961771 - DNA, 15 bp, Homo sapiens
tgccttgcccacagg

SEQ ID NO: 2961772 - DNA, 18 bp, Homo sapiens
tgccttgcccacaggtgc

SEQ ID NO: 2961773 - DNA, 12 bp, Homo sapiens
tgccttgccttt

SEQ ID NO: 2961774 - DNA, 13 bp, Homo sapiens
tgccttggctcag

SEQ ID NO: 2961775 - DNA, 16 bp, Homo sapiens
tgccttggctcagaca

SEQ ID NO: 2961776 - DNA, 17 bp, Homo sapiens
tgccttggctcagacat

SEQ ID NO: 2961777 - DNA, 17 bp, Homo sapiens
tgccttgtcacgccaga

SEQ ID NO: 2961778 - DNA, 21 bp, Homo sapiens
tgcctttagcccctcccaagc

SEQ ID NO: 2961779 - DNA, 17 bp, Homo sapiens
tgcctttatctcagcca

SEQ ID NO: 2961780 - DNA, 22 bp, Homo sapiens
tgcctttatctcagccatccgc

SEQ ID NO: 2961781 - DNA, 12 bp, Homo sapiens
tgcctttcaaat

SEQ ID NO: 2961782 - DNA, 23 bp, Homo sapiens
tgcctttcctatcacctcgagaa

SEQ ID NO: 2961783 - DNA, 19 bp, Homo sapiens
tgcctttgcaccacgggac

SEQ ID NO: 2961784 - DNA, 17 bp, Homo sapiens
tgcctttggcagagttc

SEQ ID NO: 2961785 - DNA, 12 bp, Homo sapiens
tgcctttgggag

SEQ ID NO: 2961786 - DNA, 23 bp, Homo sapiens
tgcctttgggtcgacatagtatg

SEQ ID NO: 2961787 - DNA, 16 bp, Homo sapiens
tgccttttgcagaaga

SEQ ID NO: 2961788 - DNA, 23 bp, Homo sapiens
tgcccacccccgggatcctgccc

SEQ ID NO: 2961789 - DNA, 14 bp, Homo sapiens
tgcccacctctctt

SEQ ID NO: 2961790 - DNA, 23 bp, Homo sapiens
tgcccacctgcctggccggccag

SEQ ID NO: 2961791 - DNA, 22 bp, Homo sapiens
tgcccactgctgcagtagggga

SEQ ID NO: 2961792 - DNA, 18 bp, Homo sapiens
tgcccagaatgaggctgc

SEQ ID NO: 2961793 - DNA, 19 bp, Homo sapiens
tgcccagaatgaggctgct

SEQ ID NO: 2961794 - DNA, 21 bp, Homo sapiens
tgcccagacatcagcctcctt

SEQ ID NO: 2961795 - DNA, 12 bp, Homo sapiens
tgcccagagatg

SEQ ID NO: 2961796 - DNA, 18 bp, Homo sapiens
tgcccagagatgcctcca

SEQ ID NO: 2961797 - DNA, 22 bp, Homo sapiens
tgcccagagatgcctccaccgc

SEQ ID NO: 2961798 - DNA, 13 bp, Homo sapiens
tgcccagccactc

SEQ ID NO: 2961799 - DNA, 16 bp, Homo sapiens
tgcccagccactccaa

SEQ ID NO: 2961800 - DNA, 22 bp, Homo sapiens
tgcccagccactccaagccccc

SEQ ID NO: 2961801 - DNA, 15 bp, Homo sapiens
tgcccagccagccac

SEQ ID NO: 2961802 - DNA, 20 bp, Homo sapiens
tgcccagccagccacccctg

SEQ ID NO: 2961803 - DNA, 21 bp, Homo sapiens
tgcccagccagccacccctgc

SEQ ID NO: 2961804 - DNA, 14 bp, Homo sapiens
tgcccagcctgggg

SEQ ID NO: 2961805 - DNA, 23 bp, Homo sapiens
tgcccagcctggggcaaacctag

SEQ ID NO: 2961806 - DNA, 23 bp, Homo sapiens
tgcccaggaactcgcacctgtgc

SEQ ID NO: 2961807 - DNA, 21 bp, Homo sapiens
tgcccaggagagccagccctc

SEQ ID NO: 2961808 - DNA, 23 bp, Homo sapiens
tgcccaggagagccagccctccc

SEQ ID NO: 2961809 - DNA, 15 bp, Homo sapiens
tgcccaggcactgca

SEQ ID NO: 2961810 - DNA, 13 bp, Homo sapiens
tgcccaggcctct

SEQ ID NO: 2961811 - DNA, 13 bp, Homo sapiens
tgcccaggctgga

SEQ ID NO: 2961812 - DNA, 20 bp, Homo sapiens
tgcccaggctggagtgcagt

SEQ ID NO: 2961813 - DNA, 13 bp, Homo sapiens
tgcccaggctggt

SEQ ID NO: 2961814 - DNA, 14 bp, Homo sapiens
tgcccagtctttca

SEQ ID NO: 2961815 - DNA, 13 bp, Homo sapiens
tgcccagttcact

SEQ ID NO: 2961816 - DNA, 14 bp, Homo sapiens
tgcccatcatctct

SEQ ID NO: 2961817 - DNA, 16 bp, Homo sapiens
tgcccatcatctctgc

SEQ ID NO: 2961818 - DNA, 17 bp, Homo sapiens
tgcccatcatctctgcc

SEQ ID NO: 2961819 - DNA, 18 bp, Homo sapiens
tgcccatcatctctgcct

SEQ ID NO: 2961820 - DNA, 21 bp, Homo sapiens
tgcccatcatctctgcctttg

SEQ ID NO: 2961821 - DNA, 24 bp, Homo sapiens
tgcccatggacaggctggctccag

SEQ ID NO: 2961822 - DNA, 17 bp, Homo sapiens
tgcccattcttttcact

SEQ ID NO: 2961823 - DNA, 18 bp, Homo sapiens
tgcccattcttttcactt

SEQ ID NO: 2961824 - DNA, 22 bp, Homo sapiens
tgcccatttcatattctttcaa

SEQ ID NO: 2961825 - DNA, 15 bp, Homo sapiens
tgccccaactcctgg

SEQ ID NO: 2961826 - DNA, 15 bp, Homo sapiens
tgccccactctgcct

SEQ ID NO: 2961827 - DNA, 21 bp, Homo sapiens
tgccccagactgagctctcca

SEQ ID NO: 2961828 - DNA, 12 bp, Homo sapiens
tgccccagccaa

SEQ ID NO: 2961829 - DNA, 13 bp, Homo sapiens
tgccccaggacca

SEQ ID NO: 2961830 - DNA, 14 bp, Homo sapiens
tgccccaggccgga

SEQ ID NO: 2961831 - DNA, 12 bp, Homo sapiens
tgccccaggctc

SEQ ID NO: 2961832 - DNA, 18 bp, Homo sapiens
tgccccatcctccagcag

SEQ ID NO: 2961833 - DNA, 19 bp, Homo sapiens
tgccccatcctccagcagg

SEQ ID NO: 2961834 - DNA, 21 bp, Homo sapiens
tgccccatgaagccacagccc

SEQ ID NO: 2961835 - DNA, 12 bp, Homo sapiens
tgccccattctt

SEQ ID NO: 2961836 - DNA, 19 bp, Homo sapiens
tgcccccagcccagagccc

SEQ ID NO: 2961837 - DNA, 14 bp, Homo sapiens
tgccccccagggct

SEQ ID NO: 2961838 - DNA, 15 bp, Homo sapiens
tgccccccagggcta

SEQ ID NO: 2961839 - DNA, 19 bp, Homo sapiens
tgaatggactcatcttagt

SEQ ID NO: 2961840 - DNA, 22 bp, Homo sapiens
tgaatggctttgtcttgaaaaa

SEQ ID NO: 2961841 - DNA, 21 bp, Homo sapiens
tgaatgggatattttgaaatg

SEQ ID NO: 2961842 - DNA, 17 bp, Homo sapiens
tgaatgggtccattttg

SEQ ID NO: 2961843 - DNA, 17 bp, Homo sapiens
tgaatgtaaaagacact

SEQ ID NO: 2961844 - DNA, 14 bp, Homo sapiens
tgaatgtatgcttc

SEQ ID NO: 2961845 - DNA, 15 bp, Homo sapiens
tgaatgtatttattt

SEQ ID NO: 2961846 - DNA, 14 bp, Homo sapiens
tgaatgtcattatt

SEQ ID NO: 2961847 - DNA, 18 bp, Homo sapiens
tgaatgtcattatttgat

SEQ ID NO: 2961848 - DNA, 19 bp, Homo sapiens
tgaatgtcattatttgata

SEQ ID NO: 2961849 - DNA, 22 bp, Homo sapiens
tgaatgtcttccttttctttct

SEQ ID NO: 2961850 - DNA, 20 bp, Homo sapiens
tgaatgtgcaaaaaaagaaa

SEQ ID NO: 2961851 - DNA, 16 bp, Homo sapiens
tgaatgtgtgagaaaa

SEQ ID NO: 2961852 - DNA, 18 bp, Homo sapiens
tgaatgtgtgagaaaaac

SEQ ID NO: 2961853 - DNA, 20 bp, Homo sapiens
tgaatgttaacaggtatttt

SEQ ID NO: 2961854 - DNA, 13 bp, Homo sapiens
tgaatgtttacat

SEQ ID NO: 2961855 - DNA, 19 bp, Homo sapiens
tgaatgtttgtgtctgtgg

SEQ ID NO: 2961856 - DNA, 19 bp, Homo sapiens
tgaattaaaataaaacaca

SEQ ID NO: 2961857 - DNA, 13 bp, Homo sapiens
tgaattaaacatg

SEQ ID NO: 2961858 - DNA, 21 bp, Homo sapiens
tgaattatccacatgaaaata

SEQ ID NO: 2961859 - DNA, 22 bp, Homo sapiens
tgaattcagacctggaatgtaa

SEQ ID NO: 2961860 - DNA, 18 bp, Homo sapiens
tgaattcatactctgttg

SEQ ID NO: 2961861 - DNA, 17 bp, Homo sapiens
tgaattccaagtgtatt

SEQ ID NO: 2961862 - DNA, 21 bp, Homo sapiens
tgaattcttggttgaggaaac

SEQ ID NO: 2961863 - DNA, 13 bp, Homo sapiens
tgaattgaaattt

SEQ ID NO: 2961864 - DNA, 22 bp, Homo sapiens
tgaattgcgttggtctctgcat

SEQ ID NO: 2961865 - DNA, 13 bp, Homo sapiens
tgaattgttacat

SEQ ID NO: 2961866 - DNA, 23 bp, Homo sapiens
tgaatttctgacctcaagtgatt

SEQ ID NO: 2961867 - DNA, 14 bp, Homo sapiens
tgaatttctttgat

SEQ ID NO: 2961868 - DNA, 18 bp, Homo sapiens
tgaatttgagtttgctgt

SEQ ID NO: 2961869 - DNA, 14 bp, Homo sapiens
tgaatttgcaaagt

SEQ ID NO: 2961870 - DNA, 17 bp, Homo sapiens
tgaatttgcaaagtact

SEQ ID NO: 2961871 - DNA, 19 bp, Homo sapiens
tgaatttgcaaagtactgt

SEQ ID NO: 2961872 - DNA, 20 bp, Homo sapiens
tgaatttgcaaagtactgta

SEQ ID NO: 2961873 - DNA, 15 bp, Homo sapiens
tgaatttgccctggg

SEQ ID NO: 2961874 - DNA, 21 bp, Homo sapiens
tgaattttaaaacatgctgtt

SEQ ID NO: 2961875 - DNA, 15 bp, Homo sapiens
tgaattttctgtgtt

SEQ ID NO: 2961876 - DNA, 21 bp, Homo sapiens
tgaatttttatttctttttaa

SEQ ID NO: 2961877 - DNA, 22 bp, Homo sapiens
tgaatttttctctaactcagaa

SEQ ID NO: 2961878 - DNA, 23 bp, Homo sapiens
tgaatttttttcatcttctctgg

SEQ ID NO: 2961879 - DNA, 18 bp, Homo sapiens
tgacaaaaaatgttttaa

SEQ ID NO: 2961880 - DNA, 14 bp, Homo sapiens
tgacaaaagtgaca

SEQ ID NO: 2961881 - DNA, 20 bp, Homo sapiens
tgacaaacccggaagatcag

SEQ ID NO: 2961882 - DNA, 23 bp, Homo sapiens
tgacaaagtgttgaaaatgtatt

SEQ ID NO: 2961883 - DNA, 21 bp, Homo sapiens
tgacaacatggcttctccttt

SEQ ID NO: 2961884 - DNA, 19 bp, Homo sapiens
tgacaaccgagaaggttta

SEQ ID NO: 2961885 - DNA, 15 bp, Homo sapiens
tgacaacgtctcttc

SEQ ID NO: 2961886 - DNA, 13 bp, Homo sapiens
tgacaactggcag

SEQ ID NO: 2961887 - DNA, 15 bp, Homo sapiens
tgacaactggcaggc

SEQ ID NO: 2961888 - DNA, 18 bp, Homo sapiens
tgacaactggcaggcagg

SEQ ID NO: 2961889 - DNA, 13 bp, Homo sapiens
tgacaagcagata

SEQ ID NO: 2961890 - DNA, 22 bp, Homo sapiens
tgacaagcagatactgctgtgt

SEQ ID NO: 2961891 - DNA, 21 bp, Homo sapiens
tgacaagctgtatcactgcct

SEQ ID NO: 2961892 - DNA, 14 bp, Homo sapiens
tgacaataaaacat

SEQ ID NO: 2961893 - DNA, 17 bp, Homo sapiens
tgacaatactgctgcct

SEQ ID NO: 2961894 - DNA, 22 bp, Homo sapiens
tgacaatactgctgccttaccc

SEQ ID NO: 2961895 - DNA, 17 bp, Homo sapiens
tgacaatagttatgcct

SEQ ID NO: 2961896 - DNA, 14 bp, Homo sapiens
tgacaatcttttgg

SEQ ID NO: 2961897 - DNA, 13 bp, Homo sapiens
tgacaatgttgta

SEQ ID NO: 2961898 - DNA, 17 bp, Homo sapiens
tgacaattctgttttta

SEQ ID NO: 2961899 - DNA, 18 bp, Homo sapiens
tgacaattttgtacaaat

SEQ ID NO: 2961900 - DNA, 19 bp, Homo sapiens
tgacacaagtggaccttag

SEQ ID NO: 2961901 - DNA, 15 bp, Homo sapiens
tgacacactacacca

SEQ ID NO: 2961902 - DNA, 16 bp, Homo sapiens
tgacacactacaccac

SEQ ID NO: 2961903 - DNA, 18 bp, Homo sapiens
tgacacactacaccacac

SEQ ID NO: 2961904 - DNA, 20 bp, Homo sapiens
tgacacactacaccacacac

SEQ ID NO: 2961905 - DNA, 23 bp, Homo sapiens
tgacacagaaaatgttgagaatc

SEQ ID NO: 2961906 - DNA, 12 bp, Homo sapiens
tgacacagactc

SEQ ID NO: 2961907 - DNA, 17 bp, Homo sapiens
tgacacagactcatcct

SEQ ID NO: 2961908 - DNA, 17 bp, Homo sapiens
tgacacaggtctttcct

SEQ ID NO: 2961909 - DNA, 13 bp, Homo sapiens
tgacacatcagca

SEQ ID NO: 2961910 - DNA, 14 bp, Homo sapiens
tgacacatcagcat

SEQ ID NO: 2961911 - DNA, 20 bp, Homo sapiens
tgacacatcagcatgttttc

SEQ ID NO: 2961912 - DNA, 13 bp, Homo sapiens
tgacaccatcaga

SEQ ID NO: 2961913 - DNA, 19 bp, Homo sapiens
tgacacccaagagggctgc

SEQ ID NO: 2961914 - DNA, 13 bp, Homo sapiens
tgacacggtagca

SEQ ID NO: 2961915 - DNA, 17 bp, Homo sapiens
tgacactctccttgcag

SEQ ID NO: 2961916 - DNA, 18 bp, Homo sapiens
tgacactctccttgcagt

SEQ ID NO: 2961917 - DNA, 13 bp, Homo sapiens
tgacactggacca

SEQ ID NO: 2961918 - DNA, 15 bp, Homo sapiens
tgacacttcaaggtg

SEQ ID NO: 2961919 - DNA, 16 bp, Homo sapiens
tgacagacatccttgc

SEQ ID NO: 2961920 - DNA, 19 bp, Homo sapiens
tgacagatcaagctgtgag

SEQ ID NO: 2961921 - DNA, 17 bp, Homo sapiens
tgacagcagcctgtgag

SEQ ID NO: 2961922 - DNA, 20 bp, Homo sapiens
tgacagccttgggcctttca

SEQ ID NO: 2961923 - DNA, 15 bp, Homo sapiens
tgacagctgctccta

SEQ ID NO: 2961924 - DNA, 18 bp, Homo sapiens
tgacagctgctcctagag

SEQ ID NO: 2961925 - DNA, 21 bp, Homo sapiens
tgacagctgctcctagaggga

SEQ ID NO: 2961926 - DNA, 22 bp, Homo sapiens
tgacagctgctcctagagggag

SEQ ID NO: 2961927 - DNA, 13 bp, Homo sapiens
tgacagctttgct

SEQ ID NO: 2961928 - DNA, 14 bp, Homo sapiens
tgacagctttgctg

SEQ ID NO: 2961929 - DNA, 18 bp, Homo sapiens
tgacagctttgctgctga

SEQ ID NO: 2961930 - DNA, 21 bp, Homo sapiens
tgacagctttgctgctgaagg

SEQ ID NO: 2961931 - DNA, 19 bp, Homo sapiens
tgacaggaaagattcatgt

SEQ ID NO: 2961932 - DNA, 18 bp, Homo sapiens
tgacaggcagcctggaca

SEQ ID NO: 2961933 - DNA, 13 bp, Homo sapiens
tgacagggaagct

SEQ ID NO: 2961934 - DNA, 14 bp, Homo sapiens
tgacagggaagcta

SEQ ID NO: 2961935 - DNA, 20 bp, Homo sapiens
tgacagggaagctacaggtt

SEQ ID NO: 2961936 - DNA, 17 bp, Homo sapiens
tgacaggtttgggaccc

SEQ ID NO: 2961937 - DNA, 21 bp, Homo sapiens
tgacagtattatacgctggca

SEQ ID NO: 2961938 - DNA, 18 bp, Homo sapiens
tgagcaatgtataacccc

SEQ ID NO: 2961939 - DNA, 16 bp, Homo sapiens
tgagcaccaggggatg

SEQ ID NO: 2961940 - DNA, 15 bp, Homo sapiens
tgagcactcctgatt

SEQ ID NO: 2961941 - DNA, 21 bp, Homo sapiens
tgagcagaagactatttacca

SEQ ID NO: 2961942 - DNA, 22 bp, Homo sapiens
tgagcagaatacaatgggaaaa

SEQ ID NO: 2961943 - DNA, 22 bp, Homo sapiens
tgagcagtctacttctgtgtct

SEQ ID NO: 2961944 - DNA, 22 bp, Homo sapiens
tgagcatacatcttaaatcttt

SEQ ID NO: 2961945 - DNA, 20 bp, Homo sapiens
tgagcatagagaacaaagta

SEQ ID NO: 2961946 - DNA, 22 bp, Homo sapiens
tgagcatagagaacaaagtaaa

SEQ ID NO: 2961947 - DNA, 14 bp, Homo sapiens
tgagccaagaaaca

SEQ ID NO: 2961948 - DNA, 16 bp, Homo sapiens
tgagccaccacacctg

SEQ ID NO: 2961949 - DNA, 15 bp, Homo sapiens
tgagccactgcgccc

SEQ ID NO: 2961950 - DNA, 22 bp, Homo sapiens
tgagccaggctagctggagcct

SEQ ID NO: 2961951 - DNA, 23 bp, Homo sapiens
tgagccaggctagctggagcctg

SEQ ID NO: 2961952 - DNA, 21 bp, Homo sapiens
tgagccagttgtcctatggac

SEQ ID NO: 2961953 - DNA, 22 bp, Homo sapiens
tgagccatagagatatttaaaa

SEQ ID NO: 2961954 - DNA, 21 bp, Homo sapiens
tgagcccagctgggtcaggca

SEQ ID NO: 2961955 - DNA, 17 bp, Homo sapiens
tgagcccctgtctagag

SEQ ID NO: 2961956 - DNA, 22 bp, Homo sapiens
tgagcccctgtctagagaggga

SEQ ID NO: 2961957 - DNA, 15 bp, Homo sapiens
tgagcccgcagccca

SEQ ID NO: 2961958 - DNA, 16 bp, Homo sapiens
tgagcccgcagcccag

SEQ ID NO: 2961959 - DNA, 14 bp, Homo sapiens
tgagccctcagaac

SEQ ID NO: 2961960 - DNA, 22 bp, Homo sapiens
tgagccctcagaacccttggct

SEQ ID NO: 2961961 - DNA, 13 bp, Homo sapiens
tgagccctcccca

SEQ ID NO: 2961962 - DNA, 14 bp, Homo sapiens
tgagccctccccag

SEQ ID NO: 2961963 - DNA, 16 bp, Homo sapiens
tgagccctccccagga

SEQ ID NO: 2961964 - DNA, 14 bp, Homo sapiens
tgagccctctaggg

SEQ ID NO: 2961965 - DNA, 20 bp, Homo sapiens
tgagccgcatcttctccatc

SEQ ID NO: 2961966 - DNA, 17 bp, Homo sapiens
tgagcctagccctggga

SEQ ID NO: 2961967 - DNA, 14 bp, Homo sapiens
tgagcctctgctcc

SEQ ID NO: 2961968 - DNA, 16 bp, Homo sapiens
tgagcctctgctcccc

SEQ ID NO: 2961969 - DNA, 13 bp, Homo sapiens
tgagcctgcaggg

SEQ ID NO: 2961970 - DNA, 12 bp, Homo sapiens
tgagcctggcca

SEQ ID NO: 2961971 - DNA, 18 bp, Homo sapiens
tgagcctgtgaccttggg

SEQ ID NO: 2961972 - DNA, 19 bp, Homo sapiens
tgagcctgtttattgccat

SEQ ID NO: 2961973 - DNA, 15 bp, Homo sapiens
tgagccttctactta

SEQ ID NO: 2961974 - DNA, 13 bp, Homo sapiens
tgagccttgctgc

SEQ ID NO: 2961975 - DNA, 17 bp, Homo sapiens
tgagccttgctgccaag

SEQ ID NO: 2961976 - DNA, 15 bp, Homo sapiens
tgagcgaggaaaaac

SEQ ID NO: 2961977 - DNA, 17 bp, Homo sapiens
tgagcgaggaaaaacaa

SEQ ID NO: 2961978 - DNA, 22 bp, Homo sapiens
tgagcgaggagatgctccttgg

SEQ ID NO: 2961979 - DNA, 19 bp, Homo sapiens
tgagcgagtggatgctgtg

SEQ ID NO: 2961980 - DNA, 15 bp, Homo sapiens
tgagcgcaagccaca

SEQ ID NO: 2961981 - DNA, 13 bp, Homo sapiens
tgagctacaaatg

SEQ ID NO: 2961982 - DNA, 16 bp, Homo sapiens
tgagctacaaatgcat

SEQ ID NO: 2961983 - DNA, 15 bp, Homo sapiens
tgagtctagatgttt

SEQ ID NO: 2961984 - DNA, 19 bp, Homo sapiens
tgagtctcaagggtggcag

SEQ ID NO: 2961985 - DNA, 15 bp, Homo sapiens
tgagtctccagggcc

SEQ ID NO: 2961986 - DNA, 11 bp, Homo sapiens
tgagtctctga

SEQ ID NO: 2961987 - DNA, 14 bp, Homo sapiens
tgagtctggcaaac

SEQ ID NO: 2961988 - DNA, 18 bp, Homo sapiens
tgagtctggcaaacatgt

SEQ ID NO: 2961989 - DNA, 21 bp, Homo sapiens
tgagtctgggcagctgtccct

SEQ ID NO: 2961990 - DNA, 17 bp, Homo sapiens
tgagtctttggttctaa

SEQ ID NO: 2961991 - DNA, 18 bp, Homo sapiens
tgagtctttggttctaag

SEQ ID NO: 2961992 - DNA, 15 bp, Homo sapiens
tgagtgaaagtactt

SEQ ID NO: 2961993 - DNA, 19 bp, Homo sapiens
tgagtgacatagcctcatg

SEQ ID NO: 2961994 - DNA, 19 bp, Homo sapiens
tgagtgcagccgtttgaga

SEQ ID NO: 2961995 - DNA, 13 bp, Homo sapiens
tgagtgctctgat

SEQ ID NO: 2961996 - DNA, 15 bp, Homo sapiens
tgagtggagtttcca

SEQ ID NO: 2961997 - DNA, 13 bp, Homo sapiens
tgagtggcatgtg

SEQ ID NO: 2961998 - DNA, 18 bp, Homo sapiens
tgagtgtctctgcctgga

SEQ ID NO: 2961999 - DNA, 23 bp, Homo sapiens
tgagtgtgtgtgatgggatctgt

SEQ ID NO: 2962000 - DNA, 23 bp, Homo sapiens
tgagtgttcctttttaaatgtga

SEQ ID NO: 2962001 - DNA, 21 bp, Homo sapiens
tgagtgttttatgagaaagcc

SEQ ID NO: 2962002 - DNA, 19 bp, Homo sapiens
tgagttacattaaaataaa

SEQ ID NO: 2962003 - DNA, 23 bp, Homo sapiens
tgagttacattaaaataaaccaa

SEQ ID NO: 2962004 - DNA, 16 bp, Homo sapiens
tgagttactgtgcatt

SEQ ID NO: 2962005 - DNA, 17 bp, Homo sapiens
tgagttactgtgcattg

SEQ ID NO: 2962006 - DNA, 20 bp, Homo sapiens
tgagttatatgttcactgtc

SEQ ID NO: 2962007 - DNA, 15 bp, Homo sapiens
tgagttatctaagaa

SEQ ID NO: 2962008 - DNA, 18 bp, Homo sapiens
tgagttcctagccaccgc

SEQ ID NO: 2962009 - DNA, 12 bp, Homo sapiens
tgagttctcact

SEQ ID NO: 2962010 - DNA, 18 bp, Homo sapiens
tgagttctcactatgttt

SEQ ID NO: 2962011 - DNA, 19 bp, Homo sapiens
tgagttctcactatgtttc

SEQ ID NO: 2962012 - DNA, 19 bp, Homo sapiens
tgagttggggtctggcagc

SEQ ID NO: 2962013 - DNA, 19 bp, Homo sapiens
tgagtttaaaaatcaactt

SEQ ID NO: 2962014 - DNA, 17 bp, Homo sapiens
tgagtttcagctggaaa

SEQ ID NO: 2962015 - DNA, 16 bp, Homo sapiens
tgagtttcccttcctt

SEQ ID NO: 2962016 - DNA, 19 bp, Homo sapiens
tgagtttggtccctaaatt

SEQ ID NO: 2962017 - DNA, 19 bp, Homo sapiens
tgagttttccatggcagga

SEQ ID NO: 2962018 - DNA, 18 bp, Homo sapiens
tgagtttttatggggctg

SEQ ID NO: 2962019 - DNA, 15 bp, Homo sapiens
tgataaaatgttcct

SEQ ID NO: 2962020 - DNA, 19 bp, Homo sapiens
tgataaagtagtaaaaatt

SEQ ID NO: 2962021 - DNA, 14 bp, Homo sapiens
tgataactttgctt

SEQ ID NO: 2962022 - DNA, 15 bp, Homo sapiens
tgataactttgcttg

SEQ ID NO: 2962023 - DNA, 13 bp, Homo sapiens
tgataagattgaa

SEQ ID NO: 2962024 - DNA, 16 bp, Homo sapiens
tgataagattgaaatt

SEQ ID NO: 2962025 - DNA, 19 bp, Homo sapiens
tgataagattgaaattcca

SEQ ID NO: 2962026 - DNA, 16 bp, Homo sapiens
tgataatgaactttat

SEQ ID NO: 2962027 - DNA, 19 bp, Homo sapiens
tgataattgcattcatctt

SEQ ID NO: 2962028 - DNA, 16 bp, Homo sapiens
tgatacaagattagaa

SEQ ID NO: 2962029 - DNA, 17 bp, Homo sapiens
tgatacaagattagaag

SEQ ID NO: 2962030 - DNA, 21 bp, Homo sapiens
tgatacagtgttttttaggaa

SEQ ID NO: 2962031 - DNA, 16 bp, Homo sapiens
tgatactcatttctta

SEQ ID NO: 2962032 - DNA, 14 bp, Homo sapiens
tgatactgatgcca

SEQ ID NO: 2962033 - DNA, 19 bp, Homo sapiens
tgatactgatgccatgtaa

SEQ ID NO: 2962034 - DNA, 13 bp, Homo sapiens
tgatactgatggt

SEQ ID NO: 2962035 - DNA, 18 bp, Homo sapiens
tgatactggaggaacact

SEQ ID NO: 2962036 - DNA, 18 bp, Homo sapiens
tgatagaactgtactgtt

SEQ ID NO: 2962037 - DNA, 17 bp, Homo sapiens
tgatagatgtttgactt

SEQ ID NO: 2962038 - DNA, 13 bp, Homo sapiens
tgataggaggggg

SEQ ID NO: 2962039 - DNA, 18 bp, Homo sapiens
tgatagtgcaaggaatga

SEQ ID NO: 2962040 - DNA, 12 bp, Homo sapiens
tgatagtgcttc

SEQ ID NO: 2962041 - DNA, 16 bp, Homo sapiens
tgatagtgcttcttgt

SEQ ID NO: 2962042 - DNA, 19 bp, Homo sapiens
tgatagtgcttcttgtaat

SEQ ID NO: 2962043 - DNA, 20 bp, Homo sapiens
tgatagtgcttcttgtaata

SEQ ID NO: 2962044 - DNA, 17 bp, Homo sapiens
tgatatagaattagctt

SEQ ID NO: 2962045 - DNA, 18 bp, Homo sapiens
tgatatagaattagcttt

SEQ ID NO: 2962046 - DNA, 22 bp, Homo sapiens
tgatatagaattagctttttca

SEQ ID NO: 2962047 - DNA, 18 bp, Homo sapiens
tgatatatgtattaataa

SEQ ID NO: 2962048 - DNA, 21 bp, Homo sapiens
tgatatatgtgtttttcacat

SEQ ID NO: 2962049 - DNA, 19 bp, Homo sapiens
tgatatcggtgctatgtgt

SEQ ID NO: 2962050 - DNA, 12 bp, Homo sapiens
tgatatgcagcc

SEQ ID NO: 2962051 - DNA, 19 bp, Homo sapiens
tgatatgcagttttcctta

SEQ ID NO: 2962052 - DNA, 21 bp, Homo sapiens
tgatatggtactaaggagaat

SEQ ID NO: 2962053 - DNA, 17 bp, Homo sapiens
tgatatgttttatttca

SEQ ID NO: 2962054 - DNA, 15 bp, Homo sapiens
tgatattgctgtgag

SEQ ID NO: 2962055 - DNA, 13 bp, Homo sapiens
tgatattgtgaac

SEQ ID NO: 2962056 - DNA, 19 bp, Homo sapiens
tgatatttattatattttt

SEQ ID NO: 2962057 - DNA, 14 bp, Homo sapiens
tgatatttccttca

SEQ ID NO: 2962058 - DNA, 15 bp, Homo sapiens
tgatatttccttcac

SEQ ID NO: 2962059 - DNA, 15 bp, Homo sapiens
tgatatttctctagt

SEQ ID NO: 2962060 - DNA, 18 bp, Homo sapiens
tgatatttctctagtagt

SEQ ID NO: 2962061 - DNA, 19 bp, Homo sapiens
tgatatttctctagtagtt

SEQ ID NO: 2962062 - DNA, 15 bp, Homo sapiens
tgatatttcttgctt

SEQ ID NO: 2962063 - DNA, 18 bp, Homo sapiens
tgatcaaagccacactct

SEQ ID NO: 2962064 - DNA, 14 bp, Homo sapiens
tgatcaatgaaatg

SEQ ID NO: 2962065 - DNA, 18 bp, Homo sapiens
tgatcacccccctgctta

SEQ ID NO: 2962066 - DNA, 19 bp, Homo sapiens
tgatcacccccctgcttag

SEQ ID NO: 2962067 - DNA, 15 bp, Homo sapiens
tgatcagcaaaaaga

SEQ ID NO: 2962068 - DNA, 19 bp, Homo sapiens
tgatcaggcttcctggtga

SEQ ID NO: 2962069 - DNA, 21 bp, Homo sapiens
tgatcaggcttcctggtgaga

SEQ ID NO: 2962070 - DNA, 15 bp, Homo sapiens
tgatcagtggacagt

SEQ ID NO: 2962071 - DNA, 19 bp, Homo sapiens
tgatcagtggacagtctgc

SEQ ID NO: 2962072 - DNA, 11 bp, Homo sapiens
tgatcagtgtt

SEQ ID NO: 2962073 - DNA, 21 bp, Homo sapiens
tgatcagttttttcacctgga

SEQ ID NO: 2962074 - DNA, 15 bp, Homo sapiens
tgatcatcgccagag

SEQ ID NO: 2962075 - DNA, 13 bp, Homo sapiens
tgatcatctttgc

SEQ ID NO: 2962076 - DNA, 22 bp, Homo sapiens
tgatcattcataattttatcta

SEQ ID NO: 2962077 - DNA, 14 bp, Homo sapiens
tgatcattctggag

SEQ ID NO: 2962078 - DNA, 14 bp, Homo sapiens
tgatccacccacct

SEQ ID NO: 2962079 - DNA, 21 bp, Homo sapiens
tgatccacccacctcagcctc

SEQ ID NO: 2962080 - DNA, 22 bp, Homo sapiens
tgatccacccacctcagcctcc

SEQ ID NO: 2962081 - DNA, 17 bp, Homo sapiens
tgatccagccctgagtt

SEQ ID NO: 2962082 - DNA, 13 bp, Homo sapiens
tgatccatccagc

SEQ ID NO: 2962083 - DNA, 19 bp, Homo sapiens
tgatccatccagcttgcca

SEQ ID NO: 2962084 - DNA, 18 bp, Homo sapiens
tgatccccaagtgtgaac

SEQ ID NO: 2962085 - DNA, 20 bp, Homo sapiens
tgatcccgttttccccatga

SEQ ID NO: 2962086 - DNA, 15 bp, Homo sapiens
tgatccctggccact

SEQ ID NO: 2962087 - DNA, 16 bp, Homo sapiens
tgatccctggccactg

SEQ ID NO: 2962088 - DNA, 17 bp, Homo sapiens
tgatcctcacgccttgg

SEQ ID NO: 2962089 - DNA, 13 bp, Homo sapiens
tgatcctccaaca

SEQ ID NO: 2962090 - DNA, 14 bp, Homo sapiens
tgatcctctcacct

SEQ ID NO: 2962091 - DNA, 15 bp, Homo sapiens
tgatcctggaggccc

SEQ ID NO: 2962092 - DNA, 17 bp, Homo sapiens
tgatcctggaggcccag

SEQ ID NO: 2962093 - DNA, 18 bp, Homo sapiens
tgatcctggaggcccagt

SEQ ID NO: 2962094 - DNA, 20 bp, Homo sapiens
tgatcctggaggcccagttc

SEQ ID NO: 2962095 - DNA, 23 bp, Homo sapiens
tgatcctggaggtcttttctagt

SEQ ID NO: 2962096 - DNA, 15 bp, Homo sapiens
tgatcgacgtggtga

SEQ ID NO: 2962097 - DNA, 23 bp, Homo sapiens
tgatcgccttatttatattcatc

SEQ ID NO: 2962098 - DNA, 17 bp, Homo sapiens
tgatcgcctttcccagg

SEQ ID NO: 2962099 - DNA, 15 bp, Homo sapiens
tgatcgcttggttat

SEQ ID NO: 2962100 - DNA, 15 bp, Homo sapiens
tgatcgtgacgctga

SEQ ID NO: 2962101 - DNA, 21 bp, Homo sapiens
tgatcgtgacgctgaataaat

SEQ ID NO: 2962102 - DNA, 15 bp, Homo sapiens
tgatctacccgtgcc

SEQ ID NO: 2962103 - DNA, 17 bp, Homo sapiens
tgatctacccgtgcctg

SEQ ID NO: 2962104 - DNA, 21 bp, Homo sapiens
tgatctaccttgaattgatat

SEQ ID NO: 2962105 - DNA, 15 bp, Homo sapiens
tgatctcaagtatat

SEQ ID NO: 2962106 - DNA, 15 bp, Homo sapiens
tgatctccctgccgc

SEQ ID NO: 2962107 - DNA, 17 bp, Homo sapiens
tgatctccctgccgcct

SEQ ID NO: 2962108 - DNA, 16 bp, Homo sapiens
tgatctccgtatgatg

SEQ ID NO: 2962109 - DNA, 14 bp, Homo sapiens
tgatctggaaccca

SEQ ID NO: 2962110 - DNA, 18 bp, Homo sapiens
tgatctggtggtctcctc

SEQ ID NO: 2962111 - DNA, 11 bp, Homo sapiens
tgatcttaaag

SEQ ID NO: 2962112 - DNA, 13 bp, Homo sapiens
tgatcttaaagat

SEQ ID NO: 2962113 - DNA, 16 bp, Homo sapiens
tgatcttaagaggctg

SEQ ID NO: 2962114 - DNA, 15 bp, Homo sapiens
tgatcttatttttct

SEQ ID NO: 2962115 - DNA, 18 bp, Homo sapiens
tgatcttggaaaaacagc

SEQ ID NO: 2962116 - DNA, 23 bp, Homo sapiens
tgcaaaatgcgtatttgcatttg

SEQ ID NO: 2962117 - DNA, 12 bp, Homo sapiens
tgcaaaatgtct

SEQ ID NO: 2962118 - DNA, 13 bp, Homo sapiens
tgcaaaatgtctt

SEQ ID NO: 2962119 - DNA, 15 bp, Homo sapiens
tgcaaacgctgcctg

SEQ ID NO: 2962120 - DNA, 16 bp, Homo sapiens
tgcaaacgctgcctgc

SEQ ID NO: 2962121 - DNA, 21 bp, Homo sapiens
tgcaaacgctgcctgccggta

SEQ ID NO: 2962122 - DNA, 15 bp, Homo sapiens
tgcaaagaggcaaga

SEQ ID NO: 2962123 - DNA, 12 bp, Homo sapiens
tgcaaagatctg

SEQ ID NO: 2962124 - DNA, 21 bp, Homo sapiens
tgcaaagctctgtggccacat

SEQ ID NO: 2962125 - DNA, 21 bp, Homo sapiens
tgcaaagtactgtaagaataa

SEQ ID NO: 2962126 - DNA, 15 bp, Homo sapiens
tgcaaagtctccaga

SEQ ID NO: 2962127 - DNA, 10 bp, Homo sapiens
tgcaaagtgt

SEQ ID NO: 2962128 - DNA, 16 bp, Homo sapiens
tgcaaataagactctt

SEQ ID NO: 2962129 - DNA, 20 bp, Homo sapiens
tgcaaatagccttcctgacc

SEQ ID NO: 2962130 - DNA, 18 bp, Homo sapiens
tgcaaatattagcaaaga

SEQ ID NO: 2962131 - DNA, 10 bp, Homo sapiens
tgcaaatcct

SEQ ID NO: 2962132 - DNA, 19 bp, Homo sapiens
tgcaaatcctatgtgattt

SEQ ID NO: 2962133 - DNA, 14 bp, Homo sapiens
tgcaaatcttgaaa

SEQ ID NO: 2962134 - DNA, 20 bp, Homo sapiens
tgcaacacaacatttgtgtc

SEQ ID NO: 2962135 - DNA, 22 bp, Homo sapiens
tgcaacatggattccaaagcat

SEQ ID NO: 2962136 - DNA, 19 bp, Homo sapiens
tgcaaccaaaagggaaaaa

SEQ ID NO: 2962137 - DNA, 21 bp, Homo sapiens
tgcaaccaaaagggaaaaaat

SEQ ID NO: 2962138 - DNA, 15 bp, Homo sapiens
tgcaacctccgcctc

SEQ ID NO: 2962139 - DNA, 19 bp, Homo sapiens
tgcaacctcgctggactct

SEQ ID NO: 2962140 - DNA, 22 bp, Homo sapiens
tgcaacctcgctggactctcag

SEQ ID NO: 2962141 - DNA, 16 bp, Homo sapiens
tgcaacctctgcctcc

SEQ ID NO: 2962142 - DNA, 18 bp, Homo sapiens
tgcaacctctgcttccca

SEQ ID NO: 2962143 - DNA, 20 bp, Homo sapiens
tgcaacggtctcctgactgg

SEQ ID NO: 2962144 - DNA, 14 bp, Homo sapiens
tgcaactcctgtaa

SEQ ID NO: 2962145 - DNA, 13 bp, Homo sapiens
tgcaactcttgta

SEQ ID NO: 2962146 - DNA, 16 bp, Homo sapiens
tgcaactgaatacttg

SEQ ID NO: 2962147 - DNA, 22 bp, Homo sapiens
tgcaacttagatctctcctgca

SEQ ID NO: 2962148 - DNA, 18 bp, Homo sapiens
tgcaagaactcatcactg

SEQ ID NO: 2962149 - DNA, 21 bp, Homo sapiens
tgcaagaagtctggccatttt

SEQ ID NO: 2962150 - DNA, 18 bp, Homo sapiens
tgcaagattctgaaacat

SEQ ID NO: 2962151 - DNA, 13 bp, Homo sapiens
tgcaagcagagga

SEQ ID NO: 2962152 - DNA, 16 bp, Homo sapiens
tgcaagcagaggacca

SEQ ID NO: 2962153 - DNA, 17 bp, Homo sapiens
tgcaagcagaggaccag

SEQ ID NO: 2962154 - DNA, 20 bp, Homo sapiens
tgcaagccccaactttctta

SEQ ID NO: 2962155 - DNA, 11 bp, Homo sapiens
tgcaagggaaa

SEQ ID NO: 2962156 - DNA, 22 bp, Homo sapiens
tgcaagggacaggaaggtctga

SEQ ID NO: 2962157 - DNA, 14 bp, Homo sapiens
tgcaagggcccaga

SEQ ID NO: 2962158 - DNA, 15 bp, Homo sapiens
tgcaagggcccagag

SEQ ID NO: 2962159 - DNA, 18 bp, Homo sapiens
tgcaaggttccacagagt

SEQ ID NO: 2962160 - DNA, 19 bp, Homo sapiens
tgcaaggttccacagagta

SEQ ID NO: 2962161 - DNA, 17 bp, Homo sapiens
tgcaagtatactaggga

SEQ ID NO: 2962162 - DNA, 16 bp, Homo sapiens
tgcaagtccttttgta

SEQ ID NO: 2962163 - DNA, 19 bp, Homo sapiens
tgcaagtccttttgtaaag

SEQ ID NO: 2962164 - DNA, 20 bp, Homo sapiens
tgcaagtccttttgtaaagt

SEQ ID NO: 2962165 - DNA, 12 bp, Homo sapiens
tgcaagtctctt

SEQ ID NO: 2962166 - DNA, 19 bp, Homo sapiens
tgcaagtgggagatgaaaa

SEQ ID NO: 2962167 - DNA, 21 bp, Homo sapiens
tgcaagtgggagatgaaaacc

SEQ ID NO: 2962168 - DNA, 16 bp, Homo sapiens
tgcaagtgtctggagc

SEQ ID NO: 2962169 - DNA, 22 bp, Homo sapiens
tgcaagttcaagggctctttct

SEQ ID NO: 2962170 - DNA, 23 bp, Homo sapiens
tgcaataaatctgacccagtgcc

SEQ ID NO: 2962171 - DNA, 14 bp, Homo sapiens
tgcaataacttcta

SEQ ID NO: 2962172 - DNA, 14 bp, Homo sapiens
tgcaataatgcagt

SEQ ID NO: 2962173 - DNA, 16 bp, Homo sapiens
tgcaataatgcagtat

SEQ ID NO: 2962174 - DNA, 22 bp, Homo sapiens
tgcaatagtcagagtgtccctt

SEQ ID NO: 2962175 - DNA, 19 bp, Homo sapiens
tgcaatatatctaaattga

SEQ ID NO: 2962176 - DNA, 18 bp, Homo sapiens
tcttaattctgatgctag

SEQ ID NO: 2962177 - DNA, 17 bp, Homo sapiens
tcttaatttctatcttg

SEQ ID NO: 2962178 - DNA, 16 bp, Homo sapiens
tcttaatttggataat

SEQ ID NO: 2962179 - DNA, 19 bp, Homo sapiens
tcttaatttggatctattt

SEQ ID NO: 2962180 - DNA, 20 bp, Homo sapiens
tcttaatttggatctattta

SEQ ID NO: 2962181 - DNA, 21 bp, Homo sapiens
tcttaatttggatctatttat

SEQ ID NO: 2962182 - DNA, 17 bp, Homo sapiens
tcttaattttggttgta

SEQ ID NO: 2962183 - DNA, 19 bp, Homo sapiens
tcttaattttggttgtatt

SEQ ID NO: 2962184 - DNA, 21 bp, Homo sapiens
tcttacagcacatcacctctt

SEQ ID NO: 2962185 - DNA, 15 bp, Homo sapiens
tcttacatgttttct

SEQ ID NO: 2962186 - DNA, 17 bp, Homo sapiens
tcttaccagtctcctcc

SEQ ID NO: 2962187 - DNA, 20 bp, Homo sapiens
tcttaccctagttctcttat

SEQ ID NO: 2962188 - DNA, 23 bp, Homo sapiens
tcttaccctagttctcttatctt

SEQ ID NO: 2962189 - DNA, 21 bp, Homo sapiens
tcttacctacaaaatgagatt

SEQ ID NO: 2962190 - DNA, 13 bp, Homo sapiens
tcttacctggcag

SEQ ID NO: 2962191 - DNA, 15 bp, Homo sapiens
tcttacctggcagca

SEQ ID NO: 2962192 - DNA, 23 bp, Homo sapiens
tcttactgaaggtaaaattgaaa

SEQ ID NO: 2962193 - DNA, 14 bp, Homo sapiens
tcttactgataatt

SEQ ID NO: 2962194 - DNA, 15 bp, Homo sapiens
tcttacttcccccac

SEQ ID NO: 2962195 - DNA, 13 bp, Homo sapiens
tcttactttcagt

SEQ ID NO: 2962196 - DNA, 23 bp, Homo sapiens
tcttagatattcactaaggactt

SEQ ID NO: 2962197 - DNA, 14 bp, Homo sapiens
tcttagatctggtg

SEQ ID NO: 2962198 - DNA, 22 bp, Homo sapiens
tcttagatctggtgtccagcat

SEQ ID NO: 2962199 - DNA, 22 bp, Homo sapiens
tcttagatggattctccactca

SEQ ID NO: 2962200 - DNA, 16 bp, Homo sapiens
tcttagattcagggga

SEQ ID NO: 2962201 - DNA, 15 bp, Homo sapiens
tcttagctctggacg

SEQ ID NO: 2962202 - DNA, 20 bp, Homo sapiens
tcttagctctggacgtgaaa

SEQ ID NO: 2962203 - DNA, 23 bp, Homo sapiens
tcttagctgaggctgagaaagct

SEQ ID NO: 2962204 - DNA, 19 bp, Homo sapiens
tcttaggtcttcctgtggc

SEQ ID NO: 2962205 - DNA, 19 bp, Homo sapiens
tcttagttctgtatataaa

SEQ ID NO: 2962206 - DNA, 21 bp, Homo sapiens
tcttagttctgtatataaata

SEQ ID NO: 2962207 - DNA, 16 bp, Homo sapiens
tcttagtttggattct

SEQ ID NO: 2962208 - DNA, 23 bp, Homo sapiens
tcttagtttggattcttatgtag

SEQ ID NO: 2962209 - DNA, 12 bp, Homo sapiens
tcttataaatat

SEQ ID NO: 2962210 - DNA, 13 bp, Homo sapiens
tcttataatttaa

SEQ ID NO: 2962211 - DNA, 14 bp, Homo sapiens
tcttataatttaaa

SEQ ID NO: 2962212 - DNA, 16 bp, Homo sapiens
tcttatactgtacaat

SEQ ID NO: 2962213 - DNA, 12 bp, Homo sapiens
tcttatagaata

SEQ ID NO: 2962214 - DNA, 13 bp, Homo sapiens
tcttatagaataa

SEQ ID NO: 2962215 - DNA, 15 bp, Homo sapiens
tcttatagaataaaa

SEQ ID NO: 2962216 - DNA, 18 bp, Homo sapiens
tcttatagaataaaagct

SEQ ID NO: 2962217 - DNA, 19 bp, Homo sapiens
tcttatagaataaaagctg

SEQ ID NO: 2962218 - DNA, 21 bp, Homo sapiens
tcttatagaataaaagctgtg

SEQ ID NO: 2962219 - DNA, 13 bp, Homo sapiens
tcttatagatttt

SEQ ID NO: 2962220 - DNA, 15 bp, Homo sapiens
tcttatagatttttt

SEQ ID NO: 2962221 - DNA, 17 bp, Homo sapiens
tcttatagggtaaaaaa

SEQ ID NO: 2962222 - DNA, 22 bp, Homo sapiens
tcttatagtcaatgtttctttt

SEQ ID NO: 2962223 - DNA, 22 bp, Homo sapiens
tcttatatatatattgattatt

SEQ ID NO: 2962224 - DNA, 15 bp, Homo sapiens
tcttatatctgaaga

SEQ ID NO: 2962225 - DNA, 18 bp, Homo sapiens
tcttatctgagctgagcc

SEQ ID NO: 2962226 - DNA, 12 bp, Homo sapiens
tcttatctttga

SEQ ID NO: 2962227 - DNA, 21 bp, Homo sapiens
tcttatgctctcactgtttgt

SEQ ID NO: 2962228 - DNA, 17 bp, Homo sapiens
tcttatggaattgattt

SEQ ID NO: 2962229 - DNA, 21 bp, Homo sapiens
tcttatggaattgatttgcat

SEQ ID NO: 2962230 - DNA, 15 bp, Homo sapiens
tcttattactgttgg

SEQ ID NO: 2962231 - DNA, 13 bp, Homo sapiens
tcttattcacttt

SEQ ID NO: 2962232 - DNA, 18 bp, Homo sapiens
tcttatttggaattgaca

SEQ ID NO: 2962233 - DNA, 16 bp, Homo sapiens
tcttcaaaagtaatgc

SEQ ID NO: 2962234 - DNA, 13 bp, Homo sapiens
tcttcaaacacaa

SEQ ID NO: 2962235 - DNA, 11 bp, Homo sapiens
tcttcaacaga

SEQ ID NO: 2962236 - DNA, 18 bp, Homo sapiens
tcttcaagcatcctcaga

SEQ ID NO: 2962237 - DNA, 15 bp, Homo sapiens
tcttcaaggcttcag

SEQ ID NO: 2962238 - DNA, 22 bp, Homo sapiens
tcttcaatttgttaacagagca

SEQ ID NO: 2962239 - DNA, 17 bp, Homo sapiens
tcttcaccatttggcaa

SEQ ID NO: 2962240 - DNA, 19 bp, Homo sapiens
tcttcacccaggcctatgt

SEQ ID NO: 2962241 - DNA, 14 bp, Homo sapiens
tcttcacggcagga

SEQ ID NO: 2962242 - DNA, 16 bp, Homo sapiens
tcttcacttcctccag

SEQ ID NO: 2962243 - DNA, 22 bp, Homo sapiens
tcttcacttcctccagaagcct

SEQ ID NO: 2962244 - DNA, 14 bp, Homo sapiens
tcttcagagaaatc

SEQ ID NO: 2962245 - DNA, 15 bp, Homo sapiens
tcttcagaggccctc

SEQ ID NO: 2962246 - DNA, 12 bp, Homo sapiens
tcttcagctgca

SEQ ID NO: 2962247 - DNA, 20 bp, Homo sapiens
tcttcagcttgtgcacaatt

SEQ ID NO: 2962248 - DNA, 15 bp, Homo sapiens
tcttcagggcctggt

SEQ ID NO: 2962249 - DNA, 23 bp, Homo sapiens
tcttcagggcctggttgaagaag

SEQ ID NO: 2962250 - DNA, 23 bp, Homo sapiens
tcttcaggtggaaaaacatctga

SEQ ID NO: 2962251 - DNA, 19 bp, Homo sapiens
tcttcagtgggagaaaaca

SEQ ID NO: 2962252 - DNA, 17 bp, Homo sapiens
tcttcagtgtaatgtga

SEQ ID NO: 2962253 - DNA, 15 bp, Homo sapiens
tcttcagttaattct

SEQ ID NO: 2962254 - DNA, 19 bp, Homo sapiens
tcttcagttaattcttaga

SEQ ID NO: 2962255 - DNA, 22 bp, Homo sapiens
tcttcatagggacctttaaaaa

SEQ ID NO: 2962256 - DNA, 19 bp, Homo sapiens
tcttcatctccctgccatc

SEQ ID NO: 2962257 - DNA, 21 bp, Homo sapiens
tcttcatctccctgccatccc

SEQ ID NO: 2962258 - DNA, 15 bp, Homo sapiens
tcttccaccagagca

SEQ ID NO: 2962259 - DNA, 18 bp, Homo sapiens
tcttccagaagtgtgatt

SEQ ID NO: 2962260 - DNA, 16 bp, Homo sapiens
tcttccagccacctag

SEQ ID NO: 2962261 - DNA, 18 bp, Homo sapiens
tcttccaggagccacctt

SEQ ID NO: 2962262 - DNA, 15 bp, Homo sapiens
tcttccaggtgccca

SEQ ID NO: 2962263 - DNA, 15 bp, Homo sapiens
tcttccattccttca

SEQ ID NO: 2962264 - DNA, 13 bp, Homo sapiens
tcttccatttgca

SEQ ID NO: 2962265 - DNA, 17 bp, Homo sapiens
tcttcccgaaccccaag

SEQ ID NO: 2962266 - DNA, 19 bp, Homo sapiens
tcttcccgaaccccaagga

SEQ ID NO: 2962267 - DNA, 16 bp, Homo sapiens
tcttcccgcctcagcc

SEQ ID NO: 2962268 - DNA, 13 bp, Homo sapiens
tcttccctctcta

SEQ ID NO: 2962269 - DNA, 20 bp, Homo sapiens
tcttccctgcccctgtgcct

SEQ ID NO: 2962270 - DNA, 18 bp, Homo sapiens
tcttcctatttctggaat

SEQ ID NO: 2962271 - DNA, 19 bp, Homo sapiens
tcttcctcaagtcttgaca

SEQ ID NO: 2962272 - DNA, 16 bp, Homo sapiens
tcttcctcatcctgct

SEQ ID NO: 2962273 - DNA, 19 bp, Homo sapiens
tcttcctccagtctgttct

SEQ ID NO: 2962274 - DNA, 23 bp, Homo sapiens
tcttcctccagtctgttctcaca

SEQ ID NO: 2962275 - DNA, 15 bp, Homo sapiens
tcttcctcttagcct

SEQ ID NO: 2962276 - DNA, 19 bp, Homo sapiens
tcttcctcttagcctctgg

SEQ ID NO: 2962277 - DNA, 15 bp, Homo sapiens
tcttcctgtctcctt

SEQ ID NO: 2962278 - DNA, 12 bp, Homo sapiens
tcttcctgtggc

SEQ ID NO: 2962279 - DNA, 15 bp, Homo sapiens
tcttcctgtggctcc

SEQ ID NO: 2962280 - DNA, 17 bp, Homo sapiens
tcttcctgtggctccct

SEQ ID NO: 2962281 - DNA, 17 bp, Homo sapiens
tcttcctgttctgtgac

SEQ ID NO: 2962282 - DNA, 14 bp, Homo sapiens
tcttcgggaccagg

SEQ ID NO: 2962283 - DNA, 19 bp, Homo sapiens
tcttcggggaactcctgga

SEQ ID NO: 2962284 - DNA, 15 bp, Homo sapiens
tcttcgtaacttcat

SEQ ID NO: 2962285 - DNA, 19 bp, Homo sapiens
tcttcgttctttttaagtt

SEQ ID NO: 2962286 - DNA, 13 bp, Homo sapiens
tcttctaaacttc

SEQ ID NO: 2962287 - DNA, 22 bp, Homo sapiens
tcttctaaacttccccatcttc

SEQ ID NO: 2962288 - DNA, 13 bp, Homo sapiens
tcttctaaatgag

SEQ ID NO: 2962289 - DNA, 15 bp, Homo sapiens
tcttctaatcataac

SEQ ID NO: 2962290 - DNA, 12 bp, Homo sapiens
tcttctaccaga

SEQ ID NO: 2962291 - DNA, 18 bp, Homo sapiens
tcttctagaagataacat

SEQ ID NO: 2962292 - DNA, 19 bp, Homo sapiens
tcttctagaagataacatt

SEQ ID NO: 2962293 - DNA, 22 bp, Homo sapiens
tcttctagatggaccccagcat

SEQ ID NO: 2962294 - DNA, 14 bp, Homo sapiens
tcttctatgaccca

SEQ ID NO: 2962295 - DNA, 19 bp, Homo sapiens
tcttctatgtaggaaaaaa

SEQ ID NO: 2962296 - DNA, 20 bp, Homo sapiens
tcttctatttttatcatgaa

SEQ ID NO: 2962297 - DNA, 16 bp, Homo sapiens
tcttctcaaagctggg

SEQ ID NO: 2962298 - DNA, 17 bp, Homo sapiens
tcttctcaaagctggga

SEQ ID NO: 2962299 - DNA, 23 bp, Homo sapiens
tcttctcaagttctaagattcta

SEQ ID NO: 2962300 - DNA, 17 bp, Homo sapiens
tcttctccccgaggctg

SEQ ID NO: 2962301 - DNA, 21 bp, Homo sapiens
tcttctcctggagttgcattg

SEQ ID NO: 2962302 - DNA, 18 bp, Homo sapiens
tcttctcgcctaggattt

SEQ ID NO: 2962303 - DNA, 20 bp, Homo sapiens
tcttctcgcctaggatttca

SEQ ID NO: 2962304 - DNA, 14 bp, Homo sapiens
tcttctctatcctc

SEQ ID NO: 2962305 - DNA, 19 bp, Homo sapiens
tcttctcttccttttatca

SEQ ID NO: 2962306 - DNA, 18 bp, Homo sapiens
tcttctcttgacagtctg

SEQ ID NO: 2962307 - DNA, 16 bp, Homo sapiens
tcttctgaatatttta

SEQ ID NO: 2962308 - DNA, 18 bp, Homo sapiens
tcttctggactggttttc

SEQ ID NO: 2962309 - DNA, 20 bp, Homo sapiens
tcttctgggagggcagcagg

SEQ ID NO: 2962310 - DNA, 23 bp, Homo sapiens
tcttctgggagggcagcagggct

SEQ ID NO: 2962311 - DNA, 22 bp, Homo sapiens
tcttctgggcagagcctgtccc

SEQ ID NO: 2962312 - DNA, 18 bp, Homo sapiens
tctctgtgacccacttct

SEQ ID NO: 2962313 - DNA, 11 bp, Homo sapiens
tctctgtgtat

SEQ ID NO: 2962314 - DNA, 21 bp, Homo sapiens
tctctgtgtatttatataaaa

SEQ ID NO: 2962315 - DNA, 17 bp, Homo sapiens
tctctgtgtctaagatt

SEQ ID NO: 2962316 - DNA, 21 bp, Homo sapiens
tctctgtgtctaagattctag

SEQ ID NO: 2962317 - DNA, 23 bp, Homo sapiens
tctctgtgtctaagattctagat

SEQ ID NO: 2962318 - DNA, 13 bp, Homo sapiens
tctctgttcttca

SEQ ID NO: 2962319 - DNA, 16 bp, Homo sapiens
tctctgttcttcatct

SEQ ID NO: 2962320 - DNA, 23 bp, Homo sapiens
tctctgttcttcatctgctatta

SEQ ID NO: 2962321 - DNA, 12 bp, Homo sapiens
tctcttatcttt

SEQ ID NO: 2962322 - DNA, 13 bp, Homo sapiens
tctcttccgggag

SEQ ID NO: 2962323 - DNA, 21 bp, Homo sapiens
tctcttcctgcagtgttttgc

SEQ ID NO: 2962324 - DNA, 16 bp, Homo sapiens
tctcttctcttctttg

SEQ ID NO: 2962325 - DNA, 13 bp, Homo sapiens
tctcttctgtcca

SEQ ID NO: 2962326 - DNA, 14 bp, Homo sapiens
tctcttctgtccat

SEQ ID NO: 2962327 - DNA, 13 bp, Homo sapiens
tctcttctgttct

SEQ ID NO: 2962328 - DNA, 18 bp, Homo sapiens
tctcttcttttggcttcc

SEQ ID NO: 2962329 - DNA, 17 bp, Homo sapiens
tctcttggaattagatg

SEQ ID NO: 2962330 - DNA, 16 bp, Homo sapiens
tctcttgggaactgaa

SEQ ID NO: 2962331 - DNA, 19 bp, Homo sapiens
tctcttgtttaaaaaaaga

SEQ ID NO: 2962332 - DNA, 19 bp, Homo sapiens
tctctttcagtattaaact

SEQ ID NO: 2962333 - DNA, 22 bp, Homo sapiens
tctctttgtaccacagtttctt

SEQ ID NO: 2962334 - DNA, 15 bp, Homo sapiens
tctctttgtcctgaa

SEQ ID NO: 2962335 - DNA, 20 bp, Homo sapiens
tctgccaggcccccaccaca

SEQ ID NO: 2962336 - DNA, 13 bp, Homo sapiens
tctgccatctaat

SEQ ID NO: 2962337 - DNA, 17 bp, Homo sapiens
tctgcccaactttcatt

SEQ ID NO: 2962338 - DNA, 22 bp, Homo sapiens
tctgcccacctcagcctcccaa

SEQ ID NO: 2962339 - DNA, 15 bp, Homo sapiens
tctgcccacctctct

SEQ ID NO: 2962340 - DNA, 13 bp, Homo sapiens
tctgcccagccgg

SEQ ID NO: 2962341 - DNA, 17 bp, Homo sapiens
tctgccccccagggcta

SEQ ID NO: 2962342 - DNA, 22 bp, Homo sapiens
tctgccccccagggctagtgaa

SEQ ID NO: 2962343 - DNA, 18 bp, Homo sapiens
tctgccctaacctgacag

SEQ ID NO: 2962344 - DNA, 19 bp, Homo sapiens
tctgccctaacctgacaga

SEQ ID NO: 2962345 - DNA, 14 bp, Homo sapiens
tctgccctctgctg

SEQ ID NO: 2962346 - DNA, 19 bp, Homo sapiens
tctgccgctacctccctcc

SEQ ID NO: 2962347 - DNA, 17 bp, Homo sapiens
tctgccggccctggggc

SEQ ID NO: 2962348 - DNA, 16 bp, Homo sapiens
tctgcctagaaacagt

SEQ ID NO: 2962349 - DNA, 23 bp, Homo sapiens
tctgcctataaatttactctgtt

SEQ ID NO: 2962350 - DNA, 21 bp, Homo sapiens
tctgcctcaatgtgaatcaga

SEQ ID NO: 2962351 - DNA, 14 bp, Homo sapiens
tctgcctcatcctc

SEQ ID NO: 2962352 - DNA, 16 bp, Homo sapiens
tctgcctcatcctcct

SEQ ID NO: 2962353 - DNA, 18 bp, Homo sapiens
tctgcctcatcctcctcc

SEQ ID NO: 2962354 - DNA, 21 bp, Homo sapiens
tctgcctcatcctcctcctca

SEQ ID NO: 2962355 - DNA, 17 bp, Homo sapiens
tctgcctctaactccct

SEQ ID NO: 2962356 - DNA, 14 bp, Homo sapiens
tctgcctcttctgg

SEQ ID NO: 2962357 - DNA, 22 bp, Homo sapiens
tctgcctgcactccctggcctt

SEQ ID NO: 2962358 - DNA, 21 bp, Homo sapiens
tctgcctgccagctgcactga

SEQ ID NO: 2962359 - DNA, 13 bp, Homo sapiens
tctgcctgcctgc

SEQ ID NO: 2962360 - DNA, 11 bp, Homo sapiens
tctgcctgctg

SEQ ID NO: 2962361 - DNA, 14 bp, Homo sapiens
tctgcctgctgggc

SEQ ID NO: 2962362 - DNA, 15 bp, Homo sapiens
tctgcctgctgggct

SEQ ID NO: 2962363 - DNA, 17 bp, Homo sapiens
tctgcctgtcctagtct

SEQ ID NO: 2962364 - DNA, 12 bp, Homo sapiens
tctgccttccag

SEQ ID NO: 2962365 - DNA, 18 bp, Homo sapiens
tctgccttccagcccaga

SEQ ID NO: 2962366 - DNA, 11 bp, Homo sapiens
tctgccttttc

SEQ ID NO: 2962367 - DNA, 17 bp, Homo sapiens
tctgcgattttatctgt

SEQ ID NO: 2962368 - DNA, 18 bp, Homo sapiens
tctgcgattttatctgtt

SEQ ID NO: 2962369 - DNA, 13 bp, Homo sapiens
tctgcgccaggca

SEQ ID NO: 2962370 - DNA, 14 bp, Homo sapiens
tctgcgcctcaggc

SEQ ID NO: 2962371 - DNA, 15 bp, Homo sapiens
tctgcgtgtcacctg

SEQ ID NO: 2962372 - DNA, 14 bp, Homo sapiens
tctgctaactctgt

SEQ ID NO: 2962373 - DNA, 18 bp, Homo sapiens
tctgctagagcagacagg

SEQ ID NO: 2962374 - DNA, 19 bp, Homo sapiens
tctgctcactttaaacctg

SEQ ID NO: 2962375 - DNA, 19 bp, Homo sapiens
tctgctcaggaattgaaga

SEQ ID NO: 2962376 - DNA, 23 bp, Homo sapiens
tctgctcatcattctctgtctca

SEQ ID NO: 2962377 - DNA, 21 bp, Homo sapiens
tctgctccacctttcagccca

SEQ ID NO: 2962378 - DNA, 23 bp, Homo sapiens
tctgctccacctttcagcccacg

SEQ ID NO: 2962379 - DNA, 16 bp, Homo sapiens
tctgctccccagggga

SEQ ID NO: 2962380 - DNA, 16 bp, Homo sapiens
tctgctcgccttagca

SEQ ID NO: 2962381 - DNA, 16 bp, Homo sapiens
tctgctgaagacttgc

SEQ ID NO: 2962382 - DNA, 15 bp, Homo sapiens
tctgctgcctgtaca

SEQ ID NO: 2962383 - DNA, 14 bp, Homo sapiens
tctgctgctgcccg

SEQ ID NO: 2962384 - DNA, 13 bp, Homo sapiens
tctgctggagttt

SEQ ID NO: 2962385 - DNA, 19 bp, Homo sapiens
tctgctggagtttcatgta

SEQ ID NO: 2962386 - DNA, 17 bp, Homo sapiens
tctgctggtctctggct

SEQ ID NO: 2962387 - DNA, 16 bp, Homo sapiens
tctgcttaccacatca

SEQ ID NO: 2962388 - DNA, 14 bp, Homo sapiens
tctgcttcccaggt

SEQ ID NO: 2962389 - DNA, 21 bp, Homo sapiens
tctgcttctcggggtccagtg

SEQ ID NO: 2962390 - DNA, 18 bp, Homo sapiens
tctgcttgacaacatctg

SEQ ID NO: 2962391 - DNA, 13 bp, Homo sapiens
tctgctttctcta

SEQ ID NO: 2962392 - DNA, 13 bp, Homo sapiens
tctgctttctgtt

SEQ ID NO: 2962393 - DNA, 19 bp, Homo sapiens
tctgctttctgttcatctc

SEQ ID NO: 2962394 - DNA, 16 bp, Homo sapiens
tctgcttttaagtttt

SEQ ID NO: 2962395 - DNA, 17 bp, Homo sapiens
tctgcttttaagttttt

SEQ ID NO: 2962396 - DNA, 17 bp, Homo sapiens
tctggaacctcagcctg

SEQ ID NO: 2962397 - DNA, 20 bp, Homo sapiens
tctggaagtattttcctcca

SEQ ID NO: 2962398 - DNA, 18 bp, Homo sapiens
tctggacagtcagctctt

SEQ ID NO: 2962399 - DNA, 17 bp, Homo sapiens
tctggacctctcttgtg

SEQ ID NO: 2962400 - DNA, 14 bp, Homo sapiens
tctggacgtgaaat

SEQ ID NO: 2962401 - DNA, 19 bp, Homo sapiens
tctggacgtgaaatacttc

SEQ ID NO: 2962402 - DNA, 12 bp, Homo sapiens
tctggagacaga

SEQ ID NO: 2962403 - DNA, 20 bp, Homo sapiens
tctggagaccagggagcctt

SEQ ID NO: 2962404 - DNA, 21 bp, Homo sapiens
tctggagtgcccccagcccag

SEQ ID NO: 2962405 - DNA, 19 bp, Homo sapiens
tctggagtggccactaagc

SEQ ID NO: 2962406 - DNA, 20 bp, Homo sapiens
tctggattccccatctcagg

SEQ ID NO: 2962407 - DNA, 21 bp, Homo sapiens
tctggcagcctcccatccagg

SEQ ID NO: 2962408 - DNA, 23 bp, Homo sapiens
tctggcagttttgacatcagcca

SEQ ID NO: 2962409 - DNA, 15 bp, Homo sapiens
tctggccctgccttc

SEQ ID NO: 2962410 - DNA, 16 bp, Homo sapiens
tctggccctgccttct

SEQ ID NO: 2962411 - DNA, 14 bp, Homo sapiens
tctggccctggcgg

SEQ ID NO: 2962412 - DNA, 22 bp, Homo sapiens
tctggcggtggccacagcgtgc

SEQ ID NO: 2962413 - DNA, 23 bp, Homo sapiens
tctggctactttttcatgtatgt

SEQ ID NO: 2962414 - DNA, 16 bp, Homo sapiens
tctggctcagctgtgg

SEQ ID NO: 2962415 - DNA, 22 bp, Homo sapiens
tctggctcagctgtggtcccac

SEQ ID NO: 2962416 - DNA, 21 bp, Homo sapiens
tctggctggctaactggaagc

SEQ ID NO: 2962417 - DNA, 18 bp, Homo sapiens
tctggcttctggccagga

SEQ ID NO: 2962418 - DNA, 20 bp, Homo sapiens
tctggcttctggccaggaag

SEQ ID NO: 2962419 - DNA, 14 bp, Homo sapiens
tctggcttggccta

SEQ ID NO: 2962420 - DNA, 22 bp, Homo sapiens
tctggcttgggcagggtctgtt

SEQ ID NO: 2962421 - DNA, 21 bp, Homo sapiens
tctggctttgttcttgtcatc

SEQ ID NO: 2962422 - DNA, 20 bp, Homo sapiens
tctgggaactgaatcaggaa

SEQ ID NO: 2962423 - DNA, 23 bp, Homo sapiens
tctgggaggaatggacagacaga

SEQ ID NO: 2962424 - DNA, 13 bp, Homo sapiens
tctgggagggcag

SEQ ID NO: 2962425 - DNA, 16 bp, Homo sapiens
tctgggcagagcctgt

SEQ ID NO: 2962426 - DNA, 20 bp, Homo sapiens
tctggggacctggtttgaat

SEQ ID NO: 2962427 - DNA, 14 bp, Homo sapiens
tctgggggaaaaag

SEQ ID NO: 2962428 - DNA, 17 bp, Homo sapiens
tctggggttcagcccct

SEQ ID NO: 2962429 - DNA, 19 bp, Homo sapiens
tctggggttcagcccctcc

SEQ ID NO: 2962430 - DNA, 21 bp, Homo sapiens
tctggggttcagcccctcctc

SEQ ID NO: 2962431 - DNA, 23 bp, Homo sapiens
tctggggttcagcccctcctctg

SEQ ID NO: 2962432 - DNA, 20 bp, Homo sapiens
tctgggtacctgcaagcaga

SEQ ID NO: 2962433 - DNA, 12 bp, Homo sapiens
tctgggtagaag

SEQ ID NO: 2962434 - DNA, 16 bp, Homo sapiens
tctgggtagaagccac

SEQ ID NO: 2962435 - DNA, 15 bp, Homo sapiens
tctgggtcccggggt

SEQ ID NO: 2962436 - DNA, 12 bp, Homo sapiens
tctgggtgccct

SEQ ID NO: 2962437 - DNA, 18 bp, Homo sapiens
tctgggtttacaacaaac

SEQ ID NO: 2962438 - DNA, 21 bp, Homo sapiens
tctggtcaacctcctggacat

SEQ ID NO: 2962439 - DNA, 21 bp, Homo sapiens
tctggtcccctgtggtgatgt

SEQ ID NO: 2962440 - DNA, 22 bp, Homo sapiens
tctggtcctgttttctaaaaaa

SEQ ID NO: 2962441 - DNA, 16 bp, Homo sapiens
tctggtgaccttccaa

SEQ ID NO: 2962442 - DNA, 18 bp, Homo sapiens
tctggtgaccttccaaga

SEQ ID NO: 2962443 - DNA, 15 bp, Homo sapiens
tctggtgcctccaga

SEQ ID NO: 2962444 - DNA, 16 bp, Homo sapiens
tctggtgcctccagag

SEQ ID NO: 2962445 - DNA, 13 bp, Homo sapiens
tctggtggaggag

SEQ ID NO: 2962446 - DNA, 14 bp, Homo sapiens
tctggtggaggagc

SEQ ID NO: 2962447 - DNA, 20 bp, Homo sapiens
tctggtggaggagctgaggg

SEQ ID NO: 2962448 - DNA, 23 bp, Homo sapiens
tctggtggaggagctgagggagg

SEQ ID NO: 2962449 - DNA, 16 bp, Homo sapiens
tctggtggttatttaa

SEQ ID NO: 2962450 - DNA, 15 bp, Homo sapiens
tctggtgtaaaagta

SEQ ID NO: 2962451 - DNA, 16 bp, Homo sapiens
tctggttaggtgtgtc

SEQ ID NO: 2962452 - DNA, 20 bp, Homo sapiens
tctgtaaaaaagaaaaacaa

SEQ ID NO: 2962453 - DNA, 14 bp, Homo sapiens
tctgtaaaagtgtc

SEQ ID NO: 2962454 - DNA, 22 bp, Homo sapiens
tccttgaagacatatcatgtgt

SEQ ID NO: 2962455 - DNA, 22 bp, Homo sapiens
tccttgactgaagcgaacatct

SEQ ID NO: 2962456 - DNA, 23 bp, Homo sapiens
tccttgagacacggagcccagcc

SEQ ID NO: 2962457 - DNA, 21 bp, Homo sapiens
tccttgcagtttaagatgaca

SEQ ID NO: 2962458 - DNA, 22 bp, Homo sapiens
tccttgcatcaaggggtcactt

SEQ ID NO: 2962459 - DNA, 23 bp, Homo sapiens
tccttgcatcaaggggtcactta

SEQ ID NO: 2962460 - DNA, 19 bp, Homo sapiens
tccttgccagccccacccc

SEQ ID NO: 2962461 - DNA, 20 bp, Homo sapiens
tccttgcccatcgggaccag

SEQ ID NO: 2962462 - DNA, 19 bp, Homo sapiens
tccttgcctgctttctcca

SEQ ID NO: 2962463 - DNA, 12 bp, Homo sapiens
tccttggaaatc

SEQ ID NO: 2962464 - DNA, 16 bp, Homo sapiens
tccttggagtcccagg

SEQ ID NO: 2962465 - DNA, 19 bp, Homo sapiens
tccttggagtcccaggggc

SEQ ID NO: 2962466 - DNA, 21 bp, Homo sapiens
tccttggctgtatccatgtaa

SEQ ID NO: 2962467 - DNA, 22 bp, Homo sapiens
tccttgggaggccccactgggg

SEQ ID NO: 2962468 - DNA, 13 bp, Homo sapiens
tccttgggcaggg

SEQ ID NO: 2962469 - DNA, 16 bp, Homo sapiens
tccttgggcagggtct

SEQ ID NO: 2962470 - DNA, 16 bp, Homo sapiens
tccttgggccctttga

SEQ ID NO: 2962471 - DNA, 16 bp, Homo sapiens
tccttgggcctggcca

SEQ ID NO: 2962472 - DNA, 14 bp, Homo sapiens
tccttggtgcctgg

SEQ ID NO: 2962473 - DNA, 15 bp, Homo sapiens
tcctttaaagtgagt

SEQ ID NO: 2962474 - DNA, 22 bp, Homo sapiens
tcctttaaagtgagtactgtta

SEQ ID NO: 2962475 - DNA, 17 bp, Homo sapiens
tcctttaactatcagag

SEQ ID NO: 2962476 - DNA, 23 bp, Homo sapiens
tcctttaactatcagagggatct

SEQ ID NO: 2962477 - DNA, 12 bp, Homo sapiens
tcctttataagt

SEQ ID NO: 2962478 - DNA, 16 bp, Homo sapiens
tcctttatactgtgaa

SEQ ID NO: 2962479 - DNA, 22 bp, Homo sapiens
tcctttatactgtgaagttaca

SEQ ID NO: 2962480 - DNA, 18 bp, Homo sapiens
tcctttatattttttgtc

SEQ ID NO: 2962481 - DNA, 21 bp, Homo sapiens
tcctttatgtggaaaacagaa

SEQ ID NO: 2962482 - DNA, 17 bp, Homo sapiens
tcctttatttctgataa

SEQ ID NO: 2962483 - DNA, 21 bp, Homo sapiens
tcctttcaccccagggcctga

SEQ ID NO: 2962484 - DNA, 17 bp, Homo sapiens
tcctttccatctgtcca

SEQ ID NO: 2962485 - DNA, 19 bp, Homo sapiens
tcctttctagagcactgcc

SEQ ID NO: 2962486 - DNA, 20 bp, Homo sapiens
tcctttctagagcactgcca

SEQ ID NO: 2962487 - DNA, 12 bp, Homo sapiens
tcctttctctgt

SEQ ID NO: 2962488 - DNA, 13 bp, Homo sapiens
tcctttctgcccc

SEQ ID NO: 2962489 - DNA, 14 bp, Homo sapiens
tcctttctgccccc

SEQ ID NO: 2962490 - DNA, 21 bp, Homo sapiens
tcctttctgccccccagggct

SEQ ID NO: 2962491 - DNA, 18 bp, Homo sapiens
tcctttcttccttggcca

SEQ ID NO: 2962492 - DNA, 15 bp, Homo sapiens
tcctttctttctaac

SEQ ID NO: 2962493 - DNA, 12 bp, Homo sapiens
tcctttgaagat

SEQ ID NO: 2962494 - DNA, 22 bp, Homo sapiens
tcctttgaccactgtctttttc

SEQ ID NO: 2962495 - DNA, 22 bp, Homo sapiens
tcctttgatcagtataattttt

SEQ ID NO: 2962496 - DNA, 22 bp, Homo sapiens
tcctttgctcttgccattttaa

SEQ ID NO: 2962497 - DNA, 22 bp, Homo sapiens
tcctttggaacaagacagcctt

SEQ ID NO: 2962498 - DNA, 11 bp, Homo sapiens
tcctttgtata

SEQ ID NO: 2962499 - DNA, 13 bp, Homo sapiens
tccttttctgtga

SEQ ID NO: 2962500 - DNA, 15 bp, Homo sapiens
tccttttcttctatg

SEQ ID NO: 2962501 - DNA, 14 bp, Homo sapiens
tccttttcttgctt

SEQ ID NO: 2962502 - DNA, 13 bp, Homo sapiens
tccttttgaactt

SEQ ID NO: 2962503 - DNA, 15 bp, Homo sapiens
tccttttggtgtgtt

SEQ ID NO: 2962504 - DNA, 20 bp, Homo sapiens
tccttttgtaaagtgaagaa

SEQ ID NO: 2962505 - DNA, 12 bp, Homo sapiens
tccttttgtaga

SEQ ID NO: 2962506 - DNA, 14 bp, Homo sapiens
tcctttttaaatgt

SEQ ID NO: 2962507 - DNA, 19 bp, Homo sapiens
tcctttttaaatgtgaatt

SEQ ID NO: 2962508 - DNA, 19 bp, Homo sapiens
tcctttttaaccattccaa

SEQ ID NO: 2962509 - DNA, 22 bp, Homo sapiens
tccttttttgttcctttttcct

SEQ ID NO: 2962510 - DNA, 10 bp, Homo sapiens
tcctgctgcc

SEQ ID NO: 2962511 - DNA, 14 bp, Homo sapiens
tcctgctgtcctgg

SEQ ID NO: 2962512 - DNA, 15 bp, Homo sapiens
tcctgctgtcctggt

SEQ ID NO: 2962513 - DNA, 19 bp, Homo sapiens
tcctgctgtcctggtggct

SEQ ID NO: 2962514 - DNA, 22 bp, Homo sapiens
tcctgcttgatgggattctgga

SEQ ID NO: 2962515 - DNA, 21 bp, Homo sapiens
tcctgctttacaggatcatgt

SEQ ID NO: 2962516 - DNA, 13 bp, Homo sapiens
tcctgctttctct

SEQ ID NO: 2962517 - DNA, 18 bp, Homo sapiens
tcctgctttctctttcag

SEQ ID NO: 2962518 - DNA, 14 bp, Homo sapiens
tcctggaagcagag

SEQ ID NO: 2962519 - DNA, 15 bp, Homo sapiens
tcctggaagcagagc

SEQ ID NO: 2962520 - DNA, 19 bp, Homo sapiens
tcctggaagcagagcaaaa

SEQ ID NO: 2962521 - DNA, 14 bp, Homo sapiens
tcctggaagctgtg

SEQ ID NO: 2962522 - DNA, 21 bp, Homo sapiens
tcctggaagctgtgtccttgc

SEQ ID NO: 2962523 - DNA, 14 bp, Homo sapiens
tcctggacattttt

SEQ ID NO: 2962524 - DNA, 21 bp, Homo sapiens
tcctggaccttgacagagcag

SEQ ID NO: 2962525 - DNA, 23 bp, Homo sapiens
tcctggaccttgacagagcagct

SEQ ID NO: 2962526 - DNA, 19 bp, Homo sapiens
tcctggactggttatcttg

SEQ ID NO: 2962527 - DNA, 20 bp, Homo sapiens
tcctggactggttatcttgt

SEQ ID NO: 2962528 - DNA, 18 bp, Homo sapiens
tcctggagcaatcacaga

SEQ ID NO: 2962529 - DNA, 20 bp, Homo sapiens
tcctggagcaatcacagatg

SEQ ID NO: 2962530 - DNA, 13 bp, Homo sapiens
tcctggaggccca

SEQ ID NO: 2962531 - DNA, 14 bp, Homo sapiens
tcctggaggcccag

SEQ ID NO: 2962532 - DNA, 18 bp, Homo sapiens
tcctggaggcccagttca

SEQ ID NO: 2962533 - DNA, 15 bp, Homo sapiens
tcctggaggctgcct

SEQ ID NO: 2962534 - DNA, 19 bp, Homo sapiens
tcctggaggctggggatgg

SEQ ID NO: 2962535 - DNA, 19 bp, Homo sapiens
tcctggagggcgcccagca

SEQ ID NO: 2962536 - DNA, 15 bp, Homo sapiens
tcctggataaaaaag

SEQ ID NO: 2962537 - DNA, 16 bp, Homo sapiens
tcctggataaaaaaga

SEQ ID NO: 2962538 - DNA, 17 bp, Homo sapiens
tcctggatgtttggaaa

SEQ ID NO: 2962539 - DNA, 14 bp, Homo sapiens
tcctggcccaggcc

SEQ ID NO: 2962540 - DNA, 15 bp, Homo sapiens
tcctggcccaggcct

SEQ ID NO: 2962541 - DNA, 17 bp, Homo sapiens
tcctggcccaggccttg

SEQ ID NO: 2962542 - DNA, 20 bp, Homo sapiens
tcctggcccaggccttgctg

SEQ ID NO: 2962543 - DNA, 21 bp, Homo sapiens
tcctggcctcaagccatcttc

SEQ ID NO: 2962544 - DNA, 22 bp, Homo sapiens
tcctggcctcaagccatcttcc

SEQ ID NO: 2962545 - DNA, 23 bp, Homo sapiens
tcctggcctcaagccatcttccc

SEQ ID NO: 2962546 - DNA, 13 bp, Homo sapiens
tcctggcctcaga

SEQ ID NO: 2962547 - DNA, 15 bp, Homo sapiens
tcctggctcaggccc

SEQ ID NO: 2962548 - DNA, 17 bp, Homo sapiens
tcctggctcaggcccag

SEQ ID NO: 2962549 - DNA, 14 bp, Homo sapiens
tcctggctgcactc

SEQ ID NO: 2962550 - DNA, 16 bp, Homo sapiens
tcctggctgcactctt

SEQ ID NO: 2962551 - DNA, 20 bp, Homo sapiens
tcctggcttctgggagcctt

SEQ ID NO: 2962552 - DNA, 14 bp, Homo sapiens
tcctgggaaatatt

SEQ ID NO: 2962553 - DNA, 21 bp, Homo sapiens
tcctgggagctcatgtgtccc

SEQ ID NO: 2962554 - DNA, 11 bp, Homo sapiens
tcctgggagga

SEQ ID NO: 2962555 - DNA, 18 bp, Homo sapiens
tcctgggaggatcctgag

SEQ ID NO: 2962556 - DNA, 14 bp, Homo sapiens
tcctgggaggctgc

SEQ ID NO: 2962557 - DNA, 17 bp, Homo sapiens
tcctgggaggctgcagc

SEQ ID NO: 2962558 - DNA, 12 bp, Homo sapiens
tcctgggcaggt

SEQ ID NO: 2962559 - DNA, 15 bp, Homo sapiens
tcctgggcaggtggg

SEQ ID NO: 2962560 - DNA, 11 bp, Homo sapiens
tcctgggcccc

SEQ ID NO: 2962561 - DNA, 14 bp, Homo sapiens
tcctgggcccccag

SEQ ID NO: 2962562 - DNA, 15 bp, Homo sapiens
tcctgggcccccaga

SEQ ID NO: 2962563 - DNA, 23 bp, Homo sapiens
tcctgggccgttacatctgtgca

SEQ ID NO: 2962564 - DNA, 13 bp, Homo sapiens
tcctgggcctgca

SEQ ID NO: 2962565 - DNA, 17 bp, Homo sapiens
tcctgggccttctcagc

SEQ ID NO: 2962566 - DNA, 19 bp, Homo sapiens
tcctgggccttctcagctc

SEQ ID NO: 2962567 - DNA, 16 bp, Homo sapiens
tcctggggccaggccg

SEQ ID NO: 2962568 - DNA, 15 bp, Homo sapiens
tcctgggtggtctgc

SEQ ID NO: 2962569 - DNA, 19 bp, Homo sapiens
tcctgggttcaagcgattt

SEQ ID NO: 2962570 - DNA, 13 bp, Homo sapiens
tcctgggttcaca

SEQ ID NO: 2962571 - DNA, 22 bp, Homo sapiens
tcctgggttttgtattctctga

SEQ ID NO: 2962572 - DNA, 15 bp, Homo sapiens
tcctggtcctggctg

SEQ ID NO: 2962573 - DNA, 16 bp, Homo sapiens
tcctggtcctggctgc

SEQ ID NO: 2962574 - DNA, 13 bp, Homo sapiens
tcctggtgagaac

SEQ ID NO: 2962575 - DNA, 13 bp, Homo sapiens
tcctggtggctgg

SEQ ID NO: 2962576 - DNA, 22 bp, Homo sapiens
tcctggtggctgggcccagcag

SEQ ID NO: 2962577 - DNA, 18 bp, Homo sapiens
tcctggtgtcaccccaga

SEQ ID NO: 2962578 - DNA, 20 bp, Homo sapiens
tcctggtgtcaccccagagc

SEQ ID NO: 2962579 - DNA, 22 bp, Homo sapiens
tcctgtaaaaaaaaaaaagtta

SEQ ID NO: 2962580 - DNA, 21 bp, Homo sapiens
tcctgtagccttctgtaggaa

SEQ ID NO: 2962581 - DNA, 13 bp, Homo sapiens
tcctgtatgttgt

SEQ ID NO: 2962582 - DNA, 16 bp, Homo sapiens
tcctgtattcagacag

SEQ ID NO: 2962583 - DNA, 17 bp, Homo sapiens
tcctgtattcagacaga

SEQ ID NO: 2962584 - DNA, 24 bp, Homo sapiens
tcctgtcacaaggcaggaggagct

SEQ ID NO: 2962585 - DNA, 15 bp, Homo sapiens
tcctgtccagctcca

SEQ ID NO: 2962586 - DNA, 16 bp, Homo sapiens
tcctgtccccatctgt

SEQ ID NO: 2962587 - DNA, 15 bp, Homo sapiens
tcctgtccttcacct

SEQ ID NO: 2962588 - DNA, 17 bp, Homo sapiens
tcctgtcgattagactg

SEQ ID NO: 2962589 - DNA, 21 bp, Homo sapiens
tcctgtcgattagactggaca

SEQ ID NO: 2962590 - DNA, 23 bp, Homo sapiens
tcctgtctccctcctctgcccgg

SEQ ID NO: 2962591 - DNA, 13 bp, Homo sapiens
tcctgtctgtcct

SEQ ID NO: 2962592 - DNA, 17 bp, Homo sapiens
tcctgtctgtccttctg

SEQ ID NO: 2962593 - DNA, 20 bp, Homo sapiens
tcctgtcttgtctattgtat

SEQ ID NO: 2962594 - DNA, 16 bp, Homo sapiens
tcctgtctttacaaat

SEQ ID NO: 2962595 - DNA, 22 bp, Homo sapiens
tcctgtgatagagttcttttaa

SEQ ID NO: 2962596 - DNA, 17 bp, Homo sapiens
tcctgtgccaggtacta

SEQ ID NO: 2962597 - DNA, 18 bp, Homo sapiens
tcctgtgcccatcatctc

SEQ ID NO: 2962598 - DNA, 19 bp, Homo sapiens
tcctgtgcctccatcagct

SEQ ID NO: 2962599 - DNA, 16 bp, Homo sapiens
tcctgtgcctttccta

SEQ ID NO: 2962600 - DNA, 12 bp, Homo sapiens
tcctgtgctaca

SEQ ID NO: 2962601 - DNA, 13 bp, Homo sapiens
tcctgtgctacag

SEQ ID NO: 2962602 - DNA, 14 bp, Homo sapiens
tcctgtggcagctg

SEQ ID NO: 2962603 - DNA, 19 bp, Homo sapiens
tcctgtggcagctgcccct

SEQ ID NO: 2962604 - DNA, 17 bp, Homo sapiens
tcctgtggcatgcaaaa

SEQ ID NO: 2962605 - DNA, 15 bp, Homo sapiens
tcctgtggctccctc

SEQ ID NO: 2962606 - DNA, 16 bp, Homo sapiens
tcctgtgtcaatccag

SEQ ID NO: 2962607 - DNA, 22 bp, Homo sapiens
tcctgtgtgtccaaaactgcct

SEQ ID NO: 2962608 - DNA, 16 bp, Homo sapiens
tcctgttggctgctgc

SEQ ID NO: 2962609 - DNA, 16 bp, Homo sapiens
tcctgtttatttttaa

SEQ ID NO: 2962610 - DNA, 13 bp, Homo sapiens
tcctgtttctgaa

SEQ ID NO: 2962611 - DNA, 16 bp, Homo sapiens
tccttaaggctctttt

SEQ ID NO: 2962612 - DNA, 15 bp, Homo sapiens
tccttacattaaaaa

SEQ ID NO: 2962613 - DNA, 14 bp, Homo sapiens
tccttactcagagc

SEQ ID NO: 2962614 - DNA, 15 bp, Homo sapiens
tccttactcagagct

SEQ ID NO: 2962615 - DNA, 16 bp, Homo sapiens
tccttactcagagctg

SEQ ID NO: 2962616 - DNA, 18 bp, Homo sapiens
tccttactcagagctgcg

SEQ ID NO: 2962617 - DNA, 21 bp, Homo sapiens
tccttactcagagctgcgggc

SEQ ID NO: 2962618 - DNA, 13 bp, Homo sapiens
tccttacttccag

SEQ ID NO: 2962619 - DNA, 15 bp, Homo sapiens
tccttacttccagca

SEQ ID NO: 2962620 - DNA, 17 bp, Homo sapiens
tccttagatctggcatg

SEQ ID NO: 2962621 - DNA, 13 bp, Homo sapiens
tccttagctgcca

SEQ ID NO: 2962622 - DNA, 23 bp, Homo sapiens
tccttagcttggtatgagacaga

SEQ ID NO: 2962623 - DNA, 18 bp, Homo sapiens
tccttaggttgtagcaga

SEQ ID NO: 2962624 - DNA, 14 bp, Homo sapiens
tccttcacatcctg

SEQ ID NO: 2962625 - DNA, 20 bp, Homo sapiens
tccttcacatcctgtgtttc

SEQ ID NO: 2962626 - DNA, 14 bp, Homo sapiens
tccttcacatctcc

SEQ ID NO: 2962627 - DNA, 13 bp, Homo sapiens
tccttcacctttc

SEQ ID NO: 2962628 - DNA, 15 bp, Homo sapiens
tccttcactggcgcc

SEQ ID NO: 2962629 - DNA, 13 bp, Homo sapiens
tccttcagacacc

SEQ ID NO: 2962630 - DNA, 23 bp, Homo sapiens
tccttcagacaccctcaacctct

SEQ ID NO: 2962631 - DNA, 12 bp, Homo sapiens
tccttcagtgca

SEQ ID NO: 2962632 - DNA, 14 bp, Homo sapiens
tccttccaacagga

SEQ ID NO: 2962633 - DNA, 12 bp, Homo sapiens
tccttccacctc

SEQ ID NO: 2962634 - DNA, 13 bp, Homo sapiens
tccttccatgctc

SEQ ID NO: 2962635 - DNA, 14 bp, Homo sapiens
tccttccatgctcc

SEQ ID NO: 2962636 - DNA, 17 bp, Homo sapiens
tccttccatgctcccaa

SEQ ID NO: 2962637 - DNA, 12 bp, Homo sapiens
tccttcccaagg

SEQ ID NO: 2962638 - DNA, 12 bp, Homo sapiens
tccttccctggc

SEQ ID NO: 2962639 - DNA, 14 bp, Homo sapiens
tccttcctctcctt

SEQ ID NO: 2962640 - DNA, 16 bp, Homo sapiens
tccttcctgtgccctg

SEQ ID NO: 2962641 - DNA, 14 bp, Homo sapiens
tccttccttccctg

SEQ ID NO: 2962642 - DNA, 18 bp, Homo sapiens
tccttctcattgctgccc

SEQ ID NO: 2962643 - DNA, 22 bp, Homo sapiens
tccttctggctgtagataaata

SEQ ID NO: 2962644 - DNA, 19 bp, Homo sapiens
tccttcttccacttctcca

SEQ ID NO: 2962645 - DNA, 14 bp, Homo sapiens
tccttcttcctcaa

SEQ ID NO: 2962646 - DNA, 12 bp, Homo sapiens
tccttgaaacag

SEQ ID NO: 2962647 - DNA, 16 bp, Homo sapiens
tccttgaaacagaaaa

SEQ ID NO: 2962648 - DNA, 18 bp, Homo sapiens
tccttgaagacatatcat

SEQ ID NO: 2962649 - DNA, 11 bp, Homo sapiens
tcctccctcct

SEQ ID NO: 2962650 - DNA, 18 bp, Homo sapiens
tcctccctcctcactccc

SEQ ID NO: 2962651 - DNA, 20 bp, Homo sapiens
tcctccctgcctcagtggct

SEQ ID NO: 2962652 - DNA, 15 bp, Homo sapiens
tcctccctggcagac

SEQ ID NO: 2962653 - DNA, 13 bp, Homo sapiens
tcctccctggctg

SEQ ID NO: 2962654 - DNA, 13 bp, Homo sapiens
tcctcccttctgc

SEQ ID NO: 2962655 - DNA, 18 bp, Homo sapiens
tcctcccttctgctactg

SEQ ID NO: 2962656 - DNA, 16 bp, Homo sapiens
tcctccgcctactgtc

SEQ ID NO: 2962657 - DNA, 17 bp, Homo sapiens
tcctcctacctcagcct

SEQ ID NO: 2962658 - DNA, 16 bp, Homo sapiens
tcctcctcccagtgcc

SEQ ID NO: 2962659 - DNA, 17 bp, Homo sapiens
tcctcctcccagtgcct

SEQ ID NO: 2962660 - DNA, 17 bp, Homo sapiens
tcctcctccctgcatct

SEQ ID NO: 2962661 - DNA, 15 bp, Homo sapiens
tcctcctctacctct

SEQ ID NO: 2962662 - DNA, 15 bp, Homo sapiens
tcctcctctccatgc

SEQ ID NO: 2962663 - DNA, 16 bp, Homo sapiens
tcctcctctccatgca

SEQ ID NO: 2962664 - DNA, 12 bp, Homo sapiens
tcctcctctgtg

SEQ ID NO: 2962665 - DNA, 13 bp, Homo sapiens
tcctcctctgtga

SEQ ID NO: 2962666 - DNA, 14 bp, Homo sapiens
tcctcctgccagct

SEQ ID NO: 2962667 - DNA, 20 bp, Homo sapiens
tcctcctgccagctctgtca

SEQ ID NO: 2962668 - DNA, 12 bp, Homo sapiens
tcctcctgccca

SEQ ID NO: 2962669 - DNA, 17 bp, Homo sapiens
tcctcctgcccacctgt

SEQ ID NO: 2962670 - DNA, 11 bp, Homo sapiens
tcctcctgctt

SEQ ID NO: 2962671 - DNA, 19 bp, Homo sapiens
tcctccttggtgcctggcc

SEQ ID NO: 2962672 - DNA, 14 bp, Homo sapiens
tcctcctttctctg

SEQ ID NO: 2962673 - DNA, 16 bp, Homo sapiens
tcctcctttctctgta

SEQ ID NO: 2962674 - DNA, 18 bp, Homo sapiens
tcctcctttctctgtata

SEQ ID NO: 2962675 - DNA, 21 bp, Homo sapiens
tcctcgaattttatctgtgga

SEQ ID NO: 2962676 - DNA, 17 bp, Homo sapiens
tcctcgacatcactgtt

SEQ ID NO: 2962677 - DNA, 20 bp, Homo sapiens
tcctcgatgggagggatggc

SEQ ID NO: 2962678 - DNA, 13 bp, Homo sapiens
tcctcgcaagctg

SEQ ID NO: 2962679 - DNA, 14 bp, Homo sapiens
tcctcgcacacact

SEQ ID NO: 2962680 - DNA, 18 bp, Homo sapiens
tcctcgcacacactggct

SEQ ID NO: 2962681 - DNA, 16 bp, Homo sapiens
tcctcgcagatgataa

SEQ ID NO: 2962682 - DNA, 14 bp, Homo sapiens
tcctcgccctgggt

SEQ ID NO: 2962683 - DNA, 14 bp, Homo sapiens
tcctcggagctggt

SEQ ID NO: 2962684 - DNA, 20 bp, Homo sapiens
tcctcggcccatctgtccat

SEQ ID NO: 2962685 - DNA, 13 bp, Homo sapiens
tcctctatttctt

SEQ ID NO: 2962686 - DNA, 14 bp, Homo sapiens
tcctctccacagga

SEQ ID NO: 2962687 - DNA, 16 bp, Homo sapiens
tcctctccacaggagc

SEQ ID NO: 2962688 - DNA, 17 bp, Homo sapiens
tcctctccacaggagcc

SEQ ID NO: 2962689 - DNA, 22 bp, Homo sapiens
tcctctccacaggagcctctgc

SEQ ID NO: 2962690 - DNA, 18 bp, Homo sapiens
tcctctccatgcaagtgc

SEQ ID NO: 2962691 - DNA, 22 bp, Homo sapiens
tcctctcccattgtccctctgc

SEQ ID NO: 2962692 - DNA, 23 bp, Homo sapiens
tcctctcccattgtccctctgcc

SEQ ID NO: 2962693 - DNA, 18 bp, Homo sapiens
tcctctccccagcccaga

SEQ ID NO: 2962694 - DNA, 19 bp, Homo sapiens
tcctctccccagcccagag

SEQ ID NO: 2962695 - DNA, 23 bp, Homo sapiens
tcctctccccagcccagagacat

SEQ ID NO: 2962696 - DNA, 19 bp, Homo sapiens
tcctctccgcgccctccga

SEQ ID NO: 2962697 - DNA, 15 bp, Homo sapiens
tcctctccttccttg

SEQ ID NO: 2962698 - DNA, 14 bp, Homo sapiens
tcctctctccagat

SEQ ID NO: 2962699 - DNA, 19 bp, Homo sapiens
tcctctctccagatgtttc

SEQ ID NO: 2962700 - DNA, 21 bp, Homo sapiens
tcctctctcccaccctaaggg

SEQ ID NO: 2962701 - DNA, 20 bp, Homo sapiens
tcctctctccctgcctcaca

SEQ ID NO: 2962702 - DNA, 22 bp, Homo sapiens
tcctctctccctgcctcacatc

SEQ ID NO: 2962703 - DNA, 11 bp, Homo sapiens
tcctctctctc

SEQ ID NO: 2962704 - DNA, 15 bp, Homo sapiens
tcctctctctctcta

SEQ ID NO: 2962705 - DNA, 21 bp, Homo sapiens
tcctctctgtctgtctctccc

SEQ ID NO: 2962706 - DNA, 13 bp, Homo sapiens
tcctctcttggca

SEQ ID NO: 2962707 - DNA, 10 bp, Homo sapiens
tcctctgaaa

SEQ ID NO: 2962708 - DNA, 11 bp, Homo sapiens
tcctctgaaac

SEQ ID NO: 2962709 - DNA, 15 bp, Homo sapiens
tcctctgaaacagct

SEQ ID NO: 2962710 - DNA, 17 bp, Homo sapiens
tcctctgaaacagctgc

SEQ ID NO: 2962711 - DNA, 21 bp, Homo sapiens
tcctctgaaacagctgcctta

SEQ ID NO: 2962712 - DNA, 15 bp, Homo sapiens
tcctctgactcaggg

SEQ ID NO: 2962713 - DNA, 16 bp, Homo sapiens
tcctctgactcagggc

SEQ ID NO: 2962714 - DNA, 13 bp, Homo sapiens
tcctctggcttcc

SEQ ID NO: 2962715 - DNA, 17 bp, Homo sapiens
tcctctgtaagacaaca

SEQ ID NO: 2962716 - DNA, 18 bp, Homo sapiens
tcctctgtaagacaacat

SEQ ID NO: 2962717 - DNA, 17 bp, Homo sapiens
tcctctgtagtattttt

SEQ ID NO: 2962718 - DNA, 20 bp, Homo sapiens
tcctctgtagtattttttaa

SEQ ID NO: 2962719 - DNA, 22 bp, Homo sapiens
tcctctgtcagtcacagccacc

SEQ ID NO: 2962720 - DNA, 17 bp, Homo sapiens
tcctcttactttcagtt

SEQ ID NO: 2962721 - DNA, 21 bp, Homo sapiens
tcctcttagcctctggatcta

SEQ ID NO: 2962722 - DNA, 21 bp, Homo sapiens
tcctcttctcaaagctgggat

SEQ ID NO: 2962723 - DNA, 12 bp, Homo sapiens
tcctcttgtaaa

SEQ ID NO: 2962724 - DNA, 20 bp, Homo sapiens
tcctcttgtaaataaagccc

SEQ ID NO: 2962725 - DNA, 14 bp, Homo sapiens
tcctctttcccctc

SEQ ID NO: 2962726 - DNA, 23 bp, Homo sapiens
tcctctttgctttgctttctgct

SEQ ID NO: 2962727 - DNA, 17 bp, Homo sapiens
tcctgaaacaacttgga

SEQ ID NO: 2962728 - DNA, 15 bp, Homo sapiens
tcctgaaataaatgt

SEQ ID NO: 2962729 - DNA, 12 bp, Homo sapiens
tcctgaaatcaa

SEQ ID NO: 2962730 - DNA, 18 bp, Homo sapiens
tcctgaaatgccaagtgc

SEQ ID NO: 2962731 - DNA, 15 bp, Homo sapiens
tcctgaacagcatgg

SEQ ID NO: 2962732 - DNA, 14 bp, Homo sapiens
tcctgaagaaccag

SEQ ID NO: 2962733 - DNA, 18 bp, Homo sapiens
tcctgaagctgaggctca

SEQ ID NO: 2962734 - DNA, 17 bp, Homo sapiens
tcctgaaggtctgggtc

SEQ ID NO: 2962735 - DNA, 18 bp, Homo sapiens
tcctgacaacgtctcttc

SEQ ID NO: 2962736 - DNA, 19 bp, Homo sapiens
tcctgacaacgtctcttca

SEQ ID NO: 2962737 - DNA, 19 bp, Homo sapiens
tcctgacaagttattactg

SEQ ID NO: 2962738 - DNA, 20 bp, Homo sapiens
tcctgacccggattggccct

SEQ ID NO: 2962739 - DNA, 21 bp, Homo sapiens
tcctgacccggattggccctg

SEQ ID NO: 2962740 - DNA, 16 bp, Homo sapiens
tcctgacctcaggtga

SEQ ID NO: 2962741 - DNA, 18 bp, Homo sapiens
tcctgactattatgttgt

SEQ ID NO: 2962742 - DNA, 18 bp, Homo sapiens
tcctgactgggctgggtt

SEQ ID NO: 2962743 - DNA, 22 bp, Homo sapiens
tcctgactgggctgggtttgct

SEQ ID NO: 2962744 - DNA, 23 bp, Homo sapiens
tcctgactgtctcccgggactac

SEQ ID NO: 2962745 - DNA, 20 bp, Homo sapiens
tcctgagaaacgtccatctc

SEQ ID NO: 2962746 - DNA, 16 bp, Homo sapiens
tcctgagaccacagag

SEQ ID NO: 2962747 - DNA, 15 bp, Homo sapiens
tcctgagcagtccct

SEQ ID NO: 2962748 - DNA, 19 bp, Homo sapiens
tcctgaggacagctgtcct

SEQ ID NO: 2962749 - DNA, 15 bp, Homo sapiens
tcctgatcagagccg

SEQ ID NO: 2962750 - DNA, 15 bp, Homo sapiens
tcctgatttgagttt

SEQ ID NO: 2962751 - DNA, 15 bp, Homo sapiens
tcctgatttttatct

SEQ ID NO: 2962752 - DNA, 18 bp, Homo sapiens
tcctgcaaagtctccaga

SEQ ID NO: 2962753 - DNA, 19 bp, Homo sapiens
tcctgcaagggacaggaag

SEQ ID NO: 2962754 - DNA, 21 bp, Homo sapiens
tcctgcaagggacaggaaggt

SEQ ID NO: 2962755 - DNA, 18 bp, Homo sapiens
tcctgcacagattcccag

SEQ ID NO: 2962756 - DNA, 19 bp, Homo sapiens
tcctgcaggccaggccagc

SEQ ID NO: 2962757 - DNA, 18 bp, Homo sapiens
tcctgccacattagaact

SEQ ID NO: 2962758 - DNA, 15 bp, Homo sapiens
tcctgccagcccggc

SEQ ID NO: 2962759 - DNA, 16 bp, Homo sapiens
tcctgccagcccggct

SEQ ID NO: 2962760 - DNA, 14 bp, Homo sapiens
tcctgccagctctg

SEQ ID NO: 2962761 - DNA, 20 bp, Homo sapiens
tcctgcccactgctgcagta

SEQ ID NO: 2962762 - DNA, 14 bp, Homo sapiens
tcctgcccagccac

SEQ ID NO: 2962763 - DNA, 13 bp, Homo sapiens
tcctgcccaggag

SEQ ID NO: 2962764 - DNA, 14 bp, Homo sapiens
tcctgcccaggaga

SEQ ID NO: 2962765 - DNA, 12 bp, Homo sapiens
tcctgccctgcc

SEQ ID NO: 2962766 - DNA, 14 bp, Homo sapiens
tcctgccctgcccc

SEQ ID NO: 2962767 - DNA, 17 bp, Homo sapiens
tcctgcccttttcctgg

SEQ ID NO: 2962768 - DNA, 23 bp, Homo sapiens
tcctgccgcccgaggtggctgcc

SEQ ID NO: 2962769 - DNA, 16 bp, Homo sapiens
tcctgccggagaggaa

SEQ ID NO: 2962770 - DNA, 22 bp, Homo sapiens
tcctgccggagaggaagagaca

SEQ ID NO: 2962771 - DNA, 21 bp, Homo sapiens
tcctgcctcagcctcccgagt

SEQ ID NO: 2962772 - DNA, 20 bp, Homo sapiens
tcctgcctcagccttccaag

SEQ ID NO: 2962773 - DNA, 14 bp, Homo sapiens
tcctgccttcctcc

SEQ ID NO: 2962774 - DNA, 22 bp, Homo sapiens
tcctgccttcctcctgggccct

SEQ ID NO: 2962775 - DNA, 20 bp, Homo sapiens
tcctgcgggcttttccccgg

SEQ ID NO: 2962776 - DNA, 18 bp, Homo sapiens
tcctgctactctgttcct

SEQ ID NO: 2962777 - DNA, 15 bp, Homo sapiens
tcctgctagcaggcc

SEQ ID NO: 2962778 - DNA, 22 bp, Homo sapiens
tcctgctagcaggccccctagg

SEQ ID NO: 2962779 - DNA, 15 bp, Homo sapiens
tcctgctccgctgcc

SEQ ID NO: 2962780 - DNA, 19 bp, Homo sapiens
tcctgctccgctgcctgga

SEQ ID NO: 2962781 - DNA, 13 bp, Homo sapiens
tcctgctccgtgg

SEQ ID NO: 2962782 - DNA, 18 bp, Homo sapiens
tcctgctccgtggactgc

SEQ ID NO: 2962783 - DNA, 22 bp, Homo sapiens
tcctgctccgtggactgcagtc

SEQ ID NO: 2962784 - DNA, 16 bp, Homo sapiens
tcctgctctgcacggt

SEQ ID NO: 2962785 - DNA, 22 bp, Homo sapiens
tcctgctctgcacggtctgcgg

SEQ ID NO: 2962786 - DNA, 13 bp, Homo sapiens
tccgccagggccc

SEQ ID NO: 2962787 - DNA, 18 bp, Homo sapiens
tccgccagggcccacacc

SEQ ID NO: 2962788 - DNA, 19 bp, Homo sapiens
tccgccagggcccacaccc

SEQ ID NO: 2962789 - DNA, 15 bp, Homo sapiens
tccgccagtgtttct

SEQ ID NO: 2962790 - DNA, 18 bp, Homo sapiens
tccgcctacctcagcctc

SEQ ID NO: 2962791 - DNA, 15 bp, Homo sapiens
tccgcctgcgcctcc

SEQ ID NO: 2962792 - DNA, 19 bp, Homo sapiens
tccgcgccctccgacctct

SEQ ID NO: 2962793 - DNA, 20 bp, Homo sapiens
tccgcgccctccgacctctc

SEQ ID NO: 2962794 - DNA, 23 bp, Homo sapiens
tccgcgcggagacctcctgacaa

SEQ ID NO: 2962795 - DNA, 13 bp, Homo sapiens
tccgcggcctgca

SEQ ID NO: 2962796 - DNA, 14 bp, Homo sapiens
tccgcgtgtgcctg

SEQ ID NO: 2962797 - DNA, 19 bp, Homo sapiens
tccgcgtgtgcctgtgtgc

SEQ ID NO: 2962798 - DNA, 13 bp, Homo sapiens
tccgctgcctgga

SEQ ID NO: 2962799 - DNA, 19 bp, Homo sapiens
tccggaaactagtgtacat

SEQ ID NO: 2962800 - DNA, 13 bp, Homo sapiens
tccggaagggtga

SEQ ID NO: 2962801 - DNA, 21 bp, Homo sapiens
tccggccctcctaccctgcgc

SEQ ID NO: 2962802 - DNA, 15 bp, Homo sapiens
tccggcctgcgtctc

SEQ ID NO: 2962803 - DNA, 21 bp, Homo sapiens
tccgggacctggtgctgcctc

SEQ ID NO: 2962804 - DNA, 11 bp, Homo sapiens
tccgggcaggg

SEQ ID NO: 2962805 - DNA, 18 bp, Homo sapiens
tccggggttcagcctcct

SEQ ID NO: 2962806 - DNA, 15 bp, Homo sapiens
tccggtgttctaaga

SEQ ID NO: 2962807 - DNA, 17 bp, Homo sapiens
tccgtcagaaagtgtaa

SEQ ID NO: 2962808 - DNA, 16 bp, Homo sapiens
tccgtcctcgatggga

SEQ ID NO: 2962809 - DNA, 15 bp, Homo sapiens
tccgtctctgtcctc

SEQ ID NO: 2962810 - DNA, 16 bp, Homo sapiens
tccgtctctgtcctcg

SEQ ID NO: 2962811 - DNA, 14 bp, Homo sapiens
tccgtctgtgtggg

SEQ ID NO: 2962812 - DNA, 20 bp, Homo sapiens
tccgtgaatggtctctgtca

SEQ ID NO: 2962813 - DNA, 14 bp, Homo sapiens
tccgtgaggctgct

SEQ ID NO: 2962814 - DNA, 18 bp, Homo sapiens
tccgtgaggctgctgcca

SEQ ID NO: 2962815 - DNA, 15 bp, Homo sapiens
tccgtgggttgctaa

SEQ ID NO: 2962816 - DNA, 14 bp, Homo sapiens
tccgttttgcctgt

SEQ ID NO: 2962817 - DNA, 19 bp, Homo sapiens
tcctaaaagttctcaatgt

SEQ ID NO: 2962818 - DNA, 14 bp, Homo sapiens
tcctaaagctgaat

SEQ ID NO: 2962819 - DNA, 20 bp, Homo sapiens
tcctaaagctgaatcccggc

SEQ ID NO: 2962820 - DNA, 18 bp, Homo sapiens
tcctaaatattggtttgt

SEQ ID NO: 2962821 - DNA, 15 bp, Homo sapiens
tcctaagacctgggg

SEQ ID NO: 2962822 - DNA, 15 bp, Homo sapiens
tcctaagcatctaag

SEQ ID NO: 2962823 - DNA, 16 bp, Homo sapiens
tcctaagcatctaagt

SEQ ID NO: 2962824 - DNA, 14 bp, Homo sapiens
tcctaagcctaaaa

SEQ ID NO: 2962825 - DNA, 14 bp, Homo sapiens
tcctaagcctgtgg

SEQ ID NO: 2962826 - DNA, 17 bp, Homo sapiens
tcctaagcctgtggctg

SEQ ID NO: 2962827 - DNA, 20 bp, Homo sapiens
tcctaaggagttaaatcttc

SEQ ID NO: 2962828 - DNA, 16 bp, Homo sapiens
tcctaagggtcgaaag

SEQ ID NO: 2962829 - DNA, 18 bp, Homo sapiens
tcctaataaagttctgta

SEQ ID NO: 2962830 - DNA, 22 bp, Homo sapiens
tcctaatcaagagtctctccag

SEQ ID NO: 2962831 - DNA, 14 bp, Homo sapiens
tcctaatcatccaa

SEQ ID NO: 2962832 - DNA, 13 bp, Homo sapiens
tcctaatgcatta

SEQ ID NO: 2962833 - DNA, 18 bp, Homo sapiens
tcctacaacttaatggaa

SEQ ID NO: 2962834 - DNA, 19 bp, Homo sapiens
tcctacaacttaatggaaa

SEQ ID NO: 2962835 - DNA, 19 bp, Homo sapiens
tcctacaatattttattct

SEQ ID NO: 2962836 - DNA, 14 bp, Homo sapiens
tcctacatacagca

SEQ ID NO: 2962837 - DNA, 16 bp, Homo sapiens
tcctaccccctgtgcc

SEQ ID NO: 2962838 - DNA, 17 bp, Homo sapiens
tcctaccccctgtgcct

SEQ ID NO: 2962839 - DNA, 15 bp, Homo sapiens
tcctaccctgcgccc

SEQ ID NO: 2962840 - DNA, 20 bp, Homo sapiens
tcctacctcagcctcctggg

SEQ ID NO: 2962841 - DNA, 17 bp, Homo sapiens
tcctacctccactctct

SEQ ID NO: 2962842 - DNA, 22 bp, Homo sapiens
tcctactttctatttttatgat

SEQ ID NO: 2962843 - DNA, 12 bp, Homo sapiens
tcctagaggaga

SEQ ID NO: 2962844 - DNA, 15 bp, Homo sapiens
tcctagaggagacag

SEQ ID NO: 2962845 - DNA, 20 bp, Homo sapiens
tcctagagggaggggcctag

SEQ ID NO: 2962846 - DNA, 13 bp, Homo sapiens
tcctagatcctaa

SEQ ID NO: 2962847 - DNA, 19 bp, Homo sapiens
tcctagcccagtgcttctc

SEQ ID NO: 2962848 - DNA, 15 bp, Homo sapiens
tcctagctgacgcca

SEQ ID NO: 2962849 - DNA, 18 bp, Homo sapiens
tcctaggagtatcctcat

SEQ ID NO: 2962850 - DNA, 12 bp, Homo sapiens
tcctaggccctt

SEQ ID NO: 2962851 - DNA, 16 bp, Homo sapiens
tcctaggcccttgggg

SEQ ID NO: 2962852 - DNA, 21 bp, Homo sapiens
tcctaggcccttggggtggcg

SEQ ID NO: 2962853 - DNA, 20 bp, Homo sapiens
tcctagggtgggaaggggct

SEQ ID NO: 2962854 - DNA, 20 bp, Homo sapiens
tcctaggttttgagatttag

SEQ ID NO: 2962855 - DNA, 23 bp, Homo sapiens
tcctagtctctatcattaaagtt

SEQ ID NO: 2962856 - DNA, 21 bp, Homo sapiens
tcctagttaatcatcattttt

SEQ ID NO: 2962857 - DNA, 14 bp, Homo sapiens
tcctagttggtgag

SEQ ID NO: 2962858 - DNA, 17 bp, Homo sapiens
tcctagttttcctactt

SEQ ID NO: 2962859 - DNA, 18 bp, Homo sapiens
tcctatacgcagcgtgct

SEQ ID NO: 2962860 - DNA, 14 bp, Homo sapiens
tcctatcttttatt

SEQ ID NO: 2962861 - DNA, 17 bp, Homo sapiens
tcctatgaatgctttgc

SEQ ID NO: 2962862 - DNA, 13 bp, Homo sapiens
tcctatggaaacc

SEQ ID NO: 2962863 - DNA, 21 bp, Homo sapiens
tcctatgtgattttaactctg

SEQ ID NO: 2962864 - DNA, 23 bp, Homo sapiens
tcctatgtgattttaactctgtc

SEQ ID NO: 2962865 - DNA, 18 bp, Homo sapiens
tcctatgtttttgttcaa

SEQ ID NO: 2962866 - DNA, 18 bp, Homo sapiens
tcctattacttttcatct

SEQ ID NO: 2962867 - DNA, 20 bp, Homo sapiens
tcctattgtacgctagagca

SEQ ID NO: 2962868 - DNA, 11 bp, Homo sapiens
tcctatttaag

SEQ ID NO: 2962869 - DNA, 18 bp, Homo sapiens
tcctatttctagggctgg

SEQ ID NO: 2962870 - DNA, 16 bp, Homo sapiens
tcctatttgcactgta

SEQ ID NO: 2962871 - DNA, 15 bp, Homo sapiens
tcctatttttgtgaa

SEQ ID NO: 2962872 - DNA, 16 bp, Homo sapiens
tcctatttttgtgaag

SEQ ID NO: 2962873 - DNA, 16 bp, Homo sapiens
tcctcaaaaagcagaa

SEQ ID NO: 2962874 - DNA, 19 bp, Homo sapiens
tcctcaaaaagcagaagga

SEQ ID NO: 2962875 - DNA, 23 bp, Homo sapiens
tcctcaagaaataaaaggaagcc

SEQ ID NO: 2962876 - DNA, 12 bp, Homo sapiens
tcctcaatccag

SEQ ID NO: 2962877 - DNA, 13 bp, Homo sapiens
tcctcacactcca

SEQ ID NO: 2962878 - DNA, 21 bp, Homo sapiens
tcctcacgccccctgtgactt

SEQ ID NO: 2962879 - DNA, 18 bp, Homo sapiens
tcctcacgtgcaggacag

SEQ ID NO: 2962880 - DNA, 19 bp, Homo sapiens
tcctcagatcatccagaag

SEQ ID NO: 2962881 - DNA, 12 bp, Homo sapiens
tcctcagccagt

SEQ ID NO: 2962882 - DNA, 11 bp, Homo sapiens
tcctcagcctt

SEQ ID NO: 2962883 - DNA, 18 bp, Homo sapiens
tcctcagccttgccagag

SEQ ID NO: 2962884 - DNA, 21 bp, Homo sapiens
tcctcagccttgccagagatc

SEQ ID NO: 2962885 - DNA, 15 bp, Homo sapiens
tcctcagctttgctt

SEQ ID NO: 2962886 - DNA, 16 bp, Homo sapiens
tcctcaggcacacagc

SEQ ID NO: 2962887 - DNA, 17 bp, Homo sapiens
tcctcagggcagcctcc

SEQ ID NO: 2962888 - DNA, 18 bp, Homo sapiens
tcctcaggtggccatgcc

SEQ ID NO: 2962889 - DNA, 10 bp, Homo sapiens
tcctcagtgc

SEQ ID NO: 2962890 - DNA, 17 bp, Homo sapiens
tcctcagtgcaaaatgt

SEQ ID NO: 2962891 - DNA, 21 bp, Homo sapiens
tcctcagtgcaaaatgtcttg

SEQ ID NO: 2962892 - DNA, 14 bp, Homo sapiens
tcctcatcctgctt

SEQ ID NO: 2962893 - DNA, 13 bp, Homo sapiens
tcctcatctgtgc

SEQ ID NO: 2962894 - DNA, 14 bp, Homo sapiens
tcctcatctgtgcc

SEQ ID NO: 2962895 - DNA, 15 bp, Homo sapiens
tcctcatctgtgcct

SEQ ID NO: 2962896 - DNA, 16 bp, Homo sapiens
tcctcatctgtgcctg

SEQ ID NO: 2962897 - DNA, 19 bp, Homo sapiens
tcctcatctgtgcctgtct

SEQ ID NO: 2962898 - DNA, 15 bp, Homo sapiens
tcctcattcaaaggg

SEQ ID NO: 2962899 - DNA, 21 bp, Homo sapiens
tcctcatttggggtagctaga

SEQ ID NO: 2962900 - DNA, 13 bp, Homo sapiens
tcctccaaagtaa

SEQ ID NO: 2962901 - DNA, 22 bp, Homo sapiens
tcctccaacaccaagcacagca

SEQ ID NO: 2962902 - DNA, 13 bp, Homo sapiens
tcctccaacagct

SEQ ID NO: 2962903 - DNA, 20 bp, Homo sapiens
tcctccaccaccgcccgtct

SEQ ID NO: 2962904 - DNA, 21 bp, Homo sapiens
tcctccaccaccgcccgtctg

SEQ ID NO: 2962905 - DNA, 22 bp, Homo sapiens
tcctccaccaccgcccgtctgt

SEQ ID NO: 2962906 - DNA, 19 bp, Homo sapiens
tcctccacgttctgctcat

SEQ ID NO: 2962907 - DNA, 12 bp, Homo sapiens
tcctccagagga

SEQ ID NO: 2962908 - DNA, 14 bp, Homo sapiens
tcctccagcaggga

SEQ ID NO: 2962909 - DNA, 18 bp, Homo sapiens
tcctccagccctgcccac

SEQ ID NO: 2962910 - DNA, 13 bp, Homo sapiens
tcctccagggcca

SEQ ID NO: 2962911 - DNA, 17 bp, Homo sapiens
tcctccagggtgatttt

SEQ ID NO: 2962912 - DNA, 17 bp, Homo sapiens
tcctccatcgcagtgtt

SEQ ID NO: 2962913 - DNA, 14 bp, Homo sapiens
tcctcccagtgcct

SEQ ID NO: 2962914 - DNA, 13 bp, Homo sapiens
tcctccccaccag

SEQ ID NO: 2962915 - DNA, 22 bp, Homo sapiens
tcctccccaccagagctgcctc

SEQ ID NO: 2962916 - DNA, 17 bp, Homo sapiens
tcctcccccggctgggc

SEQ ID NO: 2962917 - DNA, 22 bp, Homo sapiens
tcctcccccggctgggcctcct

SEQ ID NO: 2962918 - DNA, 14 bp, Homo sapiens
tcctccccctgcca

SEQ ID NO: 2962919 - DNA, 15 bp, Homo sapiens
tcctccccgctccgt

SEQ ID NO: 2962920 - DNA, 16 bp, Homo sapiens
tcctcccctgccgcct

SEQ ID NO: 2962921 - DNA, 17 bp, Homo sapiens
tcctcccctgccgcctc

SEQ ID NO: 2962922 - DNA, 20 bp, Homo sapiens
tcctcccctgccgcctcccg

SEQ ID NO: 2962923 - DNA, 11 bp, Homo sapiens
tcctccctccc

SEQ ID NO: 2962924 - DNA, 19 bp, Homo sapiens
tccctagaaacttccaaat

SEQ ID NO: 2962925 - DNA, 20 bp, Homo sapiens
tccctagactttaggctttc

SEQ ID NO: 2962926 - DNA, 12 bp, Homo sapiens
tccctagatcca

SEQ ID NO: 2962927 - DNA, 16 bp, Homo sapiens
tccctagccagcactt

SEQ ID NO: 2962928 - DNA, 17 bp, Homo sapiens
tccctagccagcacttg

SEQ ID NO: 2962929 - DNA, 14 bp, Homo sapiens
tccctatactgctt

SEQ ID NO: 2962930 - DNA, 17 bp, Homo sapiens
tccctatactgcttgga

SEQ ID NO: 2962931 - DNA, 14 bp, Homo sapiens
tccctatttatgat

SEQ ID NO: 2962932 - DNA, 10 bp, Homo sapiens
tccctcaccc

SEQ ID NO: 2962933 - DNA, 15 bp, Homo sapiens
tccctcaccttctga

SEQ ID NO: 2962934 - DNA, 15 bp, Homo sapiens
tccctcaccttggca

SEQ ID NO: 2962935 - DNA, 20 bp, Homo sapiens
tccctcaccttggcaccaga

SEQ ID NO: 2962936 - DNA, 21 bp, Homo sapiens
tccctcaccttggcaccagac

SEQ ID NO: 2962937 - DNA, 16 bp, Homo sapiens
tccctcatctgtccct

SEQ ID NO: 2962938 - DNA, 21 bp, Homo sapiens
tccctcatctgtccctccggg

SEQ ID NO: 2962939 - DNA, 18 bp, Homo sapiens
tccctccccacccaagag

SEQ ID NO: 2962940 - DNA, 19 bp, Homo sapiens
tccctccccacccaagaga

SEQ ID NO: 2962941 - DNA, 15 bp, Homo sapiens
tccctcccccagcag

SEQ ID NO: 2962942 - DNA, 16 bp, Homo sapiens
tccctcccccccatgc

SEQ ID NO: 2962943 - DNA, 14 bp, Homo sapiens
tccctccccttctc

SEQ ID NO: 2962944 - DNA, 15 bp, Homo sapiens
tccctccccttctct

SEQ ID NO: 2962945 - DNA, 13 bp, Homo sapiens
tccctcccttcct

SEQ ID NO: 2962946 - DNA, 14 bp, Homo sapiens
tccctcccttcctt

SEQ ID NO: 2962947 - DNA, 17 bp, Homo sapiens
tccctccgactccagat

SEQ ID NO: 2962948 - DNA, 13 bp, Homo sapiens
tccctccgcctcc

SEQ ID NO: 2962949 - DNA, 18 bp, Homo sapiens
tccctccgcctcccatcc

SEQ ID NO: 2962950 - DNA, 16 bp, Homo sapiens
tccctccgggcagggg

SEQ ID NO: 2962951 - DNA, 15 bp, Homo sapiens
tccctccgtccctct

SEQ ID NO: 2962952 - DNA, 17 bp, Homo sapiens
tccctccgtccctctgt

SEQ ID NO: 2962953 - DNA, 19 bp, Homo sapiens
tccctcctcacactccaga

SEQ ID NO: 2962954 - DNA, 19 bp, Homo sapiens
tccctcgtcttcagctgca

SEQ ID NO: 2962955 - DNA, 16 bp, Homo sapiens
tccctctaacccagtg

SEQ ID NO: 2962956 - DNA, 21 bp, Homo sapiens
tccctctacagagcttccctg

SEQ ID NO: 2962957 - DNA, 19 bp, Homo sapiens
tccctctactgagtaaacc

SEQ ID NO: 2962958 - DNA, 22 bp, Homo sapiens
tccctctactgggagcctaccc

SEQ ID NO: 2962959 - DNA, 20 bp, Homo sapiens
tccctctaggctctgccttc

SEQ ID NO: 2962960 - DNA, 19 bp, Homo sapiens
tccctctatttatgtttgc

SEQ ID NO: 2962961 - DNA, 19 bp, Homo sapiens
tccctctcagtgccttctc

SEQ ID NO: 2962962 - DNA, 14 bp, Homo sapiens
tccctctcatctca

SEQ ID NO: 2962963 - DNA, 22 bp, Homo sapiens
tccctctcccccttaccccaca

SEQ ID NO: 2962964 - DNA, 21 bp, Homo sapiens
tccctctctcccatttcagga

SEQ ID NO: 2962965 - DNA, 12 bp, Homo sapiens
tccctctctcct

SEQ ID NO: 2962966 - DNA, 14 bp, Homo sapiens
tccctctctcctgg

SEQ ID NO: 2962967 - DNA, 16 bp, Homo sapiens
tccctctctcctggac

SEQ ID NO: 2962968 - DNA, 15 bp, Homo sapiens
tccctctctgtgcat

SEQ ID NO: 2962969 - DNA, 15 bp, Homo sapiens
tccctctcttccggg

SEQ ID NO: 2962970 - DNA, 17 bp, Homo sapiens
tccctctcttccgggag

SEQ ID NO: 2962971 - DNA, 16 bp, Homo sapiens
tccctctgcctcatcc

SEQ ID NO: 2962972 - DNA, 16 bp, Homo sapiens
tccctctggccctgcc

SEQ ID NO: 2962973 - DNA, 18 bp, Homo sapiens
tccctctggccctgcctt

SEQ ID NO: 2962974 - DNA, 19 bp, Homo sapiens
tccctctggccctgccttc

SEQ ID NO: 2962975 - DNA, 17 bp, Homo sapiens
tccctcttgtgctcagt

SEQ ID NO: 2962976 - DNA, 16 bp, Homo sapiens
tccctgaaaacccaga

SEQ ID NO: 2962977 - DNA, 16 bp, Homo sapiens
tccctgaaacactgct

SEQ ID NO: 2962978 - DNA, 18 bp, Homo sapiens
tccctgaaacactgcttc

SEQ ID NO: 2962979 - DNA, 14 bp, Homo sapiens
tccctgactcattc

SEQ ID NO: 2962980 - DNA, 15 bp, Homo sapiens
tccctgactgggagt

SEQ ID NO: 2962981 - DNA, 16 bp, Homo sapiens
tccctgagcagtctac

SEQ ID NO: 2962982 - DNA, 14 bp, Homo sapiens
tccctgagtcacca

SEQ ID NO: 2962983 - DNA, 16 bp, Homo sapiens
tccctgagtcaccagg

SEQ ID NO: 2962984 - DNA, 17 bp, Homo sapiens
tccctgcactgtgcccc

SEQ ID NO: 2962985 - DNA, 16 bp, Homo sapiens
tccctgcatctgacca

SEQ ID NO: 2962986 - DNA, 16 bp, Homo sapiens
tccctgcccatttcat

SEQ ID NO: 2962987 - DNA, 22 bp, Homo sapiens
tccctgcccctgtgcctctgtc

SEQ ID NO: 2962988 - DNA, 12 bp, Homo sapiens
tccctgcctcac

SEQ ID NO: 2962989 - DNA, 16 bp, Homo sapiens
tccctgcctcacatct

SEQ ID NO: 2962990 - DNA, 18 bp, Homo sapiens
tccctgcctcacatctcc

SEQ ID NO: 2962991 - DNA, 14 bp, Homo sapiens
tccctgcctccacc

SEQ ID NO: 2962992 - DNA, 15 bp, Homo sapiens
tccctgcctccagct

SEQ ID NO: 2962993 - DNA, 16 bp, Homo sapiens
tccctgcgcttcctga

SEQ ID NO: 2962994 - DNA, 20 bp, Homo sapiens
tccctgcgcttcctgagcag

SEQ ID NO: 2962995 - DNA, 17 bp, Homo sapiens
tccctgctgctgccagg

SEQ ID NO: 2962996 - DNA, 15 bp, Homo sapiens
tccctgcttatctga

SEQ ID NO: 2962997 - DNA, 22 bp, Homo sapiens
tccctgcttatctgaaacttcc

SEQ ID NO: 2962998 - DNA, 20 bp, Homo sapiens
tccctgcttatgatgggctc

SEQ ID NO: 2962999 - DNA, 21 bp, Homo sapiens
tccctgcttcatatctctccc

SEQ ID NO: 2963000 - DNA, 15 bp, Homo sapiens
tccctggcagacaca

SEQ ID NO: 2963001 - DNA, 14 bp, Homo sapiens
tccctggccactga

SEQ ID NO: 2963002 - DNA, 11 bp, Homo sapiens
tccctggctgc

SEQ ID NO: 2963003 - DNA, 12 bp, Homo sapiens
tccctggctgca

SEQ ID NO: 2963004 - DNA, 20 bp, Homo sapiens
tccctggggaaaacttgcag

SEQ ID NO: 2963005 - DNA, 18 bp, Homo sapiens
tccctggggcactccccc

SEQ ID NO: 2963006 - DNA, 19 bp, Homo sapiens
tccctggggcactccccca

SEQ ID NO: 2963007 - DNA, 21 bp, Homo sapiens
tccctggggcactcccccagg

SEQ ID NO: 2963008 - DNA, 19 bp, Homo sapiens
tccctgggggaagccctgg

SEQ ID NO: 2963009 - DNA, 12 bp, Homo sapiens
tccctggtcctt

SEQ ID NO: 2963010 - DNA, 22 bp, Homo sapiens
tccctggtccttcactggcgcc

SEQ ID NO: 2963011 - DNA, 23 bp, Homo sapiens
tccctggtccttcactggcgcct

SEQ ID NO: 2963012 - DNA, 19 bp, Homo sapiens
tccctgtaacctcttcaga

SEQ ID NO: 2963013 - DNA, 15 bp, Homo sapiens
tccctgtcccagttg

SEQ ID NO: 2963014 - DNA, 12 bp, Homo sapiens
tccctgtcctcc

SEQ ID NO: 2963015 - DNA, 14 bp, Homo sapiens
tccctgtcctcctc

SEQ ID NO: 2963016 - DNA, 23 bp, Homo sapiens
tccctgtctttactcctcacact

SEQ ID NO: 2963017 - DNA, 14 bp, Homo sapiens
tccctgtctttcct

SEQ ID NO: 2963018 - DNA, 23 bp, Homo sapiens
tccctgtctttcctaagacctgg

SEQ ID NO: 2963019 - DNA, 16 bp, Homo sapiens
tccctgttattttcaa

SEQ ID NO: 2963020 - DNA, 21 bp, Homo sapiens
tcccttccacctcacaactcc

SEQ ID NO: 2963021 - DNA, 22 bp, Homo sapiens
tcccttccacctcacaactcct

SEQ ID NO: 2963022 - DNA, 13 bp, Homo sapiens
tcccttcccagtg

SEQ ID NO: 2963023 - DNA, 19 bp, Homo sapiens
tcccttcccagtgggctgt

SEQ ID NO: 2963024 - DNA, 10 bp, Homo sapiens
tcccttccct

SEQ ID NO: 2963025 - DNA, 15 bp, Homo sapiens
tcccttccctcaccc

SEQ ID NO: 2963026 - DNA, 16 bp, Homo sapiens
tcccttccttcctctc

SEQ ID NO: 2963027 - DNA, 19 bp, Homo sapiens
tcccttccttcctctcctg

SEQ ID NO: 2963028 - DNA, 16 bp, Homo sapiens
tcccttccttgggcag

SEQ ID NO: 2963029 - DNA, 16 bp, Homo sapiens
tcccttctgtccctca

SEQ ID NO: 2963030 - DNA, 13 bp, Homo sapiens
tcccttgaccatt

SEQ ID NO: 2963031 - DNA, 19 bp, Homo sapiens
tcccttgaccattggctgc

SEQ ID NO: 2963032 - DNA, 13 bp, Homo sapiens
tcccttgagacct

SEQ ID NO: 2963033 - DNA, 17 bp, Homo sapiens
tcccttgagacctcagc

SEQ ID NO: 2963034 - DNA, 23 bp, Homo sapiens
tcccttgaggaaacaacagcttt

SEQ ID NO: 2963035 - DNA, 21 bp, Homo sapiens
tcccttgagtaggccctgctt

SEQ ID NO: 2963036 - DNA, 20 bp, Homo sapiens
tcccttgcttgcctgcaggg

SEQ ID NO: 2963037 - DNA, 21 bp, Homo sapiens
tcccttgcttgcctgcagggc

SEQ ID NO: 2963038 - DNA, 14 bp, Homo sapiens
tcccttgggctccc

SEQ ID NO: 2963039 - DNA, 21 bp, Homo sapiens
tcccttgtgttccttctgtga

SEQ ID NO: 2963040 - DNA, 18 bp, Homo sapiens
tcccttttaaacacattt

SEQ ID NO: 2963041 - DNA, 17 bp, Homo sapiens
tcccttttacatactgc

SEQ ID NO: 2963042 - DNA, 17 bp, Homo sapiens
tcccttttctttaagtt

SEQ ID NO: 2963043 - DNA, 22 bp, Homo sapiens
tccctttttgcaggggactggg

SEQ ID NO: 2963044 - DNA, 23 bp, Homo sapiens
tccctttttgcaggggactgggc

SEQ ID NO: 2963045 - DNA, 20 bp, Homo sapiens
tccgaaagaagacacagaac

SEQ ID NO: 2963046 - DNA, 16 bp, Homo sapiens
tccgaacctcctctgt

SEQ ID NO: 2963047 - DNA, 17 bp, Homo sapiens
tccgaacctcctctgtg

SEQ ID NO: 2963048 - DNA, 19 bp, Homo sapiens
tccgacctctctcagcccc

SEQ ID NO: 2963049 - DNA, 14 bp, Homo sapiens
tccgacctctctcg

SEQ ID NO: 2963050 - DNA, 20 bp, Homo sapiens
tccgacctctctcggccccc

SEQ ID NO: 2963051 - DNA, 19 bp, Homo sapiens
tccgagctgaggactctgc

SEQ ID NO: 2963052 - DNA, 15 bp, Homo sapiens
tccgaggactggact

SEQ ID NO: 2963053 - DNA, 14 bp, Homo sapiens
tccgcacctgaccg

SEQ ID NO: 2963054 - DNA, 23 bp, Homo sapiens
tccgcacctgaccgctgcccagg

SEQ ID NO: 2963055 - DNA, 14 bp, Homo sapiens
tccgcacttggaaa

SEQ ID NO: 2963056 - DNA, 23 bp, Homo sapiens
tccgcagactgcttggccagatg

SEQ ID NO: 2963057 - DNA, 15 bp, Homo sapiens
tccgcaggtgctggt

SEQ ID NO: 2963058 - DNA, 18 bp, Homo sapiens
tccgcaggtgctggtccc

SEQ ID NO: 2963059 - DNA, 16 bp, Homo sapiens
tccgcataagaaaaag

SEQ ID NO: 2963060 - DNA, 20 bp, Homo sapiens
tccgcatccctgcttctggc

SEQ ID NO: 2963061 - DNA, 18 bp, Homo sapiens
tccccagactctgcctag

SEQ ID NO: 2963062 - DNA, 19 bp, Homo sapiens
tccccagactctgcctaga

SEQ ID NO: 2963063 - DNA, 14 bp, Homo sapiens
tccccagacttgca

SEQ ID NO: 2963064 - DNA, 15 bp, Homo sapiens
tccccagacttgcac

SEQ ID NO: 2963065 - DNA, 19 bp, Homo sapiens
tccccagacttgcactggg

SEQ ID NO: 2963066 - DNA, 10 bp, Homo sapiens
tccccagaga

SEQ ID NO: 2963067 - DNA, 23 bp, Homo sapiens
tccccagagaaaggggagcccac

SEQ ID NO: 2963068 - DNA, 12 bp, Homo sapiens
tccccagagccc

SEQ ID NO: 2963069 - DNA, 18 bp, Homo sapiens
tccccagagcccagctct

SEQ ID NO: 2963070 - DNA, 19 bp, Homo sapiens
tccccagagcccagctctt

SEQ ID NO: 2963071 - DNA, 19 bp, Homo sapiens
tccccagatatttatgtat

SEQ ID NO: 2963072 - DNA, 15 bp, Homo sapiens
tccccagcaactctg

SEQ ID NO: 2963073 - DNA, 21 bp, Homo sapiens
tccccagcagggtcttttcat

SEQ ID NO: 2963074 - DNA, 12 bp, Homo sapiens
tccccagccaca

SEQ ID NO: 2963075 - DNA, 14 bp, Homo sapiens
tccccagccacagg

SEQ ID NO: 2963076 - DNA, 13 bp, Homo sapiens
tccccagcccaga

SEQ ID NO: 2963077 - DNA, 23 bp, Homo sapiens
tccccagcctttgatcaggtggg

SEQ ID NO: 2963078 - DNA, 24 bp, Homo sapiens
tccccaggaagcccactgcctcct

SEQ ID NO: 2963079 - DNA, 19 bp, Homo sapiens
tccccaggccccaggaagc

SEQ ID NO: 2963080 - DNA, 21 bp, Homo sapiens
tccccaggccccaggaagccg

SEQ ID NO: 2963081 - DNA, 22 bp, Homo sapiens
tccccagggaagaccctgaccg

SEQ ID NO: 2963082 - DNA, 14 bp, Homo sapiens
tccccaggggagag

SEQ ID NO: 2963083 - DNA, 20 bp, Homo sapiens
tccccagtagctgggattac

SEQ ID NO: 2963084 - DNA, 21 bp, Homo sapiens
tccccagtagctgggattaca

SEQ ID NO: 2963085 - DNA, 23 bp, Homo sapiens
tccccagttcgcctggagccctc

SEQ ID NO: 2963086 - DNA, 17 bp, Homo sapiens
tccccagtttgcagaaa

SEQ ID NO: 2963087 - DNA, 18 bp, Homo sapiens
tccccatatttgtgttca

SEQ ID NO: 2963088 - DNA, 21 bp, Homo sapiens
tccccatatttgtgttcagtt

SEQ ID NO: 2963089 - DNA, 21 bp, Homo sapiens
tccccatcatccacgccaagt

SEQ ID NO: 2963090 - DNA, 19 bp, Homo sapiens
tccccatcggccctgtccc

SEQ ID NO: 2963091 - DNA, 15 bp, Homo sapiens
tccccatctgtgttc

SEQ ID NO: 2963092 - DNA, 18 bp, Homo sapiens
tccccatctgtgttctaa

SEQ ID NO: 2963093 - DNA, 19 bp, Homo sapiens
tccccatcttctaaaccca

SEQ ID NO: 2963094 - DNA, 19 bp, Homo sapiens
tccccatgcctgtggctgc

SEQ ID NO: 2963095 - DNA, 13 bp, Homo sapiens
tccccatggagcc

SEQ ID NO: 2963096 - DNA, 15 bp, Homo sapiens
tccccatggagccag

SEQ ID NO: 2963097 - DNA, 22 bp, Homo sapiens
tcccccaacatataaaataatg

SEQ ID NO: 2963098 - DNA, 15 bp, Homo sapiens
tcccccaaccaagga

SEQ ID NO: 2963099 - DNA, 23 bp, Homo sapiens
tcccccaaccaaggaaggagccc

SEQ ID NO: 2963100 - DNA, 20 bp, Homo sapiens
tcccccaccccctccccagg

SEQ ID NO: 2963101 - DNA, 17 bp, Homo sapiens
tcccccacgtctctctg

SEQ ID NO: 2963102 - DNA, 18 bp, Homo sapiens
tcccccacgtctctctgc

SEQ ID NO: 2963103 - DNA, 19 bp, Homo sapiens
tcccccacgtctctctgcc

SEQ ID NO: 2963104 - DNA, 23 bp, Homo sapiens
tcccccacgtctctctgcctgct

SEQ ID NO: 2963105 - DNA, 12 bp, Homo sapiens
tcccccagcaga

SEQ ID NO: 2963106 - DNA, 18 bp, Homo sapiens
tcccccatagcaccctgc

SEQ ID NO: 2963107 - DNA, 15 bp, Homo sapiens
tccccccccaggccc

SEQ ID NO: 2963108 - DNA, 23 bp, Homo sapiens
tccccccccaggccctcccacca

SEQ ID NO: 2963109 - DNA, 18 bp, Homo sapiens
tcccccctcctctgaaac

SEQ ID NO: 2963110 - DNA, 23 bp, Homo sapiens
tcccccgaagaaggaccagtgaa

SEQ ID NO: 2963111 - DNA, 17 bp, Homo sapiens
tcccccgaatgcatttg

SEQ ID NO: 2963112 - DNA, 14 bp, Homo sapiens
tcccccgactgcct

SEQ ID NO: 2963113 - DNA, 15 bp, Homo sapiens
tcccccgactgcctg

SEQ ID NO: 2963114 - DNA, 12 bp, Homo sapiens
tccccctcctga

SEQ ID NO: 2963115 - DNA, 18 bp, Homo sapiens
tccccctgccagtgcctt

SEQ ID NO: 2963116 - DNA, 14 bp, Homo sapiens
tcccccttcacaaa

SEQ ID NO: 2963117 - DNA, 19 bp, Homo sapiens
tcccccttccgccttctcc

SEQ ID NO: 2963118 - DNA, 18 bp, Homo sapiens
tccccgacgcccacccaa

SEQ ID NO: 2963119 - DNA, 20 bp, Homo sapiens
tccccgaggctgccccaggc

SEQ ID NO: 2963120 - DNA, 15 bp, Homo sapiens
tccccgagggctcag

SEQ ID NO: 2963121 - DNA, 21 bp, Homo sapiens
tccccgaggttgtggggaggc

SEQ ID NO: 2963122 - DNA, 22 bp, Homo sapiens
tccccgaggttgtggggaggct

SEQ ID NO: 2963123 - DNA, 16 bp, Homo sapiens
tccccgatgctgacct

SEQ ID NO: 2963124 - DNA, 18 bp, Homo sapiens
tccccgcagccctggcag

SEQ ID NO: 2963125 - DNA, 12 bp, Homo sapiens
tccccgccttcc

SEQ ID NO: 2963126 - DNA, 14 bp, Homo sapiens
tccccgctctgccg

SEQ ID NO: 2963127 - DNA, 16 bp, Homo sapiens
tccccgctgctgtgca

SEQ ID NO: 2963128 - DNA, 16 bp, Homo sapiens
tccccgggcatctttg

SEQ ID NO: 2963129 - DNA, 16 bp, Homo sapiens
tccccggggcccaggg

SEQ ID NO: 2963130 - DNA, 21 bp, Homo sapiens
tcccctatccacccagcccat

SEQ ID NO: 2963131 - DNA, 11 bp, Homo sapiens
tcccctatgat

SEQ ID NO: 2963132 - DNA, 14 bp, Homo sapiens
tcccctcacagact

SEQ ID NO: 2963133 - DNA, 21 bp, Homo sapiens
tcccctcacagactcttccac

SEQ ID NO: 2963134 - DNA, 23 bp, Homo sapiens
tcccctcacagactcttccacca

SEQ ID NO: 2963135 - DNA, 13 bp, Homo sapiens
tcccctcagagcc

SEQ ID NO: 2963136 - DNA, 17 bp, Homo sapiens
tcccctcagagcccatg

SEQ ID NO: 2963137 - DNA, 13 bp, Homo sapiens
tcccctcattcag

SEQ ID NO: 2963138 - DNA, 16 bp, Homo sapiens
tcccctccatccccat

SEQ ID NO: 2963139 - DNA, 22 bp, Homo sapiens
tcccctccatccccatcggccc

SEQ ID NO: 2963140 - DNA, 15 bp, Homo sapiens
tcccctccccatctg

SEQ ID NO: 2963141 - DNA, 18 bp, Homo sapiens
tcccctccccatctgtgt

SEQ ID NO: 2963142 - DNA, 11 bp, Homo sapiens
tcccctccccc

SEQ ID NO: 2963143 - DNA, 19 bp, Homo sapiens
tcccctcccccacccctgc

SEQ ID NO: 2963144 - DNA, 17 bp, Homo sapiens
tcccctcccccactcct

SEQ ID NO: 2963145 - DNA, 18 bp, Homo sapiens
tcccctcccccactcctc

SEQ ID NO: 2963146 - DNA, 15 bp, Homo sapiens
tcccctccctctgtc

SEQ ID NO: 2963147 - DNA, 20 bp, Homo sapiens
tcccctccgccaggcgagat

SEQ ID NO: 2963148 - DNA, 14 bp, Homo sapiens
tcccctcctcactc

SEQ ID NO: 2963149 - DNA, 17 bp, Homo sapiens
tcccctcgcccatcagt

SEQ ID NO: 2963150 - DNA, 16 bp, Homo sapiens
tcccctctccttcctg

SEQ ID NO: 2963151 - DNA, 14 bp, Homo sapiens
tcccctctctgcac

SEQ ID NO: 2963152 - DNA, 15 bp, Homo sapiens
tcccctctgaaagtt

SEQ ID NO: 2963153 - DNA, 22 bp, Homo sapiens
tcccctctgaaagttgtacatg

SEQ ID NO: 2963154 - DNA, 12 bp, Homo sapiens
tcccctgccacc

SEQ ID NO: 2963155 - DNA, 15 bp, Homo sapiens
tcccctgccaccgac

SEQ ID NO: 2963156 - DNA, 21 bp, Homo sapiens
tcccctgccaccgactgccca

SEQ ID NO: 2963157 - DNA, 12 bp, Homo sapiens
tcccctgccagg

SEQ ID NO: 2963158 - DNA, 16 bp, Homo sapiens
tcccctgccgcctccc

SEQ ID NO: 2963159 - DNA, 17 bp, Homo sapiens
tcccctgccgcctcccg

SEQ ID NO: 2963160 - DNA, 20 bp, Homo sapiens
tcccctgccgcctcccggga

SEQ ID NO: 2963161 - DNA, 11 bp, Homo sapiens
tcccctgcttc

SEQ ID NO: 2963162 - DNA, 22 bp, Homo sapiens
tcccctggagtgtgtcagagcc

SEQ ID NO: 2963163 - DNA, 15 bp, Homo sapiens
tcccctggggaccca

SEQ ID NO: 2963164 - DNA, 15 bp, Homo sapiens
tcccctggggctggt

SEQ ID NO: 2963165 - DNA, 12 bp, Homo sapiens
tcccctgtcccc

SEQ ID NO: 2963166 - DNA, 18 bp, Homo sapiens
tcccctgtcccctggggc

SEQ ID NO: 2963167 - DNA, 14 bp, Homo sapiens
tccccttcttgtgt

SEQ ID NO: 2963168 - DNA, 17 bp, Homo sapiens
tccccttgcccttcctg

SEQ ID NO: 2963169 - DNA, 18 bp, Homo sapiens
tccccttgcccttcctga

SEQ ID NO: 2963170 - DNA, 21 bp, Homo sapiens
tccccttgcccttcctgaccc

SEQ ID NO: 2963171 - DNA, 15 bp, Homo sapiens
tccccttgtccctgg

SEQ ID NO: 2963172 - DNA, 18 bp, Homo sapiens
tccccttgtccctggggc

SEQ ID NO: 2963173 - DNA, 14 bp, Homo sapiens
tcccgaggaggggc

SEQ ID NO: 2963174 - DNA, 18 bp, Homo sapiens
tcccgaggcttgctgccc

SEQ ID NO: 2963175 - DNA, 14 bp, Homo sapiens
tcccgccccgggct

SEQ ID NO: 2963176 - DNA, 18 bp, Homo sapiens
tcccgccccgggctggcc

SEQ ID NO: 2963177 - DNA, 15 bp, Homo sapiens
tcccgcctcagcctc

SEQ ID NO: 2963178 - DNA, 15 bp, Homo sapiens
tcccgcctccctagt

SEQ ID NO: 2963179 - DNA, 19 bp, Homo sapiens
tcccgcgtagtgtcagtac

SEQ ID NO: 2963180 - DNA, 17 bp, Homo sapiens
tcccgcttagcgctctg

SEQ ID NO: 2963181 - DNA, 21 bp, Homo sapiens
tcccgggactcactggcagcc

SEQ ID NO: 2963182 - DNA, 14 bp, Homo sapiens
tcccgggatgggtg

SEQ ID NO: 2963183 - DNA, 16 bp, Homo sapiens
tcccggggccagcact

SEQ ID NO: 2963184 - DNA, 21 bp, Homo sapiens
tcccggggccagcacttccat

SEQ ID NO: 2963185 - DNA, 20 bp, Homo sapiens
tcccgtgaaagtttttaatt

SEQ ID NO: 2963186 - DNA, 19 bp, Homo sapiens
tcccgtggatgctctttca

SEQ ID NO: 2963187 - DNA, 20 bp, Homo sapiens
tcccgtggatgctctttcaa

SEQ ID NO: 2963188 - DNA, 16 bp, Homo sapiens
tcccgttttccccatg

SEQ ID NO: 2963189 - DNA, 23 bp, Homo sapiens
tccctaaaatggcgaacatgtgt

SEQ ID NO: 2963190 - DNA, 15 bp, Homo sapiens
tccctaacacttacc

SEQ ID NO: 2963191 - DNA, 16 bp, Homo sapiens
tccctaacacttaccc

SEQ ID NO: 2963192 - DNA, 17 bp, Homo sapiens
tccctacactgatgcaa

SEQ ID NO: 2963193 - DNA, 18 bp, Homo sapiens
tccctacaggaggaacag

SEQ ID NO: 2963194 - DNA, 21 bp, Homo sapiens
tccctacaggaggaacagtgg

SEQ ID NO: 2963195 - DNA, 13 bp, Homo sapiens
tccctaccacctc

SEQ ID NO: 2963196 - DNA, 23 bp, Homo sapiens
tccctacctaagaatttcactgt

SEQ ID NO: 2963197 - DNA, 18 bp, Homo sapiens
tccctaccttgcctcctt

SEQ ID NO: 2963198 - DNA, 20 bp, Homo sapiens
tccattttcactaaaagtgt

SEQ ID NO: 2963199 - DNA, 15 bp, Homo sapiens
tccattttcttgtca

SEQ ID NO: 2963200 - DNA, 16 bp, Homo sapiens
tccattttgtgaagcc

SEQ ID NO: 2963201 - DNA, 17 bp, Homo sapiens
tccattttgtgaagccc

SEQ ID NO: 2963202 - DNA, 13 bp, Homo sapiens
tccatttttgttg

SEQ ID NO: 2963203 - DNA, 12 bp, Homo sapiens
tcccaaaacaat

SEQ ID NO: 2963204 - DNA, 23 bp, Homo sapiens
tcccaaaacattttaaatgaaag

SEQ ID NO: 2963205 - DNA, 13 bp, Homo sapiens
tcccaaagtgctg

SEQ ID NO: 2963206 - DNA, 18 bp, Homo sapiens
tcccaaagtgctgagatt

SEQ ID NO: 2963207 - DNA, 19 bp, Homo sapiens
tcccaaagtgctgagatta

SEQ ID NO: 2963208 - DNA, 23 bp, Homo sapiens
tcccaaagtgctgagattacagg

SEQ ID NO: 2963209 - DNA, 18 bp, Homo sapiens
tcccaaatccgccagtgt

SEQ ID NO: 2963210 - DNA, 14 bp, Homo sapiens
tcccaaatgagcca

SEQ ID NO: 2963211 - DNA, 19 bp, Homo sapiens
tcccaaatttgattgattt

SEQ ID NO: 2963212 - DNA, 14 bp, Homo sapiens
tcccaacactgcca

SEQ ID NO: 2963213 - DNA, 15 bp, Homo sapiens
tcccaacactgccag

SEQ ID NO: 2963214 - DNA, 16 bp, Homo sapiens
tcccaacactgccagc

SEQ ID NO: 2963215 - DNA, 13 bp, Homo sapiens
tcccaacccccag

SEQ ID NO: 2963216 - DNA, 14 bp, Homo sapiens
tcccaacccccagc

SEQ ID NO: 2963217 - DNA, 19 bp, Homo sapiens
tcccaacccccagccccca

SEQ ID NO: 2963218 - DNA, 14 bp, Homo sapiens
tcccaacgctgaag

SEQ ID NO: 2963219 - DNA, 21 bp, Homo sapiens
tcccaacgctgaagcggtcag

SEQ ID NO: 2963220 - DNA, 21 bp, Homo sapiens
tcccaacgtgctgggattaca

SEQ ID NO: 2963221 - DNA, 10 bp, Homo sapiens
tcccaactcc

SEQ ID NO: 2963222 - DNA, 13 bp, Homo sapiens
tcccaactccctt

SEQ ID NO: 2963223 - DNA, 18 bp, Homo sapiens
tcccaactcccttctgct

SEQ ID NO: 2963224 - DNA, 14 bp, Homo sapiens
tcccaactctagct

SEQ ID NO: 2963225 - DNA, 16 bp, Homo sapiens
tcccaagctcagaggc

SEQ ID NO: 2963226 - DNA, 18 bp, Homo sapiens
tcccaagctcccaagagc

SEQ ID NO: 2963227 - DNA, 21 bp, Homo sapiens
tcccaagctcccaagagcttc

SEQ ID NO: 2963228 - DNA, 16 bp, Homo sapiens
tcccaagctggctggg

SEQ ID NO: 2963229 - DNA, 17 bp, Homo sapiens
tcccaagctggctgggg

SEQ ID NO: 2963230 - DNA, 13 bp, Homo sapiens
tcccaaggacttc

SEQ ID NO: 2963231 - DNA, 21 bp, Homo sapiens
tcccaaggacttccacatttt

SEQ ID NO: 2963232 - DNA, 24 bp, Homo sapiens
tcccaaggtgaaatgaagcaacag

SEQ ID NO: 2963233 - DNA, 18 bp, Homo sapiens
tcccaatctcaatacagc

SEQ ID NO: 2963234 - DNA, 14 bp, Homo sapiens
tcccaatggtgttt

SEQ ID NO: 2963235 - DNA, 16 bp, Homo sapiens
tcccaatggtgttttt

SEQ ID NO: 2963236 - DNA, 21 bp, Homo sapiens
tcccacaagtatatactttta

SEQ ID NO: 2963237 - DNA, 16 bp, Homo sapiens
tcccacaagtggtggt

SEQ ID NO: 2963238 - DNA, 14 bp, Homo sapiens
tcccacacctgcct

SEQ ID NO: 2963239 - DNA, 16 bp, Homo sapiens
tcccacacctgcctgc

SEQ ID NO: 2963240 - DNA, 14 bp, Homo sapiens
tcccacactcgcca

SEQ ID NO: 2963241 - DNA, 18 bp, Homo sapiens
tcccacactcgccatctc

SEQ ID NO: 2963242 - DNA, 20 bp, Homo sapiens
tcccacacttgtgccagccc

SEQ ID NO: 2963243 - DNA, 13 bp, Homo sapiens
tcccacatctttc

SEQ ID NO: 2963244 - DNA, 14 bp, Homo sapiens
tcccaccaccccat

SEQ ID NO: 2963245 - DNA, 15 bp, Homo sapiens
tcccacccacatgtg

SEQ ID NO: 2963246 - DNA, 16 bp, Homo sapiens
tcccacccacatgtga

SEQ ID NO: 2963247 - DNA, 13 bp, Homo sapiens
tcccaccccaccc

SEQ ID NO: 2963248 - DNA, 19 bp, Homo sapiens
tcccacctagtgccccaga

SEQ ID NO: 2963249 - DNA, 21 bp, Homo sapiens
tcccacctagtgccccagact

SEQ ID NO: 2963250 - DNA, 22 bp, Homo sapiens
tcccacggggaccactgggccc

SEQ ID NO: 2963251 - DNA, 11 bp, Homo sapiens
tcccactccta

SEQ ID NO: 2963252 - DNA, 18 bp, Homo sapiens
tcccactgtatgatttat

SEQ ID NO: 2963253 - DNA, 19 bp, Homo sapiens
tcccacttctcatcttaaa

SEQ ID NO: 2963254 - DNA, 23 bp, Homo sapiens
tcccactttgctgttccttactt

SEQ ID NO: 2963255 - DNA, 14 bp, Homo sapiens
tcccactttttggt

SEQ ID NO: 2963256 - DNA, 20 bp, Homo sapiens
tcccagacaaggagagcgga

SEQ ID NO: 2963257 - DNA, 16 bp, Homo sapiens
tcccagacttgtttcc

SEQ ID NO: 2963258 - DNA, 17 bp, Homo sapiens
tcccagacttgtttcct

SEQ ID NO: 2963259 - DNA, 20 bp, Homo sapiens
tcccagacttgtttcctgtg

SEQ ID NO: 2963260 - DNA, 17 bp, Homo sapiens
tcccagagacaggaaaa

SEQ ID NO: 2963261 - DNA, 18 bp, Homo sapiens
tcccagagctgcacaggg

SEQ ID NO: 2963262 - DNA, 17 bp, Homo sapiens
tcccagaggctgcccca

SEQ ID NO: 2963263 - DNA, 21 bp, Homo sapiens
tcccagagtgctgggattaca

SEQ ID NO: 2963264 - DNA, 21 bp, Homo sapiens
tcccagatcgctcccttggct

SEQ ID NO: 2963265 - DNA, 22 bp, Homo sapiens
tcccagcaatcgcatcccggct

SEQ ID NO: 2963266 - DNA, 23 bp, Homo sapiens
tcccagcactttgagaggctgag

SEQ ID NO: 2963267 - DNA, 22 bp, Homo sapiens
tcccagcactttgggaggcagg

SEQ ID NO: 2963268 - DNA, 10 bp, Homo sapiens
tcccagcctt

SEQ ID NO: 2963269 - DNA, 14 bp, Homo sapiens
tcccagccttgaga

SEQ ID NO: 2963270 - DNA, 16 bp, Homo sapiens
tcccagcggcctcagg

SEQ ID NO: 2963271 - DNA, 17 bp, Homo sapiens
tcccagcggcctcaggg

SEQ ID NO: 2963272 - DNA, 18 bp, Homo sapiens
tcccagcggcctcagggt

SEQ ID NO: 2963273 - DNA, 19 bp, Homo sapiens
tcccagcggcctcagggtc

SEQ ID NO: 2963274 - DNA, 16 bp, Homo sapiens
tcccagctacctcaac

SEQ ID NO: 2963275 - DNA, 17 bp, Homo sapiens
tcccagctactcaggag

SEQ ID NO: 2963276 - DNA, 23 bp, Homo sapiens
tcccagctactggggaggctgag

SEQ ID NO: 2963277 - DNA, 22 bp, Homo sapiens
tcccagctacttgggagcctga

SEQ ID NO: 2963278 - DNA, 16 bp, Homo sapiens
tcccagctaggaagag

SEQ ID NO: 2963279 - DNA, 20 bp, Homo sapiens
tcccagctaggaagagcagg

SEQ ID NO: 2963280 - DNA, 23 bp, Homo sapiens
tcccagctaggaagagcaggact

SEQ ID NO: 2963281 - DNA, 16 bp, Homo sapiens
tcccagctctccctct

SEQ ID NO: 2963282 - DNA, 18 bp, Homo sapiens
tcccagctctccctctgg

SEQ ID NO: 2963283 - DNA, 19 bp, Homo sapiens
tcccagctctccctctggc

SEQ ID NO: 2963284 - DNA, 22 bp, Homo sapiens
tcccagctttaaaaagaaaaaa

SEQ ID NO: 2963285 - DNA, 12 bp, Homo sapiens
tcccaggaccct

SEQ ID NO: 2963286 - DNA, 16 bp, Homo sapiens
tcccaggaccctgaag

SEQ ID NO: 2963287 - DNA, 22 bp, Homo sapiens
tcccaggacctcggatgaccat

SEQ ID NO: 2963288 - DNA, 13 bp, Homo sapiens
tcccaggccaggg

SEQ ID NO: 2963289 - DNA, 15 bp, Homo sapiens
tcccaggccagggct

SEQ ID NO: 2963290 - DNA, 21 bp, Homo sapiens
tcccaggctctcaacagggga

SEQ ID NO: 2963291 - DNA, 15 bp, Homo sapiens
tcccaggtgttaaca

SEQ ID NO: 2963292 - DNA, 23 bp, Homo sapiens
tcccaggtgttaacattccaaga

SEQ ID NO: 2963293 - DNA, 15 bp, Homo sapiens
tcccaggttccagca

SEQ ID NO: 2963294 - DNA, 20 bp, Homo sapiens
tcccagtagccaaggcccgg

SEQ ID NO: 2963295 - DNA, 20 bp, Homo sapiens
tcccagtagtgtttggaatt

SEQ ID NO: 2963296 - DNA, 21 bp, Homo sapiens
tcccagtttctgctgttgact

SEQ ID NO: 2963297 - DNA, 14 bp, Homo sapiens
tcccatcactggag

SEQ ID NO: 2963298 - DNA, 16 bp, Homo sapiens
tcccatcctccagccc

SEQ ID NO: 2963299 - DNA, 17 bp, Homo sapiens
tcccatctgtggttttc

SEQ ID NO: 2963300 - DNA, 23 bp, Homo sapiens
tcccatgagctccttaaggctct

SEQ ID NO: 2963301 - DNA, 18 bp, Homo sapiens
tcccatgtaacagaaagg

SEQ ID NO: 2963302 - DNA, 19 bp, Homo sapiens
tcccatgtaacagaaaggg

SEQ ID NO: 2963303 - DNA, 13 bp, Homo sapiens
tcccatgtatgga

SEQ ID NO: 2963304 - DNA, 13 bp, Homo sapiens
tcccattgtccct

SEQ ID NO: 2963305 - DNA, 20 bp, Homo sapiens
tcccatttcctgtcattttt

SEQ ID NO: 2963306 - DNA, 23 bp, Homo sapiens
tcccatttctacctaagtcagct

SEQ ID NO: 2963307 - DNA, 14 bp, Homo sapiens
tcccatttgtaatt

SEQ ID NO: 2963308 - DNA, 18 bp, Homo sapiens
tcccatttgttgctgctg

SEQ ID NO: 2963309 - DNA, 20 bp, Homo sapiens
tcccatttgttgctgctgct

SEQ ID NO: 2963310 - DNA, 15 bp, Homo sapiens
tccccaaagccactg

SEQ ID NO: 2963311 - DNA, 20 bp, Homo sapiens
tccccaacagtgtgaagtta

SEQ ID NO: 2963312 - DNA, 20 bp, Homo sapiens
tccccaacatggatgtgttg

SEQ ID NO: 2963313 - DNA, 16 bp, Homo sapiens
tccccaatgagacttg

SEQ ID NO: 2963314 - DNA, 11 bp, Homo sapiens
tccccacagac

SEQ ID NO: 2963315 - DNA, 13 bp, Homo sapiens
tccccacagactg

SEQ ID NO: 2963316 - DNA, 22 bp, Homo sapiens
tccccacaggcacattaactgt

SEQ ID NO: 2963317 - DNA, 23 bp, Homo sapiens
tccccacaggcacattaactgtt

SEQ ID NO: 2963318 - DNA, 16 bp, Homo sapiens
tccccaccagagctgc

SEQ ID NO: 2963319 - DNA, 17 bp, Homo sapiens
tccccaccagagctgcc

SEQ ID NO: 2963320 - DNA, 18 bp, Homo sapiens
tccccaccagagctgcct

SEQ ID NO: 2963321 - DNA, 14 bp, Homo sapiens
tccccacccaagag

SEQ ID NO: 2963322 - DNA, 22 bp, Homo sapiens
tccccaccctcctggcctcaga

SEQ ID NO: 2963323 - DNA, 20 bp, Homo sapiens
tccccacgacccctgcctcg

SEQ ID NO: 2963324 - DNA, 22 bp, Homo sapiens
tccccacgacccctgcctcgag

SEQ ID NO: 2963325 - DNA, 17 bp, Homo sapiens
tccccacgagggctggc

SEQ ID NO: 2963326 - DNA, 20 bp, Homo sapiens
tccccacgagggctggctgg

SEQ ID NO: 2963327 - DNA, 19 bp, Homo sapiens
tccccacgaggggacccat

SEQ ID NO: 2963328 - DNA, 20 bp, Homo sapiens
tccccacgaggggacccatg

SEQ ID NO: 2963329 - DNA, 22 bp, Homo sapiens
tccccacgaggggacccatggg

SEQ ID NO: 2963330 - DNA, 19 bp, Homo sapiens
tccccactgtatctaggca

SEQ ID NO: 2963331 - DNA, 18 bp, Homo sapiens
tccccacttctgtgccac

SEQ ID NO: 2963332 - DNA, 12 bp, Homo sapiens
tccccagaacaa

SEQ ID NO: 2963333 - DNA, 15 bp, Homo sapiens
tccccagactctgcc

SEQ ID NO: 2963334 - DNA, 19 bp, Homo sapiens
tccagcccccagtgcgctc

SEQ ID NO: 2963335 - DNA, 13 bp, Homo sapiens
tccagccctgccc

SEQ ID NO: 2963336 - DNA, 19 bp, Homo sapiens
tccagcctcacagatgctg

SEQ ID NO: 2963337 - DNA, 21 bp, Homo sapiens
tccagcctcacagatgctggc

SEQ ID NO: 2963338 - DNA, 22 bp, Homo sapiens
tccagcctcacagatgctggcc

SEQ ID NO: 2963339 - DNA, 23 bp, Homo sapiens
tccagcctcacagatgctggcct

SEQ ID NO: 2963340 - DNA, 22 bp, Homo sapiens
tccagcctgagtgacagagcga

SEQ ID NO: 2963341 - DNA, 24 bp, Homo sapiens
tccagcctgagtgacagagcgaga

SEQ ID NO: 2963342 - DNA, 23 bp, Homo sapiens
tccagcctgggtcacagagtgag

SEQ ID NO: 2963343 - DNA, 21 bp, Homo sapiens
tccagcgatggtgctgcccag

SEQ ID NO: 2963344 - DNA, 19 bp, Homo sapiens
tccagctacttagctggcc

SEQ ID NO: 2963345 - DNA, 20 bp, Homo sapiens
tccagctcattcattttata

SEQ ID NO: 2963346 - DNA, 12 bp, Homo sapiens
tccagctccaac

SEQ ID NO: 2963347 - DNA, 18 bp, Homo sapiens
tccagctcccgctgtggc

SEQ ID NO: 2963348 - DNA, 12 bp, Homo sapiens
tccagctgcccc

SEQ ID NO: 2963349 - DNA, 12 bp, Homo sapiens
tccagctggtgc

SEQ ID NO: 2963350 - DNA, 13 bp, Homo sapiens
tccagctggtgcc

SEQ ID NO: 2963351 - DNA, 18 bp, Homo sapiens
tccagctggtgcccccag

SEQ ID NO: 2963352 - DNA, 15 bp, Homo sapiens
tccagctgtcagcct

SEQ ID NO: 2963353 - DNA, 13 bp, Homo sapiens
tccagcttgccag

SEQ ID NO: 2963354 - DNA, 10 bp, Homo sapiens
tccaggaagt

SEQ ID NO: 2963355 - DNA, 23 bp, Homo sapiens
tccaggacacagattatcaactg

SEQ ID NO: 2963356 - DNA, 15 bp, Homo sapiens
tccaggactgggtct

SEQ ID NO: 2963357 - DNA, 23 bp, Homo sapiens
tccaggactgggtctgacctggt

SEQ ID NO: 2963358 - DNA, 16 bp, Homo sapiens
tccaggagaaggccaa

SEQ ID NO: 2963359 - DNA, 20 bp, Homo sapiens
tccaggagaaggccaattcc

SEQ ID NO: 2963360 - DNA, 22 bp, Homo sapiens
tccaggatggtgttactgcagt

SEQ ID NO: 2963361 - DNA, 17 bp, Homo sapiens
tccaggcagaaggagag

SEQ ID NO: 2963362 - DNA, 18 bp, Homo sapiens
tccaggcagatccaggac

SEQ ID NO: 2963363 - DNA, 18 bp, Homo sapiens
tccaggccagctcctttt

SEQ ID NO: 2963364 - DNA, 11 bp, Homo sapiens
tccaggccagg

SEQ ID NO: 2963365 - DNA, 13 bp, Homo sapiens
tccaggccagggc

SEQ ID NO: 2963366 - DNA, 15 bp, Homo sapiens
tccaggccaggtggg

SEQ ID NO: 2963367 - DNA, 20 bp, Homo sapiens
tccaggcccaaggctcccgg

SEQ ID NO: 2963368 - DNA, 15 bp, Homo sapiens
tccaggcccgtctgt

SEQ ID NO: 2963369 - DNA, 17 bp, Homo sapiens
tccaggcccgtctgtcc

SEQ ID NO: 2963370 - DNA, 22 bp, Homo sapiens
tccaggcccgtctgtccatctg

SEQ ID NO: 2963371 - DNA, 18 bp, Homo sapiens
tccaggccgcgccctttc

SEQ ID NO: 2963372 - DNA, 13 bp, Homo sapiens
tccaggctggcca

SEQ ID NO: 2963373 - DNA, 17 bp, Homo sapiens
tccaggctgggctgagc

SEQ ID NO: 2963374 - DNA, 16 bp, Homo sapiens
tccaggcttctcccgg

SEQ ID NO: 2963375 - DNA, 22 bp, Homo sapiens
tccaggcttctcccggacctgg

SEQ ID NO: 2963376 - DNA, 18 bp, Homo sapiens
tccaggctttcccacttc

SEQ ID NO: 2963377 - DNA, 14 bp, Homo sapiens
tccagggacagagg

SEQ ID NO: 2963378 - DNA, 23 bp, Homo sapiens
tccagggacagaggccccagcct

SEQ ID NO: 2963379 - DNA, 15 bp, Homo sapiens
tccagggagcctaga

SEQ ID NO: 2963380 - DNA, 21 bp, Homo sapiens
tccagggagcctagaagctgg

SEQ ID NO: 2963381 - DNA, 21 bp, Homo sapiens
tccagggccccaggcccgcgg

SEQ ID NO: 2963382 - DNA, 17 bp, Homo sapiens
tccagggcccccatctc

SEQ ID NO: 2963383 - DNA, 13 bp, Homo sapiens
tccagggctgcca

SEQ ID NO: 2963384 - DNA, 19 bp, Homo sapiens
tccagggtcccctgccacc

SEQ ID NO: 2963385 - DNA, 15 bp, Homo sapiens
tccaggtacgcacag

SEQ ID NO: 2963386 - DNA, 17 bp, Homo sapiens
tccaggtacgcacagac

SEQ ID NO: 2963387 - DNA, 15 bp, Homo sapiens
tccaggtcaacagaa

SEQ ID NO: 2963388 - DNA, 17 bp, Homo sapiens
tccaggtcaacagaatg

SEQ ID NO: 2963389 - DNA, 19 bp, Homo sapiens
tccaggtcaacagaatgaa

SEQ ID NO: 2963390 - DNA, 21 bp, Homo sapiens
tccaggtcaacagaatgaaaa

SEQ ID NO: 2963391 - DNA, 21 bp, Homo sapiens
tccaggtgagtgtgagggcag

SEQ ID NO: 2963392 - DNA, 22 bp, Homo sapiens
tccaggtgagtgtgagggcagc

SEQ ID NO: 2963393 - DNA, 15 bp, Homo sapiens
tccaggtgcagaggt

SEQ ID NO: 2963394 - DNA, 15 bp, Homo sapiens
tccagtaccttgctt

SEQ ID NO: 2963395 - DNA, 15 bp, Homo sapiens
tccagtatcctgctg

SEQ ID NO: 2963396 - DNA, 18 bp, Homo sapiens
tccagtcaaatctgggct

SEQ ID NO: 2963397 - DNA, 20 bp, Homo sapiens
tccagtcaaatctgggctca

SEQ ID NO: 2963398 - DNA, 13 bp, Homo sapiens
tccagtcctgctg

SEQ ID NO: 2963399 - DNA, 14 bp, Homo sapiens
tccagtcctgctgg

SEQ ID NO: 2963400 - DNA, 17 bp, Homo sapiens
tccagtcctgctggcct

SEQ ID NO: 2963401 - DNA, 20 bp, Homo sapiens
tccagtcctgctggcctgct

SEQ ID NO: 2963402 - DNA, 14 bp, Homo sapiens
tccagtctgttctc

SEQ ID NO: 2963403 - DNA, 22 bp, Homo sapiens
tccagtgcattttgtttctgta

SEQ ID NO: 2963404 - DNA, 18 bp, Homo sapiens
tccagtgccaacaatcct

SEQ ID NO: 2963405 - DNA, 13 bp, Homo sapiens
tccagttccagga

SEQ ID NO: 2963406 - DNA, 13 bp, Homo sapiens
tccagttcccact

SEQ ID NO: 2963407 - DNA, 23 bp, Homo sapiens
tccagttggagttttttgtacca

SEQ ID NO: 2963408 - DNA, 12 bp, Homo sapiens
tccagttttgtt

SEQ ID NO: 2963409 - DNA, 16 bp, Homo sapiens
tccataagtggagaaa

SEQ ID NO: 2963410 - DNA, 17 bp, Homo sapiens
tccataagtggagaaat

SEQ ID NO: 2963411 - DNA, 20 bp, Homo sapiens
tccataccccgccaaggaaa

SEQ ID NO: 2963412 - DNA, 23 bp, Homo sapiens
tccatagtggaccacttggaaat

SEQ ID NO: 2963413 - DNA, 16 bp, Homo sapiens
tccatagtttggcatt

SEQ ID NO: 2963414 - DNA, 20 bp, Homo sapiens
tccatagtttggcatttgca

SEQ ID NO: 2963415 - DNA, 19 bp, Homo sapiens
tccatagttttgatgactg

SEQ ID NO: 2963416 - DNA, 23 bp, Homo sapiens
tccatagttttgatgactggcat

SEQ ID NO: 2963417 - DNA, 20 bp, Homo sapiens
tccatatatccttttcttct

SEQ ID NO: 2963418 - DNA, 19 bp, Homo sapiens
tccatatttataggtaccc

SEQ ID NO: 2963419 - DNA, 23 bp, Homo sapiens
tccatcagcaatgcttctctcat

SEQ ID NO: 2963420 - DNA, 13 bp, Homo sapiens
tccatcatcatgt

SEQ ID NO: 2963421 - DNA, 15 bp, Homo sapiens
tccatccccatcggc

SEQ ID NO: 2963422 - DNA, 16 bp, Homo sapiens
tccatcctaccccctg

SEQ ID NO: 2963423 - DNA, 20 bp, Homo sapiens
tccatcctaccccctgtgcc

SEQ ID NO: 2963424 - DNA, 20 bp, Homo sapiens
tccatcctcctctccatgca

SEQ ID NO: 2963425 - DNA, 13 bp, Homo sapiens
tccatcctgacct

SEQ ID NO: 2963426 - DNA, 14 bp, Homo sapiens
tccatcctgtgtcc

SEQ ID NO: 2963427 - DNA, 15 bp, Homo sapiens
tccatccttgagatt

SEQ ID NO: 2963428 - DNA, 13 bp, Homo sapiens
tccatctccgcct

SEQ ID NO: 2963429 - DNA, 22 bp, Homo sapiens
tccatctccgcctccacactga

SEQ ID NO: 2963430 - DNA, 14 bp, Homo sapiens
tccatctctcatcc

SEQ ID NO: 2963431 - DNA, 18 bp, Homo sapiens
tccatctctcatcctcca

SEQ ID NO: 2963432 - DNA, 17 bp, Homo sapiens
tccatctctctccctta

SEQ ID NO: 2963433 - DNA, 19 bp, Homo sapiens
tccatctctttaaaaacaa

SEQ ID NO: 2963434 - DNA, 18 bp, Homo sapiens
tccatctgcccgcctgcc

SEQ ID NO: 2963435 - DNA, 15 bp, Homo sapiens
tccatctggcagggt

SEQ ID NO: 2963436 - DNA, 13 bp, Homo sapiens
tccatctgtccac

SEQ ID NO: 2963437 - DNA, 13 bp, Homo sapiens
tccatctgtccgt

SEQ ID NO: 2963438 - DNA, 15 bp, Homo sapiens
tccatgaaggcagag

SEQ ID NO: 2963439 - DNA, 20 bp, Homo sapiens
tccatgaatcgcttctcttt

SEQ ID NO: 2963440 - DNA, 13 bp, Homo sapiens
tccatgacatttt

SEQ ID NO: 2963441 - DNA, 12 bp, Homo sapiens
tccatgattcta

SEQ ID NO: 2963442 - DNA, 21 bp, Homo sapiens
tccatgcaccctcatacacag

SEQ ID NO: 2963443 - DNA, 16 bp, Homo sapiens
tccatggcttcctgag

SEQ ID NO: 2963444 - DNA, 17 bp, Homo sapiens
tccatggcttcctgaga

SEQ ID NO: 2963445 - DNA, 20 bp, Homo sapiens
tccatgggccatatgaaaag

SEQ ID NO: 2963446 - DNA, 16 bp, Homo sapiens
tccatgggtctggcta

SEQ ID NO: 2963447 - DNA, 15 bp, Homo sapiens
tccatggtcctgtct

SEQ ID NO: 2963448 - DNA, 21 bp, Homo sapiens
tccatgtacttccctcttgaa

SEQ ID NO: 2963449 - DNA, 14 bp, Homo sapiens
tccatgtgttttgc

SEQ ID NO: 2963450 - DNA, 19 bp, Homo sapiens
tccatgtttccaccaaatg

SEQ ID NO: 2963451 - DNA, 15 bp, Homo sapiens
tccatgttttaaaat

SEQ ID NO: 2963452 - DNA, 16 bp, Homo sapiens
tccatgttttaaaatt

SEQ ID NO: 2963453 - DNA, 15 bp, Homo sapiens
tccattagaatgcta

SEQ ID NO: 2963454 - DNA, 18 bp, Homo sapiens
tccattagtaaaacacaa

SEQ ID NO: 2963455 - DNA, 16 bp, Homo sapiens
tccattatcatgtgta

SEQ ID NO: 2963456 - DNA, 20 bp, Homo sapiens
tccattatcatgtgtaatca

SEQ ID NO: 2963457 - DNA, 14 bp, Homo sapiens
tccattcctcaggg

SEQ ID NO: 2963458 - DNA, 14 bp, Homo sapiens
tccattcttggcat

SEQ ID NO: 2963459 - DNA, 14 bp, Homo sapiens
tccattctttcttc

SEQ ID NO: 2963460 - DNA, 16 bp, Homo sapiens
tccattctttcttcct

SEQ ID NO: 2963461 - DNA, 17 bp, Homo sapiens
tccattctttcttcctc

SEQ ID NO: 2963462 - DNA, 15 bp, Homo sapiens
tccattggtccaaga

SEQ ID NO: 2963463 - DNA, 16 bp, Homo sapiens
tccattggtccaagat

SEQ ID NO: 2963464 - DNA, 19 bp, Homo sapiens
tccattggtccaagattcc

SEQ ID NO: 2963465 - DNA, 22 bp, Homo sapiens
tccattggtccaagattccgga

SEQ ID NO: 2963466 - DNA, 20 bp, Homo sapiens
tccattgtttgaaacaaaga

SEQ ID NO: 2963467 - DNA, 21 bp, Homo sapiens
tccattgtttgaaacaaagaa

SEQ ID NO: 2963468 - DNA, 20 bp, Homo sapiens
tccatttcgcccctcattta

SEQ ID NO: 2963469 - DNA, 23 bp, Homo sapiens
tccatttggcagaactgctgggg

SEQ ID NO: 2963470 - DNA, 17 bp, Homo sapiens
tccaacctggacaacaa

SEQ ID NO: 2963471 - DNA, 14 bp, Homo sapiens
tccaaccttcccaa

SEQ ID NO: 2963472 - DNA, 13 bp, Homo sapiens
tccaaccttcctt

SEQ ID NO: 2963473 - DNA, 20 bp, Homo sapiens
tccaactcctttcagccaca

SEQ ID NO: 2963474 - DNA, 21 bp, Homo sapiens
tccaactgcctaaggcccttt

SEQ ID NO: 2963475 - DNA, 20 bp, Homo sapiens
tccaactgtatatattccca

SEQ ID NO: 2963476 - DNA, 19 bp, Homo sapiens
tccaagaatagcatctgta

SEQ ID NO: 2963477 - DNA, 19 bp, Homo sapiens
tccaagaatccacatttct

SEQ ID NO: 2963478 - DNA, 18 bp, Homo sapiens
tccaagaatggaagcctg

SEQ ID NO: 2963479 - DNA, 18 bp, Homo sapiens
tccaagaccatttgtagt

SEQ ID NO: 2963480 - DNA, 13 bp, Homo sapiens
tccaagactctag

SEQ ID NO: 2963481 - DNA, 14 bp, Homo sapiens
tccaagactctaga

SEQ ID NO: 2963482 - DNA, 15 bp, Homo sapiens
tccaagactctagag

SEQ ID NO: 2963483 - DNA, 19 bp, Homo sapiens
tccaagagggtcctttagt

SEQ ID NO: 2963484 - DNA, 17 bp, Homo sapiens
tccaagagtctaaagat

SEQ ID NO: 2963485 - DNA, 13 bp, Homo sapiens
tccaagattctag

SEQ ID NO: 2963486 - DNA, 14 bp, Homo sapiens
tccaagattctaga

SEQ ID NO: 2963487 - DNA, 17 bp, Homo sapiens
tccaagattctagatga

SEQ ID NO: 2963488 - DNA, 18 bp, Homo sapiens
tccaagattctagatgat

SEQ ID NO: 2963489 - DNA, 23 bp, Homo sapiens
tccaagcagcctgagcaactctt

SEQ ID NO: 2963490 - DNA, 17 bp, Homo sapiens
tccaagccactgagcaa

SEQ ID NO: 2963491 - DNA, 22 bp, Homo sapiens
tccaagcccagttcagcttggg

SEQ ID NO: 2963492 - DNA, 14 bp, Homo sapiens
tccaagccccctgg

SEQ ID NO: 2963493 - DNA, 22 bp, Homo sapiens
tccaagcgaggtcaacagagaa

SEQ ID NO: 2963494 - DNA, 22 bp, Homo sapiens
tccaagctaagcactgccactg

SEQ ID NO: 2963495 - DNA, 19 bp, Homo sapiens
tccaaggaactaatttctt

SEQ ID NO: 2963496 - DNA, 17 bp, Homo sapiens
tccaaggccgcggccca

SEQ ID NO: 2963497 - DNA, 22 bp, Homo sapiens
tccaagtcctttaactcgttgc

SEQ ID NO: 2963498 - DNA, 13 bp, Homo sapiens
tccaagtgtattt

SEQ ID NO: 2963499 - DNA, 18 bp, Homo sapiens
tccaagtgtattttaaaa

SEQ ID NO: 2963500 - DNA, 14 bp, Homo sapiens
tccaagttcacagt

SEQ ID NO: 2963501 - DNA, 19 bp, Homo sapiens
tccaagtttgacttgtata

SEQ ID NO: 2963502 - DNA, 24 bp, Homo sapiens
tccaatcaatttaaatgtttacta

SEQ ID NO: 2963503 - DNA, 21 bp, Homo sapiens
tccaatgtgaaagattattta

SEQ ID NO: 2963504 - DNA, 22 bp, Homo sapiens
tccaattataagaggatatgaa

SEQ ID NO: 2963505 - DNA, 22 bp, Homo sapiens
tccaattgttgacagttctgaa

SEQ ID NO: 2963506 - DNA, 22 bp, Homo sapiens
tccaatttgtaaaaacagcatt

SEQ ID NO: 2963507 - DNA, 18 bp, Homo sapiens
tccaattttttttaagtt

SEQ ID NO: 2963508 - DNA, 12 bp, Homo sapiens
tccacaaaataa

SEQ ID NO: 2963509 - DNA, 18 bp, Homo sapiens
tccacaactcagtttcat

SEQ ID NO: 2963510 - DNA, 17 bp, Homo sapiens
tccacaaggaataaatg

SEQ ID NO: 2963511 - DNA, 19 bp, Homo sapiens
tccacacaagggaaggaca

SEQ ID NO: 2963512 - DNA, 14 bp, Homo sapiens
tccacactatgtgt

SEQ ID NO: 2963513 - DNA, 22 bp, Homo sapiens
tccacactatgtgtgttgtttc

SEQ ID NO: 2963514 - DNA, 18 bp, Homo sapiens
tccacagagtaagacatt

SEQ ID NO: 2963515 - DNA, 18 bp, Homo sapiens
tccacagatatctttttc

SEQ ID NO: 2963516 - DNA, 15 bp, Homo sapiens
tccacagattgtttc

SEQ ID NO: 2963517 - DNA, 17 bp, Homo sapiens
tccacagattgtttcta

SEQ ID NO: 2963518 - DNA, 19 bp, Homo sapiens
tccacagcaaccccaggct

SEQ ID NO: 2963519 - DNA, 20 bp, Homo sapiens
tccacagcaaccccaggctg

SEQ ID NO: 2963520 - DNA, 12 bp, Homo sapiens
tccacagcttcc

SEQ ID NO: 2963521 - DNA, 14 bp, Homo sapiens
tccacagcttcctg

SEQ ID NO: 2963522 - DNA, 13 bp, Homo sapiens
tccacaggagcct

SEQ ID NO: 2963523 - DNA, 14 bp, Homo sapiens
tccacaggagcctc

SEQ ID NO: 2963524 - DNA, 19 bp, Homo sapiens
tccacaggagcctctgcag

SEQ ID NO: 2963525 - DNA, 12 bp, Homo sapiens
tccacagggcac

SEQ ID NO: 2963526 - DNA, 15 bp, Homo sapiens
tccacaggtctagac

SEQ ID NO: 2963527 - DNA, 14 bp, Homo sapiens
tccacatcccggga

SEQ ID NO: 2963528 - DNA, 12 bp, Homo sapiens
tccacatcctcc

SEQ ID NO: 2963529 - DNA, 19 bp, Homo sapiens
tccacatcctccacgttct

SEQ ID NO: 2963530 - DNA, 15 bp, Homo sapiens
tccacatttctaaaa

SEQ ID NO: 2963531 - DNA, 16 bp, Homo sapiens
tccacatttctaaaat

SEQ ID NO: 2963532 - DNA, 17 bp, Homo sapiens
tccacatttttgcacag

SEQ ID NO: 2963533 - DNA, 18 bp, Homo sapiens
tccaccaacccatcagaa

SEQ ID NO: 2963534 - DNA, 20 bp, Homo sapiens
tccaccaaccccgcggccca

SEQ ID NO: 2963535 - DNA, 20 bp, Homo sapiens
tccaccaactttttccaagt

SEQ ID NO: 2963536 - DNA, 13 bp, Homo sapiens
tccaccaccgccc

SEQ ID NO: 2963537 - DNA, 22 bp, Homo sapiens
tccaccaccgcccgtctgtgtg

SEQ ID NO: 2963538 - DNA, 16 bp, Homo sapiens
tccaccagagcagggg

SEQ ID NO: 2963539 - DNA, 19 bp, Homo sapiens
tccaccagagcaggggctg

SEQ ID NO: 2963540 - DNA, 12 bp, Homo sapiens
tccaccaggcct

SEQ ID NO: 2963541 - DNA, 20 bp, Homo sapiens
tccacccaaaccccttccca

SEQ ID NO: 2963542 - DNA, 18 bp, Homo sapiens
tccacccacctcagcctc

SEQ ID NO: 2963543 - DNA, 15 bp, Homo sapiens
tccacccagcccatt

SEQ ID NO: 2963544 - DNA, 14 bp, Homo sapiens
tccaccgctgccta

SEQ ID NO: 2963545 - DNA, 17 bp, Homo sapiens
tccacctcagccttgga

SEQ ID NO: 2963546 - DNA, 18 bp, Homo sapiens
tccacctcgacgtttaca

SEQ ID NO: 2963547 - DNA, 12 bp, Homo sapiens
tccaccttccca

SEQ ID NO: 2963548 - DNA, 16 bp, Homo sapiens
tccacgactgtctcca

SEQ ID NO: 2963549 - DNA, 17 bp, Homo sapiens
tccacgactgtctccat

SEQ ID NO: 2963550 - DNA, 14 bp, Homo sapiens
tccacgcggccacc

SEQ ID NO: 2963551 - DNA, 16 bp, Homo sapiens
tccacgcggccacctc

SEQ ID NO: 2963552 - DNA, 19 bp, Homo sapiens
tccacgcggccacctcacc

SEQ ID NO: 2963553 - DNA, 20 bp, Homo sapiens
tccacggagccactcctctg

SEQ ID NO: 2963554 - DNA, 21 bp, Homo sapiens
tccacggtccgcggcctgcac

SEQ ID NO: 2963555 - DNA, 19 bp, Homo sapiens
tccacgttctgctcatcat

SEQ ID NO: 2963556 - DNA, 15 bp, Homo sapiens
tccactccattgtcg

SEQ ID NO: 2963557 - DNA, 12 bp, Homo sapiens
tccactcctctc

SEQ ID NO: 2963558 - DNA, 12 bp, Homo sapiens
tccactgtgtat

SEQ ID NO: 2963559 - DNA, 20 bp, Homo sapiens
tccactgtgtatagaagtag

SEQ ID NO: 2963560 - DNA, 16 bp, Homo sapiens
tccacttctctgggtc

SEQ ID NO: 2963561 - DNA, 15 bp, Homo sapiens
tccacttctggtccc

SEQ ID NO: 2963562 - DNA, 20 bp, Homo sapiens
tccacttctggtcccctgtg

SEQ ID NO: 2963563 - DNA, 14 bp, Homo sapiens
tccacttggaaatg

SEQ ID NO: 2963564 - DNA, 20 bp, Homo sapiens
tccacttgtgggtcctgggg

SEQ ID NO: 2963565 - DNA, 11 bp, Homo sapiens
tccagaagcct

SEQ ID NO: 2963566 - DNA, 16 bp, Homo sapiens
tccagaaggatttctt

SEQ ID NO: 2963567 - DNA, 20 bp, Homo sapiens
tccagaagtattgtttacat

SEQ ID NO: 2963568 - DNA, 18 bp, Homo sapiens
tccagaatctaaagccag

SEQ ID NO: 2963569 - DNA, 19 bp, Homo sapiens
tccagaatctaaagccagt

SEQ ID NO: 2963570 - DNA, 21 bp, Homo sapiens
tccagaatgctgtacatctat

SEQ ID NO: 2963571 - DNA, 18 bp, Homo sapiens
tccagaatgtgctgcctt

SEQ ID NO: 2963572 - DNA, 21 bp, Homo sapiens
tccagaattacccttcctcat

SEQ ID NO: 2963573 - DNA, 13 bp, Homo sapiens
tccagacactttt

SEQ ID NO: 2963574 - DNA, 14 bp, Homo sapiens
tccagacttccttg

SEQ ID NO: 2963575 - DNA, 19 bp, Homo sapiens
tccagacttccttgagaca

SEQ ID NO: 2963576 - DNA, 17 bp, Homo sapiens
tccagagaaagcacaat

SEQ ID NO: 2963577 - DNA, 20 bp, Homo sapiens
tccagagaaagcacaattta

SEQ ID NO: 2963578 - DNA, 13 bp, Homo sapiens
tccagagacatgt

SEQ ID NO: 2963579 - DNA, 17 bp, Homo sapiens
tccagagccggcatcct

SEQ ID NO: 2963580 - DNA, 13 bp, Homo sapiens
tccagagctctga

SEQ ID NO: 2963581 - DNA, 18 bp, Homo sapiens
tccagagctgcttctgtc

SEQ ID NO: 2963582 - DNA, 10 bp, Homo sapiens
tccagagctt

SEQ ID NO: 2963583 - DNA, 13 bp, Homo sapiens
tccagagcttttc

SEQ ID NO: 2963584 - DNA, 15 bp, Homo sapiens
tccagagttaaaatg

SEQ ID NO: 2963585 - DNA, 19 bp, Homo sapiens
tccagagttaaaatgttta

SEQ ID NO: 2963586 - DNA, 15 bp, Homo sapiens
tccagatgcagggca

SEQ ID NO: 2963587 - DNA, 16 bp, Homo sapiens
tccagatgcagggcag

SEQ ID NO: 2963588 - DNA, 18 bp, Homo sapiens
tccagatgcagggcagtc

SEQ ID NO: 2963589 - DNA, 14 bp, Homo sapiens
tccagatggtggga

SEQ ID NO: 2963590 - DNA, 18 bp, Homo sapiens
tccagatgtttccagact

SEQ ID NO: 2963591 - DNA, 19 bp, Homo sapiens
tccagatgtttccagactt

SEQ ID NO: 2963592 - DNA, 14 bp, Homo sapiens
tccagcaaaatcca

SEQ ID NO: 2963593 - DNA, 15 bp, Homo sapiens
tccagcaaaatccaa

SEQ ID NO: 2963594 - DNA, 20 bp, Homo sapiens
tccagcaaaatccaaactgc

SEQ ID NO: 2963595 - DNA, 21 bp, Homo sapiens
tccagcaaaatccaaactgct

SEQ ID NO: 2963596 - DNA, 22 bp, Homo sapiens
tccagcaaaatccaaactgctg

SEQ ID NO: 2963597 - DNA, 16 bp, Homo sapiens
tccagcaacacagcct

SEQ ID NO: 2963598 - DNA, 17 bp, Homo sapiens
tccagcaacacagcctg

SEQ ID NO: 2963599 - DNA, 21 bp, Homo sapiens
tccagcaacacagcctgggcc

SEQ ID NO: 2963600 - DNA, 22 bp, Homo sapiens
tccagcaacacagcctgggccc

SEQ ID NO: 2963601 - DNA, 15 bp, Homo sapiens
tccagcacaaacaca

SEQ ID NO: 2963602 - DNA, 20 bp, Homo sapiens
tccagcagtcacttcggcca

SEQ ID NO: 2963603 - DNA, 17 bp, Homo sapiens
tccagcagtctctgcct

SEQ ID NO: 2963604 - DNA, 19 bp, Homo sapiens
tccagcagtctctgccttg

SEQ ID NO: 2963605 - DNA, 19 bp, Homo sapiens
tccagccatcaagagactg

SEQ ID NO: 2963606 - DNA, 21 bp, Homo sapiens
tccagcccagacccccagtgt

SEQ ID NO: 2963607 - DNA, 22 bp, Homo sapiens
tcagcccctcctctgccacctc

SEQ ID NO: 2963608 - DNA, 23 bp, Homo sapiens
tcagcccctcctctgccacctcc

SEQ ID NO: 2963609 - DNA, 23 bp, Homo sapiens
tcagccctagggtggagagccac

SEQ ID NO: 2963610 - DNA, 13 bp, Homo sapiens
tcagccctgaccc

SEQ ID NO: 2963611 - DNA, 18 bp, Homo sapiens
tcagccctgattgtgcca

SEQ ID NO: 2963612 - DNA, 18 bp, Homo sapiens
tcagccgcagacaagtaa

SEQ ID NO: 2963613 - DNA, 15 bp, Homo sapiens
tcagcctcctgggta

SEQ ID NO: 2963614 - DNA, 13 bp, Homo sapiens
tcagcctcctgtc

SEQ ID NO: 2963615 - DNA, 22 bp, Homo sapiens
tcagcctgatcaggcttcctgg

SEQ ID NO: 2963616 - DNA, 21 bp, Homo sapiens
tcactgtggtaaatgccacac

SEQ ID NO: 2963617 - DNA, 18 bp, Homo sapiens
tcactgttgcagtggcct

SEQ ID NO: 2963618 - DNA, 14 bp, Homo sapiens
tcactgttgcttaa

SEQ ID NO: 2963619 - DNA, 16 bp, Homo sapiens
tcactgtttgttttta

SEQ ID NO: 2963620 - DNA, 22 bp, Homo sapiens
tcactgtttttagacaccttca

SEQ ID NO: 2963621 - DNA, 19 bp, Homo sapiens
tcacttaggggcagcatgt

SEQ ID NO: 2963622 - DNA, 18 bp, Homo sapiens
tcacttcccgagcgctgg

SEQ ID NO: 2963623 - DNA, 17 bp, Homo sapiens
tcacttcctccagaagc

SEQ ID NO: 2963624 - DNA, 18 bp, Homo sapiens
tcacttcctccagaagcc

SEQ ID NO: 2963625 - DNA, 22 bp, Homo sapiens
tcacttcgttggtgaccagttt

SEQ ID NO: 2963626 - DNA, 18 bp, Homo sapiens
tcacttctagatctcagc

SEQ ID NO: 2963627 - DNA, 19 bp, Homo sapiens
tcacttgatgtttcctgga

SEQ ID NO: 2963628 - DNA, 14 bp, Homo sapiens
tcacttgattcata

SEQ ID NO: 2963629 - DNA, 22 bp, Homo sapiens
tcacttgattcataaagattca

SEQ ID NO: 2963630 - DNA, 12 bp, Homo sapiens
tcacttgcatgt

SEQ ID NO: 2963631 - DNA, 14 bp, Homo sapiens
tcacttttcacttg

SEQ ID NO: 2963632 - DNA, 13 bp, Homo sapiens
tcacttttcatct

SEQ ID NO: 2963633 - DNA, 13 bp, Homo sapiens
tcacttttctgag

SEQ ID NO: 2963634 - DNA, 16 bp, Homo sapiens
tcaagggtggcaggtc

SEQ ID NO: 2963635 - DNA, 11 bp, Homo sapiens
tcaaggttcta

SEQ ID NO: 2963636 - DNA, 21 bp, Homo sapiens
tcaagtaaaagaaaagccgaa

SEQ ID NO: 2963637 - DNA, 21 bp, Homo sapiens
tcaagtagctgggattttaaa

SEQ ID NO: 2963638 - DNA, 13 bp, Homo sapiens
tcaagtataaagt

SEQ ID NO: 2963639 - DNA, 15 bp, Homo sapiens
tcaagtataaagtca

SEQ ID NO: 2963640 - DNA, 20 bp, Homo sapiens
tcaagtatatgtcatttact

SEQ ID NO: 2963641 - DNA, 16 bp, Homo sapiens
tcaagtatcttctatt

SEQ ID NO: 2963642 - DNA, 13 bp, Homo sapiens
tcaagtgagtggc

SEQ ID NO: 2963643 - DNA, 14 bp, Homo sapiens
tcaagttccagtgc

SEQ ID NO: 2963644 - DNA, 19 bp, Homo sapiens
tcaagttccagtgcagaga

SEQ ID NO: 2963645 - DNA, 14 bp, Homo sapiens
tcaagttctaagat

SEQ ID NO: 2963646 - DNA, 23 bp, Homo sapiens
tcaagttgttccttaagtcagaa

SEQ ID NO: 2963647 - DNA, 13 bp, Homo sapiens
tcaagttgtttaa

SEQ ID NO: 2963648 - DNA, 16 bp, Homo sapiens
tcaagttgtttaactg

SEQ ID NO: 2963649 - DNA, 20 bp, Homo sapiens
tcaagttgtttaactgtgca

SEQ ID NO: 2963650 - DNA, 16 bp, Homo sapiens
tcaagtttttacaaaa

SEQ ID NO: 2963651 - DNA, 15 bp, Homo sapiens
tcaataaaaataaat

SEQ ID NO: 2963652 - DNA, 15 bp, Homo sapiens
tcaataaacgattta

SEQ ID NO: 2963653 - DNA, 15 bp, Homo sapiens
tcaataaacttgtag

SEQ ID NO: 2963654 - DNA, 14 bp, Homo sapiens
tcaataaagcacta

SEQ ID NO: 2963655 - DNA, 17 bp, Homo sapiens
tcaataaagcactattg

SEQ ID NO: 2963656 - DNA, 16 bp, Homo sapiens
tcaataaatgatatat

SEQ ID NO: 2963657 - DNA, 15 bp, Homo sapiens
tcaataaatgtctgt

SEQ ID NO: 2963658 - DNA, 15 bp, Homo sapiens
tcaataatatatttt

SEQ ID NO: 2963659 - DNA, 22 bp, Homo sapiens
tcaatacagcctgaataaacca

SEQ ID NO: 2963660 - DNA, 20 bp, Homo sapiens
tcaatacagtacaggcagca

SEQ ID NO: 2963661 - DNA, 22 bp, Homo sapiens
tcaatacctgtttagttgcttg

SEQ ID NO: 2963662 - DNA, 13 bp, Homo sapiens
tcaatactctctg

SEQ ID NO: 2963663 - DNA, 16 bp, Homo sapiens
tcaatactctctgagt

SEQ ID NO: 2963664 - DNA, 17 bp, Homo sapiens
tcaatagctccaagctg

SEQ ID NO: 2963665 - DNA, 14 bp, Homo sapiens
tcaatatcctttgc

SEQ ID NO: 2963666 - DNA, 17 bp, Homo sapiens
tcaatatgtatatatgt

SEQ ID NO: 2963667 - DNA, 13 bp, Homo sapiens
tcaatcaacacta

SEQ ID NO: 2963668 - DNA, 16 bp, Homo sapiens
tcaatcaacctgcact

SEQ ID NO: 2963669 - DNA, 22 bp, Homo sapiens
tcaatcactgtcctccacacaa

SEQ ID NO: 2963670 - DNA, 20 bp, Homo sapiens
tcaatccatcagcaatgctt

SEQ ID NO: 2963671 - DNA, 22 bp, Homo sapiens
tcaatccatcagcaatgcttct

SEQ ID NO: 2963672 - DNA, 15 bp, Homo sapiens
tcaatcccctcattc

SEQ ID NO: 2963673 - DNA, 20 bp, Homo sapiens
tcaatcccctcattcaggaa

SEQ ID NO: 2963674 - DNA, 22 bp, Homo sapiens
tcaatcccctcattcaggaaaa

SEQ ID NO: 2963675 - DNA, 18 bp, Homo sapiens
tcaatctcaatcctgcag

SEQ ID NO: 2963676 - DNA, 21 bp, Homo sapiens
tcaatgcaagccccaactttc

SEQ ID NO: 2963677 - DNA, 22 bp, Homo sapiens
tcaatgcagcacccttgccatc

SEQ ID NO: 2963678 - DNA, 18 bp, Homo sapiens
tcaatggaagaaaccctt

SEQ ID NO: 2963679 - DNA, 17 bp, Homo sapiens
tcaatgtacatagaccc

SEQ ID NO: 2963680 - DNA, 15 bp, Homo sapiens
tcaattatagtttct

SEQ ID NO: 2963681 - DNA, 16 bp, Homo sapiens
tcaattatagtttctg

SEQ ID NO: 2963682 - DNA, 18 bp, Homo sapiens
tcaattatagtttctgag

SEQ ID NO: 2963683 - DNA, 19 bp, Homo sapiens
tcaattatagtttctgagg

SEQ ID NO: 2963684 - DNA, 13 bp, Homo sapiens
tcaattcagtgat

SEQ ID NO: 2963685 - DNA, 23 bp, Homo sapiens
tcaattctgtaggttaaaaaaat

SEQ ID NO: 2963686 - DNA, 15 bp, Homo sapiens
tcaattcttgccaaa

SEQ ID NO: 2963687 - DNA, 14 bp, Homo sapiens
tcaatttaaaccca

SEQ ID NO: 2963688 - DNA, 16 bp, Homo sapiens
tcaatttaaatgttta

SEQ ID NO: 2963689 - DNA, 17 bp, Homo sapiens
tcaatttactttttaaa

SEQ ID NO: 2963690 - DNA, 19 bp, Homo sapiens
tcaatttactttttaaaca

SEQ ID NO: 2963691 - DNA, 13 bp, Homo sapiens
tcaatttcaggct

SEQ ID NO: 2963692 - DNA, 17 bp, Homo sapiens
tcaatttggatatttgg

SEQ ID NO: 2963693 - DNA, 20 bp, Homo sapiens
tcaatttgggggacatgcta

SEQ ID NO: 2963694 - DNA, 18 bp, Homo sapiens
tcaattttcattaaactt

SEQ ID NO: 2963695 - DNA, 21 bp, Homo sapiens
tcaattttcattaaacttgaa

SEQ ID NO: 2963696 - DNA, 16 bp, Homo sapiens
tcaatttttctttaaa

SEQ ID NO: 2963697 - DNA, 21 bp, Homo sapiens
tcaattttttaaaccactaat

SEQ ID NO: 2963698 - DNA, 23 bp, Homo sapiens
tcaatttttttgtgtgtgtttct

SEQ ID NO: 2963699 - DNA, 16 bp, Homo sapiens
tcacaaaacagccttt

SEQ ID NO: 2963700 - DNA, 21 bp, Homo sapiens
tcacaaacttttatactcttt

SEQ ID NO: 2963701 - DNA, 15 bp, Homo sapiens
tcacaacaaaaggaa

SEQ ID NO: 2963702 - DNA, 23 bp, Homo sapiens
tcacaacaactcatttttacaga

SEQ ID NO: 2963703 - DNA, 22 bp, Homo sapiens
tcacaactccttccatccttga

SEQ ID NO: 2963704 - DNA, 23 bp, Homo sapiens
tcacaaggcaggaggagctgata

SEQ ID NO: 2963705 - DNA, 17 bp, Homo sapiens
tcacaaggtataataag

SEQ ID NO: 2963706 - DNA, 20 bp, Homo sapiens
tcacaagttgtgtttgatat

SEQ ID NO: 2963707 - DNA, 22 bp, Homo sapiens
tcacaatgaaatgctctccttt

SEQ ID NO: 2963708 - DNA, 18 bp, Homo sapiens
tcacaatgagtttgggca

SEQ ID NO: 2963709 - DNA, 18 bp, Homo sapiens
tcacaattcttagatctg

SEQ ID NO: 2963710 - DNA, 15 bp, Homo sapiens
tcacacactttctct

SEQ ID NO: 2963711 - DNA, 16 bp, Homo sapiens
tcacacatctgggtgc

SEQ ID NO: 2963712 - DNA, 21 bp, Homo sapiens
tcacacgtttaatcccagcac

SEQ ID NO: 2963713 - DNA, 12 bp, Homo sapiens
tcacactccaga

SEQ ID NO: 2963714 - DNA, 13 bp, Homo sapiens
tcacactcctcct

SEQ ID NO: 2963715 - DNA, 15 bp, Homo sapiens
tcacactcctcctgc

SEQ ID NO: 2963716 - DNA, 21 bp, Homo sapiens
tcacactcctcctgccagctc

SEQ ID NO: 2963717 - DNA, 21 bp, Homo sapiens
tcacactgggtggtggcctgg

SEQ ID NO: 2963718 - DNA, 22 bp, Homo sapiens
tcacactgggtggtggcctggt

SEQ ID NO: 2963719 - DNA, 23 bp, Homo sapiens
tcacactgggtggtggcctggtc

SEQ ID NO: 2963720 - DNA, 19 bp, Homo sapiens
tcacactggttctcaatga

SEQ ID NO: 2963721 - DNA, 21 bp, Homo sapiens
tcacactggttctcaatgaaa

SEQ ID NO: 2963722 - DNA, 21 bp, Homo sapiens
tcacacttactgtaagacatt

SEQ ID NO: 2963723 - DNA, 16 bp, Homo sapiens
tcacagaaaaagcatg

SEQ ID NO: 2963724 - DNA, 19 bp, Homo sapiens
tcacagaaaaagcatgatg

SEQ ID NO: 2963725 - DNA, 23 bp, Homo sapiens
tcacagaaaaagcatgatgggaa

SEQ ID NO: 2963726 - DNA, 12 bp, Homo sapiens
tcacagaagaat

SEQ ID NO: 2963727 - DNA, 19 bp, Homo sapiens
tcacagaagggtgtggcat

SEQ ID NO: 2963728 - DNA, 23 bp, Homo sapiens
tcacagaagggtgtggcatttgg

SEQ ID NO: 2963729 - DNA, 22 bp, Homo sapiens
tcacagacgctcctgaagttag

SEQ ID NO: 2963730 - DNA, 14 bp, Homo sapiens
tcacagactcttcc

SEQ ID NO: 2963731 - DNA, 16 bp, Homo sapiens
tcacagactcttccac

SEQ ID NO: 2963732 - DNA, 18 bp, Homo sapiens
tcacagagcacgcctgcc

SEQ ID NO: 2963733 - DNA, 15 bp, Homo sapiens
tcacagatgctggcc

SEQ ID NO: 2963734 - DNA, 23 bp, Homo sapiens
tcacagatttttggtagtttctg

SEQ ID NO: 2963735 - DNA, 17 bp, Homo sapiens
tcacagcacagagaaga

SEQ ID NO: 2963736 - DNA, 18 bp, Homo sapiens
tcacagcacagagaagac

SEQ ID NO: 2963737 - DNA, 13 bp, Homo sapiens
tcacagcagcttt

SEQ ID NO: 2963738 - DNA, 16 bp, Homo sapiens
tcacagccacccctga

SEQ ID NO: 2963739 - DNA, 16 bp, Homo sapiens
tcacagctcttgtttg

SEQ ID NO: 2963740 - DNA, 20 bp, Homo sapiens
tcacaggagcaatcacagga

SEQ ID NO: 2963741 - DNA, 16 bp, Homo sapiens
tcacagggtgggcctc

SEQ ID NO: 2963742 - DNA, 16 bp, Homo sapiens
tcacagtagagtaggg

SEQ ID NO: 2963743 - DNA, 16 bp, Homo sapiens
tcacagtgtttacact

SEQ ID NO: 2963744 - DNA, 19 bp, Homo sapiens
tcacagttcaaaattctaa

SEQ ID NO: 2963745 - DNA, 17 bp, Homo sapiens
tcacagttcctcgccct

SEQ ID NO: 2963746 - DNA, 20 bp, Homo sapiens
tcacagttcctcgccctggg

SEQ ID NO: 2963747 - DNA, 19 bp, Homo sapiens
tcacagttctttgggccag

SEQ ID NO: 2963748 - DNA, 18 bp, Homo sapiens
tcacataaatgcagccca

SEQ ID NO: 2963749 - DNA, 18 bp, Homo sapiens
tcacatacaattattttt

SEQ ID NO: 2963750 - DNA, 14 bp, Homo sapiens
tcacatatgattct

SEQ ID NO: 2963751 - DNA, 17 bp, Homo sapiens
tcacatatgattctctt

SEQ ID NO: 2963752 - DNA, 23 bp, Homo sapiens
tcacatattttattaagaactca

SEQ ID NO: 2963753 - DNA, 12 bp, Homo sapiens
tcacatcaagca

SEQ ID NO: 2963754 - DNA, 13 bp, Homo sapiens
tcacatcaagcat

SEQ ID NO: 2963755 - DNA, 15 bp, Homo sapiens
tcacatcaagcatca

SEQ ID NO: 2963756 - DNA, 18 bp, Homo sapiens
tcacatcctgtgtttcta

SEQ ID NO: 2963757 - DNA, 13 bp, Homo sapiens
tcacatcttttaa

SEQ ID NO: 2963758 - DNA, 18 bp, Homo sapiens
tcacatcttttaagacaa

SEQ ID NO: 2963759 - DNA, 16 bp, Homo sapiens
tcacatgatgaaaaat

SEQ ID NO: 2963760 - DNA, 14 bp, Homo sapiens
tcacattagaagac

SEQ ID NO: 2963761 - DNA, 15 bp, Homo sapiens
tcacattagaagaca

SEQ ID NO: 2963762 - DNA, 18 bp, Homo sapiens
tcacattcccctggggac

SEQ ID NO: 2963763 - DNA, 18 bp, Homo sapiens
tcacattcttataaatat

SEQ ID NO: 2963764 - DNA, 19 bp, Homo sapiens
tcacattcttataaatatg

SEQ ID NO: 2963765 - DNA, 20 bp, Homo sapiens
tcacattcttataaatatga

SEQ ID NO: 2963766 - DNA, 14 bp, Homo sapiens
tcacattgaatcat

SEQ ID NO: 2963767 - DNA, 21 bp, Homo sapiens
tcacatttcaagatccaaatg

SEQ ID NO: 2963768 - DNA, 13 bp, Homo sapiens
tcaccaaggaaac

SEQ ID NO: 2963769 - DNA, 22 bp, Homo sapiens
tcaccacaaactgtaatacaat

SEQ ID NO: 2963770 - DNA, 16 bp, Homo sapiens
tcaaaatccaaaaaga

SEQ ID NO: 2963771 - DNA, 23 bp, Homo sapiens
tcaaaatccaaaaagaaatgatg

SEQ ID NO: 2963772 - DNA, 22 bp, Homo sapiens
tcaaaatgatgcaaccaaaagg

SEQ ID NO: 2963773 - DNA, 12 bp, Homo sapiens
tcaaaatgcttt

SEQ ID NO: 2963774 - DNA, 17 bp, Homo sapiens
tcaaaatgctttttatt

SEQ ID NO: 2963775 - DNA, 19 bp, Homo sapiens
tcaaaatgctttttatttc

SEQ ID NO: 2963776 - DNA, 21 bp, Homo sapiens
tcaaaatgttatcttctcaag

SEQ ID NO: 2963777 - DNA, 16 bp, Homo sapiens
tcaaaattaatagctt

SEQ ID NO: 2963778 - DNA, 17 bp, Homo sapiens
tcaaaattctaaatgta

SEQ ID NO: 2963779 - DNA, 19 bp, Homo sapiens
tcaaaattctagctgtatg

SEQ ID NO: 2963780 - DNA, 19 bp, Homo sapiens
tcaaacaaactctctgaac

SEQ ID NO: 2963781 - DNA, 15 bp, Homo sapiens
tcaaacaaagccaga

SEQ ID NO: 2963782 - DNA, 17 bp, Homo sapiens
tcaaacaaagccagaag

SEQ ID NO: 2963783 - DNA, 16 bp, Homo sapiens
tcaaacaaccttcagc

SEQ ID NO: 2963784 - DNA, 15 bp, Homo sapiens
tcaaacacaaatgca

SEQ ID NO: 2963785 - DNA, 13 bp, Homo sapiens
tcaaacacaacac

SEQ ID NO: 2963786 - DNA, 16 bp, Homo sapiens
tcaaacacaacacaag

SEQ ID NO: 2963787 - DNA, 17 bp, Homo sapiens
tcaaaccttgaggagaa

SEQ ID NO: 2963788 - DNA, 20 bp, Homo sapiens
tcaaacctttgccaactcag

SEQ ID NO: 2963789 - DNA, 13 bp, Homo sapiens
tcaaaccttttta

SEQ ID NO: 2963790 - DNA, 16 bp, Homo sapiens
tcaaactgctggaaat

SEQ ID NO: 2963791 - DNA, 14 bp, Homo sapiens
tcaaactggggcct

SEQ ID NO: 2963792 - DNA, 12 bp, Homo sapiens
tcaaactgtaaa

SEQ ID NO: 2963793 - DNA, 21 bp, Homo sapiens
tcaaagaaccttgaagaagtg

SEQ ID NO: 2963794 - DNA, 16 bp, Homo sapiens
tcaaagaataagaaaa

SEQ ID NO: 2963795 - DNA, 12 bp, Homo sapiens
tcaaagatgctg

SEQ ID NO: 2963796 - DNA, 11 bp, Homo sapiens
tcaaagatgta

SEQ ID NO: 2963797 - DNA, 17 bp, Homo sapiens
tcaaagatgtaatgtag

SEQ ID NO: 2963798 - DNA, 12 bp, Homo sapiens
tcaaagcattta

SEQ ID NO: 2963799 - DNA, 15 bp, Homo sapiens
tcaaagccctgcctc

SEQ ID NO: 2963800 - DNA, 18 bp, Homo sapiens
tcaaagccctgcctctgt

SEQ ID NO: 2963801 - DNA, 22 bp, Homo sapiens
tcaaagccggcctgagaaacac

SEQ ID NO: 2963802 - DNA, 14 bp, Homo sapiens
tcaaagctgaaatg

SEQ ID NO: 2963803 - DNA, 17 bp, Homo sapiens
tcaaagggacggtcagt

SEQ ID NO: 2963804 - DNA, 19 bp, Homo sapiens
tcaaagggacggtcagttt

SEQ ID NO: 2963805 - DNA, 14 bp, Homo sapiens
tcaaagggactttt

SEQ ID NO: 2963806 - DNA, 19 bp, Homo sapiens
tcaaaggtagccatcatgg

SEQ ID NO: 2963807 - DNA, 12 bp, Homo sapiens
tcaaaggttcta

SEQ ID NO: 2963808 - DNA, 20 bp, Homo sapiens
tcaaaggttctaggtttcaa

SEQ ID NO: 2963809 - DNA, 21 bp, Homo sapiens
tcaaaggttctaggtttcaaa

SEQ ID NO: 2963810 - DNA, 22 bp, Homo sapiens
tcaaagtggaaaggatcacaga

SEQ ID NO: 2963811 - DNA, 20 bp, Homo sapiens
tcaaagtgtaaacaccatag

SEQ ID NO: 2963812 - DNA, 11 bp, Homo sapiens
tcaaagtttta

SEQ ID NO: 2963813 - DNA, 13 bp, Homo sapiens
tcaaataaatgtt

SEQ ID NO: 2963814 - DNA, 14 bp, Homo sapiens
tcaaataaatgttt

SEQ ID NO: 2963815 - DNA, 21 bp, Homo sapiens
tcaaataaatgtttcccccac

SEQ ID NO: 2963816 - DNA, 20 bp, Homo sapiens
tcaaatatttattggatgat

SEQ ID NO: 2963817 - DNA, 14 bp, Homo sapiens
tcaaatcagtcagt

SEQ ID NO: 2963818 - DNA, 20 bp, Homo sapiens
tatttcacaaataataggtg

SEQ ID NO: 2963819 - DNA, 15 bp, Homo sapiens
tatttcacagagcac

SEQ ID NO: 2963820 - DNA, 23 bp, Homo sapiens
tatttcacagagcacgcctgcca

SEQ ID NO: 2963821 - DNA, 18 bp, Homo sapiens
tatttcagatatcaaaat

SEQ ID NO: 2963822 - DNA, 19 bp, Homo sapiens
tatttcagatatcaaaatt

SEQ ID NO: 2963823 - DNA, 21 bp, Homo sapiens
tatttcagatatcaaaattct

SEQ ID NO: 2963824 - DNA, 20 bp, Homo sapiens
tatttcaggccctcagctgt

SEQ ID NO: 2963825 - DNA, 20 bp, Homo sapiens
tatttcagtgccatacatgt

SEQ ID NO: 2963826 - DNA, 22 bp, Homo sapiens
tatttcatgtgctatagacatt

SEQ ID NO: 2963827 - DNA, 16 bp, Homo sapiens
tatttccaatgtgaaa

SEQ ID NO: 2963828 - DNA, 22 bp, Homo sapiens
tatttccctgaaggaaccaaag

SEQ ID NO: 2963829 - DNA, 21 bp, Homo sapiens
tatttcctgaaataaatgttt

SEQ ID NO: 2963830 - DNA, 16 bp, Homo sapiens
tatttcctgacttgag

SEQ ID NO: 2963831 - DNA, 17 bp, Homo sapiens
tatttcctgacttgagt

SEQ ID NO: 2963832 - DNA, 22 bp, Homo sapiens
tatttcctttgcgcaaacttta

SEQ ID NO: 2963833 - DNA, 20 bp, Homo sapiens
tatttctacaaggtgttcat

SEQ ID NO: 2963834 - DNA, 19 bp, Homo sapiens
tatttctaggaagaatttt

SEQ ID NO: 2963835 - DNA, 22 bp, Homo sapiens
tatttctaggaagaattttaaa

SEQ ID NO: 2963836 - DNA, 19 bp, Homo sapiens
tatttctagggctgggaaa

SEQ ID NO: 2963837 - DNA, 16 bp, Homo sapiens
tatttctctagtagtt

SEQ ID NO: 2963838 - DNA, 21 bp, Homo sapiens
tatttctctgtgtatttatat

SEQ ID NO: 2963839 - DNA, 17 bp, Homo sapiens
tatttctgagcaaagca

SEQ ID NO: 2963840 - DNA, 20 bp, Homo sapiens
tatttctgagcaaagcatcg

SEQ ID NO: 2963841 - DNA, 18 bp, Homo sapiens
tatttctgcctataaatt

SEQ ID NO: 2963842 - DNA, 23 bp, Homo sapiens
tatttcttaacctttgctatgta

SEQ ID NO: 2963843 - DNA, 14 bp, Homo sapiens
tatttcttaatttg

SEQ ID NO: 2963844 - DNA, 19 bp, Homo sapiens
tatttcttcgttcttttta

SEQ ID NO: 2963845 - DNA, 14 bp, Homo sapiens
tatttcttgctttc

SEQ ID NO: 2963846 - DNA, 21 bp, Homo sapiens
tatttctttaatctgttgttt

SEQ ID NO: 2963847 - DNA, 23 bp, Homo sapiens
tatttctttttaattattttaaa

SEQ ID NO: 2963848 - DNA, 16 bp, Homo sapiens
tatttgaaccaataaa

SEQ ID NO: 2963849 - DNA, 23 bp, Homo sapiens
tatttgaagcagctctgccttct

SEQ ID NO: 2963850 - DNA, 14 bp, Homo sapiens
tatttgacagacat

SEQ ID NO: 2963851 - DNA, 19 bp, Homo sapiens
tatttgaggggtttcagaa

SEQ ID NO: 2963852 - DNA, 19 bp, Homo sapiens
tatttgctaaatatttctt

SEQ ID NO: 2963853 - DNA, 14 bp, Homo sapiens
tatttgctgtcaca

SEQ ID NO: 2963854 - DNA, 20 bp, Homo sapiens
tatttgctgtcacatagttt

SEQ ID NO: 2963855 - DNA, 19 bp, Homo sapiens
tatttggaagcaacgtgtt

SEQ ID NO: 2963856 - DNA, 19 bp, Homo sapiens
tatttggaattgacattct

SEQ ID NO: 2963857 - DNA, 14 bp, Homo sapiens
tatttggaatttat

SEQ ID NO: 2963858 - DNA, 20 bp, Homo sapiens
tatttggaatttatatacaa

SEQ ID NO: 2963859 - DNA, 14 bp, Homo sapiens
tatttgggaagtga

SEQ ID NO: 2963860 - DNA, 23 bp, Homo sapiens
tatttgggcctgctccagacctg

SEQ ID NO: 2963861 - DNA, 17 bp, Homo sapiens
tatttggtactgtattt

SEQ ID NO: 2963862 - DNA, 23 bp, Homo sapiens
tatttgtactttgtttttccatg

SEQ ID NO: 2963863 - DNA, 23 bp, Homo sapiens
tatttgtcggggaagatgaaacc

SEQ ID NO: 2963864 - DNA, 11 bp, Homo sapiens
tatttgtgact

SEQ ID NO: 2963865 - DNA, 21 bp, Homo sapiens
tatttgtgactaattgtataa

SEQ ID NO: 2963866 - DNA, 18 bp, Homo sapiens
tatttgtgctttgaaaaa

SEQ ID NO: 2963867 - DNA, 13 bp, Homo sapiens
tatttgtgtattt

SEQ ID NO: 2963868 - DNA, 15 bp, Homo sapiens
tatttgtgtatttaa

SEQ ID NO: 2963869 - DNA, 14 bp, Homo sapiens
tatttgtgttcagt

SEQ ID NO: 2963870 - DNA, 16 bp, Homo sapiens
tatttgtttgtagctt

SEQ ID NO: 2963871 - DNA, 14 bp, Homo sapiens
tattttaaaatatt

SEQ ID NO: 2963872 - DNA, 18 bp, Homo sapiens
tattttaagactgatttt

SEQ ID NO: 2963873 - DNA, 23 bp, Homo sapiens
tattttaagactgattttaatag

SEQ ID NO: 2963874 - DNA, 21 bp, Homo sapiens
tattttaataacatatctaaa

SEQ ID NO: 2963875 - DNA, 12 bp, Homo sapiens
tattttagaaat

SEQ ID NO: 2963876 - DNA, 13 bp, Homo sapiens
tattttagacttt

SEQ ID NO: 2963877 - DNA, 16 bp, Homo sapiens
tattttagtttctgtt

SEQ ID NO: 2963878 - DNA, 23 bp, Homo sapiens
tattttataatgttgtatttaat

SEQ ID NO: 2963879 - DNA, 13 bp, Homo sapiens
tattttatatttg

SEQ ID NO: 2963880 - DNA, 15 bp, Homo sapiens
tattttatgagaaat

SEQ ID NO: 2963881 - DNA, 20 bp, Homo sapiens
tattttattaaattaattga

SEQ ID NO: 2963882 - DNA, 15 bp, Homo sapiens
tattttatttgaaaa

SEQ ID NO: 2963883 - DNA, 16 bp, Homo sapiens
tattttcaagaaaaga

SEQ ID NO: 2963884 - DNA, 14 bp, Homo sapiens
tattttcaccattt

SEQ ID NO: 2963885 - DNA, 14 bp, Homo sapiens
tattttcagatgtg

SEQ ID NO: 2963886 - DNA, 22 bp, Homo sapiens
tattttccaaaagtggcctctt

SEQ ID NO: 2963887 - DNA, 15 bp, Homo sapiens
tattttccaagtgtg

SEQ ID NO: 2963888 - DNA, 19 bp, Homo sapiens
tattttccaagtgtgcata

SEQ ID NO: 2963889 - DNA, 24 bp, Homo sapiens
tattttccaagtgtgcatattgta

SEQ ID NO: 2963890 - DNA, 20 bp, Homo sapiens
tattttccctacctaagaat

SEQ ID NO: 2963891 - DNA, 13 bp, Homo sapiens
tattttccttcca

SEQ ID NO: 2963892 - DNA, 14 bp, Homo sapiens
tattttctatttta

SEQ ID NO: 2963893 - DNA, 13 bp, Homo sapiens
tattttctgtcac

SEQ ID NO: 2963894 - DNA, 14 bp, Homo sapiens
tattttctgttcta

SEQ ID NO: 2963895 - DNA, 19 bp, Homo sapiens
tattttctgtttttatgtt

SEQ ID NO: 2963896 - DNA, 16 bp, Homo sapiens
tattttgaaaacactt

SEQ ID NO: 2963897 - DNA, 17 bp, Homo sapiens
tattttgaaaacactta

SEQ ID NO: 2963898 - DNA, 18 bp, Homo sapiens
tattttgaaaacacttat

SEQ ID NO: 2963899 - DNA, 20 bp, Homo sapiens
tattttgaaaacacttattt

SEQ ID NO: 2963900 - DNA, 13 bp, Homo sapiens
tattttgaatcaa

SEQ ID NO: 2963901 - DNA, 15 bp, Homo sapiens
tattttgaatcaata

SEQ ID NO: 2963902 - DNA, 22 bp, Homo sapiens
tattttgaatcaataatatatt

SEQ ID NO: 2963903 - DNA, 13 bp, Homo sapiens
tattttgataaaa

SEQ ID NO: 2963904 - DNA, 12 bp, Homo sapiens
tattttgatcac

SEQ ID NO: 2963905 - DNA, 14 bp, Homo sapiens
tattttgcacagtt

SEQ ID NO: 2963906 - DNA, 13 bp, Homo sapiens
tattttgctcttg

SEQ ID NO: 2963907 - DNA, 16 bp, Homo sapiens
tattttggaagacata

SEQ ID NO: 2963908 - DNA, 18 bp, Homo sapiens
tattttggaagacatata

SEQ ID NO: 2963909 - DNA, 20 bp, Homo sapiens
tattttggaagacatatatt

SEQ ID NO: 2963910 - DNA, 12 bp, Homo sapiens
tattttggaatt

SEQ ID NO: 2963911 - DNA, 21 bp, Homo sapiens
tattttggaattggtgtatat

SEQ ID NO: 2963912 - DNA, 21 bp, Homo sapiens
tattttgtgatgaatctacat

SEQ ID NO: 2963913 - DNA, 23 bp, Homo sapiens
tattttgtggaggcagtgtcatt

SEQ ID NO: 2963914 - DNA, 16 bp, Homo sapiens
tattttgttttccttt

SEQ ID NO: 2963915 - DNA, 14 bp, Homo sapiens
tatttttaaaagaa

SEQ ID NO: 2963916 - DNA, 18 bp, Homo sapiens
tatttttaatatgttgac

SEQ ID NO: 2963917 - DNA, 14 bp, Homo sapiens
tatttttatgatga

SEQ ID NO: 2963918 - DNA, 12 bp, Homo sapiens
tatttttattca

SEQ ID NO: 2963919 - DNA, 12 bp, Homo sapiens
tatttttcaaaa

SEQ ID NO: 2963920 - DNA, 16 bp, Homo sapiens
tatttttgactgtttt

SEQ ID NO: 2963921 - DNA, 13 bp, Homo sapiens
tatttttgattaa

SEQ ID NO: 2963922 - DNA, 20 bp, Homo sapiens
tatttttgcaaaataagttt

SEQ ID NO: 2963923 - DNA, 13 bp, Homo sapiens
tatttttgccctg

SEQ ID NO: 2963924 - DNA, 19 bp, Homo sapiens
tattttttcatagtcccac

SEQ ID NO: 2963925 - DNA, 19 bp, Homo sapiens
tattttttcttgcattgac

SEQ ID NO: 2963926 - DNA, 19 bp, Homo sapiens
tattttttgaatctatgaa

SEQ ID NO: 2963927 - DNA, 14 bp, Homo sapiens
tatttttttctccc

SEQ ID NO: 2963928 - DNA, 18 bp, Homo sapiens
tatttttttgatggctaa

SEQ ID NO: 2963929 - DNA, 18 bp, Homo sapiens
tattttttttaatattat

SEQ ID NO: 2963930 - DNA, 15 bp, Homo sapiens
tattttttttttcct

SEQ ID NO: 2963931 - DNA, 19 bp, Homo sapiens
tcaaaaaaaaaaaaagata

SEQ ID NO: 2963932 - DNA, 15 bp, Homo sapiens
tcaaaaaaaaaaaga

SEQ ID NO: 2963933 - DNA, 13 bp, Homo sapiens
tcaaaaaatgagc

SEQ ID NO: 2963934 - DNA, 20 bp, Homo sapiens
tcaaaacacttccagtctgg

SEQ ID NO: 2963935 - DNA, 18 bp, Homo sapiens
tcaaaacatacaagcaac

SEQ ID NO: 2963936 - DNA, 10 bp, Homo sapiens
tcaaaacatt

SEQ ID NO: 2963937 - DNA, 12 bp, Homo sapiens
tcaaaacattgt

SEQ ID NO: 2963938 - DNA, 16 bp, Homo sapiens
tcaaaactacaaatca

SEQ ID NO: 2963939 - DNA, 15 bp, Homo sapiens
tcaaaagacaattct

SEQ ID NO: 2963940 - DNA, 16 bp, Homo sapiens
tcaaaagacaattctt

SEQ ID NO: 2963941 - DNA, 14 bp, Homo sapiens
tcaaaagctttttg

SEQ ID NO: 2963942 - DNA, 21 bp, Homo sapiens
tcaaaaggaaccaggaggttt

SEQ ID NO: 2963943 - DNA, 23 bp, Homo sapiens
tcaaaaggtgcctgtgaggcagg

SEQ ID NO: 2963944 - DNA, 16 bp, Homo sapiens
tcaaaagtattttcct

SEQ ID NO: 2963945 - DNA, 17 bp, Homo sapiens
tcaaaagtattttcctg

SEQ ID NO: 2963946 - DNA, 18 bp, Homo sapiens
tcaaaagtattttcctgt

SEQ ID NO: 2963947 - DNA, 12 bp, Homo sapiens
tcaaaagtgcct

SEQ ID NO: 2963948 - DNA, 22 bp, Homo sapiens
tcaaaagttccaagagtctaaa

SEQ ID NO: 2963949 - DNA, 14 bp, Homo sapiens
tcaaaagttgaaat

SEQ ID NO: 2963950 - DNA, 18 bp, Homo sapiens
tcaaaataggatttctta

SEQ ID NO: 2963951 - DNA, 12 bp, Homo sapiens
tcaaaatattta

SEQ ID NO: 2963952 - DNA, 13 bp, Homo sapiens
tcaaaatatttaa

SEQ ID NO: 2963953 - DNA, 19 bp, Homo sapiens
tcaaaatatttttaaaaga

SEQ ID NO: 2963954 - DNA, 23 bp, Homo sapiens
tcaaaatatttttaaaagatctt

SEQ ID NO: 2963955 - DNA, 20 bp, Homo sapiens
tattatttctaggaagaatt

SEQ ID NO: 2963956 - DNA, 12 bp, Homo sapiens
tattattttcca

SEQ ID NO: 2963957 - DNA, 14 bp, Homo sapiens
tattcaaactacct

SEQ ID NO: 2963958 - DNA, 17 bp, Homo sapiens
tattcaaactacctata

SEQ ID NO: 2963959 - DNA, 21 bp, Homo sapiens
tattcaaactacctatattcc

SEQ ID NO: 2963960 - DNA, 18 bp, Homo sapiens
tattcaaagatgataatt

SEQ ID NO: 2963961 - DNA, 22 bp, Homo sapiens
tattcaaagatgataatttagt

SEQ ID NO: 2963962 - DNA, 15 bp, Homo sapiens
tattcaaagcagctg

SEQ ID NO: 2963963 - DNA, 14 bp, Homo sapiens
tattcaacacactg

SEQ ID NO: 2963964 - DNA, 14 bp, Homo sapiens
tattcacaaaacat

SEQ ID NO: 2963965 - DNA, 19 bp, Homo sapiens
tattcaccaatgttgtaca

SEQ ID NO: 2963966 - DNA, 16 bp, Homo sapiens
tattcaccatcatgta

SEQ ID NO: 2963967 - DNA, 22 bp, Homo sapiens
tattcactttcatttttgacag

SEQ ID NO: 2963968 - DNA, 20 bp, Homo sapiens
tattcagaatcaaacctttt

SEQ ID NO: 2963969 - DNA, 21 bp, Homo sapiens
tattcagaatcaaaccttttt

SEQ ID NO: 2963970 - DNA, 19 bp, Homo sapiens
tattcagaattatgatgga

SEQ ID NO: 2963971 - DNA, 17 bp, Homo sapiens
tattcagtagtttgagg

SEQ ID NO: 2963972 - DNA, 16 bp, Homo sapiens
tattcatagtttaatt

SEQ ID NO: 2963973 - DNA, 18 bp, Homo sapiens
tattccacagatatcttt

SEQ ID NO: 2963974 - DNA, 20 bp, Homo sapiens
tattccacagatatcttttt

SEQ ID NO: 2963975 - DNA, 22 bp, Homo sapiens
tattccacagatatctttttca

SEQ ID NO: 2963976 - DNA, 21 bp, Homo sapiens
tattccagaatgctgtacatc

SEQ ID NO: 2963977 - DNA, 13 bp, Homo sapiens
tattccagctcat

SEQ ID NO: 2963978 - DNA, 18 bp, Homo sapiens
tattccagctcattcatt

SEQ ID NO: 2963979 - DNA, 13 bp, Homo sapiens
tattccatcttct

SEQ ID NO: 2963980 - DNA, 21 bp, Homo sapiens
tattccatcttctccataagt

SEQ ID NO: 2963981 - DNA, 19 bp, Homo sapiens
tattccatgttttaaaatt

SEQ ID NO: 2963982 - DNA, 23 bp, Homo sapiens
tattccatgttttaaaattatat

SEQ ID NO: 2963983 - DNA, 20 bp, Homo sapiens
tattcccaagcccatgagtc

SEQ ID NO: 2963984 - DNA, 23 bp, Homo sapiens
tattcccaagctctagtgggaag

SEQ ID NO: 2963985 - DNA, 12 bp, Homo sapiens
tattcctttaaa

SEQ ID NO: 2963986 - DNA, 22 bp, Homo sapiens
tattctaagacttactctaaga

SEQ ID NO: 2963987 - DNA, 17 bp, Homo sapiens
tattctagggtttctta

SEQ ID NO: 2963988 - DNA, 18 bp, Homo sapiens
tattctagggtttcttaa

SEQ ID NO: 2963989 - DNA, 17 bp, Homo sapiens
tattctcataatccttc

SEQ ID NO: 2963990 - DNA, 15 bp, Homo sapiens
tattctctctatgca

SEQ ID NO: 2963991 - DNA, 18 bp, Homo sapiens
tattctctgagctgtgca

SEQ ID NO: 2963992 - DNA, 14 bp, Homo sapiens
tattctctgatgtt

SEQ ID NO: 2963993 - DNA, 13 bp, Homo sapiens
tattctctgtttg

SEQ ID NO: 2963994 - DNA, 18 bp, Homo sapiens
tattctctgtttgctttt

SEQ ID NO: 2963995 - DNA, 22 bp, Homo sapiens
tattctgctctattatataaac

SEQ ID NO: 2963996 - DNA, 20 bp, Homo sapiens
tattctggatgtataaaaat

SEQ ID NO: 2963997 - DNA, 15 bp, Homo sapiens
tattctgtaaagctt

SEQ ID NO: 2963998 - DNA, 15 bp, Homo sapiens
tattctgtacatttt

SEQ ID NO: 2963999 - DNA, 11 bp, Homo sapiens
tattctgtcat

SEQ ID NO: 2964000 - DNA, 13 bp, Homo sapiens
tattcttctcttc

SEQ ID NO: 2964001 - DNA, 22 bp, Homo sapiens
tattcttctcttccttttatca

SEQ ID NO: 2964002 - DNA, 15 bp, Homo sapiens
tattcttgaaagaag

SEQ ID NO: 2964003 - DNA, 23 bp, Homo sapiens
tattcttgaaagaagaatgtgtt

SEQ ID NO: 2964004 - DNA, 13 bp, Homo sapiens
tattcttgttata

SEQ ID NO: 2964005 - DNA, 22 bp, Homo sapiens
tattctttgatgttaacacatt

SEQ ID NO: 2964006 - DNA, 15 bp, Homo sapiens
tattcttttcaatta

SEQ ID NO: 2964007 - DNA, 22 bp, Homo sapiens
tattcttttcaattatattgtt

SEQ ID NO: 2964008 - DNA, 20 bp, Homo sapiens
tattcttttccagaaagaaa

SEQ ID NO: 2964009 - DNA, 13 bp, Homo sapiens
tattctttttcca

SEQ ID NO: 2964010 - DNA, 15 bp, Homo sapiens
tattgaaaaaatcaa

SEQ ID NO: 2964011 - DNA, 21 bp, Homo sapiens
tattgaaatattatagagagt

SEQ ID NO: 2964012 - DNA, 14 bp, Homo sapiens
tattgaagaggata

SEQ ID NO: 2964013 - DNA, 19 bp, Homo sapiens
tattgaagaggatattctt

SEQ ID NO: 2964014 - DNA, 22 bp, Homo sapiens
tattgaatataatatatttgtg

SEQ ID NO: 2964015 - DNA, 21 bp, Homo sapiens
tattgacaaccgagaaggttt

SEQ ID NO: 2964016 - DNA, 16 bp, Homo sapiens
tattgacacagaaaat

SEQ ID NO: 2964017 - DNA, 20 bp, Homo sapiens
tattgacacagaaaatgttg

SEQ ID NO: 2964018 - DNA, 15 bp, Homo sapiens
tattgaccatgtgat

SEQ ID NO: 2964019 - DNA, 22 bp, Homo sapiens
tattgacgaactggctacagta

SEQ ID NO: 2964020 - DNA, 19 bp, Homo sapiens
tattgacttcaatgatagt

SEQ ID NO: 2964021 - DNA, 14 bp, Homo sapiens
tattgactttgtct

SEQ ID NO: 2964022 - DNA, 18 bp, Homo sapiens
tattgagcgtgattctgt

SEQ ID NO: 2964023 - DNA, 17 bp, Homo sapiens
tatgcatttttttagtt

SEQ ID NO: 2964024 - DNA, 20 bp, Homo sapiens
tatgccacctgaataaagaa

SEQ ID NO: 2964025 - DNA, 23 bp, Homo sapiens
tatgcccacatttagtctcttta

SEQ ID NO: 2964026 - DNA, 18 bp, Homo sapiens
tatgcccattcttttcac

SEQ ID NO: 2964027 - DNA, 23 bp, Homo sapiens
tatgccccagttcagaaatttgg

SEQ ID NO: 2964028 - DNA, 22 bp, Homo sapiens
tatgcccctagtaactgctgtc

SEQ ID NO: 2964029 - DNA, 17 bp, Homo sapiens
tatgcctctcctttgta

SEQ ID NO: 2964030 - DNA, 21 bp, Homo sapiens
tatgcggttcttacagcacat

SEQ ID NO: 2964031 - DNA, 18 bp, Homo sapiens
tatgctagaaaaggcatt

SEQ ID NO: 2964032 - DNA, 23 bp, Homo sapiens
tatgctatcctcttattccttta

SEQ ID NO: 2964033 - DNA, 23 bp, Homo sapiens
tatgctccatcccattcacttct

SEQ ID NO: 2964034 - DNA, 22 bp, Homo sapiens
tatgctgatcatcgccagaggt

SEQ ID NO: 2964035 - DNA, 12 bp, Homo sapiens
tatgctgctttt

SEQ ID NO: 2964036 - DNA, 21 bp, Homo sapiens
tatgctggggtacacagtgag

SEQ ID NO: 2964037 - DNA, 14 bp, Homo sapiens
tatgctgtatgaat

SEQ ID NO: 2964038 - DNA, 12 bp, Homo sapiens
tatgcttcatac

SEQ ID NO: 2964039 - DNA, 13 bp, Homo sapiens
tatgcttgctcta

SEQ ID NO: 2964040 - DNA, 15 bp, Homo sapiens
tatggaacagggatg

SEQ ID NO: 2964041 - DNA, 18 bp, Homo sapiens
tatggaattgatttgcat

SEQ ID NO: 2964042 - DNA, 12 bp, Homo sapiens
tatggacactgt

SEQ ID NO: 2964043 - DNA, 13 bp, Homo sapiens
tatggacactgtg

SEQ ID NO: 2964044 - DNA, 12 bp, Homo sapiens
tatggactctgc

SEQ ID NO: 2964045 - DNA, 15 bp, Homo sapiens
tatggcactattttt

SEQ ID NO: 2964046 - DNA, 22 bp, Homo sapiens
tatggcagaaaaaatgtctgta

SEQ ID NO: 2964047 - DNA, 12 bp, Homo sapiens
tatggcatctca

SEQ ID NO: 2964048 - DNA, 18 bp, Homo sapiens
tatgggaacactggcaga

SEQ ID NO: 2964049 - DNA, 16 bp, Homo sapiens
tatgggagagtgtcaa

SEQ ID NO: 2964050 - DNA, 22 bp, Homo sapiens
tatgggagagtgtcaaccagac

SEQ ID NO: 2964051 - DNA, 14 bp, Homo sapiens
tatgggcgggcagt

SEQ ID NO: 2964052 - DNA, 16 bp, Homo sapiens
tatggggagagggcat

SEQ ID NO: 2964053 - DNA, 20 bp, Homo sapiens
tatggggctgaacggggaga

SEQ ID NO: 2964054 - DNA, 17 bp, Homo sapiens
tatggtaccagatgcag

SEQ ID NO: 2964055 - DNA, 21 bp, Homo sapiens
tatggtattgtgagatgattt

SEQ ID NO: 2964056 - DNA, 22 bp, Homo sapiens
tatggttgatagtttacctgaa

SEQ ID NO: 2964057 - DNA, 20 bp, Homo sapiens
tatggttgtaacatatgtat

SEQ ID NO: 2964058 - DNA, 17 bp, Homo sapiens
tatgtaaaatgttttag

SEQ ID NO: 2964059 - DNA, 15 bp, Homo sapiens
tatgtaaatagattt

SEQ ID NO: 2964060 - DNA, 16 bp, Homo sapiens
tatgtaacaattgttt

SEQ ID NO: 2964061 - DNA, 14 bp, Homo sapiens
tatgtaactgcatt

SEQ ID NO: 2964062 - DNA, 24 bp, Homo sapiens
tatgtaactgcattgagaactgca

SEQ ID NO: 2964063 - DNA, 21 bp, Homo sapiens
tatgtaagaattcagaagacc

SEQ ID NO: 2964064 - DNA, 12 bp, Homo sapiens
tatgtaatactt

SEQ ID NO: 2964065 - DNA, 18 bp, Homo sapiens
tatgtacagttcataaat

SEQ ID NO: 2964066 - DNA, 10 bp, Homo sapiens
tatgtaccaa

SEQ ID NO: 2964067 - DNA, 19 bp, Homo sapiens
tatgtacttgtcaaagaag

SEQ ID NO: 2964068 - DNA, 13 bp, Homo sapiens
tatgtagacattg

SEQ ID NO: 2964069 - DNA, 15 bp, Homo sapiens
tatgtagcaaaatac

SEQ ID NO: 2964070 - DNA, 20 bp, Homo sapiens
tatgtagtaattgacatgtg

SEQ ID NO: 2964071 - DNA, 15 bp, Homo sapiens
tatgtatacacaaat

SEQ ID NO: 2964072 - DNA, 14 bp, Homo sapiens
tatgtatcttgatg

SEQ ID NO: 2964073 - DNA, 22 bp, Homo sapiens
tatgtatcttgatgttcagaca

SEQ ID NO: 2964074 - DNA, 19 bp, Homo sapiens
tatgtatgtgccaattttg

SEQ ID NO: 2964075 - DNA, 14 bp, Homo sapiens
tatgtattaacttg

SEQ ID NO: 2964076 - DNA, 17 bp, Homo sapiens
tatgtattagtgatatt

SEQ ID NO: 2964077 - DNA, 15 bp, Homo sapiens
tatgtatttcattgc

SEQ ID NO: 2964078 - DNA, 16 bp, Homo sapiens
tatgtctgtcattgta

SEQ ID NO: 2964079 - DNA, 20 bp, Homo sapiens
tatgtgagtgaaagtacttc

SEQ ID NO: 2964080 - DNA, 16 bp, Homo sapiens
tatgtgattttaactc

SEQ ID NO: 2964081 - DNA, 18 bp, Homo sapiens
tatgtgattttaactctg

SEQ ID NO: 2964082 - DNA, 19 bp, Homo sapiens
tatgtgattttaactctgt

SEQ ID NO: 2964083 - DNA, 12 bp, Homo sapiens
tatgtgcacagc

SEQ ID NO: 2964084 - DNA, 17 bp, Homo sapiens
tatgtgccaattttgtc

SEQ ID NO: 2964085 - DNA, 19 bp, Homo sapiens
tatgtgccaattttgtcac

SEQ ID NO: 2964086 - DNA, 17 bp, Homo sapiens
tatgtgccaggcttgcc

SEQ ID NO: 2964087 - DNA, 18 bp, Homo sapiens
tatgtggatacagtcatt

SEQ ID NO: 2964088 - DNA, 19 bp, Homo sapiens
tatgtggttttagattttc

SEQ ID NO: 2964089 - DNA, 13 bp, Homo sapiens
tatgtgtctggaa

SEQ ID NO: 2964090 - DNA, 21 bp, Homo sapiens
tatgtgtctggaagaagcagc

SEQ ID NO: 2964091 - DNA, 17 bp, Homo sapiens
tatgtgtgttgtttcca

SEQ ID NO: 2964092 - DNA, 19 bp, Homo sapiens
tatgtgtgttgtttccata

SEQ ID NO: 2964093 - DNA, 20 bp, Homo sapiens
tatgtgtgttgtttccatag

SEQ ID NO: 2964094 - DNA, 19 bp, Homo sapiens
tatgttaaagtttaagtgt

SEQ ID NO: 2964095 - DNA, 18 bp, Homo sapiens
tatgttaataaactgcaa

SEQ ID NO: 2964096 - DNA, 12 bp, Homo sapiens
tatgttacttaa

SEQ ID NO: 2964097 - DNA, 15 bp, Homo sapiens
tatgttacttaaaca

SEQ ID NO: 2964098 - DNA, 14 bp, Homo sapiens
tatgttgcctttat

SEQ ID NO: 2964099 - DNA, 20 bp, Homo sapiens
tatgttgcctttatggtttc

SEQ ID NO: 2964100 - DNA, 12 bp, Homo sapiens
tatgttgctatt

SEQ ID NO: 2964101 - DNA, 21 bp, Homo sapiens
tatacaaaataagaacgagga

SEQ ID NO: 2964102 - DNA, 13 bp, Homo sapiens
tatacaacagtgc

SEQ ID NO: 2964103 - DNA, 21 bp, Homo sapiens
tatacaaccctggcattatgt

SEQ ID NO: 2964104 - DNA, 18 bp, Homo sapiens
tatacaactgtaaagcaa

SEQ ID NO: 2964105 - DNA, 13 bp, Homo sapiens
tatacaataatgg

SEQ ID NO: 2964106 - DNA, 20 bp, Homo sapiens
tatacaataatggaaaaaaa

SEQ ID NO: 2964107 - DNA, 12 bp, Homo sapiens
tatacacacaca

SEQ ID NO: 2964108 - DNA, 19 bp, Homo sapiens
tatacacgggacagttgct

SEQ ID NO: 2964109 - DNA, 21 bp, Homo sapiens
tatacagagtaattataggaa

SEQ ID NO: 2964110 - DNA, 18 bp, Homo sapiens
tatacagtaactttatgt

SEQ ID NO: 2964111 - DNA, 18 bp, Homo sapiens
tatacatcaatatgtata

SEQ ID NO: 2964112 - DNA, 13 bp, Homo sapiens
tatacatcacttc

SEQ ID NO: 2964113 - DNA, 14 bp, Homo sapiens
tataccatttcctc

SEQ ID NO: 2964114 - DNA, 22 bp, Homo sapiens
tataccgatcaggaatcttgct

SEQ ID NO: 2964115 - DNA, 15 bp, Homo sapiens
tatacctgtgcctcg

SEQ ID NO: 2964116 - DNA, 21 bp, Homo sapiens
tatactactttgttaggattt

SEQ ID NO: 2964117 - DNA, 19 bp, Homo sapiens
tatactattaaaaaggttt

SEQ ID NO: 2964118 - DNA, 21 bp, Homo sapiens
tatactattaaaaaggtttac

SEQ ID NO: 2964119 - DNA, 14 bp, Homo sapiens
tatactctcttccc

SEQ ID NO: 2964120 - DNA, 17 bp, Homo sapiens
tatactctttctgtata

SEQ ID NO: 2964121 - DNA, 18 bp, Homo sapiens
tatactgcactttagtgt

SEQ ID NO: 2964122 - DNA, 23 bp, Homo sapiens
tatactgcttggagctgagcaaa

SEQ ID NO: 2964123 - DNA, 16 bp, Homo sapiens
tatactggaaatgtaa

SEQ ID NO: 2964124 - DNA, 18 bp, Homo sapiens
tatactggaaatgtaaaa

SEQ ID NO: 2964125 - DNA, 16 bp, Homo sapiens
tatactgtaaagaaag

SEQ ID NO: 2964126 - DNA, 21 bp, Homo sapiens
tatactgtacaataaaaacat

SEQ ID NO: 2964127 - DNA, 15 bp, Homo sapiens
tatactgttatccat

SEQ ID NO: 2964128 - DNA, 18 bp, Homo sapiens
tatacttaaacagctttt

SEQ ID NO: 2964129 - DNA, 14 bp, Homo sapiens
tatacttaataaaa

SEQ ID NO: 2964130 - DNA, 11 bp, Homo sapiens
tatagaaaaca

SEQ ID NO: 2964131 - DNA, 14 bp, Homo sapiens
tatagaaatgtatt

SEQ ID NO: 2964132 - DNA, 23 bp, Homo sapiens
tatagaaatgtattttgaaaaca

SEQ ID NO: 2964133 - DNA, 17 bp, Homo sapiens
tatagaactgaatgaga

SEQ ID NO: 2964134 - DNA, 16 bp, Homo sapiens
tatagaattagctttt

SEQ ID NO: 2964135 - DNA, 23 bp, Homo sapiens
tatagacagtccttaaaaatcac

SEQ ID NO: 2964136 - DNA, 17 bp, Homo sapiens
tatagatgggaatgaag

SEQ ID NO: 2964137 - DNA, 17 bp, Homo sapiens
tatagattctaaagatt

SEQ ID NO: 2964138 - DNA, 22 bp, Homo sapiens
tatagattttttaaaaaaaatg

SEQ ID NO: 2964139 - DNA, 16 bp, Homo sapiens
tatagcaaaactttta

SEQ ID NO: 2964140 - DNA, 20 bp, Homo sapiens
tatagcaaagatatatattc

SEQ ID NO: 2964141 - DNA, 18 bp, Homo sapiens
tatagcacatcacctggg

SEQ ID NO: 2964142 - DNA, 22 bp, Homo sapiens
tatagcccagccaggccccagg

SEQ ID NO: 2964143 - DNA, 21 bp, Homo sapiens
tataggggtcctgggggcagg

SEQ ID NO: 2964144 - DNA, 20 bp, Homo sapiens
tataggttttgtttgctatc

SEQ ID NO: 2964145 - DNA, 14 bp, Homo sapiens
tatagtaggcatgt

SEQ ID NO: 2964146 - DNA, 13 bp, Homo sapiens
tatagttgtattt

SEQ ID NO: 2964147 - DNA, 14 bp, Homo sapiens
tatagttgtatttt

SEQ ID NO: 2964148 - DNA, 15 bp, Homo sapiens
tatagttgtattttg

SEQ ID NO: 2964149 - DNA, 21 bp, Homo sapiens
tatagttgtctttctttgctg

SEQ ID NO: 2964150 - DNA, 14 bp, Homo sapiens
tatagtttctgagg

SEQ ID NO: 2964151 - DNA, 15 bp, Homo sapiens
tatagtttgggcttc

SEQ ID NO: 2964152 - DNA, 17 bp, Homo sapiens
tatagtttgggcttcag

SEQ ID NO: 2964153 - DNA, 21 bp, Homo sapiens
tatataaaaatatatgttgaa

SEQ ID NO: 2964154 - DNA, 23 bp, Homo sapiens
tatataaaatgtggccaagaaga

SEQ ID NO: 2964155 - DNA, 22 bp, Homo sapiens
tatataaagtttttttatttct

SEQ ID NO: 2964156 - DNA, 16 bp, Homo sapiens
tatataaatatatttt

SEQ ID NO: 2964157 - DNA, 17 bp, Homo sapiens
tatataaatgggaacat

SEQ ID NO: 2964158 - DNA, 23 bp, Homo sapiens
tatataaattgagcttgcttctt

SEQ ID NO: 2964159 - DNA, 14 bp, Homo sapiens
tatataacatatat

SEQ ID NO: 2964160 - DNA, 17 bp, Homo sapiens
tatataacatatatgga

SEQ ID NO: 2964161 - DNA, 21 bp, Homo sapiens
tatataaggtcatagattctt

SEQ ID NO: 2964162 - DNA, 20 bp, Homo sapiens
tatatacaacctgcttgggt

SEQ ID NO: 2964163 - DNA, 13 bp, Homo sapiens
tatatacaataat

SEQ ID NO: 2964164 - DNA, 17 bp, Homo sapiens
tatatacttttaaatta

SEQ ID NO: 2964165 - DNA, 13 bp, Homo sapiens
tatatagaaaaga

SEQ ID NO: 2964166 - DNA, 16 bp, Homo sapiens
tatatagacagctttg

SEQ ID NO: 2964167 - DNA, 20 bp, Homo sapiens
tatataggttttgtttgcta

SEQ ID NO: 2964168 - DNA, 15 bp, Homo sapiens
tatatagtctttgca

SEQ ID NO: 2964169 - DNA, 15 bp, Homo sapiens
tatatataagaaaga

SEQ ID NO: 2964170 - DNA, 15 bp, Homo sapiens
tatatatacacacac

SEQ ID NO: 2964171 - DNA, 16 bp, Homo sapiens
tatatatacacacaca

SEQ ID NO: 2964172 - DNA, 13 bp, Homo sapiens
tatatatagaaaa

SEQ ID NO: 2964173 - DNA, 13 bp, Homo sapiens
tatatatatataa

SEQ ID NO: 2964174 - DNA, 12 bp, Homo sapiens
tatatatctttt

SEQ ID NO: 2964175 - DNA, 19 bp, Homo sapiens
tatatatcttttgtaagac

SEQ ID NO: 2964176 - DNA, 14 bp, Homo sapiens
tatatatgtacagt

SEQ ID NO: 2964177 - DNA, 14 bp, Homo sapiens
tatatatgtgagga

SEQ ID NO: 2964178 - DNA, 16 bp, Homo sapiens
tatatattgtctgtaa

SEQ ID NO: 2964179 - DNA, 16 bp, Homo sapiens
tatatatttaacatgt

SEQ ID NO: 2964180 - DNA, 17 bp, Homo sapiens
tatatatttctattatt

SEQ ID NO: 2964181 - DNA, 13 bp, Homo sapiens
tatatcaaatgag

SEQ ID NO: 2964182 - DNA, 20 bp, Homo sapiens
tatatccttttcttctatgt

SEQ ID NO: 2964183 - DNA, 17 bp, Homo sapiens
tatatctaaattgaata

SEQ ID NO: 2964184 - DNA, 20 bp, Homo sapiens
tatatctgtatgtattagtg

SEQ ID NO: 2964185 - DNA, 12 bp, Homo sapiens
tatatgaaaaca

SEQ ID NO: 2964186 - DNA, 13 bp, Homo sapiens
tatatgaaaacac

SEQ ID NO: 2964187 - DNA, 16 bp, Homo sapiens
tatatgaaaacactca

SEQ ID NO: 2964188 - DNA, 12 bp, Homo sapiens
tatatgactgca

SEQ ID NO: 2964189 - DNA, 18 bp, Homo sapiens
tatatgcacccctggaac

SEQ ID NO: 2964190 - DNA, 23 bp, Homo sapiens
tatatgctacttttacttgttca

SEQ ID NO: 2964191 - DNA, 21 bp, Homo sapiens
tatatgggcttttacctgtgc

SEQ ID NO: 2964192 - DNA, 22 bp, Homo sapiens
tatatgggcttttacctgtgca

SEQ ID NO: 2964193 - DNA, 18 bp, Homo sapiens
tatatggtatatatacat

SEQ ID NO: 2964194 - DNA, 19 bp, Homo sapiens
tatatgtacttgtcaaaga

SEQ ID NO: 2964195 - DNA, 12 bp, Homo sapiens
tatatgttgaat

SEQ ID NO: 2964196 - DNA, 11 bp, Homo sapiens
tatattaaaat

SEQ ID NO: 2964197 - DNA, 15 bp, Homo sapiens
tatattaaataacat

SEQ ID NO: 2964198 - DNA, 17 bp, Homo sapiens
tatattacccaatggaa

SEQ ID NO: 2964199 - DNA, 13 bp, Homo sapiens
tatattatataag

SEQ ID NO: 2964200 - DNA, 20 bp, Homo sapiens
tatattatcatgcaaatgct

SEQ ID NO: 2964201 - DNA, 14 bp, Homo sapiens
tatattatttacat

SEQ ID NO: 2964202 - DNA, 23 bp, Homo sapiens
tatattatttctaggaagaattt

SEQ ID NO: 2964203 - DNA, 15 bp, Homo sapiens
tatattcctaaacta

SEQ ID NO: 2964204 - DNA, 22 bp, Homo sapiens
tatattctggccagactcgatg

SEQ ID NO: 2964205 - DNA, 17 bp, Homo sapiens
tatattgattatttgtt

SEQ ID NO: 2964206 - DNA, 16 bp, Homo sapiens
tatattgtctgtaaaa

SEQ ID NO: 2964207 - DNA, 16 bp, Homo sapiens
tatatttaacatgtgg

SEQ ID NO: 2964208 - DNA, 15 bp, Homo sapiens
tatatttacaaatgg

SEQ ID NO: 2964209 - DNA, 13 bp, Homo sapiens
tatatttctatta

SEQ ID NO: 2964210 - DNA, 12 bp, Homo sapiens
tatatttgacat

SEQ ID NO: 2964211 - DNA, 13 bp, Homo sapiens
tatatttgacatg

SEQ ID NO: 2964212 - DNA, 17 bp, Homo sapiens
tatatttgtaaagctat

SEQ ID NO: 2964213 - DNA, 16 bp, Homo sapiens
tatatttgtgctatag

SEQ ID NO: 2964214 - DNA, 20 bp, Homo sapiens
tatatttgtgctatagtatt

SEQ ID NO: 2964215 - DNA, 12 bp, Homo sapiens
tatattttaata

SEQ ID NO: 2964216 - DNA, 21 bp, Homo sapiens
tatattttatactgcacttta

SEQ ID NO: 2964217 - DNA, 22 bp, Homo sapiens
tatattttatactgcactttag

SEQ ID NO: 2964218 - DNA, 18 bp, Homo sapiens
tatattttcagcaaagaa

SEQ ID NO: 2964219 - DNA, 14 bp, Homo sapiens
tatattttctgttt

SEQ ID NO: 2964220 - DNA, 11 bp, Homo sapiens
tatattttgac

SEQ ID NO: 2964221 - DNA, 16 bp, Homo sapiens
tatatttttgatacct

SEQ ID NO: 2964222 - DNA, 21 bp, Homo sapiens
tatatttttttaactgtgata

SEQ ID NO: 2964223 - DNA, 21 bp, Homo sapiens
tatcaaaactctatcaaatgt

SEQ ID NO: 2964224 - DNA, 12 bp, Homo sapiens
tatcaaaagtga

SEQ ID NO: 2964225 - DNA, 13 bp, Homo sapiens
tatcaaaagtgat

SEQ ID NO: 2964226 - DNA, 14 bp, Homo sapiens
tatcaaagcttcaa

SEQ ID NO: 2964227 - DNA, 20 bp, Homo sapiens
tatcaaatattagatgtgat

SEQ ID NO: 2964228 - DNA, 23 bp, Homo sapiens
tatcaaatattagatgtgattta

SEQ ID NO: 2964229 - DNA, 19 bp, Homo sapiens
tatcaaatgcagtatattt

SEQ ID NO: 2964230 - DNA, 19 bp, Homo sapiens
tatcaaccccagacactgg

SEQ ID NO: 2964231 - DNA, 21 bp, Homo sapiens
tatcaagaagtcagagaaaac

SEQ ID NO: 2964232 - DNA, 22 bp, Homo sapiens
tatcaagaagtcagagaaaaca

SEQ ID NO: 2964233 - DNA, 15 bp, Homo sapiens
tatcaagacatagca

SEQ ID NO: 2964234 - DNA, 21 bp, Homo sapiens
tatcaagtactacattttctt

SEQ ID NO: 2964235 - DNA, 17 bp, Homo sapiens
tatcaagtgttctaaaa

SEQ ID NO: 2964236 - DNA, 13 bp, Homo sapiens
tatcaataaagca

SEQ ID NO: 2964237 - DNA, 15 bp, Homo sapiens
tatcaataaagcact

SEQ ID NO: 2964238 - DNA, 21 bp, Homo sapiens
tagctgctacaaagaagacat

SEQ ID NO: 2964239 - DNA, 23 bp, Homo sapiens
tagctggagatctgaacccagct

SEQ ID NO: 2964240 - DNA, 15 bp, Homo sapiens
tagctgtctagagta

SEQ ID NO: 2964241 - DNA, 20 bp, Homo sapiens
tagcttaagggaatatgcat

SEQ ID NO: 2964242 - DNA, 21 bp, Homo sapiens
tagcttaagggaatatgcatt

SEQ ID NO: 2964243 - DNA, 17 bp, Homo sapiens
tagcttataagagggca

SEQ ID NO: 2964244 - DNA, 18 bp, Homo sapiens
tagcttatctccctgctt

SEQ ID NO: 2964245 - DNA, 21 bp, Homo sapiens
tagcttcaccccaatcccagc

SEQ ID NO: 2964246 - DNA, 15 bp, Homo sapiens
tagcttcaggaacct

SEQ ID NO: 2964247 - DNA, 18 bp, Homo sapiens
tagcttcaggaacctcga

SEQ ID NO: 2964248 - DNA, 13 bp, Homo sapiens
tagcttcctccag

SEQ ID NO: 2964249 - DNA, 16 bp, Homo sapiens
tagcttcctccagagg

SEQ ID NO: 2964250 - DNA, 21 bp, Homo sapiens
tagcttctaccatgaacagaa

SEQ ID NO: 2964251 - DNA, 22 bp, Homo sapiens
tagcttgtttctgtcaagcata

SEQ ID NO: 2964252 - DNA, 15 bp, Homo sapiens
tagctttcaattccg

SEQ ID NO: 2964253 - DNA, 23 bp, Homo sapiens
tagctttcaattccgtagccagc

SEQ ID NO: 2964254 - DNA, 14 bp, Homo sapiens
tagctttccagttc

SEQ ID NO: 2964255 - DNA, 13 bp, Homo sapiens
tagctttcctgga

SEQ ID NO: 2964256 - DNA, 15 bp, Homo sapiens
tagctttcctggaag

SEQ ID NO: 2964257 - DNA, 11 bp, Homo sapiens
tagctttgaca

SEQ ID NO: 2964258 - DNA, 16 bp, Homo sapiens
tagcttttcaccttta

SEQ ID NO: 2964259 - DNA, 22 bp, Homo sapiens
tagcttttttcctcctttctct

SEQ ID NO: 2964260 - DNA, 12 bp, Homo sapiens
taggaaaagcat

SEQ ID NO: 2964261 - DNA, 21 bp, Homo sapiens
taggaaacaaagcttagcagg

SEQ ID NO: 2964262 - DNA, 13 bp, Homo sapiens
taggaaacaagtg

SEQ ID NO: 2964263 - DNA, 18 bp, Homo sapiens
taggaaataaaattaatg

SEQ ID NO: 2964264 - DNA, 20 bp, Homo sapiens
taggaacggtaaatttctgt

SEQ ID NO: 2964265 - DNA, 23 bp, Homo sapiens
taggaagaacgttttttcctcag

SEQ ID NO: 2964266 - DNA, 18 bp, Homo sapiens
taggaagaattttaaaaa

SEQ ID NO: 2964267 - DNA, 21 bp, Homo sapiens
taggaagaattttaaaaatga

SEQ ID NO: 2964268 - DNA, 16 bp, Homo sapiens
taggaagtaaattata

SEQ ID NO: 2964269 - DNA, 12 bp, Homo sapiens
taggaataaata

SEQ ID NO: 2964270 - DNA, 22 bp, Homo sapiens
taggaatactgttttatctcca

SEQ ID NO: 2964271 - DNA, 19 bp, Homo sapiens
taggaatctgccttccagc

SEQ ID NO: 2964272 - DNA, 13 bp, Homo sapiens
taggacaaatgat

SEQ ID NO: 2964273 - DNA, 23 bp, Homo sapiens
taggaccatggttaagagtccaa

SEQ ID NO: 2964274 - DNA, 16 bp, Homo sapiens
taggacccaagcagag

SEQ ID NO: 2964275 - DNA, 16 bp, Homo sapiens
taggacgttggcctca

SEQ ID NO: 2964276 - DNA, 18 bp, Homo sapiens
taggacgttggcctcagg

SEQ ID NO: 2964277 - DNA, 19 bp, Homo sapiens
taggactacattttgctct

SEQ ID NO: 2964278 - DNA, 21 bp, Homo sapiens
taggactgtggcaaacaaaac

SEQ ID NO: 2964279 - DNA, 18 bp, Homo sapiens
taggactttcttctaaat

SEQ ID NO: 2964280 - DNA, 18 bp, Homo sapiens
taggacttttaaacaaaa

SEQ ID NO: 2964281 - DNA, 20 bp, Homo sapiens
taggacttttaaacaaaagt

SEQ ID NO: 2964282 - DNA, 21 bp, Homo sapiens
taggagaacgtatcaatacag

SEQ ID NO: 2964283 - DNA, 23 bp, Homo sapiens
taggagacagatcactcctggag

SEQ ID NO: 2964284 - DNA, 17 bp, Homo sapiens
taggagacttgccagag

SEQ ID NO: 2964285 - DNA, 20 bp, Homo sapiens
taggagagataccttgaaaa

SEQ ID NO: 2964286 - DNA, 23 bp, Homo sapiens
taggagagggagatgatccagag

SEQ ID NO: 2964287 - DNA, 13 bp, Homo sapiens
taggagctaaggc

SEQ ID NO: 2964288 - DNA, 17 bp, Homo sapiens
taggagctaaggctcta

SEQ ID NO: 2964289 - DNA, 23 bp, Homo sapiens
taggagctgccttggctcagaca

SEQ ID NO: 2964290 - DNA, 14 bp, Homo sapiens
taggaggaggcatg

SEQ ID NO: 2964291 - DNA, 20 bp, Homo sapiens
taggaggaggcatggaaacc

SEQ ID NO: 2964292 - DNA, 17 bp, Homo sapiens
taggatcctggaggctg

SEQ ID NO: 2964293 - DNA, 21 bp, Homo sapiens
taggatctaaggctgtttgct

SEQ ID NO: 2964294 - DNA, 23 bp, Homo sapiens
taggatctcgcctggaaacagag

SEQ ID NO: 2964295 - DNA, 18 bp, Homo sapiens
taggatgctcagttgcta

SEQ ID NO: 2964296 - DNA, 16 bp, Homo sapiens
taggatggtaaagtta

SEQ ID NO: 2964297 - DNA, 19 bp, Homo sapiens
taggattccccctgccctg

SEQ ID NO: 2964298 - DNA, 15 bp, Homo sapiens
taggattgcttcaat

SEQ ID NO: 2964299 - DNA, 17 bp, Homo sapiens
taggatttcttaaattt

SEQ ID NO: 2964300 - DNA, 22 bp, Homo sapiens
taggattttttttttttcttca

SEQ ID NO: 2964301 - DNA, 23 bp, Homo sapiens
taggcaaaaataatttattttgc

SEQ ID NO: 2964302 - DNA, 18 bp, Homo sapiens
taggcaaaagtgtaacaa

SEQ ID NO: 2964303 - DNA, 12 bp, Homo sapiens
taggcaacatag

SEQ ID NO: 2964304 - DNA, 21 bp, Homo sapiens
taggcactgtagttctaagac

SEQ ID NO: 2964305 - DNA, 22 bp, Homo sapiens
taggcactgtagttctaagact

SEQ ID NO: 2964306 - DNA, 22 bp, Homo sapiens
taggcagactctttatgcttgc

SEQ ID NO: 2964307 - DNA, 24 bp, Homo sapiens
taggcagtaggccggtgtgcctga

SEQ ID NO: 2964308 - DNA, 21 bp, Homo sapiens
taggcatttttaccatcactg

SEQ ID NO: 2964309 - DNA, 19 bp, Homo sapiens
taggccaactgcctccttg

SEQ ID NO: 2964310 - DNA, 21 bp, Homo sapiens
taggccacagaaggtgaactt

SEQ ID NO: 2964311 - DNA, 14 bp, Homo sapiens
taggccatgaaaaa

SEQ ID NO: 2964312 - DNA, 16 bp, Homo sapiens
taggcccacacacagg

SEQ ID NO: 2964313 - DNA, 15 bp, Homo sapiens
taggcccctgtgtag

SEQ ID NO: 2964314 - DNA, 19 bp, Homo sapiens
taggccctggttcctgctg

SEQ ID NO: 2964315 - DNA, 18 bp, Homo sapiens
taggcctcagccagagaa

SEQ ID NO: 2964316 - DNA, 22 bp, Homo sapiens
taggcctctcacctctgtgcct

SEQ ID NO: 2964317 - DNA, 21 bp, Homo sapiens
taggccttcctctctccagat

SEQ ID NO: 2964318 - DNA, 16 bp, Homo sapiens
taggctagggtgggga

SEQ ID NO: 2964319 - DNA, 12 bp, Homo sapiens
taggctctgcct

SEQ ID NO: 2964320 - DNA, 19 bp, Homo sapiens
taggctggagcccagggag

SEQ ID NO: 2964321 - DNA, 16 bp, Homo sapiens
taggctggtggcccag

SEQ ID NO: 2964322 - DNA, 14 bp, Homo sapiens
taggctttcagctt

SEQ ID NO: 2964323 - DNA, 21 bp, Homo sapiens
tagggaaaaatgcaaaaaaga

SEQ ID NO: 2964324 - DNA, 14 bp, Homo sapiens
tagggaagggcctg

SEQ ID NO: 2964325 - DNA, 15 bp, Homo sapiens
tagggaagtaaaaaa

SEQ ID NO: 2964326 - DNA, 19 bp, Homo sapiens
tagggagatggagaaaatg

SEQ ID NO: 2964327 - DNA, 12 bp, Homo sapiens
tagggagccatg

SEQ ID NO: 2964328 - DNA, 16 bp, Homo sapiens
tagggatgcctccttt

SEQ ID NO: 2964329 - DNA, 23 bp, Homo sapiens
tagggccaagcccagcactgctt

SEQ ID NO: 2964330 - DNA, 19 bp, Homo sapiens
tagggcctcggaggctcct

SEQ ID NO: 2964331 - DNA, 21 bp, Homo sapiens
tagggcctcggaggctcctcc

SEQ ID NO: 2964332 - DNA, 16 bp, Homo sapiens
tagggcttttattttt

SEQ ID NO: 2964333 - DNA, 21 bp, Homo sapiens
taggggagccacatttacata

SEQ ID NO: 2964334 - DNA, 12 bp, Homo sapiens
taggggcttggt

SEQ ID NO: 2964335 - DNA, 16 bp, Homo sapiens
tagggggtgggagggg

SEQ ID NO: 2964336 - DNA, 16 bp, Homo sapiens
tagggtccttgaaaca

SEQ ID NO: 2964337 - DNA, 13 bp, Homo sapiens
tagggttctgctt

SEQ ID NO: 2964338 - DNA, 19 bp, Homo sapiens
tagggttggttcctttcca

SEQ ID NO: 2964339 - DNA, 18 bp, Homo sapiens
taggtactttttgtgaag

SEQ ID NO: 2964340 - DNA, 16 bp, Homo sapiens
taggtcagtgcaaata

SEQ ID NO: 2964341 - DNA, 17 bp, Homo sapiens
taggtcttcctgtggct

SEQ ID NO: 2964342 - DNA, 23 bp, Homo sapiens
taggtcttcctgtggctccctct

SEQ ID NO: 2964343 - DNA, 23 bp, Homo sapiens
taggtgatcccgttttccccatg

SEQ ID NO: 2964344 - DNA, 16 bp, Homo sapiens
taggtggatcacctga

SEQ ID NO: 2964345 - DNA, 17 bp, Homo sapiens
taggttaaaaaaaggca

SEQ ID NO: 2964346 - DNA, 16 bp, Homo sapiens
taggttctaaagttct

SEQ ID NO: 2964347 - DNA, 19 bp, Homo sapiens
taggttctgtagagccaat

SEQ ID NO: 2964348 - DNA, 20 bp, Homo sapiens
taggttgtttttaaaaccac

SEQ ID NO: 2964349 - DNA, 22 bp, Homo sapiens
taggttgtttttaaaaccacta

SEQ ID NO: 2964350 - DNA, 15 bp, Homo sapiens
taggtttcaggaagt

SEQ ID NO: 2964351 - DNA, 19 bp, Homo sapiens
tagtaaaaacatttaaata

SEQ ID NO: 2964352 - DNA, 15 bp, Homo sapiens
tagtaaaaatacaaa

SEQ ID NO: 2964353 - DNA, 14 bp, Homo sapiens
tagatgatgtattt

SEQ ID NO: 2964354 - DNA, 19 bp, Homo sapiens
tagatgattaaataagatt

SEQ ID NO: 2964355 - DNA, 19 bp, Homo sapiens
tagatgcatgttgaccatg

SEQ ID NO: 2964356 - DNA, 17 bp, Homo sapiens
tagatgctggcatctct

SEQ ID NO: 2964357 - DNA, 13 bp, Homo sapiens
tagatgctggccc

SEQ ID NO: 2964358 - DNA, 16 bp, Homo sapiens
tagatgctggcccagg

SEQ ID NO: 2964359 - DNA, 20 bp, Homo sapiens
tagatgctttcctaaatcag

SEQ ID NO: 2964360 - DNA, 14 bp, Homo sapiens
tagatggattctcc

SEQ ID NO: 2964361 - DNA, 23 bp, Homo sapiens
tagatggcactttagtgattgct

SEQ ID NO: 2964362 - DNA, 14 bp, Homo sapiens
tagatggctcctct

SEQ ID NO: 2964363 - DNA, 13 bp, Homo sapiens
tagatgggaatga

SEQ ID NO: 2964364 - DNA, 16 bp, Homo sapiens
tagatgggaggatgaa

SEQ ID NO: 2964365 - DNA, 15 bp, Homo sapiens
tagatgtgatttaat

SEQ ID NO: 2964366 - DNA, 19 bp, Homo sapiens
tagatgtgatttaatagtg

SEQ ID NO: 2964367 - DNA, 18 bp, Homo sapiens
tagatgttccagtaatct

SEQ ID NO: 2964368 - DNA, 15 bp, Homo sapiens
tagatgttgccatgt

SEQ ID NO: 2964369 - DNA, 17 bp, Homo sapiens
tagatgtttatatcaaa

SEQ ID NO: 2964370 - DNA, 20 bp, Homo sapiens
tagatgtttattcttctaga

SEQ ID NO: 2964371 - DNA, 14 bp, Homo sapiens
tagatgtttgactt

SEQ ID NO: 2964372 - DNA, 16 bp, Homo sapiens
tagatgttttaactta

SEQ ID NO: 2964373 - DNA, 22 bp, Homo sapiens
tagatgttttaacttatttata

SEQ ID NO: 2964374 - DNA, 16 bp, Homo sapiens
tagattaaaaattata

SEQ ID NO: 2964375 - DNA, 18 bp, Homo sapiens
tagattaagagatgggtt

SEQ ID NO: 2964376 - DNA, 17 bp, Homo sapiens
tagattatatcaaagta

SEQ ID NO: 2964377 - DNA, 19 bp, Homo sapiens
tagattatatcaaagtatt

SEQ ID NO: 2964378 - DNA, 13 bp, Homo sapiens
tagattcaaaggt

SEQ ID NO: 2964379 - DNA, 18 bp, Homo sapiens
tagattcaaaggttctag

SEQ ID NO: 2964380 - DNA, 21 bp, Homo sapiens
tagattccattggtccaagat

SEQ ID NO: 2964381 - DNA, 18 bp, Homo sapiens
tagattcgctgtcccctc

SEQ ID NO: 2964382 - DNA, 11 bp, Homo sapiens
tagattctaaa

SEQ ID NO: 2964383 - DNA, 12 bp, Homo sapiens
tagattctaaag

SEQ ID NO: 2964384 - DNA, 13 bp, Homo sapiens
tagattctaaaga

SEQ ID NO: 2964385 - DNA, 17 bp, Homo sapiens
tagattctaaagattct

SEQ ID NO: 2964386 - DNA, 23 bp, Homo sapiens
tagattctctggctgtaaggctc

SEQ ID NO: 2964387 - DNA, 20 bp, Homo sapiens
tagattctctgtgtctaaga

SEQ ID NO: 2964388 - DNA, 23 bp, Homo sapiens
tagattgaaaacttttctcagat

SEQ ID NO: 2964389 - DNA, 16 bp, Homo sapiens
tagattgtattaacta

SEQ ID NO: 2964390 - DNA, 13 bp, Homo sapiens
tagatttattaga

SEQ ID NO: 2964391 - DNA, 20 bp, Homo sapiens
tagatttggctcctctgctt

SEQ ID NO: 2964392 - DNA, 17 bp, Homo sapiens
tagattttctggttcta

SEQ ID NO: 2964393 - DNA, 14 bp, Homo sapiens
tagcaaaaacatgt

SEQ ID NO: 2964394 - DNA, 14 bp, Homo sapiens
tagcaaactttgta

SEQ ID NO: 2964395 - DNA, 17 bp, Homo sapiens
tagcaaagatatatatt

SEQ ID NO: 2964396 - DNA, 18 bp, Homo sapiens
tagcaagtgaatttttct

SEQ ID NO: 2964397 - DNA, 22 bp, Homo sapiens
tagcaagtgaatttttctctaa

SEQ ID NO: 2964398 - DNA, 14 bp, Homo sapiens
tagcaatgtgtttc

SEQ ID NO: 2964399 - DNA, 21 bp, Homo sapiens
tagcacaacgtggtactattt

SEQ ID NO: 2964400 - DNA, 19 bp, Homo sapiens
tagcacaagttatttaaat

SEQ ID NO: 2964401 - DNA, 10 bp, Homo sapiens
tagcaccctg

SEQ ID NO: 2964402 - DNA, 16 bp, Homo sapiens
tagcactaccactcct

SEQ ID NO: 2964403 - DNA, 15 bp, Homo sapiens
tagcactcaggctct

SEQ ID NO: 2964404 - DNA, 23 bp, Homo sapiens
tagcagaaaccaagtctacttca

SEQ ID NO: 2964405 - DNA, 16 bp, Homo sapiens
tagcagacagaagtgt

SEQ ID NO: 2964406 - DNA, 11 bp, Homo sapiens
tagcagacagg

SEQ ID NO: 2964407 - DNA, 19 bp, Homo sapiens
tagcagacaggccccgtga

SEQ ID NO: 2964408 - DNA, 14 bp, Homo sapiens
tagcagcccaccct

SEQ ID NO: 2964409 - DNA, 13 bp, Homo sapiens
tagcagcccagca

SEQ ID NO: 2964410 - DNA, 17 bp, Homo sapiens
tagcaggagaggagagc

SEQ ID NO: 2964411 - DNA, 19 bp, Homo sapiens
tagcaggagaggagagcca

SEQ ID NO: 2964412 - DNA, 22 bp, Homo sapiens
tagcaggagaggagagccagag

SEQ ID NO: 2964413 - DNA, 14 bp, Homo sapiens
tagcaggcccccta

SEQ ID NO: 2964414 - DNA, 18 bp, Homo sapiens
tagcaggccccctaggat

SEQ ID NO: 2964415 - DNA, 16 bp, Homo sapiens
tagcaggggctgcagt

SEQ ID NO: 2964416 - DNA, 17 bp, Homo sapiens
tagcaggtaccactgat

SEQ ID NO: 2964417 - DNA, 15 bp, Homo sapiens
tagcataaatttaat

SEQ ID NO: 2964418 - DNA, 13 bp, Homo sapiens
tagcataagggct

SEQ ID NO: 2964419 - DNA, 12 bp, Homo sapiens
tagcataggcta

SEQ ID NO: 2964420 - DNA, 14 bp, Homo sapiens
tagcatccaggctg

SEQ ID NO: 2964421 - DNA, 16 bp, Homo sapiens
tagcatgacatttctt

SEQ ID NO: 2964422 - DNA, 13 bp, Homo sapiens
tagcatgccaaca

SEQ ID NO: 2964423 - DNA, 19 bp, Homo sapiens
tagcatgccaacaagaatg

SEQ ID NO: 2964424 - DNA, 13 bp, Homo sapiens
tagcatgtgactc

SEQ ID NO: 2964425 - DNA, 17 bp, Homo sapiens
tagccacaccaggatag

SEQ ID NO: 2964426 - DNA, 18 bp, Homo sapiens
tagccacaggagccctgc

SEQ ID NO: 2964427 - DNA, 18 bp, Homo sapiens
tagccaccgcctcctaca

SEQ ID NO: 2964428 - DNA, 21 bp, Homo sapiens
tagccaccttgattttcttct

SEQ ID NO: 2964429 - DNA, 13 bp, Homo sapiens
tagccagcttcac

SEQ ID NO: 2964430 - DNA, 20 bp, Homo sapiens
tagccagtgaaacacttgct

SEQ ID NO: 2964431 - DNA, 22 bp, Homo sapiens
tagccatgcatttgatttgttt

SEQ ID NO: 2964432 - DNA, 15 bp, Homo sapiens
tagcccactctgctc

SEQ ID NO: 2964433 - DNA, 14 bp, Homo sapiens
tagcccaggctgga

SEQ ID NO: 2964434 - DNA, 13 bp, Homo sapiens
tagccccagactg

SEQ ID NO: 2964435 - DNA, 21 bp, Homo sapiens
tagccccagactgggcccagg

SEQ ID NO: 2964436 - DNA, 17 bp, Homo sapiens
tagccccagtcagaagt

SEQ ID NO: 2964437 - DNA, 14 bp, Homo sapiens
tagcccctcccaag

SEQ ID NO: 2964438 - DNA, 16 bp, Homo sapiens
tagccctcccactttg

SEQ ID NO: 2964439 - DNA, 21 bp, Homo sapiens
tagccctctcatcgtctttta

SEQ ID NO: 2964440 - DNA, 15 bp, Homo sapiens
tagccctctccctct

SEQ ID NO: 2964441 - DNA, 15 bp, Homo sapiens
tagccgaactccagg

SEQ ID NO: 2964442 - DNA, 17 bp, Homo sapiens
tagccgactgcgctgct

SEQ ID NO: 2964443 - DNA, 18 bp, Homo sapiens
tagccgagagcctgctcc

SEQ ID NO: 2964444 - DNA, 19 bp, Homo sapiens
tagccgcccatgcactggg

SEQ ID NO: 2964445 - DNA, 14 bp, Homo sapiens
tagccgccctgaga

SEQ ID NO: 2964446 - DNA, 17 bp, Homo sapiens
tagccggaaggccgagg

SEQ ID NO: 2964447 - DNA, 15 bp, Homo sapiens
tagccgggcatggtg

SEQ ID NO: 2964448 - DNA, 19 bp, Homo sapiens
tagccgggcatggtggcgc

SEQ ID NO: 2964449 - DNA, 11 bp, Homo sapiens
tagcctaccat

SEQ ID NO: 2964450 - DNA, 19 bp, Homo sapiens
tagcctccttcgcaggcat

SEQ ID NO: 2964451 - DNA, 13 bp, Homo sapiens
tagcctgatgaga

SEQ ID NO: 2964452 - DNA, 20 bp, Homo sapiens
tagcctgcactttgggtttt

SEQ ID NO: 2964453 - DNA, 18 bp, Homo sapiens
tagcctggatagccttga

SEQ ID NO: 2964454 - DNA, 14 bp, Homo sapiens
tagcctggggtggg

SEQ ID NO: 2964455 - DNA, 13 bp, Homo sapiens
tagcctgtggccc

SEQ ID NO: 2964456 - DNA, 16 bp, Homo sapiens
tagcctgtggccctgt

SEQ ID NO: 2964457 - DNA, 20 bp, Homo sapiens
tagcctgtggccctgtcctg

SEQ ID NO: 2964458 - DNA, 13 bp, Homo sapiens
tagcctgtggcct

SEQ ID NO: 2964459 - DNA, 14 bp, Homo sapiens
tagccttgaaaaca

SEQ ID NO: 2964460 - DNA, 21 bp, Homo sapiens
tagcctttacatggacagaat

SEQ ID NO: 2964461 - DNA, 14 bp, Homo sapiens
tagcctttgacatt

SEQ ID NO: 2964462 - DNA, 23 bp, Homo sapiens
tagcctttgacattgatgtgttc

SEQ ID NO: 2964463 - DNA, 12 bp, Homo sapiens
tagcgctctgga

SEQ ID NO: 2964464 - DNA, 15 bp, Homo sapiens
tagcgtcctgccctg

SEQ ID NO: 2964465 - DNA, 20 bp, Homo sapiens
tagctaaacggattccaaag

SEQ ID NO: 2964466 - DNA, 15 bp, Homo sapiens
tagctaactgtaaat

SEQ ID NO: 2964467 - DNA, 17 bp, Homo sapiens
tagctaactgtaaatca

SEQ ID NO: 2964468 - DNA, 14 bp, Homo sapiens
tagctagaagtggg

SEQ ID NO: 2964469 - DNA, 13 bp, Homo sapiens
tagctagaggaac

SEQ ID NO: 2964470 - DNA, 14 bp, Homo sapiens
tagctagaggaacc

SEQ ID NO: 2964471 - DNA, 15 bp, Homo sapiens
tagctagccagccaa

SEQ ID NO: 2964472 - DNA, 18 bp, Homo sapiens
tagctagctatttctatg

SEQ ID NO: 2964473 - DNA, 16 bp, Homo sapiens
tagctatttctatgta

SEQ ID NO: 2964474 - DNA, 23 bp, Homo sapiens
tagctcaagagaaaagttgacac

SEQ ID NO: 2964475 - DNA, 19 bp, Homo sapiens
tagctccaagctgttaaag

SEQ ID NO: 2964476 - DNA, 17 bp, Homo sapiens
tagctcctcctcctggg

SEQ ID NO: 2964477 - DNA, 14 bp, Homo sapiens
tagctccttgaaga

SEQ ID NO: 2964478 - DNA, 15 bp, Homo sapiens
tagctccttgaagac

SEQ ID NO: 2964479 - DNA, 13 bp, Homo sapiens
tagctctggacgt

SEQ ID NO: 2964480 - DNA, 17 bp, Homo sapiens
tagctcttcacttcctc

SEQ ID NO: 2964481 - DNA, 17 bp, Homo sapiens
tagctgacacagaaaaa

SEQ ID NO: 2964482 - DNA, 14 bp, Homo sapiens
tagaaaagcacttg

SEQ ID NO: 2964483 - DNA, 14 bp, Homo sapiens
tagaaaagttatta

SEQ ID NO: 2964484 - DNA, 22 bp, Homo sapiens
tagaaaatttgttattttgcaa

SEQ ID NO: 2964485 - DNA, 23 bp, Homo sapiens
tagaaaatttgttattttgcaac

SEQ ID NO: 2964486 - DNA, 16 bp, Homo sapiens
tagaaacaccattcat

SEQ ID NO: 2964487 - DNA, 21 bp, Homo sapiens
tagaaacctttatccctgctt

SEQ ID NO: 2964488 - DNA, 19 bp, Homo sapiens
tagaaactaattgacttta

SEQ ID NO: 2964489 - DNA, 16 bp, Homo sapiens
tagaaagatacactga

SEQ ID NO: 2964490 - DNA, 18 bp, Homo sapiens
tagaaagctgacattgcc

SEQ ID NO: 2964491 - DNA, 13 bp, Homo sapiens
tagaaaggagaga

SEQ ID NO: 2964492 - DNA, 20 bp, Homo sapiens
tagaaataaaggatgtgatt

SEQ ID NO: 2964493 - DNA, 16 bp, Homo sapiens
tagaaataaattccta

SEQ ID NO: 2964494 - DNA, 13 bp, Homo sapiens
tagaaatcacaac

SEQ ID NO: 2964495 - DNA, 19 bp, Homo sapiens
tagaaatgatgatgtggaa

SEQ ID NO: 2964496 - DNA, 16 bp, Homo sapiens
tagaaatggaaatttt

SEQ ID NO: 2964497 - DNA, 17 bp, Homo sapiens
tagaaatggaaattttg

SEQ ID NO: 2964498 - DNA, 18 bp, Homo sapiens
tagaaatggtttcctctg

SEQ ID NO: 2964499 - DNA, 15 bp, Homo sapiens
tagaaatgtagcagc

SEQ ID NO: 2964500 - DNA, 13 bp, Homo sapiens
tagaaattcttaa

SEQ ID NO: 2964501 - DNA, 20 bp, Homo sapiens
tagaacaaaggacagagtat

SEQ ID NO: 2964502 - DNA, 23 bp, Homo sapiens
tagaacaatgtacaaggtatgta

SEQ ID NO: 2964503 - DNA, 17 bp, Homo sapiens
tagaacaattttcttgt

SEQ ID NO: 2964504 - DNA, 17 bp, Homo sapiens
tagaacacagagtgtgt

SEQ ID NO: 2964505 - DNA, 14 bp, Homo sapiens
tagaacattcagat

SEQ ID NO: 2964506 - DNA, 15 bp, Homo sapiens
tagaaccactatgaa

SEQ ID NO: 2964507 - DNA, 16 bp, Homo sapiens
tagaaccactatgaag

SEQ ID NO: 2964508 - DNA, 20 bp, Homo sapiens
tagaacccttctgctttcta

SEQ ID NO: 2964509 - DNA, 16 bp, Homo sapiens
tagaacgagagtgcct

SEQ ID NO: 2964510 - DNA, 19 bp, Homo sapiens
tagaacgagcctggaagca

SEQ ID NO: 2964511 - DNA, 22 bp, Homo sapiens
tagaacgtccagggtttacatt

SEQ ID NO: 2964512 - DNA, 23 bp, Homo sapiens
tagaacttctccgtcctcgatgg

SEQ ID NO: 2964513 - DNA, 19 bp, Homo sapiens
tagaactttaagcaacaag

SEQ ID NO: 2964514 - DNA, 16 bp, Homo sapiens
tagaagataacatttt

SEQ ID NO: 2964515 - DNA, 23 bp, Homo sapiens
tagaagccacccttccctgcctc

SEQ ID NO: 2964516 - DNA, 19 bp, Homo sapiens
tagaaggttgacacagttg

SEQ ID NO: 2964517 - DNA, 17 bp, Homo sapiens
tagaagtaagaagagga

SEQ ID NO: 2964518 - DNA, 14 bp, Homo sapiens
tagaagtagattct

SEQ ID NO: 2964519 - DNA, 16 bp, Homo sapiens
tagaagtgctcccctc

SEQ ID NO: 2964520 - DNA, 18 bp, Homo sapiens
tagaagtggaccaggaca

SEQ ID NO: 2964521 - DNA, 16 bp, Homo sapiens
tagaagtgggccagga

SEQ ID NO: 2964522 - DNA, 15 bp, Homo sapiens
tagaagtgtcatgtt

SEQ ID NO: 2964523 - DNA, 15 bp, Homo sapiens
tagaagttttaaatt

SEQ ID NO: 2964524 - DNA, 21 bp, Homo sapiens
tagaatagcctgtggcctttg

SEQ ID NO: 2964525 - DNA, 13 bp, Homo sapiens
tagaatcctgctt

SEQ ID NO: 2964526 - DNA, 18 bp, Homo sapiens
tagaatctgcaattcaaa

SEQ ID NO: 2964527 - DNA, 22 bp, Homo sapiens
tagaatctgcaattcaaaagtt

SEQ ID NO: 2964528 - DNA, 20 bp, Homo sapiens
tagaatctttattcaaactt

SEQ ID NO: 2964529 - DNA, 18 bp, Homo sapiens
tagaatgaaccactgccc

SEQ ID NO: 2964530 - DNA, 20 bp, Homo sapiens
tagaatgaagaactgcatgt

SEQ ID NO: 2964531 - DNA, 14 bp, Homo sapiens
tagaatgataaatg

SEQ ID NO: 2964532 - DNA, 20 bp, Homo sapiens
tagaatgcatctcatcaact

SEQ ID NO: 2964533 - DNA, 15 bp, Homo sapiens
tagaatgtaaagctt

SEQ ID NO: 2964534 - DNA, 18 bp, Homo sapiens
tagaatgtattgtacctt

SEQ ID NO: 2964535 - DNA, 12 bp, Homo sapiens
tagaatgtgatt

SEQ ID NO: 2964536 - DNA, 13 bp, Homo sapiens
tagaatgtgattt

SEQ ID NO: 2964537 - DNA, 14 bp, Homo sapiens
tagaattaaaaaag

SEQ ID NO: 2964538 - DNA, 21 bp, Homo sapiens
tagaattaaaaaagcatactt

SEQ ID NO: 2964539 - DNA, 13 bp, Homo sapiens
tagaattaaaatt

SEQ ID NO: 2964540 - DNA, 23 bp, Homo sapiens
tagaattatttcacaaataatag

SEQ ID NO: 2964541 - DNA, 16 bp, Homo sapiens
tagaattctagctttt

SEQ ID NO: 2964542 - DNA, 14 bp, Homo sapiens
tagaattctctggg

SEQ ID NO: 2964543 - DNA, 15 bp, Homo sapiens
tagaattgatttcca

SEQ ID NO: 2964544 - DNA, 21 bp, Homo sapiens
tagaattgatttccaagaatc

SEQ ID NO: 2964545 - DNA, 13 bp, Homo sapiens
tagaattgcattg

SEQ ID NO: 2964546 - DNA, 13 bp, Homo sapiens
tagaatttcctaa

SEQ ID NO: 2964547 - DNA, 14 bp, Homo sapiens
tagacaaatactca

SEQ ID NO: 2964548 - DNA, 17 bp, Homo sapiens
tagacaaatactcatgt

SEQ ID NO: 2964549 - DNA, 18 bp, Homo sapiens
tagacaaatactcatgtg

SEQ ID NO: 2964550 - DNA, 19 bp, Homo sapiens
tagacaaatactcatgtgt

SEQ ID NO: 2964551 - DNA, 20 bp, Homo sapiens
tagacaaatactcatgtgta

SEQ ID NO: 2964552 - DNA, 21 bp, Homo sapiens
tagacaaatactcatgtgtat

SEQ ID NO: 2964553 - DNA, 15 bp, Homo sapiens
tagacaagccagaac

SEQ ID NO: 2964554 - DNA, 14 bp, Homo sapiens
tagacaccctggca

SEQ ID NO: 2964555 - DNA, 21 bp, Homo sapiens
tagacactccccgaagtcttt

SEQ ID NO: 2964556 - DNA, 16 bp, Homo sapiens
tagacagttttgagaa

SEQ ID NO: 2964557 - DNA, 19 bp, Homo sapiens
tagacatggaggttctaag

SEQ ID NO: 2964558 - DNA, 14 bp, Homo sapiens
tagacattatcttt

SEQ ID NO: 2964559 - DNA, 23 bp, Homo sapiens
tagacatttcaaaattaatagct

SEQ ID NO: 2964560 - DNA, 17 bp, Homo sapiens
tagacattttaacaaga

SEQ ID NO: 2964561 - DNA, 15 bp, Homo sapiens
tagaccaaaaggaga

SEQ ID NO: 2964562 - DNA, 18 bp, Homo sapiens
tagaccctctttcttgtt

SEQ ID NO: 2964563 - DNA, 13 bp, Homo sapiens
tagaccgttataa

SEQ ID NO: 2964564 - DNA, 21 bp, Homo sapiens
tagactaagaataagaagcat

SEQ ID NO: 2964565 - DNA, 23 bp, Homo sapiens
tagactaaggccattattgtact

SEQ ID NO: 2964566 - DNA, 22 bp, Homo sapiens
tagactatggaatgtcagtgtt

SEQ ID NO: 2964567 - DNA, 21 bp, Homo sapiens
tagactattccttttctgtat

SEQ ID NO: 2964568 - DNA, 21 bp, Homo sapiens
tagactcatggtgtgttacac

SEQ ID NO: 2964569 - DNA, 14 bp, Homo sapiens
tagactggacagct

SEQ ID NO: 2964570 - DNA, 18 bp, Homo sapiens
tagactggacagcttgtg

SEQ ID NO: 2964571 - DNA, 22 bp, Homo sapiens
tagagaaactttgagtacagat

SEQ ID NO: 2964572 - DNA, 14 bp, Homo sapiens
tagagaacaaagta

SEQ ID NO: 2964573 - DNA, 12 bp, Homo sapiens
tagagaactgaa

SEQ ID NO: 2964574 - DNA, 16 bp, Homo sapiens
tagagaactgaaaaga

SEQ ID NO: 2964575 - DNA, 21 bp, Homo sapiens
tagagaactgaaaagagagca

SEQ ID NO: 2964576 - DNA, 15 bp, Homo sapiens
tagagaatgagaaat

SEQ ID NO: 2964577 - DNA, 15 bp, Homo sapiens
tagagagaaaaagaa

SEQ ID NO: 2964578 - DNA, 16 bp, Homo sapiens
tagagatatttaaaag

SEQ ID NO: 2964579 - DNA, 11 bp, Homo sapiens
tagagcactgc

SEQ ID NO: 2964580 - DNA, 12 bp, Homo sapiens
tagagcattaaa

SEQ ID NO: 2964581 - DNA, 20 bp, Homo sapiens
tagagcattaaaataactat

SEQ ID NO: 2964582 - DNA, 14 bp, Homo sapiens
tagagccagccttg

SEQ ID NO: 2964583 - DNA, 13 bp, Homo sapiens
tagagcctttgat

SEQ ID NO: 2964584 - DNA, 11 bp, Homo sapiens
tagagctgcca

SEQ ID NO: 2964585 - DNA, 18 bp, Homo sapiens
tagagctgccactgggca

SEQ ID NO: 2964586 - DNA, 17 bp, Homo sapiens
tagagctgttcaacatc

SEQ ID NO: 2964587 - DNA, 20 bp, Homo sapiens
tagagcttctgtattttcaa

SEQ ID NO: 2964588 - DNA, 18 bp, Homo sapiens
tagaggctttgagcaact

SEQ ID NO: 2964589 - DNA, 21 bp, Homo sapiens
tagagggacggccaagaatgt

SEQ ID NO: 2964590 - DNA, 24 bp, Homo sapiens
tagaggggaaaagagatgatgaaa

SEQ ID NO: 2964591 - DNA, 19 bp, Homo sapiens
tagaggggaaacgagaagg

SEQ ID NO: 2964592 - DNA, 14 bp, Homo sapiens
tagagtaagaaatt

SEQ ID NO: 2964593 - DNA, 22 bp, Homo sapiens
tagagtagggtagaaggaaagc

SEQ ID NO: 2964594 - DNA, 14 bp, Homo sapiens
tagagttcttttgg

SEQ ID NO: 2964595 - DNA, 19 bp, Homo sapiens
tagagttggcctttttaca

SEQ ID NO: 2964596 - DNA, 17 bp, Homo sapiens
tagagtttacagctctg

SEQ ID NO: 2964597 - DNA, 18 bp, Homo sapiens
tagagtttatacagtgta

SEQ ID NO: 2964598 - DNA, 22 bp, Homo sapiens
tagagtttatttttttgatggc

SEQ ID NO: 2964599 - DNA, 23 bp, Homo sapiens
tagagtttatttttttgatggct

SEQ ID NO: 2964600 - DNA, 15 bp, Homo sapiens
tagataaaggaaaca

SEQ ID NO: 2964601 - DNA, 18 bp, Homo sapiens
tagataactgctctttta

SEQ ID NO: 2964602 - DNA, 20 bp, Homo sapiens
tagataactgctcttttact

SEQ ID NO: 2964603 - DNA, 18 bp, Homo sapiens
tagataatcttttacatt

SEQ ID NO: 2964604 - DNA, 17 bp, Homo sapiens
tagatagttagaacctg

SEQ ID NO: 2964605 - DNA, 20 bp, Homo sapiens
tagatcagatgctccaagat

SEQ ID NO: 2964606 - DNA, 14 bp, Homo sapiens
tagatcataaggct

SEQ ID NO: 2964607 - DNA, 20 bp, Homo sapiens
tagatccaggcttctcccgg

SEQ ID NO: 2964608 - DNA, 21 bp, Homo sapiens
tagatccaggcttctcccgga

SEQ ID NO: 2964609 - DNA, 18 bp, Homo sapiens
tagatcccacatcgtata

SEQ ID NO: 2964610 - DNA, 17 bp, Homo sapiens
tagatcccatatttact

SEQ ID NO: 2964611 - DNA, 14 bp, Homo sapiens
tagatctcagccat

SEQ ID NO: 2964612 - DNA, 21 bp, Homo sapiens
tagatctgctttctgttcatc

SEQ ID NO: 2964613 - DNA, 22 bp, Homo sapiens
tagatctgctttctgttcatct

SEQ ID NO: 2964614 - DNA, 22 bp, Homo sapiens
tagatcttcaatttggatattt

SEQ ID NO: 2964615 - DNA, 22 bp, Homo sapiens
tagatgacataaaatttacatt

SEQ ID NO: 2964616 - DNA, 22 bp, Homo sapiens
tagatgacctcattaaccgatg

SEQ ID NO: 2964617 - DNA, 16 bp, Homo sapiens
tagatgactttgcaga

SEQ ID NO: 2964618 - DNA, 11 bp, Homo sapiens
tactctcttcc

SEQ ID NO: 2964619 - DNA, 19 bp, Homo sapiens
tactctgaagggcatcatg

SEQ ID NO: 2964620 - DNA, 22 bp, Homo sapiens
tactctgaagggcatcatgcat

SEQ ID NO: 2964621 - DNA, 13 bp, Homo sapiens
tactctgttgcct

SEQ ID NO: 2964622 - DNA, 14 bp, Homo sapiens
tactctgttgcctc

SEQ ID NO: 2964623 - DNA, 17 bp, Homo sapiens
tactctgttgcctcctc

SEQ ID NO: 2964624 - DNA, 20 bp, Homo sapiens
tactctgttgcctcctctct

SEQ ID NO: 2964625 - DNA, 22 bp, Homo sapiens
tactctgttgcctcctctctcc

SEQ ID NO: 2964626 - DNA, 23 bp, Homo sapiens
tactctgttgcctcctctctccc

SEQ ID NO: 2964627 - DNA, 16 bp, Homo sapiens
tactcttaagccatct

SEQ ID NO: 2964628 - DNA, 23 bp, Homo sapiens
tactcttaagccatcttggtaaa

SEQ ID NO: 2964629 - DNA, 19 bp, Homo sapiens
tactctttacccttgagcc

SEQ ID NO: 2964630 - DNA, 21 bp, Homo sapiens
tactctttacccttgagccct

SEQ ID NO: 2964631 - DNA, 13 bp, Homo sapiens
tactctttctgta

SEQ ID NO: 2964632 - DNA, 15 bp, Homo sapiens
tactctttctgtata

SEQ ID NO: 2964633 - DNA, 20 bp, Homo sapiens
tactgaaaggttaccctgta

SEQ ID NO: 2964634 - DNA, 12 bp, Homo sapiens
tactgaaatctt

SEQ ID NO: 2964635 - DNA, 16 bp, Homo sapiens
tactgaaccagccacg

SEQ ID NO: 2964636 - DNA, 22 bp, Homo sapiens
tactgaactgtgtgtaattgtt

SEQ ID NO: 2964637 - DNA, 16 bp, Homo sapiens
tactgaagttgggaaa

SEQ ID NO: 2964638 - DNA, 20 bp, Homo sapiens
tactgacaatgtattttgga

SEQ ID NO: 2964639 - DNA, 13 bp, Homo sapiens
tactgacttggat

SEQ ID NO: 2964640 - DNA, 16 bp, Homo sapiens
tactgagcgcaagcca

SEQ ID NO: 2964641 - DNA, 22 bp, Homo sapiens
tactgagcgcaagccacagcct

SEQ ID NO: 2964642 - DNA, 20 bp, Homo sapiens
tactgagctgctaaaataaa

SEQ ID NO: 2964643 - DNA, 20 bp, Homo sapiens
tactgataaaaatgatattg

SEQ ID NO: 2964644 - DNA, 17 bp, Homo sapiens
tactgatcatctgctgt

SEQ ID NO: 2964645 - DNA, 16 bp, Homo sapiens
tactgatcttaccttt

SEQ ID NO: 2964646 - DNA, 13 bp, Homo sapiens
tactgatttaatt

SEQ ID NO: 2964647 - DNA, 22 bp, Homo sapiens
tactgcaacttaacttaaaatt

SEQ ID NO: 2964648 - DNA, 21 bp, Homo sapiens
tactgcaaggttcaacttatt

SEQ ID NO: 2964649 - DNA, 13 bp, Homo sapiens
tactgcaataaat

SEQ ID NO: 2964650 - DNA, 18 bp, Homo sapiens
tactgcatgtttgctgtt

SEQ ID NO: 2964651 - DNA, 19 bp, Homo sapiens
tactgcatgtttgctgttc

SEQ ID NO: 2964652 - DNA, 20 bp, Homo sapiens
tactgccaaaacatttatga

SEQ ID NO: 2964653 - DNA, 14 bp, Homo sapiens
tactgccagatgct

SEQ ID NO: 2964654 - DNA, 21 bp, Homo sapiens
tactgccagatgctgatgttc

SEQ ID NO: 2964655 - DNA, 16 bp, Homo sapiens
tactgcccctctccga

SEQ ID NO: 2964656 - DNA, 19 bp, Homo sapiens
tactgctatctactaagtt

SEQ ID NO: 2964657 - DNA, 13 bp, Homo sapiens
tactgcttgctta

SEQ ID NO: 2964658 - DNA, 17 bp, Homo sapiens
tactggcatagtttcat

SEQ ID NO: 2964659 - DNA, 19 bp, Homo sapiens
tactggctcctctgtggtg

SEQ ID NO: 2964660 - DNA, 12 bp, Homo sapiens
tactggtgtaat

SEQ ID NO: 2964661 - DNA, 20 bp, Homo sapiens
tactggtgtaatctcaatgc

SEQ ID NO: 2964662 - DNA, 21 bp, Homo sapiens
tactgtaaagaaagagagaaa

SEQ ID NO: 2964663 - DNA, 11 bp, Homo sapiens
tactgtaaatt

SEQ ID NO: 2964664 - DNA, 12 bp, Homo sapiens
tactgtaaattt

SEQ ID NO: 2964665 - DNA, 15 bp, Homo sapiens
tactgtaagacatta

SEQ ID NO: 2964666 - DNA, 18 bp, Homo sapiens
tactgtacaataaaaaca

SEQ ID NO: 2964667 - DNA, 17 bp, Homo sapiens
tactgtagaactgattt

SEQ ID NO: 2964668 - DNA, 19 bp, Homo sapiens
tactgtagaactgatttta

SEQ ID NO: 2964669 - DNA, 14 bp, Homo sapiens
tactgtagtattct

SEQ ID NO: 2964670 - DNA, 17 bp, Homo sapiens
tactgtattttgtattg

SEQ ID NO: 2964671 - DNA, 19 bp, Homo sapiens
tactgtcccacttctcatc

SEQ ID NO: 2964672 - DNA, 21 bp, Homo sapiens
tactgtccctctcagtgcctt

SEQ ID NO: 2964673 - DNA, 16 bp, Homo sapiens
tactgtctaagcagtt

SEQ ID NO: 2964674 - DNA, 21 bp, Homo sapiens
tactgtctaagcagttttgta

SEQ ID NO: 2964675 - DNA, 23 bp, Homo sapiens
tactgtctctggcatttgtttcc

SEQ ID NO: 2964676 - DNA, 17 bp, Homo sapiens
tactgtgagcttacatt

SEQ ID NO: 2964677 - DNA, 16 bp, Homo sapiens
tactgtgggcaattta

SEQ ID NO: 2964678 - DNA, 18 bp, Homo sapiens
tactgtgggcaatttaga

SEQ ID NO: 2964679 - DNA, 19 bp, Homo sapiens
tactgtgggcaatttagaa

SEQ ID NO: 2964680 - DNA, 22 bp, Homo sapiens
tactgtgtgtgtgaatgaacac

SEQ ID NO: 2964681 - DNA, 18 bp, Homo sapiens
tactgtgttttataaaat

SEQ ID NO: 2964682 - DNA, 13 bp, Homo sapiens
tactgttaagaat

SEQ ID NO: 2964683 - DNA, 23 bp, Homo sapiens
tactgttaagaataataaaatac

SEQ ID NO: 2964684 - DNA, 17 bp, Homo sapiens
tactgttactgggccct

SEQ ID NO: 2964685 - DNA, 21 bp, Homo sapiens
tactgttatccatattacgtt

SEQ ID NO: 2964686 - DNA, 14 bp, Homo sapiens
tactgttctaaagc

SEQ ID NO: 2964687 - DNA, 19 bp, Homo sapiens
tactgttctaaagctctga

SEQ ID NO: 2964688 - DNA, 14 bp, Homo sapiens
tactgttgtgacct

SEQ ID NO: 2964689 - DNA, 19 bp, Homo sapiens
tactgttttatctggcccc

SEQ ID NO: 2964690 - DNA, 17 bp, Homo sapiens
tactgttttctgggcca

SEQ ID NO: 2964691 - DNA, 23 bp, Homo sapiens
tacttaaaaatagtcttccacaa

SEQ ID NO: 2964692 - DNA, 12 bp, Homo sapiens
tacttaaacagc

SEQ ID NO: 2964693 - DNA, 15 bp, Homo sapiens
tacttaaacagcttt

SEQ ID NO: 2964694 - DNA, 20 bp, Homo sapiens
tacttaaatggaaaaaatga

SEQ ID NO: 2964695 - DNA, 15 bp, Homo sapiens
tacttaataaaacat

SEQ ID NO: 2964696 - DNA, 15 bp, Homo sapiens
tacttacattctcta

SEQ ID NO: 2964697 - DNA, 19 bp, Homo sapiens
tacttagatatttcatgtg

SEQ ID NO: 2964698 - DNA, 14 bp, Homo sapiens
tacttagctggcca

SEQ ID NO: 2964699 - DNA, 16 bp, Homo sapiens
tacttagctggccaag

SEQ ID NO: 2964700 - DNA, 17 bp, Homo sapiens
tacttagtagattaaaa

SEQ ID NO: 2964701 - DNA, 21 bp, Homo sapiens
tacttatccctgcccatttca

SEQ ID NO: 2964702 - DNA, 12 bp, Homo sapiens
tacttcaaaagt

SEQ ID NO: 2964703 - DNA, 14 bp, Homo sapiens
tacttcagcaagag

SEQ ID NO: 2964704 - DNA, 17 bp, Homo sapiens
tacttcagcaagagaga

SEQ ID NO: 2964705 - DNA, 19 bp, Homo sapiens
tacttcaggggcacttcat

SEQ ID NO: 2964706 - DNA, 16 bp, Homo sapiens
tacttcattttcagag

SEQ ID NO: 2964707 - DNA, 12 bp, Homo sapiens
tacttccagcaa

SEQ ID NO: 2964708 - DNA, 15 bp, Homo sapiens
tacttccagcaaaat

SEQ ID NO: 2964709 - DNA, 16 bp, Homo sapiens
tacttccagcaaaatc

SEQ ID NO: 2964710 - DNA, 18 bp, Homo sapiens
tacttccagcaaaatcca

SEQ ID NO: 2964711 - DNA, 22 bp, Homo sapiens
tacttccagcaaaatccaaact

SEQ ID NO: 2964712 - DNA, 23 bp, Homo sapiens
tacttccagcaaaatccaaactg

SEQ ID NO: 2964713 - DNA, 14 bp, Homo sapiens
tacttccctcaggc

SEQ ID NO: 2964714 - DNA, 21 bp, Homo sapiens
tacttccctcaggcctatgca

SEQ ID NO: 2964715 - DNA, 20 bp, Homo sapiens
tacttctgaaataaatgttc

SEQ ID NO: 2964716 - DNA, 23 bp, Homo sapiens
tacttctgaaataaatgttctct

SEQ ID NO: 2964717 - DNA, 19 bp, Homo sapiens
tacttgaagggccagagcc

SEQ ID NO: 2964718 - DNA, 21 bp, Homo sapiens
tacttgaagggccagagccag

SEQ ID NO: 2964719 - DNA, 13 bp, Homo sapiens
tacttgaagtaac

SEQ ID NO: 2964720 - DNA, 23 bp, Homo sapiens
tacttgaagtctaaaagcagaaa

SEQ ID NO: 2964721 - DNA, 18 bp, Homo sapiens
tacttgatatttccttca

SEQ ID NO: 2964722 - DNA, 16 bp, Homo sapiens
tacttgctcaggtact

SEQ ID NO: 2964723 - DNA, 20 bp, Homo sapiens
tacttgcttattacatttaa

SEQ ID NO: 2964724 - DNA, 15 bp, Homo sapiens
tacttgggagcctga

SEQ ID NO: 2964725 - DNA, 19 bp, Homo sapiens
tacttgggagcctgaggca

SEQ ID NO: 2964726 - DNA, 17 bp, Homo sapiens
tacttggtccaactgca

SEQ ID NO: 2964727 - DNA, 22 bp, Homo sapiens
tacttggtcccgtggatgctct

SEQ ID NO: 2964728 - DNA, 16 bp, Homo sapiens
tacttgtgatttcgat

SEQ ID NO: 2964729 - DNA, 18 bp, Homo sapiens
tacttgtgttacttgcca

SEQ ID NO: 2964730 - DNA, 18 bp, Homo sapiens
tactttaaaaatcagttt

SEQ ID NO: 2964731 - DNA, 14 bp, Homo sapiens
tactttaagtgata

SEQ ID NO: 2964732 - DNA, 15 bp, Homo sapiens
tactttactgcctga

SEQ ID NO: 2964733 - DNA, 21 bp, Homo sapiens
tactttcggagaaattctctt

SEQ ID NO: 2964734 - DNA, 22 bp, Homo sapiens
tactttctatttttatgatgac

SEQ ID NO: 2964735 - DNA, 17 bp, Homo sapiens
tactttctcttgtttaa

SEQ ID NO: 2964736 - DNA, 21 bp, Homo sapiens
tactttgattctgataatgct

SEQ ID NO: 2964737 - DNA, 21 bp, Homo sapiens
tactttgcctttccataatca

SEQ ID NO: 2964738 - DNA, 15 bp, Homo sapiens
tactttggatgactt

SEQ ID NO: 2964739 - DNA, 14 bp, Homo sapiens
tactttgtgctgat

SEQ ID NO: 2964740 - DNA, 17 bp, Homo sapiens
tactttgttgtttttaa

SEQ ID NO: 2964741 - DNA, 16 bp, Homo sapiens
tactttgtttttccat

SEQ ID NO: 2964742 - DNA, 19 bp, Homo sapiens
tactttgtttttccatgtg

SEQ ID NO: 2964743 - DNA, 12 bp, Homo sapiens
tacttttaacgt

SEQ ID NO: 2964744 - DNA, 16 bp, Homo sapiens
tacttttcattctctt

SEQ ID NO: 2964745 - DNA, 16 bp, Homo sapiens
tacttttccttacctt

SEQ ID NO: 2964746 - DNA, 21 bp, Homo sapiens
tacttttgataatagataact

SEQ ID NO: 2964747 - DNA, 13 bp, Homo sapiens
tacttttttaaat

SEQ ID NO: 2964748 - DNA, 20 bp, Homo sapiens
tacttttttaaatattttct

SEQ ID NO: 2964749 - DNA, 18 bp, Homo sapiens
tacttttttacactgagt

SEQ ID NO: 2964750 - DNA, 22 bp, Homo sapiens
tacttttttacactgagtttct

SEQ ID NO: 2964751 - DNA, 19 bp, Homo sapiens
tagaaaaagaacatgcagt

SEQ ID NO: 2964752 - DNA, 23 bp, Homo sapiens
tagaaaacaaaggagcattaagc

SEQ ID NO: 2964753 - DNA, 17 bp, Homo sapiens
tagaaaacccaagtttt

SEQ ID NO: 2964754 - DNA, 18 bp, Homo sapiens
cgggcctgtacagtctgt

SEQ ID NO: 2964755 - DNA, 16 bp, Homo sapiens
cgggcggtcctgcaca

SEQ ID NO: 2964756 - DNA, 13 bp, Homo sapiens
cgggctcgcccat

SEQ ID NO: 2964757 - DNA, 22 bp, Homo sapiens
cgggctgagggcatctctgagt

SEQ ID NO: 2964758 - DNA, 17 bp, Homo sapiens
cgggctgcaggtgctgc

SEQ ID NO: 2964759 - DNA, 14 bp, Homo sapiens
cgggctggccctgt

SEQ ID NO: 2964760 - DNA, 18 bp, Homo sapiens
cgggctggccctgtgcag

SEQ ID NO: 2964761 - DNA, 19 bp, Homo sapiens
cgggcttgactttggctga

SEQ ID NO: 2964762 - DNA, 15 bp, Homo sapiens
cgggcttttccccgg

SEQ ID NO: 2964763 - DNA, 14 bp, Homo sapiens
cggggaactcctgg

SEQ ID NO: 2964764 - DNA, 14 bp, Homo sapiens
cggggaagccagac

SEQ ID NO: 2964765 - DNA, 19 bp, Homo sapiens
cggggaccactgggcccct

SEQ ID NO: 2964766 - DNA, 16 bp, Homo sapiens
cggggaccttggtctg

SEQ ID NO: 2964767 - DNA, 20 bp, Homo sapiens
cggggaccttggtctgatcg

SEQ ID NO: 2964768 - DNA, 15 bp, Homo sapiens
cggggactgctggct

SEQ ID NO: 2964769 - DNA, 21 bp, Homo sapiens
cggggagggggcacggcaggc

SEQ ID NO: 2964770 - DNA, 22 bp, Homo sapiens
cggggagggggcacggcaggcg

SEQ ID NO: 2964771 - DNA, 18 bp, Homo sapiens
cggggatggatcttttct

SEQ ID NO: 2964772 - DNA, 17 bp, Homo sapiens
cggggcaagagggaagg

SEQ ID NO: 2964773 - DNA, 18 bp, Homo sapiens
cggggcaagagggaaggt

SEQ ID NO: 2964774 - DNA, 22 bp, Homo sapiens
cggggcccagcgctctcctgga

SEQ ID NO: 2964775 - DNA, 23 bp, Homo sapiens
cggggcccagcgctctcctggac

SEQ ID NO: 2964776 - DNA, 19 bp, Homo sapiens
cggggccctctctgcaccg

SEQ ID NO: 2964777 - DNA, 19 bp, Homo sapiens
cggggcctgggcaggaggg

SEQ ID NO: 2964778 - DNA, 22 bp, Homo sapiens
cggggctgctgtgtggacggcg

SEQ ID NO: 2964779 - DNA, 21 bp, Homo sapiens
cgggggcacgtgtgggccgtg

SEQ ID NO: 2964780 - DNA, 14 bp, Homo sapiens
cgggggcctgtggt

SEQ ID NO: 2964781 - DNA, 15 bp, Homo sapiens
cgggggcctgtggtg

SEQ ID NO: 2964782 - DNA, 19 bp, Homo sapiens
cgggggccttgaagactcc

SEQ ID NO: 2964783 - DNA, 20 bp, Homo sapiens
cgggggctgcccttgggcca

SEQ ID NO: 2964784 - DNA, 18 bp, Homo sapiens
cgggggctgtgactctgg

SEQ ID NO: 2964785 - DNA, 23 bp, Homo sapiens
cgggggctgtgactctgggcagg

SEQ ID NO: 2964786 - DNA, 22 bp, Homo sapiens
cgggggttgtggcccccgcccc

SEQ ID NO: 2964787 - DNA, 14 bp, Homo sapiens
cggggtccccgccc

SEQ ID NO: 2964788 - DNA, 18 bp, Homo sapiens
cggggtcctgggaggctg

SEQ ID NO: 2964789 - DNA, 22 bp, Homo sapiens
cggggtcctgggaggctgcagc

SEQ ID NO: 2964790 - DNA, 13 bp, Homo sapiens
cggggtctcctgg

SEQ ID NO: 2964791 - DNA, 17 bp, Homo sapiens
cggggtggggtgggggt

SEQ ID NO: 2964792 - DNA, 19 bp, Homo sapiens
cgggtcaacatttccaaaa

SEQ ID NO: 2964793 - DNA, 17 bp, Homo sapiens
cgggtcaccctgtgacc

SEQ ID NO: 2964794 - DNA, 17 bp, Homo sapiens
cgggtccacttgccagg

SEQ ID NO: 2964795 - DNA, 21 bp, Homo sapiens
cgggtccacttgccagggctc

SEQ ID NO: 2964796 - DNA, 22 bp, Homo sapiens
taccctcttcatggatggggga

SEQ ID NO: 2964797 - DNA, 17 bp, Homo sapiens
taccctgagctgaggca

SEQ ID NO: 2964798 - DNA, 23 bp, Homo sapiens
taccctgcgcccagtccttccac

SEQ ID NO: 2964799 - DNA, 12 bp, Homo sapiens
tacccttcctca

SEQ ID NO: 2964800 - DNA, 20 bp, Homo sapiens
taccgagttcaagtgatttt

SEQ ID NO: 2964801 - DNA, 14 bp, Homo sapiens
taccgcatggcagc

SEQ ID NO: 2964802 - DNA, 18 bp, Homo sapiens
taccgcatggcagctggg

SEQ ID NO: 2964803 - DNA, 19 bp, Homo sapiens
taccgtgagcgacaaagat

SEQ ID NO: 2964804 - DNA, 23 bp, Homo sapiens
taccgtgagtgacatagcctcat

SEQ ID NO: 2964805 - DNA, 23 bp, Homo sapiens
tacctaagaatttcactgtcttt

SEQ ID NO: 2964806 - DNA, 16 bp, Homo sapiens
tacctacaataaactg

SEQ ID NO: 2964807 - DNA, 23 bp, Homo sapiens
tacctactggtgtaatctcaatg

SEQ ID NO: 2964808 - DNA, 15 bp, Homo sapiens
tacctatattccttg

SEQ ID NO: 2964809 - DNA, 23 bp, Homo sapiens
tacctatattgatttaaaagtgt

SEQ ID NO: 2964810 - DNA, 12 bp, Homo sapiens
tacctatttgac

SEQ ID NO: 2964811 - DNA, 11 bp, Homo sapiens
tacctccctcc

SEQ ID NO: 2964812 - DNA, 13 bp, Homo sapiens
tacctcctgccca

SEQ ID NO: 2964813 - DNA, 15 bp, Homo sapiens
tacctcctgcccagg

SEQ ID NO: 2964814 - DNA, 11 bp, Homo sapiens
tacctctctcc

SEQ ID NO: 2964815 - DNA, 12 bp, Homo sapiens
tacctctctgtc

SEQ ID NO: 2964816 - DNA, 18 bp, Homo sapiens
tacctctctgtcccttgc

SEQ ID NO: 2964817 - DNA, 21 bp, Homo sapiens
tacctctctgtcccttgctgt

SEQ ID NO: 2964818 - DNA, 14 bp, Homo sapiens
tacctctgtgtgct

SEQ ID NO: 2964819 - DNA, 20 bp, Homo sapiens
tacctgcaacacaacatttg

SEQ ID NO: 2964820 - DNA, 19 bp, Homo sapiens
tacctgccctaagggactt

SEQ ID NO: 2964821 - DNA, 16 bp, Homo sapiens
tacctggacggtgcgc

SEQ ID NO: 2964822 - DNA, 16 bp, Homo sapiens
tacctgttctgtagct

SEQ ID NO: 2964823 - DNA, 17 bp, Homo sapiens
taccttaagatttttct

SEQ ID NO: 2964824 - DNA, 21 bp, Homo sapiens
taccttattgagcgtgattct

SEQ ID NO: 2964825 - DNA, 19 bp, Homo sapiens
taccttattgatctttgcc

SEQ ID NO: 2964826 - DNA, 15 bp, Homo sapiens
taccttcaatactta

SEQ ID NO: 2964827 - DNA, 16 bp, Homo sapiens
taccttgacctttgta

SEQ ID NO: 2964828 - DNA, 14 bp, Homo sapiens
tacctttcaaagct

SEQ ID NO: 2964829 - DNA, 15 bp, Homo sapiens
tacctttcaaagctt

SEQ ID NO: 2964830 - DNA, 21 bp, Homo sapiens
tacctttcacagcttttatca

SEQ ID NO: 2964831 - DNA, 22 bp, Homo sapiens
tacctttgtagttactcaagca

SEQ ID NO: 2964832 - DNA, 23 bp, Homo sapiens
taccttttttgttttttcaaaat

SEQ ID NO: 2964833 - DNA, 14 bp, Homo sapiens
tacgataaggaaga

SEQ ID NO: 2964834 - DNA, 16 bp, Homo sapiens
tacgatcaggcacagg

SEQ ID NO: 2964835 - DNA, 14 bp, Homo sapiens
tacgcaaggaagga

SEQ ID NO: 2964836 - DNA, 14 bp, Homo sapiens
tacgcacagacagg

SEQ ID NO: 2964837 - DNA, 21 bp, Homo sapiens
tacgctagagcatgctgcctg

SEQ ID NO: 2964838 - DNA, 14 bp, Homo sapiens
tacgctcatcacct

SEQ ID NO: 2964839 - DNA, 13 bp, Homo sapiens
tacgctctccttt

SEQ ID NO: 2964840 - DNA, 13 bp, Homo sapiens
tacgctgaagatg

SEQ ID NO: 2964841 - DNA, 14 bp, Homo sapiens
tacgctggtgctga

SEQ ID NO: 2964842 - DNA, 14 bp, Homo sapiens
tacgctttgattca

SEQ ID NO: 2964843 - DNA, 17 bp, Homo sapiens
tacgcttttctttgtta

SEQ ID NO: 2964844 - DNA, 19 bp, Homo sapiens
tacggaccaggtatagaga

SEQ ID NO: 2964845 - DNA, 14 bp, Homo sapiens
tacgggggctgtga

SEQ ID NO: 2964846 - DNA, 14 bp, Homo sapiens
tacgtctgggagaa

SEQ ID NO: 2964847 - DNA, 17 bp, Homo sapiens
tacgtgaccctctgctg

SEQ ID NO: 2964848 - DNA, 13 bp, Homo sapiens
tacgtttgtatgt

SEQ ID NO: 2964849 - DNA, 20 bp, Homo sapiens
tacgtttgtatgtgtgtaga

SEQ ID NO: 2964850 - DNA, 17 bp, Homo sapiens
tacgtttgtgcagaatc

SEQ ID NO: 2964851 - DNA, 21 bp, Homo sapiens
tacgtttgtgcagaatctcta

SEQ ID NO: 2964852 - DNA, 23 bp, Homo sapiens
tacgtttttaaataggctaattt

SEQ ID NO: 2964853 - DNA, 14 bp, Homo sapiens
tactaaagccaaac

SEQ ID NO: 2964854 - DNA, 18 bp, Homo sapiens
tactaaagccaaacatat

SEQ ID NO: 2964855 - DNA, 23 bp, Homo sapiens
tactaagacatagtctctaccta

SEQ ID NO: 2964856 - DNA, 16 bp, Homo sapiens
tactaagccaggaggc

SEQ ID NO: 2964857 - DNA, 19 bp, Homo sapiens
tactaaggtgactttctga

SEQ ID NO: 2964858 - DNA, 23 bp, Homo sapiens
tactaaggtgactttctgaaact

SEQ ID NO: 2964859 - DNA, 19 bp, Homo sapiens
tactaagttattttatgac

SEQ ID NO: 2964860 - DNA, 13 bp, Homo sapiens
tactaagtttcct

SEQ ID NO: 2964861 - DNA, 16 bp, Homo sapiens
tactaagtttcctttt

SEQ ID NO: 2964862 - DNA, 20 bp, Homo sapiens
tactaagtttccttttaatt

SEQ ID NO: 2964863 - DNA, 13 bp, Homo sapiens
tactaattccaca

SEQ ID NO: 2964864 - DNA, 16 bp, Homo sapiens
tactaattccacacct

SEQ ID NO: 2964865 - DNA, 21 bp, Homo sapiens
tactacatacctcatctcttg

SEQ ID NO: 2964866 - DNA, 13 bp, Homo sapiens
tactaccttgaaa

SEQ ID NO: 2964867 - DNA, 14 bp, Homo sapiens
tactactactgtta

SEQ ID NO: 2964868 - DNA, 15 bp, Homo sapiens
tactactactgttat

SEQ ID NO: 2964869 - DNA, 22 bp, Homo sapiens
tactactttgttaggattttca

SEQ ID NO: 2964870 - DNA, 16 bp, Homo sapiens
tactagaaataaataa

SEQ ID NO: 2964871 - DNA, 22 bp, Homo sapiens
tactagagtaaaggccatcaaa

SEQ ID NO: 2964872 - DNA, 20 bp, Homo sapiens
tactagggagccatttgaga

SEQ ID NO: 2964873 - DNA, 21 bp, Homo sapiens
tactagttgtgaccttagtgt

SEQ ID NO: 2964874 - DNA, 17 bp, Homo sapiens
tactataagaactttga

SEQ ID NO: 2964875 - DNA, 18 bp, Homo sapiens
tactatagaccaaaagga

SEQ ID NO: 2964876 - DNA, 14 bp, Homo sapiens
tactatctcactgc

SEQ ID NO: 2964877 - DNA, 16 bp, Homo sapiens
tactatctcactgctg

SEQ ID NO: 2964878 - DNA, 14 bp, Homo sapiens
tactatgcctgtgt

SEQ ID NO: 2964879 - DNA, 16 bp, Homo sapiens
tactattaatagaaca

SEQ ID NO: 2964880 - DNA, 14 bp, Homo sapiens
tactattttcattt

SEQ ID NO: 2964881 - DNA, 22 bp, Homo sapiens
tactcaatgttactatctgctt

SEQ ID NO: 2964882 - DNA, 13 bp, Homo sapiens
tactcagagctgc

SEQ ID NO: 2964883 - DNA, 23 bp, Homo sapiens
tactcagagctgcgggctgaggg

SEQ ID NO: 2964884 - DNA, 18 bp, Homo sapiens
tactcagcagccctcctc

SEQ ID NO: 2964885 - DNA, 23 bp, Homo sapiens
tactcagccctgggccccaccac

SEQ ID NO: 2964886 - DNA, 13 bp, Homo sapiens
tactcaggaagaa

SEQ ID NO: 2964887 - DNA, 15 bp, Homo sapiens
tactcaggaggctga

SEQ ID NO: 2964888 - DNA, 22 bp, Homo sapiens
tactcaggaggctgagacagga

SEQ ID NO: 2964889 - DNA, 14 bp, Homo sapiens
tactcaggggatgt

SEQ ID NO: 2964890 - DNA, 17 bp, Homo sapiens
tactcaggggatgttta

SEQ ID NO: 2964891 - DNA, 19 bp, Homo sapiens
tactcataatgtgaagtgt

SEQ ID NO: 2964892 - DNA, 20 bp, Homo sapiens
tactcatcgggcccagggac

SEQ ID NO: 2964893 - DNA, 21 bp, Homo sapiens
tactcatctttatcctaaaaa

SEQ ID NO: 2964894 - DNA, 12 bp, Homo sapiens
tactcatgtgta

SEQ ID NO: 2964895 - DNA, 14 bp, Homo sapiens
tactcatgtgtatg

SEQ ID NO: 2964896 - DNA, 13 bp, Homo sapiens
tactccagcctgg

SEQ ID NO: 2964897 - DNA, 21 bp, Homo sapiens
tactccagtgccaacaatcct

SEQ ID NO: 2964898 - DNA, 18 bp, Homo sapiens
tactccgtgaggctgctg

SEQ ID NO: 2964899 - DNA, 20 bp, Homo sapiens
tactccgtgaggctgctgcc

SEQ ID NO: 2964900 - DNA, 22 bp, Homo sapiens
tactccgtgaggctgctgccat

SEQ ID NO: 2964901 - DNA, 21 bp, Homo sapiens
tactcctcacacttactgtaa

SEQ ID NO: 2964902 - DNA, 23 bp, Homo sapiens
tactccttaatttacctgttgtt

SEQ ID NO: 2964903 - DNA, 19 bp, Homo sapiens
tactcggaaattaaagttt

SEQ ID NO: 2964904 - DNA, 13 bp, Homo sapiens
tactctaagatct

SEQ ID NO: 2964905 - DNA, 14 bp, Homo sapiens
tactctagatacct

SEQ ID NO: 2964906 - DNA, 21 bp, Homo sapiens
tactctcaaagccatgtgtgg

SEQ ID NO: 2964907 - DNA, 15 bp, Homo sapiens
tactctccccacgag

SEQ ID NO: 2964908 - DNA, 20 bp, Homo sapiens
tactctccccacgagggctg

SEQ ID NO: 2964909 - DNA, 18 bp, Homo sapiens
tctttcagacttgccatg

SEQ ID NO: 2964910 - DNA, 16 bp, Homo sapiens
tctttcagtacttttt

SEQ ID NO: 2964911 - DNA, 21 bp, Homo sapiens
tctttcagtacttttttaaat

SEQ ID NO: 2964912 - DNA, 23 bp, Homo sapiens
tctttcattctctcttcctgcag

SEQ ID NO: 2964913 - DNA, 23 bp, Homo sapiens
tctttccacggagccactcctct

SEQ ID NO: 2964914 - DNA, 21 bp, Homo sapiens
aagattatagattctaaagat

SEQ ID NO: 2964915 - DNA, 17 bp, Homo sapiens
aagattattttattatg

SEQ ID NO: 2964916 - DNA, 21 bp, Homo sapiens
aagattccggatcctaagcat

SEQ ID NO: 2964917 - DNA, 24 bp, Homo sapiens
aagattccggatcctaagcatcta

SEQ ID NO: 2964918 - DNA, 14 bp, Homo sapiens
aagattcctgtcct

SEQ ID NO: 2964919 - DNA, 17 bp, Homo sapiens
aagattctatagttcta

SEQ ID NO: 2964920 - DNA, 15 bp, Homo sapiens
aagattctgaaacca

SEQ ID NO: 2964921 - DNA, 16 bp, Homo sapiens
aagattggaaagacag

SEQ ID NO: 2964922 - DNA, 14 bp, Homo sapiens
aagatttatctgga

SEQ ID NO: 2964923 - DNA, 18 bp, Homo sapiens
aagatttctaaataaaag

SEQ ID NO: 2964924 - DNA, 13 bp, Homo sapiens
aagatttcttgag

SEQ ID NO: 2964925 - DNA, 17 bp, Homo sapiens
aagatttggaaagatat

SEQ ID NO: 2964926 - DNA, 19 bp, Homo sapiens
aagattttagggcttttat

SEQ ID NO: 2964927 - DNA, 15 bp, Homo sapiens
aagattttattgtat

SEQ ID NO: 2964928 - DNA, 17 bp, Homo sapiens
aagatttttaaaatgaa

SEQ ID NO: 2964929 - DNA, 23 bp, Homo sapiens
aagcaaaaacaaaccatgactga

SEQ ID NO: 2964930 - DNA, 17 bp, Homo sapiens
aagcaaaatcatggaat

SEQ ID NO: 2964931 - DNA, 16 bp, Homo sapiens
aagcaaacagggtggc

SEQ ID NO: 2964932 - DNA, 17 bp, Homo sapiens
aagcaaacagggtggcc

SEQ ID NO: 2964933 - DNA, 13 bp, Homo sapiens
aagcaaacccaga

SEQ ID NO: 2964934 - DNA, 13 bp, Homo sapiens
aagcaaaggcagt

SEQ ID NO: 2964935 - DNA, 20 bp, Homo sapiens
aagcaaaggcagtcccggga

SEQ ID NO: 2964936 - DNA, 16 bp, Homo sapiens
aagcaacgtgttaatt

SEQ ID NO: 2964937 - DNA, 13 bp, Homo sapiens
aagcaagctgtgt

SEQ ID NO: 2964938 - DNA, 16 bp, Homo sapiens
aagcaagctgtgttac

SEQ ID NO: 2964939 - DNA, 18 bp, Homo sapiens
aagcaagctgtgttactt

SEQ ID NO: 2964940 - DNA, 16 bp, Homo sapiens
aagcaaggaaaactta

SEQ ID NO: 2964941 - DNA, 12 bp, Homo sapiens
aagcaaggggga

SEQ ID NO: 2964942 - DNA, 15 bp, Homo sapiens
aagcaagggggaagg

SEQ ID NO: 2964943 - DNA, 20 bp, Homo sapiens
aagcaaggtgtccctgcctt

SEQ ID NO: 2964944 - DNA, 14 bp, Homo sapiens
aagcaataaatgaa

SEQ ID NO: 2964945 - DNA, 18 bp, Homo sapiens
aagcaatacgtttgtgca

SEQ ID NO: 2964946 - DNA, 20 bp, Homo sapiens
aagcaatacgtttgtgcaga

SEQ ID NO: 2964947 - DNA, 22 bp, Homo sapiens
aagcaatacgtttgtgcagaat

SEQ ID NO: 2964948 - DNA, 23 bp, Homo sapiens
aagcaatacgtttgtgcagaatc

SEQ ID NO: 2964949 - DNA, 15 bp, Homo sapiens
aagcaatagaaacaa

SEQ ID NO: 2964950 - DNA, 19 bp, Homo sapiens
aagcaatatgcatttaaat

SEQ ID NO: 2964951 - DNA, 19 bp, Homo sapiens
aagcaatcagcaaacacaa

SEQ ID NO: 2964952 - DNA, 21 bp, Homo sapiens
aagcaatcagcaaacacaata

SEQ ID NO: 2964953 - DNA, 14 bp, Homo sapiens
aagcaatcctccta

SEQ ID NO: 2964954 - DNA, 17 bp, Homo sapiens
aagcaatcctcctacct

SEQ ID NO: 2964955 - DNA, 20 bp, Homo sapiens
aagcaatcctctcacctcag

SEQ ID NO: 2964956 - DNA, 15 bp, Homo sapiens
aagcaattatttaaa

SEQ ID NO: 2964957 - DNA, 17 bp, Homo sapiens
aagcaattatttttaaa

SEQ ID NO: 2964958 - DNA, 23 bp, Homo sapiens
aagcacaagaaactttggaagca

SEQ ID NO: 2964959 - DNA, 18 bp, Homo sapiens
aagcacacacaaaataaa

SEQ ID NO: 2964960 - DNA, 16 bp, Homo sapiens
aagcacagcagcctgg

SEQ ID NO: 2964961 - DNA, 14 bp, Homo sapiens
aagcacagtggtgg

SEQ ID NO: 2964962 - DNA, 20 bp, Homo sapiens
aagcacagtggtggcagggc

SEQ ID NO: 2964963 - DNA, 23 bp, Homo sapiens
aagcacagtggtggcagggccta

SEQ ID NO: 2964964 - DNA, 18 bp, Homo sapiens
aagcacagtttgaacaaa

SEQ ID NO: 2964965 - DNA, 12 bp, Homo sapiens
aagcacctgccg

SEQ ID NO: 2964966 - DNA, 14 bp, Homo sapiens
aagcactattgttt

SEQ ID NO: 2964967 - DNA, 16 bp, Homo sapiens
aagcactgtttttcca

SEQ ID NO: 2964968 - DNA, 18 bp, Homo sapiens
aagcacttaaacagaagc

SEQ ID NO: 2964969 - DNA, 19 bp, Homo sapiens
aagcacttcccaggatctg

SEQ ID NO: 2964970 - DNA, 21 bp, Homo sapiens
aagcagaccactgataaaacc

SEQ ID NO: 2964971 - DNA, 16 bp, Homo sapiens
aagcagagataaataa

SEQ ID NO: 2964972 - DNA, 15 bp, Homo sapiens
aagcagaggaggggc

SEQ ID NO: 2964973 - DNA, 22 bp, Homo sapiens
aagcagaggaggggccgctgcc

SEQ ID NO: 2964974 - DNA, 17 bp, Homo sapiens
aagcagagttctttgca

SEQ ID NO: 2964975 - DNA, 18 bp, Homo sapiens
aagcagatgcaaagaggc

SEQ ID NO: 2964976 - DNA, 16 bp, Homo sapiens
aagcagcaaaatcctt

SEQ ID NO: 2964977 - DNA, 16 bp, Homo sapiens
aagcagctaaattttc

SEQ ID NO: 2964978 - DNA, 13 bp, Homo sapiens
aagcagctcaaag

SEQ ID NO: 2964979 - DNA, 22 bp, Homo sapiens
aagcagctctaaaacatagact

SEQ ID NO: 2964980 - DNA, 14 bp, Homo sapiens
aagcagctctgcct

SEQ ID NO: 2964981 - DNA, 15 bp, Homo sapiens
aagcagctctgcctt

SEQ ID NO: 2964982 - DNA, 22 bp, Homo sapiens
aagcaggaaataccaactgaag

SEQ ID NO: 2964983 - DNA, 22 bp, Homo sapiens
aagcaggaaatgaaaatgtctt

SEQ ID NO: 2964984 - DNA, 13 bp, Homo sapiens
aagcaggccactt

SEQ ID NO: 2964985 - DNA, 23 bp, Homo sapiens
aagcagggagagttggggaaggc

SEQ ID NO: 2964986 - DNA, 21 bp, Homo sapiens
aagcaggttagagaaaataga

SEQ ID NO: 2964987 - DNA, 19 bp, Homo sapiens
aagcaggttcccaagctca

SEQ ID NO: 2964988 - DNA, 18 bp, Homo sapiens
aagcagttttgtaaatgt

SEQ ID NO: 2964989 - DNA, 20 bp, Homo sapiens
aagcataatttgtttaaaat

SEQ ID NO: 2964990 - DNA, 21 bp, Homo sapiens
aagcataatttgtttaaaatt

SEQ ID NO: 2964991 - DNA, 14 bp, Homo sapiens
aagcatattggaaa

SEQ ID NO: 2964992 - DNA, 16 bp, Homo sapiens
aagcatattggaaagt

SEQ ID NO: 2964993 - DNA, 23 bp, Homo sapiens
aagcatattggaaagtgatttta

SEQ ID NO: 2964994 - DNA, 13 bp, Homo sapiens
aagcatcattgtc

SEQ ID NO: 2964995 - DNA, 16 bp, Homo sapiens
aagcatcctcagaagc

SEQ ID NO: 2964996 - DNA, 13 bp, Homo sapiens
aagcatcctcccc

SEQ ID NO: 2964997 - DNA, 21 bp, Homo sapiens
aagcatcctccccaccagagc

SEQ ID NO: 2964998 - DNA, 20 bp, Homo sapiens
aagcatcggtcatgtgtgta

SEQ ID NO: 2964999 - DNA, 15 bp, Homo sapiens
aagcatgatgggaaa

SEQ ID NO: 2965000 - DNA, 16 bp, Homo sapiens
aagcatgtaggagaat

SEQ ID NO: 2965001 - DNA, 19 bp, Homo sapiens
aagcatgtctctgcttcca

SEQ ID NO: 2965002 - DNA, 13 bp, Homo sapiens
aagcattccaaca

SEQ ID NO: 2965003 - DNA, 14 bp, Homo sapiens
aagcattgtgagta

SEQ ID NO: 2965004 - DNA, 21 bp, Homo sapiens
gggccactgtgtttctgtgct

SEQ ID NO: 2965005 - DNA, 22 bp, Homo sapiens
gggccactgtgtttctgtgctc

SEQ ID NO: 2965006 - DNA, 14 bp, Homo sapiens
gggccagagccagg

SEQ ID NO: 2965007 - DNA, 14 bp, Homo sapiens
gggccagatccagc

SEQ ID NO: 2965008 - DNA, 18 bp, Homo sapiens
gggccagatccagcctgg

SEQ ID NO: 2965009 - DNA, 16 bp, Homo sapiens
gggccagcaggcagcg

SEQ ID NO: 2965010 - DNA, 19 bp, Homo sapiens
gggccagcaggcagcgcct

SEQ ID NO: 2965011 - DNA, 16 bp, Homo sapiens
gggccaggacaggccc

SEQ ID NO: 2965012 - DNA, 19 bp, Homo sapiens
gggccaggccctggagggc

SEQ ID NO: 2965013 - DNA, 23 bp, Homo sapiens
gggccaggccctggagggcagag

SEQ ID NO: 2965014 - DNA, 15 bp, Homo sapiens
gggccagggaggcag

SEQ ID NO: 2965015 - DNA, 21 bp, Homo sapiens
gggccagggaggcagagcggg

SEQ ID NO: 2965016 - DNA, 15 bp, Homo sapiens
gggccatggctcagg

SEQ ID NO: 2965017 - DNA, 16 bp, Homo sapiens
gggccattctccacag

SEQ ID NO: 2965018 - DNA, 18 bp, Homo sapiens
gggcccacagcccccacc

SEQ ID NO: 2965019 - DNA, 12 bp, Homo sapiens
gggcccagagcc

SEQ ID NO: 2965020 - DNA, 15 bp, Homo sapiens
gggcccagagcccag

SEQ ID NO: 2965021 - DNA, 20 bp, Homo sapiens
gggcccagagcccagctcca

SEQ ID NO: 2965022 - DNA, 17 bp, Homo sapiens
gggcccaggccatgtgg

SEQ ID NO: 2965023 - DNA, 22 bp, Homo sapiens
gggcccaggccatgtggcctgc

SEQ ID NO: 2965024 - DNA, 13 bp, Homo sapiens
gggcccaggcctg

SEQ ID NO: 2965025 - DNA, 22 bp, Homo sapiens
gggcccagggacattgcagagt

SEQ ID NO: 2965026 - DNA, 13 bp, Homo sapiens
gggcccagtgcat

SEQ ID NO: 2965027 - DNA, 22 bp, Homo sapiens
gggcccagtgcatggtggccag

SEQ ID NO: 2965028 - DNA, 11 bp, Homo sapiens
gggccccagct

SEQ ID NO: 2965029 - DNA, 22 bp, Homo sapiens
gggccccaggcccgcgggcaca

SEQ ID NO: 2965030 - DNA, 23 bp, Homo sapiens
gggccccaggcccgcgggcacag

SEQ ID NO: 2965031 - DNA, 19 bp, Homo sapiens
gggcccccaccgccggggt

SEQ ID NO: 2965032 - DNA, 12 bp, Homo sapiens
gggcccccagag

SEQ ID NO: 2965033 - DNA, 13 bp, Homo sapiens
gggcccccctgcc

SEQ ID NO: 2965034 - DNA, 10 bp, Homo sapiens
gggcccctcc

SEQ ID NO: 2965035 - DNA, 13 bp, Homo sapiens
gggcccctcccct

SEQ ID NO: 2965036 - DNA, 17 bp, Homo sapiens
gggcccctcccctcaga

SEQ ID NO: 2965037 - DNA, 11 bp, Homo sapiens
gggcccctggc

SEQ ID NO: 2965038 - DNA, 15 bp, Homo sapiens
gggcccctggcactc

SEQ ID NO: 2965039 - DNA, 15 bp, Homo sapiens
gggcccctggcccag

SEQ ID NO: 2965040 - DNA, 19 bp, Homo sapiens
gggcccctggcccaggagg

SEQ ID NO: 2965041 - DNA, 19 bp, Homo sapiens
gggcccggtggcggcaggg

SEQ ID NO: 2965042 - DNA, 21 bp, Homo sapiens
gggccctatgtctcaggagtg

SEQ ID NO: 2965043 - DNA, 17 bp, Homo sapiens
gggccctctctgcaccg

SEQ ID NO: 2965044 - DNA, 18 bp, Homo sapiens
gggccctgcaggctgcag

SEQ ID NO: 2965045 - DNA, 22 bp, Homo sapiens
gggccctggtggtggctcggga

SEQ ID NO: 2965046 - DNA, 18 bp, Homo sapiens
gggccctgtggagtccag

SEQ ID NO: 2965047 - DNA, 20 bp, Homo sapiens
gggccctgtggagtccagct

SEQ ID NO: 2965048 - DNA, 17 bp, Homo sapiens
gggccgcaagggcctgg

SEQ ID NO: 2965049 - DNA, 18 bp, Homo sapiens
gggccgcaagggcctgga

SEQ ID NO: 2965050 - DNA, 22 bp, Homo sapiens
gggccgccgctgaccctgggcc

SEQ ID NO: 2965051 - DNA, 13 bp, Homo sapiens
gggccgcctgcct

SEQ ID NO: 2965052 - DNA, 18 bp, Homo sapiens
gggccgcgtgccgggccc

SEQ ID NO: 2965053 - DNA, 22 bp, Homo sapiens
gggccgcgtgccgggcccccac

SEQ ID NO: 2965054 - DNA, 20 bp, Homo sapiens
gggccgcgtggtgccatccc

SEQ ID NO: 2965055 - DNA, 23 bp, Homo sapiens
gggccgcgtggtgccatccccag

SEQ ID NO: 2965056 - DNA, 13 bp, Homo sapiens
gggccgctgccac

SEQ ID NO: 2965057 - DNA, 14 bp, Homo sapiens
gggccggacctgag

SEQ ID NO: 2965058 - DNA, 20 bp, Homo sapiens
gggccggacctgagcccgca

SEQ ID NO: 2965059 - DNA, 19 bp, Homo sapiens
gggccggacgcaggtgctg

SEQ ID NO: 2965060 - DNA, 13 bp, Homo sapiens
gggccggggctga

SEQ ID NO: 2965061 - DNA, 19 bp, Homo sapiens
gggccgttacatctgtgca

SEQ ID NO: 2965062 - DNA, 23 bp, Homo sapiens
gggcctagctgctacaaagaaga

SEQ ID NO: 2965063 - DNA, 17 bp, Homo sapiens
gggcctaggcctcagcc

SEQ ID NO: 2965064 - DNA, 12 bp, Homo sapiens
gggcctccctcc

SEQ ID NO: 2965065 - DNA, 13 bp, Homo sapiens
gggcctccctccg

SEQ ID NO: 2965066 - DNA, 19 bp, Homo sapiens
gggcctccctccgagtgag

SEQ ID NO: 2965067 - DNA, 20 bp, Homo sapiens
gggcctccgcttatcctgct

SEQ ID NO: 2965068 - DNA, 22 bp, Homo sapiens
gggcctccgcttatcctgctag

SEQ ID NO: 2965069 - DNA, 21 bp, Homo sapiens
gggcctcctcacccaccctgt

SEQ ID NO: 2965070 - DNA, 20 bp, Homo sapiens
gggcctcggaggctcctccc

SEQ ID NO: 2965071 - DNA, 15 bp, Homo sapiens
gggcctctgcctggg

SEQ ID NO: 2965072 - DNA, 17 bp, Homo sapiens
gggcctgctccagacct

SEQ ID NO: 2965073 - DNA, 18 bp, Homo sapiens
gggcctgctccagacctg

SEQ ID NO: 2965074 - DNA, 15 bp, Homo sapiens
gggcctggagcatgg

SEQ ID NO: 2965075 - DNA, 16 bp, Homo sapiens
gggcctggagcatgga

SEQ ID NO: 2965076 - DNA, 16 bp, Homo sapiens
gggcctggcagctcag

SEQ ID NO: 2965077 - DNA, 21 bp, Homo sapiens
gggcctggccagtcctggtcc

SEQ ID NO: 2965078 - DNA, 23 bp, Homo sapiens
gggcctggccagtcctggtcctg

SEQ ID NO: 2965079 - DNA, 17 bp, Homo sapiens
gggcctggccagtcttc

SEQ ID NO: 2965080 - DNA, 13 bp, Homo sapiens
gggcctggggctc

SEQ ID NO: 2965081 - DNA, 16 bp, Homo sapiens
gggcctggtccctggg

SEQ ID NO: 2965082 - DNA, 19 bp, Homo sapiens
gggcctgtacagtctgtct

SEQ ID NO: 2965083 - DNA, 21 bp, Homo sapiens
gggcctgtacagtctgtcttc

SEQ ID NO: 2965084 - DNA, 14 bp, Homo sapiens
gggcctgtgtggag

SEQ ID NO: 2965085 - DNA, 17 bp, Homo sapiens
gggccttgcccagagat

SEQ ID NO: 2965086 - DNA, 20 bp, Homo sapiens
gggcctttgttctgggggga

SEQ ID NO: 2965087 - DNA, 21 bp, Homo sapiens
gggccttttctggcaccgcag

SEQ ID NO: 2965088 - DNA, 14 bp, Homo sapiens
gggcgcccagcagc

SEQ ID NO: 2965089 - DNA, 16 bp, Homo sapiens
gggcgcccagcagcct

SEQ ID NO: 2965090 - DNA, 18 bp, Homo sapiens
gggcgcctagagcgcggc

SEQ ID NO: 2965091 - DNA, 12 bp, Homo sapiens
gggcgcctggag

SEQ ID NO: 2965092 - DNA, 18 bp, Homo sapiens
gggcgcctggagagcgag

SEQ ID NO: 2965093 - DNA, 14 bp, Homo sapiens
gggcgcggctggga

SEQ ID NO: 2965094 - DNA, 19 bp, Homo sapiens
gggcggacaaaagggccag

SEQ ID NO: 2965095 - DNA, 13 bp, Homo sapiens
gggcggccaggga

SEQ ID NO: 2965096 - DNA, 19 bp, Homo sapiens
gggcgggcagccaggctgg

SEQ ID NO: 2965097 - DNA, 15 bp, Homo sapiens
gggcggggactgctg

SEQ ID NO: 2965098 - DNA, 13 bp, Homo sapiens
gggcggtgtcagg

SEQ ID NO: 2965099 - DNA, 16 bp, Homo sapiens
gggcgtgactcaccca

SEQ ID NO: 2965100 - DNA, 13 bp, Homo sapiens
gggcgtggaggga

SEQ ID NO: 2965101 - DNA, 21 bp, Homo sapiens
gggcgtggagggaggccccag

SEQ ID NO: 2965102 - DNA, 22 bp, Homo sapiens
gggcgtggggaatgggcaggtg

SEQ ID NO: 2965103 - DNA, 23 bp, Homo sapiens
gggctaagagctagcgctgccgc

SEQ ID NO: 2965104 - DNA, 16 bp, Homo sapiens
gggctacaaaggagga

SEQ ID NO: 2965105 - DNA, 21 bp, Homo sapiens
gggctacaaaggaggacaaga

SEQ ID NO: 2965106 - DNA, 16 bp, Homo sapiens
gggctaccctgagctg

SEQ ID NO: 2965107 - DNA, 21 bp, Homo sapiens
gggctaccctgagctgaggca

SEQ ID NO: 2965108 - DNA, 22 bp, Homo sapiens
gggctaccctgagctgaggcag

SEQ ID NO: 2965109 - DNA, 17 bp, Homo sapiens
gggctatggtgtggact

SEQ ID NO: 2965110 - DNA, 22 bp, Homo sapiens
gggctcaaggcaccgcagcctg

SEQ ID NO: 2965111 - DNA, 23 bp, Homo sapiens
gggctccccaggaagcccactgc

SEQ ID NO: 2965112 - DNA, 13 bp, Homo sapiens
gggctccccttgc

SEQ ID NO: 2965113 - DNA, 15 bp, Homo sapiens
gggctccccttgccc

SEQ ID NO: 2965114 - DNA, 18 bp, Homo sapiens
gggctctccacctcagcc

SEQ ID NO: 2965115 - DNA, 19 bp, Homo sapiens
gggctctccacctcagcct

SEQ ID NO: 2965116 - DNA, 23 bp, Homo sapiens
gggctgagccaaagccagagtgg

SEQ ID NO: 2965117 - DNA, 13 bp, Homo sapiens
gggctgagctggg

SEQ ID NO: 2965118 - DNA, 13 bp, Homo sapiens
gggctgagggagc

SEQ ID NO: 2965119 - DNA, 20 bp, Homo sapiens
gggctgagggcatctctgag

SEQ ID NO: 2965120 - DNA, 21 bp, Homo sapiens
gggctgatggattccaaacca

SEQ ID NO: 2965121 - DNA, 15 bp, Homo sapiens
gggctgcagagtgcc

SEQ ID NO: 2965122 - DNA, 11 bp, Homo sapiens
gggctgcaggt

SEQ ID NO: 2965123 - DNA, 12 bp, Homo sapiens
gggctgctgggg

SEQ ID NO: 2965124 - DNA, 13 bp, Homo sapiens
gggctgctggggg

SEQ ID NO: 2965125 - DNA, 14 bp, Homo sapiens
gggctgctgggggc

SEQ ID NO: 2965126 - DNA, 11 bp, Homo sapiens
gggctggccct

SEQ ID NO: 2965127 - DNA, 12 bp, Homo sapiens
gggctggccctg

SEQ ID NO: 2965128 - DNA, 14 bp, Homo sapiens
gggctggccctgtg

SEQ ID NO: 2965129 - DNA, 12 bp, Homo sapiens
gggctgggcagc

SEQ ID NO: 2965130 - DNA, 13 bp, Homo sapiens
gggctgggcagcc

SEQ ID NO: 2965131 - DNA, 15 bp, Homo sapiens
gggctgggtttgctg

SEQ ID NO: 2965132 - DNA, 22 bp, Homo sapiens
gggctggtgaggccggccctgc

SEQ ID NO: 2965133 - DNA, 22 bp, Homo sapiens
gggctgtgactctgggcaggga

SEQ ID NO: 2965134 - DNA, 20 bp, Homo sapiens
gggctgtgttgactgctgct

SEQ ID NO: 2965135 - DNA, 21 bp, Homo sapiens
gggctgtgttgactgctgctc

SEQ ID NO: 2965136 - DNA, 17 bp, Homo sapiens
gggcttacaggcatgga

SEQ ID NO: 2965137 - DNA, 14 bp, Homo sapiens
gggcttcagggcag

SEQ ID NO: 2965138 - DNA, 16 bp, Homo sapiens
gggcttctgcgtccac

SEQ ID NO: 2965139 - DNA, 13 bp, Homo sapiens
gggcttgaatttg

SEQ ID NO: 2965140 - DNA, 15 bp, Homo sapiens
gggcttgaatttgca

SEQ ID NO: 2965141 - DNA, 17 bp, Homo sapiens
gggaccaaagggggagt

SEQ ID NO: 2965142 - DNA, 12 bp, Homo sapiens
gggaccaaatag

SEQ ID NO: 2965143 - DNA, 16 bp, Homo sapiens
gggaccactgggcccc

SEQ ID NO: 2965144 - DNA, 18 bp, Homo sapiens
gggaccactgggcccctc

SEQ ID NO: 2965145 - DNA, 14 bp, Homo sapiens
gggaccatggggag

SEQ ID NO: 2965146 - DNA, 15 bp, Homo sapiens
gggaccatggggagg

SEQ ID NO: 2965147 - DNA, 19 bp, Homo sapiens
gggacccaaagcaggatga

SEQ ID NO: 2965148 - DNA, 16 bp, Homo sapiens
gggacccagtgcagaa

SEQ ID NO: 2965149 - DNA, 18 bp, Homo sapiens
gggaccccgagcctggct

SEQ ID NO: 2965150 - DNA, 20 bp, Homo sapiens
gggacccctggtggttcact

SEQ ID NO: 2965151 - DNA, 19 bp, Homo sapiens
gggacccggggtctcctgg

SEQ ID NO: 2965152 - DNA, 17 bp, Homo sapiens
gggaccgagcccagcag

SEQ ID NO: 2965153 - DNA, 12 bp, Homo sapiens
gggacctcagcc

SEQ ID NO: 2965154 - DNA, 12 bp, Homo sapiens
gggacctctccc

SEQ ID NO: 2965155 - DNA, 21 bp, Homo sapiens
gggacgaagaagagccacagt

SEQ ID NO: 2965156 - DNA, 22 bp, Homo sapiens
gggacgcctgggggtgccagga

SEQ ID NO: 2965157 - DNA, 23 bp, Homo sapiens
gggacgggcaagtgagaggggag

SEQ ID NO: 2965158 - DNA, 24 bp, Homo sapiens
gggacgggcaagtgagaggggagg

SEQ ID NO: 2965159 - DNA, 19 bp, Homo sapiens
gggacgtggctcagccagc

SEQ ID NO: 2965160 - DNA, 22 bp, Homo sapiens
gggacgtggctcagccagcact

SEQ ID NO: 2965161 - DNA, 19 bp, Homo sapiens
gggactagtgagtcagcac

SEQ ID NO: 2965162 - DNA, 20 bp, Homo sapiens
gggactagtttataggagaa

SEQ ID NO: 2965163 - DNA, 16 bp, Homo sapiens
gggactcactggcagc

SEQ ID NO: 2965164 - DNA, 19 bp, Homo sapiens
gggactcggcccagggccg

SEQ ID NO: 2965165 - DNA, 12 bp, Homo sapiens
gggagaagctcc

SEQ ID NO: 2965166 - DNA, 18 bp, Homo sapiens
gggagaaggcctcccctg

SEQ ID NO: 2965167 - DNA, 19 bp, Homo sapiens
gggagaaggcctcccctga

SEQ ID NO: 2965168 - DNA, 17 bp, Homo sapiens
gggagaatgcagcccac

SEQ ID NO: 2965169 - DNA, 19 bp, Homo sapiens
gggagacagttgagagcgg

SEQ ID NO: 2965170 - DNA, 20 bp, Homo sapiens
gggagacagttgagagcggg

SEQ ID NO: 2965171 - DNA, 18 bp, Homo sapiens
gggagacggtttccaggg

SEQ ID NO: 2965172 - DNA, 14 bp, Homo sapiens
gggagactgggctg

SEQ ID NO: 2965173 - DNA, 17 bp, Homo sapiens
gggagagaactgagcat

SEQ ID NO: 2965174 - DNA, 13 bp, Homo sapiens
gggagagaccctt

SEQ ID NO: 2965175 - DNA, 12 bp, Homo sapiens
gggagagccagg

SEQ ID NO: 2965176 - DNA, 15 bp, Homo sapiens
gggagagctgagcca

SEQ ID NO: 2965177 - DNA, 14 bp, Homo sapiens
gggagattgaactt

SEQ ID NO: 2965178 - DNA, 15 bp, Homo sapiens
gggagattgaacttt

SEQ ID NO: 2965179 - DNA, 15 bp, Homo sapiens
gggagccatttgaga

SEQ ID NO: 2965180 - DNA, 23 bp, Homo sapiens
gggagccctcaggcacctgcact

SEQ ID NO: 2965181 - DNA, 16 bp, Homo sapiens
gggagccgctggcaga

SEQ ID NO: 2965182 - DNA, 13 bp, Homo sapiens
gggagccgggagc

SEQ ID NO: 2965183 - DNA, 17 bp, Homo sapiens
gggagctgaggcctccc

SEQ ID NO: 2965184 - DNA, 18 bp, Homo sapiens
gggagctgaggcctccct

SEQ ID NO: 2965185 - DNA, 13 bp, Homo sapiens
gggagctgggccc

SEQ ID NO: 2965186 - DNA, 19 bp, Homo sapiens
gggagctgggcccgacatg

SEQ ID NO: 2965187 - DNA, 16 bp, Homo sapiens
gggaggaaaagaaaag

SEQ ID NO: 2965188 - DNA, 21 bp, Homo sapiens
gggaggaaagggcctggccag

SEQ ID NO: 2965189 - DNA, 24 bp, Homo sapiens
gggaggaaatttgaatgggtccat

SEQ ID NO: 2965190 - DNA, 14 bp, Homo sapiens
gggaggaagagaga

SEQ ID NO: 2965191 - DNA, 19 bp, Homo sapiens
gggaggcacttcctcccct

SEQ ID NO: 2965192 - DNA, 17 bp, Homo sapiens
gggaggcagagcgggag

SEQ ID NO: 2965193 - DNA, 19 bp, Homo sapiens
gggaggccaggcgagcctg

SEQ ID NO: 2965194 - DNA, 17 bp, Homo sapiens
gggaggccagtgagcca

SEQ ID NO: 2965195 - DNA, 18 bp, Homo sapiens
gggaggccccactgggga

SEQ ID NO: 2965196 - DNA, 23 bp, Homo sapiens
gggaggcccccccagaagcaaga

SEQ ID NO: 2965197 - DNA, 16 bp, Homo sapiens
gggaggctgaggcagg

SEQ ID NO: 2965198 - DNA, 22 bp, Homo sapiens
gggaggctgcactggagccaca

SEQ ID NO: 2965199 - DNA, 24 bp, Homo sapiens
gggaggctgcactggagccacagg

SEQ ID NO: 2965200 - DNA, 13 bp, Homo sapiens
gggaggctgcagc

SEQ ID NO: 2965201 - DNA, 14 bp, Homo sapiens
gggaggctgcagcc

SEQ ID NO: 2965202 - DNA, 19 bp, Homo sapiens
gggaggctgcagccaggcc

SEQ ID NO: 2965203 - DNA, 22 bp, Homo sapiens
gggaggctgcagccaggcctcg

SEQ ID NO: 2965204 - DNA, 12 bp, Homo sapiens
gggagggactgc

SEQ ID NO: 2965205 - DNA, 13 bp, Homo sapiens
gggagggagctga

SEQ ID NO: 2965206 - DNA, 13 bp, Homo sapiens
gggagggcagcag

SEQ ID NO: 2965207 - DNA, 21 bp, Homo sapiens
gggagggccagggaggcagag

SEQ ID NO: 2965208 - DNA, 17 bp, Homo sapiens
gggaggggccggccctg

SEQ ID NO: 2965209 - DNA, 14 bp, Homo sapiens
gggaggggcctagg

SEQ ID NO: 2965210 - DNA, 14 bp, Homo sapiens
gggagggggagagg

SEQ ID NO: 2965211 - DNA, 18 bp, Homo sapiens
gggagggggcacggcagg

SEQ ID NO: 2965212 - DNA, 18 bp, Homo sapiens
gggagtgcagagaaagaa

SEQ ID NO: 2965213 - DNA, 21 bp, Homo sapiens
gggagtggggtagaggaagac

SEQ ID NO: 2965214 - DNA, 16 bp, Homo sapiens
gggatagtctgggtca

SEQ ID NO: 2965215 - DNA, 23 bp, Homo sapiens
gggatagtctgggtcagacccat

SEQ ID NO: 2965216 - DNA, 23 bp, Homo sapiens
gggatcaaagttctgctttctcc

SEQ ID NO: 2965217 - DNA, 14 bp, Homo sapiens
gggatcccacagcc

SEQ ID NO: 2965218 - DNA, 23 bp, Homo sapiens
gggatctggtcctacccatcccc

SEQ ID NO: 2965219 - DNA, 20 bp, Homo sapiens
gggatgccactcctccctcc

SEQ ID NO: 2965220 - DNA, 16 bp, Homo sapiens
gggatgctatttcagc

SEQ ID NO: 2965221 - DNA, 15 bp, Homo sapiens
gggatggaggagaag

SEQ ID NO: 2965222 - DNA, 12 bp, Homo sapiens
gggatgggaggt

SEQ ID NO: 2965223 - DNA, 16 bp, Homo sapiens
gggatgggcagcccaa

SEQ ID NO: 2965224 - DNA, 23 bp, Homo sapiens
gggatggggggggatgtggatca

SEQ ID NO: 2965225 - DNA, 21 bp, Homo sapiens
gggatggggtggggggacagg

SEQ ID NO: 2965226 - DNA, 17 bp, Homo sapiens
gggatggtggagggcca

SEQ ID NO: 2965227 - DNA, 16 bp, Homo sapiens
gggatggtgttcaaaa

SEQ ID NO: 2965228 - DNA, 17 bp, Homo sapiens
gggatgtttacctggtg

SEQ ID NO: 2965229 - DNA, 15 bp, Homo sapiens
gggattgctgccact

SEQ ID NO: 2965230 - DNA, 20 bp, Homo sapiens
gggattggaccgagctggaa

SEQ ID NO: 2965231 - DNA, 14 bp, Homo sapiens
gggatttcttaggg

SEQ ID NO: 2965232 - DNA, 14 bp, Homo sapiens
gggatttctttgct

SEQ ID NO: 2965233 - DNA, 19 bp, Homo sapiens
gggattttctagtttcctg

SEQ ID NO: 2965234 - DNA, 16 bp, Homo sapiens
gggcacaaagggccca

SEQ ID NO: 2965235 - DNA, 18 bp, Homo sapiens
gggcacaggaggcaggca

SEQ ID NO: 2965236 - DNA, 12 bp, Homo sapiens
gggcacccaccc

SEQ ID NO: 2965237 - DNA, 12 bp, Homo sapiens
gggcacctgcca

SEQ ID NO: 2965238 - DNA, 13 bp, Homo sapiens
gggcacggcaggc

SEQ ID NO: 2965239 - DNA, 11 bp, Homo sapiens
gggcactcccc

SEQ ID NO: 2965240 - DNA, 12 bp, Homo sapiens
gggcactccccc

SEQ ID NO: 2965241 - DNA, 15 bp, Homo sapiens
gggcactcccccagg

SEQ ID NO: 2965242 - DNA, 14 bp, Homo sapiens
gggcagaatcctgg

SEQ ID NO: 2965243 - DNA, 22 bp, Homo sapiens
gggcagaatcctgggcccccag

SEQ ID NO: 2965244 - DNA, 14 bp, Homo sapiens
gggcagagcccaag

SEQ ID NO: 2965245 - DNA, 13 bp, Homo sapiens
gggcagagcctgt

SEQ ID NO: 2965246 - DNA, 16 bp, Homo sapiens
gggcagaggctggagg

SEQ ID NO: 2965247 - DNA, 21 bp, Homo sapiens
gggcagaggctggaggcaggg

SEQ ID NO: 2965248 - DNA, 20 bp, Homo sapiens
gggcagagggcagaggctgg

SEQ ID NO: 2965249 - DNA, 14 bp, Homo sapiens
gggcagagggctgg

SEQ ID NO: 2965250 - DNA, 17 bp, Homo sapiens
gggcagagtgagaccca

SEQ ID NO: 2965251 - DNA, 18 bp, Homo sapiens
gggcagccaggctgggcc

SEQ ID NO: 2965252 - DNA, 16 bp, Homo sapiens
gggcagcgccaggctg

SEQ ID NO: 2965253 - DNA, 12 bp, Homo sapiens
gggcagctgcct

SEQ ID NO: 2965254 - DNA, 14 bp, Homo sapiens
gggcagctgcctgg

SEQ ID NO: 2965255 - DNA, 22 bp, Homo sapiens
gggcaggcgtgactcagcagcc

SEQ ID NO: 2965256 - DNA, 22 bp, Homo sapiens
gggcagggtctctgctccagca

SEQ ID NO: 2965257 - DNA, 17 bp, Homo sapiens
gggcaggtcaggaccag

SEQ ID NO: 2965258 - DNA, 20 bp, Homo sapiens
gggcaggtcaggaccaggac

SEQ ID NO: 2965259 - DNA, 13 bp, Homo sapiens
gggcaggtgggag

SEQ ID NO: 2965260 - DNA, 18 bp, Homo sapiens
gggcagtcgctgcaggga

SEQ ID NO: 2965261 - DNA, 17 bp, Homo sapiens
gggcagtctgagagagg

SEQ ID NO: 2965262 - DNA, 18 bp, Homo sapiens
gggcagtctgagagaggc

SEQ ID NO: 2965263 - DNA, 13 bp, Homo sapiens
gggcagtgccagc

SEQ ID NO: 2965264 - DNA, 17 bp, Homo sapiens
gggcagtggacgtgctg

SEQ ID NO: 2965265 - DNA, 15 bp, Homo sapiens
gggcagtggcttctt

SEQ ID NO: 2965266 - DNA, 14 bp, Homo sapiens
gggcatctatggga

SEQ ID NO: 2965267 - DNA, 13 bp, Homo sapiens
gggcatctctgag

SEQ ID NO: 2965268 - DNA, 17 bp, Homo sapiens
gggcatgcacacggctg

SEQ ID NO: 2965269 - DNA, 18 bp, Homo sapiens
gggcatgggtcgggagag

SEQ ID NO: 2965270 - DNA, 21 bp, Homo sapiens
gggcatgggtcgggagagggg

SEQ ID NO: 2965271 - DNA, 19 bp, Homo sapiens
gggcatgtattagccagtc

SEQ ID NO: 2965272 - DNA, 15 bp, Homo sapiens
gggcatgtctgcctg

SEQ ID NO: 2965273 - DNA, 14 bp, Homo sapiens
gggcatgtgggctt

SEQ ID NO: 2965274 - DNA, 16 bp, Homo sapiens
gggcattttgacaaca

SEQ ID NO: 2965275 - DNA, 19 bp, Homo sapiens
gggcattttgacaacatgg

SEQ ID NO: 2965276 - DNA, 11 bp, Homo sapiens
gggccacaggg

SEQ ID NO: 2965277 - DNA, 13 bp, Homo sapiens
gggccactgtgtt

SEQ ID NO: 2965278 - DNA, 16 bp, Homo sapiens
gggccactgtgtttct

SEQ ID NO: 2965279 - DNA, 16 bp, Homo sapiens
gggcttgaatttgcat

SEQ ID NO: 2965280 - DNA, 16 bp, Homo sapiens
gggcttgactttggct

SEQ ID NO: 2965281 - DNA, 15 bp, Homo sapiens
gggcttggtcctagg

SEQ ID NO: 2965282 - DNA, 16 bp, Homo sapiens
gggcttttgttctgag

SEQ ID NO: 2965283 - DNA, 19 bp, Homo sapiens
gggcttttgttctgagggg

SEQ ID NO: 2965284 - DNA, 14 bp, Homo sapiens
ggggaaaaaaatgt

SEQ ID NO: 2965285 - DNA, 17 bp, Homo sapiens
ggggaaacgtctcccag

SEQ ID NO: 2965286 - DNA, 22 bp, Homo sapiens
ggggaaagacactgcctgggct

SEQ ID NO: 2965287 - DNA, 18 bp, Homo sapiens
ggggaactcagatccagg

SEQ ID NO: 2965288 - DNA, 12 bp, Homo sapiens
ggggaagatgaa

SEQ ID NO: 2965289 - DNA, 23 bp, Homo sapiens
ggggaagatgaaaccgtccctga

SEQ ID NO: 2965290 - DNA, 15 bp, Homo sapiens
ggggaaggactggcc

SEQ ID NO: 2965291 - DNA, 15 bp, Homo sapiens
ggggaaggctgcaaa

SEQ ID NO: 2965292 - DNA, 14 bp, Homo sapiens
ggggaaggggtgca

SEQ ID NO: 2965293 - DNA, 15 bp, Homo sapiens
ggggaatgggcaggt

SEQ ID NO: 2965294 - DNA, 16 bp, Homo sapiens
ggggaccactgggccc

SEQ ID NO: 2965295 - DNA, 19 bp, Homo sapiens
ggggaccactgggcccctc

SEQ ID NO: 2965296 - DNA, 16 bp, Homo sapiens
ggggacccatgggggc

SEQ ID NO: 2965297 - DNA, 13 bp, Homo sapiens
ggggacccccgcc

SEQ ID NO: 2965298 - DNA, 21 bp, Homo sapiens
ggggacccctggctctgggcc

SEQ ID NO: 2965299 - DNA, 16 bp, Homo sapiens
ggggacctcagcctgc

SEQ ID NO: 2965300 - DNA, 22 bp, Homo sapiens
ggggacctggtttgaatggaga

SEQ ID NO: 2965301 - DNA, 16 bp, Homo sapiens
ggggaccttggtctga

SEQ ID NO: 2965302 - DNA, 13 bp, Homo sapiens
ggggacgcaggcc

SEQ ID NO: 2965303 - DNA, 16 bp, Homo sapiens
ggggacgcaggcccct

SEQ ID NO: 2965304 - DNA, 17 bp, Homo sapiens
ggggacgcaggcccctc

SEQ ID NO: 2965305 - DNA, 22 bp, Homo sapiens
ggggacgcaggcccctctcctc

SEQ ID NO: 2965306 - DNA, 17 bp, Homo sapiens
ggggacgtgggccctgc

SEQ ID NO: 2965307 - DNA, 14 bp, Homo sapiens
ggggacttctcttc

SEQ ID NO: 2965308 - DNA, 19 bp, Homo sapiens
ggggacttgtaggaatctg

SEQ ID NO: 2965309 - DNA, 16 bp, Homo sapiens
ggggagaaggcctccc

SEQ ID NO: 2965310 - DNA, 16 bp, Homo sapiens
ggggagaatgcagccc

SEQ ID NO: 2965311 - DNA, 16 bp, Homo sapiens
ggggagacagttgaga

SEQ ID NO: 2965312 - DNA, 15 bp, Homo sapiens
ggggagattgaactt

SEQ ID NO: 2965313 - DNA, 20 bp, Homo sapiens
ggggagccgagggcgtcaga

SEQ ID NO: 2965314 - DNA, 12 bp, Homo sapiens
ggggagggaggg

SEQ ID NO: 2965315 - DNA, 15 bp, Homo sapiens
ggggaggtggcacta

SEQ ID NO: 2965316 - DNA, 14 bp, Homo sapiens
ggggaggtgggagg

SEQ ID NO: 2965317 - DNA, 18 bp, Homo sapiens
ggggagtttagggtgggg

SEQ ID NO: 2965318 - DNA, 22 bp, Homo sapiens
ggggatcatctgccgtgcctgg

SEQ ID NO: 2965319 - DNA, 21 bp, Homo sapiens
ggggatccctcccccccatgc

SEQ ID NO: 2965320 - DNA, 23 bp, Homo sapiens
ggggatccctcccccccatgcac

SEQ ID NO: 2965321 - DNA, 12 bp, Homo sapiens
ggggattttatt

SEQ ID NO: 2965322 - DNA, 22 bp, Homo sapiens
ggggcaaacctagccggaaggc

SEQ ID NO: 2965323 - DNA, 16 bp, Homo sapiens
ggggcagagggcagag

SEQ ID NO: 2965324 - DNA, 13 bp, Homo sapiens
ggggcagccacac

SEQ ID NO: 2965325 - DNA, 12 bp, Homo sapiens
ggggcaggcagt

SEQ ID NO: 2965326 - DNA, 19 bp, Homo sapiens
ggggcaggccagggcagtt

SEQ ID NO: 2965327 - DNA, 14 bp, Homo sapiens
ggggcaggtcagga

SEQ ID NO: 2965328 - DNA, 18 bp, Homo sapiens
ggggcaggtcaggaccag

SEQ ID NO: 2965329 - DNA, 15 bp, Homo sapiens
ggggcagtctgagag

SEQ ID NO: 2965330 - DNA, 15 bp, Homo sapiens
ggggcatgaccagat

SEQ ID NO: 2965331 - DNA, 14 bp, Homo sapiens
ggggcatgacccag

SEQ ID NO: 2965332 - DNA, 13 bp, Homo sapiens
ggggccagatcca

SEQ ID NO: 2965333 - DNA, 18 bp, Homo sapiens
ggggcccagcgctctcct

SEQ ID NO: 2965334 - DNA, 19 bp, Homo sapiens
ggggcccagcgctctcctg

SEQ ID NO: 2965335 - DNA, 12 bp, Homo sapiens
ggggcccagggg

SEQ ID NO: 2965336 - DNA, 14 bp, Homo sapiens
ggggcccagtcctt

SEQ ID NO: 2965337 - DNA, 18 bp, Homo sapiens
ggggcccctggcccagga

SEQ ID NO: 2965338 - DNA, 15 bp, Homo sapiens
ggggcccggagatag

SEQ ID NO: 2965339 - DNA, 15 bp, Homo sapiens
ggggcccggccagcc

SEQ ID NO: 2965340 - DNA, 22 bp, Homo sapiens
ggggcccggtggcggcagggcc

SEQ ID NO: 2965341 - DNA, 19 bp, Homo sapiens
ggggccgccgctgaccctg

SEQ ID NO: 2965342 - DNA, 21 bp, Homo sapiens
ggggccggctggcctggaggc

SEQ ID NO: 2965343 - DNA, 14 bp, Homo sapiens
ggggccggggaggg

SEQ ID NO: 2965344 - DNA, 23 bp, Homo sapiens
ggggcctaggcctcagccagaga

SEQ ID NO: 2965345 - DNA, 13 bp, Homo sapiens
ggggcctccctcc

SEQ ID NO: 2965346 - DNA, 16 bp, Homo sapiens
ggggcctgaggcaagc

SEQ ID NO: 2965347 - DNA, 12 bp, Homo sapiens
ggggcctgggca

SEQ ID NO: 2965348 - DNA, 13 bp, Homo sapiens
ggggctagctgga

SEQ ID NO: 2965349 - DNA, 17 bp, Homo sapiens
ggggctccccttgccct

SEQ ID NO: 2965350 - DNA, 18 bp, Homo sapiens
ggggctgcccttgggcca

SEQ ID NO: 2965351 - DNA, 14 bp, Homo sapiens
ggggctgctcctcc

SEQ ID NO: 2965352 - DNA, 19 bp, Homo sapiens
ggggctggcggctactcag

SEQ ID NO: 2965353 - DNA, 14 bp, Homo sapiens
ggggctggggaggg

SEQ ID NO: 2965354 - DNA, 16 bp, Homo sapiens
ggggctgtctttgcag

SEQ ID NO: 2965355 - DNA, 21 bp, Homo sapiens
ggggcttctggacctagggtg

SEQ ID NO: 2965356 - DNA, 16 bp, Homo sapiens
gggggagaaggcctcc

SEQ ID NO: 2965357 - DNA, 22 bp, Homo sapiens
gggggatgccactcctccctcc

SEQ ID NO: 2965358 - DNA, 11 bp, Homo sapiens
gggggcagagg

SEQ ID NO: 2965359 - DNA, 12 bp, Homo sapiens
gggggcagaggg

SEQ ID NO: 2965360 - DNA, 12 bp, Homo sapiens
gggggccactgt

SEQ ID NO: 2965361 - DNA, 11 bp, Homo sapiens
gggggccaggc

SEQ ID NO: 2965362 - DNA, 12 bp, Homo sapiens
gggggctgaaac

SEQ ID NO: 2965363 - DNA, 22 bp, Homo sapiens
gggggcttcatacacatgagat

SEQ ID NO: 2965364 - DNA, 14 bp, Homo sapiens
ggggggcgcctgga

SEQ ID NO: 2965365 - DNA, 13 bp, Homo sapiens
gggggggctgcct

SEQ ID NO: 2965366 - DNA, 17 bp, Homo sapiens
gggggtgaaggcaggag

SEQ ID NO: 2965367 - DNA, 17 bp, Homo sapiens
ggggtacacagtgagag

SEQ ID NO: 2965368 - DNA, 15 bp, Homo sapiens
ggggtaccagccact

SEQ ID NO: 2965369 - DNA, 14 bp, Homo sapiens
ggggtaccaggcac

SEQ ID NO: 2965370 - DNA, 18 bp, Homo sapiens
ggggtagctagaggaacc

SEQ ID NO: 2965371 - DNA, 17 bp, Homo sapiens
ggggtcaagctgagctg

SEQ ID NO: 2965372 - DNA, 23 bp, Homo sapiens
ggggtcaggtgtcaggcccgtcg

SEQ ID NO: 2965373 - DNA, 18 bp, Homo sapiens
ggggtcatgccctcctct

SEQ ID NO: 2965374 - DNA, 19 bp, Homo sapiens
ggggtcatgccctcctctc

SEQ ID NO: 2965375 - DNA, 17 bp, Homo sapiens
ggggtccagggagcagg

SEQ ID NO: 2965376 - DNA, 22 bp, Homo sapiens
ggggtccctagcagcccaccct

SEQ ID NO: 2965377 - DNA, 14 bp, Homo sapiens
ggggtcctagccca

SEQ ID NO: 2965378 - DNA, 12 bp, Homo sapiens
ggggtctcctgg

SEQ ID NO: 2965379 - DNA, 20 bp, Homo sapiens
ggggtctggagttgatctgg

SEQ ID NO: 2965380 - DNA, 21 bp, Homo sapiens
ggggtctggagttgatctgga

SEQ ID NO: 2965381 - DNA, 12 bp, Homo sapiens
ggggtgacacag

SEQ ID NO: 2965382 - DNA, 17 bp, Homo sapiens
ggggtgatggccagagg

SEQ ID NO: 2965383 - DNA, 17 bp, Homo sapiens
ggggtggcctgcagtga

SEQ ID NO: 2965384 - DNA, 11 bp, Homo sapiens
ggggtggcgcg

SEQ ID NO: 2965385 - DNA, 20 bp, Homo sapiens
ggggtggcgcgcctgccttt

SEQ ID NO: 2965386 - DNA, 14 bp, Homo sapiens
ggggtgggccaggc

SEQ ID NO: 2965387 - DNA, 16 bp, Homo sapiens
ggggtgttaatttatg

SEQ ID NO: 2965388 - DNA, 16 bp, Homo sapiens
ggggttcagcccctcc

SEQ ID NO: 2965389 - DNA, 14 bp, Homo sapiens
ggggttcaggcccg

SEQ ID NO: 2965390 - DNA, 20 bp, Homo sapiens
ggggttccttccacttctgg

SEQ ID NO: 2965391 - DNA, 21 bp, Homo sapiens
ggggtttcctgcatggacagt

SEQ ID NO: 2965392 - DNA, 16 bp, Homo sapiens
gggtaagggatttctt

SEQ ID NO: 2965393 - DNA, 13 bp, Homo sapiens
gggtaccaggcac

SEQ ID NO: 2965394 - DNA, 21 bp, Homo sapiens
gggtaccaggcacatggctgg

SEQ ID NO: 2965395 - DNA, 14 bp, Homo sapiens
gggtacctcatgag

SEQ ID NO: 2965396 - DNA, 18 bp, Homo sapiens
gggtagaaaactccaggg

SEQ ID NO: 2965397 - DNA, 14 bp, Homo sapiens
gggtagaagccacc

SEQ ID NO: 2965398 - DNA, 20 bp, Homo sapiens
gggtagaagccacccttccc

SEQ ID NO: 2965399 - DNA, 15 bp, Homo sapiens
gggtagctagaggaa

SEQ ID NO: 2965400 - DNA, 19 bp, Homo sapiens
gggtcaggtgtcaggcccg

SEQ ID NO: 2965401 - DNA, 14 bp, Homo sapiens
gggtcatagaaatt

SEQ ID NO: 2965402 - DNA, 14 bp, Homo sapiens
gggtcatcagggag

SEQ ID NO: 2965403 - DNA, 14 bp, Homo sapiens
gggtcatgccctcc

SEQ ID NO: 2965404 - DNA, 16 bp, Homo sapiens
gggtcatgccctcctc

SEQ ID NO: 2965405 - DNA, 20 bp, Homo sapiens
gggtccacttgccagggctc

SEQ ID NO: 2965406 - DNA, 19 bp, Homo sapiens
gggtccaggggatgggagg

SEQ ID NO: 2965407 - DNA, 12 bp, Homo sapiens
gggtcccactgc

SEQ ID NO: 2965408 - DNA, 16 bp, Homo sapiens
gggtccctctaaccca

SEQ ID NO: 2965409 - DNA, 19 bp, Homo sapiens
gggtccctctaacccagtg

SEQ ID NO: 2965410 - DNA, 14 bp, Homo sapiens
gggtcctcggccca

SEQ ID NO: 2965411 - DNA, 16 bp, Homo sapiens
gggtcctggccatccc

SEQ ID NO: 2965412 - DNA, 14 bp, Homo sapiens
gggtcctgggaggc

SEQ ID NO: 2965413 - DNA, 20 bp, Homo sapiens
gggtcctgggaggctgcagc

SEQ ID NO: 2965414 - DNA, 22 bp, Homo sapiens
gggtcctgggaggctgcagcca

SEQ ID NO: 2965415 - DNA, 23 bp, Homo sapiens
gggtccttgggcctggccagtct

SEQ ID NO: 2965416 - DNA, 17 bp, Homo sapiens
gggtcgacttcgggctg

SEQ ID NO: 2965417 - DNA, 23 bp, Homo sapiens
gggtcggaacccaagcttagaac

SEQ ID NO: 2965418 - DNA, 14 bp, Homo sapiens
ggctgccctgaggg

SEQ ID NO: 2965419 - DNA, 20 bp, Homo sapiens
ggctgccctgaggggctggg

SEQ ID NO: 2965420 - DNA, 16 bp, Homo sapiens
ggctgcccttgggcca

SEQ ID NO: 2965421 - DNA, 17 bp, Homo sapiens
ggctgccgactccccca

SEQ ID NO: 2965422 - DNA, 12 bp, Homo sapiens
ggctgcctccgc

SEQ ID NO: 2965423 - DNA, 15 bp, Homo sapiens
ggctgcctccgcacc

SEQ ID NO: 2965424 - DNA, 15 bp, Homo sapiens
ggctgcctggagccc

SEQ ID NO: 2965425 - DNA, 11 bp, Homo sapiens
ggctgcctttg

SEQ ID NO: 2965426 - DNA, 23 bp, Homo sapiens
ggctgcctttgatcacaggagca

SEQ ID NO: 2965427 - DNA, 21 bp, Homo sapiens
ggctgcctttgtggtgggcgc

SEQ ID NO: 2965428 - DNA, 15 bp, Homo sapiens
ggctgcgcttcctat

SEQ ID NO: 2965429 - DNA, 19 bp, Homo sapiens
ggctgctcctccagggcca

SEQ ID NO: 2965430 - DNA, 17 bp, Homo sapiens
ggctgctcgcccaggaa

SEQ ID NO: 2965431 - DNA, 20 bp, Homo sapiens
ggctgctcgcccaggaaggc

SEQ ID NO: 2965432 - DNA, 13 bp, Homo sapiens
ggctgctgggggc

SEQ ID NO: 2965433 - DNA, 22 bp, Homo sapiens
ggctgctgggggcaactggcca

SEQ ID NO: 2965434 - DNA, 22 bp, Homo sapiens
ggctgctgggggctccccttgc

SEQ ID NO: 2965435 - DNA, 22 bp, Homo sapiens
ggctgctgtgtggacggcgctg

SEQ ID NO: 2965436 - DNA, 19 bp, Homo sapiens
ggctgcttctacggccatg

SEQ ID NO: 2965437 - DNA, 15 bp, Homo sapiens
ggctgcttgcagcca

SEQ ID NO: 2965438 - DNA, 16 bp, Homo sapiens
ggctgcttgcagccag

SEQ ID NO: 2965439 - DNA, 15 bp, Homo sapiens
ggctggaatgaggga

SEQ ID NO: 2965440 - DNA, 23 bp, Homo sapiens
ggctggagcccagggagcggaaa

SEQ ID NO: 2965441 - DNA, 15 bp, Homo sapiens
ggctggaggcccagg

SEQ ID NO: 2965442 - DNA, 19 bp, Homo sapiens
ggctggaggcccaggctgg

SEQ ID NO: 2965443 - DNA, 21 bp, Homo sapiens
ggctggaggtgctggtagctg

SEQ ID NO: 2965444 - DNA, 13 bp, Homo sapiens
ggctggagtacag

SEQ ID NO: 2965445 - DNA, 19 bp, Homo sapiens
ggctggcaagataaacact

SEQ ID NO: 2965446 - DNA, 13 bp, Homo sapiens
ggctggcacagga

SEQ ID NO: 2965447 - DNA, 12 bp, Homo sapiens
ggctggccctgt

SEQ ID NO: 2965448 - DNA, 15 bp, Homo sapiens
ggctggccctgtgca

SEQ ID NO: 2965449 - DNA, 19 bp, Homo sapiens
ggctggccctgtgcagacc

SEQ ID NO: 2965450 - DNA, 20 bp, Homo sapiens
ggctggcctcccaaatgagc

SEQ ID NO: 2965451 - DNA, 24 bp, Homo sapiens
ggctggctccagatgcagggcagt

SEQ ID NO: 2965452 - DNA, 13 bp, Homo sapiens
ggctggctggcct

SEQ ID NO: 2965453 - DNA, 15 bp, Homo sapiens
ggctggctggcctca

SEQ ID NO: 2965454 - DNA, 14 bp, Homo sapiens
ggctggcttttctg

SEQ ID NO: 2965455 - DNA, 23 bp, Homo sapiens
ggctggcttttctgtttcctgta

SEQ ID NO: 2965456 - DNA, 22 bp, Homo sapiens
ggctgggaaacactccttgcat

SEQ ID NO: 2965457 - DNA, 21 bp, Homo sapiens
ggctgggatgctggtggctct

SEQ ID NO: 2965458 - DNA, 22 bp, Homo sapiens
ggctgggccgcaagggcctgga

SEQ ID NO: 2965459 - DNA, 20 bp, Homo sapiens
ggctgggctgagccaaagcc

SEQ ID NO: 2965460 - DNA, 17 bp, Homo sapiens
ggctgggggagggactg

SEQ ID NO: 2965461 - DNA, 21 bp, Homo sapiens
ggctgggtccttgggcctggc

SEQ ID NO: 2965462 - DNA, 14 bp, Homo sapiens
ggctggtcactctg

SEQ ID NO: 2965463 - DNA, 20 bp, Homo sapiens
ggctggtcactctgccctct

SEQ ID NO: 2965464 - DNA, 22 bp, Homo sapiens
ggctggtgaggccggccctgcc

SEQ ID NO: 2965465 - DNA, 23 bp, Homo sapiens
ggctggttggcatttgctggcct

SEQ ID NO: 2965466 - DNA, 14 bp, Homo sapiens
ggctgtaaggctct

SEQ ID NO: 2965467 - DNA, 15 bp, Homo sapiens
ggctgtaaggctcta

SEQ ID NO: 2965468 - DNA, 18 bp, Homo sapiens
ggctgtcagtatgacatt

SEQ ID NO: 2965469 - DNA, 14 bp, Homo sapiens
ggctgtcatctgtg

SEQ ID NO: 2965470 - DNA, 18 bp, Homo sapiens
ggctgtcccaagctccca

SEQ ID NO: 2965471 - DNA, 21 bp, Homo sapiens
ggctgtctggatccttcccaa

SEQ ID NO: 2965472 - DNA, 14 bp, Homo sapiens
ggctgtgctgccct

SEQ ID NO: 2965473 - DNA, 15 bp, Homo sapiens
ggctgtgctgccctg

SEQ ID NO: 2965474 - DNA, 23 bp, Homo sapiens
ggctgtggagacaatgtctgcag

SEQ ID NO: 2965475 - DNA, 21 bp, Homo sapiens
ggctgtggcatccagagtccc

SEQ ID NO: 2965476 - DNA, 13 bp, Homo sapiens
ggctgtgtccctg

SEQ ID NO: 2965477 - DNA, 19 bp, Homo sapiens
ggctgtgttgactgctgct

SEQ ID NO: 2965478 - DNA, 21 bp, Homo sapiens
ggctgtgttgactgctgctcc

SEQ ID NO: 2965479 - DNA, 21 bp, Homo sapiens
ggctgttttagtgccaggctg

SEQ ID NO: 2965480 - DNA, 22 bp, Homo sapiens
ggcttaataaaaatgacagact

SEQ ID NO: 2965481 - DNA, 16 bp, Homo sapiens
ggcttacaggcatgga

SEQ ID NO: 2965482 - DNA, 17 bp, Homo sapiens
ggcttatttagaaaaaa

SEQ ID NO: 2965483 - DNA, 21 bp, Homo sapiens
ggcttcactctccctgacggc

SEQ ID NO: 2965484 - DNA, 16 bp, Homo sapiens
ggcttcagctccagcc

SEQ ID NO: 2965485 - DNA, 19 bp, Homo sapiens
ggcttcaggcaattctcct

SEQ ID NO: 2965486 - DNA, 16 bp, Homo sapiens
ggcttcagggcaggtg

SEQ ID NO: 2965487 - DNA, 22 bp, Homo sapiens
ggcttcggaacacggagtggcc

SEQ ID NO: 2965488 - DNA, 18 bp, Homo sapiens
ggcttctcctttggcatg

SEQ ID NO: 2965489 - DNA, 20 bp, Homo sapiens
ggcttctcctttggcatgtt

SEQ ID NO: 2965490 - DNA, 22 bp, Homo sapiens
ggcttctcctttggcatgttta

SEQ ID NO: 2965491 - DNA, 13 bp, Homo sapiens
ggcttctctgtct

SEQ ID NO: 2965492 - DNA, 16 bp, Homo sapiens
ggcttctctgtctctg

SEQ ID NO: 2965493 - DNA, 18 bp, Homo sapiens
ggcttctgcgtccaccag

SEQ ID NO: 2965494 - DNA, 18 bp, Homo sapiens
ggcttctggccaggaagc

SEQ ID NO: 2965495 - DNA, 15 bp, Homo sapiens
ggcttctttctccct

SEQ ID NO: 2965496 - DNA, 11 bp, Homo sapiens
ggcttgaattt

SEQ ID NO: 2965497 - DNA, 17 bp, Homo sapiens
ggcttgaatttgcatgt

SEQ ID NO: 2965498 - DNA, 17 bp, Homo sapiens
ggcttgactttggctga

SEQ ID NO: 2965499 - DNA, 19 bp, Homo sapiens
ggcttggcatctgtgtgcg

SEQ ID NO: 2965500 - DNA, 16 bp, Homo sapiens
ggcttgggctggtcag

SEQ ID NO: 2965501 - DNA, 17 bp, Homo sapiens
ggcttgtacatttttaa

SEQ ID NO: 2965502 - DNA, 21 bp, Homo sapiens
ggcttgtacatttttaaattc

SEQ ID NO: 2965503 - DNA, 12 bp, Homo sapiens
ggcttgtttatt

SEQ ID NO: 2965504 - DNA, 17 bp, Homo sapiens
ggcttgttttattttgg

SEQ ID NO: 2965505 - DNA, 16 bp, Homo sapiens
ggctttaaaagaaaaa

SEQ ID NO: 2965506 - DNA, 17 bp, Homo sapiens
ggctttaaaagaaaaaa

SEQ ID NO: 2965507 - DNA, 13 bp, Homo sapiens
ggctttcagctta

SEQ ID NO: 2965508 - DNA, 14 bp, Homo sapiens
ggctttcggggagg

SEQ ID NO: 2965509 - DNA, 20 bp, Homo sapiens
ggctttcgtccacagcttcc

SEQ ID NO: 2965510 - DNA, 13 bp, Homo sapiens
ggctttggcttct

SEQ ID NO: 2965511 - DNA, 15 bp, Homo sapiens
ggctttggggtccta

SEQ ID NO: 2965512 - DNA, 19 bp, Homo sapiens
ggctttgtcttgaaaaaaa

SEQ ID NO: 2965513 - DNA, 15 bp, Homo sapiens
ggctttgttcttgtc

SEQ ID NO: 2965514 - DNA, 24 bp, Homo sapiens
ggctttgttcttgtcatcagtaag

SEQ ID NO: 2965515 - DNA, 14 bp, Homo sapiens
ggctttgttgctgg

SEQ ID NO: 2965516 - DNA, 20 bp, Homo sapiens
ggcttttattaatgcacttt

SEQ ID NO: 2965517 - DNA, 15 bp, Homo sapiens
ggcttttctcagctg

SEQ ID NO: 2965518 - DNA, 13 bp, Homo sapiens
ggcttttctgttt

SEQ ID NO: 2965519 - DNA, 14 bp, Homo sapiens
ggcttttgttctga

SEQ ID NO: 2965520 - DNA, 22 bp, Homo sapiens
gggaaaactgccaatatagaaa

SEQ ID NO: 2965521 - DNA, 17 bp, Homo sapiens
gggaaaattatttgcat

SEQ ID NO: 2965522 - DNA, 22 bp, Homo sapiens
gggaaacaaataatttgaactt

SEQ ID NO: 2965523 - DNA, 23 bp, Homo sapiens
gggaaacaaataatttgaacttt

SEQ ID NO: 2965524 - DNA, 15 bp, Homo sapiens
gggaaacactccttg

SEQ ID NO: 2965525 - DNA, 16 bp, Homo sapiens
gggaaacactccttgc

SEQ ID NO: 2965526 - DNA, 20 bp, Homo sapiens
gggaaacgtgggttcaattt

SEQ ID NO: 2965527 - DNA, 12 bp, Homo sapiens
gggaaactggct

SEQ ID NO: 2965528 - DNA, 14 bp, Homo sapiens
gggaaactgtgaat

SEQ ID NO: 2965529 - DNA, 17 bp, Homo sapiens
gggaaagacactgcctg

SEQ ID NO: 2965530 - DNA, 21 bp, Homo sapiens
gggaaataccttgagcagaat

SEQ ID NO: 2965531 - DNA, 10 bp, Homo sapiens
gggaacattt

SEQ ID NO: 2965532 - DNA, 15 bp, Homo sapiens
gggaacgcagcctcc

SEQ ID NO: 2965533 - DNA, 19 bp, Homo sapiens
gggaagaaaagagctttct

SEQ ID NO: 2965534 - DNA, 20 bp, Homo sapiens
gggaagaaacactttctctt

SEQ ID NO: 2965535 - DNA, 19 bp, Homo sapiens
gggaagagatccaaagact

SEQ ID NO: 2965536 - DNA, 12 bp, Homo sapiens
gggaagccagac

SEQ ID NO: 2965537 - DNA, 12 bp, Homo sapiens
gggaagctgcta

SEQ ID NO: 2965538 - DNA, 15 bp, Homo sapiens
gggaaggatcccatg

SEQ ID NO: 2965539 - DNA, 12 bp, Homo sapiens
gggaaggccagc

SEQ ID NO: 2965540 - DNA, 14 bp, Homo sapiens
gggaaggctgcaaa

SEQ ID NO: 2965541 - DNA, 17 bp, Homo sapiens
gggaaggggcctccctc

SEQ ID NO: 2965542 - DNA, 18 bp, Homo sapiens
gggaaggggcctccctcc

SEQ ID NO: 2965543 - DNA, 15 bp, Homo sapiens
gggaaggggctaggg

SEQ ID NO: 2965544 - DNA, 14 bp, Homo sapiens
gggaaggggtgcag

SEQ ID NO: 2965545 - DNA, 13 bp, Homo sapiens
gggaaggtgaccg

SEQ ID NO: 2965546 - DNA, 14 bp, Homo sapiens
gggaagtaaaaaaa

SEQ ID NO: 2965547 - DNA, 16 bp, Homo sapiens
gggaagtacgtcccag

SEQ ID NO: 2965548 - DNA, 19 bp, Homo sapiens
gggaataaatatgcctctc

SEQ ID NO: 2965549 - DNA, 18 bp, Homo sapiens
gggaatctcccagacttg

SEQ ID NO: 2965550 - DNA, 17 bp, Homo sapiens
gggaattaaataaataa

SEQ ID NO: 2965551 - DNA, 18 bp, Homo sapiens
gggacagagacacctgca

SEQ ID NO: 2965552 - DNA, 23 bp, Homo sapiens
gggacaggctggaatgagggagg

SEQ ID NO: 2965553 - DNA, 22 bp, Homo sapiens
gggacatcacagggtgggcctc

SEQ ID NO: 2965554 - DNA, 20 bp, Homo sapiens
gggacatgctaaataactat

SEQ ID NO: 2965555 - DNA, 16 bp, Homo sapiens
aagctgtgttgaaaca

SEQ ID NO: 2965556 - DNA, 20 bp, Homo sapiens
aagctgtgttgaaacagaaa

SEQ ID NO: 2965557 - DNA, 23 bp, Homo sapiens
aagctgtgttgaaacagaaaaat

SEQ ID NO: 2965558 - DNA, 16 bp, Homo sapiens
aagctgttaaagatat

SEQ ID NO: 2965559 - DNA, 14 bp, Homo sapiens
aagctgttattctt

SEQ ID NO: 2965560 - DNA, 17 bp, Homo sapiens
aagctgttattcttgtt

SEQ ID NO: 2965561 - DNA, 13 bp, Homo sapiens
aagctgttcctgt

SEQ ID NO: 2965562 - DNA, 18 bp, Homo sapiens
aagcttatgcttaaattc

SEQ ID NO: 2965563 - DNA, 18 bp, Homo sapiens
aagcttctgccttctgga

SEQ ID NO: 2965564 - DNA, 21 bp, Homo sapiens
aagcttgtgtatccattatca

SEQ ID NO: 2965565 - DNA, 15 bp, Homo sapiens
aagcttgttttccag

SEQ ID NO: 2965566 - DNA, 22 bp, Homo sapiens
aagctttactggggctggggaa

SEQ ID NO: 2965567 - DNA, 19 bp, Homo sapiens
aagctttggtgagaacctg

SEQ ID NO: 2965568 - DNA, 12 bp, Homo sapiens
aagctttttaat

SEQ ID NO: 2965569 - DNA, 20 bp, Homo sapiens
aaggaaaaaattatgttttt

SEQ ID NO: 2965570 - DNA, 22 bp, Homo sapiens
aaggaaaactatgtattaattt

SEQ ID NO: 2965571 - DNA, 14 bp, Homo sapiens
aaggaaaactgcat

SEQ ID NO: 2965572 - DNA, 16 bp, Homo sapiens
aaggaaaagattcctg

SEQ ID NO: 2965573 - DNA, 14 bp, Homo sapiens
aaggaaaagcacaa

SEQ ID NO: 2965574 - DNA, 11 bp, Homo sapiens
aaggaaagaaa

SEQ ID NO: 2965575 - DNA, 18 bp, Homo sapiens
aaggaaagatgatgctca

SEQ ID NO: 2965576 - DNA, 22 bp, Homo sapiens
aaggaaagatgatgctcagttt

SEQ ID NO: 2965577 - DNA, 18 bp, Homo sapiens
aaggaaatgagtggccag

SEQ ID NO: 2965578 - DNA, 20 bp, Homo sapiens
aaggaaatgcaagctctgga

SEQ ID NO: 2965579 - DNA, 13 bp, Homo sapiens
aaggaacaaaaat

SEQ ID NO: 2965580 - DNA, 22 bp, Homo sapiens
aaggaaccaaagcgaattttaa

SEQ ID NO: 2965581 - DNA, 23 bp, Homo sapiens
aaggaaccaaagcgaattttaaa

SEQ ID NO: 2965582 - DNA, 16 bp, Homo sapiens
aaggaagctaaaagca

SEQ ID NO: 2965583 - DNA, 14 bp, Homo sapiens
aaggaaggagagat

SEQ ID NO: 2965584 - DNA, 13 bp, Homo sapiens
aaggaatataatg

SEQ ID NO: 2965585 - DNA, 15 bp, Homo sapiens
aaggaatcaaatctt

SEQ ID NO: 2965586 - DNA, 20 bp, Homo sapiens
aaggaatcactttagaaagc

SEQ ID NO: 2965587 - DNA, 23 bp, Homo sapiens
aaggaatcactttagaaagccag

SEQ ID NO: 2965588 - DNA, 14 bp, Homo sapiens
taatattgtattgc

SEQ ID NO: 2965589 - DNA, 18 bp, Homo sapiens
taatattgtattgctgct

SEQ ID NO: 2965590 - DNA, 13 bp, Homo sapiens
taatatttccaat

SEQ ID NO: 2965591 - DNA, 21 bp, Homo sapiens
taatatttcttaatttggata

SEQ ID NO: 2965592 - DNA, 12 bp, Homo sapiens
taatatttcttc

SEQ ID NO: 2965593 - DNA, 17 bp, Homo sapiens
taatatttgaagcagct

SEQ ID NO: 2965594 - DNA, 20 bp, Homo sapiens
taatatttgaagcagctctg

SEQ ID NO: 2965595 - DNA, 15 bp, Homo sapiens
taatatttgtgcttt

SEQ ID NO: 2965596 - DNA, 20 bp, Homo sapiens
taatatttgtgctttgaaaa

SEQ ID NO: 2965597 - DNA, 17 bp, Homo sapiens
taatattttatttgaaa

SEQ ID NO: 2965598 - DNA, 14 bp, Homo sapiens
taatattttctgtg

SEQ ID NO: 2965599 - DNA, 20 bp, Homo sapiens
taatcaagagtctctccagc

SEQ ID NO: 2965600 - DNA, 22 bp, Homo sapiens
taatcaagagtctctccagcct

SEQ ID NO: 2965601 - DNA, 11 bp, Homo sapiens
taatcaagatt

SEQ ID NO: 2965602 - DNA, 22 bp, Homo sapiens
taatcaataaacgatttaattc

SEQ ID NO: 2965603 - DNA, 13 bp, Homo sapiens
taatcaatttaaa

SEQ ID NO: 2965604 - DNA, 17 bp, Homo sapiens
taatcacatgtgctgca

SEQ ID NO: 2965605 - DNA, 15 bp, Homo sapiens
taatcagtgactgaa

SEQ ID NO: 2965606 - DNA, 23 bp, Homo sapiens
taatcagtgactgaaaccatttt

SEQ ID NO: 2965607 - DNA, 14 bp, Homo sapiens
taatcatactgtct

SEQ ID NO: 2965608 - DNA, 17 bp, Homo sapiens
taatcatccaatgctca

SEQ ID NO: 2965609 - DNA, 16 bp, Homo sapiens
taatcatgaaattact

SEQ ID NO: 2965610 - DNA, 18 bp, Homo sapiens
taatcatgagcctgttta

SEQ ID NO: 2965611 - DNA, 20 bp, Homo sapiens
taatcatgagcctgtttatt

SEQ ID NO: 2965612 - DNA, 22 bp, Homo sapiens
taatcatgagcctgtttattgc

SEQ ID NO: 2965613 - DNA, 17 bp, Homo sapiens
taatcattttcattcct

SEQ ID NO: 2965614 - DNA, 18 bp, Homo sapiens
taatccaggcagatccag

SEQ ID NO: 2965615 - DNA, 19 bp, Homo sapiens
taatccaggtaactttgaa

SEQ ID NO: 2965616 - DNA, 21 bp, Homo sapiens
taatcccagcattttgggaag

SEQ ID NO: 2965617 - DNA, 12 bp, Homo sapiens
taatcccagcta

SEQ ID NO: 2965618 - DNA, 14 bp, Homo sapiens
taatcccagctact

SEQ ID NO: 2965619 - DNA, 19 bp, Homo sapiens
taatccccagttcgcctgg

SEQ ID NO: 2965620 - DNA, 20 bp, Homo sapiens
taatccctatgtttgtctca

SEQ ID NO: 2965621 - DNA, 19 bp, Homo sapiens
taatccctgggcattgctt

SEQ ID NO: 2965622 - DNA, 23 bp, Homo sapiens
taatcgactcaaaaataagtcat

SEQ ID NO: 2965623 - DNA, 16 bp, Homo sapiens
taatcggcccacagct

SEQ ID NO: 2965624 - DNA, 15 bp, Homo sapiens
taatctatgtttata

SEQ ID NO: 2965625 - DNA, 17 bp, Homo sapiens
taatctcacaaaacata

SEQ ID NO: 2965626 - DNA, 17 bp, Homo sapiens
taatctcgtttcaaaaa

SEQ ID NO: 2965627 - DNA, 18 bp, Homo sapiens
taatctgaggatgagaca

SEQ ID NO: 2965628 - DNA, 13 bp, Homo sapiens
taatctgtgtaca

SEQ ID NO: 2965629 - DNA, 20 bp, Homo sapiens
taatcttaaatcagaataaa

SEQ ID NO: 2965630 - DNA, 22 bp, Homo sapiens
taatcttgaattgtaactgttc

SEQ ID NO: 2965631 - DNA, 20 bp, Homo sapiens
taatcttgctctgcttgaca

SEQ ID NO: 2965632 - DNA, 15 bp, Homo sapiens
taatcttgggtttct

SEQ ID NO: 2965633 - DNA, 20 bp, Homo sapiens
taatctttcacttgaaagat

SEQ ID NO: 2965634 - DNA, 14 bp, Homo sapiens
taatcttttacatt

SEQ ID NO: 2965635 - DNA, 15 bp, Homo sapiens
taatgaaacttggat

SEQ ID NO: 2965636 - DNA, 15 bp, Homo sapiens
taatgaaattccaga

SEQ ID NO: 2965637 - DNA, 16 bp, Homo sapiens
taatgaagaaagtgga

SEQ ID NO: 2965638 - DNA, 22 bp, Homo sapiens
taatgaagaaagtggaaaacaa

SEQ ID NO: 2965639 - DNA, 23 bp, Homo sapiens
taatgaagaaagtggaaaacaag

SEQ ID NO: 2965640 - DNA, 15 bp, Homo sapiens
taatgaaggtgtgct

SEQ ID NO: 2965641 - DNA, 18 bp, Homo sapiens
taatgaaggtgtgctaca

SEQ ID NO: 2965642 - DNA, 14 bp, Homo sapiens
taatgaattgaaat

SEQ ID NO: 2965643 - DNA, 18 bp, Homo sapiens
taatgagatatatcttta

SEQ ID NO: 2965644 - DNA, 22 bp, Homo sapiens
taatgatgacaaaaaatgtttt

SEQ ID NO: 2965645 - DNA, 22 bp, Homo sapiens
taatgatgaggatctgaaaact

SEQ ID NO: 2965646 - DNA, 16 bp, Homo sapiens
taatgatgttatctta

SEQ ID NO: 2965647 - DNA, 12 bp, Homo sapiens
taattgcattca

SEQ ID NO: 2965648 - DNA, 13 bp, Homo sapiens
taattgcattcat

SEQ ID NO: 2965649 - DNA, 18 bp, Homo sapiens
taattgctgataccatat

SEQ ID NO: 2965650 - DNA, 12 bp, Homo sapiens
taattgctgcaa

SEQ ID NO: 2965651 - DNA, 18 bp, Homo sapiens
taattgctgttgaaagca

SEQ ID NO: 2965652 - DNA, 19 bp, Homo sapiens
taattggagtgcagctaac

SEQ ID NO: 2965653 - DNA, 18 bp, Homo sapiens
taattgtactaaagccaa

SEQ ID NO: 2965654 - DNA, 19 bp, Homo sapiens
taattgtatcgtatagctg

SEQ ID NO: 2965655 - DNA, 21 bp, Homo sapiens
taattgtatcgtatagctgta

SEQ ID NO: 2965656 - DNA, 21 bp, Homo sapiens
taattgtcacatcaagcatca

SEQ ID NO: 2965657 - DNA, 19 bp, Homo sapiens
taattgtgaccaatacatt

SEQ ID NO: 2965658 - DNA, 21 bp, Homo sapiens
taattgtgaccaatacatttg

SEQ ID NO: 2965659 - DNA, 23 bp, Homo sapiens
taattgtgaccaatacatttgta

SEQ ID NO: 2965660 - DNA, 18 bp, Homo sapiens
taattgtgatatttgaca

SEQ ID NO: 2965661 - DNA, 18 bp, Homo sapiens
taattgttccctatgaaa

SEQ ID NO: 2965662 - DNA, 11 bp, Homo sapiens
taattgtttca

SEQ ID NO: 2965663 - DNA, 13 bp, Homo sapiens
taattgttttatt

SEQ ID NO: 2965664 - DNA, 21 bp, Homo sapiens
taatttaaaaaagcaaatgga

SEQ ID NO: 2965665 - DNA, 22 bp, Homo sapiens
taatttaaaaaagcaaatggaa

SEQ ID NO: 2965666 - DNA, 22 bp, Homo sapiens
taatttaagttggctagagctt

SEQ ID NO: 2965667 - DNA, 16 bp, Homo sapiens
taatttagtaaatgtt

SEQ ID NO: 2965668 - DNA, 17 bp, Homo sapiens
taatttagtaaatgtta

SEQ ID NO: 2965669 - DNA, 20 bp, Homo sapiens
taatttagtaaatgttatct

SEQ ID NO: 2965670 - DNA, 16 bp, Homo sapiens
taatttagtggattaa

SEQ ID NO: 2965671 - DNA, 18 bp, Homo sapiens
taatttagttaataaaat

SEQ ID NO: 2965672 - DNA, 15 bp, Homo sapiens
taatttatcagtaca

SEQ ID NO: 2965673 - DNA, 15 bp, Homo sapiens
taatttattaatcta

SEQ ID NO: 2965674 - DNA, 12 bp, Homo sapiens
taatttcaaaat

SEQ ID NO: 2965675 - DNA, 15 bp, Homo sapiens
taatttcaaaatgct

SEQ ID NO: 2965676 - DNA, 16 bp, Homo sapiens
taatttcaaaatgctt

SEQ ID NO: 2965677 - DNA, 19 bp, Homo sapiens
taatttcagggaaattaat

SEQ ID NO: 2965678 - DNA, 20 bp, Homo sapiens
taatttcagggaaattaatc

SEQ ID NO: 2965679 - DNA, 22 bp, Homo sapiens
taatttcagggaaattaatcaa

SEQ ID NO: 2965680 - DNA, 17 bp, Homo sapiens
taatttcctggtgtgaa

SEQ ID NO: 2965681 - DNA, 17 bp, Homo sapiens
taatttctaagtgtaag

SEQ ID NO: 2965682 - DNA, 22 bp, Homo sapiens
taatttctgcacaggtctctgt

SEQ ID NO: 2965683 - DNA, 23 bp, Homo sapiens
taatttctgcacaggtctctgtt

SEQ ID NO: 2965684 - DNA, 12 bp, Homo sapiens
taatttctttgc

SEQ ID NO: 2965685 - DNA, 16 bp, Homo sapiens
taatttctttgcctgt

SEQ ID NO: 2965686 - DNA, 18 bp, Homo sapiens
taatttctttgcctgttc

SEQ ID NO: 2965687 - DNA, 12 bp, Homo sapiens
taatttgaactt

SEQ ID NO: 2965688 - DNA, 21 bp, Homo sapiens
taatttgagatcgtccactgt

SEQ ID NO: 2965689 - DNA, 20 bp, Homo sapiens
taatttgatgaggtattttt

SEQ ID NO: 2965690 - DNA, 19 bp, Homo sapiens
taatttggataataaaaat

SEQ ID NO: 2965691 - DNA, 20 bp, Homo sapiens
taatttggataataaaaatt

SEQ ID NO: 2965692 - DNA, 16 bp, Homo sapiens
taatttggatctattt

SEQ ID NO: 2965693 - DNA, 18 bp, Homo sapiens
taatttgtttaaaattct

SEQ ID NO: 2965694 - DNA, 17 bp, Homo sapiens
taattttaaaaatggtg

SEQ ID NO: 2965695 - DNA, 21 bp, Homo sapiens
taattttacatgtttataaat

SEQ ID NO: 2965696 - DNA, 22 bp, Homo sapiens
taattttacatgtttataaatc

SEQ ID NO: 2965697 - DNA, 17 bp, Homo sapiens
taattttcctttgtcat

SEQ ID NO: 2965698 - DNA, 13 bp, Homo sapiens
taattttctatgt

SEQ ID NO: 2965699 - DNA, 17 bp, Homo sapiens
taattttggttgtattc

SEQ ID NO: 2965700 - DNA, 15 bp, Homo sapiens
taattttgtattttc

SEQ ID NO: 2965701 - DNA, 18 bp, Homo sapiens
taattttgtattttccaa

SEQ ID NO: 2965702 - DNA, 21 bp, Homo sapiens
taattttgtattttccaagtg

SEQ ID NO: 2965703 - DNA, 18 bp, Homo sapiens
taattttgtctttcaaat

SEQ ID NO: 2965704 - DNA, 19 bp, Homo sapiens
taatttttaatgatgacaa

SEQ ID NO: 2965705 - DNA, 14 bp, Homo sapiens
taatttttgtaatt

SEQ ID NO: 2965706 - DNA, 13 bp, Homo sapiens
taattttttacta

SEQ ID NO: 2965707 - DNA, 20 bp, Homo sapiens
tacaaaaaggtataaataat

SEQ ID NO: 2965708 - DNA, 17 bp, Homo sapiens
tacaaaaataaatttat

SEQ ID NO: 2965709 - DNA, 20 bp, Homo sapiens
tacaaaaggtttgagattcc

SEQ ID NO: 2965710 - DNA, 18 bp, Homo sapiens
tacaaacaaaagcagccc

SEQ ID NO: 2965711 - DNA, 20 bp, Homo sapiens
tacaaacaaaagcagccctc

SEQ ID NO: 2965712 - DNA, 13 bp, Homo sapiens
tacaaagaaaata

SEQ ID NO: 2965713 - DNA, 23 bp, Homo sapiens
tacaaagaaccatgcaggaagga

SEQ ID NO: 2965714 - DNA, 23 bp, Homo sapiens
tacataattgattaaaatctctt

SEQ ID NO: 2965715 - DNA, 16 bp, Homo sapiens
tacatacaccagcatt

SEQ ID NO: 2965716 - DNA, 21 bp, Homo sapiens
tacatacagagattgtagtat

SEQ ID NO: 2965717 - DNA, 12 bp, Homo sapiens
tacatactgctg

SEQ ID NO: 2965718 - DNA, 13 bp, Homo sapiens
tacatactgctgt

SEQ ID NO: 2965719 - DNA, 20 bp, Homo sapiens
tacatagaccctctttcttg

SEQ ID NO: 2965720 - DNA, 14 bp, Homo sapiens
tacataggatggct

SEQ ID NO: 2965721 - DNA, 18 bp, Homo sapiens
tacatagtaaagtatttt

SEQ ID NO: 2965722 - DNA, 21 bp, Homo sapiens
tacatagtgcattgtttctgt

SEQ ID NO: 2965723 - DNA, 22 bp, Homo sapiens
tacatagtgcattgtttctgtg

SEQ ID NO: 2965724 - DNA, 14 bp, Homo sapiens
tacatatttcagtt

SEQ ID NO: 2965725 - DNA, 14 bp, Homo sapiens
tacatcacttcctg

SEQ ID NO: 2965726 - DNA, 22 bp, Homo sapiens
tacatcatgctggaacctgcaa

SEQ ID NO: 2965727 - DNA, 16 bp, Homo sapiens
tacatcccatgtaaca

SEQ ID NO: 2965728 - DNA, 17 bp, Homo sapiens
tacatcccatgtaacag

SEQ ID NO: 2965729 - DNA, 21 bp, Homo sapiens
tacatcccatgtaacagaaag

SEQ ID NO: 2965730 - DNA, 17 bp, Homo sapiens
tacatcctttttctgct

SEQ ID NO: 2965731 - DNA, 20 bp, Homo sapiens
tacatctgaacaaaatgcct

SEQ ID NO: 2965732 - DNA, 19 bp, Homo sapiens
tacatctgaggtcctgtga

SEQ ID NO: 2965733 - DNA, 14 bp, Homo sapiens
tacatctttcacat

SEQ ID NO: 2965734 - DNA, 18 bp, Homo sapiens
tacatcttttttcacaaa

SEQ ID NO: 2965735 - DNA, 20 bp, Homo sapiens
tacatcttttttcacaaatt

SEQ ID NO: 2965736 - DNA, 19 bp, Homo sapiens
tacatgaaaatttgtttga

SEQ ID NO: 2965737 - DNA, 19 bp, Homo sapiens
tacatgaaatttttgtaaa

SEQ ID NO: 2965738 - DNA, 18 bp, Homo sapiens
tacatgagaacaaacaga

SEQ ID NO: 2965739 - DNA, 20 bp, Homo sapiens
tacatgaggaactgtagatg

SEQ ID NO: 2965740 - DNA, 17 bp, Homo sapiens
tacatgcatacttcaaa

SEQ ID NO: 2965741 - DNA, 19 bp, Homo sapiens
tacatgcatacttcaaaag

SEQ ID NO: 2965742 - DNA, 16 bp, Homo sapiens
tacatggcagagtttg

SEQ ID NO: 2965743 - DNA, 20 bp, Homo sapiens
tacatggcagtgttttagtt

SEQ ID NO: 2965744 - DNA, 14 bp, Homo sapiens
tacatgtaatttga

SEQ ID NO: 2965745 - DNA, 15 bp, Homo sapiens
tacatgtacatagta

SEQ ID NO: 2965746 - DNA, 12 bp, Homo sapiens
tacatgtattat

SEQ ID NO: 2965747 - DNA, 15 bp, Homo sapiens
tacatgtgctggaag

SEQ ID NO: 2965748 - DNA, 16 bp, Homo sapiens
tacatgtgtagcctgt

SEQ ID NO: 2965749 - DNA, 18 bp, Homo sapiens
tacatgtgtagcctgtgc

SEQ ID NO: 2965750 - DNA, 18 bp, Homo sapiens
tacatgttattgttttca

SEQ ID NO: 2965751 - DNA, 21 bp, Homo sapiens
tacattagtcattcaataaat

SEQ ID NO: 2965752 - DNA, 21 bp, Homo sapiens
tacattctctaataagaaaac

SEQ ID NO: 2965753 - DNA, 17 bp, Homo sapiens
tacattgcctgactaaa

SEQ ID NO: 2965754 - DNA, 16 bp, Homo sapiens
tacatttaatacagat

SEQ ID NO: 2965755 - DNA, 13 bp, Homo sapiens
tacatttgtattt

SEQ ID NO: 2965756 - DNA, 18 bp, Homo sapiens
tacatttgtattttgtga

SEQ ID NO: 2965757 - DNA, 23 bp, Homo sapiens
tacatttgtattttgtgatgaat

SEQ ID NO: 2965758 - DNA, 18 bp, Homo sapiens
tacattttgctctgtgaa

SEQ ID NO: 2965759 - DNA, 16 bp, Homo sapiens
tacatttttaaattct

SEQ ID NO: 2965760 - DNA, 17 bp, Homo sapiens
tacatttttaaattctt

SEQ ID NO: 2965761 - DNA, 20 bp, Homo sapiens
tacatttttcaactttgaat

SEQ ID NO: 2965762 - DNA, 13 bp, Homo sapiens
tacattttttctt

SEQ ID NO: 2965763 - DNA, 18 bp, Homo sapiens
tacattttttctttatca

SEQ ID NO: 2965764 - DNA, 12 bp, Homo sapiens
taccaaacagca

SEQ ID NO: 2965765 - DNA, 19 bp, Homo sapiens
taccaaaggtttttaaagt

SEQ ID NO: 2965766 - DNA, 17 bp, Homo sapiens
taccaaagtgtcttttg

SEQ ID NO: 2965767 - DNA, 13 bp, Homo sapiens
aaaaaaaaaaaga

SEQ ID NO: 2965768 - DNA, 13 bp, Homo sapiens
aaaaaaaaaccaa

SEQ ID NO: 2965769 - DNA, 12 bp, Homo sapiens
aaaaaaaaatgc

SEQ ID NO: 2965770 - DNA, 11 bp, Homo sapiens
aaaaaaaagag

SEQ ID NO: 2965771 - DNA, 11 bp, Homo sapiens
aaaaaaaagtt

SEQ ID NO: 2965772 - DNA, 13 bp, Homo sapiens
aaaaaaaatagga

SEQ ID NO: 2965773 - DNA, 13 bp, Homo sapiens
aaaaaaaatgcca

SEQ ID NO: 2965774 - DNA, 11 bp, Homo sapiens
aaaaaaacaaa

SEQ ID NO: 2965775 - DNA, 11 bp, Homo sapiens
aaaaaaaccaa

SEQ ID NO: 2965776 - DNA, 12 bp, Homo sapiens
aaaaaaagcatg

SEQ ID NO: 2965777 - DNA, 14 bp, Homo sapiens
aaaaaaagtattat

SEQ ID NO: 2965778 - DNA, 12 bp, Homo sapiens
aaaaaaataata

SEQ ID NO: 2965779 - DNA, 15 bp, Homo sapiens
aaaaaagaagtttgg

SEQ ID NO: 2965780 - DNA, 12 bp, Homo sapiens
aaaaaagaattc

SEQ ID NO: 2965781 - DNA, 12 bp, Homo sapiens
aaaaaaggaaaa

SEQ ID NO: 2965782 - DNA, 19 bp, Homo sapiens
aaaaaaggttaatttttcc

SEQ ID NO: 2965783 - DNA, 22 bp, Homo sapiens
aaaaaagtacaattcattgttt

SEQ ID NO: 2965784 - DNA, 12 bp, Homo sapiens
aaaaaagttata

SEQ ID NO: 2965785 - DNA, 19 bp, Homo sapiens
aaaaaatatagcctttaca

SEQ ID NO: 2965786 - DNA, 12 bp, Homo sapiens
aaaaaatgcttc

SEQ ID NO: 2965787 - DNA, 11 bp, Homo sapiens
aaaaaatgttg

SEQ ID NO: 2965788 - DNA, 13 bp, Homo sapiens
aaaaaatgttgtt

SEQ ID NO: 2965789 - DNA, 22 bp, Homo sapiens
aaaaaatttgagaaagccttca

SEQ ID NO: 2965790 - DNA, 13 bp, Homo sapiens
aaaaacaacaaat

SEQ ID NO: 2965791 - DNA, 22 bp, Homo sapiens
aaaccatgtgactaaaaatgca

SEQ ID NO: 2965792 - DNA, 12 bp, Homo sapiens
aaaccattggac

SEQ ID NO: 2965793 - DNA, 15 bp, Homo sapiens
aaacccaatccaaat

SEQ ID NO: 2965794 - DNA, 15 bp, Homo sapiens
aaacccagactgaac

SEQ ID NO: 2965795 - DNA, 17 bp, Homo sapiens
aaacccagttgccatct

SEQ ID NO: 2965796 - DNA, 13 bp, Homo sapiens
aaacccccatctc

SEQ ID NO: 2965797 - DNA, 12 bp, Homo sapiens
aaacccctggct

SEQ ID NO: 2965798 - DNA, 14 bp, Homo sapiens
aaacctacagcata

SEQ ID NO: 2965799 - DNA, 14 bp, Homo sapiens
aaacctagccggaa

SEQ ID NO: 2965800 - DNA, 12 bp, Homo sapiens
aaacctgcattt

SEQ ID NO: 2965801 - DNA, 20 bp, Homo sapiens
aaacctgcatttttaaagga

SEQ ID NO: 2965802 - DNA, 14 bp, Homo sapiens
aaacctgggagaga

SEQ ID NO: 2965803 - DNA, 19 bp, Homo sapiens
aaacctgtagatgcagaaa

SEQ ID NO: 2965804 - DNA, 22 bp, Homo sapiens
aaacctgtagatgcagaaaaag

SEQ ID NO: 2965805 - DNA, 12 bp, Homo sapiens
aaacctgtatct

SEQ ID NO: 2965806 - DNA, 14 bp, Homo sapiens
aaacctgtgcctcc

SEQ ID NO: 2965807 - DNA, 21 bp, Homo sapiens
aaacctgttgaagattatttc

SEQ ID NO: 2965808 - DNA, 16 bp, Homo sapiens
aaaccttgaaggtctg

SEQ ID NO: 2965809 - DNA, 22 bp, Homo sapiens
aaaccttgggccctggaagagt

SEQ ID NO: 2965810 - DNA, 17 bp, Homo sapiens
aaaccttgtttgtttta

SEQ ID NO: 2965811 - DNA, 13 bp, Homo sapiens
aaacctttccatt

SEQ ID NO: 2965812 - DNA, 22 bp, Homo sapiens
aaacctttgcttaccttgtttt

SEQ ID NO: 2965813 - DNA, 13 bp, Homo sapiens
aaaccttttgaaa

SEQ ID NO: 2965814 - DNA, 23 bp, Homo sapiens
aaacgagatgtttgccaaataaa

SEQ ID NO: 2965815 - DNA, 18 bp, Homo sapiens
aaacgctacctctctgtc

SEQ ID NO: 2965816 - DNA, 17 bp, Homo sapiens
aaacgtatgcatgtgaa

SEQ ID NO: 2965817 - DNA, 18 bp, Homo sapiens
aaacgtatggaatgcttc

SEQ ID NO: 2965818 - DNA, 19 bp, Homo sapiens
aaacgtatggaatgcttct

SEQ ID NO: 2965819 - DNA, 14 bp, Homo sapiens
aaacgtctcccaga

SEQ ID NO: 2965820 - DNA, 22 bp, Homo sapiens
aaacgtgaggactcaggaaaaa

SEQ ID NO: 2965821 - DNA, 18 bp, Homo sapiens
aaacgttaaaagtgtaca

SEQ ID NO: 2965822 - DNA, 17 bp, Homo sapiens
aaactaaatgtgtacac

SEQ ID NO: 2965823 - DNA, 21 bp, Homo sapiens
aaactaaggaaccctggaaac

SEQ ID NO: 2965824 - DNA, 13 bp, Homo sapiens
aaactaaggtgct

SEQ ID NO: 2965825 - DNA, 16 bp, Homo sapiens
aaactaatattttatg

SEQ ID NO: 2965826 - DNA, 20 bp, Homo sapiens
aaactaatggtccacaccca

SEQ ID NO: 2965827 - DNA, 20 bp, Homo sapiens
aaactaccagtgggcatgta

SEQ ID NO: 2965828 - DNA, 23 bp, Homo sapiens
aaactaccagtgggcatgtatta

SEQ ID NO: 2965829 - DNA, 16 bp, Homo sapiens
aaactagatgacctca

SEQ ID NO: 2965830 - DNA, 19 bp, Homo sapiens
aaactagggttttggcctg

SEQ ID NO: 2965831 - DNA, 17 bp, Homo sapiens
aaactagtagttctctt

SEQ ID NO: 2965832 - DNA, 16 bp, Homo sapiens
aaactataaagtttta

SEQ ID NO: 2965833 - DNA, 15 bp, Homo sapiens
aaactataaatacaa

SEQ ID NO: 2965834 - DNA, 23 bp, Homo sapiens
aaactataaatacaaatctgtat

SEQ ID NO: 2965835 - DNA, 14 bp, Homo sapiens
aaactatgaaacct

SEQ ID NO: 2965836 - DNA, 19 bp, Homo sapiens
aaactatgtattaatttag

SEQ ID NO: 2965837 - DNA, 21 bp, Homo sapiens
aaactattaaggatgtagctt

SEQ ID NO: 2965838 - DNA, 22 bp, Homo sapiens
aaactattaaggatgtagcttt

SEQ ID NO: 2965839 - DNA, 19 bp, Homo sapiens
aaactattcatgctaccca

SEQ ID NO: 2965840 - DNA, 15 bp, Homo sapiens
aaactattccatgtt

SEQ ID NO: 2965841 - DNA, 19 bp, Homo sapiens
aaactatttacaatgtgta

SEQ ID NO: 2965842 - DNA, 11 bp, Homo sapiens
aaactatttat

SEQ ID NO: 2965843 - DNA, 22 bp, Homo sapiens
aaactcatttcctatgtaactg

SEQ ID NO: 2965844 - DNA, 12 bp, Homo sapiens
aaactccagggt

SEQ ID NO: 2965845 - DNA, 23 bp, Homo sapiens
aaactccagggtcccctgccacc

SEQ ID NO: 2965846 - DNA, 15 bp, Homo sapiens
aaactcctactgctt

SEQ ID NO: 2965847 - DNA, 22 bp, Homo sapiens
aaactcgagaccataaagatat

SEQ ID NO: 2965848 - DNA, 16 bp, Homo sapiens
aaactcgaggactgta

SEQ ID NO: 2965849 - DNA, 19 bp, Homo sapiens
aaactcgaggactgtattt

SEQ ID NO: 2965850 - DNA, 23 bp, Homo sapiens
aaactcgaggactgtatttgtga

SEQ ID NO: 2965851 - DNA, 15 bp, Homo sapiens
aaactctacatttaa

SEQ ID NO: 2965852 - DNA, 17 bp, Homo sapiens
aaactctcttcttccat

SEQ ID NO: 2965853 - DNA, 20 bp, Homo sapiens
aaactctgttgcaagtgcaa

SEQ ID NO: 2965854 - DNA, 22 bp, Homo sapiens
aaactcttcagttaattcttag

SEQ ID NO: 2965855 - DNA, 12 bp, Homo sapiens
aaactcttgcta

SEQ ID NO: 2965856 - DNA, 11 bp, Homo sapiens
aaactgagcct

SEQ ID NO: 2965857 - DNA, 18 bp, Homo sapiens
aaactgagcctcacttgc

SEQ ID NO: 2965858 - DNA, 21 bp, Homo sapiens
aaactgagctcgcagcccccg

SEQ ID NO: 2965859 - DNA, 22 bp, Homo sapiens
aaactgcagtcatcaacaatga

SEQ ID NO: 2965860 - DNA, 18 bp, Homo sapiens
aaactgccataacatacc

SEQ ID NO: 2965861 - DNA, 17 bp, Homo sapiens
aaactggagaaatgatt

SEQ ID NO: 2965862 - DNA, 9 bp, Homo sapiens
aaactggct

SEQ ID NO: 2965863 - DNA, 13 bp, Homo sapiens
aaactggctttgg

SEQ ID NO: 2965864 - DNA, 19 bp, Homo sapiens
aaactgggatgaaactaaa

SEQ ID NO: 2965865 - DNA, 17 bp, Homo sapiens
aaactgtaatacaatga

SEQ ID NO: 2965866 - DNA, 18 bp, Homo sapiens
aaactgtagaaatgatga

SEQ ID NO: 2965867 - DNA, 12 bp, Homo sapiens
aaactgtgaatg

SEQ ID NO: 2965868 - DNA, 22 bp, Homo sapiens
aaacttacctataaattaagaa

SEQ ID NO: 2965869 - DNA, 13 bp, Homo sapiens
aaacttatgaatg

SEQ ID NO: 2965870 - DNA, 17 bp, Homo sapiens
aaacttccccatcttct

SEQ ID NO: 2965871 - DNA, 13 bp, Homo sapiens
aaacttgaagcag

SEQ ID NO: 2965872 - DNA, 19 bp, Homo sapiens
aaacttgtaaataaaggaa

SEQ ID NO: 2965873 - DNA, 17 bp, Homo sapiens
aaacttgtcacttgcat

SEQ ID NO: 2965874 - DNA, 19 bp, Homo sapiens
aaacttgtcacttgcatgt

SEQ ID NO: 2965875 - DNA, 18 bp, Homo sapiens
aaacttgtgagcatcaga

SEQ ID NO: 2965876 - DNA, 18 bp, Homo sapiens
aaacttgttactaaagaa

SEQ ID NO: 2965877 - DNA, 21 bp, Homo sapiens
aaactttactaagatgacatt

SEQ ID NO: 2965878 - DNA, 14 bp, Homo sapiens
aaacttttctcaga

SEQ ID NO: 2965879 - DNA, 12 bp, Homo sapiens
aaacttttgttt

SEQ ID NO: 2965880 - DNA, 13 bp, Homo sapiens
aaagaaaacattc

SEQ ID NO: 2965881 - DNA, 17 bp, Homo sapiens
aaagaaaacattccaga

SEQ ID NO: 2965882 - DNA, 20 bp, Homo sapiens
aaagaaacccgacagaggga

SEQ ID NO: 2965883 - DNA, 16 bp, Homo sapiens
aaagaaagagagaaaa

SEQ ID NO: 2965884 - DNA, 20 bp, Homo sapiens
aaagaaaggtgccatgtctt

SEQ ID NO: 2965885 - DNA, 13 bp, Homo sapiens
aaagaaagtgaaa

SEQ ID NO: 2965886 - DNA, 15 bp, Homo sapiens
aaagaaataataata

SEQ ID NO: 2965887 - DNA, 16 bp, Homo sapiens
aaagaaataataatat

SEQ ID NO: 2965888 - DNA, 17 bp, Homo sapiens
aaagaaattatctttag

SEQ ID NO: 2965889 - DNA, 23 bp, Homo sapiens
aaagaaattatctttagttgaat

SEQ ID NO: 2965890 - DNA, 18 bp, Homo sapiens
aaagaaattcgcatgttt

SEQ ID NO: 2965891 - DNA, 20 bp, Homo sapiens
aaagaaattcgcatgtttaa

SEQ ID NO: 2965892 - DNA, 21 bp, Homo sapiens
aaagaaattcgcatgtttaat

SEQ ID NO: 2965893 - DNA, 19 bp, Homo sapiens
aaagaacatgcagtttgaa

SEQ ID NO: 2965894 - DNA, 16 bp, Homo sapiens
aaagaaccatgcagga

SEQ ID NO: 2965895 - DNA, 12 bp, Homo sapiens
aaagaagaacag

SEQ ID NO: 2965896 - DNA, 13 bp, Homo sapiens
aaagaagaacagc

SEQ ID NO: 2965897 - DNA, 15 bp, Homo sapiens
aaagaagaacagctg

SEQ ID NO: 2965898 - DNA, 20 bp, Homo sapiens
aaagaagaatgtgtttcaaa

SEQ ID NO: 2965899 - DNA, 10 bp, Homo sapiens
aaagaagaca

SEQ ID NO: 2965900 - DNA, 12 bp, Homo sapiens
aaagaagacatg

SEQ ID NO: 2965901 - DNA, 12 bp, Homo sapiens
aaagaagccaca

SEQ ID NO: 2965902 - DNA, 16 bp, Homo sapiens
aaagaagcccccagct

SEQ ID NO: 2965903 - DNA, 14 bp, Homo sapiens
aaagaatacttgaa

SEQ ID NO: 2965904 - DNA, 17 bp, Homo sapiens
aaagaatacttgaactt

SEQ ID NO: 2965905 - DNA, 15 bp, Homo sapiens
aaagaatatgacttt

SEQ ID NO: 2965906 - DNA, 20 bp, Homo sapiens
aaagaatcggcagtattttc

SEQ ID NO: 2965907 - DNA, 12 bp, Homo sapiens
aaagaatctact

SEQ ID NO: 2965908 - DNA, 18 bp, Homo sapiens
aaagaatgggcagttaca

SEQ ID NO: 2965909 - DNA, 20 bp, Homo sapiens
aaagaattacttgtgttact

SEQ ID NO: 2965910 - DNA, 22 bp, Homo sapiens
aaagacaaattctgtttcttga

SEQ ID NO: 2965911 - DNA, 17 bp, Homo sapiens
aaagacaatcactgaaa

SEQ ID NO: 2965912 - DNA, 15 bp, Homo sapiens
aaagacaattcttta

SEQ ID NO: 2965913 - DNA, 17 bp, Homo sapiens
aaagacaattctttata

SEQ ID NO: 2965914 - DNA, 19 bp, Homo sapiens
aaagacaattctttataca

SEQ ID NO: 2965915 - DNA, 20 bp, Homo sapiens
aaagacaattctttatacaa

SEQ ID NO: 2965916 - DNA, 17 bp, Homo sapiens
aaagacactgcctgggc

SEQ ID NO: 2965917 - DNA, 16 bp, Homo sapiens
aaagacagcagacaaa

SEQ ID NO: 2965918 - DNA, 13 bp, Homo sapiens
aaagacaggaaga

SEQ ID NO: 2965919 - DNA, 13 bp, Homo sapiens
aaagacatctttc

SEQ ID NO: 2965920 - DNA, 17 bp, Homo sapiens
aaagaccaaattttgag

SEQ ID NO: 2965921 - DNA, 15 bp, Homo sapiens
aaagacgatgtttat

SEQ ID NO: 2965922 - DNA, 22 bp, Homo sapiens
aaagacgatgtttatgttctta

SEQ ID NO: 2965923 - DNA, 22 bp, Homo sapiens
aaagacgctaataaaaatttat

SEQ ID NO: 2965924 - DNA, 21 bp, Homo sapiens
aaatgatctggtggttattta

SEQ ID NO: 2965925 - DNA, 17 bp, Homo sapiens
aaatgatgcaaccaaaa

SEQ ID NO: 2965926 - DNA, 16 bp, Homo sapiens
aaatgatgtgttggtt

SEQ ID NO: 2965927 - DNA, 13 bp, Homo sapiens
aaatgcaaatcct

SEQ ID NO: 2965928 - DNA, 16 bp, Homo sapiens
aaatgcaagctctgga

SEQ ID NO: 2965929 - DNA, 14 bp, Homo sapiens
aaatgcagtatatt

SEQ ID NO: 2965930 - DNA, 16 bp, Homo sapiens
aaatgcatccattcct

SEQ ID NO: 2965931 - DNA, 20 bp, Homo sapiens
aaatgcattgtatcgatgtt

SEQ ID NO: 2965932 - DNA, 23 bp, Homo sapiens
aaatgccataatacaaaaggctc

SEQ ID NO: 2965933 - DNA, 19 bp, Homo sapiens
aaatgccatttatttattg

SEQ ID NO: 2965934 - DNA, 20 bp, Homo sapiens
aaatgccatttatttattga

SEQ ID NO: 2965935 - DNA, 13 bp, Homo sapiens
aaatgcccaagga

SEQ ID NO: 2965936 - DNA, 12 bp, Homo sapiens
aaatgcccagtt

SEQ ID NO: 2965937 - DNA, 17 bp, Homo sapiens
aaatgctcaatttcagc

SEQ ID NO: 2965938 - DNA, 19 bp, Homo sapiens
aaatgctgtgcaaacagtg

SEQ ID NO: 2965939 - DNA, 14 bp, Homo sapiens
aaatggaaaatgta

SEQ ID NO: 2965940 - DNA, 14 bp, Homo sapiens
aaatggaaattttg

SEQ ID NO: 2965941 - DNA, 17 bp, Homo sapiens
aaatggaattactccaa

SEQ ID NO: 2965942 - DNA, 13 bp, Homo sapiens
aaatggatactgg

SEQ ID NO: 2965943 - DNA, 22 bp, Homo sapiens
aaatggatgccttgaataataa

SEQ ID NO: 2965944 - DNA, 23 bp, Homo sapiens
aaatggatgccttgaataataag

SEQ ID NO: 2965945 - DNA, 17 bp, Homo sapiens
aaatggctctgtgaaat

SEQ ID NO: 2965946 - DNA, 19 bp, Homo sapiens
aaatgggaaaaataaaaga

SEQ ID NO: 2965947 - DNA, 21 bp, Homo sapiens
aaatgggaacatttattttat

SEQ ID NO: 2965948 - DNA, 15 bp, Homo sapiens
aaatgggaatttata

SEQ ID NO: 2965949 - DNA, 20 bp, Homo sapiens
aaatgggacttcttttcaca

SEQ ID NO: 2965950 - DNA, 13 bp, Homo sapiens
aaatggggccaga

SEQ ID NO: 2965951 - DNA, 17 bp, Homo sapiens
aaatggggccagatcca

SEQ ID NO: 2965952 - DNA, 21 bp, Homo sapiens
aaatggggccagatccagcct

SEQ ID NO: 2965953 - DNA, 18 bp, Homo sapiens
aaatggtagctgaaaaaa

SEQ ID NO: 2965954 - DNA, 22 bp, Homo sapiens
aaatggtagctgaaaaaactat

SEQ ID NO: 2965955 - DNA, 19 bp, Homo sapiens
aaatggtaggcatttccta

SEQ ID NO: 2965956 - DNA, 20 bp, Homo sapiens
aaatggtcctatttttgtga

SEQ ID NO: 2965957 - DNA, 20 bp, Homo sapiens
aaatggtggcttcagctcca

SEQ ID NO: 2965958 - DNA, 19 bp, Homo sapiens
aaatgtaaaaaacaaaaaa

SEQ ID NO: 2965959 - DNA, 16 bp, Homo sapiens
aaatgtaaaattgaaa

SEQ ID NO: 2965960 - DNA, 13 bp, Homo sapiens
aaatgtaaagcca

SEQ ID NO: 2965961 - DNA, 13 bp, Homo sapiens
aaatgtaacagtc

SEQ ID NO: 2965962 - DNA, 23 bp, Homo sapiens
aaatgtaactgtgccagttcttt

SEQ ID NO: 2965963 - DNA, 22 bp, Homo sapiens
aaatgtaagattatagattcta

SEQ ID NO: 2965964 - DNA, 13 bp, Homo sapiens
aaatgtactggta

SEQ ID NO: 2965965 - DNA, 14 bp, Homo sapiens
aaatgtataaactt

SEQ ID NO: 2965966 - DNA, 15 bp, Homo sapiens
aaatgtatatgcact

SEQ ID NO: 2965967 - DNA, 13 bp, Homo sapiens
aaatgtattaatg

SEQ ID NO: 2965968 - DNA, 15 bp, Homo sapiens
aaatgtcagatacaa

SEQ ID NO: 2965969 - DNA, 19 bp, Homo sapiens
aaatgtctgggaagccctc

SEQ ID NO: 2965970 - DNA, 20 bp, Homo sapiens
aaatgtctgtaaatatgttt

SEQ ID NO: 2965971 - DNA, 21 bp, Homo sapiens
aaatgtctgttttagttggaa

SEQ ID NO: 2965972 - DNA, 17 bp, Homo sapiens
aaatgtgaatttttatt

SEQ ID NO: 2965973 - DNA, 19 bp, Homo sapiens
aaatgtgatgttctaaggc

SEQ ID NO: 2965974 - DNA, 20 bp, Homo sapiens
aaatgtgatgttctaaggct

SEQ ID NO: 2965975 - DNA, 21 bp, Homo sapiens
aaatgtggtcctatttaagcc

SEQ ID NO: 2965976 - DNA, 14 bp, Homo sapiens
aaatgtggtctgcc

SEQ ID NO: 2965977 - DNA, 16 bp, Homo sapiens
aaatgtgtaataatgt

SEQ ID NO: 2965978 - DNA, 19 bp, Homo sapiens
aaatgtgttggacaaatgt

SEQ ID NO: 2965979 - DNA, 20 bp, Homo sapiens
aaatgtgttggacaaatgtg

SEQ ID NO: 2965980 - DNA, 23 bp, Homo sapiens
aaatgtgttttgtttattaaata

SEQ ID NO: 2965981 - DNA, 13 bp, Homo sapiens
aaatgttagttct

SEQ ID NO: 2965982 - DNA, 19 bp, Homo sapiens
aaatgttagtttcttggta

SEQ ID NO: 2965983 - DNA, 23 bp, Homo sapiens
aaatgttatcttatactgtacaa

SEQ ID NO: 2965984 - DNA, 20 bp, Homo sapiens
aaatgttcccttgaccattg

SEQ ID NO: 2965985 - DNA, 21 bp, Homo sapiens
aaatgttctaagtttctaaga

SEQ ID NO: 2965986 - DNA, 18 bp, Homo sapiens
aaatgtttactatagacc

SEQ ID NO: 2965987 - DNA, 12 bp, Homo sapiens
aaatgtttcccc

SEQ ID NO: 2965988 - DNA, 13 bp, Homo sapiens
aaatgtttccccc

SEQ ID NO: 2965989 - DNA, 15 bp, Homo sapiens
aaatgtttcccccac

SEQ ID NO: 2965990 - DNA, 18 bp, Homo sapiens
aaatgtttcccccactcc

SEQ ID NO: 2965991 - DNA, 11 bp, Homo sapiens
aaatgtttgtt

SEQ ID NO: 2965992 - DNA, 20 bp, Homo sapiens
aaatgtttgttaaaaataaa

SEQ ID NO: 2965993 - DNA, 15 bp, Homo sapiens
aaattaaaaaagctg

SEQ ID NO: 2965994 - DNA, 11 bp, Homo sapiens
aaattaaaatt

SEQ ID NO: 2965995 - DNA, 13 bp, Homo sapiens
aaattaaaatttt

SEQ ID NO: 2965996 - DNA, 22 bp, Homo sapiens
aaattaaaattttatgacagta

SEQ ID NO: 2965997 - DNA, 20 bp, Homo sapiens
aaattaaacgtaaatgtttt

SEQ ID NO: 2965998 - DNA, 15 bp, Homo sapiens
aaattaagtagaaca

SEQ ID NO: 2965999 - DNA, 15 bp, Homo sapiens
aaattaatattgtat

SEQ ID NO: 2966000 - DNA, 15 bp, Homo sapiens
aaattaatatttgtg

SEQ ID NO: 2966001 - DNA, 18 bp, Homo sapiens
aaattacaaagaaaataa

SEQ ID NO: 2966002 - DNA, 12 bp, Homo sapiens
aaattacaacta

SEQ ID NO: 2966003 - DNA, 15 bp, Homo sapiens
aaattacactttatt

SEQ ID NO: 2966004 - DNA, 22 bp, Homo sapiens
aaattacataagttagaacaag

SEQ ID NO: 2966005 - DNA, 20 bp, Homo sapiens
aaattactcaggaagaacac

SEQ ID NO: 2966006 - DNA, 15 bp, Homo sapiens
aaattactgataaaa

SEQ ID NO: 2966007 - DNA, 14 bp, Homo sapiens
aaattactttgtga

SEQ ID NO: 2966008 - DNA, 14 bp, Homo sapiens
aaattaggaataaa

SEQ ID NO: 2966009 - DNA, 12 bp, Homo sapiens
aaattatatagc

SEQ ID NO: 2966010 - DNA, 13 bp, Homo sapiens
aaattatatagca

SEQ ID NO: 2966011 - DNA, 22 bp, Homo sapiens
aaattatatagcaaagatatat

SEQ ID NO: 2966012 - DNA, 19 bp, Homo sapiens
aaattatctttagttgaat

SEQ ID NO: 2966013 - DNA, 20 bp, Homo sapiens
aaattatctttagttgaatt

SEQ ID NO: 2966014 - DNA, 21 bp, Homo sapiens
aaattatgcaattcagtgttc

SEQ ID NO: 2966015 - DNA, 19 bp, Homo sapiens
aaattattagtttacatca

SEQ ID NO: 2966016 - DNA, 23 bp, Homo sapiens
aaattattagtttacatcatttt

SEQ ID NO: 2966017 - DNA, 21 bp, Homo sapiens
aaattattatcttcttaacag

SEQ ID NO: 2966018 - DNA, 17 bp, Homo sapiens
aaattattatttagctt

SEQ ID NO: 2966019 - DNA, 13 bp, Homo sapiens
aaattatttgaaa

SEQ ID NO: 2966020 - DNA, 12 bp, Homo sapiens
aaattcaaaaga

SEQ ID NO: 2966021 - DNA, 18 bp, Homo sapiens
aaattcacaagttgtgtt

SEQ ID NO: 2966022 - DNA, 22 bp, Homo sapiens
aaattcactgtttcactgaaat

SEQ ID NO: 2966023 - DNA, 16 bp, Homo sapiens
aaattcatttctaatt

SEQ ID NO: 2966024 - DNA, 13 bp, Homo sapiens
aaattccatgttt

SEQ ID NO: 2966025 - DNA, 15 bp, Homo sapiens
aaattctactaagtt

SEQ ID NO: 2966026 - DNA, 18 bp, Homo sapiens
aaattctactaagttatt

SEQ ID NO: 2966027 - DNA, 23 bp, Homo sapiens
aaattctataggaacatatgaaa

SEQ ID NO: 2966028 - DNA, 16 bp, Homo sapiens
aaattctcttcttttt

SEQ ID NO: 2966029 - DNA, 12 bp, Homo sapiens
aaattctgaatt

SEQ ID NO: 2966030 - DNA, 13 bp, Homo sapiens
aaattctgaattt

SEQ ID NO: 2966031 - DNA, 16 bp, Homo sapiens
aaattctgaatttgca

SEQ ID NO: 2966032 - DNA, 14 bp, Homo sapiens
aaattctgtttctt

SEQ ID NO: 2966033 - DNA, 16 bp, Homo sapiens
aaattcttactctgga

SEQ ID NO: 2966034 - DNA, 16 bp, Homo sapiens
aaattctttttcaaaa

SEQ ID NO: 2966035 - DNA, 22 bp, Homo sapiens
aaattgaaaggcattctctgaa

SEQ ID NO: 2966036 - DNA, 23 bp, Homo sapiens
aaattgaaaggcattctctgaag

SEQ ID NO: 2966037 - DNA, 20 bp, Homo sapiens
aaattgacacaagtggacct

SEQ ID NO: 2966038 - DNA, 18 bp, Homo sapiens
aaattgagacagtgcaca

SEQ ID NO: 2966039 - DNA, 14 bp, Homo sapiens
aaattgcaaatctt

SEQ ID NO: 2966040 - DNA, 20 bp, Homo sapiens
aaattgcacagaagtcctgt

SEQ ID NO: 2966041 - DNA, 12 bp, Homo sapiens
aaattgcactga

SEQ ID NO: 2966042 - DNA, 17 bp, Homo sapiens
aaattgcactgaagttt

SEQ ID NO: 2966043 - DNA, 18 bp, Homo sapiens
aaattgcagacagtgttt

SEQ ID NO: 2966044 - DNA, 20 bp, Homo sapiens
aaattgcctgaaacccattt

SEQ ID NO: 2966045 - DNA, 22 bp, Homo sapiens
aaattgctaacgttttttcttc

SEQ ID NO: 2966046 - DNA, 13 bp, Homo sapiens
aaattgcttctag

SEQ ID NO: 2966047 - DNA, 12 bp, Homo sapiens
aaattgggacta

SEQ ID NO: 2966048 - DNA, 22 bp, Homo sapiens
aaattggttcagggtgataact

SEQ ID NO: 2966049 - DNA, 12 bp, Homo sapiens
aaattgtataaa

SEQ ID NO: 2966050 - DNA, 23 bp, Homo sapiens
aaattgtccgtgttcatacattt

SEQ ID NO: 2966051 - DNA, 15 bp, Homo sapiens
aaattgtctttatga

SEQ ID NO: 2966052 - DNA, 21 bp, Homo sapiens
aaattgtttcaaaataaaaac

SEQ ID NO: 2966053 - DNA, 16 bp, Homo sapiens
aaatttaatgtagaca

SEQ ID NO: 2966054 - DNA, 17 bp, Homo sapiens
aaatttaattcatgttt

SEQ ID NO: 2966055 - DNA, 19 bp, Homo sapiens
aaatttactgtgagactgt

SEQ ID NO: 2966056 - DNA, 16 bp, Homo sapiens
aacagagaaggcagga

SEQ ID NO: 2966057 - DNA, 16 bp, Homo sapiens
aacagagcaaatttga

SEQ ID NO: 2966058 - DNA, 21 bp, Homo sapiens
aacagaggcgtctcacatttt

SEQ ID NO: 2966059 - DNA, 20 bp, Homo sapiens
aacagagggaccaaattgct

SEQ ID NO: 2966060 - DNA, 15 bp, Homo sapiens
aacagaggtaaaaaa

SEQ ID NO: 2966061 - DNA, 19 bp, Homo sapiens
aacagaggtaaaaaaaaga

SEQ ID NO: 2966062 - DNA, 15 bp, Homo sapiens
aacagagttatagaa

SEQ ID NO: 2966063 - DNA, 21 bp, Homo sapiens
aacagatctggaacctcagcc

SEQ ID NO: 2966064 - DNA, 22 bp, Homo sapiens
aacagatctggaacctcagcct

SEQ ID NO: 2966065 - DNA, 13 bp, Homo sapiens
aacagatgtaaat

SEQ ID NO: 2966066 - DNA, 14 bp, Homo sapiens
aacagatgtaaatc

SEQ ID NO: 2966067 - DNA, 22 bp, Homo sapiens
aacagatgtccctgaagtcttg

SEQ ID NO: 2966068 - DNA, 23 bp, Homo sapiens
aacagatttgtgaactcagccaa

SEQ ID NO: 2966069 - DNA, 17 bp, Homo sapiens
aacagcacttttcctct

SEQ ID NO: 2966070 - DNA, 22 bp, Homo sapiens
aacagcagggtttgagcacaat

SEQ ID NO: 2966071 - DNA, 14 bp, Homo sapiens
aacagcattgcttt

SEQ ID NO: 2966072 - DNA, 15 bp, Homo sapiens
aacagcattgctttc

SEQ ID NO: 2966073 - DNA, 16 bp, Homo sapiens
aacagcattgctttct

SEQ ID NO: 2966074 - DNA, 17 bp, Homo sapiens
aacagcattgctttctg

SEQ ID NO: 2966075 - DNA, 13 bp, Homo sapiens
aacagcctcacag

SEQ ID NO: 2966076 - DNA, 20 bp, Homo sapiens
aacagcctttgggaaatgct

SEQ ID NO: 2966077 - DNA, 13 bp, Homo sapiens
aacagctacaaca

SEQ ID NO: 2966078 - DNA, 22 bp, Homo sapiens
aacagctacaacagcctcactt

SEQ ID NO: 2966079 - DNA, 22 bp, Homo sapiens
aacagctctcttcaatgacata

SEQ ID NO: 2966080 - DNA, 23 bp, Homo sapiens
aacagctctcttcaatgacatag

SEQ ID NO: 2966081 - DNA, 11 bp, Homo sapiens
aacagctgcct

SEQ ID NO: 2966082 - DNA, 19 bp, Homo sapiens
aacagctgccttagcttca

SEQ ID NO: 2966083 - DNA, 22 bp, Homo sapiens
aacagctgccttagcttcagga

SEQ ID NO: 2966084 - DNA, 18 bp, Homo sapiens
aacagctgtcacaacttg

SEQ ID NO: 2966085 - DNA, 21 bp, Homo sapiens
aacagcttttcccaggagacc

SEQ ID NO: 2966086 - DNA, 12 bp, Homo sapiens
aacaggaccggg

SEQ ID NO: 2966087 - DNA, 21 bp, Homo sapiens
aacaggagctgggatcctaag

SEQ ID NO: 2966088 - DNA, 16 bp, Homo sapiens
aacaggaggacaattc

SEQ ID NO: 2966089 - DNA, 18 bp, Homo sapiens
aacaggaggacaattcat

SEQ ID NO: 2966090 - DNA, 16 bp, Homo sapiens
aacaggcagaaatata

SEQ ID NO: 2966091 - DNA, 17 bp, Homo sapiens
aacaggcagaaatataa

SEQ ID NO: 2966092 - DNA, 13 bp, Homo sapiens
aacaggcgtggga

SEQ ID NO: 2966093 - DNA, 17 bp, Homo sapiens
aacagggacaaagaaat

SEQ ID NO: 2966094 - DNA, 11 bp, Homo sapiens
aacagggaggg

SEQ ID NO: 2966095 - DNA, 18 bp, Homo sapiens
aacagggcccaggcctgg

SEQ ID NO: 2966096 - DNA, 21 bp, Homo sapiens
aacagggcccaggcctggagc

SEQ ID NO: 2966097 - DNA, 17 bp, Homo sapiens
aacaggtgctggcccag

SEQ ID NO: 2966098 - DNA, 19 bp, Homo sapiens
aacaggtgctggcccagca

SEQ ID NO: 2966099 - DNA, 23 bp, Homo sapiens
aacaggtgctggcccagcatgga

SEQ ID NO: 2966100 - DNA, 16 bp, Homo sapiens
aacaggttattttagt

SEQ ID NO: 2966101 - DNA, 20 bp, Homo sapiens
aacaggttattttagtttct

SEQ ID NO: 2966102 - DNA, 15 bp, Homo sapiens
aacagtcatgtttta

SEQ ID NO: 2966103 - DNA, 16 bp, Homo sapiens
aacagtctaaagaaga

SEQ ID NO: 2966104 - DNA, 23 bp, Homo sapiens
aacagtctgatcgtgacgctgaa

SEQ ID NO: 2966105 - DNA, 16 bp, Homo sapiens
aacagtgaagacagaa

SEQ ID NO: 2966106 - DNA, 17 bp, Homo sapiens
aacagtgaagacagaag

SEQ ID NO: 2966107 - DNA, 20 bp, Homo sapiens
aacagtgaatttaagcatga

SEQ ID NO: 2966108 - DNA, 12 bp, Homo sapiens
aacagtgacttc

SEQ ID NO: 2966109 - DNA, 15 bp, Homo sapiens
aacagtgatgatgca

SEQ ID NO: 2966110 - DNA, 14 bp, Homo sapiens
aacagtgcctgctg

SEQ ID NO: 2966111 - DNA, 15 bp, Homo sapiens
aacagtgtgaagtta

SEQ ID NO: 2966112 - DNA, 19 bp, Homo sapiens
aacagtttggatgtcctca

SEQ ID NO: 2966113 - DNA, 14 bp, Homo sapiens
aacataaaatgagg

SEQ ID NO: 2966114 - DNA, 21 bp, Homo sapiens
aacataacttctcatgtatat

SEQ ID NO: 2966115 - DNA, 17 bp, Homo sapiens
aacataactttgtaaat

SEQ ID NO: 2966116 - DNA, 13 bp, Homo sapiens
aacatagactgaa

SEQ ID NO: 2966117 - DNA, 18 bp, Homo sapiens
aacatagactgaagattt

SEQ ID NO: 2966118 - DNA, 21 bp, Homo sapiens
aacatagactgaagatttatt

SEQ ID NO: 2966119 - DNA, 15 bp, Homo sapiens
aacatagttgaaaaa

SEQ ID NO: 2966120 - DNA, 24 bp, Homo sapiens
aacatagttgaaaaaagaagtttg

SEQ ID NO: 2966121 - DNA, 15 bp, Homo sapiens
aacatataaagcact

SEQ ID NO: 2966122 - DNA, 14 bp, Homo sapiens
aacatataactatt

SEQ ID NO: 2966123 - DNA, 15 bp, Homo sapiens
aacatatatatacta

SEQ ID NO: 2966124 - DNA, 17 bp, Homo sapiens
aacatatttaagaaata

SEQ ID NO: 2966125 - DNA, 19 bp, Homo sapiens
aacatcagaactgaaataa

SEQ ID NO: 2966126 - DNA, 19 bp, Homo sapiens
aacatcagttactctgaag

SEQ ID NO: 2966127 - DNA, 21 bp, Homo sapiens
aacatcatcaggaagcctgtg

SEQ ID NO: 2966128 - DNA, 16 bp, Homo sapiens
aacatcctgaaaattc

SEQ ID NO: 2966129 - DNA, 17 bp, Homo sapiens
aacatctagcaaatgtt

SEQ ID NO: 2966130 - DNA, 14 bp, Homo sapiens
aacatctattctct

SEQ ID NO: 2966131 - DNA, 16 bp, Homo sapiens
aacatcttcatataaa

SEQ ID NO: 2966132 - DNA, 18 bp, Homo sapiens
aacatcttcatataaact

SEQ ID NO: 2966133 - DNA, 12 bp, Homo sapiens
aacatgaaaaca

SEQ ID NO: 2966134 - DNA, 15 bp, Homo sapiens
aacatgaaaacattg

SEQ ID NO: 2966135 - DNA, 21 bp, Homo sapiens
aacatgaaaacattgatgaat

SEQ ID NO: 2966136 - DNA, 13 bp, Homo sapiens
aacatgaaacacc

SEQ ID NO: 2966137 - DNA, 22 bp, Homo sapiens
aacatgaagcataatttgttta

SEQ ID NO: 2966138 - DNA, 20 bp, Homo sapiens
aacatgaccctaaatcttga

SEQ ID NO: 2966139 - DNA, 19 bp, Homo sapiens
aacatgcaattttgcattt

SEQ ID NO: 2966140 - DNA, 22 bp, Homo sapiens
aacatgcaattttgcatttgaa

SEQ ID NO: 2966141 - DNA, 18 bp, Homo sapiens
aacatgcagctctgcagc

SEQ ID NO: 2966142 - DNA, 15 bp, Homo sapiens
aacatgcagtttgaa

SEQ ID NO: 2966143 - DNA, 22 bp, Homo sapiens
aacatgcagtttgaaattctga

SEQ ID NO: 2966144 - DNA, 14 bp, Homo sapiens
aacatgcctgattt

SEQ ID NO: 2966145 - DNA, 15 bp, Homo sapiens
aacatgcctgatttt

SEQ ID NO: 2966146 - DNA, 20 bp, Homo sapiens
aacatgcctgattttaaaag

SEQ ID NO: 2966147 - DNA, 21 bp, Homo sapiens
aacatgctcagtacctgtgtt

SEQ ID NO: 2966148 - DNA, 17 bp, Homo sapiens
aacatgcttttacttta

SEQ ID NO: 2966149 - DNA, 20 bp, Homo sapiens
aacatggaccatccaaattt

SEQ ID NO: 2966150 - DNA, 19 bp, Homo sapiens
aacatggagaaaccctgtc

SEQ ID NO: 2966151 - DNA, 15 bp, Homo sapiens
aacatggattccaaa

SEQ ID NO: 2966152 - DNA, 22 bp, Homo sapiens
aacatggcttctcctttggcat

SEQ ID NO: 2966153 - DNA, 22 bp, Homo sapiens
aacatgggctgtgattactgca

SEQ ID NO: 2966154 - DNA, 20 bp, Homo sapiens
aacatggtgtgtgtctctga

SEQ ID NO: 2966155 - DNA, 19 bp, Homo sapiens
aacatgtaatataaagatg

SEQ ID NO: 2966156 - DNA, 16 bp, Homo sapiens
aacatgtatctgtcta

SEQ ID NO: 2966157 - DNA, 20 bp, Homo sapiens
aacatgtatctgtctacttt

SEQ ID NO: 2966158 - DNA, 11 bp, Homo sapiens
aacatgtatgt

SEQ ID NO: 2966159 - DNA, 14 bp, Homo sapiens
aacatgtatgtgga

SEQ ID NO: 2966160 - DNA, 16 bp, Homo sapiens
aacatgtggaagaaaa

SEQ ID NO: 2966161 - DNA, 15 bp, Homo sapiens
aacatgtttcactta

SEQ ID NO: 2966162 - DNA, 11 bp, Homo sapiens
aacatgtttcc

SEQ ID NO: 2966163 - DNA, 13 bp, Homo sapiens
aacattccaagaa

SEQ ID NO: 2966164 - DNA, 18 bp, Homo sapiens
aacattctgatttggaaa

SEQ ID NO: 2966165 - DNA, 19 bp, Homo sapiens
aacattgccttgcatttgt

SEQ ID NO: 2966166 - DNA, 15 bp, Homo sapiens
aacatttaggagaag

SEQ ID NO: 2966167 - DNA, 20 bp, Homo sapiens
aacatttatctaaaagaatt

SEQ ID NO: 2966168 - DNA, 17 bp, Homo sapiens
aacatttattttatgag

SEQ ID NO: 2966169 - DNA, 22 bp, Homo sapiens
aacatttgtgatatatgtatta

SEQ ID NO: 2966170 - DNA, 21 bp, Homo sapiens
aacatttgtgtaatatgaaat

SEQ ID NO: 2966171 - DNA, 21 bp, Homo sapiens
aacattttaagttttactgat

SEQ ID NO: 2966172 - DNA, 22 bp, Homo sapiens
aacattttaagttttactgata

SEQ ID NO: 2966173 - DNA, 17 bp, Homo sapiens
aacattttacccacaca

SEQ ID NO: 2966174 - DNA, 20 bp, Homo sapiens
aacattttgagaacaaagat

SEQ ID NO: 2966175 - DNA, 19 bp, Homo sapiens
aacatttttgataaagcct

SEQ ID NO: 2966176 - DNA, 16 bp, Homo sapiens
aaccaaagtctaaact

SEQ ID NO: 2966177 - DNA, 15 bp, Homo sapiens
aaccaaatatgttaa

SEQ ID NO: 2966178 - DNA, 16 bp, Homo sapiens
aaccaaatatgttaaa

SEQ ID NO: 2966179 - DNA, 22 bp, Homo sapiens
aaccaaatatgttaaagtttaa

SEQ ID NO: 2966180 - DNA, 12 bp, Homo sapiens
aaccaagacaag

SEQ ID NO: 2966181 - DNA, 16 bp, Homo sapiens
aaccaagagattgcta

SEQ ID NO: 2966182 - DNA, 18 bp, Homo sapiens
aaccaagagattgctaat

SEQ ID NO: 2966183 - DNA, 13 bp, Homo sapiens
aaccaaggaagga

SEQ ID NO: 2966184 - DNA, 23 bp, Homo sapiens
aaccaaggaaggagcccctgagt

SEQ ID NO: 2966185 - DNA, 16 bp, Homo sapiens
aaccaagtcaggccag

SEQ ID NO: 2966186 - DNA, 18 bp, Homo sapiens
aaccaagtcaggccaggt

SEQ ID NO: 2966187 - DNA, 15 bp, Homo sapiens
aaccaagtgggctgg

SEQ ID NO: 2966188 - DNA, 15 bp, Homo sapiens
aactgttcccacctg

SEQ ID NO: 2966189 - DNA, 20 bp, Homo sapiens
aactgttgctcgaagactgt

SEQ ID NO: 2966190 - DNA, 19 bp, Homo sapiens
aactgttggaattcacttt

SEQ ID NO: 2966191 - DNA, 13 bp, Homo sapiens
aacttaacttaaa

SEQ ID NO: 2966192 - DNA, 18 bp, Homo sapiens
aacttaagtggctaaaga

SEQ ID NO: 2966193 - DNA, 23 bp, Homo sapiens
aacttacattgtgaaacttctgt

SEQ ID NO: 2966194 - DNA, 23 bp, Homo sapiens
aacttaccgtgagcgacaaagat

SEQ ID NO: 2966195 - DNA, 14 bp, Homo sapiens
aacttagaggaaaa

SEQ ID NO: 2966196 - DNA, 16 bp, Homo sapiens
aacttatgaatgtttc

SEQ ID NO: 2966197 - DNA, 22 bp, Homo sapiens
aacttattgcctgggcagtgcc

SEQ ID NO: 2966198 - DNA, 17 bp, Homo sapiens
aacttatttatatgaag

SEQ ID NO: 2966199 - DNA, 20 bp, Homo sapiens
aacttcagcaagctagaact

SEQ ID NO: 2966200 - DNA, 16 bp, Homo sapiens
aacttcagcattgtaa

SEQ ID NO: 2966201 - DNA, 21 bp, Homo sapiens
aacttcatattaatataagtt

SEQ ID NO: 2966202 - DNA, 19 bp, Homo sapiens
aacttccaggtgttactgt

SEQ ID NO: 2966203 - DNA, 22 bp, Homo sapiens
aacttccaggtgttactgtaat

SEQ ID NO: 2966204 - DNA, 17 bp, Homo sapiens
aacttccctgttcttta

SEQ ID NO: 2966205 - DNA, 19 bp, Homo sapiens
aacttcctgtgcctttcct

SEQ ID NO: 2966206 - DNA, 20 bp, Homo sapiens
aacttccttcacatctccca

SEQ ID NO: 2966207 - DNA, 17 bp, Homo sapiens
aacttcgcatcaaaaga

SEQ ID NO: 2966208 - DNA, 14 bp, Homo sapiens
aacttcttactagc

SEQ ID NO: 2966209 - DNA, 21 bp, Homo sapiens
aacttgaaatatcctgcttga

SEQ ID NO: 2966210 - DNA, 21 bp, Homo sapiens
aacttgaactgattcacatct

SEQ ID NO: 2966211 - DNA, 19 bp, Homo sapiens
aacttgaggtggcctcctt

SEQ ID NO: 2966212 - DNA, 15 bp, Homo sapiens
aacttgatcacatgc

SEQ ID NO: 2966213 - DNA, 21 bp, Homo sapiens
aacttgcatccaactccagga

SEQ ID NO: 2966214 - DNA, 13 bp, Homo sapiens
aacttgcttctaa

SEQ ID NO: 2966215 - DNA, 17 bp, Homo sapiens
aacttgcttctaaatgc

SEQ ID NO: 2966216 - DNA, 14 bp, Homo sapiens
aacttgctttcttc

SEQ ID NO: 2966217 - DNA, 16 bp, Homo sapiens
aacttgctttcttctt

SEQ ID NO: 2966218 - DNA, 19 bp, Homo sapiens
aacttgctttcttctttcc

SEQ ID NO: 2966219 - DNA, 21 bp, Homo sapiens
aacttggggagttaagacctg

SEQ ID NO: 2966220 - DNA, 12 bp, Homo sapiens
aacttgtcactt

SEQ ID NO: 2966221 - DNA, 13 bp, Homo sapiens
aactttaaaactg

SEQ ID NO: 2966222 - DNA, 19 bp, Homo sapiens
aactttagggggtgggagg

SEQ ID NO: 2966223 - DNA, 18 bp, Homo sapiens
aactttccagtcttagct

SEQ ID NO: 2966224 - DNA, 19 bp, Homo sapiens
aactttcctcttcctgcct

SEQ ID NO: 2966225 - DNA, 18 bp, Homo sapiens
aactttcctggatgtctg

SEQ ID NO: 2966226 - DNA, 12 bp, Homo sapiens
aactttgaataa

SEQ ID NO: 2966227 - DNA, 17 bp, Homo sapiens
aactttgaataaagaat

SEQ ID NO: 2966228 - DNA, 17 bp, Homo sapiens
aactttgagtacagata

SEQ ID NO: 2966229 - DNA, 22 bp, Homo sapiens
aactttgcatagcagctgctac

SEQ ID NO: 2966230 - DNA, 15 bp, Homo sapiens
aactttgctggaaaa

SEQ ID NO: 2966231 - DNA, 12 bp, Homo sapiens
aactttgcttgc

SEQ ID NO: 2966232 - DNA, 16 bp, Homo sapiens
aactttggaacagggt

SEQ ID NO: 2966233 - DNA, 14 bp, Homo sapiens
aacttttatctatt

SEQ ID NO: 2966234 - DNA, 15 bp, Homo sapiens
aactttttaaagagt

SEQ ID NO: 2966235 - DNA, 14 bp, Homo sapiens
aactttttattgcc

SEQ ID NO: 2966236 - DNA, 21 bp, Homo sapiens
aactttttgaccagtttcttt

SEQ ID NO: 2966237 - DNA, 18 bp, Homo sapiens
aagaaaaaaaaatgccat

SEQ ID NO: 2966238 - DNA, 15 bp, Homo sapiens
aagaaaaaaaccaaa

SEQ ID NO: 2966239 - DNA, 9 bp, Homo sapiens
aagaaaaag

SEQ ID NO: 2966240 - DNA, 15 bp, Homo sapiens
aagaaaacaaagttc

SEQ ID NO: 2966241 - DNA, 18 bp, Homo sapiens
aagaaaacatctattctc

SEQ ID NO: 2966242 - DNA, 12 bp, Homo sapiens
aagaaaacattc

SEQ ID NO: 2966243 - DNA, 20 bp, Homo sapiens
aagaaaaccaccccttagat

SEQ ID NO: 2966244 - DNA, 13 bp, Homo sapiens
aagaaaagacctt

SEQ ID NO: 2966245 - DNA, 20 bp, Homo sapiens
aagaaaagccgaaagggtta

SEQ ID NO: 2966246 - DNA, 12 bp, Homo sapiens
aagaaaatcagt

SEQ ID NO: 2966247 - DNA, 12 bp, Homo sapiens
aagaaaatgaag

SEQ ID NO: 2966248 - DNA, 19 bp, Homo sapiens
aagaaaatgaatttgactg

SEQ ID NO: 2966249 - DNA, 15 bp, Homo sapiens
aagaaaatgtgtctg

SEQ ID NO: 2966250 - DNA, 22 bp, Homo sapiens
aagaaacacactgaggcaggga

SEQ ID NO: 2966251 - DNA, 14 bp, Homo sapiens
aagaaacactcaac

SEQ ID NO: 2966252 - DNA, 22 bp, Homo sapiens
aagaaacactcaacaataaaga

SEQ ID NO: 2966253 - DNA, 11 bp, Homo sapiens
aagaaacccaa

SEQ ID NO: 2966254 - DNA, 21 bp, Homo sapiens
aagaaacccttccacgtgtat

SEQ ID NO: 2966255 - DNA, 15 bp, Homo sapiens
aagaaactttggaag

SEQ ID NO: 2966256 - DNA, 12 bp, Homo sapiens
aagaaagaaata

SEQ ID NO: 2966257 - DNA, 14 bp, Homo sapiens
aagaaagagagaaa

SEQ ID NO: 2966258 - DNA, 18 bp, Homo sapiens
aagaaagagagaaaataa

SEQ ID NO: 2966259 - DNA, 12 bp, Homo sapiens
aagaaagcactt

SEQ ID NO: 2966260 - DNA, 21 bp, Homo sapiens
aagaaataaaaggaagccaaa

SEQ ID NO: 2966261 - DNA, 13 bp, Homo sapiens
aagaaataaccac

SEQ ID NO: 2966262 - DNA, 18 bp, Homo sapiens
aagaaataataatatcca

SEQ ID NO: 2966263 - DNA, 17 bp, Homo sapiens
aagaaatcgccttatga

SEQ ID NO: 2966264 - DNA, 21 bp, Homo sapiens
aagaaatcgccttatgagaac

SEQ ID NO: 2966265 - DNA, 23 bp, Homo sapiens
aagaaatgatgttggagaaggga

SEQ ID NO: 2966266 - DNA, 23 bp, Homo sapiens
aagaaatggaatgaatctccaag

SEQ ID NO: 2966267 - DNA, 18 bp, Homo sapiens
aagaaatggattctattt

SEQ ID NO: 2966268 - DNA, 14 bp, Homo sapiens
aagaaatgtataaa

SEQ ID NO: 2966269 - DNA, 18 bp, Homo sapiens
aagaaattatctttagtt

SEQ ID NO: 2966270 - DNA, 15 bp, Homo sapiens
aagaaatttgcagtt

SEQ ID NO: 2966271 - DNA, 21 bp, Homo sapiens
aagaacaatattgactttgtc

SEQ ID NO: 2966272 - DNA, 12 bp, Homo sapiens
aagaacataaag

SEQ ID NO: 2966273 - DNA, 20 bp, Homo sapiens
aagaacatgcagtttgaaat

SEQ ID NO: 2966274 - DNA, 17 bp, Homo sapiens
aagaaccagtcccccca

SEQ ID NO: 2966275 - DNA, 24 bp, Homo sapiens
aagaaccatgcaggaaggaaaact

SEQ ID NO: 2966276 - DNA, 15 bp, Homo sapiens
aagaaccgcattttg

SEQ ID NO: 2966277 - DNA, 20 bp, Homo sapiens
aagaacctgacatccactgt

SEQ ID NO: 2966278 - DNA, 13 bp, Homo sapiens
aagaactgcatgt

SEQ ID NO: 2966279 - DNA, 20 bp, Homo sapiens
aagaactgtcatgtaaacat

SEQ ID NO: 2966280 - DNA, 22 bp, Homo sapiens
aagaactgtcatgtaaacatac

SEQ ID NO: 2966281 - DNA, 12 bp, Homo sapiens
aagaagaagaat

SEQ ID NO: 2966282 - DNA, 13 bp, Homo sapiens
aagaagacatgtt

SEQ ID NO: 2966283 - DNA, 14 bp, Homo sapiens
aagaagacatgttt

SEQ ID NO: 2966284 - DNA, 14 bp, Homo sapiens
aagaagagaaagaa

SEQ ID NO: 2966285 - DNA, 15 bp, Homo sapiens
aagaagagccacagt

SEQ ID NO: 2966286 - DNA, 12 bp, Homo sapiens
aagaagaggagc

SEQ ID NO: 2966287 - DNA, 15 bp, Homo sapiens
aagaagatgaatggc

SEQ ID NO: 2966288 - DNA, 12 bp, Homo sapiens
aagaagatgctc

SEQ ID NO: 2966289 - DNA, 16 bp, Homo sapiens
aagaagcaaggaacca

SEQ ID NO: 2966290 - DNA, 11 bp, Homo sapiens
aagaagcagcg

SEQ ID NO: 2966291 - DNA, 19 bp, Homo sapiens
aagaagcccccagctaaga

SEQ ID NO: 2966292 - DNA, 18 bp, Homo sapiens
aagaagccctgttctcgt

SEQ ID NO: 2966293 - DNA, 17 bp, Homo sapiens
aagaaggaagctgtgtt

SEQ ID NO: 2966294 - DNA, 14 bp, Homo sapiens
aagaaggcaaaaat

SEQ ID NO: 2966295 - DNA, 18 bp, Homo sapiens
aagaaggtttgtgttttt

SEQ ID NO: 2966296 - DNA, 17 bp, Homo sapiens
aagaagtcagttaacgt

SEQ ID NO: 2966297 - DNA, 14 bp, Homo sapiens
aagaagtctggcca

SEQ ID NO: 2966298 - DNA, 15 bp, Homo sapiens
aagaagtgcatgaaa

SEQ ID NO: 2966299 - DNA, 19 bp, Homo sapiens
aagaagtggtgttccatga

SEQ ID NO: 2966300 - DNA, 20 bp, Homo sapiens
aagaataataaaatactttt

SEQ ID NO: 2966301 - DNA, 21 bp, Homo sapiens
aagaataataaaatacttttt

SEQ ID NO: 2966302 - DNA, 16 bp, Homo sapiens
aagaatacttgaactt

SEQ ID NO: 2966303 - DNA, 16 bp, Homo sapiens
aagaatcattttgtgt

SEQ ID NO: 2966304 - DNA, 17 bp, Homo sapiens
aagaatccacatttcta

SEQ ID NO: 2966305 - DNA, 21 bp, Homo sapiens
aagaatccacatttctaaaat

SEQ ID NO: 2966306 - DNA, 18 bp, Homo sapiens
aagaatccctagacttta

SEQ ID NO: 2966307 - DNA, 13 bp, Homo sapiens
aagaatcggcagt

SEQ ID NO: 2966308 - DNA, 21 bp, Homo sapiens
aagaatcggcatgtatactta

SEQ ID NO: 2966309 - DNA, 21 bp, Homo sapiens
aagaatcttggtttgccttcc

SEQ ID NO: 2966310 - DNA, 20 bp, Homo sapiens
aagaatgaacacaatcacgt

SEQ ID NO: 2966311 - DNA, 15 bp, Homo sapiens
aagaatggaaaagag

SEQ ID NO: 2966312 - DNA, 17 bp, Homo sapiens
aagaatgggcagttaca

SEQ ID NO: 2966313 - DNA, 18 bp, Homo sapiens
aagaatgggcagttacat

SEQ ID NO: 2966314 - DNA, 13 bp, Homo sapiens
aagaatgtgtttc

SEQ ID NO: 2966315 - DNA, 18 bp, Homo sapiens
aagaatgttaagacttga

SEQ ID NO: 2966316 - DNA, 19 bp, Homo sapiens
aagaatgttaagacttgac

SEQ ID NO: 2966317 - DNA, 16 bp, Homo sapiens
aagaattattttgatg

SEQ ID NO: 2966318 - DNA, 14 bp, Homo sapiens
aagaattgaaacca

SEQ ID NO: 2966319 - DNA, 19 bp, Homo sapiens
aagaattgaacccaggagg

SEQ ID NO: 2966320 - DNA, 17 bp, Homo sapiens
aagaattgccaatcttg

SEQ ID NO: 2966321 - DNA, 18 bp, Homo sapiens
aaggacctgaaattccaa

SEQ ID NO: 2966322 - DNA, 15 bp, Homo sapiens
aaggacgtaaaattt

SEQ ID NO: 2966323 - DNA, 12 bp, Homo sapiens
aaggactctggg

SEQ ID NO: 2966324 - DNA, 20 bp, Homo sapiens
aaggactggccgtggctcca

SEQ ID NO: 2966325 - DNA, 22 bp, Homo sapiens
aaggactggccgtggctccaga

SEQ ID NO: 2966326 - DNA, 15 bp, Homo sapiens
aaggacttccacatt

SEQ ID NO: 2966327 - DNA, 18 bp, Homo sapiens
aaggacttccacattttt

SEQ ID NO: 2966328 - DNA, 21 bp, Homo sapiens
aaggacttcctgtccagctcc

SEQ ID NO: 2966329 - DNA, 23 bp, Homo sapiens
aaggacttcctgtccagctccaa

SEQ ID NO: 2966330 - DNA, 15 bp, Homo sapiens
aaggagaaattttgg

SEQ ID NO: 2966331 - DNA, 15 bp, Homo sapiens
aaggagacacagatg

SEQ ID NO: 2966332 - DNA, 16 bp, Homo sapiens
aaggagacacagatgt

SEQ ID NO: 2966333 - DNA, 18 bp, Homo sapiens
aaggagacacagatgttc

SEQ ID NO: 2966334 - DNA, 16 bp, Homo sapiens
aaggagacaggcagag

SEQ ID NO: 2966335 - DNA, 19 bp, Homo sapiens
aaggagacaggcagagctg

SEQ ID NO: 2966336 - DNA, 20 bp, Homo sapiens
aaggagactggtaggaggag

SEQ ID NO: 2966337 - DNA, 18 bp, Homo sapiens
aaggagacttaatttcaa

SEQ ID NO: 2966338 - DNA, 20 bp, Homo sapiens
aaggagaggcaacatccaaa

SEQ ID NO: 2966339 - DNA, 20 bp, Homo sapiens
aaggagcacatactacctag

SEQ ID NO: 2966340 - DNA, 19 bp, Homo sapiens
aaggagcgctagtgccttg

SEQ ID NO: 2966341 - DNA, 23 bp, Homo sapiens
aaggagcggcgccctggacttgg

SEQ ID NO: 2966342 - DNA, 15 bp, Homo sapiens
aaggagcgggcaggg

SEQ ID NO: 2966343 - DNA, 18 bp, Homo sapiens
aaggagctgctatagcct

SEQ ID NO: 2966344 - DNA, 21 bp, Homo sapiens
aaggagctgctatagcctggg

SEQ ID NO: 2966345 - DNA, 17 bp, Homo sapiens
aaggagctttcttgttt

SEQ ID NO: 2966346 - DNA, 21 bp, Homo sapiens
aaggagctttcttgtttctta

SEQ ID NO: 2966347 - DNA, 12 bp, Homo sapiens
aaggaggacaag

SEQ ID NO: 2966348 - DNA, 19 bp, Homo sapiens
aaggaggacaagaccctct

SEQ ID NO: 2966349 - DNA, 17 bp, Homo sapiens
aaggaggggaaaaaaat

SEQ ID NO: 2966350 - DNA, 19 bp, Homo sapiens
aaggaggggaaaaaaatgt

SEQ ID NO: 2966351 - DNA, 20 bp, Homo sapiens
aaggaggggaaaaaaatgtt

SEQ ID NO: 2966352 - DNA, 15 bp, Homo sapiens
aaggaggggacggga

SEQ ID NO: 2966353 - DNA, 12 bp, Homo sapiens
aaggagggtgag

SEQ ID NO: 2966354 - DNA, 18 bp, Homo sapiens
aaggagtaatctgtgtac

SEQ ID NO: 2966355 - DNA, 13 bp, Homo sapiens
aaggagtagaaaa

SEQ ID NO: 2966356 - DNA, 17 bp, Homo sapiens
aaggagtcaaaactaca

SEQ ID NO: 2966357 - DNA, 23 bp, Homo sapiens
aaggatatgaaactctacattta

SEQ ID NO: 2966358 - DNA, 21 bp, Homo sapiens
aaggatcagaagtatggaatt

SEQ ID NO: 2966359 - DNA, 16 bp, Homo sapiens
aaggatctttgtggcc

SEQ ID NO: 2966360 - DNA, 15 bp, Homo sapiens
aaggatgagggttca

SEQ ID NO: 2966361 - DNA, 16 bp, Homo sapiens
aaggatggttagacag

SEQ ID NO: 2966362 - DNA, 17 bp, Homo sapiens
aaggatgtaaacagtgc

SEQ ID NO: 2966363 - DNA, 19 bp, Homo sapiens
aaggatgtaaacagtgcct

SEQ ID NO: 2966364 - DNA, 20 bp, Homo sapiens
aaggatgtgttttcagtctt

SEQ ID NO: 2966365 - DNA, 20 bp, Homo sapiens
aaggattacagaaactgatg

SEQ ID NO: 2966366 - DNA, 15 bp, Homo sapiens
aaggatttgatgctt

SEQ ID NO: 2966367 - DNA, 21 bp, Homo sapiens
aaggatttgatgcttttctct

SEQ ID NO: 2966368 - DNA, 22 bp, Homo sapiens
aaggatttgatgcttttctctc

SEQ ID NO: 2966369 - DNA, 14 bp, Homo sapiens
aaggcaaaaatgta

SEQ ID NO: 2966370 - DNA, 14 bp, Homo sapiens
aaggcaaaattgca

SEQ ID NO: 2966371 - DNA, 15 bp, Homo sapiens
aaggcaaacccatca

SEQ ID NO: 2966372 - DNA, 21 bp, Homo sapiens
aaggcaaagggtccagaagga

SEQ ID NO: 2966373 - DNA, 13 bp, Homo sapiens
aaggcaacggcac

SEQ ID NO: 2966374 - DNA, 23 bp, Homo sapiens
aaggcaagattggaaagacagga

SEQ ID NO: 2966375 - DNA, 18 bp, Homo sapiens
aaggcaagcacttgtggg

SEQ ID NO: 2966376 - DNA, 15 bp, Homo sapiens
aaggcactctagatt

SEQ ID NO: 2966377 - DNA, 21 bp, Homo sapiens
aaggcactctgttatttagac

SEQ ID NO: 2966378 - DNA, 15 bp, Homo sapiens
aaggcagaggaattt

SEQ ID NO: 2966379 - DNA, 12 bp, Homo sapiens
aaggcaggcctg

SEQ ID NO: 2966380 - DNA, 16 bp, Homo sapiens
aaggcagtccagagct

SEQ ID NO: 2966381 - DNA, 18 bp, Homo sapiens
aaggcagtccagagcttt

SEQ ID NO: 2966382 - DNA, 17 bp, Homo sapiens
aaggcatacgagagcag

SEQ ID NO: 2966383 - DNA, 21 bp, Homo sapiens
aaggcatacgagagcagaggt

SEQ ID NO: 2966384 - DNA, 14 bp, Homo sapiens
aaggcattccacag

SEQ ID NO: 2966385 - DNA, 17 bp, Homo sapiens
aaggcattccacaggat

SEQ ID NO: 2966386 - DNA, 13 bp, Homo sapiens
aaggccaaggtgc

SEQ ID NO: 2966387 - DNA, 15 bp, Homo sapiens
aaggccaaggtgctg

SEQ ID NO: 2966388 - DNA, 17 bp, Homo sapiens
aaggccagctggcagca

SEQ ID NO: 2966389 - DNA, 18 bp, Homo sapiens
aaggccataaaacaggta

SEQ ID NO: 2966390 - DNA, 22 bp, Homo sapiens
aaggccatccttccctgtctgc

SEQ ID NO: 2966391 - DNA, 17 bp, Homo sapiens
aaggccgacaccactcc

SEQ ID NO: 2966392 - DNA, 19 bp, Homo sapiens
aaggccgacaccactcctg

SEQ ID NO: 2966393 - DNA, 17 bp, Homo sapiens
aaggccgagaagcaaga

SEQ ID NO: 2966394 - DNA, 18 bp, Homo sapiens
aaggcctaggattctaaa

SEQ ID NO: 2966395 - DNA, 22 bp, Homo sapiens
aaggcctaggctaggacgttgg

SEQ ID NO: 2966396 - DNA, 16 bp, Homo sapiens
aaggcctcccctgagg

SEQ ID NO: 2966397 - DNA, 15 bp, Homo sapiens
aaggcctcggcagaa

SEQ ID NO: 2966398 - DNA, 17 bp, Homo sapiens
aaggcctgtggggagcc

SEQ ID NO: 2966399 - DNA, 20 bp, Homo sapiens
aaggcctgtggggagccgag

SEQ ID NO: 2966400 - DNA, 18 bp, Homo sapiens
aaggccttctcaggctgg

SEQ ID NO: 2966401 - DNA, 16 bp, Homo sapiens
aaggccttgcctggcc

SEQ ID NO: 2966402 - DNA, 21 bp, Homo sapiens
aaggcgagcttgagttctgca

SEQ ID NO: 2966403 - DNA, 21 bp, Homo sapiens
aaggcggtggacttgaacttt

SEQ ID NO: 2966404 - DNA, 22 bp, Homo sapiens
aaggcggtggacttgaactttc

SEQ ID NO: 2966405 - DNA, 14 bp, Homo sapiens
aaggctcagaagga

SEQ ID NO: 2966406 - DNA, 18 bp, Homo sapiens
aaggctcctgatcattct

SEQ ID NO: 2966407 - DNA, 16 bp, Homo sapiens
aaggctctatgagtct

SEQ ID NO: 2966408 - DNA, 21 bp, Homo sapiens
aaggctctgagagtctagatt

SEQ ID NO: 2966409 - DNA, 22 bp, Homo sapiens
aaggctctgagagtctagattc

SEQ ID NO: 2966410 - DNA, 17 bp, Homo sapiens
aaggctctgtgccttgg

SEQ ID NO: 2966411 - DNA, 17 bp, Homo sapiens
aaggctgaggaaaggcc

SEQ ID NO: 2966412 - DNA, 23 bp, Homo sapiens
aaggctgaggaaaggccagctgg

SEQ ID NO: 2966413 - DNA, 22 bp, Homo sapiens
aaggctggtacaacggaggcct

SEQ ID NO: 2966414 - DNA, 22 bp, Homo sapiens
aaggctgtccttacccatctgc

SEQ ID NO: 2966415 - DNA, 23 bp, Homo sapiens
aaggctgtgtttagattgtatta

SEQ ID NO: 2966416 - DNA, 13 bp, Homo sapiens
aaggctgttgcat

SEQ ID NO: 2966417 - DNA, 23 bp, Homo sapiens
aaggctgttgcatgggctaatga

SEQ ID NO: 2966418 - DNA, 15 bp, Homo sapiens
aaggcttcagtctca

SEQ ID NO: 2966419 - DNA, 18 bp, Homo sapiens
aaggcttctctctgtggg

SEQ ID NO: 2966420 - DNA, 14 bp, Homo sapiens
aaggctttctttat

SEQ ID NO: 2966421 - DNA, 18 bp, Homo sapiens
aagggaaaaatcaagttt

SEQ ID NO: 2966422 - DNA, 14 bp, Homo sapiens
aagggaaggacaga

SEQ ID NO: 2966423 - DNA, 14 bp, Homo sapiens
aagggaaggacagc

SEQ ID NO: 2966424 - DNA, 20 bp, Homo sapiens
aagggacatgttttgataaa

SEQ ID NO: 2966425 - DNA, 20 bp, Homo sapiens
aagggacggctgtgggacca

SEQ ID NO: 2966426 - DNA, 18 bp, Homo sapiens
aagggacttaacttgttt

SEQ ID NO: 2966427 - DNA, 13 bp, Homo sapiens
aagggagaaaaaa

SEQ ID NO: 2966428 - DNA, 17 bp, Homo sapiens
aagggagaaagaaaact

SEQ ID NO: 2966429 - DNA, 17 bp, Homo sapiens
aagggagagctgagcca

SEQ ID NO: 2966430 - DNA, 22 bp, Homo sapiens
aagggagagggcctctgcctgg

SEQ ID NO: 2966431 - DNA, 17 bp, Homo sapiens
aagggagctagccagag

SEQ ID NO: 2966432 - DNA, 11 bp, Homo sapiens
aagggaggagg

SEQ ID NO: 2966433 - DNA, 17 bp, Homo sapiens
aagggaggggaaggggc

SEQ ID NO: 2966434 - DNA, 13 bp, Homo sapiens
aagggagggggag

SEQ ID NO: 2966435 - DNA, 15 bp, Homo sapiens
aagggatctggtcct

SEQ ID NO: 2966436 - DNA, 23 bp, Homo sapiens
aagggatgcaggctcccctgagg

SEQ ID NO: 2966437 - DNA, 17 bp, Homo sapiens
aagggattacccaagca

SEQ ID NO: 2966438 - DNA, 18 bp, Homo sapiens
aagggattacccaagcaa

SEQ ID NO: 2966439 - DNA, 19 bp, Homo sapiens
aagggattacccaagcaaa

SEQ ID NO: 2966440 - DNA, 16 bp, Homo sapiens
aagggatttcttaggg

SEQ ID NO: 2966441 - DNA, 20 bp, Homo sapiens
aagggcaacaataaaatagc

SEQ ID NO: 2966442 - DNA, 15 bp, Homo sapiens
aagggcagaggaaga

SEQ ID NO: 2966443 - DNA, 17 bp, Homo sapiens
aagggcagaggaagaga

SEQ ID NO: 2966444 - DNA, 12 bp, Homo sapiens
aagggcagccct

SEQ ID NO: 2966445 - DNA, 18 bp, Homo sapiens
aagggcatgggtcgggag

SEQ ID NO: 2966446 - DNA, 20 bp, Homo sapiens
aagggcatgggtcgggagag

SEQ ID NO: 2966447 - DNA, 22 bp, Homo sapiens
aagggccacctacaatacatct

SEQ ID NO: 2966448 - DNA, 15 bp, Homo sapiens
aagggccagagccag

SEQ ID NO: 2966449 - DNA, 16 bp, Homo sapiens
aagggccagagccagg

SEQ ID NO: 2966450 - DNA, 17 bp, Homo sapiens
aagggccagagccaggg

SEQ ID NO: 2966451 - DNA, 14 bp, Homo sapiens
aagggcccccacat

SEQ ID NO: 2966452 - DNA, 15 bp, Homo sapiens
aagggccggggatgg

SEQ ID NO: 2966453 - DNA, 23 bp, Homo sapiens
aatacaggagacccaacaatgag

SEQ ID NO: 2966454 - DNA, 21 bp, Homo sapiens
aatacagtcttccatttgcaa

SEQ ID NO: 2966455 - DNA, 20 bp, Homo sapiens
aatacagtttataaagccaa

SEQ ID NO: 2966456 - DNA, 21 bp, Homo sapiens
aatacataaatagtagaaaaa

SEQ ID NO: 2966457 - DNA, 17 bp, Homo sapiens
aatacatgacatttatt

SEQ ID NO: 2966458 - DNA, 15 bp, Homo sapiens
aatacattctgcttt

SEQ ID NO: 2966459 - DNA, 12 bp, Homo sapiens
aatacatttgta

SEQ ID NO: 2966460 - DNA, 13 bp, Homo sapiens
aatacatttgtat

SEQ ID NO: 2966461 - DNA, 18 bp, Homo sapiens
aatacatttgtattttgt

SEQ ID NO: 2966462 - DNA, 15 bp, Homo sapiens
aataccaaaaattag

SEQ ID NO: 2966463 - DNA, 15 bp, Homo sapiens
aataccaactgaagt

SEQ ID NO: 2966464 - DNA, 20 bp, Homo sapiens
aatacctacaataaactggt

SEQ ID NO: 2966465 - DNA, 13 bp, Homo sapiens
aatacctctgtgt

SEQ ID NO: 2966466 - DNA, 14 bp, Homo sapiens
aatacctctgtgtg

SEQ ID NO: 2966467 - DNA, 13 bp, Homo sapiens
aatacctcttgga

SEQ ID NO: 2966468 - DNA, 18 bp, Homo sapiens
aatacctttgtagttact

SEQ ID NO: 2966469 - DNA, 16 bp, Homo sapiens
aatacgaagccctctt

SEQ ID NO: 2966470 - DNA, 13 bp, Homo sapiens
aatacgtttgtgt

SEQ ID NO: 2966471 - DNA, 17 bp, Homo sapiens
aatacgtttgtgtttct

SEQ ID NO: 2966472 - DNA, 17 bp, Homo sapiens
aatactactactgttat

SEQ ID NO: 2966473 - DNA, 17 bp, Homo sapiens
aatactagttgtgacct

SEQ ID NO: 2966474 - DNA, 16 bp, Homo sapiens
aatactcataatgtga

SEQ ID NO: 2966475 - DNA, 12 bp, Homo sapiens
aatactcatgtg

SEQ ID NO: 2966476 - DNA, 13 bp, Homo sapiens
aatactcatgtgt

SEQ ID NO: 2966477 - DNA, 15 bp, Homo sapiens
aatactcatgtgtat

SEQ ID NO: 2966478 - DNA, 13 bp, Homo sapiens
aatactcttccca

SEQ ID NO: 2966479 - DNA, 16 bp, Homo sapiens
aatactgccaaaacat

SEQ ID NO: 2966480 - DNA, 18 bp, Homo sapiens
aatactgccagatgctga

SEQ ID NO: 2966481 - DNA, 22 bp, Homo sapiens
aatactgccagatgctgatgtt

SEQ ID NO: 2966482 - DNA, 13 bp, Homo sapiens
aatactgctgaga

SEQ ID NO: 2966483 - DNA, 15 bp, Homo sapiens
aatactgctgagata

SEQ ID NO: 2966484 - DNA, 18 bp, Homo sapiens
aatactgctgagatacat

SEQ ID NO: 2966485 - DNA, 16 bp, Homo sapiens
aatactgtattttgta

SEQ ID NO: 2966486 - DNA, 14 bp, Homo sapiens
aatacttttcctta

SEQ ID NO: 2966487 - DNA, 11 bp, Homo sapiens
aatacttttgc

SEQ ID NO: 2966488 - DNA, 15 bp, Homo sapiens
aatactttttacaat

SEQ ID NO: 2966489 - DNA, 16 bp, Homo sapiens
aatactttttctaatg

SEQ ID NO: 2966490 - DNA, 22 bp, Homo sapiens
aatagaaataaaggatgtgatt

SEQ ID NO: 2966491 - DNA, 20 bp, Homo sapiens
aatagaaataaattcctaaa

SEQ ID NO: 2966492 - DNA, 22 bp, Homo sapiens
aatagaaggatgtacatttcca

SEQ ID NO: 2966493 - DNA, 13 bp, Homo sapiens
aatagagcaagaa

SEQ ID NO: 2966494 - DNA, 15 bp, Homo sapiens
aatagagctgccact

SEQ ID NO: 2966495 - DNA, 16 bp, Homo sapiens
aatagagctgccactg

SEQ ID NO: 2966496 - DNA, 13 bp, Homo sapiens
aatagaggagctg

SEQ ID NO: 2966497 - DNA, 21 bp, Homo sapiens
aatagaggctttgagcaacta

SEQ ID NO: 2966498 - DNA, 23 bp, Homo sapiens
aatagatacttttgataatagat

SEQ ID NO: 2966499 - DNA, 22 bp, Homo sapiens
aatagatggacagtttgtttcc

SEQ ID NO: 2966500 - DNA, 14 bp, Homo sapiens
aatagatgttttaa

SEQ ID NO: 2966501 - DNA, 17 bp, Homo sapiens
aatagatgttttaactt

SEQ ID NO: 2966502 - DNA, 15 bp, Homo sapiens
aatagattatagttg

SEQ ID NO: 2966503 - DNA, 12 bp, Homo sapiens
aatagattctct

SEQ ID NO: 2966504 - DNA, 22 bp, Homo sapiens
aatagattttaagcttcattat

SEQ ID NO: 2966505 - DNA, 16 bp, Homo sapiens
aatagcatctgtacaa

SEQ ID NO: 2966506 - DNA, 20 bp, Homo sapiens
aatagccacatttggaatac

SEQ ID NO: 2966507 - DNA, 15 bp, Homo sapiens
aatagccccagactg

SEQ ID NO: 2966508 - DNA, 14 bp, Homo sapiens
aatagcctgtggcc

SEQ ID NO: 2966509 - DNA, 19 bp, Homo sapiens
aatagctttagtgaattaa

SEQ ID NO: 2966510 - DNA, 23 bp, Homo sapiens
aataggattgcttcaattaaaat

SEQ ID NO: 2966511 - DNA, 18 bp, Homo sapiens
aataggcgtaactaattt

SEQ ID NO: 2966512 - DNA, 23 bp, Homo sapiens
aatagtatgagtaatgcttaagg

SEQ ID NO: 2966513 - DNA, 14 bp, Homo sapiens
aatagtcagagtgt

SEQ ID NO: 2966514 - DNA, 19 bp, Homo sapiens
aatagtcattaaaaacata

SEQ ID NO: 2966515 - DNA, 15 bp, Homo sapiens
aatagtcctaaaaag

SEQ ID NO: 2966516 - DNA, 16 bp, Homo sapiens
aatagtctttgccagt

SEQ ID NO: 2966517 - DNA, 13 bp, Homo sapiens
aatagtgaaatga

SEQ ID NO: 2966518 - DNA, 18 bp, Homo sapiens
aatagtgttaatcaattt

SEQ ID NO: 2966519 - DNA, 21 bp, Homo sapiens
aatagttaagacatgatttcc

SEQ ID NO: 2966520 - DNA, 23 bp, Homo sapiens
aatagttaagacatgatttcctt

SEQ ID NO: 2966521 - DNA, 13 bp, Homo sapiens
aatagttaatata

SEQ ID NO: 2966522 - DNA, 15 bp, Homo sapiens
aatagttactccagt

SEQ ID NO: 2966523 - DNA, 18 bp, Homo sapiens
aatagttactccagtgcc

SEQ ID NO: 2966524 - DNA, 22 bp, Homo sapiens
aatagttcaaagccaagtttat

SEQ ID NO: 2966525 - DNA, 19 bp, Homo sapiens
aatagttttagattatttt

SEQ ID NO: 2966526 - DNA, 23 bp, Homo sapiens
aatataaacaaagattcatgatt

SEQ ID NO: 2966527 - DNA, 19 bp, Homo sapiens
aatataaacacattaaaag

SEQ ID NO: 2966528 - DNA, 19 bp, Homo sapiens
aatataaatgttaagaaaa

SEQ ID NO: 2966529 - DNA, 21 bp, Homo sapiens
aatataaggaaagcaataaat

SEQ ID NO: 2966530 - DNA, 14 bp, Homo sapiens
aatataagtttctt

SEQ ID NO: 2966531 - DNA, 21 bp, Homo sapiens
aatatactgagctgctaaaat

SEQ ID NO: 2966532 - DNA, 22 bp, Homo sapiens
aatatactgagctgctaaaata

SEQ ID NO: 2966533 - DNA, 19 bp, Homo sapiens
aatatactgattttgaaaa

SEQ ID NO: 2966534 - DNA, 14 bp, Homo sapiens
aatatactgtaaag

SEQ ID NO: 2966535 - DNA, 18 bp, Homo sapiens
aatatactgtaaagaaag

SEQ ID NO: 2966536 - DNA, 23 bp, Homo sapiens
aatatactgtaaagaaagagaga

SEQ ID NO: 2966537 - DNA, 18 bp, Homo sapiens
aatatagttgtctttctt

SEQ ID NO: 2966538 - DNA, 21 bp, Homo sapiens
aatatagttgtctttctttgc

SEQ ID NO: 2966539 - DNA, 21 bp, Homo sapiens
aatatagttttctaactcctg

SEQ ID NO: 2966540 - DNA, 13 bp, Homo sapiens
aatatataaaaat

SEQ ID NO: 2966541 - DNA, 16 bp, Homo sapiens
aatatatataaattga

SEQ ID NO: 2966542 - DNA, 14 bp, Homo sapiens
aatatatctctatt

SEQ ID NO: 2966543 - DNA, 11 bp, Homo sapiens
aatatatgtat

SEQ ID NO: 2966544 - DNA, 18 bp, Homo sapiens
aatatatgttgaatgtta

SEQ ID NO: 2966545 - DNA, 13 bp, Homo sapiens
aatatatttgtgt

SEQ ID NO: 2966546 - DNA, 19 bp, Homo sapiens
aatatatttgtgtatttaa

SEQ ID NO: 2966547 - DNA, 21 bp, Homo sapiens
aatatatttgtgtatttaaca

SEQ ID NO: 2966548 - DNA, 15 bp, Homo sapiens
aatatattttctgtt

SEQ ID NO: 2966549 - DNA, 23 bp, Homo sapiens
aatatattttctttctagtttgt

SEQ ID NO: 2966550 - DNA, 22 bp, Homo sapiens
aatatcaaatgcagtatatttc

SEQ ID NO: 2966551 - DNA, 19 bp, Homo sapiens
aatatcaagtactacattt

SEQ ID NO: 2966552 - DNA, 23 bp, Homo sapiens
aatatccaggtcaacagaatgaa

SEQ ID NO: 2966553 - DNA, 23 bp, Homo sapiens
aatatccctttttcacatattaa

SEQ ID NO: 2966554 - DNA, 20 bp, Homo sapiens
aatatctaaagttatatttc

SEQ ID NO: 2966555 - DNA, 13 bp, Homo sapiens
aatatctgaaatg

SEQ ID NO: 2966556 - DNA, 23 bp, Homo sapiens
aatatctttgcatcatagaacag

SEQ ID NO: 2966557 - DNA, 12 bp, Homo sapiens
aatatgaagctc

SEQ ID NO: 2966558 - DNA, 23 bp, Homo sapiens
aatatgaagttactttcttaatg

SEQ ID NO: 2966559 - DNA, 18 bp, Homo sapiens
aatatgcacacagtgctt

SEQ ID NO: 2966560 - DNA, 21 bp, Homo sapiens
aatatgcctctcctttgtata

SEQ ID NO: 2966561 - DNA, 14 bp, Homo sapiens
aatatgctggctgg

SEQ ID NO: 2966562 - DNA, 23 bp, Homo sapiens
aatatgctttcatcttctgttgc

SEQ ID NO: 2966563 - DNA, 23 bp, Homo sapiens
aatatggggatagtctgggtcag

SEQ ID NO: 2966564 - DNA, 14 bp, Homo sapiens
aatatgttaaagtt

SEQ ID NO: 2966565 - DNA, 13 bp, Homo sapiens
aatatgttgactt

SEQ ID NO: 2966566 - DNA, 22 bp, Homo sapiens
aatatgttgactttatttctga

SEQ ID NO: 2966567 - DNA, 12 bp, Homo sapiens
aatattaaaagt

SEQ ID NO: 2966568 - DNA, 18 bp, Homo sapiens
aatattaagaaacaattt

SEQ ID NO: 2966569 - DNA, 19 bp, Homo sapiens
aatattaagaaacaattta

SEQ ID NO: 2966570 - DNA, 17 bp, Homo sapiens
aatattaccttaagatt

SEQ ID NO: 2966571 - DNA, 15 bp, Homo sapiens
aatattagatgtgat

SEQ ID NO: 2966572 - DNA, 19 bp, Homo sapiens
aatattagatgtgatttaa

SEQ ID NO: 2966573 - DNA, 20 bp, Homo sapiens
aatattagatgtgatttaat

SEQ ID NO: 2966574 - DNA, 15 bp, Homo sapiens
aatattccctagaaa

SEQ ID NO: 2966575 - DNA, 15 bp, Homo sapiens
aatattgactttgtc

SEQ ID NO: 2966576 - DNA, 16 bp, Homo sapiens
aatattgactttgtct

SEQ ID NO: 2966577 - DNA, 21 bp, Homo sapiens
aatattgtattgctgctgtgc

SEQ ID NO: 2966578 - DNA, 16 bp, Homo sapiens
aatattgtcatgttta

SEQ ID NO: 2966579 - DNA, 21 bp, Homo sapiens
aatattgtcatgtttattcta

SEQ ID NO: 2966580 - DNA, 15 bp, Homo sapiens
aatatttatactata

SEQ ID NO: 2966581 - DNA, 13 bp, Homo sapiens
aatatttattgga

SEQ ID NO: 2966582 - DNA, 16 bp, Homo sapiens
aatatttccaatgtga

SEQ ID NO: 2966583 - DNA, 14 bp, Homo sapiens
aatatttccagaag

SEQ ID NO: 2966584 - DNA, 20 bp, Homo sapiens
aatatttccagaaggatttc

SEQ ID NO: 2966585 - DNA, 23 bp, Homo sapiens
aatgttggtgcaattaactctgg

SEQ ID NO: 2966586 - DNA, 15 bp, Homo sapiens
aatgttgtacagaga

SEQ ID NO: 2966587 - DNA, 12 bp, Homo sapiens
aatgttgtttcc

SEQ ID NO: 2966588 - DNA, 22 bp, Homo sapiens
aatgttgtttcctaatatcaaa

SEQ ID NO: 2966589 - DNA, 15 bp, Homo sapiens
aatgtttaaacattt

SEQ ID NO: 2966590 - DNA, 15 bp, Homo sapiens
aatgtttactataga

SEQ ID NO: 2966591 - DNA, 16 bp, Homo sapiens
aatgtttactgtaaat

SEQ ID NO: 2966592 - DNA, 12 bp, Homo sapiens
aatgtttccttt

SEQ ID NO: 2966593 - DNA, 13 bp, Homo sapiens
aatgtttccttta

SEQ ID NO: 2966594 - DNA, 15 bp, Homo sapiens
aatgtttctgtgtca

SEQ ID NO: 2966595 - DNA, 17 bp, Homo sapiens
aatgtttctgtgtcatt

SEQ ID NO: 2966596 - DNA, 21 bp, Homo sapiens
aatgtttgcttttcactggca

SEQ ID NO: 2966597 - DNA, 21 bp, Homo sapiens
aatgtttggattctcttagct

SEQ ID NO: 2966598 - DNA, 20 bp, Homo sapiens
aatgtttgtgtctgtggttg

SEQ ID NO: 2966599 - DNA, 16 bp, Homo sapiens
aatgttttaaatgtac

SEQ ID NO: 2966600 - DNA, 14 bp, Homo sapiens
aattaaaacacttt

SEQ ID NO: 2966601 - DNA, 16 bp, Homo sapiens
aattaaaattacaaaa

SEQ ID NO: 2966602 - DNA, 16 bp, Homo sapiens
aattaaaattttatga

SEQ ID NO: 2966603 - DNA, 14 bp, Homo sapiens
aattaaacatgaaa

SEQ ID NO: 2966604 - DNA, 14 bp, Homo sapiens
aattaaagcctttg

SEQ ID NO: 2966605 - DNA, 17 bp, Homo sapiens
aattaaagtgctgttta

SEQ ID NO: 2966606 - DNA, 18 bp, Homo sapiens
aattaaagtgctgtttag

SEQ ID NO: 2966607 - DNA, 20 bp, Homo sapiens
aattaaataaataaataaga

SEQ ID NO: 2966608 - DNA, 14 bp, Homo sapiens
aattaacagaaaaa

SEQ ID NO: 2966609 - DNA, 12 bp, Homo sapiens
aattaagtgttg

SEQ ID NO: 2966610 - DNA, 16 bp, Homo sapiens
aattaagtttgtgaat

SEQ ID NO: 2966611 - DNA, 14 bp, Homo sapiens
aattaatagctttt

SEQ ID NO: 2966612 - DNA, 18 bp, Homo sapiens
aattaatcatctggattt

SEQ ID NO: 2966613 - DNA, 13 bp, Homo sapiens
aattaatgattct

SEQ ID NO: 2966614 - DNA, 16 bp, Homo sapiens
aattaatgattctgaa

SEQ ID NO: 2966615 - DNA, 16 bp, Homo sapiens
aattaatttgttaatt

SEQ ID NO: 2966616 - DNA, 17 bp, Homo sapiens
aattaatttgttaatta

SEQ ID NO: 2966617 - DNA, 19 bp, Homo sapiens
aattaatttgttaattaaa

SEQ ID NO: 2966618 - DNA, 14 bp, Homo sapiens
aattacaattttat

SEQ ID NO: 2966619 - DNA, 15 bp, Homo sapiens
aattacaattttatc

SEQ ID NO: 2966620 - DNA, 23 bp, Homo sapiens
aattacacagtaagtcatttaac

SEQ ID NO: 2966621 - DNA, 14 bp, Homo sapiens
aattacactacaag

SEQ ID NO: 2966622 - DNA, 23 bp, Homo sapiens
aattacagcagttgactcagagt

SEQ ID NO: 2966623 - DNA, 17 bp, Homo sapiens
aattacgataaggaaga

SEQ ID NO: 2966624 - DNA, 23 bp, Homo sapiens
aattacggtgtacagtttaacag

SEQ ID NO: 2966625 - DNA, 21 bp, Homo sapiens
aattacttatccctgcccatt

SEQ ID NO: 2966626 - DNA, 17 bp, Homo sapiens
aattacttgtgttactt

SEQ ID NO: 2966627 - DNA, 21 bp, Homo sapiens
aattacttgtgttacttgcca

SEQ ID NO: 2966628 - DNA, 23 bp, Homo sapiens
aattacttttttccaattttaga

SEQ ID NO: 2966629 - DNA, 14 bp, Homo sapiens
aattagatgtttat

SEQ ID NO: 2966630 - DNA, 17 bp, Homo sapiens
aattaggaaaaaaacta

SEQ ID NO: 2966631 - DNA, 14 bp, Homo sapiens
aattagtggatttt

SEQ ID NO: 2966632 - DNA, 14 bp, Homo sapiens
aattataaaatgca

SEQ ID NO: 2966633 - DNA, 17 bp, Homo sapiens
aattataaacagcaggg

SEQ ID NO: 2966634 - DNA, 18 bp, Homo sapiens
aattataaacagcagggt

SEQ ID NO: 2966635 - DNA, 15 bp, Homo sapiens
aattatagatgggaa

SEQ ID NO: 2966636 - DNA, 16 bp, Homo sapiens
aattataggaagttct

SEQ ID NO: 2966637 - DNA, 22 bp, Homo sapiens
aattatagtgatgtaatcttga

SEQ ID NO: 2966638 - DNA, 15 bp, Homo sapiens
aattatagtttctga

SEQ ID NO: 2966639 - DNA, 20 bp, Homo sapiens
aattatatagcaaagatata

SEQ ID NO: 2966640 - DNA, 23 bp, Homo sapiens
aattatatagcaaagatatatat

SEQ ID NO: 2966641 - DNA, 14 bp, Homo sapiens
aattatattgttag

SEQ ID NO: 2966642 - DNA, 18 bp, Homo sapiens
aattatctttagttgaat

SEQ ID NO: 2966643 - DNA, 14 bp, Homo sapiens
aattatgagatttt

SEQ ID NO: 2966644 - DNA, 21 bp, Homo sapiens
aattatgcaattcagtgttcc

SEQ ID NO: 2966645 - DNA, 19 bp, Homo sapiens
aattatgccttttttgatc

SEQ ID NO: 2966646 - DNA, 23 bp, Homo sapiens
aattatggatacgtgttttgaat

SEQ ID NO: 2966647 - DNA, 14 bp, Homo sapiens
aattatgtaaataa

SEQ ID NO: 2966648 - DNA, 18 bp, Homo sapiens
aattatgtacaacattta

SEQ ID NO: 2966649 - DNA, 16 bp, Homo sapiens
aattattaatgaaaat

SEQ ID NO: 2966650 - DNA, 22 bp, Homo sapiens
aattattaatgaaaataagaat

SEQ ID NO: 2966651 - DNA, 20 bp, Homo sapiens
aattattagtttacatcatt

SEQ ID NO: 2966652 - DNA, 15 bp, Homo sapiens
aattattatttaact

SEQ ID NO: 2966653 - DNA, 16 bp, Homo sapiens
aattattatttaactc

SEQ ID NO: 2966654 - DNA, 18 bp, Homo sapiens
aattattatttaactctt

SEQ ID NO: 2966655 - DNA, 14 bp, Homo sapiens
aattatttaaagaa

SEQ ID NO: 2966656 - DNA, 12 bp, Homo sapiens
aattattttaaa

SEQ ID NO: 2966657 - DNA, 15 bp, Homo sapiens
aattattttaaaaga

SEQ ID NO: 2966658 - DNA, 15 bp, Homo sapiens
aattattttaaaata

SEQ ID NO: 2966659 - DNA, 17 bp, Homo sapiens
aattatttttacagttc

SEQ ID NO: 2966660 - DNA, 23 bp, Homo sapiens
aattcaaaagagagagagagatc

SEQ ID NO: 2966661 - DNA, 23 bp, Homo sapiens
aattcaaaagttccaagagtcta

SEQ ID NO: 2966662 - DNA, 13 bp, Homo sapiens
aattcacaaactt

SEQ ID NO: 2966663 - DNA, 12 bp, Homo sapiens
aattcactctga

SEQ ID NO: 2966664 - DNA, 22 bp, Homo sapiens
aattcagacctggaatgtaagt

SEQ ID NO: 2966665 - DNA, 14 bp, Homo sapiens
aattcagtctgctc

SEQ ID NO: 2966666 - DNA, 18 bp, Homo sapiens
aattcagtgtatttcagt

SEQ ID NO: 2966667 - DNA, 13 bp, Homo sapiens
aattcatactctg

SEQ ID NO: 2966668 - DNA, 22 bp, Homo sapiens
aattcatactctgttgcctcct

SEQ ID NO: 2966669 - DNA, 23 bp, Homo sapiens
aattcatactctgttgcctcctc

SEQ ID NO: 2966670 - DNA, 18 bp, Homo sapiens
aattcatatttttcctta

SEQ ID NO: 2966671 - DNA, 23 bp, Homo sapiens
aattcatatttttccttataggg

SEQ ID NO: 2966672 - DNA, 11 bp, Homo sapiens
aattcatgaac

SEQ ID NO: 2966673 - DNA, 14 bp, Homo sapiens
aattcatgtttctt

SEQ ID NO: 2966674 - DNA, 19 bp, Homo sapiens
aattcattgttttgcaaaa

SEQ ID NO: 2966675 - DNA, 12 bp, Homo sapiens
aattcatttact

SEQ ID NO: 2966676 - DNA, 11 bp, Homo sapiens
aattcatttgg

SEQ ID NO: 2966677 - DNA, 16 bp, Homo sapiens
aattccaattaaattt

SEQ ID NO: 2966678 - DNA, 24 bp, Homo sapiens
aattccatagtggaccacttggaa

SEQ ID NO: 2966679 - DNA, 19 bp, Homo sapiens
aattccatatatccttttc

SEQ ID NO: 2966680 - DNA, 10 bp, Homo sapiens
aattccatga

SEQ ID NO: 2966681 - DNA, 11 bp, Homo sapiens
aattccatgaa

SEQ ID NO: 2966682 - DNA, 20 bp, Homo sapiens
aattcccgggcccttcagtc

SEQ ID NO: 2966683 - DNA, 14 bp, Homo sapiens
aattcctacaactt

SEQ ID NO: 2966684 - DNA, 22 bp, Homo sapiens
aattcctacaacttaatggaaa

SEQ ID NO: 2966685 - DNA, 14 bp, Homo sapiens
aattcctagaatta

SEQ ID NO: 2966686 - DNA, 19 bp, Homo sapiens
aattcctctttgctttgct

SEQ ID NO: 2966687 - DNA, 16 bp, Homo sapiens
aattccttcagggtga

SEQ ID NO: 2966688 - DNA, 15 bp, Homo sapiens
aattcgcatgtttaa

SEQ ID NO: 2966689 - DNA, 18 bp, Homo sapiens
aattcgctgcaacctgtt

SEQ ID NO: 2966690 - DNA, 13 bp, Homo sapiens
aattctaaatgta

SEQ ID NO: 2966691 - DNA, 18 bp, Homo sapiens
aattctactaagttattt

SEQ ID NO: 2966692 - DNA, 21 bp, Homo sapiens
aattctatagagatagatatt

SEQ ID NO: 2966693 - DNA, 20 bp, Homo sapiens
aattctccctatcttgtgaa

SEQ ID NO: 2966694 - DNA, 20 bp, Homo sapiens
aattctcctgcctcagcctc

SEQ ID NO: 2966695 - DNA, 14 bp, Homo sapiens
aattctctcctaat

SEQ ID NO: 2966696 - DNA, 19 bp, Homo sapiens
aattctcttctttttcttt

SEQ ID NO: 2966697 - DNA, 14 bp, Homo sapiens
aattctgaatttgc

SEQ ID NO: 2966698 - DNA, 17 bp, Homo sapiens
aattctgaatttgcaaa

SEQ ID NO: 2966699 - DNA, 18 bp, Homo sapiens
aattctgaatttgcaaag

SEQ ID NO: 2966700 - DNA, 13 bp, Homo sapiens
aattctgtttctt

SEQ ID NO: 2966701 - DNA, 16 bp, Homo sapiens
aattctgtttcttgag

SEQ ID NO: 2966702 - DNA, 12 bp, Homo sapiens
aattctgtttta

SEQ ID NO: 2966703 - DNA, 22 bp, Homo sapiens
aattctgtttttaatgctattt

SEQ ID NO: 2966704 - DNA, 16 bp, Homo sapiens
aattcttaagtatgtt

SEQ ID NO: 2966705 - DNA, 22 bp, Homo sapiens
aattcttaatttggatctattt

SEQ ID NO: 2966706 - DNA, 17 bp, Homo sapiens
aattcttattttgtgga

SEQ ID NO: 2966707 - DNA, 19 bp, Homo sapiens
aattcttggttgaggaaac

SEQ ID NO: 2966708 - DNA, 22 bp, Homo sapiens
aattctttaaaattacaactaa

SEQ ID NO: 2966709 - DNA, 19 bp, Homo sapiens
aattctttatacaacagtg

SEQ ID NO: 2966710 - DNA, 17 bp, Homo sapiens
aattgaaaggcattctc

SEQ ID NO: 2966711 - DNA, 21 bp, Homo sapiens
aattgaaaggcattctctgaa

SEQ ID NO: 2966712 - DNA, 22 bp, Homo sapiens
aattgaataatggtaccagata

SEQ ID NO: 2966713 - DNA, 20 bp, Homo sapiens
aattgacatgaccctctgtc

SEQ ID NO: 2966714 - DNA, 15 bp, Homo sapiens
aattgagaaggaaaa

SEQ ID NO: 2966715 - DNA, 17 bp, Homo sapiens
aattgagcttgcttctt

SEQ ID NO: 2966716 - DNA, 17 bp, Homo sapiens
aattgagttttcagtgg

SEQ ID NO: 2966717 - DNA, 15 bp, Homo sapiens
aattgattgtcagcc

SEQ ID NO: 2966718 - DNA, 20 bp, Homo sapiens
acaaggacagacagcaggca

SEQ ID NO: 2966719 - DNA, 17 bp, Homo sapiens
acaaggagagcggagga

SEQ ID NO: 2966720 - DNA, 18 bp, Homo sapiens
acaaggagctttcttgtt

SEQ ID NO: 2966721 - DNA, 22 bp, Homo sapiens
acaaggagctttcttgtttctt

SEQ ID NO: 2966722 - DNA, 23 bp, Homo sapiens
acaaggagctttcttgtttctta

SEQ ID NO: 2966723 - DNA, 18 bp, Homo sapiens
acaaggatagatgctggc

SEQ ID NO: 2966724 - DNA, 22 bp, Homo sapiens
acaaggatagatgctggcccag

SEQ ID NO: 2966725 - DNA, 14 bp, Homo sapiens
acaaggcaggcctg

SEQ ID NO: 2966726 - DNA, 15 bp, Homo sapiens
acaaggcccctctgc

SEQ ID NO: 2966727 - DNA, 16 bp, Homo sapiens
acaaggcccctctgca

SEQ ID NO: 2966728 - DNA, 11 bp, Homo sapiens
acaaggcctgg

SEQ ID NO: 2966729 - DNA, 12 bp, Homo sapiens
acaaggcctggt

SEQ ID NO: 2966730 - DNA, 19 bp, Homo sapiens
acaaggccttgcctggcct

SEQ ID NO: 2966731 - DNA, 16 bp, Homo sapiens
acaagggaaggacaga

SEQ ID NO: 2966732 - DNA, 22 bp, Homo sapiens
acaagggaaggggcctccctcc

SEQ ID NO: 2966733 - DNA, 14 bp, Homo sapiens
acaagggagaagac

SEQ ID NO: 2966734 - DNA, 19 bp, Homo sapiens
acaaggttatatgaatata

SEQ ID NO: 2966735 - DNA, 22 bp, Homo sapiens
acaaggttcttcccttttacat

SEQ ID NO: 2966736 - DNA, 23 bp, Homo sapiens
acaagtaagagactcagcctgca

SEQ ID NO: 2966737 - DNA, 18 bp, Homo sapiens
acaagtatatacttttaa

SEQ ID NO: 2966738 - DNA, 18 bp, Homo sapiens
acaagtcatggacattca

SEQ ID NO: 2966739 - DNA, 15 bp, Homo sapiens
acaagtgaacaaaat

SEQ ID NO: 2966740 - DNA, 17 bp, Homo sapiens
acaagtgccgcaaattg

SEQ ID NO: 2966741 - DNA, 20 bp, Homo sapiens
acaagtgccgcaaattgtac

SEQ ID NO: 2966742 - DNA, 14 bp, Homo sapiens
acaagttgtgtttg

SEQ ID NO: 2966743 - DNA, 14 bp, Homo sapiens
acaataaaattttt

SEQ ID NO: 2966744 - DNA, 20 bp, Homo sapiens
acaataaaattttttttcat

SEQ ID NO: 2966745 - DNA, 12 bp, Homo sapiens
acaataaactgg

SEQ ID NO: 2966746 - DNA, 13 bp, Homo sapiens
acaataaactggt

SEQ ID NO: 2966747 - DNA, 22 bp, Homo sapiens
acaataaagaaagaaatattaa

SEQ ID NO: 2966748 - DNA, 14 bp, Homo sapiens
acaataataaagat

SEQ ID NO: 2966749 - DNA, 15 bp, Homo sapiens
acaataataaagatg

SEQ ID NO: 2966750 - DNA, 16 bp, Homo sapiens
acaataataaagatgt

SEQ ID NO: 2966751 - DNA, 20 bp, Homo sapiens
acaatacctacaataaactg

SEQ ID NO: 2966752 - DNA, 20 bp, Homo sapiens
acaatactcataatgtgaag

SEQ ID NO: 2966753 - DNA, 21 bp, Homo sapiens
acaatacttgcattccagagt

SEQ ID NO: 2966754 - DNA, 18 bp, Homo sapiens
acaatattttattctagg

SEQ ID NO: 2966755 - DNA, 13 bp, Homo sapiens
acaatctgttcta

SEQ ID NO: 2966756 - DNA, 16 bp, Homo sapiens
acaatctgttctactc

SEQ ID NO: 2966757 - DNA, 19 bp, Homo sapiens
acaatctgttctactctta

SEQ ID NO: 2966758 - DNA, 15 bp, Homo sapiens
acaatgaatgtcttt

SEQ ID NO: 2966759 - DNA, 16 bp, Homo sapiens
acaatgacatttatat

SEQ ID NO: 2966760 - DNA, 15 bp, Homo sapiens
acaatgactaagcca

SEQ ID NO: 2966761 - DNA, 17 bp, Homo sapiens
acaatgactaagccaag

SEQ ID NO: 2966762 - DNA, 22 bp, Homo sapiens
acaatgactaagccaagctgtg

SEQ ID NO: 2966763 - DNA, 22 bp, Homo sapiens
acaatgatcctgtattcagaca

SEQ ID NO: 2966764 - DNA, 19 bp, Homo sapiens
acaatgattaatcagctgt

SEQ ID NO: 2966765 - DNA, 17 bp, Homo sapiens
acaatgctgatttggtg

SEQ ID NO: 2966766 - DNA, 15 bp, Homo sapiens
acaatgcttatggaa

SEQ ID NO: 2966767 - DNA, 18 bp, Homo sapiens
acaatggcagaacaggtg

SEQ ID NO: 2966768 - DNA, 16 bp, Homo sapiens
acaatggtttttaaat

SEQ ID NO: 2966769 - DNA, 14 bp, Homo sapiens
acaatgtatttatt

SEQ ID NO: 2966770 - DNA, 23 bp, Homo sapiens
acaatgtatttatttaaaagatt

SEQ ID NO: 2966771 - DNA, 20 bp, Homo sapiens
acaatgtattttaataacat

SEQ ID NO: 2966772 - DNA, 16 bp, Homo sapiens
acaatgtctgcagccc

SEQ ID NO: 2966773 - DNA, 14 bp, Homo sapiens
acaatgtgtattca

SEQ ID NO: 2966774 - DNA, 13 bp, Homo sapiens
acaatgttcttta

SEQ ID NO: 2966775 - DNA, 16 bp, Homo sapiens
acaatgttctttatat

SEQ ID NO: 2966776 - DNA, 22 bp, Homo sapiens
acaatgttgtagtgtcccccac

SEQ ID NO: 2966777 - DNA, 16 bp, Homo sapiens
acaatgttgtgtttgg

SEQ ID NO: 2966778 - DNA, 18 bp, Homo sapiens
acaattattgtatattga

SEQ ID NO: 2966779 - DNA, 19 bp, Homo sapiens
acaattattgtatattgat

SEQ ID NO: 2966780 - DNA, 17 bp, Homo sapiens
acaattatttaaagcaa

SEQ ID NO: 2966781 - DNA, 13 bp, Homo sapiens
acaattctttata

SEQ ID NO: 2966782 - DNA, 14 bp, Homo sapiens
acaattctttatac

SEQ ID NO: 2966783 - DNA, 18 bp, Homo sapiens
acaattctttatacaaca

SEQ ID NO: 2966784 - DNA, 19 bp, Homo sapiens
acaattctttatacaacag

SEQ ID NO: 2966785 - DNA, 16 bp, Homo sapiens
acaattgcaaatcaga

SEQ ID NO: 2966786 - DNA, 15 bp, Homo sapiens
acaatttaaattgtt

SEQ ID NO: 2966787 - DNA, 15 bp, Homo sapiens
acaatttctttaaaa

SEQ ID NO: 2966788 - DNA, 21 bp, Homo sapiens
acaatttctttaaaaaagaaa

SEQ ID NO: 2966789 - DNA, 13 bp, Homo sapiens
acaattttcttgt

SEQ ID NO: 2966790 - DNA, 12 bp, Homo sapiens
acaattttgtac

SEQ ID NO: 2966791 - DNA, 17 bp, Homo sapiens
acaatttttttaatttt

SEQ ID NO: 2966792 - DNA, 10 bp, Homo sapiens
acacaaaaag

SEQ ID NO: 2966793 - DNA, 14 bp, Homo sapiens
acacaaacacacac

SEQ ID NO: 2966794 - DNA, 17 bp, Homo sapiens
acacaaacacattgtta

SEQ ID NO: 2966795 - DNA, 15 bp, Homo sapiens
acacaaactgtaaat

SEQ ID NO: 2966796 - DNA, 12 bp, Homo sapiens
acacaaatgata

SEQ ID NO: 2966797 - DNA, 17 bp, Homo sapiens
acacaacacaagaaaac

SEQ ID NO: 2966798 - DNA, 14 bp, Homo sapiens
acacaacagccaac

SEQ ID NO: 2966799 - DNA, 18 bp, Homo sapiens
acacaacccaataggagt

SEQ ID NO: 2966800 - DNA, 17 bp, Homo sapiens
acacaactatcaaaatt

SEQ ID NO: 2966801 - DNA, 13 bp, Homo sapiens
acacaagaaaact

SEQ ID NO: 2966802 - DNA, 23 bp, Homo sapiens
acacaagaaaactcaaagaatgt

SEQ ID NO: 2966803 - DNA, 21 bp, Homo sapiens
acacaaggagctttcttgttt

SEQ ID NO: 2966804 - DNA, 23 bp, Homo sapiens
acacaaggagctttcttgtttct

SEQ ID NO: 2966805 - DNA, 16 bp, Homo sapiens
acacaaggtcatggcc

SEQ ID NO: 2966806 - DNA, 23 bp, Homo sapiens
acacaaggtcatggccacactgt

SEQ ID NO: 2966807 - DNA, 16 bp, Homo sapiens
acacaagtaagagact

SEQ ID NO: 2966808 - DNA, 12 bp, Homo sapiens
acacacaaaaag

SEQ ID NO: 2966809 - DNA, 15 bp, Homo sapiens
acacacaacagccaa

SEQ ID NO: 2966810 - DNA, 17 bp, Homo sapiens
acacacaacagccaaca

SEQ ID NO: 2966811 - DNA, 9 bp, Homo sapiens
acacacaca

SEQ ID NO: 2966812 - DNA, 14 bp, Homo sapiens
acacacacacacaa

SEQ ID NO: 2966813 - DNA, 16 bp, Homo sapiens
acacacacacacatgc

SEQ ID NO: 2966814 - DNA, 13 bp, Homo sapiens
acacacacacagc

SEQ ID NO: 2966815 - DNA, 13 bp, Homo sapiens
acacacacacatg

SEQ ID NO: 2966816 - DNA, 14 bp, Homo sapiens
acacacacacatgc

SEQ ID NO: 2966817 - DNA, 17 bp, Homo sapiens
acacacacacatgcata

SEQ ID NO: 2966818 - DNA, 12 bp, Homo sapiens
acacacacagaa

SEQ ID NO: 2966819 - DNA, 12 bp, Homo sapiens
acacacacagcc

SEQ ID NO: 2966820 - DNA, 13 bp, Homo sapiens
acacacacagcca

SEQ ID NO: 2966821 - DNA, 15 bp, Homo sapiens
acacacacagccaca

SEQ ID NO: 2966822 - DNA, 13 bp, Homo sapiens
acacacacatgca

SEQ ID NO: 2966823 - DNA, 15 bp, Homo sapiens
acacacacatgcata

SEQ ID NO: 2966824 - DNA, 16 bp, Homo sapiens
acacacacatgcatac

SEQ ID NO: 2966825 - DNA, 21 bp, Homo sapiens
acacacaccagtttacaggaa

SEQ ID NO: 2966826 - DNA, 13 bp, Homo sapiens
acacacactcctt

SEQ ID NO: 2966827 - DNA, 15 bp, Homo sapiens
acacacagaaaatat

SEQ ID NO: 2966828 - DNA, 18 bp, Homo sapiens
acacacagaaaatatact

SEQ ID NO: 2966829 - DNA, 22 bp, Homo sapiens
acacacagaaaatatactgtaa

SEQ ID NO: 2966830 - DNA, 21 bp, Homo sapiens
acacacagccacacacacaga

SEQ ID NO: 2966831 - DNA, 23 bp, Homo sapiens
acacacaggtggtgtcactgtcc

SEQ ID NO: 2966832 - DNA, 16 bp, Homo sapiens
acacacatgcatacac

SEQ ID NO: 2966833 - DNA, 13 bp, Homo sapiens
acacacctctgct

SEQ ID NO: 2966834 - DNA, 16 bp, Homo sapiens
acacacctctgctcca

SEQ ID NO: 2966835 - DNA, 14 bp, Homo sapiens
acacactccttccc

SEQ ID NO: 2966836 - DNA, 18 bp, Homo sapiens
acacactgaggcagggaa

SEQ ID NO: 2966837 - DNA, 13 bp, Homo sapiens
acacactgatgct

SEQ ID NO: 2966838 - DNA, 15 bp, Homo sapiens
acacactgatgctta

SEQ ID NO: 2966839 - DNA, 13 bp, Homo sapiens
acacactgcctta

SEQ ID NO: 2966840 - DNA, 13 bp, Homo sapiens
acacagaaacact

SEQ ID NO: 2966841 - DNA, 19 bp, Homo sapiens
acacagaaacctttttaaa

SEQ ID NO: 2966842 - DNA, 23 bp, Homo sapiens
acacagactcatcctgaacagca

SEQ ID NO: 2966843 - DNA, 14 bp, Homo sapiens
acacagagtgtgtt

SEQ ID NO: 2966844 - DNA, 18 bp, Homo sapiens
acacagagtgtgtttttg

SEQ ID NO: 2966845 - DNA, 11 bp, Homo sapiens
acacagatgtt

SEQ ID NO: 2966846 - DNA, 14 bp, Homo sapiens
acacagccacacac

SEQ ID NO: 2966847 - DNA, 19 bp, Homo sapiens
acacagccgattcacctga

SEQ ID NO: 2966848 - DNA, 23 bp, Homo sapiens
acacagccgattcacctgagcag

SEQ ID NO: 2966849 - DNA, 18 bp, Homo sapiens
acacagcctgggccccag

SEQ ID NO: 2966850 - DNA, 19 bp, Homo sapiens
acacagcctgggccccagc

SEQ ID NO: 2966851 - DNA, 16 bp, Homo sapiens
acacagcggctgcctc

SEQ ID NO: 2966852 - DNA, 23 bp, Homo sapiens
acatttttcaactttgaataaag

SEQ ID NO: 2966853 - DNA, 21 bp, Homo sapiens
acatttttgcagctaaattac

SEQ ID NO: 2966854 - DNA, 19 bp, Homo sapiens
accaaaaactgaaagtgaa

SEQ ID NO: 2966855 - DNA, 17 bp, Homo sapiens
accaaaactgtgcagag

SEQ ID NO: 2966856 - DNA, 23 bp, Homo sapiens
accaaaaggagagattattaaat

SEQ ID NO: 2966857 - DNA, 21 bp, Homo sapiens
accaaaagggaaaaaataaaa

SEQ ID NO: 2966858 - DNA, 21 bp, Homo sapiens
accaaagaacgtaataaacca

SEQ ID NO: 2966859 - DNA, 22 bp, Homo sapiens
accaaagaacgtaataaaccag

SEQ ID NO: 2966860 - DNA, 16 bp, Homo sapiens
accaaagagtctctgg

SEQ ID NO: 2966861 - DNA, 20 bp, Homo sapiens
accaaagagtctctggctca

SEQ ID NO: 2966862 - DNA, 13 bp, Homo sapiens
accaaagggggag

SEQ ID NO: 2966863 - DNA, 11 bp, Homo sapiens
accaaagttct

SEQ ID NO: 2966864 - DNA, 12 bp, Homo sapiens
accaaagttcta

SEQ ID NO: 2966865 - DNA, 15 bp, Homo sapiens
accaaagttctaata

SEQ ID NO: 2966866 - DNA, 21 bp, Homo sapiens
accaaagttctaataatttct

SEQ ID NO: 2966867 - DNA, 23 bp, Homo sapiens
accaaagttgttttacagctgtg

SEQ ID NO: 2966868 - DNA, 24 bp, Homo sapiens
accaaagttgttttacagctgtgt

SEQ ID NO: 2966869 - DNA, 12 bp, Homo sapiens
accaaatgaatt

SEQ ID NO: 2966870 - DNA, 20 bp, Homo sapiens
accaaattaacttacttcca

SEQ ID NO: 2966871 - DNA, 16 bp, Homo sapiens
accaaattgcttctag

SEQ ID NO: 2966872 - DNA, 21 bp, Homo sapiens
accaacatcccattgccctgg

SEQ ID NO: 2966873 - DNA, 22 bp, Homo sapiens
accaacatcccattgccctggt

SEQ ID NO: 2966874 - DNA, 15 bp, Homo sapiens
accaacatggagaaa

SEQ ID NO: 2966875 - DNA, 15 bp, Homo sapiens
accaacccactgccc

SEQ ID NO: 2966876 - DNA, 22 bp, Homo sapiens
accaacccatcagaaggagaag

SEQ ID NO: 2966877 - DNA, 20 bp, Homo sapiens
accaacccccatctccctag

SEQ ID NO: 2966878 - DNA, 21 bp, Homo sapiens
accaacccccatctccctagc

SEQ ID NO: 2966879 - DNA, 12 bp, Homo sapiens
accaagagaagg

SEQ ID NO: 2966880 - DNA, 16 bp, Homo sapiens
accaagagattgctaa

SEQ ID NO: 2966881 - DNA, 21 bp, Homo sapiens
accaagagattgctaattgct

SEQ ID NO: 2966882 - DNA, 18 bp, Homo sapiens
accaagattttgaaggaa

SEQ ID NO: 2966883 - DNA, 14 bp, Homo sapiens
accaagcacagcag

SEQ ID NO: 2966884 - DNA, 16 bp, Homo sapiens
accaagcacagcagcc

SEQ ID NO: 2966885 - DNA, 24 bp, Homo sapiens
accaagcaggaagctcagactggt

SEQ ID NO: 2966886 - DNA, 21 bp, Homo sapiens
accaagccaccgcagctgctg

SEQ ID NO: 2966887 - DNA, 23 bp, Homo sapiens
accaagccaccgcagctgctgcc

SEQ ID NO: 2966888 - DNA, 19 bp, Homo sapiens
accaagctcacagttcctc

SEQ ID NO: 2966889 - DNA, 21 bp, Homo sapiens
accaagctttcaaacatgttg

SEQ ID NO: 2966890 - DNA, 20 bp, Homo sapiens
accaaggaaacgctacctct

SEQ ID NO: 2966891 - DNA, 21 bp, Homo sapiens
accaaggaaacgctacctctc

SEQ ID NO: 2966892 - DNA, 12 bp, Homo sapiens
accaaggaagga

SEQ ID NO: 2966893 - DNA, 18 bp, Homo sapiens
accaaggaaggagcccct

SEQ ID NO: 2966894 - DNA, 19 bp, Homo sapiens
accaaggaaggagcccctg

SEQ ID NO: 2966895 - DNA, 14 bp, Homo sapiens
accaaggctgtgtt

SEQ ID NO: 2966896 - DNA, 14 bp, Homo sapiens
accaagggggcggg

SEQ ID NO: 2966897 - DNA, 20 bp, Homo sapiens
accaagggggcggggactgc

SEQ ID NO: 2966898 - DNA, 21 bp, Homo sapiens
accaaggggtggccgggcaca

SEQ ID NO: 2966899 - DNA, 17 bp, Homo sapiens
accaagtcagacaccaa

SEQ ID NO: 2966900 - DNA, 17 bp, Homo sapiens
accaagtcaggccaggt

SEQ ID NO: 2966901 - DNA, 15 bp, Homo sapiens
accaagtgggctggt

SEQ ID NO: 2966902 - DNA, 20 bp, Homo sapiens
accaagttgtttattccaaa

SEQ ID NO: 2966903 - DNA, 20 bp, Homo sapiens
accaatacaaaatgtattac

SEQ ID NO: 2966904 - DNA, 13 bp, Homo sapiens
accaatcctggac

SEQ ID NO: 2966905 - DNA, 17 bp, Homo sapiens
accaattatggaaatag

SEQ ID NO: 2966906 - DNA, 18 bp, Homo sapiens
accacaaactgtaataca

SEQ ID NO: 2966907 - DNA, 21 bp, Homo sapiens
accacaaggctgttgcatggg

SEQ ID NO: 2966908 - DNA, 14 bp, Homo sapiens
accacacatcccag

SEQ ID NO: 2966909 - DNA, 17 bp, Homo sapiens
accacacatcccagccc

SEQ ID NO: 2966910 - DNA, 12 bp, Homo sapiens
accacacatctg

SEQ ID NO: 2966911 - DNA, 16 bp, Homo sapiens
accacaccctgcctgc

SEQ ID NO: 2966912 - DNA, 21 bp, Homo sapiens
accacaccctgcctgctgtgg

SEQ ID NO: 2966913 - DNA, 22 bp, Homo sapiens
accacaccctgcctgctgtgga

SEQ ID NO: 2966914 - DNA, 13 bp, Homo sapiens
accacacctggct

SEQ ID NO: 2966915 - DNA, 22 bp, Homo sapiens
accacactggactccggccctc

SEQ ID NO: 2966916 - DNA, 15 bp, Homo sapiens
accacactttcaaag

SEQ ID NO: 2966917 - DNA, 20 bp, Homo sapiens
accacagtttcttctgtaaa

SEQ ID NO: 2966918 - DNA, 19 bp, Homo sapiens
accacatagcatgaggcca

SEQ ID NO: 2966919 - DNA, 21 bp, Homo sapiens
accaccaccttatacatcact

SEQ ID NO: 2966920 - DNA, 19 bp, Homo sapiens
accacccccactggtgaga

SEQ ID NO: 2966921 - DNA, 20 bp, Homo sapiens
accaccccggccccctgccc

SEQ ID NO: 2966922 - DNA, 15 bp, Homo sapiens
accaccgagctctgt

SEQ ID NO: 2966923 - DNA, 18 bp, Homo sapiens
accaccgagctctgtggg

SEQ ID NO: 2966924 - DNA, 19 bp, Homo sapiens
accaccgttcagtcatttt

SEQ ID NO: 2966925 - DNA, 15 bp, Homo sapiens
accacctctctgtct

SEQ ID NO: 2966926 - DNA, 16 bp, Homo sapiens
accacctctctgtctt

SEQ ID NO: 2966927 - DNA, 21 bp, Homo sapiens
accaccttatacatcacttcc

SEQ ID NO: 2966928 - DNA, 20 bp, Homo sapiens
accaccttcccagctctccc

SEQ ID NO: 2966929 - DNA, 21 bp, Homo sapiens
accaccttcccagctctccct

SEQ ID NO: 2966930 - DNA, 22 bp, Homo sapiens
accaccttcccagctctccctc

SEQ ID NO: 2966931 - DNA, 16 bp, Homo sapiens
accacgatgtggccct

SEQ ID NO: 2966932 - DNA, 18 bp, Homo sapiens
accacgatgtggccctgg

SEQ ID NO: 2966933 - DNA, 21 bp, Homo sapiens
accacgatgtggccctggcct

SEQ ID NO: 2966934 - DNA, 16 bp, Homo sapiens
accacgctggggtctg

SEQ ID NO: 2966935 - DNA, 22 bp, Homo sapiens
accactaatgcttgccaagaaa

SEQ ID NO: 2966936 - DNA, 12 bp, Homo sapiens
accactcctgcc

SEQ ID NO: 2966937 - DNA, 13 bp, Homo sapiens
accactcctgcca

SEQ ID NO: 2966938 - DNA, 16 bp, Homo sapiens
accactcctgccagcc

SEQ ID NO: 2966939 - DNA, 17 bp, Homo sapiens
accactcctgccagccc

SEQ ID NO: 2966940 - DNA, 19 bp, Homo sapiens
accactcctgccagcccgg

SEQ ID NO: 2966941 - DNA, 17 bp, Homo sapiens
accactgcaagtccttt

SEQ ID NO: 2966942 - DNA, 13 bp, Homo sapiens
accactgggcccc

SEQ ID NO: 2966943 - DNA, 18 bp, Homo sapiens
accactgtctttttctta

SEQ ID NO: 2966944 - DNA, 21 bp, Homo sapiens
accactgtggaagtccctcag

SEQ ID NO: 2966945 - DNA, 17 bp, Homo sapiens
accacttcttttataac

SEQ ID NO: 2966946 - DNA, 13 bp, Homo sapiens
accacttggaaat

SEQ ID NO: 2966947 - DNA, 17 bp, Homo sapiens
accactttattgcaatg

SEQ ID NO: 2966948 - DNA, 18 bp, Homo sapiens
accactttattgcaatgc

SEQ ID NO: 2966949 - DNA, 21 bp, Homo sapiens
accactttcttattctgtatc

SEQ ID NO: 2966950 - DNA, 20 bp, Homo sapiens
accacttttcattgcaaagt

SEQ ID NO: 2966951 - DNA, 22 bp, Homo sapiens
accagaaacctgggagagactt

SEQ ID NO: 2966952 - DNA, 17 bp, Homo sapiens
accagaagttaaaccat

SEQ ID NO: 2966953 - DNA, 12 bp, Homo sapiens
accagacaatgt

SEQ ID NO: 2966954 - DNA, 16 bp, Homo sapiens
accagacacccaggac

SEQ ID NO: 2966955 - DNA, 23 bp, Homo sapiens
accagactacttgggagcaccgc

SEQ ID NO: 2966956 - DNA, 20 bp, Homo sapiens
accagactcgccaacatggt

SEQ ID NO: 2966957 - DNA, 12 bp, Homo sapiens
accagacttttc

SEQ ID NO: 2966958 - DNA, 14 bp, Homo sapiens
accagagcaaaaat

SEQ ID NO: 2966959 - DNA, 16 bp, Homo sapiens
accagagcaaaaatgt

SEQ ID NO: 2966960 - DNA, 22 bp, Homo sapiens
accagagcaaaaatgtaaaaaa

SEQ ID NO: 2966961 - DNA, 15 bp, Homo sapiens
accagagcaggggct

SEQ ID NO: 2966962 - DNA, 18 bp, Homo sapiens
accagagctgcctcccca

SEQ ID NO: 2966963 - DNA, 14 bp, Homo sapiens
accagaggagcctt

SEQ ID NO: 2966964 - DNA, 19 bp, Homo sapiens
accagataactgaggaggg

SEQ ID NO: 2966965 - DNA, 15 bp, Homo sapiens
accagcaagtcccag

SEQ ID NO: 2966966 - DNA, 16 bp, Homo sapiens
accagcaagtcccaga

SEQ ID NO: 2966967 - DNA, 20 bp, Homo sapiens
accagcaagtcccagacaag

SEQ ID NO: 2966968 - DNA, 17 bp, Homo sapiens
accagcaatatatctga

SEQ ID NO: 2966969 - DNA, 14 bp, Homo sapiens
accagcagcactgg

SEQ ID NO: 2966970 - DNA, 17 bp, Homo sapiens
accagcagcgcctttcc

SEQ ID NO: 2966971 - DNA, 17 bp, Homo sapiens
accagcattccttttga

SEQ ID NO: 2966972 - DNA, 14 bp, Homo sapiens
accagcccagatgt

SEQ ID NO: 2966973 - DNA, 21 bp, Homo sapiens
accagccctgctgcttcctaa

SEQ ID NO: 2966974 - DNA, 13 bp, Homo sapiens
accagcctcctgg

SEQ ID NO: 2966975 - DNA, 15 bp, Homo sapiens
accagcctggccaac

SEQ ID NO: 2966976 - DNA, 17 bp, Homo sapiens
accagcctggccaacat

SEQ ID NO: 2966977 - DNA, 22 bp, Homo sapiens
accagcctgtccaacatggtga

SEQ ID NO: 2966978 - DNA, 11 bp, Homo sapiens
accagcctttc

SEQ ID NO: 2966979 - DNA, 12 bp, Homo sapiens
accagcctttct

SEQ ID NO: 2966980 - DNA, 13 bp, Homo sapiens
accagcctttggg

SEQ ID NO: 2966981 - DNA, 23 bp, Homo sapiens
accagcctttgggtcctgggcag

SEQ ID NO: 2966982 - DNA, 24 bp, Homo sapiens
accagcctttgggtcctgggcagg

SEQ ID NO: 2966983 - DNA, 13 bp, Homo sapiens
acctcggccctcc

SEQ ID NO: 2966984 - DNA, 20 bp, Homo sapiens
acctctccatcttcagcttc

SEQ ID NO: 2966985 - DNA, 15 bp, Homo sapiens
acctctcccacggga

SEQ ID NO: 2966986 - DNA, 13 bp, Homo sapiens
acctctcccaggg

SEQ ID NO: 2966987 - DNA, 16 bp, Homo sapiens
acctctctatttttaa

SEQ ID NO: 2966988 - DNA, 14 bp, Homo sapiens
acctctctcctctc

SEQ ID NO: 2966989 - DNA, 14 bp, Homo sapiens
acctctctgtagtt

SEQ ID NO: 2966990 - DNA, 15 bp, Homo sapiens
acctctctgtccctt

SEQ ID NO: 2966991 - DNA, 13 bp, Homo sapiens
acctctgcctcaa

SEQ ID NO: 2966992 - DNA, 17 bp, Homo sapiens
acctctgcttcccaggt

SEQ ID NO: 2966993 - DNA, 21 bp, Homo sapiens
acctctggattaggtctctgt

SEQ ID NO: 2966994 - DNA, 12 bp, Homo sapiens
acctctgtgtgc

SEQ ID NO: 2966995 - DNA, 14 bp, Homo sapiens
acctctgttcagtg

SEQ ID NO: 2966996 - DNA, 17 bp, Homo sapiens
acctcttcagaggccct

SEQ ID NO: 2966997 - DNA, 14 bp, Homo sapiens
acctcttctggctc

SEQ ID NO: 2966998 - DNA, 17 bp, Homo sapiens
acctctttaagtattga

SEQ ID NO: 2966999 - DNA, 22 bp, Homo sapiens
acctctttaagtattgattctg

SEQ ID NO: 2967000 - DNA, 16 bp, Homo sapiens
acctgaaagagccttc

SEQ ID NO: 2967001 - DNA, 14 bp, Homo sapiens
acctgaaattccaa

SEQ ID NO: 2967002 - DNA, 19 bp, Homo sapiens
acctgaaattccaaagtct

SEQ ID NO: 2967003 - DNA, 18 bp, Homo sapiens
acctgaaccccagaggca

SEQ ID NO: 2967004 - DNA, 20 bp, Homo sapiens
acctgaaggtcccctggcag

SEQ ID NO: 2967005 - DNA, 18 bp, Homo sapiens
acctgaataaagaatgaa

SEQ ID NO: 2967006 - DNA, 13 bp, Homo sapiens
acctgaatttgta

SEQ ID NO: 2967007 - DNA, 19 bp, Homo sapiens
acctgacactcccttgggc

SEQ ID NO: 2967008 - DNA, 18 bp, Homo sapiens
acctgaccgctgcccagg

SEQ ID NO: 2967009 - DNA, 22 bp, Homo sapiens
acctgaccgctgcccaggtggg

SEQ ID NO: 2967010 - DNA, 18 bp, Homo sapiens
acctgagcattcaggcag

SEQ ID NO: 2967011 - DNA, 15 bp, Homo sapiens
acctgaggtcaggag

SEQ ID NO: 2967012 - DNA, 19 bp, Homo sapiens
acctgaggtcaggagttca

SEQ ID NO: 2967013 - DNA, 16 bp, Homo sapiens
acctgatcaatgacag

SEQ ID NO: 2967014 - DNA, 22 bp, Homo sapiens
acctgatcctggaggcccagtt

SEQ ID NO: 2967015 - DNA, 22 bp, Homo sapiens
acctgattaactgaggcatcca

SEQ ID NO: 2967016 - DNA, 11 bp, Homo sapiens
acctgattcaa

SEQ ID NO: 2967017 - DNA, 21 bp, Homo sapiens
acctgatttattgaaattttt

SEQ ID NO: 2967018 - DNA, 15 bp, Homo sapiens
acctgcaaaaaatac

SEQ ID NO: 2967019 - DNA, 15 bp, Homo sapiens
acctgcaaagatctg

SEQ ID NO: 2967020 - DNA, 22 bp, Homo sapiens
acctgcaaagatctgtcctcag

SEQ ID NO: 2967021 - DNA, 15 bp, Homo sapiens
acctgcaagcagaac

SEQ ID NO: 2967022 - DNA, 13 bp, Homo sapiens
acctgcaagcctt

SEQ ID NO: 2967023 - DNA, 17 bp, Homo sapiens
acctgcaagtatccaga

SEQ ID NO: 2967024 - DNA, 18 bp, Homo sapiens
acctgcaagtatccagac

SEQ ID NO: 2967025 - DNA, 15 bp, Homo sapiens
acctgcaatcccagc

SEQ ID NO: 2967026 - DNA, 16 bp, Homo sapiens
acctgcacctcccccc

SEQ ID NO: 2967027 - DNA, 17 bp, Homo sapiens
acctgcacctcccccca

SEQ ID NO: 2967028 - DNA, 19 bp, Homo sapiens
acctgcagtgccagctccc

SEQ ID NO: 2967029 - DNA, 15 bp, Homo sapiens
acctgcatatctcta

SEQ ID NO: 2967030 - DNA, 18 bp, Homo sapiens
acctgcatctaagcccat

SEQ ID NO: 2967031 - DNA, 10 bp, Homo sapiens
acctgcattt

SEQ ID NO: 2967032 - DNA, 19 bp, Homo sapiens
acctgccaatgattccaga

SEQ ID NO: 2967033 - DNA, 18 bp, Homo sapiens
acctgccgacctcgtcct

SEQ ID NO: 2967034 - DNA, 20 bp, Homo sapiens
acctgccgacctcgtcctcc

SEQ ID NO: 2967035 - DNA, 21 bp, Homo sapiens
acctgcctagctcttgggcct

SEQ ID NO: 2967036 - DNA, 21 bp, Homo sapiens
acctgcctcggcctcccaaag

SEQ ID NO: 2967037 - DNA, 10 bp, Homo sapiens
acctgcctgg

SEQ ID NO: 2967038 - DNA, 20 bp, Homo sapiens
acctgcgggtcctcagctgc

SEQ ID NO: 2967039 - DNA, 13 bp, Homo sapiens
acctgctcccttc

SEQ ID NO: 2967040 - DNA, 22 bp, Homo sapiens
acctgctctccggcgcagacag

SEQ ID NO: 2967041 - DNA, 16 bp, Homo sapiens
acctgctgagagaccc

SEQ ID NO: 2967042 - DNA, 22 bp, Homo sapiens
acctgctgagagacccaaggag

SEQ ID NO: 2967043 - DNA, 18 bp, Homo sapiens
acctggaacttggggagt

SEQ ID NO: 2967044 - DNA, 17 bp, Homo sapiens
acctggacacaggcctg

SEQ ID NO: 2967045 - DNA, 17 bp, Homo sapiens
acctggaccccctgccc

SEQ ID NO: 2967046 - DNA, 19 bp, Homo sapiens
acctggaccccctgcccgc

SEQ ID NO: 2967047 - DNA, 20 bp, Homo sapiens
acctggaccccctgcccgcc

SEQ ID NO: 2967048 - DNA, 20 bp, Homo sapiens
acctggccccctcagctctg

SEQ ID NO: 2967049 - DNA, 17 bp, Homo sapiens
acctgggggagccgacc

SEQ ID NO: 2967050 - DNA, 16 bp, Homo sapiens
acctggggttgtcagc

SEQ ID NO: 2967051 - DNA, 20 bp, Homo sapiens
acctgggttgcagacaggaa

SEQ ID NO: 2967052 - DNA, 21 bp, Homo sapiens
acctggtactccctctcagga

SEQ ID NO: 2967053 - DNA, 16 bp, Homo sapiens
acctggtccacagggc

SEQ ID NO: 2967054 - DNA, 16 bp, Homo sapiens
acctggtcctccgcct

SEQ ID NO: 2967055 - DNA, 23 bp, Homo sapiens
acctggtgctcgggaagggaggg

SEQ ID NO: 2967056 - DNA, 19 bp, Homo sapiens
acctgtagatgcagaaaaa

SEQ ID NO: 2967057 - DNA, 21 bp, Homo sapiens
acctgtagatgcagaaaaaga

SEQ ID NO: 2967058 - DNA, 20 bp, Homo sapiens
acctgtatatttgtaaagct

SEQ ID NO: 2967059 - DNA, 20 bp, Homo sapiens
acctgtatttaaaaatagaa

SEQ ID NO: 2967060 - DNA, 23 bp, Homo sapiens
acctgtatttaaaaatagaaaca

SEQ ID NO: 2967061 - DNA, 24 bp, Homo sapiens
acctgtcaaacaaagccagaagct

SEQ ID NO: 2967062 - DNA, 12 bp, Homo sapiens
acctgtccaggt

SEQ ID NO: 2967063 - DNA, 21 bp, Homo sapiens
acctgtccttactcagagctg

SEQ ID NO: 2967064 - DNA, 23 bp, Homo sapiens
acctgtccttactcagagctgcg

SEQ ID NO: 2967065 - DNA, 12 bp, Homo sapiens
acctgtctcctt

SEQ ID NO: 2967066 - DNA, 15 bp, Homo sapiens
acctgtcttgctcct

SEQ ID NO: 2967067 - DNA, 16 bp, Homo sapiens
acctgtcttgctcctg

SEQ ID NO: 2967068 - DNA, 17 bp, Homo sapiens
acctgtcttgctcctgg

SEQ ID NO: 2967069 - DNA, 21 bp, Homo sapiens
acctgtcttgctcctggggag

SEQ ID NO: 2967070 - DNA, 16 bp, Homo sapiens
acctgtgcctccctct

SEQ ID NO: 2967071 - DNA, 22 bp, Homo sapiens
acctgtgctgaacataacttct

SEQ ID NO: 2967072 - DNA, 23 bp, Homo sapiens
acctgtgctggagccctgttcct

SEQ ID NO: 2967073 - DNA, 20 bp, Homo sapiens
acctgtgtctgcgaagtcct

SEQ ID NO: 2967074 - DNA, 15 bp, Homo sapiens
acctgtgttccagcc

SEQ ID NO: 2967075 - DNA, 17 bp, Homo sapiens
acctgttagcagacagg

SEQ ID NO: 2967076 - DNA, 22 bp, Homo sapiens
acctgttcacagaaaaagcatg

SEQ ID NO: 2967077 - DNA, 14 bp, Homo sapiens
acctgttgaagatt

SEQ ID NO: 2967078 - DNA, 14 bp, Homo sapiens
acctgttgagcatc

SEQ ID NO: 2967079 - DNA, 15 bp, Homo sapiens
acctgttgcttacaa

SEQ ID NO: 2967080 - DNA, 15 bp, Homo sapiens
acctgtttctctgcc

SEQ ID NO: 2967081 - DNA, 18 bp, Homo sapiens
acctgttttttttctttt

SEQ ID NO: 2967082 - DNA, 16 bp, Homo sapiens
accttaaacacccctc

SEQ ID NO: 2967083 - DNA, 19 bp, Homo sapiens
accttaagatttttctttt

SEQ ID NO: 2967084 - DNA, 18 bp, Homo sapiens
accttacgatcaggcaca

SEQ ID NO: 2967085 - DNA, 19 bp, Homo sapiens
accttacgatcaggcacag

SEQ ID NO: 2967086 - DNA, 20 bp, Homo sapiens
accttacgatcaggcacagg

SEQ ID NO: 2967087 - DNA, 13 bp, Homo sapiens
accttactaatta

SEQ ID NO: 2967088 - DNA, 22 bp, Homo sapiens
accttagatgttctaagtcttt

SEQ ID NO: 2967089 - DNA, 21 bp, Homo sapiens
accttagatttagtagtgtaa

SEQ ID NO: 2967090 - DNA, 13 bp, Homo sapiens
accttaggcaggg

SEQ ID NO: 2967091 - DNA, 13 bp, Homo sapiens
accttaggccttc

SEQ ID NO: 2967092 - DNA, 17 bp, Homo sapiens
accttaggccttcctct

SEQ ID NO: 2967093 - DNA, 14 bp, Homo sapiens
accttagtgtttct

SEQ ID NO: 2967094 - DNA, 19 bp, Homo sapiens
accttagtgtttctgtgca

SEQ ID NO: 2967095 - DNA, 21 bp, Homo sapiens
accttagtgtttctgtgcatg

SEQ ID NO: 2967096 - DNA, 12 bp, Homo sapiens
accttatacatc

SEQ ID NO: 2967097 - DNA, 14 bp, Homo sapiens
accttatacatcac

SEQ ID NO: 2967098 - DNA, 17 bp, Homo sapiens
accttcagagccagccg

SEQ ID NO: 2967099 - DNA, 12 bp, Homo sapiens
accttcagctca

SEQ ID NO: 2967100 - DNA, 20 bp, Homo sapiens
accttcattctgagaccaaa

SEQ ID NO: 2967101 - DNA, 17 bp, Homo sapiens
accttcatttcatcctg

SEQ ID NO: 2967102 - DNA, 15 bp, Homo sapiens
accttcatttcatgt

SEQ ID NO: 2967103 - DNA, 16 bp, Homo sapiens
accttccaagagcctg

SEQ ID NO: 2967104 - DNA, 21 bp, Homo sapiens
accttcccaaacgcctcccct

SEQ ID NO: 2967105 - DNA, 22 bp, Homo sapiens
accttcccaaacgcctcccctg

SEQ ID NO: 2967106 - DNA, 11 bp, Homo sapiens
accttcccagc

SEQ ID NO: 2967107 - DNA, 14 bp, Homo sapiens
accttccccagact

SEQ ID NO: 2967108 - DNA, 16 bp, Homo sapiens
accttcctcctccccg

SEQ ID NO: 2967109 - DNA, 18 bp, Homo sapiens
accttcctcctccccgct

SEQ ID NO: 2967110 - DNA, 23 bp, Homo sapiens
accttcctttttttaaattttct

SEQ ID NO: 2967111 - DNA, 22 bp, Homo sapiens
accttcgtttactatgcctgtg

SEQ ID NO: 2967112 - DNA, 19 bp, Homo sapiens
accttcttcaggctgccta

SEQ ID NO: 2967113 - DNA, 20 bp, Homo sapiens
accttctttggccccttgct

SEQ ID NO: 2967114 - DNA, 20 bp, Homo sapiens
accttgaaaataagaataga

SEQ ID NO: 2967115 - DNA, 23 bp, Homo sapiens
actccagcggttgccttttttat

SEQ ID NO: 2967116 - DNA, 21 bp, Homo sapiens
actccaggcccaaggctcccg

SEQ ID NO: 2967117 - DNA, 18 bp, Homo sapiens
actccaggctgggctgag

SEQ ID NO: 2967118 - DNA, 23 bp, Homo sapiens
actccaggcttgattccaacagg

SEQ ID NO: 2967119 - DNA, 16 bp, Homo sapiens
actccatctctttaaa

SEQ ID NO: 2967120 - DNA, 15 bp, Homo sapiens
actccatttctttct

SEQ ID NO: 2967121 - DNA, 16 bp, Homo sapiens
actccatttctttctt

SEQ ID NO: 2967122 - DNA, 16 bp, Homo sapiens
actcccactcctaatc

SEQ ID NO: 2967123 - DNA, 13 bp, Homo sapiens
actcccattcctg

SEQ ID NO: 2967124 - DNA, 16 bp, Homo sapiens
actcccattcctgaag

SEQ ID NO: 2967125 - DNA, 19 bp, Homo sapiens
actcccccaaccaaggaag

SEQ ID NO: 2967126 - DNA, 13 bp, Homo sapiens
actcccccaggat

SEQ ID NO: 2967127 - DNA, 14 bp, Homo sapiens
actcccctgtttca

SEQ ID NO: 2967128 - DNA, 21 bp, Homo sapiens
actcccctgtttcaatcactg

SEQ ID NO: 2967129 - DNA, 20 bp, Homo sapiens
actcccgccccgggctggcc

SEQ ID NO: 2967130 - DNA, 23 bp, Homo sapiens
actcccgccccgggctggccctg

SEQ ID NO: 2967131 - DNA, 22 bp, Homo sapiens
actcccgggttcacgccattct

SEQ ID NO: 2967132 - DNA, 17 bp, Homo sapiens
actccctacactgatgc

SEQ ID NO: 2967133 - DNA, 11 bp, Homo sapiens
actccctaggc

SEQ ID NO: 2967134 - DNA, 13 bp, Homo sapiens
actccctccatag

SEQ ID NO: 2967135 - DNA, 12 bp, Homo sapiens
actccctcctca

SEQ ID NO: 2967136 - DNA, 13 bp, Homo sapiens
actccctctcagg

SEQ ID NO: 2967137 - DNA, 21 bp, Homo sapiens
actccctctcaggatccaagc

SEQ ID NO: 2967138 - DNA, 17 bp, Homo sapiens
actccctgatcccagac

SEQ ID NO: 2967139 - DNA, 18 bp, Homo sapiens
actccctggctgttctga

SEQ ID NO: 2967140 - DNA, 15 bp, Homo sapiens
actcccttctgcttg

SEQ ID NO: 2967141 - DNA, 14 bp, Homo sapiens
actccctttcatgt

SEQ ID NO: 2967142 - DNA, 22 bp, Homo sapiens
actccgatttggagagtagtaa

SEQ ID NO: 2967143 - DNA, 15 bp, Homo sapiens
actccggccctccta

SEQ ID NO: 2967144 - DNA, 23 bp, Homo sapiens
actcctaggcccttggggtggcg

SEQ ID NO: 2967145 - DNA, 13 bp, Homo sapiens
actcctcacactt

SEQ ID NO: 2967146 - DNA, 20 bp, Homo sapiens
actcctcacacttactgtaa

SEQ ID NO: 2967147 - DNA, 18 bp, Homo sapiens
actcctcagggcagcctc

SEQ ID NO: 2967148 - DNA, 12 bp, Homo sapiens
actcctccctcc

SEQ ID NO: 2967149 - DNA, 13 bp, Homo sapiens
actcctcctagcc

SEQ ID NO: 2967150 - DNA, 16 bp, Homo sapiens
actcctcctagccacc

SEQ ID NO: 2967151 - DNA, 18 bp, Homo sapiens
actcctcctagccaccca

SEQ ID NO: 2967152 - DNA, 21 bp, Homo sapiens
actcctcctgccagctctgtc

SEQ ID NO: 2967153 - DNA, 16 bp, Homo sapiens
actcctgaggacagct

SEQ ID NO: 2967154 - DNA, 21 bp, Homo sapiens
actcctgaggacagctgtcct

SEQ ID NO: 2967155 - DNA, 16 bp, Homo sapiens
actcctgatttttatc

SEQ ID NO: 2967156 - DNA, 18 bp, Homo sapiens
actcctgatttttatcta

SEQ ID NO: 2967157 - DNA, 13 bp, Homo sapiens
actcctgccagcc

SEQ ID NO: 2967158 - DNA, 15 bp, Homo sapiens
actcctgccagcccg

SEQ ID NO: 2967159 - DNA, 18 bp, Homo sapiens
actcctgccagcccggct

SEQ ID NO: 2967160 - DNA, 23 bp, Homo sapiens
actcctgccagcccggctcggcc

SEQ ID NO: 2967161 - DNA, 16 bp, Homo sapiens
actcctggaagctgtg

SEQ ID NO: 2967162 - DNA, 10 bp, Homo sapiens
actcctggct

SEQ ID NO: 2967163 - DNA, 19 bp, Homo sapiens
actcctggctcaagccctg

SEQ ID NO: 2967164 - DNA, 14 bp, Homo sapiens
actccttccatcct

SEQ ID NO: 2967165 - DNA, 19 bp, Homo sapiens
actccttccccacttctgt

SEQ ID NO: 2967166 - DNA, 17 bp, Homo sapiens
actccttccccttgtcc

SEQ ID NO: 2967167 - DNA, 15 bp, Homo sapiens
actccttgcatcaag

SEQ ID NO: 2967168 - DNA, 15 bp, Homo sapiens
actcctttcagccac

SEQ ID NO: 2967169 - DNA, 16 bp, Homo sapiens
actcctttcagccaca

SEQ ID NO: 2967170 - DNA, 12 bp, Homo sapiens
actcctttctgc

SEQ ID NO: 2967171 - DNA, 18 bp, Homo sapiens
actcctttggtatttcac

SEQ ID NO: 2967172 - DNA, 17 bp, Homo sapiens
actcgagcccacccagc

SEQ ID NO: 2967173 - DNA, 14 bp, Homo sapiens
actcgcacctgtgc

SEQ ID NO: 2967174 - DNA, 18 bp, Homo sapiens
actcgcacctgtgctgga

SEQ ID NO: 2967175 - DNA, 20 bp, Homo sapiens
actcgcacctgtgctggagc

SEQ ID NO: 2967176 - DNA, 13 bp, Homo sapiens
actcgcaggacca

SEQ ID NO: 2967177 - DNA, 21 bp, Homo sapiens
actcgccatttcctcacgtgc

SEQ ID NO: 2967178 - DNA, 12 bp, Homo sapiens
actcgcctcagc

SEQ ID NO: 2967179 - DNA, 13 bp, Homo sapiens
actcggcccaggg

SEQ ID NO: 2967180 - DNA, 22 bp, Homo sapiens
actcgtgtctggcacagcctgg

SEQ ID NO: 2967181 - DNA, 16 bp, Homo sapiens
actcgttgcagtctgt

SEQ ID NO: 2967182 - DNA, 19 bp, Homo sapiens
actctaaagccaagcactt

SEQ ID NO: 2967183 - DNA, 20 bp, Homo sapiens
actctaaccaaggctgtgtt

SEQ ID NO: 2967184 - DNA, 20 bp, Homo sapiens
actctaagatcttagattct

SEQ ID NO: 2967185 - DNA, 21 bp, Homo sapiens
actctaagatcttagattctc

SEQ ID NO: 2967186 - DNA, 19 bp, Homo sapiens
actctaattggtcattcct

SEQ ID NO: 2967187 - DNA, 18 bp, Homo sapiens
actctacatgtaactatt

SEQ ID NO: 2967188 - DNA, 22 bp, Homo sapiens
actctaccagtgcaggctggcc

SEQ ID NO: 2967189 - DNA, 19 bp, Homo sapiens
actctagcaaggctcatct

SEQ ID NO: 2967190 - DNA, 20 bp, Homo sapiens
actctagctgggggtgggcc

SEQ ID NO: 2967191 - DNA, 22 bp, Homo sapiens
actctatatagctgatcagttt

SEQ ID NO: 2967192 - DNA, 15 bp, Homo sapiens
actctatcaaatgtg

SEQ ID NO: 2967193 - DNA, 21 bp, Homo sapiens
actctcacactggttctcaat

SEQ ID NO: 2967194 - DNA, 13 bp, Homo sapiens
actctcagtctct

SEQ ID NO: 2967195 - DNA, 17 bp, Homo sapiens
actctccaacctggaca

SEQ ID NO: 2967196 - DNA, 19 bp, Homo sapiens
actctccaacctggacaac

SEQ ID NO: 2967197 - DNA, 21 bp, Homo sapiens
actctcccaaagggcacaccc

SEQ ID NO: 2967198 - DNA, 13 bp, Homo sapiens
actctcccctccc

SEQ ID NO: 2967199 - DNA, 16 bp, Homo sapiens
actctcccctccccat

SEQ ID NO: 2967200 - DNA, 23 bp, Homo sapiens
actctcccctccccatctgtgtt

SEQ ID NO: 2967201 - DNA, 12 bp, Homo sapiens
actctcctgcct

SEQ ID NO: 2967202 - DNA, 22 bp, Homo sapiens
actctcctttgatattatgtgg

SEQ ID NO: 2967203 - DNA, 14 bp, Homo sapiens
actctctcccagga

SEQ ID NO: 2967204 - DNA, 15 bp, Homo sapiens
actctctcccaggac

SEQ ID NO: 2967205 - DNA, 18 bp, Homo sapiens
actctctgagctggggag

SEQ ID NO: 2967206 - DNA, 17 bp, Homo sapiens
actctctgtcttctctc

SEQ ID NO: 2967207 - DNA, 19 bp, Homo sapiens
actctctgtcttctctcca

SEQ ID NO: 2967208 - DNA, 11 bp, Homo sapiens
actctcttccc

SEQ ID NO: 2967209 - DNA, 13 bp, Homo sapiens
actctcttccctt

SEQ ID NO: 2967210 - DNA, 14 bp, Homo sapiens
actctgagacaaaa

SEQ ID NO: 2967211 - DNA, 20 bp, Homo sapiens
actctgagtgttttatgaga

SEQ ID NO: 2967212 - DNA, 21 bp, Homo sapiens
actctgagtgttttatgagaa

SEQ ID NO: 2967213 - DNA, 21 bp, Homo sapiens
actctgcaagtgtctggagcg

SEQ ID NO: 2967214 - DNA, 11 bp, Homo sapiens
actctgcacat

SEQ ID NO: 2967215 - DNA, 17 bp, Homo sapiens
actctgcacatgtcttg

SEQ ID NO: 2967216 - DNA, 18 bp, Homo sapiens
actctgcacatgtcttgt

SEQ ID NO: 2967217 - DNA, 21 bp, Homo sapiens
actctgcacatgtcttgtaca

SEQ ID NO: 2967218 - DNA, 18 bp, Homo sapiens
actctgccctctgctgct

SEQ ID NO: 2967219 - DNA, 23 bp, Homo sapiens
actctgccctctgctgctgcccg

SEQ ID NO: 2967220 - DNA, 16 bp, Homo sapiens
actctgcggcccgggc

SEQ ID NO: 2967221 - DNA, 21 bp, Homo sapiens
actctgcggcccgggccgacc

SEQ ID NO: 2967222 - DNA, 13 bp, Homo sapiens
actctgcttgtta

SEQ ID NO: 2967223 - DNA, 18 bp, Homo sapiens
actctggaccaaggagca

SEQ ID NO: 2967224 - DNA, 19 bp, Homo sapiens
actctggacctctcttgtg

SEQ ID NO: 2967225 - DNA, 22 bp, Homo sapiens
actctggcttggcctatctcct

SEQ ID NO: 2967226 - DNA, 23 bp, Homo sapiens
actctgggctcaagcaatcctct

SEQ ID NO: 2967227 - DNA, 17 bp, Homo sapiens
actctggggtttttact

SEQ ID NO: 2967228 - DNA, 16 bp, Homo sapiens
actctggtgcctccag

SEQ ID NO: 2967229 - DNA, 16 bp, Homo sapiens
actctgtaaaagtgtc

SEQ ID NO: 2967230 - DNA, 16 bp, Homo sapiens
actctgtcttcacctg

SEQ ID NO: 2967231 - DNA, 17 bp, Homo sapiens
actctgtcttcacctga

SEQ ID NO: 2967232 - DNA, 13 bp, Homo sapiens
actctgtgtaaat

SEQ ID NO: 2967233 - DNA, 23 bp, Homo sapiens
actctgttattcttcaaacacaa

SEQ ID NO: 2967234 - DNA, 15 bp, Homo sapiens
actctgttatttaga

SEQ ID NO: 2967235 - DNA, 20 bp, Homo sapiens
actctgttgcaagtgcaata

SEQ ID NO: 2967236 - DNA, 13 bp, Homo sapiens
actctgttgcctc

SEQ ID NO: 2967237 - DNA, 23 bp, Homo sapiens
actctgttgcctcctctctccct

SEQ ID NO: 2967238 - DNA, 19 bp, Homo sapiens
actcttagatggattctcc

SEQ ID NO: 2967239 - DNA, 19 bp, Homo sapiens
actcttaggcactttgggg

SEQ ID NO: 2967240 - DNA, 21 bp, Homo sapiens
actcttaggcactttgggggt

SEQ ID NO: 2967241 - DNA, 17 bp, Homo sapiens
actcttcaccttggttt

SEQ ID NO: 2967242 - DNA, 15 bp, Homo sapiens
actcttcagagaaat

SEQ ID NO: 2967243 - DNA, 15 bp, Homo sapiens
actcttccaccagag

SEQ ID NO: 2967244 - DNA, 15 bp, Homo sapiens
actcttcctcatcct

SEQ ID NO: 2967245 - DNA, 19 bp, Homo sapiens
actcttcctcatcctgctt

SEQ ID NO: 2967246 - DNA, 15 bp, Homo sapiens
actcttggagcctgc

SEQ ID NO: 2967247 - DNA, 22 bp, Homo sapiens
acttttgaagaacaaaaggctt

SEQ ID NO: 2967248 - DNA, 12 bp, Homo sapiens
acttttgacaaa

SEQ ID NO: 2967249 - DNA, 23 bp, Homo sapiens
acttttgcaatcttaagcagaga

SEQ ID NO: 2967250 - DNA, 15 bp, Homo sapiens
acttttgccctttga

SEQ ID NO: 2967251 - DNA, 19 bp, Homo sapiens
acttttgtaaaatcaaatc

SEQ ID NO: 2967252 - DNA, 20 bp, Homo sapiens
acttttgttccagtgtttaa

SEQ ID NO: 2967253 - DNA, 21 bp, Homo sapiens
acttttgttccagtgtttaaa

SEQ ID NO: 2967254 - DNA, 16 bp, Homo sapiens
acttttgttctcttct

SEQ ID NO: 2967255 - DNA, 13 bp, Homo sapiens
acttttgtttaaa

SEQ ID NO: 2967256 - DNA, 14 bp, Homo sapiens
actttttaaactca

SEQ ID NO: 2967257 - DNA, 18 bp, Homo sapiens
actttttaaagaagtgca

SEQ ID NO: 2967258 - DNA, 15 bp, Homo sapiens
actttttattgcctt

SEQ ID NO: 2967259 - DNA, 16 bp, Homo sapiens
actttttattgccttc

SEQ ID NO: 2967260 - DNA, 21 bp, Homo sapiens
actttttcagaggtgaattaa

SEQ ID NO: 2967261 - DNA, 13 bp, Homo sapiens
actttttccaagt

SEQ ID NO: 2967262 - DNA, 15 bp, Homo sapiens
actttttccaagtcc

SEQ ID NO: 2967263 - DNA, 22 bp, Homo sapiens
acttttttctttaaattttgtt

SEQ ID NO: 2967264 - DNA, 13 bp, Homo sapiens
agaaaaaaaaaca

SEQ ID NO: 2967265 - DNA, 13 bp, Homo sapiens
agaaaaaaaaatg

SEQ ID NO: 2967266 - DNA, 21 bp, Homo sapiens
agaaaaaaaaatgccataata

SEQ ID NO: 2967267 - DNA, 12 bp, Homo sapiens
agaaaaaaacca

SEQ ID NO: 2967268 - DNA, 14 bp, Homo sapiens
agaaaaaaaccaaa

SEQ ID NO: 2967269 - DNA, 17 bp, Homo sapiens
agaaaaaaaccaaagta

SEQ ID NO: 2967270 - DNA, 18 bp, Homo sapiens
agaaaaaaactataaata

SEQ ID NO: 2967271 - DNA, 17 bp, Homo sapiens
agaaaaagataagaaat

SEQ ID NO: 2967272 - DNA, 16 bp, Homo sapiens
agaaaacaaaggagca

SEQ ID NO: 2967273 - DNA, 22 bp, Homo sapiens
agaaaacaaagttctattttat

SEQ ID NO: 2967274 - DNA, 13 bp, Homo sapiens
agaaaacactttc

SEQ ID NO: 2967275 - DNA, 16 bp, Homo sapiens
agaaaacactttcctg

SEQ ID NO: 2967276 - DNA, 12 bp, Homo sapiens
agaaaacatcta

SEQ ID NO: 2967277 - DNA, 12 bp, Homo sapiens
agaaaaccactt

SEQ ID NO: 2967278 - DNA, 14 bp, Homo sapiens
agaaaactggaaat

SEQ ID NO: 2967279 - DNA, 13 bp, Homo sapiens
agaaaagccgaaa

SEQ ID NO: 2967280 - DNA, 12 bp, Homo sapiens
agaaaataaaaa

SEQ ID NO: 2967281 - DNA, 14 bp, Homo sapiens
agaaaataacaata

SEQ ID NO: 2967282 - DNA, 13 bp, Homo sapiens
agaaaatatactg

SEQ ID NO: 2967283 - DNA, 20 bp, Homo sapiens
agaaaatatactgtaaagaa

SEQ ID NO: 2967284 - DNA, 21 bp, Homo sapiens
agaaaatatactgtaaagaaa

SEQ ID NO: 2967285 - DNA, 17 bp, Homo sapiens
agaaaatatatgtattt

SEQ ID NO: 2967286 - DNA, 22 bp, Homo sapiens
agaaaatatctgaaatgtgata

SEQ ID NO: 2967287 - DNA, 15 bp, Homo sapiens
agaaaatgaatttga

SEQ ID NO: 2967288 - DNA, 13 bp, Homo sapiens
agaaaatggaatt

SEQ ID NO: 2967289 - DNA, 13 bp, Homo sapiens
agaaaatgtgtct

SEQ ID NO: 2967290 - DNA, 17 bp, Homo sapiens
agaaaattgcctttaaa

SEQ ID NO: 2967291 - DNA, 21 bp, Homo sapiens
agaaaatttaataacttttta

SEQ ID NO: 2967292 - DNA, 17 bp, Homo sapiens
agaaacacactgaggca

SEQ ID NO: 2967293 - DNA, 17 bp, Homo sapiens
agaaacacataaattat

SEQ ID NO: 2967294 - DNA, 19 bp, Homo sapiens
agaaacactatttgtgact

SEQ ID NO: 2967295 - DNA, 20 bp, Homo sapiens
agaaacactatttgtgactt

SEQ ID NO: 2967296 - DNA, 12 bp, Homo sapiens
agaaacactgcc

SEQ ID NO: 2967297 - DNA, 15 bp, Homo sapiens
agaaacactgccttt

SEQ ID NO: 2967298 - DNA, 12 bp, Homo sapiens
agaaacagaaga

SEQ ID NO: 2967299 - DNA, 18 bp, Homo sapiens
agaaacagggacaaagaa

SEQ ID NO: 2967300 - DNA, 16 bp, Homo sapiens
agaaacatcagttact

SEQ ID NO: 2967301 - DNA, 15 bp, Homo sapiens
agaaacatttagatt

SEQ ID NO: 2967302 - DNA, 22 bp, Homo sapiens
agaaaccaaagctttatttcaa

SEQ ID NO: 2967303 - DNA, 18 bp, Homo sapiens
agaaaccaagtgggctgg

SEQ ID NO: 2967304 - DNA, 18 bp, Homo sapiens
agaaacccgacagaggga

SEQ ID NO: 2967305 - DNA, 17 bp, Homo sapiens
agaaacctgtatctttc

SEQ ID NO: 2967306 - DNA, 13 bp, Homo sapiens
agaaaccttgttt

SEQ ID NO: 2967307 - DNA, 16 bp, Homo sapiens
agaaacgtctacgtat

SEQ ID NO: 2967308 - DNA, 12 bp, Homo sapiens
agaaactgatgc

SEQ ID NO: 2967309 - DNA, 18 bp, Homo sapiens
agaaactgatgccaaggg

SEQ ID NO: 2967310 - DNA, 15 bp, Homo sapiens
agaaactgcagggaa

SEQ ID NO: 2967311 - DNA, 15 bp, Homo sapiens
agaaactgttcccac

SEQ ID NO: 2967312 - DNA, 21 bp, Homo sapiens
agaaactgttcccacctgctg

SEQ ID NO: 2967313 - DNA, 23 bp, Homo sapiens
agaaacttgtgaagtggaaatgt

SEQ ID NO: 2967314 - DNA, 20 bp, Homo sapiens
agaaactttgagtacagata

SEQ ID NO: 2967315 - DNA, 22 bp, Homo sapiens
agaaactttgagtacagatact

SEQ ID NO: 2967316 - DNA, 15 bp, Homo sapiens
agaaactttggaagc

SEQ ID NO: 2967317 - DNA, 16 bp, Homo sapiens
agaaactttggaagca

SEQ ID NO: 2967318 - DNA, 14 bp, Homo sapiens
agaaagaaaatgaa

SEQ ID NO: 2967319 - DNA, 22 bp, Homo sapiens
agaaagaaacccgacagaggga

SEQ ID NO: 2967320 - DNA, 10 bp, Homo sapiens
agaaagaaag

SEQ ID NO: 2967321 - DNA, 15 bp, Homo sapiens
agaaagaaagggaaa

SEQ ID NO: 2967322 - DNA, 16 bp, Homo sapiens
agaaagaaatattaac

SEQ ID NO: 2967323 - DNA, 10 bp, Homo sapiens
agaaagagag

SEQ ID NO: 2967324 - DNA, 17 bp, Homo sapiens
agaaagagagaaaataa

SEQ ID NO: 2967325 - DNA, 22 bp, Homo sapiens
agaaagagtttgaaactcgaga

SEQ ID NO: 2967326 - DNA, 17 bp, Homo sapiens
agaaagcaaattatttt

SEQ ID NO: 2967327 - DNA, 21 bp, Homo sapiens
agaaagcaatacgtttgtgca

SEQ ID NO: 2967328 - DNA, 13 bp, Homo sapiens
agaaagcccacct

SEQ ID NO: 2967329 - DNA, 23 bp, Homo sapiens
agaaaggagagaacgggcgtcag

SEQ ID NO: 2967330 - DNA, 19 bp, Homo sapiens
agaaagggaaactggctga

SEQ ID NO: 2967331 - DNA, 20 bp, Homo sapiens
agaaagggcagaggaagaga

SEQ ID NO: 2967332 - DNA, 16 bp, Homo sapiens
agaaaggggagcccac

SEQ ID NO: 2967333 - DNA, 17 bp, Homo sapiens
agaaaggggctcttctg

SEQ ID NO: 2967334 - DNA, 17 bp, Homo sapiens
agaaagggtgtttttct

SEQ ID NO: 2967335 - DNA, 15 bp, Homo sapiens
agaaagtaaaaaagg

SEQ ID NO: 2967336 - DNA, 22 bp, Homo sapiens
agaaagtaagcatttccagcct

SEQ ID NO: 2967337 - DNA, 23 bp, Homo sapiens
agaaagtgaagcaaatcagaaac

SEQ ID NO: 2967338 - DNA, 23 bp, Homo sapiens
agaaagtgcctttatctcagcca

SEQ ID NO: 2967339 - DNA, 21 bp, Homo sapiens
agaaagtggtgctcagttgta

SEQ ID NO: 2967340 - DNA, 13 bp, Homo sapiens
agaaagtgtaaat

SEQ ID NO: 2967341 - DNA, 16 bp, Homo sapiens
agaaagtgtgagcaaa

SEQ ID NO: 2967342 - DNA, 17 bp, Homo sapiens
agaaagtgtgagcaaac

SEQ ID NO: 2967343 - DNA, 20 bp, Homo sapiens
agaaataaaaggaagccaaa

SEQ ID NO: 2967344 - DNA, 21 bp, Homo sapiens
agaaataaagtttgcttagaa

SEQ ID NO: 2967345 - DNA, 11 bp, Homo sapiens
agaaataaatt

SEQ ID NO: 2967346 - DNA, 16 bp, Homo sapiens
agaaataagaaaatgg

SEQ ID NO: 2967347 - DNA, 21 bp, Homo sapiens
agaaataataaaaagaaagat

SEQ ID NO: 2967348 - DNA, 13 bp, Homo sapiens
agaaataataata

SEQ ID NO: 2967349 - DNA, 19 bp, Homo sapiens
agaaatataaacacattaa

SEQ ID NO: 2967350 - DNA, 14 bp, Homo sapiens
agaaatatggacac

SEQ ID NO: 2967351 - DNA, 13 bp, Homo sapiens
agaaatcaatttt

SEQ ID NO: 2967352 - DNA, 14 bp, Homo sapiens
agaaatcaattttt

SEQ ID NO: 2967353 - DNA, 19 bp, Homo sapiens
agaaatccccccttcagaa

SEQ ID NO: 2967354 - DNA, 18 bp, Homo sapiens
agaaatcgccttatgaga

SEQ ID NO: 2967355 - DNA, 17 bp, Homo sapiens
agaaatctggcttctgg

SEQ ID NO: 2967356 - DNA, 12 bp, Homo sapiens
agaaatgaaaag

SEQ ID NO: 2967357 - DNA, 17 bp, Homo sapiens
agaaatgacaatagagg

SEQ ID NO: 2967358 - DNA, 16 bp, Homo sapiens
agaaatgatgttgtca

SEQ ID NO: 2967359 - DNA, 18 bp, Homo sapiens
agaaatgcatccattcct

SEQ ID NO: 2967360 - DNA, 22 bp, Homo sapiens
agaaatgccaagcacttctttt

SEQ ID NO: 2967361 - DNA, 12 bp, Homo sapiens
agaaatgctctg

SEQ ID NO: 2967362 - DNA, 12 bp, Homo sapiens
agaaatgtttct

SEQ ID NO: 2967363 - DNA, 22 bp, Homo sapiens
agaaattatctttagttgaatt

SEQ ID NO: 2967364 - DNA, 23 bp, Homo sapiens
agaaattatctttagttgaattc

SEQ ID NO: 2967365 - DNA, 22 bp, Homo sapiens
agaaattcgcatgtttaatgtg

SEQ ID NO: 2967366 - DNA, 16 bp, Homo sapiens
agaaattctgctgtta

SEQ ID NO: 2967367 - DNA, 17 bp, Homo sapiens
agaaatttaattcatgt

SEQ ID NO: 2967368 - DNA, 18 bp, Homo sapiens
agaaattttggtttttca

SEQ ID NO: 2967369 - DNA, 18 bp, Homo sapiens
agaaatttttcagatgct

SEQ ID NO: 2967370 - DNA, 13 bp, Homo sapiens
agaacaaaaaacc

SEQ ID NO: 2967371 - DNA, 20 bp, Homo sapiens
agaacaaaacctcttctgta

SEQ ID NO: 2967372 - DNA, 16 bp, Homo sapiens
agaacaaagagtgaaa

SEQ ID NO: 2967373 - DNA, 14 bp, Homo sapiens
agaacaaaggacag

SEQ ID NO: 2967374 - DNA, 17 bp, Homo sapiens
agaacaatattgacttt

SEQ ID NO: 2967375 - DNA, 21 bp, Homo sapiens
agaacaatattgactttgtct

SEQ ID NO: 2967376 - DNA, 15 bp, Homo sapiens
agaacaccctctaaa

SEQ ID NO: 2967377 - DNA, 18 bp, Homo sapiens
agaacacctggccgggtc

SEQ ID NO: 2967378 - DNA, 17 bp, Homo sapiens
agaacagaaatatataa

SEQ ID NO: 2967379 - DNA, 18 bp, Homo sapiens
agaacagaggcatttaaa

SEQ ID NO: 2967380 - DNA, 12 bp, Homo sapiens
agactggtctcg

SEQ ID NO: 2967381 - DNA, 19 bp, Homo sapiens
agactgtgacatcagaagt

SEQ ID NO: 2967382 - DNA, 22 bp, Homo sapiens
agactgtgtaaaatgtaatgca

SEQ ID NO: 2967383 - DNA, 14 bp, Homo sapiens
agactgttgtgctc

SEQ ID NO: 2967384 - DNA, 14 bp, Homo sapiens
agacttattctttt

SEQ ID NO: 2967385 - DNA, 21 bp, Homo sapiens
agacttattcttttataataa

SEQ ID NO: 2967386 - DNA, 15 bp, Homo sapiens
agacttcacactgca

SEQ ID NO: 2967387 - DNA, 21 bp, Homo sapiens
agacttcacactgcaagagcc

SEQ ID NO: 2967388 - DNA, 22 bp, Homo sapiens
agacttgaaatacgtttgtgtt

SEQ ID NO: 2967389 - DNA, 12 bp, Homo sapiens
agacttgacagt

SEQ ID NO: 2967390 - DNA, 15 bp, Homo sapiens
agacttgacagtgga

SEQ ID NO: 2967391 - DNA, 22 bp, Homo sapiens
agacttgccttcctaagcctgt

SEQ ID NO: 2967392 - DNA, 18 bp, Homo sapiens
agacttggagaatactgc

SEQ ID NO: 2967393 - DNA, 22 bp, Homo sapiens
agacttggagaatactgccaaa

SEQ ID NO: 2967394 - DNA, 15 bp, Homo sapiens
agacttggatgagga

SEQ ID NO: 2967395 - DNA, 20 bp, Homo sapiens
agacttggtggtctgagctg

SEQ ID NO: 2967396 - DNA, 18 bp, Homo sapiens
agacttgtttcctgtgcc

SEQ ID NO: 2967397 - DNA, 20 bp, Homo sapiens
agactttcaagggaattaaa

SEQ ID NO: 2967398 - DNA, 21 bp, Homo sapiens
agactttctttaaattatgtt

SEQ ID NO: 2967399 - DNA, 18 bp, Homo sapiens
agactttgtttttaaaat

SEQ ID NO: 2967400 - DNA, 20 bp, Homo sapiens
agagaaaaagaaagaactgt

SEQ ID NO: 2967401 - DNA, 12 bp, Homo sapiens
agagaaaactct

SEQ ID NO: 2967402 - DNA, 16 bp, Homo sapiens
agagaaaataaaaagt

SEQ ID NO: 2967403 - DNA, 18 bp, Homo sapiens
agagaaaataaaaagtta

SEQ ID NO: 2967404 - DNA, 19 bp, Homo sapiens
agagaaaatactatttcaa

SEQ ID NO: 2967405 - DNA, 14 bp, Homo sapiens
agagaaaatatatg

SEQ ID NO: 2967406 - DNA, 23 bp, Homo sapiens
agagaaaatatatgtatttttat

SEQ ID NO: 2967407 - DNA, 22 bp, Homo sapiens
agagaaactttgagtacagata

SEQ ID NO: 2967408 - DNA, 10 bp, Homo sapiens
agagaaagaa

SEQ ID NO: 2967409 - DNA, 14 bp, Homo sapiens
agagaaatgtcttt

SEQ ID NO: 2967410 - DNA, 21 bp, Homo sapiens
agagaacctaactgtatcttg

SEQ ID NO: 2967411 - DNA, 23 bp, Homo sapiens
agagaacctaactgtatcttgag

SEQ ID NO: 2967412 - DNA, 23 bp, Homo sapiens
agagaacgggcgtcaggggtgca

SEQ ID NO: 2967413 - DNA, 12 bp, Homo sapiens
agagaactgaaa

SEQ ID NO: 2967414 - DNA, 17 bp, Homo sapiens
agagaactgaaaagaga

SEQ ID NO: 2967415 - DNA, 17 bp, Homo sapiens
agagaactgagcatctc

SEQ ID NO: 2967416 - DNA, 14 bp, Homo sapiens
agagaactgtggcc

SEQ ID NO: 2967417 - DNA, 11 bp, Homo sapiens
agagaagacaa

SEQ ID NO: 2967418 - DNA, 21 bp, Homo sapiens
agagaagcaaaatcttttttc

SEQ ID NO: 2967419 - DNA, 16 bp, Homo sapiens
agagaaggaaaagact

SEQ ID NO: 2967420 - DNA, 12 bp, Homo sapiens
agagaaggcagg

SEQ ID NO: 2967421 - DNA, 18 bp, Homo sapiens
agagaaggggtgtgcatg

SEQ ID NO: 2967422 - DNA, 14 bp, Homo sapiens
agagaagtgacagg

SEQ ID NO: 2967423 - DNA, 15 bp, Homo sapiens
agagaagtgacaggg

SEQ ID NO: 2967424 - DNA, 19 bp, Homo sapiens
agagaagttgacatggaaa

SEQ ID NO: 2967425 - DNA, 20 bp, Homo sapiens
agagaatagagctgccactg

SEQ ID NO: 2967426 - DNA, 23 bp, Homo sapiens
agagaatagagctgccactgggc

SEQ ID NO: 2967427 - DNA, 17 bp, Homo sapiens
agagaatataacatgaa

SEQ ID NO: 2967428 - DNA, 14 bp, Homo sapiens
agagaatgagaaat

SEQ ID NO: 2967429 - DNA, 22 bp, Homo sapiens
agagaatgtatttccttttcta

SEQ ID NO: 2967430 - DNA, 13 bp, Homo sapiens
agagacacctgca

SEQ ID NO: 2967431 - DNA, 15 bp, Homo sapiens
agagacacctgcacc

SEQ ID NO: 2967432 - DNA, 21 bp, Homo sapiens
agagacacctgcacctccccc

SEQ ID NO: 2967433 - DNA, 21 bp, Homo sapiens
agagacagctacacagagctt

SEQ ID NO: 2967434 - DNA, 23 bp, Homo sapiens
agagacaggaaaatcctctggct

SEQ ID NO: 2967435 - DNA, 16 bp, Homo sapiens
agagacaggaaagaat

SEQ ID NO: 2967436 - DNA, 18 bp, Homo sapiens
agagacattaactcatta

SEQ ID NO: 2967437 - DNA, 22 bp, Homo sapiens
agagacattaactcattagact

SEQ ID NO: 2967438 - DNA, 23 bp, Homo sapiens
agagacattaactcattagactg

SEQ ID NO: 2967439 - DNA, 19 bp, Homo sapiens
agagaccagcctttcttcc

SEQ ID NO: 2967440 - DNA, 16 bp, Homo sapiens
agagaccaggccctgg

SEQ ID NO: 2967441 - DNA, 16 bp, Homo sapiens
agagacccaaggagga

SEQ ID NO: 2967442 - DNA, 23 bp, Homo sapiens
agagacccgggaaggaaggctct

SEQ ID NO: 2967443 - DNA, 15 bp, Homo sapiens
agagacctgaagtgt

SEQ ID NO: 2967444 - DNA, 16 bp, Homo sapiens
agagacctgaagtgtg

SEQ ID NO: 2967445 - DNA, 17 bp, Homo sapiens
agagaccttcaaatgcg

SEQ ID NO: 2967446 - DNA, 20 bp, Homo sapiens
agagaccttcaaatgcgaac

SEQ ID NO: 2967447 - DNA, 12 bp, Homo sapiens
agagagaaaaag

SEQ ID NO: 2967448 - DNA, 15 bp, Homo sapiens
agagagaaaataaaa

SEQ ID NO: 2967449 - DNA, 16 bp, Homo sapiens
agagagaaaataaaaa

SEQ ID NO: 2967450 - DNA, 18 bp, Homo sapiens
agagagaaaataaaaagt

SEQ ID NO: 2967451 - DNA, 22 bp, Homo sapiens
agagagaaagaagatagtgaga

SEQ ID NO: 2967452 - DNA, 21 bp, Homo sapiens
agagagaacctaactgtatct

SEQ ID NO: 2967453 - DNA, 16 bp, Homo sapiens
agagagaatagagctg

SEQ ID NO: 2967454 - DNA, 22 bp, Homo sapiens
agagagaatagagctgccactg

SEQ ID NO: 2967455 - DNA, 21 bp, Homo sapiens
agagagaatttgctttatctg

SEQ ID NO: 2967456 - DNA, 21 bp, Homo sapiens
agagagacatggaaaaggaaa

SEQ ID NO: 2967457 - DNA, 13 bp, Homo sapiens
agagagagaaaga

SEQ ID NO: 2967458 - DNA, 15 bp, Homo sapiens
agagagagagaaaga

SEQ ID NO: 2967459 - DNA, 21 bp, Homo sapiens
agagagccctgggtgacttca

SEQ ID NO: 2967460 - DNA, 22 bp, Homo sapiens
agagaggaaggacccctcacca

SEQ ID NO: 2967461 - DNA, 14 bp, Homo sapiens
agagaggaatcaga

SEQ ID NO: 2967462 - DNA, 15 bp, Homo sapiens
agagaggcagcaagt

SEQ ID NO: 2967463 - DNA, 12 bp, Homo sapiens
agagaggccatt

SEQ ID NO: 2967464 - DNA, 22 bp, Homo sapiens
agagaggccattctttcccaac

SEQ ID NO: 2967465 - DNA, 23 bp, Homo sapiens
agagaggccattctttcccaaca

SEQ ID NO: 2967466 - DNA, 16 bp, Homo sapiens
agagagggagaagaag

SEQ ID NO: 2967467 - DNA, 17 bp, Homo sapiens
agagagggaggtatgga

SEQ ID NO: 2967468 - DNA, 13 bp, Homo sapiens
agagaggtggcca

SEQ ID NO: 2967469 - DNA, 14 bp, Homo sapiens
agagaggtggccac

SEQ ID NO: 2967470 - DNA, 13 bp, Homo sapiens
agagatacagagg

SEQ ID NO: 2967471 - DNA, 15 bp, Homo sapiens
agagatagcctgtgg

SEQ ID NO: 2967472 - DNA, 17 bp, Homo sapiens
agagatatggcagcgaa

SEQ ID NO: 2967473 - DNA, 13 bp, Homo sapiens
agagatatttaaa

SEQ ID NO: 2967474 - DNA, 15 bp, Homo sapiens
agagatattttgggc

SEQ ID NO: 2967475 - DNA, 20 bp, Homo sapiens
agagatattttgggcatgtg

SEQ ID NO: 2967476 - DNA, 18 bp, Homo sapiens
agagatccaaaagaagcc

SEQ ID NO: 2967477 - DNA, 13 bp, Homo sapiens
agagatccaaaga

SEQ ID NO: 2967478 - DNA, 14 bp, Homo sapiens
agagatccaaagac

SEQ ID NO: 2967479 - DNA, 21 bp, Homo sapiens
agagatcccaagtagaatctc

SEQ ID NO: 2967480 - DNA, 12 bp, Homo sapiens
agagatgcctcc

SEQ ID NO: 2967481 - DNA, 21 bp, Homo sapiens
agagatgcctccaccgctgcc

SEQ ID NO: 2967482 - DNA, 14 bp, Homo sapiens
agagatgcttggag

SEQ ID NO: 2967483 - DNA, 19 bp, Homo sapiens
agagattctgatttgccac

SEQ ID NO: 2967484 - DNA, 14 bp, Homo sapiens
agagattgtagtat

SEQ ID NO: 2967485 - DNA, 20 bp, Homo sapiens
agagcaaaaatgtaaaaaac

SEQ ID NO: 2967486 - DNA, 21 bp, Homo sapiens
agagcaaaaatgtaaaaaaca

SEQ ID NO: 2967487 - DNA, 21 bp, Homo sapiens
agagcaaagcgcccacccagg

SEQ ID NO: 2967488 - DNA, 23 bp, Homo sapiens
agagcaaaggagacaaagcagga

SEQ ID NO: 2967489 - DNA, 14 bp, Homo sapiens
agagcaaagtgacc

SEQ ID NO: 2967490 - DNA, 24 bp, Homo sapiens
agagcaacccattaatcttttgta

SEQ ID NO: 2967491 - DNA, 23 bp, Homo sapiens
agagcaaggtttcgtggcagcac

SEQ ID NO: 2967492 - DNA, 17 bp, Homo sapiens
agagcaatggttgtatt

SEQ ID NO: 2967493 - DNA, 15 bp, Homo sapiens
agagcaggactccag

SEQ ID NO: 2967494 - DNA, 17 bp, Homo sapiens
agagcaggactccaggc

SEQ ID NO: 2967495 - DNA, 20 bp, Homo sapiens
agagcaggactccaggccca

SEQ ID NO: 2967496 - DNA, 21 bp, Homo sapiens
agagcaggactccaggcccaa

SEQ ID NO: 2967497 - DNA, 17 bp, Homo sapiens
agagcaggccagcccgg

SEQ ID NO: 2967498 - DNA, 15 bp, Homo sapiens
agagcaggggctgct

SEQ ID NO: 2967499 - DNA, 18 bp, Homo sapiens
agagcaggggctgctggg

SEQ ID NO: 2967500 - DNA, 18 bp, Homo sapiens
agagcagtccatttctac

SEQ ID NO: 2967501 - DNA, 13 bp, Homo sapiens
agagcagtgggca

SEQ ID NO: 2967502 - DNA, 14 bp, Homo sapiens
agagcatgtgaggg

SEQ ID NO: 2967503 - DNA, 18 bp, Homo sapiens
agagcatgtgaggggtag

SEQ ID NO: 2967504 - DNA, 12 bp, Homo sapiens
agagcattaaaa

SEQ ID NO: 2967505 - DNA, 14 bp, Homo sapiens
agagcattaaaata

SEQ ID NO: 2967506 - DNA, 21 bp, Homo sapiens
agagccaagggggcagagggc

SEQ ID NO: 2967507 - DNA, 17 bp, Homo sapiens
agagccaattagacttg

SEQ ID NO: 2967508 - DNA, 13 bp, Homo sapiens
agagccacacatg

SEQ ID NO: 2967509 - DNA, 14 bp, Homo sapiens
agagccacacatgg

SEQ ID NO: 2967510 - DNA, 19 bp, Homo sapiens
agagccaccaagagggacg

SEQ ID NO: 2967511 - DNA, 10 bp, Homo sapiens
agagccagag

SEQ ID NO: 2967512 - DNA, 15 bp, Homo sapiens
agattatatcaaagt

SEQ ID NO: 2967513 - DNA, 16 bp, Homo sapiens
agattatatcaaagta

SEQ ID NO: 2967514 - DNA, 15 bp, Homo sapiens
agattatctatttgt

SEQ ID NO: 2967515 - DNA, 15 bp, Homo sapiens
agattattaaaatta

SEQ ID NO: 2967516 - DNA, 16 bp, Homo sapiens
agattattaaaattag

SEQ ID NO: 2967517 - DNA, 15 bp, Homo sapiens
agattattaaatcgt

SEQ ID NO: 2967518 - DNA, 16 bp, Homo sapiens
agattattaaatcgtt

SEQ ID NO: 2967519 - DNA, 13 bp, Homo sapiens
agattatttaaat

SEQ ID NO: 2967520 - DNA, 14 bp, Homo sapiens
agattatttaaatg

SEQ ID NO: 2967521 - DNA, 13 bp, Homo sapiens
agattattttgga

SEQ ID NO: 2967522 - DNA, 19 bp, Homo sapiens
agattcaaaggttctaggt

SEQ ID NO: 2967523 - DNA, 17 bp, Homo sapiens
agattcaagtagttttg

SEQ ID NO: 2967524 - DNA, 13 bp, Homo sapiens
agattcaggggaa

SEQ ID NO: 2967525 - DNA, 18 bp, Homo sapiens
agattcaggtatgttgcc

SEQ ID NO: 2967526 - DNA, 21 bp, Homo sapiens
agattcatcattttctccacc

SEQ ID NO: 2967527 - DNA, 20 bp, Homo sapiens
agattcatttttaatcatga

SEQ ID NO: 2967528 - DNA, 21 bp, Homo sapiens
agattccattggtccaagatt

SEQ ID NO: 2967529 - DNA, 14 bp, Homo sapiens
agattcccagagac

SEQ ID NO: 2967530 - DNA, 12 bp, Homo sapiens
agattcccaggc

SEQ ID NO: 2967531 - DNA, 17 bp, Homo sapiens
agattcccaggccaggg

SEQ ID NO: 2967532 - DNA, 19 bp, Homo sapiens
agattcccaggccagggct

SEQ ID NO: 2967533 - DNA, 16 bp, Homo sapiens
agattccggatcctaa

SEQ ID NO: 2967534 - DNA, 18 bp, Homo sapiens
agattccggatcctaagc

SEQ ID NO: 2967535 - DNA, 23 bp, Homo sapiens
agattccggatcctaagcatcta

SEQ ID NO: 2967536 - DNA, 13 bp, Homo sapiens
agattcctgtcct

SEQ ID NO: 2967537 - DNA, 17 bp, Homo sapiens
agattcctttcctgtgt

SEQ ID NO: 2967538 - DNA, 15 bp, Homo sapiens
agattcgctgtcccc

SEQ ID NO: 2967539 - DNA, 11 bp, Homo sapiens
agattctaaag

SEQ ID NO: 2967540 - DNA, 12 bp, Homo sapiens
agattctaaaga

SEQ ID NO: 2967541 - DNA, 13 bp, Homo sapiens
agattctaaagat

SEQ ID NO: 2967542 - DNA, 14 bp, Homo sapiens
agattctaaagatt

SEQ ID NO: 2967543 - DNA, 16 bp, Homo sapiens
agattctaaagattct

SEQ ID NO: 2967544 - DNA, 21 bp, Homo sapiens
agattctaaagattctatagt

SEQ ID NO: 2967545 - DNA, 13 bp, Homo sapiens
agattctaatgat

SEQ ID NO: 2967546 - DNA, 19 bp, Homo sapiens
agattctacatattcttta

SEQ ID NO: 2967547 - DNA, 15 bp, Homo sapiens
agattctactttgaa

SEQ ID NO: 2967548 - DNA, 18 bp, Homo sapiens
agattctatagttctaga

SEQ ID NO: 2967549 - DNA, 19 bp, Homo sapiens
agattctatagttctagac

SEQ ID NO: 2967550 - DNA, 20 bp, Homo sapiens
agattctatagttctagaca

SEQ ID NO: 2967551 - DNA, 21 bp, Homo sapiens
agattctatagttctagacat

SEQ ID NO: 2967552 - DNA, 14 bp, Homo sapiens
agattctctgccca

SEQ ID NO: 2967553 - DNA, 21 bp, Homo sapiens
agattctctggctgtaaggct

SEQ ID NO: 2967554 - DNA, 16 bp, Homo sapiens
agattctctgtgtcta

SEQ ID NO: 2967555 - DNA, 17 bp, Homo sapiens
agattctgaaacattgc

SEQ ID NO: 2967556 - DNA, 14 bp, Homo sapiens
agattctgatttta

SEQ ID NO: 2967557 - DNA, 13 bp, Homo sapiens
agattctgtgtca

SEQ ID NO: 2967558 - DNA, 13 bp, Homo sapiens
agattcttctgtg

SEQ ID NO: 2967559 - DNA, 16 bp, Homo sapiens
agattcttctgtgttt

SEQ ID NO: 2967560 - DNA, 12 bp, Homo sapiens
agattgaacttt

SEQ ID NO: 2967561 - DNA, 15 bp, Homo sapiens
agattgcatgtgact

SEQ ID NO: 2967562 - DNA, 19 bp, Homo sapiens
agattgcatgtgactctga

SEQ ID NO: 2967563 - DNA, 19 bp, Homo sapiens
agattgctaattgctgttg

SEQ ID NO: 2967564 - DNA, 16 bp, Homo sapiens
agattggaaggagaca

SEQ ID NO: 2967565 - DNA, 14 bp, Homo sapiens
agattggttctgtt

SEQ ID NO: 2967566 - DNA, 23 bp, Homo sapiens
agattgtaaaccgctttggcctg

SEQ ID NO: 2967567 - DNA, 16 bp, Homo sapiens
agattgtatctcttaa

SEQ ID NO: 2967568 - DNA, 20 bp, Homo sapiens
agattgtgccactgctctcc

SEQ ID NO: 2967569 - DNA, 15 bp, Homo sapiens
agattgttgtttgcc

SEQ ID NO: 2967570 - DNA, 14 bp, Homo sapiens
agattgtttctata

SEQ ID NO: 2967571 - DNA, 17 bp, Homo sapiens
agatttagagcaatgca

SEQ ID NO: 2967572 - DNA, 19 bp, Homo sapiens
agatttagctgaagggctt

SEQ ID NO: 2967573 - DNA, 18 bp, Homo sapiens
agatttagtgaaagctag

SEQ ID NO: 2967574 - DNA, 19 bp, Homo sapiens
agatttatttgtttgattt

SEQ ID NO: 2967575 - DNA, 14 bp, Homo sapiens
agatttatttttaa

SEQ ID NO: 2967576 - DNA, 19 bp, Homo sapiens
agatttattttttggactt

SEQ ID NO: 2967577 - DNA, 15 bp, Homo sapiens
agatttcagtaatgt

SEQ ID NO: 2967578 - DNA, 22 bp, Homo sapiens
agatttcagtaatgtcttcagt

SEQ ID NO: 2967579 - DNA, 19 bp, Homo sapiens
agatttcctcctcccagtg

SEQ ID NO: 2967580 - DNA, 15 bp, Homo sapiens
agatttctaaataaa

SEQ ID NO: 2967581 - DNA, 19 bp, Homo sapiens
agatttcttgagttttgtt

SEQ ID NO: 2967582 - DNA, 22 bp, Homo sapiens
agatttgacctcctccctgtta

SEQ ID NO: 2967583 - DNA, 18 bp, Homo sapiens
agatttggtgatggaaaa

SEQ ID NO: 2967584 - DNA, 15 bp, Homo sapiens
agatttgtgaactca

SEQ ID NO: 2967585 - DNA, 22 bp, Homo sapiens
agatttgtgaactcagccaagc

SEQ ID NO: 2967586 - DNA, 15 bp, Homo sapiens
agattttatattttc

SEQ ID NO: 2967587 - DNA, 19 bp, Homo sapiens
agattttatattttctatt

SEQ ID NO: 2967588 - DNA, 19 bp, Homo sapiens
agattttctggttctaaca

SEQ ID NO: 2967589 - DNA, 18 bp, Homo sapiens
agattttctttaaaagaa

SEQ ID NO: 2967590 - DNA, 13 bp, Homo sapiens
agattttgcattt

SEQ ID NO: 2967591 - DNA, 15 bp, Homo sapiens
agattttggtaatga

SEQ ID NO: 2967592 - DNA, 19 bp, Homo sapiens
agatttttaaaaaatattt

SEQ ID NO: 2967593 - DNA, 21 bp, Homo sapiens
agatttttaaaaaatattttc

SEQ ID NO: 2967594 - DNA, 14 bp, Homo sapiens
agatttttgcaata

SEQ ID NO: 2967595 - DNA, 19 bp, Homo sapiens
agatttttggtagtttctg

SEQ ID NO: 2967596 - DNA, 14 bp, Homo sapiens
agatttttgtttgt

SEQ ID NO: 2967597 - DNA, 23 bp, Homo sapiens
agcaaaaaaaacccatgtggtga

SEQ ID NO: 2967598 - DNA, 22 bp, Homo sapiens
agcaaaaaagtccaattttaat

SEQ ID NO: 2967599 - DNA, 11 bp, Homo sapiens
agcaaaaatgc

SEQ ID NO: 2967600 - DNA, 13 bp, Homo sapiens
agcaaaaatgcta

SEQ ID NO: 2967601 - DNA, 20 bp, Homo sapiens
agcaaaaatgctaatattaa

SEQ ID NO: 2967602 - DNA, 14 bp, Homo sapiens
agcaaaaatgtaaa

SEQ ID NO: 2967603 - DNA, 21 bp, Homo sapiens
agcaaaaatgtaaaaaacaaa

SEQ ID NO: 2967604 - DNA, 20 bp, Homo sapiens
agcaaaatcaagcaagcctc

SEQ ID NO: 2967605 - DNA, 11 bp, Homo sapiens
agcaaaatcca

SEQ ID NO: 2967606 - DNA, 13 bp, Homo sapiens
agcaaaatccaaa

SEQ ID NO: 2967607 - DNA, 17 bp, Homo sapiens
agcaaaatgctcttgtc

SEQ ID NO: 2967608 - DNA, 15 bp, Homo sapiens
agcaaacacaataag

SEQ ID NO: 2967609 - DNA, 21 bp, Homo sapiens
agcaaacagggtggcccaggt

SEQ ID NO: 2967610 - DNA, 13 bp, Homo sapiens
agcaaaccaagag

SEQ ID NO: 2967611 - DNA, 16 bp, Homo sapiens
agcaaaccagcctcag

SEQ ID NO: 2967612 - DNA, 13 bp, Homo sapiens
agcaaacccagac

SEQ ID NO: 2967613 - DNA, 13 bp, Homo sapiens
agcaaactctgct

SEQ ID NO: 2967614 - DNA, 17 bp, Homo sapiens
agcaaagagaatgtatt

SEQ ID NO: 2967615 - DNA, 15 bp, Homo sapiens
agcaaagatatatat

SEQ ID NO: 2967616 - DNA, 22 bp, Homo sapiens
agcaaagtggtaggtacttttt

SEQ ID NO: 2967617 - DNA, 16 bp, Homo sapiens
agcaaatgcattctat

SEQ ID NO: 2967618 - DNA, 18 bp, Homo sapiens
agcaaatggaaaatgtat

SEQ ID NO: 2967619 - DNA, 17 bp, Homo sapiens
agcaaattagttggttt

SEQ ID NO: 2967620 - DNA, 14 bp, Homo sapiens
agcaaattattttt

SEQ ID NO: 2967621 - DNA, 15 bp, Homo sapiens
agcaaattttcagca

SEQ ID NO: 2967622 - DNA, 14 bp, Homo sapiens
agcaacaaaatcat

SEQ ID NO: 2967623 - DNA, 13 bp, Homo sapiens
agcaacacagcct

SEQ ID NO: 2967624 - DNA, 17 bp, Homo sapiens
agcaacacagcctgggc

SEQ ID NO: 2967625 - DNA, 14 bp, Homo sapiens
agcaacagcaaaag

SEQ ID NO: 2967626 - DNA, 19 bp, Homo sapiens
agcaacagtaattattatt

SEQ ID NO: 2967627 - DNA, 13 bp, Homo sapiens
agcaacgccagtg

SEQ ID NO: 2967628 - DNA, 17 bp, Homo sapiens
agcaacgtgttaattat

SEQ ID NO: 2967629 - DNA, 20 bp, Homo sapiens
agcaactcttgattatccat

SEQ ID NO: 2967630 - DNA, 16 bp, Homo sapiens
agcaacttgcttctaa

SEQ ID NO: 2967631 - DNA, 16 bp, Homo sapiens
agcaagaaaaaaaaat

SEQ ID NO: 2967632 - DNA, 20 bp, Homo sapiens
agcaagaaaaaaaaatgcca

SEQ ID NO: 2967633 - DNA, 12 bp, Homo sapiens
agcaagacagct

SEQ ID NO: 2967634 - DNA, 14 bp, Homo sapiens
agcaagacagctct

SEQ ID NO: 2967635 - DNA, 14 bp, Homo sapiens
agcaagagagaacc

SEQ ID NO: 2967636 - DNA, 23 bp, Homo sapiens
agcaagagagaacctaactgtat

SEQ ID NO: 2967637 - DNA, 16 bp, Homo sapiens
agcaagcaactgagat

SEQ ID NO: 2967638 - DNA, 10 bp, Homo sapiens
agcaagctgt

SEQ ID NO: 2967639 - DNA, 13 bp, Homo sapiens
agcaagctgtgtt

SEQ ID NO: 2967640 - DNA, 22 bp, Homo sapiens
agcaagctgtgttacttgaagt

SEQ ID NO: 2967641 - DNA, 16 bp, Homo sapiens
agcaaggaaaacttat

SEQ ID NO: 2967642 - DNA, 21 bp, Homo sapiens
agcaaggcggtggacttgaac

SEQ ID NO: 2967643 - DNA, 19 bp, Homo sapiens
agcaaggtttcgtggcagc

SEQ ID NO: 2967644 - DNA, 22 bp, Homo sapiens
agcaagtcccagacaaggagag

SEQ ID NO: 2967645 - DNA, 16 bp, Homo sapiens
agcaagtcttaacaaa

SEQ ID NO: 2967646 - DNA, 22 bp, Homo sapiens
agcccactgtcctgggcctgca

SEQ ID NO: 2967647 - DNA, 23 bp, Homo sapiens
agcccagacccccagtgtatttt

SEQ ID NO: 2967648 - DNA, 11 bp, Homo sapiens
agcccagagac

SEQ ID NO: 2967649 - DNA, 12 bp, Homo sapiens
agcccagagaca

SEQ ID NO: 2967650 - DNA, 21 bp, Homo sapiens
agcccagagacatacttgaag

SEQ ID NO: 2967651 - DNA, 15 bp, Homo sapiens
agcccagcactgctt

SEQ ID NO: 2967652 - DNA, 21 bp, Homo sapiens
agcccagcactgcttgaggaa

SEQ ID NO: 2967653 - DNA, 12 bp, Homo sapiens
agcccagctctg

SEQ ID NO: 2967654 - DNA, 13 bp, Homo sapiens
agcccagctgggt

SEQ ID NO: 2967655 - DNA, 15 bp, Homo sapiens
agcccagctgggtca

SEQ ID NO: 2967656 - DNA, 16 bp, Homo sapiens
agcccagctgggtcag

SEQ ID NO: 2967657 - DNA, 21 bp, Homo sapiens
agcccaggggagaatgcagcc

SEQ ID NO: 2967658 - DNA, 22 bp, Homo sapiens
agcccaggggagaatgcagccc

SEQ ID NO: 2967659 - DNA, 18 bp, Homo sapiens
agcccagtgaccttactc

SEQ ID NO: 2967660 - DNA, 21 bp, Homo sapiens
agcccagttcccgtgacgagg

SEQ ID NO: 2967661 - DNA, 22 bp, Homo sapiens
agcccatccatagtaactgaca

SEQ ID NO: 2967662 - DNA, 17 bp, Homo sapiens
agcccatgagtccttga

SEQ ID NO: 2967663 - DNA, 17 bp, Homo sapiens
agcccattctctctcct

SEQ ID NO: 2967664 - DNA, 16 bp, Homo sapiens
agcccatttctccaga

SEQ ID NO: 2967665 - DNA, 17 bp, Homo sapiens
agccccacatgtccagc

SEQ ID NO: 2967666 - DNA, 21 bp, Homo sapiens
agccccagcaccaccaggtct

SEQ ID NO: 2967667 - DNA, 21 bp, Homo sapiens
agccccatcgccccaactcca

SEQ ID NO: 2967668 - DNA, 17 bp, Homo sapiens
agcccccaccccagcac

SEQ ID NO: 2967669 - DNA, 14 bp, Homo sapiens
agccccctggcagc

SEQ ID NO: 2967670 - DNA, 21 bp, Homo sapiens
agccccctggcagctgcccct

SEQ ID NO: 2967671 - DNA, 17 bp, Homo sapiens
agccccctggcctctgt

SEQ ID NO: 2967672 - DNA, 19 bp, Homo sapiens
agccccctggcctctgtgc

SEQ ID NO: 2967673 - DNA, 23 bp, Homo sapiens
agccccgcgtggaactcgtgtct

SEQ ID NO: 2967674 - DNA, 14 bp, Homo sapiens
agccccgctcccac

SEQ ID NO: 2967675 - DNA, 16 bp, Homo sapiens
agccccgctcccacct

SEQ ID NO: 2967676 - DNA, 12 bp, Homo sapiens
agcccctacccc

SEQ ID NO: 2967677 - DNA, 18 bp, Homo sapiens
agcccctacccctgccct

SEQ ID NO: 2967678 - DNA, 16 bp, Homo sapiens
agcccctccatctgta

SEQ ID NO: 2967679 - DNA, 13 bp, Homo sapiens
agcccctcctccc

SEQ ID NO: 2967680 - DNA, 19 bp, Homo sapiens
agcccctcctcccccggct

SEQ ID NO: 2967681 - DNA, 21 bp, Homo sapiens
agcccctcctctgccacctcc

SEQ ID NO: 2967682 - DNA, 22 bp, Homo sapiens
agcccctcctctgccacctccc

SEQ ID NO: 2967683 - DNA, 17 bp, Homo sapiens
agcccctgaaagcctca

SEQ ID NO: 2967684 - DNA, 19 bp, Homo sapiens
agcccctgagtccgcctgc

SEQ ID NO: 2967685 - DNA, 12 bp, Homo sapiens
agcccctgcaga

SEQ ID NO: 2967686 - DNA, 21 bp, Homo sapiens
agcccctgtctagagagggag

SEQ ID NO: 2967687 - DNA, 15 bp, Homo sapiens
agccccttctgctca

SEQ ID NO: 2967688 - DNA, 16 bp, Homo sapiens
agccccttctgctcag

SEQ ID NO: 2967689 - DNA, 22 bp, Homo sapiens
agccccttctgctcagctctgg

SEQ ID NO: 2967690 - DNA, 21 bp, Homo sapiens
agccccttcttccaaggagca

SEQ ID NO: 2967691 - DNA, 12 bp, Homo sapiens
agcccctttcca

SEQ ID NO: 2967692 - DNA, 14 bp, Homo sapiens
agcccctttccaaa

SEQ ID NO: 2967693 - DNA, 15 bp, Homo sapiens
agcccgcggggacat

SEQ ID NO: 2967694 - DNA, 14 bp, Homo sapiens
agcccggccgctcc

SEQ ID NO: 2967695 - DNA, 19 bp, Homo sapiens
agcccggctcggcccagca

SEQ ID NO: 2967696 - DNA, 15 bp, Homo sapiens
agcccgtcctcctct

SEQ ID NO: 2967697 - DNA, 16 bp, Homo sapiens
agccctagggtggaga

SEQ ID NO: 2967698 - DNA, 23 bp, Homo sapiens
agccctagtatgaaagctggggg

SEQ ID NO: 2967699 - DNA, 14 bp, Homo sapiens
agccctatcactga

SEQ ID NO: 2967700 - DNA, 15 bp, Homo sapiens
agccctccccaggaa

SEQ ID NO: 2967701 - DNA, 12 bp, Homo sapiens
agccctccccat

SEQ ID NO: 2967702 - DNA, 23 bp, Homo sapiens
agccctccccatctcggggctgc

SEQ ID NO: 2967703 - DNA, 20 bp, Homo sapiens
agccctccccatggagccag

SEQ ID NO: 2967704 - DNA, 14 bp, Homo sapiens
agccctccctgtcc

SEQ ID NO: 2967705 - DNA, 17 bp, Homo sapiens
agccctccctgtcctcc

SEQ ID NO: 2967706 - DNA, 12 bp, Homo sapiens
agccctcctcac

SEQ ID NO: 2967707 - DNA, 12 bp, Homo sapiens
agccctctccct

SEQ ID NO: 2967708 - DNA, 22 bp, Homo sapiens
agccctctgcctcctccccagg

SEQ ID NO: 2967709 - DNA, 19 bp, Homo sapiens
agccctctttaatgctgtc

SEQ ID NO: 2967710 - DNA, 17 bp, Homo sapiens
agccctgaatttcttct

SEQ ID NO: 2967711 - DNA, 17 bp, Homo sapiens
agccctgaccctgtgga

SEQ ID NO: 2967712 - DNA, 23 bp, Homo sapiens
agccctgagttcctagccaccgc

SEQ ID NO: 2967713 - DNA, 22 bp, Homo sapiens
agccctgccactcaatgggaga

SEQ ID NO: 2967714 - DNA, 15 bp, Homo sapiens
agccctgcctctgtg

SEQ ID NO: 2967715 - DNA, 19 bp, Homo sapiens
agccctgctgcttcctaac

SEQ ID NO: 2967716 - DNA, 12 bp, Homo sapiens
agccctggcccc

SEQ ID NO: 2967717 - DNA, 15 bp, Homo sapiens
agccctggccccctg

SEQ ID NO: 2967718 - DNA, 18 bp, Homo sapiens
agccctgggatcactgtg

SEQ ID NO: 2967719 - DNA, 14 bp, Homo sapiens
agccctgtcgggct

SEQ ID NO: 2967720 - DNA, 22 bp, Homo sapiens
agccctgtcgggctttgtgtga

SEQ ID NO: 2967721 - DNA, 18 bp, Homo sapiens
agccctgtctactgacca

SEQ ID NO: 2967722 - DNA, 12 bp, Homo sapiens
agccctgttctc

SEQ ID NO: 2967723 - DNA, 13 bp, Homo sapiens
agccctgttctcg

SEQ ID NO: 2967724 - DNA, 15 bp, Homo sapiens
agccctgttctcgtt

SEQ ID NO: 2967725 - DNA, 21 bp, Homo sapiens
agccctgttctcgttgcccta

SEQ ID NO: 2967726 - DNA, 17 bp, Homo sapiens
agccctgttgacacagg

SEQ ID NO: 2967727 - DNA, 23 bp, Homo sapiens
agccctgttgacacaggtctttc

SEQ ID NO: 2967728 - DNA, 17 bp, Homo sapiens
agccctgttgtgccaca

SEQ ID NO: 2967729 - DNA, 12 bp, Homo sapiens
agcccttccttg

SEQ ID NO: 2967730 - DNA, 17 bp, Homo sapiens
agcccttgcattgcaga

SEQ ID NO: 2967731 - DNA, 13 bp, Homo sapiens
agcccttgtttat

SEQ ID NO: 2967732 - DNA, 17 bp, Homo sapiens
agccctttgcctgtaga

SEQ ID NO: 2967733 - DNA, 22 bp, Homo sapiens
agccctttgcctgtagagccag

SEQ ID NO: 2967734 - DNA, 16 bp, Homo sapiens
agccgaactccaggct

SEQ ID NO: 2967735 - DNA, 21 bp, Homo sapiens
agccgaactccaggctgggct

SEQ ID NO: 2967736 - DNA, 22 bp, Homo sapiens
agccgaactccaggctgggctg

SEQ ID NO: 2967737 - DNA, 16 bp, Homo sapiens
agccgactgcgctgct

SEQ ID NO: 2967738 - DNA, 17 bp, Homo sapiens
agccgactgcgctgctt

SEQ ID NO: 2967739 - DNA, 14 bp, Homo sapiens
agccgagagcctgc

SEQ ID NO: 2967740 - DNA, 15 bp, Homo sapiens
agccgagagcctgct

SEQ ID NO: 2967741 - DNA, 15 bp, Homo sapiens
agccgagcgtagtga

SEQ ID NO: 2967742 - DNA, 15 bp, Homo sapiens
agccgagggcgtcag

SEQ ID NO: 2967743 - DNA, 22 bp, Homo sapiens
agccgattttagagttcttttg

SEQ ID NO: 2967744 - DNA, 18 bp, Homo sapiens
agccgctgccctgggtcc

SEQ ID NO: 2967745 - DNA, 22 bp, Homo sapiens
agccggacacttctcaggaaat

SEQ ID NO: 2967746 - DNA, 18 bp, Homo sapiens
agccggcatccttgcctg

SEQ ID NO: 2967747 - DNA, 20 bp, Homo sapiens
agccggcatccttgcctgtc

SEQ ID NO: 2967748 - DNA, 21 bp, Homo sapiens
agccggcatccttgcctgtct

SEQ ID NO: 2967749 - DNA, 18 bp, Homo sapiens
agccggcctgagaaacac

SEQ ID NO: 2967750 - DNA, 14 bp, Homo sapiens
agccgggcatggtg

SEQ ID NO: 2967751 - DNA, 15 bp, Homo sapiens
agccgggcatggtgg

SEQ ID NO: 2967752 - DNA, 21 bp, Homo sapiens
agccgggtctgcctcttctgg

SEQ ID NO: 2967753 - DNA, 23 bp, Homo sapiens
agccgggtgtggcacgcacctgt

SEQ ID NO: 2967754 - DNA, 14 bp, Homo sapiens
agccgtcagccatc

SEQ ID NO: 2967755 - DNA, 22 bp, Homo sapiens
agcctaatccctgggcattgct

SEQ ID NO: 2967756 - DNA, 16 bp, Homo sapiens
agcctacaaagagatg

SEQ ID NO: 2967757 - DNA, 16 bp, Homo sapiens
agcctacgctgaagat

SEQ ID NO: 2967758 - DNA, 16 bp, Homo sapiens
agcctagccctgggac

SEQ ID NO: 2967759 - DNA, 19 bp, Homo sapiens
agcctaggaggactggggt

SEQ ID NO: 2967760 - DNA, 22 bp, Homo sapiens
agcctcaaggttttaggttcta

SEQ ID NO: 2967761 - DNA, 16 bp, Homo sapiens
agcctcacagatgctg

SEQ ID NO: 2967762 - DNA, 19 bp, Homo sapiens
agcctcacagatgctggcc

SEQ ID NO: 2967763 - DNA, 21 bp, Homo sapiens
agcctcacttctagggtatgg

SEQ ID NO: 2967764 - DNA, 20 bp, Homo sapiens
agcctcacttggtctgccag

SEQ ID NO: 2967765 - DNA, 23 bp, Homo sapiens
agcctcacttttaatgaacaaat

SEQ ID NO: 2967766 - DNA, 12 bp, Homo sapiens
agcctcagaaga

SEQ ID NO: 2967767 - DNA, 15 bp, Homo sapiens
agcctcagtgaaaca

SEQ ID NO: 2967768 - DNA, 14 bp, Homo sapiens
agcctcatgttctg

SEQ ID NO: 2967769 - DNA, 16 bp, Homo sapiens
agcctcccaaagtgtt

SEQ ID NO: 2967770 - DNA, 15 bp, Homo sapiens
agcctcccctgccag

SEQ ID NO: 2967771 - DNA, 18 bp, Homo sapiens
agcctcccctgccagggc

SEQ ID NO: 2967772 - DNA, 13 bp, Homo sapiens
agcctccctgaag

SEQ ID NO: 2967773 - DNA, 11 bp, Homo sapiens
agcctcctgag

SEQ ID NO: 2967774 - DNA, 19 bp, Homo sapiens
agcctcctgagtagctgga

SEQ ID NO: 2967775 - DNA, 13 bp, Homo sapiens
agcctcctgggta

SEQ ID NO: 2967776 - DNA, 14 bp, Homo sapiens
agcctcctgggtag

SEQ ID NO: 2967777 - DNA, 18 bp, Homo sapiens
agcctcgacacagagtgg

SEQ ID NO: 2967778 - DNA, 13 bp, Homo sapiens
agctgttcctgtg

SEQ ID NO: 2967779 - DNA, 16 bp, Homo sapiens
agctgttcctgtgttc

SEQ ID NO: 2967780 - DNA, 16 bp, Homo sapiens
agctgttcctgttcag

SEQ ID NO: 2967781 - DNA, 17 bp, Homo sapiens
agctgttctcattcctg

SEQ ID NO: 2967782 - DNA, 21 bp, Homo sapiens
agctgttctcattcctgttct

SEQ ID NO: 2967783 - DNA, 16 bp, Homo sapiens
agctgtttactaggga

SEQ ID NO: 2967784 - DNA, 15 bp, Homo sapiens
agcttacaagccagc

SEQ ID NO: 2967785 - DNA, 17 bp, Homo sapiens
agcttacaagccagctg

SEQ ID NO: 2967786 - DNA, 16 bp, Homo sapiens
agcttacacaaatcta

SEQ ID NO: 2967787 - DNA, 21 bp, Homo sapiens
agcttacattgaaaacagata

SEQ ID NO: 2967788 - DNA, 22 bp, Homo sapiens
agcttaccagaagcttccatag

SEQ ID NO: 2967789 - DNA, 14 bp, Homo sapiens
agcttactgcagca

SEQ ID NO: 2967790 - DNA, 15 bp, Homo sapiens
agcttagattctgta

SEQ ID NO: 2967791 - DNA, 19 bp, Homo sapiens
agcttagattttctgtaaa

SEQ ID NO: 2967792 - DNA, 16 bp, Homo sapiens
agcttatctccctgct

SEQ ID NO: 2967793 - DNA, 18 bp, Homo sapiens
agcttatctccctgcttc

SEQ ID NO: 2967794 - DNA, 20 bp, Homo sapiens
agcttatctccctgcttcat

SEQ ID NO: 2967795 - DNA, 17 bp, Homo sapiens
agcttatctcttttata

SEQ ID NO: 2967796 - DNA, 14 bp, Homo sapiens
agcttatgtttctt

SEQ ID NO: 2967797 - DNA, 20 bp, Homo sapiens
agcttattgtgtgcgctgcc

SEQ ID NO: 2967798 - DNA, 23 bp, Homo sapiens
agcttattgtgtgcgctgcctgg

SEQ ID NO: 2967799 - DNA, 14 bp, Homo sapiens
agcttcaaaaactt

SEQ ID NO: 2967800 - DNA, 13 bp, Homo sapiens
agcttcctccaga

SEQ ID NO: 2967801 - DNA, 15 bp, Homo sapiens
agcttccttggcttt

SEQ ID NO: 2967802 - DNA, 20 bp, Homo sapiens
agcttctaattttgtgctct

SEQ ID NO: 2967803 - DNA, 18 bp, Homo sapiens
agcttctaccatgaacag

SEQ ID NO: 2967804 - DNA, 17 bp, Homo sapiens
agcttctgccttctgga

SEQ ID NO: 2967805 - DNA, 19 bp, Homo sapiens
agcttctggggtccccagg

SEQ ID NO: 2967806 - DNA, 20 bp, Homo sapiens
agcttcttccaggtgcccag

SEQ ID NO: 2967807 - DNA, 15 bp, Homo sapiens
agcttgagttctgca

SEQ ID NO: 2967808 - DNA, 22 bp, Homo sapiens
agcttgagttctgcactccaga

SEQ ID NO: 2967809 - DNA, 17 bp, Homo sapiens
agcttgcagtgaagtgt

SEQ ID NO: 2967810 - DNA, 19 bp, Homo sapiens
agcttgccagatgctgcag

SEQ ID NO: 2967811 - DNA, 14 bp, Homo sapiens
agcttgccagggat

SEQ ID NO: 2967812 - DNA, 14 bp, Homo sapiens
agcttgctcttcag

SEQ ID NO: 2967813 - DNA, 18 bp, Homo sapiens
agcttggaaagggaagat

SEQ ID NO: 2967814 - DNA, 19 bp, Homo sapiens
agcttgtgcacaattctgt

SEQ ID NO: 2967815 - DNA, 20 bp, Homo sapiens
agcttgtgtatccattatca

SEQ ID NO: 2967816 - DNA, 15 bp, Homo sapiens
agcttgtttctgtca

SEQ ID NO: 2967817 - DNA, 18 bp, Homo sapiens
agctttaaaaagaaaaaa

SEQ ID NO: 2967818 - DNA, 14 bp, Homo sapiens
agctttaatgttac

SEQ ID NO: 2967819 - DNA, 15 bp, Homo sapiens
agctttactgtttgt

SEQ ID NO: 2967820 - DNA, 18 bp, Homo sapiens
agctttagacagcagagc

SEQ ID NO: 2967821 - DNA, 20 bp, Homo sapiens
agctttatttatagaaatga

SEQ ID NO: 2967822 - DNA, 15 bp, Homo sapiens
agctttatttttctt

SEQ ID NO: 2967823 - DNA, 20 bp, Homo sapiens
agctttcctcaaaaagcaga

SEQ ID NO: 2967824 - DNA, 12 bp, Homo sapiens
agctttcctgga

SEQ ID NO: 2967825 - DNA, 14 bp, Homo sapiens
agctttcctggaag

SEQ ID NO: 2967826 - DNA, 21 bp, Homo sapiens
agctttctaagagaagcaatt

SEQ ID NO: 2967827 - DNA, 19 bp, Homo sapiens
agctttctgaccttcagct

SEQ ID NO: 2967828 - DNA, 17 bp, Homo sapiens
agctttctgccttagcc

SEQ ID NO: 2967829 - DNA, 15 bp, Homo sapiens
agctttctggaattt

SEQ ID NO: 2967830 - DNA, 12 bp, Homo sapiens
agctttctgtat

SEQ ID NO: 2967831 - DNA, 12 bp, Homo sapiens
agctttcttcag

SEQ ID NO: 2967832 - DNA, 16 bp, Homo sapiens
agctttgacagttctt

SEQ ID NO: 2967833 - DNA, 20 bp, Homo sapiens
agctttgcaattctttttgg

SEQ ID NO: 2967834 - DNA, 13 bp, Homo sapiens
agctttgctgctg

SEQ ID NO: 2967835 - DNA, 22 bp, Homo sapiens
agctttgctgctgaaggctcat

SEQ ID NO: 2967836 - DNA, 13 bp, Homo sapiens
agctttggcagtg

SEQ ID NO: 2967837 - DNA, 22 bp, Homo sapiens
agctttgggtcatttttaacta

SEQ ID NO: 2967838 - DNA, 16 bp, Homo sapiens
agctttgtcccctgct

SEQ ID NO: 2967839 - DNA, 17 bp, Homo sapiens
agctttgtcccctgctt

SEQ ID NO: 2967840 - DNA, 18 bp, Homo sapiens
agctttgtcccctgcttc

SEQ ID NO: 2967841 - DNA, 14 bp, Homo sapiens
agcttttcaccttt

SEQ ID NO: 2967842 - DNA, 23 bp, Homo sapiens
agctttttaatgctgtaaaatat

SEQ ID NO: 2967843 - DNA, 20 bp, Homo sapiens
agcttttttcctcctttctc

SEQ ID NO: 2967844 - DNA, 23 bp, Homo sapiens
agcttttttcctcctttctctgt

SEQ ID NO: 2967845 - DNA, 13 bp, Homo sapiens
aggaaaaaaatag

SEQ ID NO: 2967846 - DNA, 20 bp, Homo sapiens
aggaaaaaaattacaaagaa

SEQ ID NO: 2967847 - DNA, 19 bp, Homo sapiens
aggaaaaacaacaaataat

SEQ ID NO: 2967848 - DNA, 13 bp, Homo sapiens
aggaaaaacaggt

SEQ ID NO: 2967849 - DNA, 13 bp, Homo sapiens
aggaaaaataatc

SEQ ID NO: 2967850 - DNA, 14 bp, Homo sapiens
aggaaaactgcatg

SEQ ID NO: 2967851 - DNA, 20 bp, Homo sapiens
aggaaaactgcatggagacg

SEQ ID NO: 2967852 - DNA, 13 bp, Homo sapiens
aggaaaagcacaa

SEQ ID NO: 2967853 - DNA, 18 bp, Homo sapiens
aggaaaagcacaaggact

SEQ ID NO: 2967854 - DNA, 11 bp, Homo sapiens
aggaaaagcat

SEQ ID NO: 2967855 - DNA, 12 bp, Homo sapiens
aggaaaagcatc

SEQ ID NO: 2967856 - DNA, 18 bp, Homo sapiens
aggaaaagcatctgccac

SEQ ID NO: 2967857 - DNA, 22 bp, Homo sapiens
aggaaaatgtatccagaggaat

SEQ ID NO: 2967858 - DNA, 21 bp, Homo sapiens
aggaaaattttagcgtgctca

SEQ ID NO: 2967859 - DNA, 21 bp, Homo sapiens
aggaaacaaagcttagcagga

SEQ ID NO: 2967860 - DNA, 16 bp, Homo sapiens
aggaaacaagggaagg

SEQ ID NO: 2967861 - DNA, 13 bp, Homo sapiens
aggaaacaagtga

SEQ ID NO: 2967862 - DNA, 12 bp, Homo sapiens
aggaaacagtta

SEQ ID NO: 2967863 - DNA, 20 bp, Homo sapiens
aggaaacatgaagcataatt

SEQ ID NO: 2967864 - DNA, 22 bp, Homo sapiens
aggaaaccacaaccttgcagta

SEQ ID NO: 2967865 - DNA, 16 bp, Homo sapiens
aggaaacgctacctct

SEQ ID NO: 2967866 - DNA, 19 bp, Homo sapiens
aggaaagatgatgctcagt

SEQ ID NO: 2967867 - DNA, 18 bp, Homo sapiens
aggaaagcaataaatgaa

SEQ ID NO: 2967868 - DNA, 22 bp, Homo sapiens
aggaaagcaataaatgaatggg

SEQ ID NO: 2967869 - DNA, 22 bp, Homo sapiens
aggaaagcatgtctctgcttcc

SEQ ID NO: 2967870 - DNA, 23 bp, Homo sapiens
aggaaagcatgtctctgcttcca

SEQ ID NO: 2967871 - DNA, 13 bp, Homo sapiens
aggaaaggccagc

SEQ ID NO: 2967872 - DNA, 17 bp, Homo sapiens
aggaaaggccagctggc

SEQ ID NO: 2967873 - DNA, 13 bp, Homo sapiens
aggaaagggcctg

SEQ ID NO: 2967874 - DNA, 17 bp, Homo sapiens
aggaaagttcagagttt

SEQ ID NO: 2967875 - DNA, 22 bp, Homo sapiens
aggaaagttcagagttttctgg

SEQ ID NO: 2967876 - DNA, 19 bp, Homo sapiens
aggaaataccaactgaagt

SEQ ID NO: 2967877 - DNA, 21 bp, Homo sapiens
aggaaatagtaccttcaatac

SEQ ID NO: 2967878 - DNA, 16 bp, Homo sapiens
aggaacaaaaattaca

SEQ ID NO: 2967879 - DNA, 18 bp, Homo sapiens
aggaacagtggccttgct

SEQ ID NO: 2967880 - DNA, 21 bp, Homo sapiens
aggaacagtgtggtttgggaa

SEQ ID NO: 2967881 - DNA, 18 bp, Homo sapiens
aggaacagttaccctgct

SEQ ID NO: 2967882 - DNA, 13 bp, Homo sapiens
aggaacatttttt

SEQ ID NO: 2967883 - DNA, 19 bp, Homo sapiens
aggaacccttacagtagga

SEQ ID NO: 2967884 - DNA, 20 bp, Homo sapiens
aggaacctcgagtactgtgg

SEQ ID NO: 2967885 - DNA, 20 bp, Homo sapiens
aggaactcgcacctgtgctg

SEQ ID NO: 2967886 - DNA, 17 bp, Homo sapiens
aggaactcgcctcagcc

SEQ ID NO: 2967887 - DNA, 17 bp, Homo sapiens
aggaactgcagcaatct

SEQ ID NO: 2967888 - DNA, 14 bp, Homo sapiens
aggaacttccaggt

SEQ ID NO: 2967889 - DNA, 23 bp, Homo sapiens
aggaagaatggtgtgtttcccta

SEQ ID NO: 2967890 - DNA, 21 bp, Homo sapiens
aggaagagacatgagaaaggg

SEQ ID NO: 2967891 - DNA, 20 bp, Homo sapiens
aggaagatctctgcagggcc

SEQ ID NO: 2967892 - DNA, 22 bp, Homo sapiens
aggaagatgctcatctgagcca

SEQ ID NO: 2967893 - DNA, 15 bp, Homo sapiens
aggaagcagggagag

SEQ ID NO: 2967894 - DNA, 16 bp, Homo sapiens
aggaagcccactgcct

SEQ ID NO: 2967895 - DNA, 14 bp, Homo sapiens
aggaagctcagact

SEQ ID NO: 2967896 - DNA, 16 bp, Homo sapiens
aggaagctcagactgg

SEQ ID NO: 2967897 - DNA, 17 bp, Homo sapiens
aggaagctcagactggt

SEQ ID NO: 2967898 - DNA, 18 bp, Homo sapiens
aggaaggacccctcacca

SEQ ID NO: 2967899 - DNA, 23 bp, Homo sapiens
aggaaggagactcacctctgcct

SEQ ID NO: 2967900 - DNA, 21 bp, Homo sapiens
aggaaggagagatgaccccta

SEQ ID NO: 2967901 - DNA, 12 bp, Homo sapiens
aggaaggagccc

SEQ ID NO: 2967902 - DNA, 23 bp, Homo sapiens
aggaaggagcggcgccctggact

SEQ ID NO: 2967903 - DNA, 19 bp, Homo sapiens
aggaaggcagcattccatg

SEQ ID NO: 2967904 - DNA, 15 bp, Homo sapiens
aggaaggcctaggct

SEQ ID NO: 2967905 - DNA, 12 bp, Homo sapiens
aggaaggctctc

SEQ ID NO: 2967906 - DNA, 19 bp, Homo sapiens
aggaaggcttgttgtgctt

SEQ ID NO: 2967907 - DNA, 21 bp, Homo sapiens
aggaaggcttgttgtgctttt

SEQ ID NO: 2967908 - DNA, 21 bp, Homo sapiens
aggaagggagggagctgaggc

SEQ ID NO: 2967909 - DNA, 16 bp, Homo sapiens
aggaaggggccagagg

SEQ ID NO: 2967910 - DNA, 18 bp, Homo sapiens
aggcaaccatttttagaa

SEQ ID NO: 2967911 - DNA, 15 bp, Homo sapiens
aggcaacgcagacca

SEQ ID NO: 2967912 - DNA, 18 bp, Homo sapiens
aggcaacggcaccattgg

SEQ ID NO: 2967913 - DNA, 14 bp, Homo sapiens
aggcaacttgaaga

SEQ ID NO: 2967914 - DNA, 16 bp, Homo sapiens
aggcaacttgaagaaa

SEQ ID NO: 2967915 - DNA, 21 bp, Homo sapiens
aggcaacttgaagaaacgctt

SEQ ID NO: 2967916 - DNA, 22 bp, Homo sapiens
aggcaagattggaaagacagga

SEQ ID NO: 2967917 - DNA, 20 bp, Homo sapiens
aggcaagtcacactgcattg

SEQ ID NO: 2967918 - DNA, 13 bp, Homo sapiens
aggcacacagcta

SEQ ID NO: 2967919 - DNA, 14 bp, Homo sapiens
aggcacagcaaact

SEQ ID NO: 2967920 - DNA, 22 bp, Homo sapiens
aggcacaggtcaggggtgacac

SEQ ID NO: 2967921 - DNA, 16 bp, Homo sapiens
aggcacatggctgggg

SEQ ID NO: 2967922 - DNA, 18 bp, Homo sapiens
aggcacatggctggggga

SEQ ID NO: 2967923 - DNA, 16 bp, Homo sapiens
aggcaccgggctggct

SEQ ID NO: 2967924 - DNA, 20 bp, Homo sapiens
aggcacctcacaggccccag

SEQ ID NO: 2967925 - DNA, 14 bp, Homo sapiens
aggcacgaacccac

SEQ ID NO: 2967926 - DNA, 18 bp, Homo sapiens
aggcacgaacccacctgc

SEQ ID NO: 2967927 - DNA, 19 bp, Homo sapiens
aggcacgaacccacctgct

SEQ ID NO: 2967928 - DNA, 21 bp, Homo sapiens
aggcacgaacccacctgctga

SEQ ID NO: 2967929 - DNA, 15 bp, Homo sapiens
aggcactagtcaccg

SEQ ID NO: 2967930 - DNA, 20 bp, Homo sapiens
aggcactagtcaccgacagc

SEQ ID NO: 2967931 - DNA, 15 bp, Homo sapiens
aggcactctagattc

SEQ ID NO: 2967932 - DNA, 17 bp, Homo sapiens
aggcactctagattcca

SEQ ID NO: 2967933 - DNA, 18 bp, Homo sapiens
aggcactctcctgtctga

SEQ ID NO: 2967934 - DNA, 19 bp, Homo sapiens
aggcactgtagttctaaga

SEQ ID NO: 2967935 - DNA, 17 bp, Homo sapiens
aggcacttcctcccctc

SEQ ID NO: 2967936 - DNA, 22 bp, Homo sapiens
aggcactttgggggtttgaggg

SEQ ID NO: 2967937 - DNA, 22 bp, Homo sapiens
aggcagaatgaacccataggga

SEQ ID NO: 2967938 - DNA, 22 bp, Homo sapiens
aggcagactctttatgcttgca

SEQ ID NO: 2967939 - DNA, 15 bp, Homo sapiens
aggcagagctgaggg

SEQ ID NO: 2967940 - DNA, 20 bp, Homo sapiens
aggcagagctgagggccctg

SEQ ID NO: 2967941 - DNA, 20 bp, Homo sapiens
aggcagaggaatttggctgc

SEQ ID NO: 2967942 - DNA, 21 bp, Homo sapiens
aggcagaggaatttggctgct

SEQ ID NO: 2967943 - DNA, 23 bp, Homo sapiens
aggcagaggaatttggctgcttc

SEQ ID NO: 2967944 - DNA, 19 bp, Homo sapiens
aggcagagttctgtgaaga

SEQ ID NO: 2967945 - DNA, 22 bp, Homo sapiens
aggcagcctggacatagagagg

SEQ ID NO: 2967946 - DNA, 15 bp, Homo sapiens
aggcagcgcctgtcc

SEQ ID NO: 2967947 - DNA, 16 bp, Homo sapiens
aggcagcgcctgtccc

SEQ ID NO: 2967948 - DNA, 17 bp, Homo sapiens
aggcagcgcctgtcccc

SEQ ID NO: 2967949 - DNA, 19 bp, Homo sapiens
aggcagcgcctgtcccctc

SEQ ID NO: 2967950 - DNA, 17 bp, Homo sapiens
aggcagctgcctgctct

SEQ ID NO: 2967951 - DNA, 21 bp, Homo sapiens
aggcaggaccttcgggctgtg

SEQ ID NO: 2967952 - DNA, 19 bp, Homo sapiens
aggcaggagttgggggcag

SEQ ID NO: 2967953 - DNA, 17 bp, Homo sapiens
aggcaggcatggccctg

SEQ ID NO: 2967954 - DNA, 18 bp, Homo sapiens
aggcaggcatggccctgg

SEQ ID NO: 2967955 - DNA, 14 bp, Homo sapiens
aggcaggcctttcc

SEQ ID NO: 2967956 - DNA, 16 bp, Homo sapiens
aggcaggctcccaggg

SEQ ID NO: 2967957 - DNA, 21 bp, Homo sapiens
aggcagggccttgcccagaga

SEQ ID NO: 2967958 - DNA, 17 bp, Homo sapiens
aggcagggctgcattgg

SEQ ID NO: 2967959 - DNA, 18 bp, Homo sapiens
aggcaggggacaagggag

SEQ ID NO: 2967960 - DNA, 21 bp, Homo sapiens
aggcaggggacaagggaggca

SEQ ID NO: 2967961 - DNA, 19 bp, Homo sapiens
aggcaggtctgcaagggcc

SEQ ID NO: 2967962 - DNA, 22 bp, Homo sapiens
aggcaggtctgcaagggcccag

SEQ ID NO: 2967963 - DNA, 12 bp, Homo sapiens
aggcagtccaga

SEQ ID NO: 2967964 - DNA, 19 bp, Homo sapiens
aggcagtgatgctggatgc

SEQ ID NO: 2967965 - DNA, 12 bp, Homo sapiens
aggcagtggcta

SEQ ID NO: 2967966 - DNA, 13 bp, Homo sapiens
aggcagtgtcatt

SEQ ID NO: 2967967 - DNA, 20 bp, Homo sapiens
aggcatacgagagcagaggt

SEQ ID NO: 2967968 - DNA, 21 bp, Homo sapiens
aggcatacgagagcagaggtc

SEQ ID NO: 2967969 - DNA, 19 bp, Homo sapiens
aggcatctgtgggcatggt

SEQ ID NO: 2967970 - DNA, 16 bp, Homo sapiens
aggcatggccctgggc

SEQ ID NO: 2967971 - DNA, 17 bp, Homo sapiens
aggcatggctggtgcct

SEQ ID NO: 2967972 - DNA, 19 bp, Homo sapiens
aggcatggctggtgcctga

SEQ ID NO: 2967973 - DNA, 22 bp, Homo sapiens
aggcatggctggtgcctgaaga

SEQ ID NO: 2967974 - DNA, 12 bp, Homo sapiens
aggcatggtgga

SEQ ID NO: 2967975 - DNA, 12 bp, Homo sapiens
aggcatggtggc

SEQ ID NO: 2967976 - DNA, 14 bp, Homo sapiens
aggcatgtcctgga

SEQ ID NO: 2967977 - DNA, 20 bp, Homo sapiens
aggcattgccaagggctttg

SEQ ID NO: 2967978 - DNA, 21 bp, Homo sapiens
aggcattgccaagggctttgt

SEQ ID NO: 2967979 - DNA, 21 bp, Homo sapiens
aggcatttgcagggtcctctt

SEQ ID NO: 2967980 - DNA, 15 bp, Homo sapiens
aggcatttttaccat

SEQ ID NO: 2967981 - DNA, 15 bp, Homo sapiens
aggccaaacctctgt

SEQ ID NO: 2967982 - DNA, 16 bp, Homo sapiens
aggccaaacctctgtt

SEQ ID NO: 2967983 - DNA, 22 bp, Homo sapiens
aggccaaacctctgttcagtgt

SEQ ID NO: 2967984 - DNA, 13 bp, Homo sapiens
aggccaactgcct

SEQ ID NO: 2967985 - DNA, 14 bp, Homo sapiens
aggccaactgcctc

SEQ ID NO: 2967986 - DNA, 23 bp, Homo sapiens
aggccaactgcctccttgccagc

SEQ ID NO: 2967987 - DNA, 19 bp, Homo sapiens
aggccaagcagtgcctgcc

SEQ ID NO: 2967988 - DNA, 18 bp, Homo sapiens
aggccaatagttttagat

SEQ ID NO: 2967989 - DNA, 18 bp, Homo sapiens
aggccacactcagcacaa

SEQ ID NO: 2967990 - DNA, 21 bp, Homo sapiens
aggccacagaaggtgaacttt

SEQ ID NO: 2967991 - DNA, 19 bp, Homo sapiens
aggccactcctccaaagga

SEQ ID NO: 2967992 - DNA, 16 bp, Homo sapiens
aggccagcccggacct

SEQ ID NO: 2967993 - DNA, 16 bp, Homo sapiens
aggccagctggcagca

SEQ ID NO: 2967994 - DNA, 17 bp, Homo sapiens
aggccagctggcagcag

SEQ ID NO: 2967995 - DNA, 20 bp, Homo sapiens
aggccagctggcagcagagt

SEQ ID NO: 2967996 - DNA, 13 bp, Homo sapiens
aggccaggccagc

SEQ ID NO: 2967997 - DNA, 15 bp, Homo sapiens
aggccaggccagctg

SEQ ID NO: 2967998 - DNA, 14 bp, Homo sapiens
aggccagggctcct

SEQ ID NO: 2967999 - DNA, 13 bp, Homo sapiens
aggccagggctgg

SEQ ID NO: 2968000 - DNA, 15 bp, Homo sapiens
aggccagggctgggt

SEQ ID NO: 2968001 - DNA, 16 bp, Homo sapiens
aggccagggctgggtc

SEQ ID NO: 2968002 - DNA, 21 bp, Homo sapiens
aggccagggctgggtcacagg

SEQ ID NO: 2968003 - DNA, 22 bp, Homo sapiens
aggccagggctgggtcacagga

SEQ ID NO: 2968004 - DNA, 16 bp, Homo sapiens
aggccataaaacaggt

SEQ ID NO: 2968005 - DNA, 15 bp, Homo sapiens
aggccatatttccat

SEQ ID NO: 2968006 - DNA, 16 bp, Homo sapiens
aggccatgtggcctgc

SEQ ID NO: 2968007 - DNA, 21 bp, Homo sapiens
aggccatgtggcctgcccagc

SEQ ID NO: 2968008 - DNA, 22 bp, Homo sapiens
aggccatgtggcctgcccagcc

SEQ ID NO: 2968009 - DNA, 23 bp, Homo sapiens
aggcccaagtctcctaggggctt

SEQ ID NO: 2968010 - DNA, 13 bp, Homo sapiens
aggcccacacaca

SEQ ID NO: 2968011 - DNA, 14 bp, Homo sapiens
aggcccacacacag

SEQ ID NO: 2968012 - DNA, 15 bp, Homo sapiens
aggcccacacacagg

SEQ ID NO: 2968013 - DNA, 16 bp, Homo sapiens
aggcccacacacaggt

SEQ ID NO: 2968014 - DNA, 14 bp, Homo sapiens
aggccccagcctcc

SEQ ID NO: 2968015 - DNA, 13 bp, Homo sapiens
aggcccccaagcc

SEQ ID NO: 2968016 - DNA, 13 bp, Homo sapiens
aggcccccaccac

SEQ ID NO: 2968017 - DNA, 16 bp, Homo sapiens
aggcccccaccacaca

SEQ ID NO: 2968018 - DNA, 19 bp, Homo sapiens
aggcccccccagaagcaag

SEQ ID NO: 2968019 - DNA, 17 bp, Homo sapiens
aggccccgcttgtccag

SEQ ID NO: 2968020 - DNA, 20 bp, Homo sapiens
aggccccgcttgtccagcgc

SEQ ID NO: 2968021 - DNA, 22 bp, Homo sapiens
aggccccgcttgtccagcgcct

SEQ ID NO: 2968022 - DNA, 14 bp, Homo sapiens
aggcccctctcctc

SEQ ID NO: 2968023 - DNA, 12 bp, Homo sapiens
aggcccctgtgt

SEQ ID NO: 2968024 - DNA, 15 bp, Homo sapiens
aggcccctgtgtagt

SEQ ID NO: 2968025 - DNA, 14 bp, Homo sapiens
aggcccggtgcagc

SEQ ID NO: 2968026 - DNA, 20 bp, Homo sapiens
aggcccgtcggagctgcctg

SEQ ID NO: 2968027 - DNA, 23 bp, Homo sapiens
aggcccgtcggagctgcctgcag

SEQ ID NO: 2968028 - DNA, 13 bp, Homo sapiens
aggccctcccacc

SEQ ID NO: 2968029 - DNA, 15 bp, Homo sapiens
aggccctcgctgcca

SEQ ID NO: 2968030 - DNA, 17 bp, Homo sapiens
aggccctcgctgccagc

SEQ ID NO: 2968031 - DNA, 22 bp, Homo sapiens
aggccctcgctgccagctctgt

SEQ ID NO: 2968032 - DNA, 16 bp, Homo sapiens
aggccctctgcctgca

SEQ ID NO: 2968033 - DNA, 21 bp, Homo sapiens
aggccctctgcctgcactccc

SEQ ID NO: 2968034 - DNA, 22 bp, Homo sapiens
aggccctctggagtggccacta

SEQ ID NO: 2968035 - DNA, 11 bp, Homo sapiens
aggccctgcat

SEQ ID NO: 2968036 - DNA, 12 bp, Homo sapiens
aggccctgcatg

SEQ ID NO: 2968037 - DNA, 13 bp, Homo sapiens
aggccctgccagt

SEQ ID NO: 2968038 - DNA, 15 bp, Homo sapiens
aggccctggagggca

SEQ ID NO: 2968039 - DNA, 16 bp, Homo sapiens
aggccctggttcctgc

SEQ ID NO: 2968040 - DNA, 19 bp, Homo sapiens
aggccctgtccagccccca

SEQ ID NO: 2968041 - DNA, 17 bp, Homo sapiens
aggcccttcctctttgg

SEQ ID NO: 2968042 - DNA, 14 bp, Homo sapiens
agggtggagctgag

SEQ ID NO: 2968043 - DNA, 22 bp, Homo sapiens
agggtggagctgagaagaggag

SEQ ID NO: 2968044 - DNA, 15 bp, Homo sapiens
agggtggcacatctg

SEQ ID NO: 2968045 - DNA, 15 bp, Homo sapiens
agggtggcaggtcac

SEQ ID NO: 2968046 - DNA, 20 bp, Homo sapiens
agggtggcaggtcactgtca

SEQ ID NO: 2968047 - DNA, 18 bp, Homo sapiens
agggtgggaaggggctag

SEQ ID NO: 2968048 - DNA, 16 bp, Homo sapiens
agggtgggaggggcca

SEQ ID NO: 2968049 - DNA, 18 bp, Homo sapiens
agggtgggaggggccatg

SEQ ID NO: 2968050 - DNA, 18 bp, Homo sapiens
agggtgggatggaggaga

SEQ ID NO: 2968051 - DNA, 21 bp, Homo sapiens
agggtggggggggggcgcggc

SEQ ID NO: 2968052 - DNA, 18 bp, Homo sapiens
agggtgggtttgagatgt

SEQ ID NO: 2968053 - DNA, 18 bp, Homo sapiens
agggttaatcatatttga

SEQ ID NO: 2968054 - DNA, 19 bp, Homo sapiens
agggttaatcatatttgaa

SEQ ID NO: 2968055 - DNA, 18 bp, Homo sapiens
agggttcatcatccctcc

SEQ ID NO: 2968056 - DNA, 23 bp, Homo sapiens
agggttcatcatccctccctgcc

SEQ ID NO: 2968057 - DNA, 18 bp, Homo sapiens
agggttttgcaataactt

SEQ ID NO: 2968058 - DNA, 13 bp, Homo sapiens
aggtaaaacaaaa

SEQ ID NO: 2968059 - DNA, 19 bp, Homo sapiens
aggtaaaattgaaaggcat

SEQ ID NO: 2968060 - DNA, 22 bp, Homo sapiens
aggtaaatctagagtttataca

SEQ ID NO: 2968061 - DNA, 19 bp, Homo sapiens
aggtaacacgggaatcaca

SEQ ID NO: 2968062 - DNA, 21 bp, Homo sapiens
aggtaacatttatagaagaaa

SEQ ID NO: 2968063 - DNA, 12 bp, Homo sapiens
aggtaaccagtt

SEQ ID NO: 2968064 - DNA, 21 bp, Homo sapiens
aggtaatacagcttgtgagga

SEQ ID NO: 2968065 - DNA, 14 bp, Homo sapiens
aggtaatggcatga

SEQ ID NO: 2968066 - DNA, 16 bp, Homo sapiens
aggtaatgtgaataaa

SEQ ID NO: 2968067 - DNA, 21 bp, Homo sapiens
aggtaccactgatttggagat

SEQ ID NO: 2968068 - DNA, 17 bp, Homo sapiens
aggtacccctttctggc

SEQ ID NO: 2968069 - DNA, 21 bp, Homo sapiens
aggtacccctttctggctctc

SEQ ID NO: 2968070 - DNA, 22 bp, Homo sapiens
aggtaccttgacctttgtacag

SEQ ID NO: 2968071 - DNA, 13 bp, Homo sapiens
aggtacgcacaga

SEQ ID NO: 2968072 - DNA, 16 bp, Homo sapiens
aggtacgcacagacag

SEQ ID NO: 2968073 - DNA, 17 bp, Homo sapiens
aggtacgcacagacagg

SEQ ID NO: 2968074 - DNA, 23 bp, Homo sapiens
aggtacgttttatattatataag

SEQ ID NO: 2968075 - DNA, 22 bp, Homo sapiens
aggtactgtcatgggctaggca

SEQ ID NO: 2968076 - DNA, 18 bp, Homo sapiens
aggtagattaaggtatct

SEQ ID NO: 2968077 - DNA, 14 bp, Homo sapiens
aggtagcagcaaat

SEQ ID NO: 2968078 - DNA, 13 bp, Homo sapiens
aggtcaacagaat

SEQ ID NO: 2968079 - DNA, 14 bp, Homo sapiens
aggtcaacagaatg

SEQ ID NO: 2968080 - DNA, 19 bp, Homo sapiens
aggtcaacagaatgaaaaa

SEQ ID NO: 2968081 - DNA, 23 bp, Homo sapiens
aggtcaatacagtacaggcagca

SEQ ID NO: 2968082 - DNA, 17 bp, Homo sapiens
aggtcaggggtgacaca

SEQ ID NO: 2968083 - DNA, 18 bp, Homo sapiens
aggtcagtttatgaaaca

SEQ ID NO: 2968084 - DNA, 17 bp, Homo sapiens
aggtcatagattcttga

SEQ ID NO: 2968085 - DNA, 16 bp, Homo sapiens
aggtcatggccacact

SEQ ID NO: 2968086 - DNA, 18 bp, Homo sapiens
aggtccacaggtctagac

SEQ ID NO: 2968087 - DNA, 18 bp, Homo sapiens
aggtccagctttactgtg

SEQ ID NO: 2968088 - DNA, 21 bp, Homo sapiens
aggtcccattgttggcgctga

SEQ ID NO: 2968089 - DNA, 17 bp, Homo sapiens
aggtccccagctttggc

SEQ ID NO: 2968090 - DNA, 19 bp, Homo sapiens
aggtcccccgactgcctgt

SEQ ID NO: 2968091 - DNA, 20 bp, Homo sapiens
aggtcccccgactgcctgtc

SEQ ID NO: 2968092 - DNA, 21 bp, Homo sapiens
aggtcccccgactgcctgtct

SEQ ID NO: 2968093 - DNA, 16 bp, Homo sapiens
aggtccccctgcagct

SEQ ID NO: 2968094 - DNA, 13 bp, Homo sapiens
aggtcccctggca

SEQ ID NO: 2968095 - DNA, 14 bp, Homo sapiens
aggtcccctggcag

SEQ ID NO: 2968096 - DNA, 19 bp, Homo sapiens
aggtccggtgttctaagat

SEQ ID NO: 2968097 - DNA, 16 bp, Homo sapiens
aggtcctacagggcca

SEQ ID NO: 2968098 - DNA, 13 bp, Homo sapiens
aggtcctctgtca

SEQ ID NO: 2968099 - DNA, 14 bp, Homo sapiens
aggtcctctgtcag

SEQ ID NO: 2968100 - DNA, 19 bp, Homo sapiens
aggtcctgtgatcttattt

SEQ ID NO: 2968101 - DNA, 14 bp, Homo sapiens
aggtccttcccaga

SEQ ID NO: 2968102 - DNA, 21 bp, Homo sapiens
aggtcgaagcaatcagcaaac

SEQ ID NO: 2968103 - DNA, 16 bp, Homo sapiens
aggtcgttcttatcta

SEQ ID NO: 2968104 - DNA, 20 bp, Homo sapiens
aggtctcacactcctcctgc

SEQ ID NO: 2968105 - DNA, 21 bp, Homo sapiens
aggtctcacactcctcctgcc

SEQ ID NO: 2968106 - DNA, 23 bp, Homo sapiens
aggtctcccgggaagccaccctc

SEQ ID NO: 2968107 - DNA, 23 bp, Homo sapiens
aggtctcgggggtccggaagggt

SEQ ID NO: 2968108 - DNA, 16 bp, Homo sapiens
aggtctctgagacagg

SEQ ID NO: 2968109 - DNA, 10 bp, Homo sapiens
aggtctcttt

SEQ ID NO: 2968110 - DNA, 15 bp, Homo sapiens
aggtctcttttctct

SEQ ID NO: 2968111 - DNA, 22 bp, Homo sapiens
aggtctgaaaagaggagccaga

SEQ ID NO: 2968112 - DNA, 17 bp, Homo sapiens
aggtctgggtctcagga

SEQ ID NO: 2968113 - DNA, 19 bp, Homo sapiens
aggtctgtggaaagtggtg

SEQ ID NO: 2968114 - DNA, 14 bp, Homo sapiens
aggtcttcctgtgg

SEQ ID NO: 2968115 - DNA, 22 bp, Homo sapiens
aggtcttcctgtggctccctct

SEQ ID NO: 2968116 - DNA, 18 bp, Homo sapiens
aggtctttcagtactttt

SEQ ID NO: 2968117 - DNA, 10 bp, Homo sapiens
aggtctttgt

SEQ ID NO: 2968118 - DNA, 14 bp, Homo sapiens
aggtcttttacata

SEQ ID NO: 2968119 - DNA, 18 bp, Homo sapiens
aggtcttttctagtctga

SEQ ID NO: 2968120 - DNA, 15 bp, Homo sapiens
aggtgaaaatgaaga

SEQ ID NO: 2968121 - DNA, 17 bp, Homo sapiens
aggtgaaaatgaagaag

SEQ ID NO: 2968122 - DNA, 19 bp, Homo sapiens
aggtgaaagttaatccact

SEQ ID NO: 2968123 - DNA, 15 bp, Homo sapiens
aggtgaaatgaagca

SEQ ID NO: 2968124 - DNA, 14 bp, Homo sapiens
aggtgaataataaa

SEQ ID NO: 2968125 - DNA, 19 bp, Homo sapiens
aggtgacagaaggaccagc

SEQ ID NO: 2968126 - DNA, 14 bp, Homo sapiens
aggtgactttctga

SEQ ID NO: 2968127 - DNA, 14 bp, Homo sapiens
aggtgagcagacag

SEQ ID NO: 2968128 - DNA, 17 bp, Homo sapiens
aggtgaggcctgtctgt

SEQ ID NO: 2968129 - DNA, 13 bp, Homo sapiens
aggtgatgagttt

SEQ ID NO: 2968130 - DNA, 18 bp, Homo sapiens
aggtgcaatttcaaggtt

SEQ ID NO: 2968131 - DNA, 19 bp, Homo sapiens
aggtgcaatttcaaggttc

SEQ ID NO: 2968132 - DNA, 20 bp, Homo sapiens
aggtgcaatttcaaggttct

SEQ ID NO: 2968133 - DNA, 21 bp, Homo sapiens
aggtgcaatttcaaggttcta

SEQ ID NO: 2968134 - DNA, 22 bp, Homo sapiens
aggtgcaatttcaaggttctaa

SEQ ID NO: 2968135 - DNA, 21 bp, Homo sapiens
aggtgcagaggtaccctgggt

SEQ ID NO: 2968136 - DNA, 18 bp, Homo sapiens
aggtgcatatagaaaaca

SEQ ID NO: 2968137 - DNA, 17 bp, Homo sapiens
aggtgcatctgcaggca

SEQ ID NO: 2968138 - DNA, 20 bp, Homo sapiens
aggtgcccttggaggccagc

SEQ ID NO: 2968139 - DNA, 21 bp, Homo sapiens
aggtgcccttggaggccagcc

SEQ ID NO: 2968140 - DNA, 22 bp, Homo sapiens
aggtgcctgtgaggcaggggcg

SEQ ID NO: 2968141 - DNA, 20 bp, Homo sapiens
aggtgccttcttcagggcct

SEQ ID NO: 2968142 - DNA, 23 bp, Homo sapiens
aggtgccttcttcagggcctggt

SEQ ID NO: 2968143 - DNA, 16 bp, Homo sapiens
aggtgcggccaccacc

SEQ ID NO: 2968144 - DNA, 17 bp, Homo sapiens
aggtgctcaataaatat

SEQ ID NO: 2968145 - DNA, 16 bp, Homo sapiens
aggtgctgacggccag

SEQ ID NO: 2968146 - DNA, 21 bp, Homo sapiens
aggtgctggaaagggagggag

SEQ ID NO: 2968147 - DNA, 13 bp, Homo sapiens
aggtgctggactg

SEQ ID NO: 2968148 - DNA, 13 bp, Homo sapiens
aggtgctggccca

SEQ ID NO: 2968149 - DNA, 20 bp, Homo sapiens
aggtgctggcccagcatgga

SEQ ID NO: 2968150 - DNA, 20 bp, Homo sapiens
aggtgctggtagctgagggg

SEQ ID NO: 2968151 - DNA, 21 bp, Homo sapiens
aggtgctggtagctgagggga

SEQ ID NO: 2968152 - DNA, 22 bp, Homo sapiens
aggtgcttctagttctgccagg

SEQ ID NO: 2968153 - DNA, 13 bp, Homo sapiens
aggtggaaaaaca

SEQ ID NO: 2968154 - DNA, 16 bp, Homo sapiens
aggtggaagagggctg

SEQ ID NO: 2968155 - DNA, 13 bp, Homo sapiens
aggtggaagccct

SEQ ID NO: 2968156 - DNA, 14 bp, Homo sapiens
aggtggaagccctc

SEQ ID NO: 2968157 - DNA, 15 bp, Homo sapiens
aggtggaagccctcc

SEQ ID NO: 2968158 - DNA, 21 bp, Homo sapiens
aggtggaagccctccttccac

SEQ ID NO: 2968159 - DNA, 17 bp, Homo sapiens
aggtggaccctgtaaat

SEQ ID NO: 2968160 - DNA, 13 bp, Homo sapiens
aggtggacctggc

SEQ ID NO: 2968161 - DNA, 16 bp, Homo sapiens
aggtggagtcttgctc

SEQ ID NO: 2968162 - DNA, 23 bp, Homo sapiens
aggtggattttgtttaaaaaatc

SEQ ID NO: 2968163 - DNA, 22 bp, Homo sapiens
aggtggcatcagtgtctttcca

SEQ ID NO: 2968164 - DNA, 23 bp, Homo sapiens
aggtggccaccgggggtggctct

SEQ ID NO: 2968165 - DNA, 12 bp, Homo sapiens
aggtggccatgc

SEQ ID NO: 2968166 - DNA, 21 bp, Homo sapiens
aggtggcctccttgcttgtta

SEQ ID NO: 2968167 - DNA, 14 bp, Homo sapiens
aggtggcctctgct

SEQ ID NO: 2968168 - DNA, 16 bp, Homo sapiens
aggtggcctctgctgg

SEQ ID NO: 2968169 - DNA, 24 bp, Homo sapiens
aggtggcctctgctggtctctggc

SEQ ID NO: 2968170 - DNA, 19 bp, Homo sapiens
aggtggctaagggggacca

SEQ ID NO: 2968171 - DNA, 20 bp, Homo sapiens
aggtggctgacccagtccct

SEQ ID NO: 2968172 - DNA, 21 bp, Homo sapiens
aggtggctgacccagtccctg

SEQ ID NO: 2968173 - DNA, 16 bp, Homo sapiens
agtcttacgaatactt

SEQ ID NO: 2968174 - DNA, 18 bp, Homo sapiens
agtcttactacagaaatg

SEQ ID NO: 2968175 - DNA, 11 bp, Homo sapiens
agtcttcctct

SEQ ID NO: 2968176 - DNA, 20 bp, Homo sapiens
agtcttcctcttagcctctg

SEQ ID NO: 2968177 - DNA, 16 bp, Homo sapiens
agtctttcccccagga

SEQ ID NO: 2968178 - DNA, 18 bp, Homo sapiens
agtctttggttctaagga

SEQ ID NO: 2968179 - DNA, 22 bp, Homo sapiens
agtcttttgttcgcatggtcac

SEQ ID NO: 2968180 - DNA, 23 bp, Homo sapiens
agtgaaacacttgcttgccaact

SEQ ID NO: 2968181 - DNA, 15 bp, Homo sapiens
agtgaaagaaaataa

SEQ ID NO: 2968182 - DNA, 17 bp, Homo sapiens
agtgaaagaaaataaca

SEQ ID NO: 2968183 - DNA, 19 bp, Homo sapiens
agtgaaagtgaggaaataa

SEQ ID NO: 2968184 - DNA, 21 bp, Homo sapiens
agtgaaagtgaggaaataaag

SEQ ID NO: 2968185 - DNA, 16 bp, Homo sapiens
agtgaaatattgtaaa

SEQ ID NO: 2968186 - DNA, 15 bp, Homo sapiens
agtgaactaagttat

SEQ ID NO: 2968187 - DNA, 19 bp, Homo sapiens
agtgaactaagttattgtt

SEQ ID NO: 2968188 - DNA, 17 bp, Homo sapiens
agtgaagaatccttttg

SEQ ID NO: 2968189 - DNA, 15 bp, Homo sapiens
agtgaagacagaagt

SEQ ID NO: 2968190 - DNA, 21 bp, Homo sapiens
agtgaaggcttctctctgtgg

SEQ ID NO: 2968191 - DNA, 15 bp, Homo sapiens
agtgaagtggcctct

SEQ ID NO: 2968192 - DNA, 16 bp, Homo sapiens
agtgaatgattcagtg

SEQ ID NO: 2968193 - DNA, 19 bp, Homo sapiens
agtgaatgattcagtgtta

SEQ ID NO: 2968194 - DNA, 17 bp, Homo sapiens
agtgaatgccagtgtgc

SEQ ID NO: 2968195 - DNA, 14 bp, Homo sapiens
agtgaatttgcctg

SEQ ID NO: 2968196 - DNA, 16 bp, Homo sapiens
agtgaatttttctcta

SEQ ID NO: 2968197 - DNA, 20 bp, Homo sapiens
agtgaatttttctctaactc

SEQ ID NO: 2968198 - DNA, 18 bp, Homo sapiens
agtgaatttttgcaataa

SEQ ID NO: 2968199 - DNA, 19 bp, Homo sapiens
agtgacacccaagagggct

SEQ ID NO: 2968200 - DNA, 12 bp, Homo sapiens
agtgacagctag

SEQ ID NO: 2968201 - DNA, 23 bp, Homo sapiens
agtgacagctttcctcaaaaagc

SEQ ID NO: 2968202 - DNA, 20 bp, Homo sapiens
agtgacagggaagctacagg

SEQ ID NO: 2968203 - DNA, 23 bp, Homo sapiens
agtgacagggaagctacaggtta

SEQ ID NO: 2968204 - DNA, 19 bp, Homo sapiens
agtgacagttgcagccctt

SEQ ID NO: 2968205 - DNA, 15 bp, Homo sapiens
agtgacatagcctca

SEQ ID NO: 2968206 - DNA, 22 bp, Homo sapiens
agtgacatctctttgatgtcat

SEQ ID NO: 2968207 - DNA, 14 bp, Homo sapiens
agtgacccctgcct

SEQ ID NO: 2968208 - DNA, 16 bp, Homo sapiens
agtgacctgaggaagc

SEQ ID NO: 2968209 - DNA, 20 bp, Homo sapiens
agtgacgtgactcagagctt

SEQ ID NO: 2968210 - DNA, 18 bp, Homo sapiens
agtgacgtggttcatccc

SEQ ID NO: 2968211 - DNA, 15 bp, Homo sapiens
agtgactaatggcat

SEQ ID NO: 2968212 - DNA, 21 bp, Homo sapiens
agtgactctcctgcctcagcc

SEQ ID NO: 2968213 - DNA, 18 bp, Homo sapiens
agtgactgaaaccatttt

SEQ ID NO: 2968214 - DNA, 17 bp, Homo sapiens
agtgagaataggcagcc

SEQ ID NO: 2968215 - DNA, 15 bp, Homo sapiens
agtgagaccctgtct

SEQ ID NO: 2968216 - DNA, 17 bp, Homo sapiens
agtgagaccctgtctca

SEQ ID NO: 2968217 - DNA, 16 bp, Homo sapiens
agtgagaggggaggga

SEQ ID NO: 2968218 - DNA, 16 bp, Homo sapiens
agtgagatagcattgt

SEQ ID NO: 2968219 - DNA, 22 bp, Homo sapiens
agtgagatttaagttcctgctg

SEQ ID NO: 2968220 - DNA, 23 bp, Homo sapiens
agtgagatttaagttcctgctgc

SEQ ID NO: 2968221 - DNA, 15 bp, Homo sapiens
agtgagccactccgg

SEQ ID NO: 2968222 - DNA, 21 bp, Homo sapiens
agtgagccagaaattgattaa

SEQ ID NO: 2968223 - DNA, 21 bp, Homo sapiens
agtgagcccagattgtgccac

SEQ ID NO: 2968224 - DNA, 19 bp, Homo sapiens
agtgagccgcatcttctcc

SEQ ID NO: 2968225 - DNA, 24 bp, Homo sapiens
agtgagccgcatcttctccatctg

SEQ ID NO: 2968226 - DNA, 14 bp, Homo sapiens
agtgagcgagtgga

SEQ ID NO: 2968227 - DNA, 14 bp, Homo sapiens
agtgaggaaggcag

SEQ ID NO: 2968228 - DNA, 16 bp, Homo sapiens
agtgagtactgttaag

SEQ ID NO: 2968229 - DNA, 22 bp, Homo sapiens
agtgagtactgttaagaataat

SEQ ID NO: 2968230 - DNA, 15 bp, Homo sapiens
agtgagtcagcacct

SEQ ID NO: 2968231 - DNA, 16 bp, Homo sapiens
agtgagtctggtggag

SEQ ID NO: 2968232 - DNA, 18 bp, Homo sapiens
agtgagtggcatgtgggt

SEQ ID NO: 2968233 - DNA, 17 bp, Homo sapiens
agtgagtgtgctgctgt

SEQ ID NO: 2968234 - DNA, 19 bp, Homo sapiens
agtgagtgtgctgctgtaa

SEQ ID NO: 2968235 - DNA, 10 bp, Homo sapiens
agtgagttca

SEQ ID NO: 2968236 - DNA, 23 bp, Homo sapiens
agtgagttcaactacatgttctg

SEQ ID NO: 2968237 - DNA, 21 bp, Homo sapiens
agtgagttcagcctttaagat

SEQ ID NO: 2968238 - DNA, 22 bp, Homo sapiens
agtgagttcagcctttaagata

SEQ ID NO: 2968239 - DNA, 22 bp, Homo sapiens
agtgatatttctctagtagtta

SEQ ID NO: 2968240 - DNA, 20 bp, Homo sapiens
agtgatcctcacgccttggc

SEQ ID NO: 2968241 - DNA, 14 bp, Homo sapiens
agtgatcctgcaag

SEQ ID NO: 2968242 - DNA, 14 bp, Homo sapiens
agtgatgcctgccc

SEQ ID NO: 2968243 - DNA, 15 bp, Homo sapiens
agtgatgtagaaaga

SEQ ID NO: 2968244 - DNA, 21 bp, Homo sapiens
agtgatgtccttaaaatgtgg

SEQ ID NO: 2968245 - DNA, 19 bp, Homo sapiens
agtgatgttcagatttcta

SEQ ID NO: 2968246 - DNA, 13 bp, Homo sapiens
agtgattgctttt

SEQ ID NO: 2968247 - DNA, 15 bp, Homo sapiens
agtgcaaaatgtctt

SEQ ID NO: 2968248 - DNA, 17 bp, Homo sapiens
agtgcaaaatgtcttgt

SEQ ID NO: 2968249 - DNA, 22 bp, Homo sapiens
agtgcaaaatgtcttgtgtatt

SEQ ID NO: 2968250 - DNA, 15 bp, Homo sapiens
agtgcaacctctgct

SEQ ID NO: 2968251 - DNA, 15 bp, Homo sapiens
agtgcaagcccctgc

SEQ ID NO: 2968252 - DNA, 18 bp, Homo sapiens
agtgcaagcccctgctcc

SEQ ID NO: 2968253 - DNA, 13 bp, Homo sapiens
agtgcaaggaatg

SEQ ID NO: 2968254 - DNA, 23 bp, Homo sapiens
agtgcaatatgggcgggcagtcg

SEQ ID NO: 2968255 - DNA, 23 bp, Homo sapiens
agtgcacttaatattagcttgct

SEQ ID NO: 2968256 - DNA, 16 bp, Homo sapiens
agtgcagaacacctgg

SEQ ID NO: 2968257 - DNA, 19 bp, Homo sapiens
agtgcagaacacctggccg

SEQ ID NO: 2968258 - DNA, 14 bp, Homo sapiens
agtgcagaatgtaa

SEQ ID NO: 2968259 - DNA, 20 bp, Homo sapiens
agtgcagaatgtaagtgggc

SEQ ID NO: 2968260 - DNA, 14 bp, Homo sapiens
agtgcaggctggcc

SEQ ID NO: 2968261 - DNA, 18 bp, Homo sapiens
agtgcaggctggccagcc

SEQ ID NO: 2968262 - DNA, 19 bp, Homo sapiens
agtgcaggctggccagccg

SEQ ID NO: 2968263 - DNA, 13 bp, Homo sapiens
agtgcatagaatt

SEQ ID NO: 2968264 - DNA, 14 bp, Homo sapiens
agtgcatctacttg

SEQ ID NO: 2968265 - DNA, 16 bp, Homo sapiens
agtgcatgaaaaacca

SEQ ID NO: 2968266 - DNA, 22 bp, Homo sapiens
agtgcatgctctctgcagccag

SEQ ID NO: 2968267 - DNA, 17 bp, Homo sapiens
agtgcatggtggccaga

SEQ ID NO: 2968268 - DNA, 17 bp, Homo sapiens
agtgcattgtttctgtg

SEQ ID NO: 2968269 - DNA, 19 bp, Homo sapiens
agtgcattttgtttctgta

SEQ ID NO: 2968270 - DNA, 12 bp, Homo sapiens
agtgccaaagaa

SEQ ID NO: 2968271 - DNA, 13 bp, Homo sapiens
agtgccaaagaaa

SEQ ID NO: 2968272 - DNA, 20 bp, Homo sapiens
agtgccaagacacagcaggg

SEQ ID NO: 2968273 - DNA, 17 bp, Homo sapiens
agtgccaatgttgtgtg

SEQ ID NO: 2968274 - DNA, 23 bp, Homo sapiens
agtgccaatgttgtgtgttgcac

SEQ ID NO: 2968275 - DNA, 24 bp, Homo sapiens
agtgccaatgttgtgtgttgcact

SEQ ID NO: 2968276 - DNA, 17 bp, Homo sapiens
agtgccagcccctgctg

SEQ ID NO: 2968277 - DNA, 23 bp, Homo sapiens
agtgccatacatgttattgtttt

SEQ ID NO: 2968278 - DNA, 16 bp, Homo sapiens
agtgcccaccaacatc

SEQ ID NO: 2968279 - DNA, 20 bp, Homo sapiens
agtgcccaccaacatcccat

SEQ ID NO: 2968280 - DNA, 20 bp, Homo sapiens
agtgccccagacagttcttt

SEQ ID NO: 2968281 - DNA, 18 bp, Homo sapiens
agtgccccagactgagct

SEQ ID NO: 2968282 - DNA, 18 bp, Homo sapiens
agtgcccccagcccagag

SEQ ID NO: 2968283 - DNA, 13 bp, Homo sapiens
agtgccgaggaca

SEQ ID NO: 2968284 - DNA, 19 bp, Homo sapiens
agtgccgcagtggggtcaa

SEQ ID NO: 2968285 - DNA, 17 bp, Homo sapiens
agtgccttacctcctgc

SEQ ID NO: 2968286 - DNA, 20 bp, Homo sapiens
agtgccttacctcctgccca

SEQ ID NO: 2968287 - DNA, 21 bp, Homo sapiens
agtgccttacctcctgcccag

SEQ ID NO: 2968288 - DNA, 12 bp, Homo sapiens
agtgccttctct

SEQ ID NO: 2968289 - DNA, 17 bp, Homo sapiens
agtgccttctctcagct

SEQ ID NO: 2968290 - DNA, 19 bp, Homo sapiens
agtgccttctctcagctcc

SEQ ID NO: 2968291 - DNA, 20 bp, Homo sapiens
agtgccttctctcagctccc

SEQ ID NO: 2968292 - DNA, 19 bp, Homo sapiens
agtgcctttatctcagcca

SEQ ID NO: 2968293 - DNA, 23 bp, Homo sapiens
agtgcctttttccttatttcaag

SEQ ID NO: 2968294 - DNA, 17 bp, Homo sapiens
agtgcgagtatgtgttt

SEQ ID NO: 2968295 - DNA, 20 bp, Homo sapiens
agtgcggcgtggagactggc

SEQ ID NO: 2968296 - DNA, 20 bp, Homo sapiens
agtgctaaagttttcttccc

SEQ ID NO: 2968297 - DNA, 13 bp, Homo sapiens
agtgctaaggttc

SEQ ID NO: 2968298 - DNA, 14 bp, Homo sapiens
agtgctaaggttct

SEQ ID NO: 2968299 - DNA, 15 bp, Homo sapiens
agtgctaaggttcta

SEQ ID NO: 2968300 - DNA, 18 bp, Homo sapiens
agtgctaaggttctaagg

SEQ ID NO: 2968301 - DNA, 23 bp, Homo sapiens
agtgctacagaaagcacaaagaa

SEQ ID NO: 2968302 - DNA, 13 bp, Homo sapiens
agtgctatttcag

SEQ ID NO: 2968303 - DNA, 14 bp, Homo sapiens
agtgctatttcagc

SEQ ID NO: 2968304 - DNA, 15 bp, Homo sapiens
ataagataaaatgat

SEQ ID NO: 2968305 - DNA, 16 bp, Homo sapiens
ataagataaaatgatg

SEQ ID NO: 2968306 - DNA, 13 bp, Homo sapiens
ataagattctaac

SEQ ID NO: 2968307 - DNA, 14 bp, Homo sapiens
ataaggaagaaaca

SEQ ID NO: 2968308 - DNA, 19 bp, Homo sapiens
ataaggacatgatgctttt

SEQ ID NO: 2968309 - DNA, 12 bp, Homo sapiens
ataagggagagc

SEQ ID NO: 2968310 - DNA, 18 bp, Homo sapiens
ataagggagagctgagcc

SEQ ID NO: 2968311 - DNA, 16 bp, Homo sapiens
ataaggtaaaatgcca

SEQ ID NO: 2968312 - DNA, 22 bp, Homo sapiens
ataaggtgttttctgtgtaacc

SEQ ID NO: 2968313 - DNA, 23 bp, Homo sapiens
ataaggtttcgtttctgtataca

SEQ ID NO: 2968314 - DNA, 16 bp, Homo sapiens
ataagtatttcaaatt

SEQ ID NO: 2968315 - DNA, 18 bp, Homo sapiens
ataagtatttcaaattgg

SEQ ID NO: 2968316 - DNA, 23 bp, Homo sapiens
ataagtggagaaatgaaaagtaa

SEQ ID NO: 2968317 - DNA, 19 bp, Homo sapiens
ataagtgttcttcagtgta

SEQ ID NO: 2968318 - DNA, 20 bp, Homo sapiens
ataagttaaaggcagtccag

SEQ ID NO: 2968319 - DNA, 13 bp, Homo sapiens
ataagttgctttc

SEQ ID NO: 2968320 - DNA, 21 bp, Homo sapiens
ataagtttaactttaaaactg

SEQ ID NO: 2968321 - DNA, 22 bp, Homo sapiens
ataagtttaactttaaaactgt

SEQ ID NO: 2968322 - DNA, 13 bp, Homo sapiens
ataagtttgaagg

SEQ ID NO: 2968323 - DNA, 19 bp, Homo sapiens
ataagtttgaaggaaacag

SEQ ID NO: 2968324 - DNA, 20 bp, Homo sapiens
ataagtttgaaggaaacagt

SEQ ID NO: 2968325 - DNA, 13 bp, Homo sapiens
ataagttttatgt

SEQ ID NO: 2968326 - DNA, 14 bp, Homo sapiens
ataataaaaattgt

SEQ ID NO: 2968327 - DNA, 15 bp, Homo sapiens
ataataaaaattgta

SEQ ID NO: 2968328 - DNA, 13 bp, Homo sapiens
ataataaaatagt

SEQ ID NO: 2968329 - DNA, 17 bp, Homo sapiens
ataataagcaggatgtt

SEQ ID NO: 2968330 - DNA, 12 bp, Homo sapiens
ataataataata

SEQ ID NO: 2968331 - DNA, 14 bp, Homo sapiens
ataataataataat

SEQ ID NO: 2968332 - DNA, 15 bp, Homo sapiens
ataataatataatga

SEQ ID NO: 2968333 - DNA, 14 bp, Homo sapiens
ataataattgaaga

SEQ ID NO: 2968334 - DNA, 13 bp, Homo sapiens
ataatacacttgc

SEQ ID NO: 2968335 - DNA, 14 bp, Homo sapiens
ataatactactact

SEQ ID NO: 2968336 - DNA, 19 bp, Homo sapiens
ataatactactactgttat

SEQ ID NO: 2968337 - DNA, 21 bp, Homo sapiens
ataatactgctgagatacata

SEQ ID NO: 2968338 - DNA, 15 bp, Homo sapiens
ataatagaatttcct

SEQ ID NO: 2968339 - DNA, 18 bp, Homo sapiens
ataatagaatttcctaat

SEQ ID NO: 2968340 - DNA, 21 bp, Homo sapiens
ataatagaatttcctaatgag

SEQ ID NO: 2968341 - DNA, 16 bp, Homo sapiens
ataatagttaatgaag

SEQ ID NO: 2968342 - DNA, 22 bp, Homo sapiens
ataatatacttttacattaaag

SEQ ID NO: 2968343 - DNA, 23 bp, Homo sapiens
ataatatacttttacattaaaga

SEQ ID NO: 2968344 - DNA, 14 bp, Homo sapiens
ataatatctaaagt

SEQ ID NO: 2968345 - DNA, 15 bp, Homo sapiens
ataatatgagaatca

SEQ ID NO: 2968346 - DNA, 12 bp, Homo sapiens
ataatatgcaca

SEQ ID NO: 2968347 - DNA, 20 bp, Homo sapiens
ataatatgcacacagtgctt

SEQ ID NO: 2968348 - DNA, 15 bp, Homo sapiens
ataatatgtaaattt

SEQ ID NO: 2968349 - DNA, 12 bp, Homo sapiens
ataatcaagatt

SEQ ID NO: 2968350 - DNA, 13 bp, Homo sapiens
ataatcaagattt

SEQ ID NO: 2968351 - DNA, 17 bp, Homo sapiens
ataatcagtgactgaaa

SEQ ID NO: 2968352 - DNA, 19 bp, Homo sapiens
ataatcattagttttagag

SEQ ID NO: 2968353 - DNA, 23 bp, Homo sapiens
ataatcattagttttagaggcat

SEQ ID NO: 2968354 - DNA, 16 bp, Homo sapiens
ataatcattttagaat

SEQ ID NO: 2968355 - DNA, 17 bp, Homo sapiens
ataatccagtaaaataa

SEQ ID NO: 2968356 - DNA, 14 bp, Homo sapiens
ataatcccagctac

SEQ ID NO: 2968357 - DNA, 18 bp, Homo sapiens
ataatcctaaacatatga

SEQ ID NO: 2968358 - DNA, 18 bp, Homo sapiens
ataatcgtcttcaaatta

SEQ ID NO: 2968359 - DNA, 20 bp, Homo sapiens
ataatctggtgttcttgcta

SEQ ID NO: 2968360 - DNA, 14 bp, Homo sapiens
ataatcttttacat

SEQ ID NO: 2968361 - DNA, 22 bp, Homo sapiens
ataatgatcagcaaaaagactg

SEQ ID NO: 2968362 - DNA, 17 bp, Homo sapiens
ataatgcagaagtattc

SEQ ID NO: 2968363 - DNA, 15 bp, Homo sapiens
ataatgctactgtct

SEQ ID NO: 2968364 - DNA, 13 bp, Homo sapiens
ataatggaaaaaa

SEQ ID NO: 2968365 - DNA, 23 bp, Homo sapiens
ataatggaaaaaaaaaaaagagg

SEQ ID NO: 2968366 - DNA, 21 bp, Homo sapiens
ataatgggccactgaaatctg

SEQ ID NO: 2968367 - DNA, 22 bp, Homo sapiens
ataatgggccactgaaatctgt

SEQ ID NO: 2968368 - DNA, 23 bp, Homo sapiens
ataatgggccactgaaatctgtc

SEQ ID NO: 2968369 - DNA, 16 bp, Homo sapiens
ataatgtgaaaatggt

SEQ ID NO: 2968370 - DNA, 14 bp, Homo sapiens
ataatgtgaaatat

SEQ ID NO: 2968371 - DNA, 12 bp, Homo sapiens
ataatgtgaagt

SEQ ID NO: 2968372 - DNA, 13 bp, Homo sapiens
ataatgttcctta

SEQ ID NO: 2968373 - DNA, 19 bp, Homo sapiens
ataatgttccttagtggta

SEQ ID NO: 2968374 - DNA, 20 bp, Homo sapiens
ataatgttgtatttaatttt

SEQ ID NO: 2968375 - DNA, 22 bp, Homo sapiens
ataatgtttaatattgagaaag

SEQ ID NO: 2968376 - DNA, 21 bp, Homo sapiens
ataattaaccaaccttgttta

SEQ ID NO: 2968377 - DNA, 22 bp, Homo sapiens
ataattaaccaaccttgtttaa

SEQ ID NO: 2968378 - DNA, 14 bp, Homo sapiens
ataattacatcttt

SEQ ID NO: 2968379 - DNA, 16 bp, Homo sapiens
ataattattattatta

SEQ ID NO: 2968380 - DNA, 18 bp, Homo sapiens
ataattcagtatgtttta

SEQ ID NO: 2968381 - DNA, 20 bp, Homo sapiens
ataattcagtatgttttaca

SEQ ID NO: 2968382 - DNA, 21 bp, Homo sapiens
ataattcagtatgttttacac

SEQ ID NO: 2968383 - DNA, 16 bp, Homo sapiens
ataattccatgattaa

SEQ ID NO: 2968384 - DNA, 19 bp, Homo sapiens
ataattctatactgttgat

SEQ ID NO: 2968385 - DNA, 13 bp, Homo sapiens
ataattcttattt

SEQ ID NO: 2968386 - DNA, 14 bp, Homo sapiens
ataattcttatttt

SEQ ID NO: 2968387 - DNA, 19 bp, Homo sapiens
ataattcttattttgtgga

SEQ ID NO: 2968388 - DNA, 12 bp, Homo sapiens
ataattgaagaa

SEQ ID NO: 2968389 - DNA, 13 bp, Homo sapiens
ataattgaagaat

SEQ ID NO: 2968390 - DNA, 13 bp, Homo sapiens
ataattgattaaa

SEQ ID NO: 2968391 - DNA, 15 bp, Homo sapiens
ataattgattaaaat

SEQ ID NO: 2968392 - DNA, 14 bp, Homo sapiens
ataattgcattcat

SEQ ID NO: 2968393 - DNA, 13 bp, Homo sapiens
ataattgtatcgt

SEQ ID NO: 2968394 - DNA, 20 bp, Homo sapiens
ataattgtatcgtatagctg

SEQ ID NO: 2968395 - DNA, 21 bp, Homo sapiens
ataatttcagggaaattaatc

SEQ ID NO: 2968396 - DNA, 14 bp, Homo sapiens
ataatttctaatgt

SEQ ID NO: 2968397 - DNA, 17 bp, Homo sapiens
ataatttgaactttgga

SEQ ID NO: 2968398 - DNA, 22 bp, Homo sapiens
ataatttgatagatgtttgact

SEQ ID NO: 2968399 - DNA, 18 bp, Homo sapiens
ataatttgtttaaaattc

SEQ ID NO: 2968400 - DNA, 15 bp, Homo sapiens
ataattttaaaaatg

SEQ ID NO: 2968401 - DNA, 17 bp, Homo sapiens
ataattttaaaaatggt

SEQ ID NO: 2968402 - DNA, 13 bp, Homo sapiens
ataattttgctgg

SEQ ID NO: 2968403 - DNA, 22 bp, Homo sapiens
ataattttgctggaattcctaa

SEQ ID NO: 2968404 - DNA, 13 bp, Homo sapiens
ataattttttaat

SEQ ID NO: 2968405 - DNA, 22 bp, Homo sapiens
atacaaaaacatacttcaaaaa

SEQ ID NO: 2968406 - DNA, 15 bp, Homo sapiens
atacaaaaatttgcc

SEQ ID NO: 2968407 - DNA, 22 bp, Homo sapiens
atacaaaaggtttgagattcct

SEQ ID NO: 2968408 - DNA, 17 bp, Homo sapiens
atacaaatataaatctt

SEQ ID NO: 2968409 - DNA, 17 bp, Homo sapiens
atacaaatctgtataaa

SEQ ID NO: 2968410 - DNA, 21 bp, Homo sapiens
atacaaatctgtataaatgtc

SEQ ID NO: 2968411 - DNA, 16 bp, Homo sapiens
atacaacagtgctaaa

SEQ ID NO: 2968412 - DNA, 22 bp, Homo sapiens
atacaaccctggcattatgtcc

SEQ ID NO: 2968413 - DNA, 20 bp, Homo sapiens
atacaactgtaaagcaaata

SEQ ID NO: 2968414 - DNA, 17 bp, Homo sapiens
atacaagctacagttgt

SEQ ID NO: 2968415 - DNA, 13 bp, Homo sapiens
atacaagttcttt

SEQ ID NO: 2968416 - DNA, 16 bp, Homo sapiens
atacaataatggaaaa

SEQ ID NO: 2968417 - DNA, 18 bp, Homo sapiens
atacaataatggaaaaaa

SEQ ID NO: 2968418 - DNA, 14 bp, Homo sapiens
atacaatgggaaaa

SEQ ID NO: 2968419 - DNA, 20 bp, Homo sapiens
atacaatgtatttatttaaa

SEQ ID NO: 2968420 - DNA, 20 bp, Homo sapiens
atacaattattgtatattga

SEQ ID NO: 2968421 - DNA, 13 bp, Homo sapiens
atacacacaaaaa

SEQ ID NO: 2968422 - DNA, 13 bp, Homo sapiens
atacacacacaca

SEQ ID NO: 2968423 - DNA, 14 bp, Homo sapiens
atacacacacacac

SEQ ID NO: 2968424 - DNA, 15 bp, Homo sapiens
atacacacacacaca

SEQ ID NO: 2968425 - DNA, 15 bp, Homo sapiens
atacacatttcacat

SEQ ID NO: 2968426 - DNA, 17 bp, Homo sapiens
atacaccagcattcctt

SEQ ID NO: 2968427 - DNA, 22 bp, Homo sapiens
atacacttggggagatttgcca

SEQ ID NO: 2968428 - DNA, 18 bp, Homo sapiens
atacagaactctttcaaa

SEQ ID NO: 2968429 - DNA, 13 bp, Homo sapiens
atacagagtaatt

SEQ ID NO: 2968430 - DNA, 14 bp, Homo sapiens
atacagcagcaaga

SEQ ID NO: 2968431 - DNA, 15 bp, Homo sapiens
atacagcagcaagaa

SEQ ID NO: 2968432 - DNA, 15 bp, Homo sapiens
atacagcagtagaca

SEQ ID NO: 2968433 - DNA, 13 bp, Homo sapiens
atacagctttctg

SEQ ID NO: 2968434 - DNA, 18 bp, Homo sapiens
atacagtaactttatgtg

SEQ ID NO: 2968435 - DNA, 19 bp, Homo sapiens
atacagtaactttatgtgt

SEQ ID NO: 2968436 - DNA, 15 bp, Homo sapiens
atacagtacaggcag

SEQ ID NO: 2968437 - DNA, 22 bp, Homo sapiens
atattatttctaggaagaattt

SEQ ID NO: 2968438 - DNA, 15 bp, Homo sapiens
atattcaacacactg

SEQ ID NO: 2968439 - DNA, 16 bp, Homo sapiens
atattcaacacactgc

SEQ ID NO: 2968440 - DNA, 17 bp, Homo sapiens
atattcaccaatgttgt

SEQ ID NO: 2968441 - DNA, 12 bp, Homo sapiens
atattcctttga

SEQ ID NO: 2968442 - DNA, 20 bp, Homo sapiens
atattctgataatgtattgc

SEQ ID NO: 2968443 - DNA, 24 bp, Homo sapiens
atattctgataatgtattgcagtg

SEQ ID NO: 2968444 - DNA, 13 bp, Homo sapiens
atattctgtacat

SEQ ID NO: 2968445 - DNA, 23 bp, Homo sapiens
atattcttcacgcagagattttc

SEQ ID NO: 2968446 - DNA, 18 bp, Homo sapiens
atattgaatataatatat

SEQ ID NO: 2968447 - DNA, 15 bp, Homo sapiens
atattgaccatgtga

SEQ ID NO: 2968448 - DNA, 16 bp, Homo sapiens
atattgaccatgtgat

SEQ ID NO: 2968449 - DNA, 17 bp, Homo sapiens
atattgaccatgtgatt

SEQ ID NO: 2968450 - DNA, 22 bp, Homo sapiens
atattgaccatgtgattatgga

SEQ ID NO: 2968451 - DNA, 18 bp, Homo sapiens
atattgcaggagacattt

SEQ ID NO: 2968452 - DNA, 20 bp, Homo sapiens
atattgcaggagacattttc

SEQ ID NO: 2968453 - DNA, 17 bp, Homo sapiens
atattgcccaggctggt

SEQ ID NO: 2968454 - DNA, 17 bp, Homo sapiens
atattgctgtatagctc

SEQ ID NO: 2968455 - DNA, 12 bp, Homo sapiens
atattgtaaata

SEQ ID NO: 2968456 - DNA, 12 bp, Homo sapiens
atattgtacact

SEQ ID NO: 2968457 - DNA, 14 bp, Homo sapiens
atattgtacacttt

SEQ ID NO: 2968458 - DNA, 20 bp, Homo sapiens
atattgtattgctgctgtgc

SEQ ID NO: 2968459 - DNA, 21 bp, Homo sapiens
atattgtcatgtttattctaa

SEQ ID NO: 2968460 - DNA, 19 bp, Homo sapiens
atattgtcctaagtgtcaa

SEQ ID NO: 2968461 - DNA, 18 bp, Homo sapiens
atattgtctgtaaaaaat

SEQ ID NO: 2968462 - DNA, 14 bp, Homo sapiens
atattgtgaacatt

SEQ ID NO: 2968463 - DNA, 13 bp, Homo sapiens
atattgtgtttgt

SEQ ID NO: 2968464 - DNA, 21 bp, Homo sapiens
atattgttagtggacttgttt

SEQ ID NO: 2968465 - DNA, 18 bp, Homo sapiens
atattgtttctttatcac

SEQ ID NO: 2968466 - DNA, 16 bp, Homo sapiens
atatttaaaaatgtct

SEQ ID NO: 2968467 - DNA, 17 bp, Homo sapiens
atatttaaaaatgtctt

SEQ ID NO: 2968468 - DNA, 18 bp, Homo sapiens
atatttaaaaatgtcttg

SEQ ID NO: 2968469 - DNA, 22 bp, Homo sapiens
atatttaaaagacaaacacctt

SEQ ID NO: 2968470 - DNA, 22 bp, Homo sapiens
atatttaaacctttttcttgat

SEQ ID NO: 2968471 - DNA, 22 bp, Homo sapiens
atatttaaggtatacaacatga

SEQ ID NO: 2968472 - DNA, 21 bp, Homo sapiens
atatttaagtataaaatacaa

SEQ ID NO: 2968473 - DNA, 13 bp, Homo sapiens
atatttaatgttt

SEQ ID NO: 2968474 - DNA, 22 bp, Homo sapiens
atatttaatgttttaaatgtac

SEQ ID NO: 2968475 - DNA, 15 bp, Homo sapiens
atatttacttactgc

SEQ ID NO: 2968476 - DNA, 15 bp, Homo sapiens
atatttagcaaataa

SEQ ID NO: 2968477 - DNA, 22 bp, Homo sapiens
atatttagcataaatttaatgt

SEQ ID NO: 2968478 - DNA, 17 bp, Homo sapiens
atatttagtattgaata

SEQ ID NO: 2968479 - DNA, 12 bp, Homo sapiens
atatttatccaa

SEQ ID NO: 2968480 - DNA, 22 bp, Homo sapiens
atatttatgaccagagcaaaaa

SEQ ID NO: 2968481 - DNA, 19 bp, Homo sapiens
atatttatggggggagaac

SEQ ID NO: 2968482 - DNA, 13 bp, Homo sapiens
atatttattggat

SEQ ID NO: 2968483 - DNA, 18 bp, Homo sapiens
atatttcaataaatgata

SEQ ID NO: 2968484 - DNA, 23 bp, Homo sapiens
atatttcagatatcaaaattcta

SEQ ID NO: 2968485 - DNA, 15 bp, Homo sapiens
atatttcagatgtaa

SEQ ID NO: 2968486 - DNA, 21 bp, Homo sapiens
atatttcagatgtaatgtttt

SEQ ID NO: 2968487 - DNA, 14 bp, Homo sapiens
atatttcagttctt

SEQ ID NO: 2968488 - DNA, 14 bp, Homo sapiens
atatttcatgtgct

SEQ ID NO: 2968489 - DNA, 19 bp, Homo sapiens
atatttcctccattcctgc

SEQ ID NO: 2968490 - DNA, 13 bp, Homo sapiens
atatttcctgact

SEQ ID NO: 2968491 - DNA, 15 bp, Homo sapiens
atatttcctgacttg

SEQ ID NO: 2968492 - DNA, 17 bp, Homo sapiens
atatttcctgacttgag

SEQ ID NO: 2968493 - DNA, 22 bp, Homo sapiens
atatttcctgacttgagtgttc

SEQ ID NO: 2968494 - DNA, 23 bp, Homo sapiens
atatttccttcaccacctcatgt

SEQ ID NO: 2968495 - DNA, 10 bp, Homo sapiens
atatttctga

SEQ ID NO: 2968496 - DNA, 13 bp, Homo sapiens
atatttcttaagt

SEQ ID NO: 2968497 - DNA, 20 bp, Homo sapiens
atatttcttaatttggataa

SEQ ID NO: 2968498 - DNA, 20 bp, Homo sapiens
atatttcttgctttcaatta

SEQ ID NO: 2968499 - DNA, 21 bp, Homo sapiens
atatttgaatgtatgcttcat

SEQ ID NO: 2968500 - DNA, 15 bp, Homo sapiens
atatttgacagacat

SEQ ID NO: 2968501 - DNA, 15 bp, Homo sapiens
atatttgatgcaaat

SEQ ID NO: 2968502 - DNA, 16 bp, Homo sapiens
atatttgtaaagctat

SEQ ID NO: 2968503 - DNA, 23 bp, Homo sapiens
atatttgtcaatttatgaatata

SEQ ID NO: 2968504 - DNA, 22 bp, Homo sapiens
atatttgtgctatagtatttga

SEQ ID NO: 2968505 - DNA, 17 bp, Homo sapiens
atatttgtgctttgaaa

SEQ ID NO: 2968506 - DNA, 15 bp, Homo sapiens
atatttgttcttata

SEQ ID NO: 2968507 - DNA, 15 bp, Homo sapiens
atattttacatctga

SEQ ID NO: 2968508 - DNA, 12 bp, Homo sapiens
atattttatact

SEQ ID NO: 2968509 - DNA, 15 bp, Homo sapiens
atattttatactgca

SEQ ID NO: 2968510 - DNA, 16 bp, Homo sapiens
atattttatactgcac

SEQ ID NO: 2968511 - DNA, 17 bp, Homo sapiens
atattttattgtatttt

SEQ ID NO: 2968512 - DNA, 15 bp, Homo sapiens
atattttatttgaaa

SEQ ID NO: 2968513 - DNA, 22 bp, Homo sapiens
atattttccctacctaagaatt

SEQ ID NO: 2968514 - DNA, 21 bp, Homo sapiens
atattttctatttctctgtgt

SEQ ID NO: 2968515 - DNA, 14 bp, Homo sapiens
atattttctatttt

SEQ ID NO: 2968516 - DNA, 14 bp, Homo sapiens
atattttgaatcaa

SEQ ID NO: 2968517 - DNA, 21 bp, Homo sapiens
atattttgttgccttcatctt

SEQ ID NO: 2968518 - DNA, 14 bp, Homo sapiens
atatttttaaaaga

SEQ ID NO: 2968519 - DNA, 12 bp, Homo sapiens
atatttttcctt

SEQ ID NO: 2968520 - DNA, 23 bp, Homo sapiens
atattttttaaaaaacacttgaa

SEQ ID NO: 2968521 - DNA, 15 bp, Homo sapiens
atattttttgtctgt

SEQ ID NO: 2968522 - DNA, 15 bp, Homo sapiens
atatttttttaactg

SEQ ID NO: 2968523 - DNA, 16 bp, Homo sapiens
atatttttttaactgt

SEQ ID NO: 2968524 - DNA, 14 bp, Homo sapiens
atcaaaagacaatt

SEQ ID NO: 2968525 - DNA, 16 bp, Homo sapiens
atcaaaagacaattct

SEQ ID NO: 2968526 - DNA, 19 bp, Homo sapiens
atcaaaagacaattcttta

SEQ ID NO: 2968527 - DNA, 21 bp, Homo sapiens
atcaaaagtgatcagcaatga

SEQ ID NO: 2968528 - DNA, 12 bp, Homo sapiens
atcaaaatgctt

SEQ ID NO: 2968529 - DNA, 17 bp, Homo sapiens
atcaaacaaccttcagc

SEQ ID NO: 2968530 - DNA, 15 bp, Homo sapiens
atcaaacacaacaca

SEQ ID NO: 2968531 - DNA, 12 bp, Homo sapiens
atcaaacatgaa

SEQ ID NO: 2968532 - DNA, 13 bp, Homo sapiens
atcaaacatgaaa

SEQ ID NO: 2968533 - DNA, 17 bp, Homo sapiens
atcaaagaataagaaaa

SEQ ID NO: 2968534 - DNA, 24 bp, Homo sapiens
atcaaagccggcctgagaaacact

SEQ ID NO: 2968535 - DNA, 15 bp, Homo sapiens
atcaaagttctgctt

SEQ ID NO: 2968536 - DNA, 20 bp, Homo sapiens
atcaaatagaaccactatga

SEQ ID NO: 2968537 - DNA, 13 bp, Homo sapiens
atcaaatattaga

SEQ ID NO: 2968538 - DNA, 15 bp, Homo sapiens
atcaaatattagatg

SEQ ID NO: 2968539 - DNA, 23 bp, Homo sapiens
atcaaatgagcatctcaaatgtt

SEQ ID NO: 2968540 - DNA, 20 bp, Homo sapiens
atcaaatggtagctgaaaaa

SEQ ID NO: 2968541 - DNA, 16 bp, Homo sapiens
atcaacaaaaattgtc

SEQ ID NO: 2968542 - DNA, 21 bp, Homo sapiens
atcaacattcttgtgtctgtt

SEQ ID NO: 2968543 - DNA, 14 bp, Homo sapiens
atcaacatttctca

SEQ ID NO: 2968544 - DNA, 16 bp, Homo sapiens
atcaacctatcaaagc

SEQ ID NO: 2968545 - DNA, 16 bp, Homo sapiens
atcaacctgcacttca

SEQ ID NO: 2968546 - DNA, 13 bp, Homo sapiens
atcaactttttat

SEQ ID NO: 2968547 - DNA, 20 bp, Homo sapiens
atcaactttttattgccttc

SEQ ID NO: 2968548 - DNA, 21 bp, Homo sapiens
atcaactttttattgccttct

SEQ ID NO: 2968549 - DNA, 22 bp, Homo sapiens
atcaactttttattgccttctc

SEQ ID NO: 2968550 - DNA, 13 bp, Homo sapiens
atcaagacatagc

SEQ ID NO: 2968551 - DNA, 13 bp, Homo sapiens
atcaagagactga

SEQ ID NO: 2968552 - DNA, 16 bp, Homo sapiens
atcaagaggctgagac

SEQ ID NO: 2968553 - DNA, 17 bp, Homo sapiens
atcaagaggctgagaca

SEQ ID NO: 2968554 - DNA, 20 bp, Homo sapiens
atcaagagtctctccagcct

SEQ ID NO: 2968555 - DNA, 21 bp, Homo sapiens
atcaagagtctctccagcctc

SEQ ID NO: 2968556 - DNA, 15 bp, Homo sapiens
atcaagcacttccca

SEQ ID NO: 2968557 - DNA, 18 bp, Homo sapiens
atcaagcaggttagagaa

SEQ ID NO: 2968558 - DNA, 19 bp, Homo sapiens
atcaagcatgaaaggcttt

SEQ ID NO: 2968559 - DNA, 15 bp, Homo sapiens
atcaagtacctatat

SEQ ID NO: 2968560 - DNA, 21 bp, Homo sapiens
atcaagtagaacaaaaactat

SEQ ID NO: 2968561 - DNA, 16 bp, Homo sapiens
atcaagtatttgggaa

SEQ ID NO: 2968562 - DNA, 13 bp, Homo sapiens
atcaagtctgttt

SEQ ID NO: 2968563 - DNA, 16 bp, Homo sapiens
atcaagtgttctaaaa

SEQ ID NO: 2968564 - DNA, 17 bp, Homo sapiens
atcaagttttaagtgaa

SEQ ID NO: 2968565 - DNA, 16 bp, Homo sapiens
atcaataatatatttt

SEQ ID NO: 2968566 - DNA, 18 bp, Homo sapiens
atcaataatatattttct

SEQ ID NO: 2968567 - DNA, 13 bp, Homo sapiens
atcaatcaaaccc

SEQ ID NO: 2968568 - DNA, 21 bp, Homo sapiens
atcaatctgtaaaactaagaa

SEQ ID NO: 2968569 - DNA, 12 bp, Homo sapiens
atcaatgacaga

SEQ ID NO: 2968570 - DNA, 20 bp, Homo sapiens
atcctatgtttttgttcaaa

SEQ ID NO: 2968571 - DNA, 18 bp, Homo sapiens
atcctattacttttcatc

SEQ ID NO: 2968572 - DNA, 19 bp, Homo sapiens
atcctattacttttcatct

SEQ ID NO: 2968573 - DNA, 20 bp, Homo sapiens
atcctcagtgcaaaatgtct

SEQ ID NO: 2968574 - DNA, 23 bp, Homo sapiens
atcctcatttggggtagctagag

SEQ ID NO: 2968575 - DNA, 19 bp, Homo sapiens
atcctccacgttctgctca

SEQ ID NO: 2968576 - DNA, 17 bp, Homo sapiens
atcctccacttgttcag

SEQ ID NO: 2968577 - DNA, 18 bp, Homo sapiens
atcctccacttgttcagg

SEQ ID NO: 2968578 - DNA, 21 bp, Homo sapiens
atcctccagtaccttgcttct

SEQ ID NO: 2968579 - DNA, 19 bp, Homo sapiens
atcctccccaccagagctg

SEQ ID NO: 2968580 - DNA, 22 bp, Homo sapiens
atcctccccaccagagctgcct

SEQ ID NO: 2968581 - DNA, 18 bp, Homo sapiens
atcctccccgctctgccg

SEQ ID NO: 2968582 - DNA, 16 bp, Homo sapiens
atcctccctggcagac

SEQ ID NO: 2968583 - DNA, 20 bp, Homo sapiens
atcctccctggcagacacaa

SEQ ID NO: 2968584 - DNA, 13 bp, Homo sapiens
atcctcctccagg

SEQ ID NO: 2968585 - DNA, 14 bp, Homo sapiens
atcctcctcctcat

SEQ ID NO: 2968586 - DNA, 22 bp, Homo sapiens
atcctcctcctcattcagacca

SEQ ID NO: 2968587 - DNA, 16 bp, Homo sapiens
atcctcctgttctgaa

SEQ ID NO: 2968588 - DNA, 14 bp, Homo sapiens
atcctcgctcccgg

SEQ ID NO: 2968589 - DNA, 21 bp, Homo sapiens
atcctcttctcaaagctggga

SEQ ID NO: 2968590 - DNA, 15 bp, Homo sapiens
atcctctttttccaa

SEQ ID NO: 2968591 - DNA, 18 bp, Homo sapiens
atcctgaaatagaggcta

SEQ ID NO: 2968592 - DNA, 21 bp, Homo sapiens
atcctgaaatagaggctaaat

SEQ ID NO: 2968593 - DNA, 14 bp, Homo sapiens
atcctgaacagcat

SEQ ID NO: 2968594 - DNA, 21 bp, Homo sapiens
atcctgactattatgttgtta

SEQ ID NO: 2968595 - DNA, 20 bp, Homo sapiens
atcctgcaagggacaggaag

SEQ ID NO: 2968596 - DNA, 10 bp, Homo sapiens
atcctgcccc

SEQ ID NO: 2968597 - DNA, 11 bp, Homo sapiens
atcctgccccc

SEQ ID NO: 2968598 - DNA, 15 bp, Homo sapiens
atcctgcccccaagt

SEQ ID NO: 2968599 - DNA, 13 bp, Homo sapiens
atcctgctaagtt

SEQ ID NO: 2968600 - DNA, 20 bp, Homo sapiens
atcctgctagcaggccccct

SEQ ID NO: 2968601 - DNA, 16 bp, Homo sapiens
atcctggaggcccagt

SEQ ID NO: 2968602 - DNA, 19 bp, Homo sapiens
atcctggaggcccagttca

SEQ ID NO: 2968603 - DNA, 21 bp, Homo sapiens
atcctggcaagaaagcttgag

SEQ ID NO: 2968604 - DNA, 18 bp, Homo sapiens
atcctgggcatccttctt

SEQ ID NO: 2968605 - DNA, 11 bp, Homo sapiens
atcctgggccc

SEQ ID NO: 2968606 - DNA, 16 bp, Homo sapiens
atcctgggcccccaga

SEQ ID NO: 2968607 - DNA, 19 bp, Homo sapiens
atcctgggcccccagagac

SEQ ID NO: 2968608 - DNA, 21 bp, Homo sapiens
atcctgggggacccaatgtag

SEQ ID NO: 2968609 - DNA, 17 bp, Homo sapiens
atcctggttagaagaaa

SEQ ID NO: 2968610 - DNA, 23 bp, Homo sapiens
atcctggttagaagaaaattaat

SEQ ID NO: 2968611 - DNA, 21 bp, Homo sapiens
atcctgtattcagacagatga

SEQ ID NO: 2968612 - DNA, 15 bp, Homo sapiens
atcctgtctttctga

SEQ ID NO: 2968613 - DNA, 18 bp, Homo sapiens
atcctgtctttctgagca

SEQ ID NO: 2968614 - DNA, 12 bp, Homo sapiens
atcctgtgaagt

SEQ ID NO: 2968615 - DNA, 13 bp, Homo sapiens
atcctgtgctaca

SEQ ID NO: 2968616 - DNA, 14 bp, Homo sapiens
atcctgtgctacag

SEQ ID NO: 2968617 - DNA, 14 bp, Homo sapiens
atcctgtgtcccct

SEQ ID NO: 2968618 - DNA, 19 bp, Homo sapiens
atcctgttggctgctgcca

SEQ ID NO: 2968619 - DNA, 19 bp, Homo sapiens
atcctgtttgtatgaaatt

SEQ ID NO: 2968620 - DNA, 14 bp, Homo sapiens
atccttacttccag

SEQ ID NO: 2968621 - DNA, 14 bp, Homo sapiens
atccttagatctgg

SEQ ID NO: 2968622 - DNA, 18 bp, Homo sapiens
atccttagatctggcatg

SEQ ID NO: 2968623 - DNA, 12 bp, Homo sapiens
atccttcccaag

SEQ ID NO: 2968624 - DNA, 18 bp, Homo sapiens
atccttcccaagtaagag

SEQ ID NO: 2968625 - DNA, 19 bp, Homo sapiens
atccttccctgtctgccag

SEQ ID NO: 2968626 - DNA, 16 bp, Homo sapiens
atccttccctttggag

SEQ ID NO: 2968627 - DNA, 23 bp, Homo sapiens
atccttctgcaactgaaattaca

SEQ ID NO: 2968628 - DNA, 21 bp, Homo sapiens
atccttgactgaagcgaacat

SEQ ID NO: 2968629 - DNA, 18 bp, Homo sapiens
atccttgagattctgaag

SEQ ID NO: 2968630 - DNA, 21 bp, Homo sapiens
atccttgagattctgaagtat

SEQ ID NO: 2968631 - DNA, 15 bp, Homo sapiens
atccttgcctgtcta

SEQ ID NO: 2968632 - DNA, 17 bp, Homo sapiens
atccttggagtcccagg

SEQ ID NO: 2968633 - DNA, 18 bp, Homo sapiens
atccttggagtcccaggg

SEQ ID NO: 2968634 - DNA, 20 bp, Homo sapiens
atccttggagtcccaggggc

SEQ ID NO: 2968635 - DNA, 13 bp, Homo sapiens
atccttgtttcaa

SEQ ID NO: 2968636 - DNA, 16 bp, Homo sapiens
atccttgtttcaaaca

SEQ ID NO: 2968637 - DNA, 22 bp, Homo sapiens
atcctttctgccccccagggct

SEQ ID NO: 2968638 - DNA, 14 bp, Homo sapiens
atcctttgttctga

SEQ ID NO: 2968639 - DNA, 16 bp, Homo sapiens
atccttttcttctatg

SEQ ID NO: 2968640 - DNA, 18 bp, Homo sapiens
atccttttgtagaatgaa

SEQ ID NO: 2968641 - DNA, 18 bp, Homo sapiens
atccttttgttttgaagc

SEQ ID NO: 2968642 - DNA, 14 bp, Homo sapiens
atcctttttctgct

SEQ ID NO: 2968643 - DNA, 13 bp, Homo sapiens
atccttttttctc

SEQ ID NO: 2968644 - DNA, 15 bp, Homo sapiens
atccttttttctctt

SEQ ID NO: 2968645 - DNA, 19 bp, Homo sapiens
atccttttttctcttctgt

SEQ ID NO: 2968646 - DNA, 23 bp, Homo sapiens
atccttttttctcttctgtccat

SEQ ID NO: 2968647 - DNA, 14 bp, Homo sapiens
atcgacccccaagg

SEQ ID NO: 2968648 - DNA, 16 bp, Homo sapiens
atcgactcaaaaataa

SEQ ID NO: 2968649 - DNA, 20 bp, Homo sapiens
atcgagcatgttgttttttc

SEQ ID NO: 2968650 - DNA, 14 bp, Homo sapiens
atcgatatgaaaaa

SEQ ID NO: 2968651 - DNA, 22 bp, Homo sapiens
atcgcaccactgcactccagcc

SEQ ID NO: 2968652 - DNA, 15 bp, Homo sapiens
atcgcatcccggctg

SEQ ID NO: 2968653 - DNA, 20 bp, Homo sapiens
atcgccccaactccaacctc

SEQ ID NO: 2968654 - DNA, 15 bp, Homo sapiens
atcgccccaccgcag

SEQ ID NO: 2968655 - DNA, 15 bp, Homo sapiens
atcgccttatgagaa

SEQ ID NO: 2968656 - DNA, 21 bp, Homo sapiens
atcgccttatgagaacatggt

SEQ ID NO: 2968657 - DNA, 20 bp, Homo sapiens
atcgcggcggagctggcccc

SEQ ID NO: 2968658 - DNA, 15 bp, Homo sapiens
atcgctcccttggct

SEQ ID NO: 2968659 - DNA, 19 bp, Homo sapiens
atcgcttgaacctgggaag

SEQ ID NO: 2968660 - DNA, 18 bp, Homo sapiens
atcggagtcagccaggag

SEQ ID NO: 2968661 - DNA, 12 bp, Homo sapiens
atcggccctgtc

SEQ ID NO: 2968662 - DNA, 14 bp, Homo sapiens
atcggccctgtccc

SEQ ID NO: 2968663 - DNA, 15 bp, Homo sapiens
atcggccctgtcccc

SEQ ID NO: 2968664 - DNA, 15 bp, Homo sapiens
atcggtcatgtgtgt

SEQ ID NO: 2968665 - DNA, 19 bp, Homo sapiens
atcggtcatgtgtgtattt

SEQ ID NO: 2968666 - DNA, 18 bp, Homo sapiens
atcgtatagctgtattga

SEQ ID NO: 2968667 - DNA, 18 bp, Homo sapiens
atcgtattaaaaaacaat

SEQ ID NO: 2968668 - DNA, 16 bp, Homo sapiens
atcgtcataggcttct

SEQ ID NO: 2968669 - DNA, 17 bp, Homo sapiens
atcgtcataggcttctg

SEQ ID NO: 2968670 - DNA, 13 bp, Homo sapiens
atcgtccagggag

SEQ ID NO: 2968671 - DNA, 15 bp, Homo sapiens
atcgtcccctccccc

SEQ ID NO: 2968672 - DNA, 17 bp, Homo sapiens
atcgtgacgctgaataa

SEQ ID NO: 2968673 - DNA, 18 bp, Homo sapiens
atcgtgacgctgaataaa

SEQ ID NO: 2968674 - DNA, 22 bp, Homo sapiens
atcgtgacgctgaataaatgtc

SEQ ID NO: 2968675 - DNA, 19 bp, Homo sapiens
atcgtgccgttactctcca

SEQ ID NO: 2968676 - DNA, 23 bp, Homo sapiens
atcgtgccgttactctccaacct

SEQ ID NO: 2968677 - DNA, 21 bp, Homo sapiens
atcgtggatgtctctgacaaa

SEQ ID NO: 2968678 - DNA, 16 bp, Homo sapiens
atcgttattataaatg

SEQ ID NO: 2968679 - DNA, 22 bp, Homo sapiens
atcgttattataaatgttagtt

SEQ ID NO: 2968680 - DNA, 16 bp, Homo sapiens
atcgtttaatgtttat

SEQ ID NO: 2968681 - DNA, 12 bp, Homo sapiens
atctaaagttat

SEQ ID NO: 2968682 - DNA, 15 bp, Homo sapiens
atctaaagttatatt

SEQ ID NO: 2968683 - DNA, 18 bp, Homo sapiens
atctaaagttatatttca

SEQ ID NO: 2968684 - DNA, 15 bp, Homo sapiens
atctaaattgaataa

SEQ ID NO: 2968685 - DNA, 13 bp, Homo sapiens
atctaaattgatc

SEQ ID NO: 2968686 - DNA, 19 bp, Homo sapiens
atctaagaatacagctttc

SEQ ID NO: 2968687 - DNA, 11 bp, Homo sapiens
atctaaggata

SEQ ID NO: 2968688 - DNA, 15 bp, Homo sapiens
atctaatacctctgt

SEQ ID NO: 2968689 - DNA, 19 bp, Homo sapiens
atctaatacctctgtgtgc

SEQ ID NO: 2968690 - DNA, 23 bp, Homo sapiens
atctaatatggccacagtagtct

SEQ ID NO: 2968691 - DNA, 17 bp, Homo sapiens
atctaatcctttaatga

SEQ ID NO: 2968692 - DNA, 16 bp, Homo sapiens
atctaattcttatttt

SEQ ID NO: 2968693 - DNA, 21 bp, Homo sapiens
atctaattcttatttttaatt

SEQ ID NO: 2968694 - DNA, 20 bp, Homo sapiens
atctacatcttttttcacaa

SEQ ID NO: 2968695 - DNA, 14 bp, Homo sapiens
atctacatgtgttt

SEQ ID NO: 2968696 - DNA, 12 bp, Homo sapiens
atctacatttgt

SEQ ID NO: 2968697 - DNA, 18 bp, Homo sapiens
atctacccagtcatgtac

SEQ ID NO: 2968698 - DNA, 16 bp, Homo sapiens
atctacccgtgcctgg

SEQ ID NO: 2968699 - DNA, 18 bp, Homo sapiens
atctacctgcaacacaac

SEQ ID NO: 2968700 - DNA, 15 bp, Homo sapiens
atctactaattccac

SEQ ID NO: 2968701 - DNA, 19 bp, Homo sapiens
atctactaattccacacct

SEQ ID NO: 2968702 - DNA, 13 bp, Homo sapiens
atctacttttttt

SEQ ID NO: 2968703 - DNA, 17 bp, Homo sapiens
atgatagtaagaaaagt

SEQ ID NO: 2968704 - DNA, 19 bp, Homo sapiens
atgatagttttctagatga

SEQ ID NO: 2968705 - DNA, 16 bp, Homo sapiens
atgatcagcaaaaaga

SEQ ID NO: 2968706 - DNA, 22 bp, Homo sapiens
atgatccacccacctcagcctc

SEQ ID NO: 2968707 - DNA, 15 bp, Homo sapiens
atgatcgctgtattt

SEQ ID NO: 2968708 - DNA, 22 bp, Homo sapiens
atgatcgctgtattttgagttt

SEQ ID NO: 2968709 - DNA, 15 bp, Homo sapiens
atgatctccctgccg

SEQ ID NO: 2968710 - DNA, 13 bp, Homo sapiens
atgatgaaaatat

SEQ ID NO: 2968711 - DNA, 15 bp, Homo sapiens
atgatgaaaatattt

SEQ ID NO: 2968712 - DNA, 12 bp, Homo sapiens
atgatgaatgag

SEQ ID NO: 2968713 - DNA, 11 bp, Homo sapiens
atgatgacaat

SEQ ID NO: 2968714 - DNA, 17 bp, Homo sapiens
atgatgaggatctgaaa

SEQ ID NO: 2968715 - DNA, 16 bp, Homo sapiens
atgatgataataataa

SEQ ID NO: 2968716 - DNA, 14 bp, Homo sapiens
atgatgatgatgat

SEQ ID NO: 2968717 - DNA, 15 bp, Homo sapiens
atgatgatgatgata

SEQ ID NO: 2968718 - DNA, 20 bp, Homo sapiens
atgatgcaaccaaaagggaa

SEQ ID NO: 2968719 - DNA, 14 bp, Homo sapiens
atgatgctcagttt

SEQ ID NO: 2968720 - DNA, 19 bp, Homo sapiens
atgatggaacagtgaaagt

SEQ ID NO: 2968721 - DNA, 15 bp, Homo sapiens
atgatggatgccaat

SEQ ID NO: 2968722 - DNA, 19 bp, Homo sapiens
atgatggatgccaatatta

SEQ ID NO: 2968723 - DNA, 17 bp, Homo sapiens
atgatgggaaaatattt

SEQ ID NO: 2968724 - DNA, 17 bp, Homo sapiens
atgatgggctccccagg

SEQ ID NO: 2968725 - DNA, 18 bp, Homo sapiens
atgatgggcttttgttct

SEQ ID NO: 2968726 - DNA, 14 bp, Homo sapiens
atgatgtgtatata

SEQ ID NO: 2968727 - DNA, 15 bp, Homo sapiens
atgatgttatcttaa

SEQ ID NO: 2968728 - DNA, 20 bp, Homo sapiens
atgatgttatcttaacactg

SEQ ID NO: 2968729 - DNA, 21 bp, Homo sapiens
atgatgttatcttaacactga

SEQ ID NO: 2968730 - DNA, 15 bp, Homo sapiens
atgatgttgataatt

SEQ ID NO: 2968731 - DNA, 19 bp, Homo sapiens
atgatgtttcttttgcaat

SEQ ID NO: 2968732 - DNA, 19 bp, Homo sapiens
atgattaaataagattcta

SEQ ID NO: 2968733 - DNA, 13 bp, Homo sapiens
atgattaatcagc

SEQ ID NO: 2968734 - DNA, 14 bp, Homo sapiens
atgattagcaagtt

SEQ ID NO: 2968735 - DNA, 14 bp, Homo sapiens
atgattcaggtgca

SEQ ID NO: 2968736 - DNA, 16 bp, Homo sapiens
atgattcagtgttaaa

SEQ ID NO: 2968737 - DNA, 21 bp, Homo sapiens
atgattctagtacataattga

SEQ ID NO: 2968738 - DNA, 22 bp, Homo sapiens
atgattctatttatatgtacat

SEQ ID NO: 2968739 - DNA, 14 bp, Homo sapiens
atgattctctgtgg

SEQ ID NO: 2968740 - DNA, 16 bp, Homo sapiens
atgattctctgtggtt

SEQ ID NO: 2968741 - DNA, 15 bp, Homo sapiens
atgattgtttgcaca

SEQ ID NO: 2968742 - DNA, 20 bp, Homo sapiens
atgatttataaacagacaat

SEQ ID NO: 2968743 - DNA, 20 bp, Homo sapiens
atgatttccaaagagaaaaa

SEQ ID NO: 2968744 - DNA, 21 bp, Homo sapiens
atgatttccctccagagaaag

SEQ ID NO: 2968745 - DNA, 23 bp, Homo sapiens
atgatttccctccagagaaagca

SEQ ID NO: 2968746 - DNA, 20 bp, Homo sapiens
atgatttccttgaatgtggc

SEQ ID NO: 2968747 - DNA, 21 bp, Homo sapiens
atgatttccttgaatgtggct

SEQ ID NO: 2968748 - DNA, 16 bp, Homo sapiens
atgatttgtacttgga

SEQ ID NO: 2968749 - DNA, 17 bp, Homo sapiens
atgatttgtacttggaa

SEQ ID NO: 2968750 - DNA, 14 bp, Homo sapiens
atgatttgttttga

SEQ ID NO: 2968751 - DNA, 19 bp, Homo sapiens
atgatttgttttgaatttt

SEQ ID NO: 2968752 - DNA, 18 bp, Homo sapiens
atgatttttgtgtatcca

SEQ ID NO: 2968753 - DNA, 21 bp, Homo sapiens
atgattttttaagtctatgtt

SEQ ID NO: 2968754 - DNA, 21 bp, Homo sapiens
atgcaaaaaagaaacaataaa

SEQ ID NO: 2968755 - DNA, 12 bp, Homo sapiens
atgcaaaagaaa

SEQ ID NO: 2968756 - DNA, 16 bp, Homo sapiens
atgcaaaagaaagcaa

SEQ ID NO: 2968757 - DNA, 14 bp, Homo sapiens
atgcaaaagtgggg

SEQ ID NO: 2968758 - DNA, 15 bp, Homo sapiens
atgcaaagaggcaag

SEQ ID NO: 2968759 - DNA, 16 bp, Homo sapiens
atgcaaagaggcaaga

SEQ ID NO: 2968760 - DNA, 19 bp, Homo sapiens
atgcaaatcctatgtgatt

SEQ ID NO: 2968761 - DNA, 14 bp, Homo sapiens
atgcaaccaaaagg

SEQ ID NO: 2968762 - DNA, 14 bp, Homo sapiens
atgcaagcagagga

SEQ ID NO: 2968763 - DNA, 14 bp, Homo sapiens
atgcaagctctgga

SEQ ID NO: 2968764 - DNA, 22 bp, Homo sapiens
atgcaaggattacagaaactga

SEQ ID NO: 2968765 - DNA, 16 bp, Homo sapiens
atgcaagggtgacatc

SEQ ID NO: 2968766 - DNA, 13 bp, Homo sapiens
atgcaagtgctgt

SEQ ID NO: 2968767 - DNA, 20 bp, Homo sapiens
atgcaagtgggagatgaaaa

SEQ ID NO: 2968768 - DNA, 21 bp, Homo sapiens
atgcaagtgggagatgaaaac

SEQ ID NO: 2968769 - DNA, 17 bp, Homo sapiens
atgcaatgtgctactga

SEQ ID NO: 2968770 - DNA, 20 bp, Homo sapiens
atgcaattttgcatttgaat

SEQ ID NO: 2968771 - DNA, 18 bp, Homo sapiens
atgcacacggctggtcac

SEQ ID NO: 2968772 - DNA, 22 bp, Homo sapiens
atgcacacggctggtcactctg

SEQ ID NO: 2968773 - DNA, 18 bp, Homo sapiens
atgcacatatggactctg

SEQ ID NO: 2968774 - DNA, 19 bp, Homo sapiens
atgcaccaaataggatcat

SEQ ID NO: 2968775 - DNA, 15 bp, Homo sapiens
atgcacccctggaac

SEQ ID NO: 2968776 - DNA, 13 bp, Homo sapiens
atgcacctaaaat

SEQ ID NO: 2968777 - DNA, 16 bp, Homo sapiens
atgcaccttgtgtctg

SEQ ID NO: 2968778 - DNA, 14 bp, Homo sapiens
atgcactatgtata

SEQ ID NO: 2968779 - DNA, 20 bp, Homo sapiens
atgcactgtgaaggaccctt

SEQ ID NO: 2968780 - DNA, 22 bp, Homo sapiens
atgcactgttccccctgtgcag

SEQ ID NO: 2968781 - DNA, 19 bp, Homo sapiens
atgcacttataattttcct

SEQ ID NO: 2968782 - DNA, 13 bp, Homo sapiens
atgcagaaaaaga

SEQ ID NO: 2968783 - DNA, 17 bp, Homo sapiens
atgcagaaaaagaaaaa

SEQ ID NO: 2968784 - DNA, 12 bp, Homo sapiens
atgcagaatgtt

SEQ ID NO: 2968785 - DNA, 15 bp, Homo sapiens
atgcagaggcctggg

SEQ ID NO: 2968786 - DNA, 15 bp, Homo sapiens
atgcagagtaagtat

SEQ ID NO: 2968787 - DNA, 16 bp, Homo sapiens
atgcagagttgacatg

SEQ ID NO: 2968788 - DNA, 16 bp, Homo sapiens
atgcagcactgctgcc

SEQ ID NO: 2968789 - DNA, 19 bp, Homo sapiens
atgcagcactgctgcctca

SEQ ID NO: 2968790 - DNA, 21 bp, Homo sapiens
atgcagcactgctgcctcagc

SEQ ID NO: 2968791 - DNA, 19 bp, Homo sapiens
atgcagcagggatgccctg

SEQ ID NO: 2968792 - DNA, 20 bp, Homo sapiens
atgcagcagggatgccctgg

SEQ ID NO: 2968793 - DNA, 21 bp, Homo sapiens
atgcagcccatttctccagaa

SEQ ID NO: 2968794 - DNA, 14 bp, Homo sapiens
atgcagctatctgg

SEQ ID NO: 2968795 - DNA, 15 bp, Homo sapiens
atgcagggagggagg

SEQ ID NO: 2968796 - DNA, 21 bp, Homo sapiens
atgcaggtctccatgaagaag

SEQ ID NO: 2968797 - DNA, 18 bp, Homo sapiens
atgcaggtttgaccagga

SEQ ID NO: 2968798 - DNA, 22 bp, Homo sapiens
atgcagtatggtacatttttca

SEQ ID NO: 2968799 - DNA, 15 bp, Homo sapiens
atgcagtttgaaatt

SEQ ID NO: 2968800 - DNA, 19 bp, Homo sapiens
atgcagtttgaaattctga

SEQ ID NO: 2968801 - DNA, 21 bp, Homo sapiens
atgcagtttgaaattctgaat

SEQ ID NO: 2968802 - DNA, 15 bp, Homo sapiens
atgcagttttcctta

SEQ ID NO: 2968803 - DNA, 20 bp, Homo sapiens
atgcataaaagggtcaaacc

SEQ ID NO: 2968804 - DNA, 22 bp, Homo sapiens
atgcataaaagggtcaaacctg

SEQ ID NO: 2968805 - DNA, 15 bp, Homo sapiens
atgcataaagtcagt

SEQ ID NO: 2968806 - DNA, 15 bp, Homo sapiens
atgcatacacacaca

SEQ ID NO: 2968807 - DNA, 22 bp, Homo sapiens
atgcatacacacacacacacag

SEQ ID NO: 2968808 - DNA, 15 bp, Homo sapiens
atgcatacatgctgc

SEQ ID NO: 2968809 - DNA, 22 bp, Homo sapiens
atgcatacgtacattcctggac

SEQ ID NO: 2968810 - DNA, 15 bp, Homo sapiens
atgcatacttcaaaa

SEQ ID NO: 2968811 - DNA, 18 bp, Homo sapiens
atgcatacttcaaaagta

SEQ ID NO: 2968812 - DNA, 18 bp, Homo sapiens
atgcatattcaacacact

SEQ ID NO: 2968813 - DNA, 21 bp, Homo sapiens
atgcatattcaacacactgcc

SEQ ID NO: 2968814 - DNA, 21 bp, Homo sapiens
atgcatcataaaacaaatccc

SEQ ID NO: 2968815 - DNA, 23 bp, Homo sapiens
atgcatccattcctcagggacag

SEQ ID NO: 2968816 - DNA, 16 bp, Homo sapiens
atgcatctctgcttag

SEQ ID NO: 2968817 - DNA, 22 bp, Homo sapiens
atgcatctctgcttagttctat

SEQ ID NO: 2968818 - DNA, 12 bp, Homo sapiens
atgcatctgttt

SEQ ID NO: 2968819 - DNA, 14 bp, Homo sapiens
atgcatcttactga

SEQ ID NO: 2968820 - DNA, 21 bp, Homo sapiens
atgcatgatccagctgtgtgt

SEQ ID NO: 2968821 - DNA, 24 bp, Homo sapiens
atgcatgatccagctgtgtgtttt

SEQ ID NO: 2968822 - DNA, 22 bp, Homo sapiens
atgcatggagtgtttgacgaag

SEQ ID NO: 2968823 - DNA, 22 bp, Homo sapiens
atgcatggtgccccaggaccag

SEQ ID NO: 2968824 - DNA, 22 bp, Homo sapiens
atgcatgttgaccatgtctatg

SEQ ID NO: 2968825 - DNA, 19 bp, Homo sapiens
atgcattagattatcaaaa

SEQ ID NO: 2968826 - DNA, 23 bp, Homo sapiens
atgcattattgacgaactggcta

SEQ ID NO: 2968827 - DNA, 14 bp, Homo sapiens
atgcattctggaga

SEQ ID NO: 2968828 - DNA, 18 bp, Homo sapiens
atgcattctggagacaga

SEQ ID NO: 2968829 - DNA, 19 bp, Homo sapiens
atgcattgatattgtgaac

SEQ ID NO: 2968830 - DNA, 21 bp, Homo sapiens
atgcattgtctgcaatggtga

SEQ ID NO: 2968831 - DNA, 20 bp, Homo sapiens
atgcatttgatttgtttagt

SEQ ID NO: 2968832 - DNA, 15 bp, Homo sapiens
atgcatttggaatta

SEQ ID NO: 2968833 - DNA, 18 bp, Homo sapiens
atgcattttgtgtacagt

SEQ ID NO: 2968834 - DNA, 16 bp, Homo sapiens
atgcatttttttagtt

SEQ ID NO: 2968835 - DNA, 18 bp, Homo sapiens
atgtatgaatacagcagc

SEQ ID NO: 2968836 - DNA, 23 bp, Homo sapiens
atgtatgaatacagcagcaagaa

SEQ ID NO: 2968837 - DNA, 15 bp, Homo sapiens
atgtatgagacagaa

SEQ ID NO: 2968838 - DNA, 15 bp, Homo sapiens
atgtatgcttcatac

SEQ ID NO: 2968839 - DNA, 16 bp, Homo sapiens
atgtatgcttcataca

SEQ ID NO: 2968840 - DNA, 20 bp, Homo sapiens
atgtatgcttcatacaggga

SEQ ID NO: 2968841 - DNA, 22 bp, Homo sapiens
atgtatggaatcccactgtatg

SEQ ID NO: 2968842 - DNA, 18 bp, Homo sapiens
atgtatgtatgagacaga

SEQ ID NO: 2968843 - DNA, 14 bp, Homo sapiens
atgtatgtgcattt

SEQ ID NO: 2968844 - DNA, 18 bp, Homo sapiens
atgtatgtgccaattttg

SEQ ID NO: 2968845 - DNA, 19 bp, Homo sapiens
atgtattaatatctccata

SEQ ID NO: 2968846 - DNA, 12 bp, Homo sapiens
atgtattagtga

SEQ ID NO: 2968847 - DNA, 19 bp, Homo sapiens
atgtattagtgatatttct

SEQ ID NO: 2968848 - DNA, 21 bp, Homo sapiens
atgtattagtgatatttctct

SEQ ID NO: 2968849 - DNA, 14 bp, Homo sapiens
atgtattgagatat

SEQ ID NO: 2968850 - DNA, 13 bp, Homo sapiens
atgtattgtacct

SEQ ID NO: 2968851 - DNA, 16 bp, Homo sapiens
atgtatttatttaaaa

SEQ ID NO: 2968852 - DNA, 14 bp, Homo sapiens
atgtatttcattgc

SEQ ID NO: 2968853 - DNA, 18 bp, Homo sapiens
atgtatttcattgctgtg

SEQ ID NO: 2968854 - DNA, 23 bp, Homo sapiens
atgtatttcattgctgtgtcaca

SEQ ID NO: 2968855 - DNA, 19 bp, Homo sapiens
atgtatttcctggatgttt

SEQ ID NO: 2968856 - DNA, 21 bp, Homo sapiens
atgtatttctatatagacttg

SEQ ID NO: 2968857 - DNA, 16 bp, Homo sapiens
atgtattttaataaca

SEQ ID NO: 2968858 - DNA, 18 bp, Homo sapiens
atgtattttgaaaacact

SEQ ID NO: 2968859 - DNA, 19 bp, Homo sapiens
atgtattttgaaaacactt

SEQ ID NO: 2968860 - DNA, 22 bp, Homo sapiens
atgtattttggaagacatatat

SEQ ID NO: 2968861 - DNA, 23 bp, Homo sapiens
atgtattttggaagacatatatt

SEQ ID NO: 2968862 - DNA, 18 bp, Homo sapiens
atgtattttttgaatcta

SEQ ID NO: 2968863 - DNA, 21 bp, Homo sapiens
atgtcaaacatgagatgtgtg

SEQ ID NO: 2968864 - DNA, 19 bp, Homo sapiens
atgtcaaagatatgttaag

SEQ ID NO: 2968865 - DNA, 22 bp, Homo sapiens
atgtcaaagtgaaagacatttc

SEQ ID NO: 2968866 - DNA, 23 bp, Homo sapiens
atgtcaaagtgaaagacatttca

SEQ ID NO: 2968867 - DNA, 19 bp, Homo sapiens
atgtcaccaccttcccagc

SEQ ID NO: 2968868 - DNA, 20 bp, Homo sapiens
atgtcagcaaatgtaaaaat

SEQ ID NO: 2968869 - DNA, 16 bp, Homo sapiens
atgtcagctgctgttg

SEQ ID NO: 2968870 - DNA, 18 bp, Homo sapiens
atgtcagctgctgttgaa

SEQ ID NO: 2968871 - DNA, 21 bp, Homo sapiens
atgtcagttggccctttaata

SEQ ID NO: 2968872 - DNA, 22 bp, Homo sapiens
atgtcattatttgataacattt

SEQ ID NO: 2968873 - DNA, 14 bp, Homo sapiens
atgtcatttgagca

SEQ ID NO: 2968874 - DNA, 15 bp, Homo sapiens
atgtccaaaatttat

SEQ ID NO: 2968875 - DNA, 14 bp, Homo sapiens
atgtccactgtgta

SEQ ID NO: 2968876 - DNA, 17 bp, Homo sapiens
atgtccactgtgtatag

SEQ ID NO: 2968877 - DNA, 22 bp, Homo sapiens
atgtccagcaccttgtgcctgg

SEQ ID NO: 2968878 - DNA, 19 bp, Homo sapiens
atgtccctgaagtcttgca

SEQ ID NO: 2968879 - DNA, 17 bp, Homo sapiens
atgtccttaaaatgtgg

SEQ ID NO: 2968880 - DNA, 17 bp, Homo sapiens
atgtcctttccatctgt

SEQ ID NO: 2968881 - DNA, 14 bp, Homo sapiens
atgtcgctgtaaat

SEQ ID NO: 2968882 - DNA, 16 bp, Homo sapiens
atgtcgtgttttcaag

SEQ ID NO: 2968883 - DNA, 23 bp, Homo sapiens
atgtcgtgttttcaaggaagaaa

SEQ ID NO: 2968884 - DNA, 20 bp, Homo sapiens
atgtctactcagcatttgat

SEQ ID NO: 2968885 - DNA, 21 bp, Homo sapiens
atgtctatgattcgtgtaatt

SEQ ID NO: 2968886 - DNA, 13 bp, Homo sapiens
atgtctctcagaa

SEQ ID NO: 2968887 - DNA, 14 bp, Homo sapiens
atgtctctgcttcc

SEQ ID NO: 2968888 - DNA, 18 bp, Homo sapiens
atgtctgaactttgggaa

SEQ ID NO: 2968889 - DNA, 19 bp, Homo sapiens
atgtctgacctgcaaaaat

SEQ ID NO: 2968890 - DNA, 21 bp, Homo sapiens
atgtctgagagaccatctcct

SEQ ID NO: 2968891 - DNA, 14 bp, Homo sapiens
atgtctgcagccct

SEQ ID NO: 2968892 - DNA, 14 bp, Homo sapiens
atgtctgcatttcg

SEQ ID NO: 2968893 - DNA, 19 bp, Homo sapiens
atgtctgctcctttcccct

SEQ ID NO: 2968894 - DNA, 12 bp, Homo sapiens
atgtctgtaaat

SEQ ID NO: 2968895 - DNA, 24 bp, Homo sapiens
atgtctgtttgctgatggtctggt

SEQ ID NO: 2968896 - DNA, 21 bp, Homo sapiens
atgtctgttttagttggaatg

SEQ ID NO: 2968897 - DNA, 23 bp, Homo sapiens
atgtcttcagtggaacacaaatg

SEQ ID NO: 2968898 - DNA, 23 bp, Homo sapiens
atgtcttgatgcatgcactgttc

SEQ ID NO: 2968899 - DNA, 20 bp, Homo sapiens
atgtcttgctgttgacatat

SEQ ID NO: 2968900 - DNA, 22 bp, Homo sapiens
atgtcttgtacatgtgtagcct

SEQ ID NO: 2968901 - DNA, 11 bp, Homo sapiens
atgtcttgtgt

SEQ ID NO: 2968902 - DNA, 19 bp, Homo sapiens
atgtctttccacttctctg

SEQ ID NO: 2968903 - DNA, 16 bp, Homo sapiens
atgtctttttaagaat

SEQ ID NO: 2968904 - DNA, 22 bp, Homo sapiens
atgtgaaaatggtccaggagaa

SEQ ID NO: 2968905 - DNA, 11 bp, Homo sapiens
atgtgaaattt

SEQ ID NO: 2968906 - DNA, 19 bp, Homo sapiens
atgtgaaatttttccacac

SEQ ID NO: 2968907 - DNA, 24 bp, Homo sapiens
atgtgaaatttttccacactatgt

SEQ ID NO: 2968908 - DNA, 16 bp, Homo sapiens
atgtgaacagcggctg

SEQ ID NO: 2968909 - DNA, 21 bp, Homo sapiens
atgtgaactctcccctcccca

SEQ ID NO: 2968910 - DNA, 23 bp, Homo sapiens
atgtgaactctcccctccccatc

SEQ ID NO: 2968911 - DNA, 12 bp, Homo sapiens
atgtgaagccaa

SEQ ID NO: 2968912 - DNA, 16 bp, Homo sapiens
atgtgaatatttgtaa

SEQ ID NO: 2968913 - DNA, 12 bp, Homo sapiens
atgtgaatcaga

SEQ ID NO: 2968914 - DNA, 15 bp, Homo sapiens
atgtgaatcagaccc

SEQ ID NO: 2968915 - DNA, 21 bp, Homo sapiens
atgtgaatcagaccctacccc

SEQ ID NO: 2968916 - DNA, 12 bp, Homo sapiens
atgtgaattttt

SEQ ID NO: 2968917 - DNA, 18 bp, Homo sapiens
atgtgaatttttatttct

SEQ ID NO: 2968918 - DNA, 11 bp, Homo sapiens
atgtgacacat

SEQ ID NO: 2968919 - DNA, 19 bp, Homo sapiens
atgtgaccatgtgaatctg

SEQ ID NO: 2968920 - DNA, 18 bp, Homo sapiens
atgtgactaaaaatgcat

SEQ ID NO: 2968921 - DNA, 14 bp, Homo sapiens
atgtgactcctgaa

SEQ ID NO: 2968922 - DNA, 22 bp, Homo sapiens
atgtgactctggcttggcctat

SEQ ID NO: 2968923 - DNA, 12 bp, Homo sapiens
atgtgactcttt

SEQ ID NO: 2968924 - DNA, 16 bp, Homo sapiens
atgtgactctttccaa

SEQ ID NO: 2968925 - DNA, 18 bp, Homo sapiens
atgtgacttcatgctata

SEQ ID NO: 2968926 - DNA, 14 bp, Homo sapiens
atgtgagagaaagt

SEQ ID NO: 2968927 - DNA, 16 bp, Homo sapiens
atgtgagaggtttgac

SEQ ID NO: 2968928 - DNA, 22 bp, Homo sapiens
atgtgaggggtagtgggatggt

SEQ ID NO: 2968929 - DNA, 19 bp, Homo sapiens
atgtgaggggtccctagca

SEQ ID NO: 2968930 - DNA, 21 bp, Homo sapiens
atgtgagtgaaagtacttcag

SEQ ID NO: 2968931 - DNA, 16 bp, Homo sapiens
atgtgatattctaaga

SEQ ID NO: 2968932 - DNA, 18 bp, Homo sapiens
atgtgatattctaagact

SEQ ID NO: 2968933 - DNA, 15 bp, Homo sapiens
atgtgatcatctttg

SEQ ID NO: 2968934 - DNA, 16 bp, Homo sapiens
atgtgatgttctaagg

SEQ ID NO: 2968935 - DNA, 21 bp, Homo sapiens
atgtgatgttctaaggctctg

SEQ ID NO: 2968936 - DNA, 15 bp, Homo sapiens
atgtgattgtggaat

SEQ ID NO: 2968937 - DNA, 14 bp, Homo sapiens
atgtgattttaact

SEQ ID NO: 2968938 - DNA, 19 bp, Homo sapiens
atgtgattttaactctgtc

SEQ ID NO: 2968939 - DNA, 20 bp, Homo sapiens
atgtgattttaactctgtct

SEQ ID NO: 2968940 - DNA, 11 bp, Homo sapiens
atgtgattttg

SEQ ID NO: 2968941 - DNA, 17 bp, Homo sapiens
atgtgcaactcttgtat

SEQ ID NO: 2968942 - DNA, 18 bp, Homo sapiens
atgtgcaattgatttctt

SEQ ID NO: 2968943 - DNA, 15 bp, Homo sapiens
atgtgcacagcccct

SEQ ID NO: 2968944 - DNA, 18 bp, Homo sapiens
atgtgcagcagattggaa

SEQ ID NO: 2968945 - DNA, 21 bp, Homo sapiens
atgtgcagcagattggaagga

SEQ ID NO: 2968946 - DNA, 16 bp, Homo sapiens
atgtgccaggcttgcc

SEQ ID NO: 2968947 - DNA, 19 bp, Homo sapiens
atgtgccaggcttgcctgg

SEQ ID NO: 2968948 - DNA, 22 bp, Homo sapiens
atgtgccccttcgcagctgaag

SEQ ID NO: 2968949 - DNA, 10 bp, Homo sapiens
atgtgcctgg

SEQ ID NO: 2968950 - DNA, 20 bp, Homo sapiens
atgtgcctgtaatctttttc

SEQ ID NO: 2968951 - DNA, 15 bp, Homo sapiens
atgtgcgtggaagtg

SEQ ID NO: 2968952 - DNA, 14 bp, Homo sapiens
atgtgctactgatt

SEQ ID NO: 2968953 - DNA, 20 bp, Homo sapiens
atgtgctactgattgtttca

SEQ ID NO: 2968954 - DNA, 13 bp, Homo sapiens
atgtgctgtgtaa

SEQ ID NO: 2968955 - DNA, 14 bp, Homo sapiens
atgtgctgtgtaaa

SEQ ID NO: 2968956 - DNA, 16 bp, Homo sapiens
atgtgctgtgtaaagt

SEQ ID NO: 2968957 - DNA, 17 bp, Homo sapiens
atgtgctgtgtaaagtt

SEQ ID NO: 2968958 - DNA, 13 bp, Homo sapiens
atgtggaaaacag

SEQ ID NO: 2968959 - DNA, 15 bp, Homo sapiens
atgtggaatataaag

SEQ ID NO: 2968960 - DNA, 16 bp, Homo sapiens
atgtggagccaggcgt

SEQ ID NO: 2968961 - DNA, 18 bp, Homo sapiens
atgtggatacagtcatta

SEQ ID NO: 2968962 - DNA, 18 bp, Homo sapiens
atgtggcaaggaaaaaca

SEQ ID NO: 2968963 - DNA, 23 bp, Homo sapiens
atgtggcagcaggcatggcttcc

SEQ ID NO: 2968964 - DNA, 16 bp, Homo sapiens
atgtggccctggcctg

SEQ ID NO: 2968965 - DNA, 20 bp, Homo sapiens
atgtggccctggcctgctgg

SEQ ID NO: 2968966 - DNA, 13 bp, Homo sapiens
atgtggcctgccc

SEQ ID NO: 2968967 - DNA, 18 bp, Homo sapiens
attcagcagcaaattttc

SEQ ID NO: 2968968 - DNA, 17 bp, Homo sapiens
attcagcggaatattga

SEQ ID NO: 2968969 - DNA, 13 bp, Homo sapiens
attcaggcactga

SEQ ID NO: 2968970 - DNA, 15 bp, Homo sapiens
attcaggggaagggc

SEQ ID NO: 2968971 - DNA, 19 bp, Homo sapiens
attcaggggaagggcaggc

SEQ ID NO: 2968972 - DNA, 12 bp, Homo sapiens
attcaggggctg

SEQ ID NO: 2968973 - DNA, 17 bp, Homo sapiens
attcaggtatgttgcct

SEQ ID NO: 2968974 - DNA, 20 bp, Homo sapiens
attcagtcttttctctgaaa

SEQ ID NO: 2968975 - DNA, 22 bp, Homo sapiens
attcagttagcagacagaagtg

SEQ ID NO: 2968976 - DNA, 18 bp, Homo sapiens
attcagttttcccacttt

SEQ ID NO: 2968977 - DNA, 21 bp, Homo sapiens
attcataactaatgaattgaa

SEQ ID NO: 2968978 - DNA, 19 bp, Homo sapiens
attcatactctgttgcctc

SEQ ID NO: 2968979 - DNA, 16 bp, Homo sapiens
attcatagtaacttct

SEQ ID NO: 2968980 - DNA, 18 bp, Homo sapiens
attcatagtaacttctta

SEQ ID NO: 2968981 - DNA, 19 bp, Homo sapiens
attcatattctgttggaag

SEQ ID NO: 2968982 - DNA, 12 bp, Homo sapiens
attcatcaaata

SEQ ID NO: 2968983 - DNA, 14 bp, Homo sapiens
attcatcaaataaa

SEQ ID NO: 2968984 - DNA, 20 bp, Homo sapiens
attcatcattttctccacct

SEQ ID NO: 2968985 - DNA, 18 bp, Homo sapiens
attcatcttttaatcatg

SEQ ID NO: 2968986 - DNA, 17 bp, Homo sapiens
attcatgaatcttgaga

SEQ ID NO: 2968987 - DNA, 13 bp, Homo sapiens
attcatgactatg

SEQ ID NO: 2968988 - DNA, 14 bp, Homo sapiens
attcatgttcatgt

SEQ ID NO: 2968989 - DNA, 18 bp, Homo sapiens
attcatgttcatgtgatt

SEQ ID NO: 2968990 - DNA, 12 bp, Homo sapiens
attcatgtttct

SEQ ID NO: 2968991 - DNA, 13 bp, Homo sapiens
attcatgtttctt

SEQ ID NO: 2968992 - DNA, 15 bp, Homo sapiens
attcatgtttcttaa

SEQ ID NO: 2968993 - DNA, 23 bp, Homo sapiens
attcattgttttgcaaaagtgta

SEQ ID NO: 2968994 - DNA, 11 bp, Homo sapiens
attcatttcta

SEQ ID NO: 2968995 - DNA, 12 bp, Homo sapiens
attcatttctaa

SEQ ID NO: 2968996 - DNA, 18 bp, Homo sapiens
attcattttatattgaaa

SEQ ID NO: 2968997 - DNA, 16 bp, Homo sapiens
attccaaaccaggaca

SEQ ID NO: 2968998 - DNA, 19 bp, Homo sapiens
attccaaagtctctaattc

SEQ ID NO: 2968999 - DNA, 19 bp, Homo sapiens
attccaactcgtatagcat

SEQ ID NO: 2969000 - DNA, 14 bp, Homo sapiens
attccaattaaatt

SEQ ID NO: 2969001 - DNA, 18 bp, Homo sapiens
attccacagatatctttt

SEQ ID NO: 2969002 - DNA, 22 bp, Homo sapiens
attccacagatatctttttcat

SEQ ID NO: 2969003 - DNA, 15 bp, Homo sapiens
attccagacgacctt

SEQ ID NO: 2969004 - DNA, 14 bp, Homo sapiens
attccagatttgtt

SEQ ID NO: 2969005 - DNA, 19 bp, Homo sapiens
attccagctcattcatttt

SEQ ID NO: 2969006 - DNA, 22 bp, Homo sapiens
attccagtcaaatctgggctca

SEQ ID NO: 2969007 - DNA, 17 bp, Homo sapiens
attccagtgtccatgtt

SEQ ID NO: 2969008 - DNA, 15 bp, Homo sapiens
attccagttgcaatt

SEQ ID NO: 2969009 - DNA, 16 bp, Homo sapiens
attccatagtggacca

SEQ ID NO: 2969010 - DNA, 17 bp, Homo sapiens
attccatagtggaccac

SEQ ID NO: 2969011 - DNA, 23 bp, Homo sapiens
attccatagtggaccacttggaa

SEQ ID NO: 2969012 - DNA, 13 bp, Homo sapiens
attccatgattaa

SEQ ID NO: 2969013 - DNA, 18 bp, Homo sapiens
attccatgttttaaaatt

SEQ ID NO: 2969014 - DNA, 16 bp, Homo sapiens
attccattggtccaag

SEQ ID NO: 2969015 - DNA, 23 bp, Homo sapiens
attccattggtccaagattccgg

SEQ ID NO: 2969016 - DNA, 14 bp, Homo sapiens
attcccactgccag

SEQ ID NO: 2969017 - DNA, 15 bp, Homo sapiens
attcccactgccagg

SEQ ID NO: 2969018 - DNA, 16 bp, Homo sapiens
attcccagagacagga

SEQ ID NO: 2969019 - DNA, 15 bp, Homo sapiens
attcccaggccaggg

SEQ ID NO: 2969020 - DNA, 21 bp, Homo sapiens
attcccaggccagggctgggt

SEQ ID NO: 2969021 - DNA, 22 bp, Homo sapiens
attcccaggccagggctgggtc

SEQ ID NO: 2969022 - DNA, 22 bp, Homo sapiens
attccccaggtggctgacccag

SEQ ID NO: 2969023 - DNA, 15 bp, Homo sapiens
attccccatatttgt

SEQ ID NO: 2969024 - DNA, 21 bp, Homo sapiens
attccccctgccctgtgccgc

SEQ ID NO: 2969025 - DNA, 20 bp, Homo sapiens
attcccgggcccttcagtcc

SEQ ID NO: 2969026 - DNA, 19 bp, Homo sapiens
attcccggtcagcagtatc

SEQ ID NO: 2969027 - DNA, 21 bp, Homo sapiens
attccctagaaacttccaaat

SEQ ID NO: 2969028 - DNA, 12 bp, Homo sapiens
attccctcccca

SEQ ID NO: 2969029 - DNA, 14 bp, Homo sapiens
attccctcctgcta

SEQ ID NO: 2969030 - DNA, 22 bp, Homo sapiens
attccgcgcggagacctcctga

SEQ ID NO: 2969031 - DNA, 16 bp, Homo sapiens
attccggatcctaagc

SEQ ID NO: 2969032 - DNA, 19 bp, Homo sapiens
attccgttgtctgtggatg

SEQ ID NO: 2969033 - DNA, 18 bp, Homo sapiens
attcctaaagaaaaatat

SEQ ID NO: 2969034 - DNA, 19 bp, Homo sapiens
attcctaaatattttcaag

SEQ ID NO: 2969035 - DNA, 21 bp, Homo sapiens
attcctacaacttaatggaaa

SEQ ID NO: 2969036 - DNA, 17 bp, Homo sapiens
attcctcaacgtattgt

SEQ ID NO: 2969037 - DNA, 14 bp, Homo sapiens
attcctcagggaca

SEQ ID NO: 2969038 - DNA, 13 bp, Homo sapiens
attcctctttgct

SEQ ID NO: 2969039 - DNA, 16 bp, Homo sapiens
attcctctttgctttg

SEQ ID NO: 2969040 - DNA, 20 bp, Homo sapiens
attcctgatatgatttaaaa

SEQ ID NO: 2969041 - DNA, 16 bp, Homo sapiens
attcctgtaaatgtga

SEQ ID NO: 2969042 - DNA, 15 bp, Homo sapiens
attcctgtaactttt

SEQ ID NO: 2969043 - DNA, 18 bp, Homo sapiens
attcctgtaacttttaat

SEQ ID NO: 2969044 - DNA, 13 bp, Homo sapiens
attcctgtatgtt

SEQ ID NO: 2969045 - DNA, 15 bp, Homo sapiens
attcctgtccttcac

SEQ ID NO: 2969046 - DNA, 16 bp, Homo sapiens
attcctgttctttctt

SEQ ID NO: 2969047 - DNA, 22 bp, Homo sapiens
attccttcagggtgatgccagg

SEQ ID NO: 2969048 - DNA, 18 bp, Homo sapiens
attcctttgtgtttctat

SEQ ID NO: 2969049 - DNA, 18 bp, Homo sapiens
attcctttttcttcactt

SEQ ID NO: 2969050 - DNA, 16 bp, Homo sapiens
attcgaatgacactgt

SEQ ID NO: 2969051 - DNA, 16 bp, Homo sapiens
attcgctgtacccttt

SEQ ID NO: 2969052 - DNA, 18 bp, Homo sapiens
attcgctgtcccctcagc

SEQ ID NO: 2969053 - DNA, 18 bp, Homo sapiens
attcgttttttacctgtt

SEQ ID NO: 2969054 - DNA, 21 bp, Homo sapiens
attctaaacagatgtccctga

SEQ ID NO: 2969055 - DNA, 20 bp, Homo sapiens
attctaaagattctatagtt

SEQ ID NO: 2969056 - DNA, 12 bp, Homo sapiens
attctaaatgta

SEQ ID NO: 2969057 - DNA, 13 bp, Homo sapiens
attctacacagag

SEQ ID NO: 2969058 - DNA, 15 bp, Homo sapiens
attctactaagttat

SEQ ID NO: 2969059 - DNA, 16 bp, Homo sapiens
attctactaagttatt

SEQ ID NO: 2969060 - DNA, 23 bp, Homo sapiens
attctactaagttattttatgac

SEQ ID NO: 2969061 - DNA, 17 bp, Homo sapiens
attctactaatgtgatg

SEQ ID NO: 2969062 - DNA, 19 bp, Homo sapiens
attctagctgtatgatttg

SEQ ID NO: 2969063 - DNA, 19 bp, Homo sapiens
attctaggcctcctggccc

SEQ ID NO: 2969064 - DNA, 21 bp, Homo sapiens
attctagggtttcttaaatat

SEQ ID NO: 2969065 - DNA, 22 bp, Homo sapiens
attctagtacataattgattaa

SEQ ID NO: 2969066 - DNA, 17 bp, Homo sapiens
attctagttttgtcaaa

SEQ ID NO: 2969067 - DNA, 15 bp, Homo sapiens
attctataaggccat

SEQ ID NO: 2969068 - DNA, 13 bp, Homo sapiens
attctatagttct

SEQ ID NO: 2969069 - DNA, 15 bp, Homo sapiens
attctatagttctag

SEQ ID NO: 2969070 - DNA, 17 bp, Homo sapiens
attctatagttctagac

SEQ ID NO: 2969071 - DNA, 15 bp, Homo sapiens
attctattaaagtgc

SEQ ID NO: 2969072 - DNA, 15 bp, Homo sapiens
attctcaaagtttta

SEQ ID NO: 2969073 - DNA, 19 bp, Homo sapiens
attctcaaagttttattat

SEQ ID NO: 2969074 - DNA, 14 bp, Homo sapiens
attctcactccacc

SEQ ID NO: 2969075 - DNA, 16 bp, Homo sapiens
attctcactccaccac

SEQ ID NO: 2969076 - DNA, 19 bp, Homo sapiens
attctcagtgccaactgtg

SEQ ID NO: 2969077 - DNA, 15 bp, Homo sapiens
attctcataatcctt

SEQ ID NO: 2969078 - DNA, 21 bp, Homo sapiens
attctcataatccttctgcaa

SEQ ID NO: 2969079 - DNA, 16 bp, Homo sapiens
attctccacagcaacc

SEQ ID NO: 2969080 - DNA, 12 bp, Homo sapiens
attctccctggg

SEQ ID NO: 2969081 - DNA, 18 bp, Homo sapiens
attctcctcctcctccct

SEQ ID NO: 2969082 - DNA, 23 bp, Homo sapiens
attctcctcctcctccctcctca

SEQ ID NO: 2969083 - DNA, 14 bp, Homo sapiens
attctcctgcctca

SEQ ID NO: 2969084 - DNA, 19 bp, Homo sapiens
attctctattgtaattttg

SEQ ID NO: 2969085 - DNA, 12 bp, Homo sapiens
attctctcctaa

SEQ ID NO: 2969086 - DNA, 11 bp, Homo sapiens
attctctgagc

SEQ ID NO: 2969087 - DNA, 13 bp, Homo sapiens
attctctgagctg

SEQ ID NO: 2969088 - DNA, 18 bp, Homo sapiens
attctctgagctgtgcag

SEQ ID NO: 2969089 - DNA, 22 bp, Homo sapiens
attctctggctgtaaggctcta

SEQ ID NO: 2969090 - DNA, 17 bp, Homo sapiens
attctctgggtcaacaa

SEQ ID NO: 2969091 - DNA, 14 bp, Homo sapiens
attctctgtctcat

SEQ ID NO: 2969092 - DNA, 16 bp, Homo sapiens
attctctgtctcatcc

SEQ ID NO: 2969093 - DNA, 18 bp, Homo sapiens
attctctgtctcatccat

SEQ ID NO: 2969094 - DNA, 21 bp, Homo sapiens
attctctgtggttttttttga

SEQ ID NO: 2969095 - DNA, 20 bp, Homo sapiens
attctctgtgtctaagattc

SEQ ID NO: 2969096 - DNA, 21 bp, Homo sapiens
attctctgtgtctaagattct

SEQ ID NO: 2969097 - DNA, 15 bp, Homo sapiens
attctctgtttgctt

SEQ ID NO: 2969098 - DNA, 13 bp, Homo sapiens
attctcttagaca

SEQ ID NO: 2969099 - DNA, 21 bp, Homo sapiens
attctcttctttttctttttt

SEQ ID NO: 2969100 - DNA, 21 bp, Homo sapiens
attgcgtttgaccttttatgt

SEQ ID NO: 2969101 - DNA, 15 bp, Homo sapiens
attgctaattgctgt

SEQ ID NO: 2969102 - DNA, 19 bp, Homo sapiens
attgctaattgctgttgaa

SEQ ID NO: 2969103 - DNA, 15 bp, Homo sapiens
attgctattgtgtta

SEQ ID NO: 2969104 - DNA, 23 bp, Homo sapiens
attgctgagcctctgctccccag

SEQ ID NO: 2969105 - DNA, 22 bp, Homo sapiens
attgctgataccatatgaatga

SEQ ID NO: 2969106 - DNA, 20 bp, Homo sapiens
attgctgccccatcagtgct

SEQ ID NO: 2969107 - DNA, 21 bp, Homo sapiens
attgctgcccgtttgtacatg

SEQ ID NO: 2969108 - DNA, 18 bp, Homo sapiens
attgctgctccttagctg

SEQ ID NO: 2969109 - DNA, 20 bp, Homo sapiens
attgctgctccttagctgcc

SEQ ID NO: 2969110 - DNA, 20 bp, Homo sapiens
attgctgtctagccttagtc

SEQ ID NO: 2969111 - DNA, 21 bp, Homo sapiens
attgctgttgaaagcaaaaat

SEQ ID NO: 2969112 - DNA, 15 bp, Homo sapiens
attgcttcaattaaa

SEQ ID NO: 2969113 - DNA, 16 bp, Homo sapiens
attgcttcaattaaaa

SEQ ID NO: 2969114 - DNA, 10 bp, Homo sapiens
attgcttcta

SEQ ID NO: 2969115 - DNA, 18 bp, Homo sapiens
attgcttgagctcaggag

SEQ ID NO: 2969116 - DNA, 14 bp, Homo sapiens
attgctttccactg

SEQ ID NO: 2969117 - DNA, 15 bp, Homo sapiens
attgctttctgaaat

SEQ ID NO: 2969118 - DNA, 17 bp, Homo sapiens
attgctttctgaaatta

SEQ ID NO: 2969119 - DNA, 17 bp, Homo sapiens
attgctttgaaaaagtt

SEQ ID NO: 2969120 - DNA, 12 bp, Homo sapiens
attgctttgagc

SEQ ID NO: 2969121 - DNA, 13 bp, Homo sapiens
attggaaagacag

SEQ ID NO: 2969122 - DNA, 22 bp, Homo sapiens
attggaaagacaggaagaccaa

SEQ ID NO: 2969123 - DNA, 14 bp, Homo sapiens
attggaagagagaa

SEQ ID NO: 2969124 - DNA, 18 bp, Homo sapiens
attggaaggagacacaga

SEQ ID NO: 2969125 - DNA, 17 bp, Homo sapiens
attggacagatttcagt

SEQ ID NO: 2969126 - DNA, 19 bp, Homo sapiens
attggacagtaaaatccac

SEQ ID NO: 2969127 - DNA, 15 bp, Homo sapiens
attggacccttccat

SEQ ID NO: 2969128 - DNA, 18 bp, Homo sapiens
attggagtgcagctaaca

SEQ ID NO: 2969129 - DNA, 16 bp, Homo sapiens
attggataaagcagct

SEQ ID NO: 2969130 - DNA, 13 bp, Homo sapiens
attggatacagca

SEQ ID NO: 2969131 - DNA, 20 bp, Homo sapiens
attggatacagcagtagaca

SEQ ID NO: 2969132 - DNA, 21 bp, Homo sapiens
attggatttgtccaaacaggt

SEQ ID NO: 2969133 - DNA, 20 bp, Homo sapiens
attggcagttggaggacaca

SEQ ID NO: 2969134 - DNA, 12 bp, Homo sapiens
attggccaatta

SEQ ID NO: 2969135 - DNA, 12 bp, Homo sapiens
attggccctgcc

SEQ ID NO: 2969136 - DNA, 17 bp, Homo sapiens
attggccctgcccctcc

SEQ ID NO: 2969137 - DNA, 18 bp, Homo sapiens
attggccctgcccctccc

SEQ ID NO: 2969138 - DNA, 12 bp, Homo sapiens
attggcctgaac

SEQ ID NO: 2969139 - DNA, 17 bp, Homo sapiens
attggcctgaacagatg

SEQ ID NO: 2969140 - DNA, 22 bp, Homo sapiens
attggcctgaacagatgtaaat

SEQ ID NO: 2969141 - DNA, 19 bp, Homo sapiens
attggccttttacctggat

SEQ ID NO: 2969142 - DNA, 19 bp, Homo sapiens
attggctatataaaatgtg

SEQ ID NO: 2969143 - DNA, 17 bp, Homo sapiens
attggctatttaaaact

SEQ ID NO: 2969144 - DNA, 19 bp, Homo sapiens
attggctatttaaagacaa

SEQ ID NO: 2969145 - DNA, 21 bp, Homo sapiens
attggctcttgaactgagctt

SEQ ID NO: 2969146 - DNA, 16 bp, Homo sapiens
attgggaataaatatg

SEQ ID NO: 2969147 - DNA, 19 bp, Homo sapiens
attgggcagaatcctgggc

SEQ ID NO: 2969148 - DNA, 16 bp, Homo sapiens
attgggcccctgccag

SEQ ID NO: 2969149 - DNA, 15 bp, Homo sapiens
attggggtccctcta

SEQ ID NO: 2969150 - DNA, 15 bp, Homo sapiens
attggggtttgattt

SEQ ID NO: 2969151 - DNA, 18 bp, Homo sapiens
attgggtcatagaaattc

SEQ ID NO: 2969152 - DNA, 18 bp, Homo sapiens
attgggtctattccagct

SEQ ID NO: 2969153 - DNA, 19 bp, Homo sapiens
attgggtctattccagctc

SEQ ID NO: 2969154 - DNA, 18 bp, Homo sapiens
attggtcatttagagttt

SEQ ID NO: 2969155 - DNA, 15 bp, Homo sapiens
attggtccagcttgc

SEQ ID NO: 2969156 - DNA, 13 bp, Homo sapiens
attggttaatttt

SEQ ID NO: 2969157 - DNA, 15 bp, Homo sapiens
attggttaattttta

SEQ ID NO: 2969158 - DNA, 19 bp, Homo sapiens
attgtaaaccgctttggcc

SEQ ID NO: 2969159 - DNA, 22 bp, Homo sapiens
attgtaaataaattttgtgcaa

SEQ ID NO: 2969160 - DNA, 15 bp, Homo sapiens
attgtaaattatatt

SEQ ID NO: 2969161 - DNA, 21 bp, Homo sapiens
attgtaaattatatttgtgct

SEQ ID NO: 2969162 - DNA, 18 bp, Homo sapiens
attgtaaatttggattta

SEQ ID NO: 2969163 - DNA, 13 bp, Homo sapiens
attgtaactgttc

SEQ ID NO: 2969164 - DNA, 19 bp, Homo sapiens
attgtaactgttcttgaat

SEQ ID NO: 2969165 - DNA, 17 bp, Homo sapiens
attgtaaggtctttgta

SEQ ID NO: 2969166 - DNA, 19 bp, Homo sapiens
attgtaaggtctttgtaaa

SEQ ID NO: 2969167 - DNA, 15 bp, Homo sapiens
attgtaatacagaca

SEQ ID NO: 2969168 - DNA, 12 bp, Homo sapiens
attgtaatcact

SEQ ID NO: 2969169 - DNA, 15 bp, Homo sapiens
attgtaatctatgtt

SEQ ID NO: 2969170 - DNA, 16 bp, Homo sapiens
attgtaattatgtaaa

SEQ ID NO: 2969171 - DNA, 18 bp, Homo sapiens
attgtaattatgtaaata

SEQ ID NO: 2969172 - DNA, 17 bp, Homo sapiens
attgtaattttgttcct

SEQ ID NO: 2969173 - DNA, 23 bp, Homo sapiens
attgtaattttgttcctgtttat

SEQ ID NO: 2969174 - DNA, 22 bp, Homo sapiens
attgtaccttttaacacctgat

SEQ ID NO: 2969175 - DNA, 17 bp, Homo sapiens
attgtacgctagagcat

SEQ ID NO: 2969176 - DNA, 15 bp, Homo sapiens
attgtactccagcct

SEQ ID NO: 2969177 - DNA, 18 bp, Homo sapiens
attgtagaaaaacccaaa

SEQ ID NO: 2969178 - DNA, 23 bp, Homo sapiens
attgtaggataattagcagtatc

SEQ ID NO: 2969179 - DNA, 13 bp, Homo sapiens
attgtataaatta

SEQ ID NO: 2969180 - DNA, 22 bp, Homo sapiens
attgtataaattactttgattc

SEQ ID NO: 2969181 - DNA, 17 bp, Homo sapiens
attgtataacaggttat

SEQ ID NO: 2969182 - DNA, 16 bp, Homo sapiens
attgtatctcttaaag

SEQ ID NO: 2969183 - DNA, 14 bp, Homo sapiens
attgtattacaaat

SEQ ID NO: 2969184 - DNA, 15 bp, Homo sapiens
attgtattacaaatc

SEQ ID NO: 2969185 - DNA, 16 bp, Homo sapiens
attgtattactttaat

SEQ ID NO: 2969186 - DNA, 14 bp, Homo sapiens
attgtcacatcaag

SEQ ID NO: 2969187 - DNA, 15 bp, Homo sapiens
attgtcatgtttatt

SEQ ID NO: 2969188 - DNA, 18 bp, Homo sapiens
attgtccaatcctatgtt

SEQ ID NO: 2969189 - DNA, 17 bp, Homo sapiens
attgtccctctgcccca

SEQ ID NO: 2969190 - DNA, 23 bp, Homo sapiens
attgtcttcggaaaccttggtgt

SEQ ID NO: 2969191 - DNA, 13 bp, Homo sapiens
attgtctttatga

SEQ ID NO: 2969192 - DNA, 15 bp, Homo sapiens
attgtgaacagccaa

SEQ ID NO: 2969193 - DNA, 16 bp, Homo sapiens
attgtgaacatttgtg

SEQ ID NO: 2969194 - DNA, 17 bp, Homo sapiens
attgtgaccaatacatt

SEQ ID NO: 2969195 - DNA, 18 bp, Homo sapiens
attgtgaccaatacattt

SEQ ID NO: 2969196 - DNA, 19 bp, Homo sapiens
attgtgaccaatacatttg

SEQ ID NO: 2969197 - DNA, 20 bp, Homo sapiens
attgtgaccaatacatttgt

SEQ ID NO: 2969198 - DNA, 19 bp, Homo sapiens
attgtgagatgatttgtac

SEQ ID NO: 2969199 - DNA, 14 bp, Homo sapiens
attgtgatgtatat

SEQ ID NO: 2969200 - DNA, 18 bp, Homo sapiens
attgtgccatgtcaaaca

SEQ ID NO: 2969201 - DNA, 20 bp, Homo sapiens
attgtgcctgccaccaccat

SEQ ID NO: 2969202 - DNA, 18 bp, Homo sapiens
attgtggatcttgagctc

SEQ ID NO: 2969203 - DNA, 18 bp, Homo sapiens
attgtgtaaaaaatggaa

SEQ ID NO: 2969204 - DNA, 22 bp, Homo sapiens
attgtgtaaaaaatggaaaaaa

SEQ ID NO: 2969205 - DNA, 22 bp, Homo sapiens
attgtgtgcgctgcctggccag

SEQ ID NO: 2969206 - DNA, 17 bp, Homo sapiens
attgtgttattttacta

SEQ ID NO: 2969207 - DNA, 15 bp, Homo sapiens
attgttaattatgta

SEQ ID NO: 2969208 - DNA, 23 bp, Homo sapiens
attgttagatggcaatagtcatt

SEQ ID NO: 2969209 - DNA, 17 bp, Homo sapiens
attgttattttcagtga

SEQ ID NO: 2969210 - DNA, 18 bp, Homo sapiens
attgttcacctttgtagc

SEQ ID NO: 2969211 - DNA, 16 bp, Homo sapiens
attgttccctatgaaa

SEQ ID NO: 2969212 - DNA, 18 bp, Homo sapiens
attgttctttgccagaga

SEQ ID NO: 2969213 - DNA, 17 bp, Homo sapiens
attgttgacagttctga

SEQ ID NO: 2969214 - DNA, 18 bp, Homo sapiens
attgttgacagttctgaa

SEQ ID NO: 2969215 - DNA, 21 bp, Homo sapiens
attgttgacagttctgaagaa

SEQ ID NO: 2969216 - DNA, 22 bp, Homo sapiens
attgttgacagttctgaagaat

SEQ ID NO: 2969217 - DNA, 16 bp, Homo sapiens
attgttgagctattgc

SEQ ID NO: 2969218 - DNA, 19 bp, Homo sapiens
attgttgtttgccatactt

SEQ ID NO: 2969219 - DNA, 22 bp, Homo sapiens
attgttgtttgccatactttgt

SEQ ID NO: 2969220 - DNA, 19 bp, Homo sapiens
attgtttcaaaataaaaac

SEQ ID NO: 2969221 - DNA, 18 bp, Homo sapiens
attgtttgaaacaaagaa

SEQ ID NO: 2969222 - DNA, 23 bp, Homo sapiens
attgttttaaaaagaaacaagat

SEQ ID NO: 2969223 - DNA, 17 bp, Homo sapiens
atttaaaaaaaaacata

SEQ ID NO: 2969224 - DNA, 15 bp, Homo sapiens
atttaaaaaaaaaga

SEQ ID NO: 2969225 - DNA, 20 bp, Homo sapiens
atttaaaaaaaaagaattct

SEQ ID NO: 2969226 - DNA, 15 bp, Homo sapiens
atttaaaaatagaaa

SEQ ID NO: 2969227 - DNA, 16 bp, Homo sapiens
atttaaaaatagaaac

SEQ ID NO: 2969228 - DNA, 21 bp, Homo sapiens
atttaaaaatgagtgtgaagg

SEQ ID NO: 2969229 - DNA, 13 bp, Homo sapiens
atttaaaacaatc

SEQ ID NO: 2969230 - DNA, 21 bp, Homo sapiens
atttaaaacaatccttactaa

SEQ ID NO: 2969231 - DNA, 13 bp, Homo sapiens
atttaaaagacaa

SEQ ID NO: 2969232 - DNA, 19 bp, Homo sapiens
attttgaaaacccctggct

SEQ ID NO: 2969233 - DNA, 22 bp, Homo sapiens
attttgaaaacccctggctgaa

SEQ ID NO: 2969234 - DNA, 15 bp, Homo sapiens
attttgaaatgtggt

SEQ ID NO: 2969235 - DNA, 11 bp, Homo sapiens
attttgaatca

SEQ ID NO: 2969236 - DNA, 23 bp, Homo sapiens
attttgatgagatattaaattct

SEQ ID NO: 2969237 - DNA, 18 bp, Homo sapiens
attttgcacccactgaaa

SEQ ID NO: 2969238 - DNA, 15 bp, Homo sapiens
attttgcccttgaca

SEQ ID NO: 2969239 - DNA, 16 bp, Homo sapiens
attttgctctgtgaac

SEQ ID NO: 2969240 - DNA, 20 bp, Homo sapiens
attttggaattggtgtatat

SEQ ID NO: 2969241 - DNA, 19 bp, Homo sapiens
attttggactgagatttct

SEQ ID NO: 2969242 - DNA, 21 bp, Homo sapiens
attttggagagtttcctgaaa

SEQ ID NO: 2969243 - DNA, 15 bp, Homo sapiens
attttggatgtcatt

SEQ ID NO: 2969244 - DNA, 14 bp, Homo sapiens
attttgggcatgtg

SEQ ID NO: 2969245 - DNA, 21 bp, Homo sapiens
attttggtcatagcattcact

SEQ ID NO: 2969246 - DNA, 16 bp, Homo sapiens
attttggtgtgcatct

SEQ ID NO: 2969247 - DNA, 18 bp, Homo sapiens
attttggtgtgcatctgt

SEQ ID NO: 2969248 - DNA, 18 bp, Homo sapiens
attttgtatccatttaaa

SEQ ID NO: 2969249 - DNA, 16 bp, Homo sapiens
attttgtattttccaa

SEQ ID NO: 2969250 - DNA, 12 bp, Homo sapiens
attttgtgaagc

SEQ ID NO: 2969251 - DNA, 14 bp, Homo sapiens
attttgtgcaaaaa

SEQ ID NO: 2969252 - DNA, 21 bp, Homo sapiens
attttgtgcaaaaaggactgg

SEQ ID NO: 2969253 - DNA, 23 bp, Homo sapiens
attttgtgcaaaaaggactggaa

SEQ ID NO: 2969254 - DNA, 13 bp, Homo sapiens
attttgtgctctt

SEQ ID NO: 2969255 - DNA, 19 bp, Homo sapiens
attttgtgctctttcctgc

SEQ ID NO: 2969256 - DNA, 23 bp, Homo sapiens
attttgtggaggcagtgtcattt

SEQ ID NO: 2969257 - DNA, 12 bp, Homo sapiens
attttgttctgt

SEQ ID NO: 2969258 - DNA, 13 bp, Homo sapiens
attttgttgcctt

SEQ ID NO: 2969259 - DNA, 14 bp, Homo sapiens
attttgtttctgta

SEQ ID NO: 2969260 - DNA, 16 bp, Homo sapiens
atttttaaaaaacaat

SEQ ID NO: 2969261 - DNA, 14 bp, Homo sapiens
atttttaaaaaata

SEQ ID NO: 2969262 - DNA, 23 bp, Homo sapiens
atttttaaaaagatttatctgga

SEQ ID NO: 2969263 - DNA, 16 bp, Homo sapiens
atttttaaaagaaaaa

SEQ ID NO: 2969264 - DNA, 15 bp, Homo sapiens
atttttaaagcatgg

SEQ ID NO: 2969265 - DNA, 15 bp, Homo sapiens
atttttaaatgtgtt

SEQ ID NO: 2969266 - DNA, 18 bp, Homo sapiens
atttttaactactgtatt

SEQ ID NO: 2969267 - DNA, 15 bp, Homo sapiens
atttttaattaaaaa

SEQ ID NO: 2969268 - DNA, 14 bp, Homo sapiens
atttttaattgctt

SEQ ID NO: 2969269 - DNA, 17 bp, Homo sapiens
atttttagccattgtcg

SEQ ID NO: 2969270 - DNA, 22 bp, Homo sapiens
atttttagtagagactggtttc

SEQ ID NO: 2969271 - DNA, 21 bp, Homo sapiens
atttttagtttaaaatcttgc

SEQ ID NO: 2969272 - DNA, 17 bp, Homo sapiens
atttttatataatatct

SEQ ID NO: 2969273 - DNA, 21 bp, Homo sapiens
atttttatataatatctaaag

SEQ ID NO: 2969274 - DNA, 23 bp, Homo sapiens
atttttatataatatctaaagtt

SEQ ID NO: 2969275 - DNA, 16 bp, Homo sapiens
atttttatcatgaatt

SEQ ID NO: 2969276 - DNA, 17 bp, Homo sapiens
atttttatcatgaattc

SEQ ID NO: 2969277 - DNA, 18 bp, Homo sapiens
atttttatcccttcctgt

SEQ ID NO: 2969278 - DNA, 17 bp, Homo sapiens
atttttatgccacctga

SEQ ID NO: 2969279 - DNA, 15 bp, Homo sapiens
atttttattaactgc

SEQ ID NO: 2969280 - DNA, 18 bp, Homo sapiens
atttttatttctttttaa

SEQ ID NO: 2969281 - DNA, 23 bp, Homo sapiens
atttttcaaccccaccctgtttg

SEQ ID NO: 2969282 - DNA, 14 bp, Homo sapiens
atttttcaactttg

SEQ ID NO: 2969283 - DNA, 22 bp, Homo sapiens
atttttcaactttgaataaaga

SEQ ID NO: 2969284 - DNA, 14 bp, Homo sapiens
atttttcagatata

SEQ ID NO: 2969285 - DNA, 15 bp, Homo sapiens
atttttcagatataa

SEQ ID NO: 2969286 - DNA, 16 bp, Homo sapiens
atttttcagatataaa

SEQ ID NO: 2969287 - DNA, 15 bp, Homo sapiens
atttttcagatgctt

SEQ ID NO: 2969288 - DNA, 16 bp, Homo sapiens
atttttccatgacatt

SEQ ID NO: 2969289 - DNA, 19 bp, Homo sapiens
atttttccatgacattttt

SEQ ID NO: 2969290 - DNA, 16 bp, Homo sapiens
atttttctaaacgtaa

SEQ ID NO: 2969291 - DNA, 14 bp, Homo sapiens
atttttctaaagaa

SEQ ID NO: 2969292 - DNA, 20 bp, Homo sapiens
atttttctaaagaaattaca

SEQ ID NO: 2969293 - DNA, 11 bp, Homo sapiens
atttttctcca

SEQ ID NO: 2969294 - DNA, 20 bp, Homo sapiens
atttttctctttaaaaacat

SEQ ID NO: 2969295 - DNA, 19 bp, Homo sapiens
atttttctggaggttgata

SEQ ID NO: 2969296 - DNA, 22 bp, Homo sapiens
atttttctggaggttgataact

SEQ ID NO: 2969297 - DNA, 18 bp, Homo sapiens
atttttctttaaagccag

SEQ ID NO: 2969298 - DNA, 14 bp, Homo sapiens
atttttctttccaa

SEQ ID NO: 2969299 - DNA, 11 bp, Homo sapiens
atttttgaatg

SEQ ID NO: 2969300 - DNA, 21 bp, Homo sapiens
atttttgattaacaatgtatt

SEQ ID NO: 2969301 - DNA, 15 bp, Homo sapiens
atttttgcaaaataa

SEQ ID NO: 2969302 - DNA, 17 bp, Homo sapiens
atttttgcaataatgca

SEQ ID NO: 2969303 - DNA, 20 bp, Homo sapiens
atttttgcaataatgcagta

SEQ ID NO: 2969304 - DNA, 22 bp, Homo sapiens
atttttggggatcatagcttgt

SEQ ID NO: 2969305 - DNA, 18 bp, Homo sapiens
atttttggtcattgtaat

SEQ ID NO: 2969306 - DNA, 12 bp, Homo sapiens
atttttgtaaat

SEQ ID NO: 2969307 - DNA, 12 bp, Homo sapiens
atttttgtaatt

SEQ ID NO: 2969308 - DNA, 15 bp, Homo sapiens
attttttaaaaacta

SEQ ID NO: 2969309 - DNA, 13 bp, Homo sapiens
attttttaaacca

SEQ ID NO: 2969310 - DNA, 17 bp, Homo sapiens
attttttaaggaaacaa

SEQ ID NO: 2969311 - DNA, 18 bp, Homo sapiens
attttttatatatacagt

SEQ ID NO: 2969312 - DNA, 11 bp, Homo sapiens
attttttcctt

SEQ ID NO: 2969313 - DNA, 17 bp, Homo sapiens
attttttcttgcattga

SEQ ID NO: 2969314 - DNA, 20 bp, Homo sapiens
attttttcttttgtaattgt

SEQ ID NO: 2969315 - DNA, 11 bp, Homo sapiens
attttttgaat

SEQ ID NO: 2969316 - DNA, 16 bp, Homo sapiens
attttttgaatctatg

SEQ ID NO: 2969317 - DNA, 18 bp, Homo sapiens
attttttgtctgtttatt

SEQ ID NO: 2969318 - DNA, 12 bp, Homo sapiens
attttttgttct

SEQ ID NO: 2969319 - DNA, 19 bp, Homo sapiens
attttttgttcttgttgtt

SEQ ID NO: 2969320 - DNA, 15 bp, Homo sapiens
atttttttaactgtg

SEQ ID NO: 2969321 - DNA, 17 bp, Homo sapiens
atttttttaattttgta

SEQ ID NO: 2969322 - DNA, 12 bp, Homo sapiens
atttttttctac

SEQ ID NO: 2969323 - DNA, 16 bp, Homo sapiens
atttttttctctctgg

SEQ ID NO: 2969324 - DNA, 18 bp, Homo sapiens
atttttttgatggctaag

SEQ ID NO: 2969325 - DNA, 20 bp, Homo sapiens
atttttttgttcttgttgta

SEQ ID NO: 2969326 - DNA, 14 bp, Homo sapiens
attttttttcatgt

SEQ ID NO: 2969327 - DNA, 21 bp, Homo sapiens
attttttttggttgtttgctg

SEQ ID NO: 2969328 - DNA, 21 bp, Homo sapiens
attttttttgttgtttcagtg

SEQ ID NO: 2969329 - DNA, 22 bp, Homo sapiens
attttttttgttgtttcagtga

SEQ ID NO: 2969330 - DNA, 15 bp, Homo sapiens
caaaaaaaaaaccct

SEQ ID NO: 2969331 - DNA, 15 bp, Homo sapiens
caaaaaaaacaacaa

SEQ ID NO: 2969332 - DNA, 16 bp, Homo sapiens
caaaaaaaggaaaaat

SEQ ID NO: 2969333 - DNA, 10 bp, Homo sapiens
caaaaaaagt

SEQ ID NO: 2969334 - DNA, 22 bp, Homo sapiens
caaaaaaagtttgttactttga

SEQ ID NO: 2969335 - DNA, 15 bp, Homo sapiens
caaaaaaatactgcc

SEQ ID NO: 2969336 - DNA, 21 bp, Homo sapiens
caaaaaactcgaggactgtat

SEQ ID NO: 2969337 - DNA, 20 bp, Homo sapiens
caaaaaactctctcccagga

SEQ ID NO: 2969338 - DNA, 19 bp, Homo sapiens
caaaaaatactttttctaa

SEQ ID NO: 2969339 - DNA, 20 bp, Homo sapiens
caaaaacaaaattagccggg

SEQ ID NO: 2969340 - DNA, 23 bp, Homo sapiens
caaaaacacagtgtttttgtaaa

SEQ ID NO: 2969341 - DNA, 15 bp, Homo sapiens
caaaaacagcctcac

SEQ ID NO: 2969342 - DNA, 22 bp, Homo sapiens
caaaaacagcctcacagaagaa

SEQ ID NO: 2969343 - DNA, 21 bp, Homo sapiens
caaaaacagctggacttattt

SEQ ID NO: 2969344 - DNA, 13 bp, Homo sapiens
caaaaacttgtta

SEQ ID NO: 2969345 - DNA, 15 bp, Homo sapiens
caaaaaggactggaa

SEQ ID NO: 2969346 - DNA, 17 bp, Homo sapiens
caaaaaggatacataat

SEQ ID NO: 2969347 - DNA, 17 bp, Homo sapiens
caaaaaggtataaataa

SEQ ID NO: 2969348 - DNA, 12 bp, Homo sapiens
caaaaatataaa

SEQ ID NO: 2969349 - DNA, 19 bp, Homo sapiens
caaaaatcaacctatcaaa

SEQ ID NO: 2969350 - DNA, 13 bp, Homo sapiens
caaaaatgctaat

SEQ ID NO: 2969351 - DNA, 18 bp, Homo sapiens
caaaaatgtaaaaaacaa

SEQ ID NO: 2969352 - DNA, 21 bp, Homo sapiens
caaaaatgtaaaaaacaaaaa

SEQ ID NO: 2969353 - DNA, 15 bp, Homo sapiens
caaaaattatgcaat

SEQ ID NO: 2969354 - DNA, 22 bp, Homo sapiens
caaaaattatgcaattcagtgt

SEQ ID NO: 2969355 - DNA, 15 bp, Homo sapiens
caaaacaaaaaacaa

SEQ ID NO: 2969356 - DNA, 15 bp, Homo sapiens
caaaacaacattttg

SEQ ID NO: 2969357 - DNA, 18 bp, Homo sapiens
caaaacagaggcacttaa

SEQ ID NO: 2969358 - DNA, 13 bp, Homo sapiens
caaaacagattgt

SEQ ID NO: 2969359 - DNA, 15 bp, Homo sapiens
caaaacccacatttc

SEQ ID NO: 2969360 - DNA, 15 bp, Homo sapiens
caaaacctgtcctat

SEQ ID NO: 2969361 - DNA, 17 bp, Homo sapiens
caaaacggatccgggca

SEQ ID NO: 2969362 - DNA, 15 bp, Homo sapiens
caaaactgcatttca

SEQ ID NO: 2969363 - DNA, 14 bp, Homo sapiens
caaaactgtgcaga

SEQ ID NO: 2969364 - DNA, 14 bp, Homo sapiens
caaaacttttaaac

SEQ ID NO: 2969365 - DNA, 17 bp, Homo sapiens
caagcagcaaaatcctt

SEQ ID NO: 2969366 - DNA, 21 bp, Homo sapiens
caagcagcctgagcaactctt

SEQ ID NO: 2969367 - DNA, 23 bp, Homo sapiens
caagcaggaaatgaaaatgtctt

SEQ ID NO: 2969368 - DNA, 16 bp, Homo sapiens
caagcaggaagctcag

SEQ ID NO: 2969369 - DNA, 23 bp, Homo sapiens
caagcagttactccctacactga

SEQ ID NO: 2969370 - DNA, 24 bp, Homo sapiens
caagcagttactccctacactgat

SEQ ID NO: 2969371 - DNA, 22 bp, Homo sapiens
caagcattagattcctttcctg

SEQ ID NO: 2969372 - DNA, 17 bp, Homo sapiens
caagcattctgtttatc

SEQ ID NO: 2969373 - DNA, 13 bp, Homo sapiens
caagccaagcagc

SEQ ID NO: 2969374 - DNA, 15 bp, Homo sapiens
caagccaagcagcca

SEQ ID NO: 2969375 - DNA, 16 bp, Homo sapiens
caagccaagcagccaa

SEQ ID NO: 2969376 - DNA, 13 bp, Homo sapiens
caagccacagcct

SEQ ID NO: 2969377 - DNA, 14 bp, Homo sapiens
caagccacagcctg

SEQ ID NO: 2969378 - DNA, 19 bp, Homo sapiens
caagccaccgcagctgctg

SEQ ID NO: 2969379 - DNA, 22 bp, Homo sapiens
caagccagcgggaatggcagct

SEQ ID NO: 2969380 - DNA, 22 bp, Homo sapiens
caagccatcttcccgcctcagc

SEQ ID NO: 2969381 - DNA, 23 bp, Homo sapiens
caagccatcttcccgcctcagcc

SEQ ID NO: 2969382 - DNA, 18 bp, Homo sapiens
caagcccaaatttaattt

SEQ ID NO: 2969383 - DNA, 18 bp, Homo sapiens
caagccccaactttctta

SEQ ID NO: 2969384 - DNA, 12 bp, Homo sapiens
caagcctctgga

SEQ ID NO: 2969385 - DNA, 12 bp, Homo sapiens
caagcctgcctc

SEQ ID NO: 2969386 - DNA, 16 bp, Homo sapiens
caagcctgtgcaaaaa

SEQ ID NO: 2969387 - DNA, 17 bp, Homo sapiens
caagcgattctcctgcc

SEQ ID NO: 2969388 - DNA, 22 bp, Homo sapiens
caagcgattctcctgcctcagc

SEQ ID NO: 2969389 - DNA, 23 bp, Homo sapiens
caagcgattctcctgcctcagcc

SEQ ID NO: 2969390 - DNA, 20 bp, Homo sapiens
caagcgattttcctgcttca

SEQ ID NO: 2969391 - DNA, 19 bp, Homo sapiens
caagctcacagttcctcgc

SEQ ID NO: 2969392 - DNA, 18 bp, Homo sapiens
caagctcccaagagcttc

SEQ ID NO: 2969393 - DNA, 15 bp, Homo sapiens
caagctcctcctccc

SEQ ID NO: 2969394 - DNA, 23 bp, Homo sapiens
caagctcctcctccctgcatctg

SEQ ID NO: 2969395 - DNA, 22 bp, Homo sapiens
caagctccttgggaggccccac

SEQ ID NO: 2969396 - DNA, 16 bp, Homo sapiens
caagctcttgtttctg

SEQ ID NO: 2969397 - DNA, 19 bp, Homo sapiens
caagctcttgtttctgttt

SEQ ID NO: 2969398 - DNA, 20 bp, Homo sapiens
caagctgcctctgacagcag

SEQ ID NO: 2969399 - DNA, 12 bp, Homo sapiens
caagctggctgg

SEQ ID NO: 2969400 - DNA, 14 bp, Homo sapiens
caagctggctgggg

SEQ ID NO: 2969401 - DNA, 22 bp, Homo sapiens
caagctggctggggtggcctgt

SEQ ID NO: 2969402 - DNA, 14 bp, Homo sapiens
caagctgtgagaca

SEQ ID NO: 2969403 - DNA, 22 bp, Homo sapiens
caagctgtgagacagtgggaaa

SEQ ID NO: 2969404 - DNA, 19 bp, Homo sapiens
caagctgtgttacttgaag

SEQ ID NO: 2969405 - DNA, 14 bp, Homo sapiens
caagctgtgttcat

SEQ ID NO: 2969406 - DNA, 17 bp, Homo sapiens
caagctgttaaagatat

SEQ ID NO: 2969407 - DNA, 21 bp, Homo sapiens
caagcttcaaagccatatgga

SEQ ID NO: 2969408 - DNA, 16 bp, Homo sapiens
caaggaaaactgcatg

SEQ ID NO: 2969409 - DNA, 20 bp, Homo sapiens
caaggaaacgctacctctct

SEQ ID NO: 2969410 - DNA, 22 bp, Homo sapiens
caaggaaaggcatgtacaaaaa

SEQ ID NO: 2969411 - DNA, 11 bp, Homo sapiens
caaggaagaaa

SEQ ID NO: 2969412 - DNA, 16 bp, Homo sapiens
caaggaagaaaacgga

SEQ ID NO: 2969413 - DNA, 13 bp, Homo sapiens
caaggaaggagcc

SEQ ID NO: 2969414 - DNA, 12 bp, Homo sapiens
caaggaagtcaa

SEQ ID NO: 2969415 - DNA, 20 bp, Homo sapiens
caaggaataaatgagaggga

SEQ ID NO: 2969416 - DNA, 22 bp, Homo sapiens
caaggacacgcgcccccctccc

SEQ ID NO: 2969417 - DNA, 15 bp, Homo sapiens
caaggacagacagca

SEQ ID NO: 2969418 - DNA, 15 bp, Homo sapiens
caaggacttccacat

SEQ ID NO: 2969419 - DNA, 23 bp, Homo sapiens
caaggacttcctgtccagctcca

SEQ ID NO: 2969420 - DNA, 22 bp, Homo sapiens
caaggactttccaaatccagga

SEQ ID NO: 2969421 - DNA, 19 bp, Homo sapiens
caaggagatatatcagtgt

SEQ ID NO: 2969422 - DNA, 12 bp, Homo sapiens
caaggagcagag

SEQ ID NO: 2969423 - DNA, 15 bp, Homo sapiens
caaggagcagagagg

SEQ ID NO: 2969424 - DNA, 20 bp, Homo sapiens
caaggagcatccctaattct

SEQ ID NO: 2969425 - DNA, 11 bp, Homo sapiens
caaggagctgc

SEQ ID NO: 2969426 - DNA, 16 bp, Homo sapiens
caaggagctttcttgt

SEQ ID NO: 2969427 - DNA, 12 bp, Homo sapiens
caaggaggaaaa

SEQ ID NO: 2969428 - DNA, 20 bp, Homo sapiens
caaggaggaaaaacagacaa

SEQ ID NO: 2969429 - DNA, 15 bp, Homo sapiens
caaggatagatgctg

SEQ ID NO: 2969430 - DNA, 16 bp, Homo sapiens
caaggatagatgctgg

SEQ ID NO: 2969431 - DNA, 17 bp, Homo sapiens
caaggatagatgctggc

SEQ ID NO: 2969432 - DNA, 21 bp, Homo sapiens
caaggattacagaaactgatg

SEQ ID NO: 2969433 - DNA, 22 bp, Homo sapiens
caaggcaccgcagcctgtcagc

SEQ ID NO: 2969434 - DNA, 15 bp, Homo sapiens
caaggcactctagat

SEQ ID NO: 2969435 - DNA, 14 bp, Homo sapiens
caaggcaggcctga

SEQ ID NO: 2969436 - DNA, 17 bp, Homo sapiens
caaggcaggcctttcct

SEQ ID NO: 2969437 - DNA, 15 bp, Homo sapiens
caaggccatccttcc

SEQ ID NO: 2969438 - DNA, 17 bp, Homo sapiens
caaggccatccttccct

SEQ ID NO: 2969439 - DNA, 22 bp, Homo sapiens
caaggcccccgggccgacggag

SEQ ID NO: 2969440 - DNA, 14 bp, Homo sapiens
caaggccctttcct

SEQ ID NO: 2969441 - DNA, 22 bp, Homo sapiens
caaggccgcggcccagacccac

SEQ ID NO: 2969442 - DNA, 16 bp, Homo sapiens
caaggcggtgcttgat

SEQ ID NO: 2969443 - DNA, 22 bp, Homo sapiens
caaggcggtggacttgaacttt

SEQ ID NO: 2969444 - DNA, 10 bp, Homo sapiens
caaggctcag

SEQ ID NO: 2969445 - DNA, 15 bp, Homo sapiens
caaggcttcagtctc

SEQ ID NO: 2969446 - DNA, 15 bp, Homo sapiens
caagggaaaagtctc

SEQ ID NO: 2969447 - DNA, 16 bp, Homo sapiens
caagggaaaagtctct

SEQ ID NO: 2969448 - DNA, 14 bp, Homo sapiens
caagggaaggacag

SEQ ID NO: 2969449 - DNA, 21 bp, Homo sapiens
caagggaaggggcctccctcc

SEQ ID NO: 2969450 - DNA, 19 bp, Homo sapiens
caagggacaaggacacgcg

SEQ ID NO: 2969451 - DNA, 13 bp, Homo sapiens
caagggacaggaa

SEQ ID NO: 2969452 - DNA, 14 bp, Homo sapiens
caagggaggcagtg

SEQ ID NO: 2969453 - DNA, 15 bp, Homo sapiens
caagggaggcagtgg

SEQ ID NO: 2969454 - DNA, 18 bp, Homo sapiens
caagggaggtaagggagg

SEQ ID NO: 2969455 - DNA, 21 bp, Homo sapiens
caagggatctggtcctaccca

SEQ ID NO: 2969456 - DNA, 17 bp, Homo sapiens
caagggcatgagcattg

SEQ ID NO: 2969457 - DNA, 12 bp, Homo sapiens
caagggcctgga

SEQ ID NO: 2969458 - DNA, 17 bp, Homo sapiens
caaggggccatttggca

SEQ ID NO: 2969459 - DNA, 17 bp, Homo sapiens
caagggggcagagggct

SEQ ID NO: 2969460 - DNA, 18 bp, Homo sapiens
caagggggcggggactgc

SEQ ID NO: 2969461 - DNA, 17 bp, Homo sapiens
caaggggtggccgggca

SEQ ID NO: 2969462 - DNA, 19 bp, Homo sapiens
caaggggtggccgggcaca

SEQ ID NO: 2969463 - DNA, 15 bp, Homo sapiens
caagggttgcttctg

SEQ ID NO: 2969464 - DNA, 14 bp, Homo sapiens
caaggtacagctgt

SEQ ID NO: 2969465 - DNA, 19 bp, Homo sapiens
caaggtcatggccacactg

SEQ ID NO: 2969466 - DNA, 20 bp, Homo sapiens
caaggtcatggccacactgt

SEQ ID NO: 2969467 - DNA, 23 bp, Homo sapiens
caaggtcatggccacactgtgac

SEQ ID NO: 2969468 - DNA, 22 bp, Homo sapiens
caaggtcctctgtcagtcacag

SEQ ID NO: 2969469 - DNA, 13 bp, Homo sapiens
caaggtgacagaa

SEQ ID NO: 2969470 - DNA, 20 bp, Homo sapiens
caaggtgacagaaggaccag

SEQ ID NO: 2969471 - DNA, 19 bp, Homo sapiens
caaggtgcatatagaaaac

SEQ ID NO: 2969472 - DNA, 17 bp, Homo sapiens
caaggtgtcatttatgt

SEQ ID NO: 2969473 - DNA, 22 bp, Homo sapiens
caaggttactcagcagcagaga

SEQ ID NO: 2969474 - DNA, 18 bp, Homo sapiens
caaggttccacagagtaa

SEQ ID NO: 2969475 - DNA, 17 bp, Homo sapiens
caaggtttaaagagtct

SEQ ID NO: 2969476 - DNA, 17 bp, Homo sapiens
caaggtttaggctggtg

SEQ ID NO: 2969477 - DNA, 20 bp, Homo sapiens
caaggtttaggctggtggcc

SEQ ID NO: 2969478 - DNA, 21 bp, Homo sapiens
caaggtttaggctggtggccc

SEQ ID NO: 2969479 - DNA, 23 bp, Homo sapiens
caaggtttaggctggtggcccag

SEQ ID NO: 2969480 - DNA, 19 bp, Homo sapiens
caaggtttatgccaccagg

SEQ ID NO: 2969481 - DNA, 16 bp, Homo sapiens
caaggtttcgtggcag

SEQ ID NO: 2969482 - DNA, 18 bp, Homo sapiens
caaggtttcgtggcagca

SEQ ID NO: 2969483 - DNA, 23 bp, Homo sapiens
caaggtttcgtggcagcacggcc

SEQ ID NO: 2969484 - DNA, 23 bp, Homo sapiens
caaggttttaggttctaaagttc

SEQ ID NO: 2969485 - DNA, 15 bp, Homo sapiens
caagtaagaggctgg

SEQ ID NO: 2969486 - DNA, 17 bp, Homo sapiens
caagtaagaggctggag

SEQ ID NO: 2969487 - DNA, 12 bp, Homo sapiens
caagtaatcact

SEQ ID NO: 2969488 - DNA, 22 bp, Homo sapiens
caagtaatccacctgcctcggc

SEQ ID NO: 2969489 - DNA, 20 bp, Homo sapiens
caagtactacattttctttt

SEQ ID NO: 2969490 - DNA, 15 bp, Homo sapiens
caagtagctgggact

SEQ ID NO: 2969491 - DNA, 19 bp, Homo sapiens
caagtagctgggattttaa

SEQ ID NO: 2969492 - DNA, 13 bp, Homo sapiens
caagtataaagtc

SEQ ID NO: 2969493 - DNA, 22 bp, Homo sapiens
caagtatatacttttaaattat

SEQ ID NO: 2969494 - DNA, 15 bp, Homo sapiens
caagtatcttctatt

SEQ ID NO: 2969495 - DNA, 16 bp, Homo sapiens
caagtatcttctattt

SEQ ID NO: 2969496 - DNA, 17 bp, Homo sapiens
caagtatcttctatttt

SEQ ID NO: 2969497 - DNA, 13 bp, Homo sapiens
cacagccacccct

SEQ ID NO: 2969498 - DNA, 14 bp, Homo sapiens
cacagccagcccaa

SEQ ID NO: 2969499 - DNA, 22 bp, Homo sapiens
cacagccagcccaaaccttggg

SEQ ID NO: 2969500 - DNA, 22 bp, Homo sapiens
cacagccagggggatgccactc

SEQ ID NO: 2969501 - DNA, 21 bp, Homo sapiens
cacagcccaggcctccagctc

SEQ ID NO: 2969502 - DNA, 22 bp, Homo sapiens
cacagcccaggcctccagctca

SEQ ID NO: 2969503 - DNA, 19 bp, Homo sapiens
cacagcccagttcccgtga

SEQ ID NO: 2969504 - DNA, 14 bp, Homo sapiens
cacagcccccaccc

SEQ ID NO: 2969505 - DNA, 20 bp, Homo sapiens
cacagcccccaccccagcac

SEQ ID NO: 2969506 - DNA, 23 bp, Homo sapiens
cacagcccccaccccagcacagc

SEQ ID NO: 2969507 - DNA, 23 bp, Homo sapiens
cacagcccccgggacaccgtggg

SEQ ID NO: 2969508 - DNA, 23 bp, Homo sapiens
cacagccctagtatgaaagctgg

SEQ ID NO: 2969509 - DNA, 16 bp, Homo sapiens
cacagcctccaagtca

SEQ ID NO: 2969510 - DNA, 14 bp, Homo sapiens
cacagcctcccctg

SEQ ID NO: 2969511 - DNA, 21 bp, Homo sapiens
cacagcctcccctgccagggc

SEQ ID NO: 2969512 - DNA, 23 bp, Homo sapiens
cacagcctcccctgccagggcag

SEQ ID NO: 2969513 - DNA, 12 bp, Homo sapiens
cacagcctgggc

SEQ ID NO: 2969514 - DNA, 16 bp, Homo sapiens
cacagcctgtcttgtc

SEQ ID NO: 2969515 - DNA, 22 bp, Homo sapiens
cacagcctgtcttgtcaggtgg

SEQ ID NO: 2969516 - DNA, 23 bp, Homo sapiens
cacagcctgtcttgtcaggtgga

SEQ ID NO: 2969517 - DNA, 19 bp, Homo sapiens
cacagcgctggccgggacc

SEQ ID NO: 2969518 - DNA, 17 bp, Homo sapiens
cacagcgtgctggcgac

SEQ ID NO: 2969519 - DNA, 20 bp, Homo sapiens
cacagcgtgctggcgacact

SEQ ID NO: 2969520 - DNA, 14 bp, Homo sapiens
cacagctcccaccc

SEQ ID NO: 2969521 - DNA, 16 bp, Homo sapiens
cacagctcccacccca

SEQ ID NO: 2969522 - DNA, 17 bp, Homo sapiens
cacagctcccaccccac

SEQ ID NO: 2969523 - DNA, 22 bp, Homo sapiens
cacagctcccaccccaccccct

SEQ ID NO: 2969524 - DNA, 13 bp, Homo sapiens
cacagctcccggc

SEQ ID NO: 2969525 - DNA, 13 bp, Homo sapiens
cacagctcctccc

SEQ ID NO: 2969526 - DNA, 15 bp, Homo sapiens
cacagctcctcccct

SEQ ID NO: 2969527 - DNA, 22 bp, Homo sapiens
cacagctcctcccctgccgcct

SEQ ID NO: 2969528 - DNA, 13 bp, Homo sapiens
cacagctcttgtt

SEQ ID NO: 2969529 - DNA, 16 bp, Homo sapiens
cacagctcttgtttgg

SEQ ID NO: 2969530 - DNA, 14 bp, Homo sapiens
cacagcttcccctc

SEQ ID NO: 2969531 - DNA, 11 bp, Homo sapiens
cacagcttcct

SEQ ID NO: 2969532 - DNA, 22 bp, Homo sapiens
cacaggacatgcggtagccagc

SEQ ID NO: 2969533 - DNA, 17 bp, Homo sapiens
cacaggaccacacgcag

SEQ ID NO: 2969534 - DNA, 21 bp, Homo sapiens
cacaggagcaatcacaggaaa

SEQ ID NO: 2969535 - DNA, 18 bp, Homo sapiens
cacaggagcctctgcagt

SEQ ID NO: 2969536 - DNA, 15 bp, Homo sapiens
cacaggaggcaggca

SEQ ID NO: 2969537 - DNA, 19 bp, Homo sapiens
cacaggaggcaggcatggc

SEQ ID NO: 2969538 - DNA, 20 bp, Homo sapiens
cacaggagtgtcctcttccc

SEQ ID NO: 2969539 - DNA, 17 bp, Homo sapiens
cacaggcacattaactg

SEQ ID NO: 2969540 - DNA, 13 bp, Homo sapiens
cacagggaagtgg

SEQ ID NO: 2969541 - DNA, 24 bp, Homo sapiens
cacagggcaaaatcgccataggcc

SEQ ID NO: 2969542 - DNA, 19 bp, Homo sapiens
cacagggtttggcccaagt

SEQ ID NO: 2969543 - DNA, 18 bp, Homo sapiens
cacaggtcaataaactta

SEQ ID NO: 2969544 - DNA, 19 bp, Homo sapiens
cacaggtcaggggtgacac

SEQ ID NO: 2969545 - DNA, 21 bp, Homo sapiens
cacaggtcaggggtgacacag

SEQ ID NO: 2969546 - DNA, 13 bp, Homo sapiens
cacaggtctagac

SEQ ID NO: 2969547 - DNA, 18 bp, Homo sapiens
cacaggtctctgtttagt

SEQ ID NO: 2969548 - DNA, 15 bp, Homo sapiens
cacaggtctttccta

SEQ ID NO: 2969549 - DNA, 18 bp, Homo sapiens
cacaggtctttcctaagg

SEQ ID NO: 2969550 - DNA, 21 bp, Homo sapiens
cacaggtggtgtcactgtccc

SEQ ID NO: 2969551 - DNA, 17 bp, Homo sapiens
cacaggtgtcagccatt

SEQ ID NO: 2969552 - DNA, 15 bp, Homo sapiens
cacaggtgtttatac

SEQ ID NO: 2969553 - DNA, 17 bp, Homo sapiens
cacaggtttgtttcttg

SEQ ID NO: 2969554 - DNA, 16 bp, Homo sapiens
cacagtacataataca

SEQ ID NO: 2969555 - DNA, 23 bp, Homo sapiens
cacagtacataatacacttgccc

SEQ ID NO: 2969556 - DNA, 16 bp, Homo sapiens
cacagtagtcttgatg

SEQ ID NO: 2969557 - DNA, 20 bp, Homo sapiens
cacagtccacagctgaagag

SEQ ID NO: 2969558 - DNA, 15 bp, Homo sapiens
cacagtgaagtgctg

SEQ ID NO: 2969559 - DNA, 18 bp, Homo sapiens
cacagtgcttacatatgt

SEQ ID NO: 2969560 - DNA, 13 bp, Homo sapiens
cacagtggctcac

SEQ ID NO: 2969561 - DNA, 15 bp, Homo sapiens
cacagtggctcacgc

SEQ ID NO: 2969562 - DNA, 19 bp, Homo sapiens
cacagtggtggcagggcct

SEQ ID NO: 2969563 - DNA, 17 bp, Homo sapiens
cacagtgtttttgtaaa

SEQ ID NO: 2969564 - DNA, 23 bp, Homo sapiens
cacagttcaaaattctaaatgta

SEQ ID NO: 2969565 - DNA, 18 bp, Homo sapiens
cacagttctttgggccag

SEQ ID NO: 2969566 - DNA, 19 bp, Homo sapiens
cacagttctttgggccaga

SEQ ID NO: 2969567 - DNA, 23 bp, Homo sapiens
cacagttctttgggccagacatg

SEQ ID NO: 2969568 - DNA, 23 bp, Homo sapiens
cacagttgaagggaggggctgtg

SEQ ID NO: 2969569 - DNA, 12 bp, Homo sapiens
cacagttggcct

SEQ ID NO: 2969570 - DNA, 21 bp, Homo sapiens
cacagttggtggggtcctgcc

SEQ ID NO: 2969571 - DNA, 20 bp, Homo sapiens
cacagtttagaacagaggga

SEQ ID NO: 2969572 - DNA, 14 bp, Homo sapiens
cacagtttcttctg

SEQ ID NO: 2969573 - DNA, 18 bp, Homo sapiens
cacataaatgcagcccat

SEQ ID NO: 2969574 - DNA, 20 bp, Homo sapiens
cacataaattatgagatttt

SEQ ID NO: 2969575 - DNA, 16 bp, Homo sapiens
cacatatacacacaca

SEQ ID NO: 2969576 - DNA, 22 bp, Homo sapiens
cacatatgcaccttgtgtctgt

SEQ ID NO: 2969577 - DNA, 23 bp, Homo sapiens
cacatcacgaaggaaaactgcca

SEQ ID NO: 2969578 - DNA, 14 bp, Homo sapiens
cacatcccagccca

SEQ ID NO: 2969579 - DNA, 15 bp, Homo sapiens
cacatcccagcccaa

SEQ ID NO: 2969580 - DNA, 16 bp, Homo sapiens
cacatccccagagccc

SEQ ID NO: 2969581 - DNA, 23 bp, Homo sapiens
cacatccccagagcccagctctt

SEQ ID NO: 2969582 - DNA, 18 bp, Homo sapiens
cacatccgcgtgtgcctg

SEQ ID NO: 2969583 - DNA, 19 bp, Homo sapiens
cacatccgcgtgtgcctgt

SEQ ID NO: 2969584 - DNA, 17 bp, Homo sapiens
cacatcgttgccgcagc

SEQ ID NO: 2969585 - DNA, 18 bp, Homo sapiens
cacatctctgtcagtgtg

SEQ ID NO: 2969586 - DNA, 19 bp, Homo sapiens
cacatctctgtcagtgtga

SEQ ID NO: 2969587 - DNA, 16 bp, Homo sapiens
cacatctgggtgccct

SEQ ID NO: 2969588 - DNA, 19 bp, Homo sapiens
cacatctgggtgccctgaa

SEQ ID NO: 2969589 - DNA, 12 bp, Homo sapiens
cacatctgtgtc

SEQ ID NO: 2969590 - DNA, 18 bp, Homo sapiens
cacatctgtgtctctgga

SEQ ID NO: 2969591 - DNA, 16 bp, Homo sapiens
cacatctgtgtcttgt

SEQ ID NO: 2969592 - DNA, 13 bp, Homo sapiens
cacatcttgtctt

SEQ ID NO: 2969593 - DNA, 14 bp, Homo sapiens
cacatcttgtcttt

SEQ ID NO: 2969594 - DNA, 15 bp, Homo sapiens
cacatgaaacattat

SEQ ID NO: 2969595 - DNA, 18 bp, Homo sapiens
cacatgaacagcttgcca

SEQ ID NO: 2969596 - DNA, 13 bp, Homo sapiens
cacatgcatacac

SEQ ID NO: 2969597 - DNA, 14 bp, Homo sapiens
cacatgcatacaca

SEQ ID NO: 2969598 - DNA, 15 bp, Homo sapiens
cacatgcatacacac

SEQ ID NO: 2969599 - DNA, 23 bp, Homo sapiens
cacatgccttgcaatggatcagc

SEQ ID NO: 2969600 - DNA, 12 bp, Homo sapiens
cacatggctggg

SEQ ID NO: 2969601 - DNA, 15 bp, Homo sapiens
cacattaactgttgc

SEQ ID NO: 2969602 - DNA, 16 bp, Homo sapiens
cacattaactgttgca

SEQ ID NO: 2969603 - DNA, 13 bp, Homo sapiens
cacattagaactt

SEQ ID NO: 2969604 - DNA, 14 bp, Homo sapiens
cacattagaacttc

SEQ ID NO: 2969605 - DNA, 23 bp, Homo sapiens
cacattcagggctattttttccc

SEQ ID NO: 2969606 - DNA, 15 bp, Homo sapiens
cacattcttataaat

SEQ ID NO: 2969607 - DNA, 13 bp, Homo sapiens
cacattcttggct

SEQ ID NO: 2969608 - DNA, 22 bp, Homo sapiens
cacattcttggcttaatcattt

SEQ ID NO: 2969609 - DNA, 19 bp, Homo sapiens
cacattggcaagtgtaaaa

SEQ ID NO: 2969610 - DNA, 23 bp, Homo sapiens
cacattgttttaaaaagaaacaa

SEQ ID NO: 2969611 - DNA, 12 bp, Homo sapiens
cacatttaaatt

SEQ ID NO: 2969612 - DNA, 12 bp, Homo sapiens
cacatttcacat

SEQ ID NO: 2969613 - DNA, 17 bp, Homo sapiens
cacatttctaaaatctt

SEQ ID NO: 2969614 - DNA, 16 bp, Homo sapiens
cacatttggaatactt

SEQ ID NO: 2969615 - DNA, 19 bp, Homo sapiens
cacatttggaatacttttt

SEQ ID NO: 2969616 - DNA, 19 bp, Homo sapiens
cacatttggcttacagtaa

SEQ ID NO: 2969617 - DNA, 15 bp, Homo sapiens
cacattttgtataat

SEQ ID NO: 2969618 - DNA, 16 bp, Homo sapiens
cacattttgtataatt

SEQ ID NO: 2969619 - DNA, 22 bp, Homo sapiens
cacattttgtataattgtatcg

SEQ ID NO: 2969620 - DNA, 21 bp, Homo sapiens
cacatttttgcacagattatg

SEQ ID NO: 2969621 - DNA, 13 bp, Homo sapiens
caccaaagttcta

SEQ ID NO: 2969622 - DNA, 14 bp, Homo sapiens
caccaaatctgtct

SEQ ID NO: 2969623 - DNA, 22 bp, Homo sapiens
caccaacatcccattgccctgg

SEQ ID NO: 2969624 - DNA, 16 bp, Homo sapiens
caccaaccccgcggcc

SEQ ID NO: 2969625 - DNA, 18 bp, Homo sapiens
caccaaccccgcggccca

SEQ ID NO: 2969626 - DNA, 15 bp, Homo sapiens
caccaagatgtctgt

SEQ ID NO: 2969627 - DNA, 17 bp, Homo sapiens
caccaagatgtctgtct

SEQ ID NO: 2969628 - DNA, 16 bp, Homo sapiens
caccaagcacagcagc

SEQ ID NO: 2969629 - DNA, 13 bp, Homo sapiens
caccgcccgtctg

SEQ ID NO: 2969630 - DNA, 15 bp, Homo sapiens
caccgcccgtctgtg

SEQ ID NO: 2969631 - DNA, 22 bp, Homo sapiens
caccgccggctttcagggcagc

SEQ ID NO: 2969632 - DNA, 20 bp, Homo sapiens
caccgccggggtcctgggag

SEQ ID NO: 2969633 - DNA, 22 bp, Homo sapiens
caccgcctccccacctccaggc

SEQ ID NO: 2969634 - DNA, 12 bp, Homo sapiens
caccgcctgccc

SEQ ID NO: 2969635 - DNA, 18 bp, Homo sapiens
caccgcggacgtgctggc

SEQ ID NO: 2969636 - DNA, 15 bp, Homo sapiens
caccgctgagaggct

SEQ ID NO: 2969637 - DNA, 18 bp, Homo sapiens
caccgcttctgccttttc

SEQ ID NO: 2969638 - DNA, 22 bp, Homo sapiens
caccgggcatgtctgcctggag

SEQ ID NO: 2969639 - DNA, 14 bp, Homo sapiens
caccggggcctggg

SEQ ID NO: 2969640 - DNA, 21 bp, Homo sapiens
caccggggcctgggcaggagg

SEQ ID NO: 2969641 - DNA, 14 bp, Homo sapiens
caccgtggggaagg

SEQ ID NO: 2969642 - DNA, 15 bp, Homo sapiens
caccgtggggaaggg

SEQ ID NO: 2969643 - DNA, 20 bp, Homo sapiens
cacctaaaaccagttttgct

SEQ ID NO: 2969644 - DNA, 22 bp, Homo sapiens
cacctaatccaggcagatccag

SEQ ID NO: 2969645 - DNA, 17 bp, Homo sapiens
cacctacttagatattt

SEQ ID NO: 2969646 - DNA, 22 bp, Homo sapiens
cacctacttttctttcctcaga

SEQ ID NO: 2969647 - DNA, 17 bp, Homo sapiens
cacctagcttagtcatg

SEQ ID NO: 2969648 - DNA, 17 bp, Homo sapiens
cacctaggccactcctc

SEQ ID NO: 2969649 - DNA, 17 bp, Homo sapiens
cacctaggctagggtgg

SEQ ID NO: 2969650 - DNA, 15 bp, Homo sapiens
cacctagtgccccag

SEQ ID NO: 2969651 - DNA, 16 bp, Homo sapiens
cacctataaaacaggt

SEQ ID NO: 2969652 - DNA, 15 bp, Homo sapiens
cacctcaaatacata

SEQ ID NO: 2969653 - DNA, 23 bp, Homo sapiens
cacctcaagaagaagaggggcat

SEQ ID NO: 2969654 - DNA, 10 bp, Homo sapiens
cacctcagcc

SEQ ID NO: 2969655 - DNA, 11 bp, Homo sapiens
cacctcagcct

SEQ ID NO: 2969656 - DNA, 12 bp, Homo sapiens
cacctcagcctc

SEQ ID NO: 2969657 - DNA, 16 bp, Homo sapiens
cacctcagcctcccaa

SEQ ID NO: 2969658 - DNA, 13 bp, Homo sapiens
cacctccacgcca

SEQ ID NO: 2969659 - DNA, 17 bp, Homo sapiens
cacctccacgccactgc

SEQ ID NO: 2969660 - DNA, 13 bp, Homo sapiens
cacctcccatcct

SEQ ID NO: 2969661 - DNA, 14 bp, Homo sapiens
cacctccccccact

SEQ ID NO: 2969662 - DNA, 23 bp, Homo sapiens
cacctccccccactgcaggcccc

SEQ ID NO: 2969663 - DNA, 13 bp, Homo sapiens
cacctcccctatc

SEQ ID NO: 2969664 - DNA, 21 bp, Homo sapiens
cacctccctatactgcttgga

SEQ ID NO: 2969665 - DNA, 13 bp, Homo sapiens
cacctccctgcct

SEQ ID NO: 2969666 - DNA, 14 bp, Homo sapiens
cacctccctgcctc

SEQ ID NO: 2969667 - DNA, 15 bp, Homo sapiens
cacctccctgcctcc

SEQ ID NO: 2969668 - DNA, 16 bp, Homo sapiens
cacctcgagaagtaat

SEQ ID NO: 2969669 - DNA, 14 bp, Homo sapiens
cacctcggccctcc

SEQ ID NO: 2969670 - DNA, 18 bp, Homo sapiens
cacctcggccctccctgc

SEQ ID NO: 2969671 - DNA, 12 bp, Homo sapiens
cacctctctgtc

SEQ ID NO: 2969672 - DNA, 14 bp, Homo sapiens
cacctctctgtctt

SEQ ID NO: 2969673 - DNA, 14 bp, Homo sapiens
cacctctgcctcaa

SEQ ID NO: 2969674 - DNA, 16 bp, Homo sapiens
cacctctttgcccccg

SEQ ID NO: 2969675 - DNA, 16 bp, Homo sapiens
cacctgaaagcctgtc

SEQ ID NO: 2969676 - DNA, 17 bp, Homo sapiens
cacctgaaagcctgtct

SEQ ID NO: 2969677 - DNA, 17 bp, Homo sapiens
cacctgaaccccagagg

SEQ ID NO: 2969678 - DNA, 20 bp, Homo sapiens
cacctgaaccccagaggcag

SEQ ID NO: 2969679 - DNA, 15 bp, Homo sapiens
cacctgaatttgtat

SEQ ID NO: 2969680 - DNA, 17 bp, Homo sapiens
cacctgaatttgtatat

SEQ ID NO: 2969681 - DNA, 16 bp, Homo sapiens
cacctgagcaggacct

SEQ ID NO: 2969682 - DNA, 13 bp, Homo sapiens
cacctgaggtcag

SEQ ID NO: 2969683 - DNA, 18 bp, Homo sapiens
cacctgattcaactaaaa

SEQ ID NO: 2969684 - DNA, 19 bp, Homo sapiens
cacctgattcaactaaaaa

SEQ ID NO: 2969685 - DNA, 17 bp, Homo sapiens
cacctgcaaagctctgt

SEQ ID NO: 2969686 - DNA, 22 bp, Homo sapiens
cacctgcacctccccccactgc

SEQ ID NO: 2969687 - DNA, 12 bp, Homo sapiens
cacctgcagtgc

SEQ ID NO: 2969688 - DNA, 14 bp, Homo sapiens
cacctgcagtgcca

SEQ ID NO: 2969689 - DNA, 21 bp, Homo sapiens
cacctgcagtgccagctccct

SEQ ID NO: 2969690 - DNA, 22 bp, Homo sapiens
cacctgcatccgtagttccctg

SEQ ID NO: 2969691 - DNA, 17 bp, Homo sapiens
cacctgccagaggatgc

SEQ ID NO: 2969692 - DNA, 13 bp, Homo sapiens
cacctgccgacct

SEQ ID NO: 2969693 - DNA, 21 bp, Homo sapiens
cacctgccgacctcgtcctcc

SEQ ID NO: 2969694 - DNA, 22 bp, Homo sapiens
cacctgcctagctcttgggcct

SEQ ID NO: 2969695 - DNA, 14 bp, Homo sapiens
cacctgcctcagct

SEQ ID NO: 2969696 - DNA, 18 bp, Homo sapiens
cacctgcctggccggcca

SEQ ID NO: 2969697 - DNA, 19 bp, Homo sapiens
cacctgcctggccggccag

SEQ ID NO: 2969698 - DNA, 13 bp, Homo sapiens
cacctgcgcacag

SEQ ID NO: 2969699 - DNA, 14 bp, Homo sapiens
cacctgcgcacagg

SEQ ID NO: 2969700 - DNA, 16 bp, Homo sapiens
cacctgcgcacaggtg

SEQ ID NO: 2969701 - DNA, 22 bp, Homo sapiens
cacctgcgcacaggtgggagga

SEQ ID NO: 2969702 - DNA, 19 bp, Homo sapiens
cacctgctgagagacccaa

SEQ ID NO: 2969703 - DNA, 15 bp, Homo sapiens
cacctggaccccctg

SEQ ID NO: 2969704 - DNA, 21 bp, Homo sapiens
cacctggacgaagagcaggcc

SEQ ID NO: 2969705 - DNA, 20 bp, Homo sapiens
cacctggccccctcagctct

SEQ ID NO: 2969706 - DNA, 12 bp, Homo sapiens
cacctgggctgg

SEQ ID NO: 2969707 - DNA, 14 bp, Homo sapiens
cacctgggctgggc

SEQ ID NO: 2969708 - DNA, 19 bp, Homo sapiens
cacctgggcttaagaaatc

SEQ ID NO: 2969709 - DNA, 10 bp, Homo sapiens
cacctggggt

SEQ ID NO: 2969710 - DNA, 18 bp, Homo sapiens
cacctggggtgtgggagg

SEQ ID NO: 2969711 - DNA, 22 bp, Homo sapiens
cacctggggtgtgggaggcccg

SEQ ID NO: 2969712 - DNA, 21 bp, Homo sapiens
cacctggtcctccgcctactg

SEQ ID NO: 2969713 - DNA, 12 bp, Homo sapiens
cacctgtacagt

SEQ ID NO: 2969714 - DNA, 18 bp, Homo sapiens
cacctgtacagtggaacc

SEQ ID NO: 2969715 - DNA, 19 bp, Homo sapiens
cacctgtaggcagaggctg

SEQ ID NO: 2969716 - DNA, 15 bp, Homo sapiens
cacctgtagtcccag

SEQ ID NO: 2969717 - DNA, 16 bp, Homo sapiens
cacctgtagtcccagc

SEQ ID NO: 2969718 - DNA, 18 bp, Homo sapiens
cacctgtcggtggctgcc

SEQ ID NO: 2969719 - DNA, 20 bp, Homo sapiens
cacctgtcggtggctgcctt

SEQ ID NO: 2969720 - DNA, 23 bp, Homo sapiens
cacctgtcggtggctgcctttga

SEQ ID NO: 2969721 - DNA, 19 bp, Homo sapiens
cacctgttcacagaaaaag

SEQ ID NO: 2969722 - DNA, 21 bp, Homo sapiens
caccttaagaaagtgtctctg

SEQ ID NO: 2969723 - DNA, 18 bp, Homo sapiens
caccttatacatcacttc

SEQ ID NO: 2969724 - DNA, 21 bp, Homo sapiens
caccttatacatcacttcctg

SEQ ID NO: 2969725 - DNA, 20 bp, Homo sapiens
caccttatctggaagatctg

SEQ ID NO: 2969726 - DNA, 15 bp, Homo sapiens
caccttcattttgag

SEQ ID NO: 2969727 - DNA, 16 bp, Homo sapiens
caccttcattttgagg

SEQ ID NO: 2969728 - DNA, 18 bp, Homo sapiens
caccttcccactttccca

SEQ ID NO: 2969729 - DNA, 17 bp, Homo sapiens
caccttcccagctctcc

SEQ ID NO: 2969730 - DNA, 21 bp, Homo sapiens
caccttcgtttactatgcctg

SEQ ID NO: 2969731 - DNA, 12 bp, Homo sapiens
caccttctgagt

SEQ ID NO: 2969732 - DNA, 14 bp, Homo sapiens
caccttgattttct

SEQ ID NO: 2969733 - DNA, 15 bp, Homo sapiens
caccttgattttctt

SEQ ID NO: 2969734 - DNA, 20 bp, Homo sapiens
caccttgctgcagtgtccag

SEQ ID NO: 2969735 - DNA, 14 bp, Homo sapiens
caccttggagcatt

SEQ ID NO: 2969736 - DNA, 17 bp, Homo sapiens
caccttggcaccagaca

SEQ ID NO: 2969737 - DNA, 13 bp, Homo sapiens
caccttggcccag

SEQ ID NO: 2969738 - DNA, 14 bp, Homo sapiens
cacctttactttag

SEQ ID NO: 2969739 - DNA, 14 bp, Homo sapiens
cacctttaggttct

SEQ ID NO: 2969740 - DNA, 14 bp, Homo sapiens
cacctttcagccca

SEQ ID NO: 2969741 - DNA, 10 bp, Homo sapiens
cacctttcct

SEQ ID NO: 2969742 - DNA, 19 bp, Homo sapiens
cacctttcctcaaatgttg

SEQ ID NO: 2969743 - DNA, 13 bp, Homo sapiens
cacctttctagtt

SEQ ID NO: 2969744 - DNA, 19 bp, Homo sapiens
cacctttcttcttgtgtct

SEQ ID NO: 2969745 - DNA, 16 bp, Homo sapiens
cacctttgaattacag

SEQ ID NO: 2969746 - DNA, 13 bp, Homo sapiens
cacctttgtagca

SEQ ID NO: 2969747 - DNA, 21 bp, Homo sapiens
cacctttgtagcactcaggct

SEQ ID NO: 2969748 - DNA, 17 bp, Homo sapiens
caccttttttcaacagt

SEQ ID NO: 2969749 - DNA, 11 bp, Homo sapiens
cacgaaagcac

SEQ ID NO: 2969750 - DNA, 14 bp, Homo sapiens
cacgaaagcacaca

SEQ ID NO: 2969751 - DNA, 14 bp, Homo sapiens
cacgaacccacctg

SEQ ID NO: 2969752 - DNA, 22 bp, Homo sapiens
cacgaacctcggggtgggggtg

SEQ ID NO: 2969753 - DNA, 15 bp, Homo sapiens
cacgacccctgcctc

SEQ ID NO: 2969754 - DNA, 17 bp, Homo sapiens
cacgacctaggcagtag

SEQ ID NO: 2969755 - DNA, 22 bp, Homo sapiens
cacgaggaatctgtgggtctgg

SEQ ID NO: 2969756 - DNA, 21 bp, Homo sapiens
cacgagggctggctggcctca

SEQ ID NO: 2969757 - DNA, 19 bp, Homo sapiens
cacgaggggacccatgggg

SEQ ID NO: 2969758 - DNA, 20 bp, Homo sapiens
cacgataaataatcggccca

SEQ ID NO: 2969759 - DNA, 14 bp, Homo sapiens
cacgatctcagctc

SEQ ID NO: 2969760 - DNA, 17 bp, Homo sapiens
cacgcacctccacgcca

SEQ ID NO: 2969761 - DNA, 15 bp, Homo sapiens
cacgcacctgcctca

SEQ ID NO: 2969762 - DNA, 16 bp, Homo sapiens
cacgcacctgcctcag

SEQ ID NO: 2969763 - DNA, 14 bp, Homo sapiens
cagaaggtgaactt

SEQ ID NO: 2969764 - DNA, 20 bp, Homo sapiens
cagaaggtgaactttgtgct

SEQ ID NO: 2969765 - DNA, 16 bp, Homo sapiens
cagaagtaactcccac

SEQ ID NO: 2969766 - DNA, 20 bp, Homo sapiens
cagaagtaactcccactcct

SEQ ID NO: 2969767 - DNA, 19 bp, Homo sapiens
cagaagtaacttattttgt

SEQ ID NO: 2969768 - DNA, 18 bp, Homo sapiens
cagaagtattcttttcaa

SEQ ID NO: 2969769 - DNA, 19 bp, Homo sapiens
cagaagtattgtttacatt

SEQ ID NO: 2969770 - DNA, 12 bp, Homo sapiens
cagaagtcctgt

SEQ ID NO: 2969771 - DNA, 20 bp, Homo sapiens
cagaataaaagttcctctcc

SEQ ID NO: 2969772 - DNA, 22 bp, Homo sapiens
cagaataaattaatattgtatt

SEQ ID NO: 2969773 - DNA, 18 bp, Homo sapiens
cagaataagttattgcag

SEQ ID NO: 2969774 - DNA, 19 bp, Homo sapiens
cagaataagttattgcagt

SEQ ID NO: 2969775 - DNA, 22 bp, Homo sapiens
cagaatagccacatttggaata

SEQ ID NO: 2969776 - DNA, 20 bp, Homo sapiens
cagaatccctctacatggac

SEQ ID NO: 2969777 - DNA, 14 bp, Homo sapiens
cagaatcctgggcc

SEQ ID NO: 2969778 - DNA, 21 bp, Homo sapiens
cagaatctctgcctagaatct

SEQ ID NO: 2969779 - DNA, 12 bp, Homo sapiens
cagaatgaaaaa

SEQ ID NO: 2969780 - DNA, 14 bp, Homo sapiens
cagaatgaaaaatg

SEQ ID NO: 2969781 - DNA, 23 bp, Homo sapiens
cagaatgaaaaatgaaagatgat

SEQ ID NO: 2969782 - DNA, 11 bp, Homo sapiens
cagaatgaatt

SEQ ID NO: 2969783 - DNA, 14 bp, Homo sapiens
cagaatgaggctgc

SEQ ID NO: 2969784 - DNA, 20 bp, Homo sapiens
cagaatgcagttgttgtaca

SEQ ID NO: 2969785 - DNA, 11 bp, Homo sapiens
cagaatgctgt

SEQ ID NO: 2969786 - DNA, 16 bp, Homo sapiens
cagaatgctgtacatc

SEQ ID NO: 2969787 - DNA, 21 bp, Homo sapiens
cagaatgtaagtgggcccacc

SEQ ID NO: 2969788 - DNA, 16 bp, Homo sapiens
cagaatgtgctgcctt

SEQ ID NO: 2969789 - DNA, 17 bp, Homo sapiens
cagaatgtgctgccttt

SEQ ID NO: 2969790 - DNA, 17 bp, Homo sapiens
cagaattaatggtcatt

SEQ ID NO: 2969791 - DNA, 21 bp, Homo sapiens
cagaattacccttcctcatct

SEQ ID NO: 2969792 - DNA, 23 bp, Homo sapiens
cagaattggatacatacaccagc

SEQ ID NO: 2969793 - DNA, 21 bp, Homo sapiens
cagacaaaaacagcctcacag

SEQ ID NO: 2969794 - DNA, 20 bp, Homo sapiens
cagacaaaatgaaagaaaat

SEQ ID NO: 2969795 - DNA, 12 bp, Homo sapiens
cagacaaggcag

SEQ ID NO: 2969796 - DNA, 15 bp, Homo sapiens
cagacaaggcaggcc

SEQ ID NO: 2969797 - DNA, 14 bp, Homo sapiens
cagacacaggccct

SEQ ID NO: 2969798 - DNA, 15 bp, Homo sapiens
cagacacaggccctc

SEQ ID NO: 2969799 - DNA, 18 bp, Homo sapiens
cagacacaggccctccct

SEQ ID NO: 2969800 - DNA, 13 bp, Homo sapiens
cagacacccagga

SEQ ID NO: 2969801 - DNA, 19 bp, Homo sapiens
cagacacgagccacctcac

SEQ ID NO: 2969802 - DNA, 24 bp, Homo sapiens
cagacactgcgccccgcctgacct

SEQ ID NO: 2969803 - DNA, 23 bp, Homo sapiens
cagacagaagtgtagtatgctgt

SEQ ID NO: 2969804 - DNA, 20 bp, Homo sapiens
cagacagagaatatgtctgc

SEQ ID NO: 2969805 - DNA, 18 bp, Homo sapiens
cagacagtcgctcagtct

SEQ ID NO: 2969806 - DNA, 17 bp, Homo sapiens
cagacatacatagacat

SEQ ID NO: 2969807 - DNA, 16 bp, Homo sapiens
cagacatggtgtctca

SEQ ID NO: 2969808 - DNA, 14 bp, Homo sapiens
cagacattggcacc

SEQ ID NO: 2969809 - DNA, 13 bp, Homo sapiens
cagaccacggctc

SEQ ID NO: 2969810 - DNA, 23 bp, Homo sapiens
cagacccagcccgcggcctggac

SEQ ID NO: 2969811 - DNA, 16 bp, Homo sapiens
cagaccctaccccacc

SEQ ID NO: 2969812 - DNA, 17 bp, Homo sapiens
cagaccctaccccacca

SEQ ID NO: 2969813 - DNA, 18 bp, Homo sapiens
cagaccctaccccaccac

SEQ ID NO: 2969814 - DNA, 14 bp, Homo sapiens
cagaccctctgccg

SEQ ID NO: 2969815 - DNA, 17 bp, Homo sapiens
cagacctgatcctggag

SEQ ID NO: 2969816 - DNA, 20 bp, Homo sapiens
cagacctgatcctggaggcc

SEQ ID NO: 2969817 - DNA, 15 bp, Homo sapiens
cagacctggtgctct

SEQ ID NO: 2969818 - DNA, 14 bp, Homo sapiens
cagacgaaggcaac

SEQ ID NO: 2969819 - DNA, 14 bp, Homo sapiens
cagacgtctggccc

SEQ ID NO: 2969820 - DNA, 16 bp, Homo sapiens
cagacgtgctccctcc

SEQ ID NO: 2969821 - DNA, 14 bp, Homo sapiens
cagacgtgtgacct

SEQ ID NO: 2969822 - DNA, 17 bp, Homo sapiens
cagacgtgtgacctcca

SEQ ID NO: 2969823 - DNA, 18 bp, Homo sapiens
cagacgtgtgacctccat

SEQ ID NO: 2969824 - DNA, 23 bp, Homo sapiens
cagactcaaatgctcagaccagc

SEQ ID NO: 2969825 - DNA, 20 bp, Homo sapiens
cagactcacaacctgaacct

SEQ ID NO: 2969826 - DNA, 21 bp, Homo sapiens
cagactcacaacctgaaccta

SEQ ID NO: 2969827 - DNA, 15 bp, Homo sapiens
cagactcagctctga

SEQ ID NO: 2969828 - DNA, 20 bp, Homo sapiens
cagactcccattcctgaaga

SEQ ID NO: 2969829 - DNA, 14 bp, Homo sapiens
cagactcctgagga

SEQ ID NO: 2969830 - DNA, 20 bp, Homo sapiens
cagactcctgaggacagctg

SEQ ID NO: 2969831 - DNA, 13 bp, Homo sapiens
cagactcttccac

SEQ ID NO: 2969832 - DNA, 22 bp, Homo sapiens
cagactgagctctccaggccag

SEQ ID NO: 2969833 - DNA, 16 bp, Homo sapiens
cagactgatcaggacc

SEQ ID NO: 2969834 - DNA, 15 bp, Homo sapiens
cagactgcacccagg

SEQ ID NO: 2969835 - DNA, 16 bp, Homo sapiens
cagactgcacccagga

SEQ ID NO: 2969836 - DNA, 17 bp, Homo sapiens
cagactgcacccaggag

SEQ ID NO: 2969837 - DNA, 18 bp, Homo sapiens
cagactgccccagccaac

SEQ ID NO: 2969838 - DNA, 19 bp, Homo sapiens
cagactgcttggccagatg

SEQ ID NO: 2969839 - DNA, 20 bp, Homo sapiens
cagactgcttggccagatgc

SEQ ID NO: 2969840 - DNA, 16 bp, Homo sapiens
cagactggccgggcag

SEQ ID NO: 2969841 - DNA, 14 bp, Homo sapiens
cagactgggcccag

SEQ ID NO: 2969842 - DNA, 18 bp, Homo sapiens
cagactgggcccaggcag

SEQ ID NO: 2969843 - DNA, 22 bp, Homo sapiens
cagactgggcccaggcaggtct

SEQ ID NO: 2969844 - DNA, 18 bp, Homo sapiens
cagacttaaacttcctta

SEQ ID NO: 2969845 - DNA, 14 bp, Homo sapiens
cagacttcacactg

SEQ ID NO: 2969846 - DNA, 20 bp, Homo sapiens
cagacttcccagctaggaag

SEQ ID NO: 2969847 - DNA, 19 bp, Homo sapiens
cagacttgccatgtgactc

SEQ ID NO: 2969848 - DNA, 21 bp, Homo sapiens
cagacttgccatgtgactctg

SEQ ID NO: 2969849 - DNA, 19 bp, Homo sapiens
cagacttgttctcagagca

SEQ ID NO: 2969850 - DNA, 15 bp, Homo sapiens
cagacttgtttcctg

SEQ ID NO: 2969851 - DNA, 20 bp, Homo sapiens
cagacttgtttcctgtgccc

SEQ ID NO: 2969852 - DNA, 23 bp, Homo sapiens
cagactttggaaaatgcattgta

SEQ ID NO: 2969853 - DNA, 13 bp, Homo sapiens
cagagaaaacact

SEQ ID NO: 2969854 - DNA, 21 bp, Homo sapiens
cagagaaaacactttcctgga

SEQ ID NO: 2969855 - DNA, 20 bp, Homo sapiens
cagagaaaatgagaaaggac

SEQ ID NO: 2969856 - DNA, 24 bp, Homo sapiens
cagagaaaatgagaaaggacagag

SEQ ID NO: 2969857 - DNA, 19 bp, Homo sapiens
cagagaagctctcgggcta

SEQ ID NO: 2969858 - DNA, 20 bp, Homo sapiens
cagagaagggctcctgcagg

SEQ ID NO: 2969859 - DNA, 14 bp, Homo sapiens
cagagaagtgacag

SEQ ID NO: 2969860 - DNA, 17 bp, Homo sapiens
cagagaagtgacaggga

SEQ ID NO: 2969861 - DNA, 22 bp, Homo sapiens
cagagaagtgacagggaagcta

SEQ ID NO: 2969862 - DNA, 19 bp, Homo sapiens
cagagaatataacatgaaa

SEQ ID NO: 2969863 - DNA, 20 bp, Homo sapiens
cagagaatatgtctgctcct

SEQ ID NO: 2969864 - DNA, 22 bp, Homo sapiens
cagagacacctgcacctccccc

SEQ ID NO: 2969865 - DNA, 13 bp, Homo sapiens
cagagacaggaaa

SEQ ID NO: 2969866 - DNA, 14 bp, Homo sapiens
cagagacaggaaaa

SEQ ID NO: 2969867 - DNA, 15 bp, Homo sapiens
cagagacaggaaaat

SEQ ID NO: 2969868 - DNA, 21 bp, Homo sapiens
cagagacatacttgaagggcc

SEQ ID NO: 2969869 - DNA, 14 bp, Homo sapiens
cagagaccattgca

SEQ ID NO: 2969870 - DNA, 19 bp, Homo sapiens
cagagacctttgcccacac

SEQ ID NO: 2969871 - DNA, 15 bp, Homo sapiens
cagagagaaaaagat

SEQ ID NO: 2969872 - DNA, 16 bp, Homo sapiens
cagagagaaaaagatt

SEQ ID NO: 2969873 - DNA, 20 bp, Homo sapiens
cagagagacccgggaaggaa

SEQ ID NO: 2969874 - DNA, 21 bp, Homo sapiens
cagagagacccgggaaggaag

SEQ ID NO: 2969875 - DNA, 12 bp, Homo sapiens
cagagagagtgt

SEQ ID NO: 2969876 - DNA, 21 bp, Homo sapiens
cagagagtacactgtgtctct

SEQ ID NO: 2969877 - DNA, 21 bp, Homo sapiens
cagagatgcctccaccgctgc

SEQ ID NO: 2969878 - DNA, 16 bp, Homo sapiens
cagagcaaaatgctct

SEQ ID NO: 2969879 - DNA, 15 bp, Homo sapiens
cagagcaaagcgccc

SEQ ID NO: 2969880 - DNA, 18 bp, Homo sapiens
cagagcaggggctgctgg

SEQ ID NO: 2969881 - DNA, 23 bp, Homo sapiens
cagagcaggggctgctgggggct

SEQ ID NO: 2969882 - DNA, 17 bp, Homo sapiens
cagagcagtgggcctgg

SEQ ID NO: 2969883 - DNA, 20 bp, Homo sapiens
cagagcagtgggcctggcca

SEQ ID NO: 2969884 - DNA, 17 bp, Homo sapiens
cagagccacacatgggc

SEQ ID NO: 2969885 - DNA, 15 bp, Homo sapiens
cagagcccaggggag

SEQ ID NO: 2969886 - DNA, 16 bp, Homo sapiens
cagagcctcgctctgt

SEQ ID NO: 2969887 - DNA, 14 bp, Homo sapiens
cagagcctgaattt

SEQ ID NO: 2969888 - DNA, 12 bp, Homo sapiens
cagagcctgtcc

SEQ ID NO: 2969889 - DNA, 15 bp, Homo sapiens
cagagcgagactcca

SEQ ID NO: 2969890 - DNA, 20 bp, Homo sapiens
cagagcgagactccatctct

SEQ ID NO: 2969891 - DNA, 20 bp, Homo sapiens
cagagctacccgcagagttc

SEQ ID NO: 2969892 - DNA, 22 bp, Homo sapiens
cagagctctgacccacagcctc

SEQ ID NO: 2969893 - DNA, 17 bp, Homo sapiens
cagagctgagggccctg

SEQ ID NO: 2969894 - DNA, 22 bp, Homo sapiens
cagagctgagggccctgtggag

SEQ ID NO: 2969895 - DNA, 24 bp, Homo sapiens
cagcctctccactcatgtgactct

SEQ ID NO: 2969896 - DNA, 11 bp, Homo sapiens
cagcctctcct

SEQ ID NO: 2969897 - DNA, 17 bp, Homo sapiens
cagcctctcctccttgg

SEQ ID NO: 2969898 - DNA, 23 bp, Homo sapiens
cagcctctcctccttgggcaggg

SEQ ID NO: 2969899 - DNA, 16 bp, Homo sapiens
cagcctctcttcactg

SEQ ID NO: 2969900 - DNA, 23 bp, Homo sapiens
cagcctctgacttaagctgcctc

SEQ ID NO: 2969901 - DNA, 17 bp, Homo sapiens
cagcctgaataaaccaa

SEQ ID NO: 2969902 - DNA, 14 bp, Homo sapiens
cagcctgcacctgg

SEQ ID NO: 2969903 - DNA, 16 bp, Homo sapiens
cagcctgccactcagg

SEQ ID NO: 2969904 - DNA, 12 bp, Homo sapiens
cagcctgccagc

SEQ ID NO: 2969905 - DNA, 13 bp, Homo sapiens
cagcctgccagca

SEQ ID NO: 2969906 - DNA, 15 bp, Homo sapiens
cagcctgcctggcag

SEQ ID NO: 2969907 - DNA, 20 bp, Homo sapiens
cagcctggcatctgtgcgtg

SEQ ID NO: 2969908 - DNA, 22 bp, Homo sapiens
cagcctggcatctgtgcgtgtg

SEQ ID NO: 2969909 - DNA, 17 bp, Homo sapiens
cagcctggccagacaca

SEQ ID NO: 2969910 - DNA, 18 bp, Homo sapiens
cagcctggccagacacag

SEQ ID NO: 2969911 - DNA, 23 bp, Homo sapiens
cagcctggctgtggcctaacctg

SEQ ID NO: 2969912 - DNA, 16 bp, Homo sapiens
cagcctgggccccagc

SEQ ID NO: 2969913 - DNA, 21 bp, Homo sapiens
cagcctggggctggcctccca

SEQ ID NO: 2969914 - DNA, 15 bp, Homo sapiens
cagcctggggtctgg

SEQ ID NO: 2969915 - DNA, 19 bp, Homo sapiens
cagcctggggtctggagtt

SEQ ID NO: 2969916 - DNA, 18 bp, Homo sapiens
cagcctgggtgacagagc

SEQ ID NO: 2969917 - DNA, 16 bp, Homo sapiens
cagcctggttttcgtc

SEQ ID NO: 2969918 - DNA, 23 bp, Homo sapiens
cagcctggttttcgtcatcttcc

SEQ ID NO: 2969919 - DNA, 16 bp, Homo sapiens
cagcctgtcagccaac

SEQ ID NO: 2969920 - DNA, 22 bp, Homo sapiens
cagcctgtctctccttgttgcc

SEQ ID NO: 2969921 - DNA, 17 bp, Homo sapiens
cagcctgtcttgtcagg

SEQ ID NO: 2969922 - DNA, 14 bp, Homo sapiens
cagcctgtgaggga

SEQ ID NO: 2969923 - DNA, 11 bp, Homo sapiens
cagccttcagc

SEQ ID NO: 2969924 - DNA, 20 bp, Homo sapiens
cagccttcagcagcagctca

SEQ ID NO: 2969925 - DNA, 23 bp, Homo sapiens
cagccttcagcagcagctcacac

SEQ ID NO: 2969926 - DNA, 15 bp, Homo sapiens
cagccttgagatgct

SEQ ID NO: 2969927 - DNA, 16 bp, Homo sapiens
cagccttgccagagat

SEQ ID NO: 2969928 - DNA, 17 bp, Homo sapiens
cagccttgggcctttca

SEQ ID NO: 2969929 - DNA, 20 bp, Homo sapiens
cagccttgggggggctgcct

SEQ ID NO: 2969930 - DNA, 19 bp, Homo sapiens
cagcctttgatcaggtggg

SEQ ID NO: 2969931 - DNA, 14 bp, Homo sapiens
cagcctttgggaaa

SEQ ID NO: 2969932 - DNA, 19 bp, Homo sapiens
cagcctttgggtcctgggc

SEQ ID NO: 2969933 - DNA, 14 bp, Homo sapiens
cagcgaagggagtg

SEQ ID NO: 2969934 - DNA, 12 bp, Homo sapiens
cagcgagaggga

SEQ ID NO: 2969935 - DNA, 18 bp, Homo sapiens
cagcgaggaggctccaga

SEQ ID NO: 2969936 - DNA, 20 bp, Homo sapiens
cagcgatggtgctgcccagg

SEQ ID NO: 2969937 - DNA, 23 bp, Homo sapiens
cagcgatgtatgcagctatctgg

SEQ ID NO: 2969938 - DNA, 12 bp, Homo sapiens
cagcgccaggct

SEQ ID NO: 2969939 - DNA, 20 bp, Homo sapiens
cagcgccaggctgaccacag

SEQ ID NO: 2969940 - DNA, 22 bp, Homo sapiens
cagcgccaggctgaccacagca

SEQ ID NO: 2969941 - DNA, 13 bp, Homo sapiens
cagcgccagggcc

SEQ ID NO: 2969942 - DNA, 17 bp, Homo sapiens
cagcgccagggcccagg

SEQ ID NO: 2969943 - DNA, 18 bp, Homo sapiens
cagcgccagggcccaggc

SEQ ID NO: 2969944 - DNA, 19 bp, Homo sapiens
cagcgccagggcccaggcc

SEQ ID NO: 2969945 - DNA, 12 bp, Homo sapiens
cagcgcccccag

SEQ ID NO: 2969946 - DNA, 19 bp, Homo sapiens
cagcgcccccaggcctgcc

SEQ ID NO: 2969947 - DNA, 19 bp, Homo sapiens
cagcgcctggcctacccag

SEQ ID NO: 2969948 - DNA, 13 bp, Homo sapiens
cagcgcctgtccc

SEQ ID NO: 2969949 - DNA, 18 bp, Homo sapiens
cagcgcctgtcccctcac

SEQ ID NO: 2969950 - DNA, 21 bp, Homo sapiens
cagcgcctgtcccctcacaga

SEQ ID NO: 2969951 - DNA, 13 bp, Homo sapiens
cagcgcctttccc

SEQ ID NO: 2969952 - DNA, 14 bp, Homo sapiens
cagcgcctttccca

SEQ ID NO: 2969953 - DNA, 13 bp, Homo sapiens
cagcgctctcctg

SEQ ID NO: 2969954 - DNA, 15 bp, Homo sapiens
cagcgctctcctgga

SEQ ID NO: 2969955 - DNA, 16 bp, Homo sapiens
cagcgctctcctggac

SEQ ID NO: 2969956 - DNA, 15 bp, Homo sapiens
cagcggcccaagagc

SEQ ID NO: 2969957 - DNA, 18 bp, Homo sapiens
cagcggcccaagagcccg

SEQ ID NO: 2969958 - DNA, 11 bp, Homo sapiens
cagcggcctca

SEQ ID NO: 2969959 - DNA, 22 bp, Homo sapiens
cagcggccttgaagacagagca

SEQ ID NO: 2969960 - DNA, 23 bp, Homo sapiens
cagcggccttgaagacagagcaa

SEQ ID NO: 2969961 - DNA, 17 bp, Homo sapiens
cagcggctccaactcct

SEQ ID NO: 2969962 - DNA, 14 bp, Homo sapiens
cagcggctgcctcc

SEQ ID NO: 2969963 - DNA, 23 bp, Homo sapiens
cagcgggaatggcagctgccacg

SEQ ID NO: 2969964 - DNA, 14 bp, Homo sapiens
cagcgggggccttg

SEQ ID NO: 2969965 - DNA, 20 bp, Homo sapiens
cagcggtgtggaccgaggaa

SEQ ID NO: 2969966 - DNA, 20 bp, Homo sapiens
cagcgtgctggcgacactca

SEQ ID NO: 2969967 - DNA, 19 bp, Homo sapiens
cagcgtgctttaaaaaata

SEQ ID NO: 2969968 - DNA, 15 bp, Homo sapiens
cagcgtgtcaacttt

SEQ ID NO: 2969969 - DNA, 19 bp, Homo sapiens
cagctaaagcaatatgcat

SEQ ID NO: 2969970 - DNA, 15 bp, Homo sapiens
cagctaactccgaga

SEQ ID NO: 2969971 - DNA, 21 bp, Homo sapiens
cagctaactccgagagcagtg

SEQ ID NO: 2969972 - DNA, 14 bp, Homo sapiens
cagctaagaacctg

SEQ ID NO: 2969973 - DNA, 19 bp, Homo sapiens
cagctaagaacctggaact

SEQ ID NO: 2969974 - DNA, 23 bp, Homo sapiens
cagctaagaacctggaacttggg

SEQ ID NO: 2969975 - DNA, 23 bp, Homo sapiens
cagctaatttttgtatttttaat

SEQ ID NO: 2969976 - DNA, 21 bp, Homo sapiens
cagctacctcaaccaatgcca

SEQ ID NO: 2969977 - DNA, 20 bp, Homo sapiens
cagctactcaggaggctgag

SEQ ID NO: 2969978 - DNA, 19 bp, Homo sapiens
cagctactcgggaggctga

SEQ ID NO: 2969979 - DNA, 19 bp, Homo sapiens
cagctactgaaccagccac

SEQ ID NO: 2969980 - DNA, 20 bp, Homo sapiens
cagctactggggaggctgag

SEQ ID NO: 2969981 - DNA, 17 bp, Homo sapiens
cagctacttagctggcc

SEQ ID NO: 2969982 - DNA, 19 bp, Homo sapiens
cagctacttgggagcctga

SEQ ID NO: 2969983 - DNA, 22 bp, Homo sapiens
cagctacttgggagcctgaggc

SEQ ID NO: 2969984 - DNA, 18 bp, Homo sapiens
cagctagacattgcaatt

SEQ ID NO: 2969985 - DNA, 20 bp, Homo sapiens
cagctaggaagagcaggact

SEQ ID NO: 2969986 - DNA, 21 bp, Homo sapiens
cagctaggaagagcaggactc

SEQ ID NO: 2969987 - DNA, 20 bp, Homo sapiens
cagctagtcctagtgaacct

SEQ ID NO: 2969988 - DNA, 15 bp, Homo sapiens
cagctcaaaggcaca

SEQ ID NO: 2969989 - DNA, 19 bp, Homo sapiens
cagctcaaggaaaggcctg

SEQ ID NO: 2969990 - DNA, 20 bp, Homo sapiens
cagctcaaggaaaggcctga

SEQ ID NO: 2969991 - DNA, 18 bp, Homo sapiens
cagctcacaccctacctt

SEQ ID NO: 2969992 - DNA, 21 bp, Homo sapiens
cagctcacaccctaccttccc

SEQ ID NO: 2969993 - DNA, 13 bp, Homo sapiens
cagctcacgcttc

SEQ ID NO: 2969994 - DNA, 17 bp, Homo sapiens
cagctcacgcttcacag

SEQ ID NO: 2969995 - DNA, 19 bp, Homo sapiens
cagctcacgcttcacagtg

SEQ ID NO: 2969996 - DNA, 13 bp, Homo sapiens
cagctcaggacag

SEQ ID NO: 2969997 - DNA, 18 bp, Homo sapiens
cagctcaggacagatgcc

SEQ ID NO: 2969998 - DNA, 19 bp, Homo sapiens
cagctcaggacagatgcca

SEQ ID NO: 2969999 - DNA, 22 bp, Homo sapiens
cagctcaggacagatgccacac

SEQ ID NO: 2970000 - DNA, 22 bp, Homo sapiens
cagctcatagtgaacacagcag

SEQ ID NO: 2970001 - DNA, 12 bp, Homo sapiens
cagctcatcttc

SEQ ID NO: 2970002 - DNA, 13 bp, Homo sapiens
cagctcattcatt

SEQ ID NO: 2970003 - DNA, 16 bp, Homo sapiens
cagctccaggcccacc

SEQ ID NO: 2970004 - DNA, 22 bp, Homo sapiens
cagctcccaccccacccccttc

SEQ ID NO: 2970005 - DNA, 12 bp, Homo sapiens
cagctcccaggc

SEQ ID NO: 2970006 - DNA, 22 bp, Homo sapiens
cagctccctcgtcttcagctgc

SEQ ID NO: 2970007 - DNA, 17 bp, Homo sapiens
cagctccgacctctctc

SEQ ID NO: 2970008 - DNA, 17 bp, Homo sapiens
cagctcctcagcggctc

SEQ ID NO: 2970009 - DNA, 18 bp, Homo sapiens
cagctcctcagcggctcc

SEQ ID NO: 2970010 - DNA, 15 bp, Homo sapiens
cagctcctcccctgc

SEQ ID NO: 2970011 - DNA, 20 bp, Homo sapiens
cagctcctcccctgccgcct

SEQ ID NO: 2970012 - DNA, 13 bp, Homo sapiens
cagctccttcctg

SEQ ID NO: 2970013 - DNA, 14 bp, Homo sapiens
cagctccttttctg

SEQ ID NO: 2970014 - DNA, 20 bp, Homo sapiens
cagctccttttctgtgaagc

SEQ ID NO: 2970015 - DNA, 15 bp, Homo sapiens
cagctctaaaacata

SEQ ID NO: 2970016 - DNA, 17 bp, Homo sapiens
cagctctaaaacataga

SEQ ID NO: 2970017 - DNA, 23 bp, Homo sapiens
cagctctaaaacatagactgaag

SEQ ID NO: 2970018 - DNA, 19 bp, Homo sapiens
cagctctaagcagccagga

SEQ ID NO: 2970019 - DNA, 22 bp, Homo sapiens
cagctctaagcagccaggaggg

SEQ ID NO: 2970020 - DNA, 18 bp, Homo sapiens
cagctctaagtctcaact

SEQ ID NO: 2970021 - DNA, 14 bp, Homo sapiens
cagctctactacct

SEQ ID NO: 2970022 - DNA, 18 bp, Homo sapiens
cagctctcatctgaggca

SEQ ID NO: 2970023 - DNA, 13 bp, Homo sapiens
cagctctcccaca

SEQ ID NO: 2970024 - DNA, 20 bp, Homo sapiens
cagctctcccacatcccact

SEQ ID NO: 2970025 - DNA, 12 bp, Homo sapiens
cagctctccctc

SEQ ID NO: 2970026 - DNA, 15 bp, Homo sapiens
cagctctccctctgg

SEQ ID NO: 2970027 - DNA, 21 bp, Homo sapiens
caggcagagctgagggccctg

SEQ ID NO: 2970028 - DNA, 16 bp, Homo sapiens
caggcagatcacctga

SEQ ID NO: 2970029 - DNA, 17 bp, Homo sapiens
caggcagatccaggact

SEQ ID NO: 2970030 - DNA, 15 bp, Homo sapiens
caggcagcacagaga

SEQ ID NO: 2970031 - DNA, 15 bp, Homo sapiens
caggcagcgcctgtc

SEQ ID NO: 2970032 - DNA, 19 bp, Homo sapiens
caggcagcgcctgtcccct

SEQ ID NO: 2970033 - DNA, 17 bp, Homo sapiens
caggcagcggggagggg

SEQ ID NO: 2970034 - DNA, 16 bp, Homo sapiens
caggcaggctcccagg

SEQ ID NO: 2970035 - DNA, 20 bp, Homo sapiens
caggcagggccaacccttct

SEQ ID NO: 2970036 - DNA, 14 bp, Homo sapiens
caggcaggtctgca

SEQ ID NO: 2970037 - DNA, 16 bp, Homo sapiens
caggcatggccctggg

SEQ ID NO: 2970038 - DNA, 18 bp, Homo sapiens
caggcatggccctgggcg

SEQ ID NO: 2970039 - DNA, 16 bp, Homo sapiens
caggccaacagtagcc

SEQ ID NO: 2970040 - DNA, 18 bp, Homo sapiens
caggccagctccttttct

SEQ ID NO: 2970041 - DNA, 20 bp, Homo sapiens
caggccagctccttttctgt

SEQ ID NO: 2970042 - DNA, 14 bp, Homo sapiens
caggccaggccagc

SEQ ID NO: 2970043 - DNA, 22 bp, Homo sapiens
caggccagggcagttgacaggt

SEQ ID NO: 2970044 - DNA, 16 bp, Homo sapiens
caggccagggctcctg

SEQ ID NO: 2970045 - DNA, 22 bp, Homo sapiens
caggccaggtgggaacggctga

SEQ ID NO: 2970046 - DNA, 19 bp, Homo sapiens
caggccaggtgggcggaca

SEQ ID NO: 2970047 - DNA, 14 bp, Homo sapiens
caggccatgtggcc

SEQ ID NO: 2970048 - DNA, 11 bp, Homo sapiens
caggcccaccg

SEQ ID NO: 2970049 - DNA, 23 bp, Homo sapiens
caggcccaccggatgctgtgcct

SEQ ID NO: 2970050 - DNA, 15 bp, Homo sapiens
caggccccaggaaag

SEQ ID NO: 2970051 - DNA, 13 bp, Homo sapiens
caggcccccaagc

SEQ ID NO: 2970052 - DNA, 15 bp, Homo sapiens
caggcccccaagcct

SEQ ID NO: 2970053 - DNA, 18 bp, Homo sapiens
caggcccccaagcctgca

SEQ ID NO: 2970054 - DNA, 19 bp, Homo sapiens
caggcccccaccacacatc

SEQ ID NO: 2970055 - DNA, 13 bp, Homo sapiens
caggccccctagg

SEQ ID NO: 2970056 - DNA, 19 bp, Homo sapiens
caggccccgcttgtccagc

SEQ ID NO: 2970057 - DNA, 14 bp, Homo sapiens
caggcccctctcct

SEQ ID NO: 2970058 - DNA, 16 bp, Homo sapiens
caggcccctctcctcc

SEQ ID NO: 2970059 - DNA, 18 bp, Homo sapiens
caggcccggcgcggtggc

SEQ ID NO: 2970060 - DNA, 15 bp, Homo sapiens
caggcccggggctgg

SEQ ID NO: 2970061 - DNA, 16 bp, Homo sapiens
caggcccggggctggc

SEQ ID NO: 2970062 - DNA, 18 bp, Homo sapiens
caggcccgtcggagctgc

SEQ ID NO: 2970063 - DNA, 19 bp, Homo sapiens
caggcccgtcggagctgcc

SEQ ID NO: 2970064 - DNA, 20 bp, Homo sapiens
caggcccgtcggagctgcct

SEQ ID NO: 2970065 - DNA, 16 bp, Homo sapiens
caggcccgtctgtcca

SEQ ID NO: 2970066 - DNA, 23 bp, Homo sapiens
caggccctcagctgtcgggggcc

SEQ ID NO: 2970067 - DNA, 12 bp, Homo sapiens
caggccctccca

SEQ ID NO: 2970068 - DNA, 15 bp, Homo sapiens
caggccctcccacca

SEQ ID NO: 2970069 - DNA, 18 bp, Homo sapiens
caggccctcccaccaccc

SEQ ID NO: 2970070 - DNA, 22 bp, Homo sapiens
caggccctccctgttccccaga

SEQ ID NO: 2970071 - DNA, 23 bp, Homo sapiens
caggccctccctgttccccagag

SEQ ID NO: 2970072 - DNA, 16 bp, Homo sapiens
caggccctctgcctgc

SEQ ID NO: 2970073 - DNA, 22 bp, Homo sapiens
caggccctctgcctgcactccc

SEQ ID NO: 2970074 - DNA, 17 bp, Homo sapiens
caggccctggagggcag

SEQ ID NO: 2970075 - DNA, 17 bp, Homo sapiens
caggccctgtccagccc

SEQ ID NO: 2970076 - DNA, 17 bp, Homo sapiens
caggccctgtggcagga

SEQ ID NO: 2970077 - DNA, 19 bp, Homo sapiens
caggccgacagtcggtgac

SEQ ID NO: 2970078 - DNA, 21 bp, Homo sapiens
caggccgacagtcggtgaccc

SEQ ID NO: 2970079 - DNA, 23 bp, Homo sapiens
caggccgacagtcggtgacccca

SEQ ID NO: 2970080 - DNA, 18 bp, Homo sapiens
caggccggagcccagata

SEQ ID NO: 2970081 - DNA, 20 bp, Homo sapiens
caggccggcgagccctgtgg

SEQ ID NO: 2970082 - DNA, 17 bp, Homo sapiens
caggccgggcctgtaca

SEQ ID NO: 2970083 - DNA, 23 bp, Homo sapiens
caggcctaggtgcagctcctcag

SEQ ID NO: 2970084 - DNA, 12 bp, Homo sapiens
caggcctcactg

SEQ ID NO: 2970085 - DNA, 20 bp, Homo sapiens
caggcctcactggctcatgc

SEQ ID NO: 2970086 - DNA, 23 bp, Homo sapiens
caggcctcactggctcatgcccc

SEQ ID NO: 2970087 - DNA, 13 bp, Homo sapiens
caggcctccagct

SEQ ID NO: 2970088 - DNA, 13 bp, Homo sapiens
caggcctccctga

SEQ ID NO: 2970089 - DNA, 18 bp, Homo sapiens
caggcctccctgcctcag

SEQ ID NO: 2970090 - DNA, 21 bp, Homo sapiens
caggcctcgcctgccctcctc

SEQ ID NO: 2970091 - DNA, 19 bp, Homo sapiens
caggcctctcggtgctcca

SEQ ID NO: 2970092 - DNA, 18 bp, Homo sapiens
caggcctcttggcagtca

SEQ ID NO: 2970093 - DNA, 12 bp, Homo sapiens
caggcctgccct

SEQ ID NO: 2970094 - DNA, 14 bp, Homo sapiens
caggcctgccctgc

SEQ ID NO: 2970095 - DNA, 18 bp, Homo sapiens
caggcctgcgtgcgctgg

SEQ ID NO: 2970096 - DNA, 12 bp, Homo sapiens
caggcctggagc

SEQ ID NO: 2970097 - DNA, 19 bp, Homo sapiens
caggcctgtcatgattggc

SEQ ID NO: 2970098 - DNA, 22 bp, Homo sapiens
caggccttatctccaagaccag

SEQ ID NO: 2970099 - DNA, 17 bp, Homo sapiens
caggccttgctgactct

SEQ ID NO: 2970100 - DNA, 20 bp, Homo sapiens
caggccttgctgactctctg

SEQ ID NO: 2970101 - DNA, 23 bp, Homo sapiens
caggccttgctgactctctgagc

SEQ ID NO: 2970102 - DNA, 12 bp, Homo sapiens
caggcctttcct

SEQ ID NO: 2970103 - DNA, 15 bp, Homo sapiens
caggcgctgtgctat

SEQ ID NO: 2970104 - DNA, 20 bp, Homo sapiens
caggcgctgtgctatcatga

SEQ ID NO: 2970105 - DNA, 23 bp, Homo sapiens
caggcggagctgctgagtgacag

SEQ ID NO: 2970106 - DNA, 16 bp, Homo sapiens
caggcggccagggcgg

SEQ ID NO: 2970107 - DNA, 17 bp, Homo sapiens
caggcggccagggcggc

SEQ ID NO: 2970108 - DNA, 20 bp, Homo sapiens
caggcggccagggcggccag

SEQ ID NO: 2970109 - DNA, 13 bp, Homo sapiens
caggcggccctca

SEQ ID NO: 2970110 - DNA, 21 bp, Homo sapiens
caggcggccctcagtgcatcc

SEQ ID NO: 2970111 - DNA, 23 bp, Homo sapiens
caggcggccctcagtgcatcccc

SEQ ID NO: 2970112 - DNA, 18 bp, Homo sapiens
caggcgggcccagaccgg

SEQ ID NO: 2970113 - DNA, 22 bp, Homo sapiens
caggcggggggggcgcctggag

SEQ ID NO: 2970114 - DNA, 21 bp, Homo sapiens
caggcggtgggcacccaccct

SEQ ID NO: 2970115 - DNA, 20 bp, Homo sapiens
caggcgtgactcagcagcct

SEQ ID NO: 2970116 - DNA, 13 bp, Homo sapiens
caggcgtgagcca

SEQ ID NO: 2970117 - DNA, 14 bp, Homo sapiens
caggcgtgtggcag

SEQ ID NO: 2970118 - DNA, 18 bp, Homo sapiens
caggcgtgtggcagccac

SEQ ID NO: 2970119 - DNA, 20 bp, Homo sapiens
caggcgtgtggcagccacac

SEQ ID NO: 2970120 - DNA, 22 bp, Homo sapiens
caggcgtgtggcagccacacgc

SEQ ID NO: 2970121 - DNA, 18 bp, Homo sapiens
caggctactggtttgtat

SEQ ID NO: 2970122 - DNA, 23 bp, Homo sapiens
caggctcccagggacacctggga

SEQ ID NO: 2970123 - DNA, 13 bp, Homo sapiens
caggctctccatt

SEQ ID NO: 2970124 - DNA, 22 bp, Homo sapiens
caggctgaccacagcacagcca

SEQ ID NO: 2970125 - DNA, 17 bp, Homo sapiens
caggctgcaggagggca

SEQ ID NO: 2970126 - DNA, 18 bp, Homo sapiens
caggctgcaggagggcac

SEQ ID NO: 2970127 - DNA, 20 bp, Homo sapiens
caggctgcggtgggcagcca

SEQ ID NO: 2970128 - DNA, 19 bp, Homo sapiens
caggctggaatgagggagg

SEQ ID NO: 2970129 - DNA, 20 bp, Homo sapiens
caggctggaatgagggaggc

SEQ ID NO: 2970130 - DNA, 21 bp, Homo sapiens
caggctggaatgagggaggcg

SEQ ID NO: 2970131 - DNA, 15 bp, Homo sapiens
caggctggagtacag

SEQ ID NO: 2970132 - DNA, 16 bp, Homo sapiens
caggctggagtgcaat

SEQ ID NO: 2970133 - DNA, 13 bp, Homo sapiens
caggctggccagc

SEQ ID NO: 2970134 - DNA, 24 bp, Homo sapiens
caggctggccagtgctgcccatga

SEQ ID NO: 2970135 - DNA, 13 bp, Homo sapiens
caggctgggccgc

SEQ ID NO: 2970136 - DNA, 22 bp, Homo sapiens
caggctgggccgcaagggcctg

SEQ ID NO: 2970137 - DNA, 17 bp, Homo sapiens
caggctgggctgagcca

SEQ ID NO: 2970138 - DNA, 16 bp, Homo sapiens
caggctgggtgacaga

SEQ ID NO: 2970139 - DNA, 17 bp, Homo sapiens
caggctggtctaaaact

SEQ ID NO: 2970140 - DNA, 22 bp, Homo sapiens
caggctggtctcaaactcctga

SEQ ID NO: 2970141 - DNA, 20 bp, Homo sapiens
caggctggtcttgaagtcct

SEQ ID NO: 2970142 - DNA, 14 bp, Homo sapiens
caggctgtcccaag

SEQ ID NO: 2970143 - DNA, 15 bp, Homo sapiens
caggctgtcccaagc

SEQ ID NO: 2970144 - DNA, 23 bp, Homo sapiens
caggctgtcccaagctcccaaga

SEQ ID NO: 2970145 - DNA, 21 bp, Homo sapiens
caggcttatgaatatatttaa

SEQ ID NO: 2970146 - DNA, 14 bp, Homo sapiens
caggcttcctggtg

SEQ ID NO: 2970147 - DNA, 19 bp, Homo sapiens
caggcttcctggtgagaac

SEQ ID NO: 2970148 - DNA, 12 bp, Homo sapiens
caggcttctccc

SEQ ID NO: 2970149 - DNA, 13 bp, Homo sapiens
caggcttgcctgg

SEQ ID NO: 2970150 - DNA, 14 bp, Homo sapiens
caggcttgcctggg

SEQ ID NO: 2970151 - DNA, 15 bp, Homo sapiens
cagggaaaagcagct

SEQ ID NO: 2970152 - DNA, 19 bp, Homo sapiens
cagggaaaagcagctctcc

SEQ ID NO: 2970153 - DNA, 15 bp, Homo sapiens
cagggaactgcttgc

SEQ ID NO: 2970154 - DNA, 14 bp, Homo sapiens
cagggaagctacag

SEQ ID NO: 2970155 - DNA, 19 bp, Homo sapiens
cagggaagctacaggttac

SEQ ID NO: 2970156 - DNA, 24 bp, Homo sapiens
cagggaagctacaggttacaacag

SEQ ID NO: 2970157 - DNA, 14 bp, Homo sapiens
cagggaagtcccca

SEQ ID NO: 2970158 - DNA, 22 bp, Homo sapiens
cagggacacctgggagaaatct

SEQ ID NO: 2970159 - DNA, 15 bp, Homo sapiens
cagtgctgagggacc

SEQ ID NO: 2970160 - DNA, 18 bp, Homo sapiens
cagtgctgcccatgagca

SEQ ID NO: 2970161 - DNA, 18 bp, Homo sapiens
cagtggaaccgttgccaa

SEQ ID NO: 2970162 - DNA, 21 bp, Homo sapiens
cagtggaccgcccttttcccc

SEQ ID NO: 2970163 - DNA, 22 bp, Homo sapiens
cagtggaccgcccttttcccct

SEQ ID NO: 2970164 - DNA, 20 bp, Homo sapiens
cagtggcacgatctcagctc

SEQ ID NO: 2970165 - DNA, 20 bp, Homo sapiens
cagtggccacgttcagggag

SEQ ID NO: 2970166 - DNA, 20 bp, Homo sapiens
cagtggccttgcttcttaga

SEQ ID NO: 2970167 - DNA, 14 bp, Homo sapiens
cagtggcgcatgcc

SEQ ID NO: 2970168 - DNA, 17 bp, Homo sapiens
cagtggcgcatgcctgt

SEQ ID NO: 2970169 - DNA, 13 bp, Homo sapiens
cagtggctctggg

SEQ ID NO: 2970170 - DNA, 20 bp, Homo sapiens
cagtggctggaagaaccact

SEQ ID NO: 2970171 - DNA, 17 bp, Homo sapiens
cagtggcttagctgcca

SEQ ID NO: 2970172 - DNA, 16 bp, Homo sapiens
cagtggcttccatcaa

SEQ ID NO: 2970173 - DNA, 12 bp, Homo sapiens
cagtgggaaata

SEQ ID NO: 2970174 - DNA, 14 bp, Homo sapiens
cagtgggaaatatt

SEQ ID NO: 2970175 - DNA, 21 bp, Homo sapiens
cagtgggaacgtgactgcccc

SEQ ID NO: 2970176 - DNA, 17 bp, Homo sapiens
cagtgggaactggaggg

SEQ ID NO: 2970177 - DNA, 14 bp, Homo sapiens
cagtgggagaaaac

SEQ ID NO: 2970178 - DNA, 17 bp, Homo sapiens
cagtgggagatgttaga

SEQ ID NO: 2970179 - DNA, 22 bp, Homo sapiens
cagtgggagggtaccagcagaa

SEQ ID NO: 2970180 - DNA, 15 bp, Homo sapiens
cagtgggatttggta

SEQ ID NO: 2970181 - DNA, 15 bp, Homo sapiens
cagtgggcaggtggc

SEQ ID NO: 2970182 - DNA, 16 bp, Homo sapiens
cagtgggcaggtggcc

SEQ ID NO: 2970183 - DNA, 14 bp, Homo sapiens
cagtgggctgtgtt

SEQ ID NO: 2970184 - DNA, 21 bp, Homo sapiens
cagtgggctgtgttgactgct

SEQ ID NO: 2970185 - DNA, 16 bp, Homo sapiens
cagtggggctctctga

SEQ ID NO: 2970186 - DNA, 18 bp, Homo sapiens
cagtggggtcaagctgag

SEQ ID NO: 2970187 - DNA, 19 bp, Homo sapiens
cagtggggtcaagctgagc

SEQ ID NO: 2970188 - DNA, 22 bp, Homo sapiens
cagtggggtttcgcagcctgag

SEQ ID NO: 2970189 - DNA, 23 bp, Homo sapiens
cagtggggtttcgcagcctgagt

SEQ ID NO: 2970190 - DNA, 19 bp, Homo sapiens
cagtggtgcgatctcggct

SEQ ID NO: 2970191 - DNA, 16 bp, Homo sapiens
cagtggtggcagggcc

SEQ ID NO: 2970192 - DNA, 18 bp, Homo sapiens
cagtgtaaattcagtctt

SEQ ID NO: 2970193 - DNA, 14 bp, Homo sapiens
cagtgtaatttctt

SEQ ID NO: 2970194 - DNA, 14 bp, Homo sapiens
cagtgtatctaatt

SEQ ID NO: 2970195 - DNA, 18 bp, Homo sapiens
cagtgtatgtagaagcat

SEQ ID NO: 2970196 - DNA, 13 bp, Homo sapiens
cagtgtcatttgc

SEQ ID NO: 2970197 - DNA, 17 bp, Homo sapiens
cagtgtcatttgctctg

SEQ ID NO: 2970198 - DNA, 20 bp, Homo sapiens
cagtgtccttcacggcactg

SEQ ID NO: 2970199 - DNA, 21 bp, Homo sapiens
cagtgtcttaaggagactggt

SEQ ID NO: 2970200 - DNA, 13 bp, Homo sapiens
cagtgtgaagtta

SEQ ID NO: 2970201 - DNA, 11 bp, Homo sapiens
cagtgtgaatg

SEQ ID NO: 2970202 - DNA, 19 bp, Homo sapiens
cagtgtgcactaaggggcc

SEQ ID NO: 2970203 - DNA, 19 bp, Homo sapiens
cagtgttagggaagggcct

SEQ ID NO: 2970204 - DNA, 17 bp, Homo sapiens
cagtgttgcctcttgca

SEQ ID NO: 2970205 - DNA, 13 bp, Homo sapiens
cagtgtttatgac

SEQ ID NO: 2970206 - DNA, 15 bp, Homo sapiens
cagtgtttatgacga

SEQ ID NO: 2970207 - DNA, 19 bp, Homo sapiens
cagtgtttctgaatgtttg

SEQ ID NO: 2970208 - DNA, 20 bp, Homo sapiens
cagtgtttcttcacttcttt

SEQ ID NO: 2970209 - DNA, 13 bp, Homo sapiens
cagtgttttgcat

SEQ ID NO: 2970210 - DNA, 11 bp, Homo sapiens
cagtgttttgg

SEQ ID NO: 2970211 - DNA, 22 bp, Homo sapiens
cagtgttttggactccatctct

SEQ ID NO: 2970212 - DNA, 13 bp, Homo sapiens
cagtgtttttcct

SEQ ID NO: 2970213 - DNA, 20 bp, Homo sapiens
cagtgtttttgtaaagtgtg

SEQ ID NO: 2970214 - DNA, 21 bp, Homo sapiens
cagtgtttttgtaaagtgtgg

SEQ ID NO: 2970215 - DNA, 15 bp, Homo sapiens
cagttaaaaaaaatt

SEQ ID NO: 2970216 - DNA, 16 bp, Homo sapiens
cagttaaaaaaaattt

SEQ ID NO: 2970217 - DNA, 22 bp, Homo sapiens
cagttaacgtcacccaaaagca

SEQ ID NO: 2970218 - DNA, 13 bp, Homo sapiens
cagttactcagcc

SEQ ID NO: 2970219 - DNA, 13 bp, Homo sapiens
cagttactctgaa

SEQ ID NO: 2970220 - DNA, 16 bp, Homo sapiens
cagttagcaaactttg

SEQ ID NO: 2970221 - DNA, 22 bp, Homo sapiens
cagttagggttttgcaataact

SEQ ID NO: 2970222 - DNA, 23 bp, Homo sapiens
cagttagggttttgcaataactt

SEQ ID NO: 2970223 - DNA, 17 bp, Homo sapiens
cagttagtaatggtgct

SEQ ID NO: 2970224 - DNA, 18 bp, Homo sapiens
cagttagttagaattgga

SEQ ID NO: 2970225 - DNA, 18 bp, Homo sapiens
cagttattacatgtaatt

SEQ ID NO: 2970226 - DNA, 21 bp, Homo sapiens
cagttattatatttacaaatg

SEQ ID NO: 2970227 - DNA, 21 bp, Homo sapiens
cagttattggtggaatcttta

SEQ ID NO: 2970228 - DNA, 21 bp, Homo sapiens
cagttcacttctttgcagagc

SEQ ID NO: 2970229 - DNA, 14 bp, Homo sapiens
cagttcagcttggg

SEQ ID NO: 2970230 - DNA, 15 bp, Homo sapiens
cagttcataaacaac

SEQ ID NO: 2970231 - DNA, 13 bp, Homo sapiens
cagttcataaatt

SEQ ID NO: 2970232 - DNA, 18 bp, Homo sapiens
cagttcataaatttgttg

SEQ ID NO: 2970233 - DNA, 14 bp, Homo sapiens
cagttccagctttt

SEQ ID NO: 2970234 - DNA, 18 bp, Homo sapiens
cagttcctcgccctgggt

SEQ ID NO: 2970235 - DNA, 16 bp, Homo sapiens
cagttcctcttcatct

SEQ ID NO: 2970236 - DNA, 23 bp, Homo sapiens
cagttccttctctttaaatcaga

SEQ ID NO: 2970237 - DNA, 14 bp, Homo sapiens
cagttctcaaatgt

SEQ ID NO: 2970238 - DNA, 16 bp, Homo sapiens
cagttctcaaatgtgt

SEQ ID NO: 2970239 - DNA, 18 bp, Homo sapiens
cagttctcaaatgtgtgt

SEQ ID NO: 2970240 - DNA, 20 bp, Homo sapiens
cagttctgggtgctccctac

SEQ ID NO: 2970241 - DNA, 20 bp, Homo sapiens
cagttcttaatacaggagac

SEQ ID NO: 2970242 - DNA, 22 bp, Homo sapiens
cagttcttagattcaggggaag

SEQ ID NO: 2970243 - DNA, 12 bp, Homo sapiens
cagttcttcccc

SEQ ID NO: 2970244 - DNA, 14 bp, Homo sapiens
cagttctttctttt

SEQ ID NO: 2970245 - DNA, 18 bp, Homo sapiens
cagttctttgggccagac

SEQ ID NO: 2970246 - DNA, 18 bp, Homo sapiens
cagttgattaagttaata

SEQ ID NO: 2970247 - DNA, 16 bp, Homo sapiens
cagttgattttctgga

SEQ ID NO: 2970248 - DNA, 13 bp, Homo sapiens
cagttgcaggagc

SEQ ID NO: 2970249 - DNA, 19 bp, Homo sapiens
cagttgcaggagcgtgaag

SEQ ID NO: 2970250 - DNA, 22 bp, Homo sapiens
cagttggtgttcaaatagcact

SEQ ID NO: 2970251 - DNA, 14 bp, Homo sapiens
cagttgtagaatgt

SEQ ID NO: 2970252 - DNA, 15 bp, Homo sapiens
cagttgtagaatgta

SEQ ID NO: 2970253 - DNA, 17 bp, Homo sapiens
cagttgtagaatgtatt

SEQ ID NO: 2970254 - DNA, 23 bp, Homo sapiens
cagttgtagcaggtttcactatt

SEQ ID NO: 2970255 - DNA, 21 bp, Homo sapiens
cagttgtagggttacagagac

SEQ ID NO: 2970256 - DNA, 17 bp, Homo sapiens
cagttgtcctatggaca

SEQ ID NO: 2970257 - DNA, 16 bp, Homo sapiens
cagtttataaagccaa

SEQ ID NO: 2970258 - DNA, 21 bp, Homo sapiens
cagtttataaagccaagaatt

SEQ ID NO: 2970259 - DNA, 13 bp, Homo sapiens
cagtttatcattc

SEQ ID NO: 2970260 - DNA, 15 bp, Homo sapiens
cagtttatcattcaa

SEQ ID NO: 2970261 - DNA, 18 bp, Homo sapiens
cagtttatttgaaccaat

SEQ ID NO: 2970262 - DNA, 18 bp, Homo sapiens
cagtttcaattcagtgct

SEQ ID NO: 2970263 - DNA, 13 bp, Homo sapiens
cagtttcccatgc

SEQ ID NO: 2970264 - DNA, 15 bp, Homo sapiens
cagtttctgctgttg

SEQ ID NO: 2970265 - DNA, 12 bp, Homo sapiens
cagtttcttaaa

SEQ ID NO: 2970266 - DNA, 16 bp, Homo sapiens
cagtttcttctgtaaa

SEQ ID NO: 2970267 - DNA, 18 bp, Homo sapiens
cagtttgaaaatattttg

SEQ ID NO: 2970268 - DNA, 17 bp, Homo sapiens
cagtttgaaattctgaa

SEQ ID NO: 2970269 - DNA, 18 bp, Homo sapiens
cagtttgaaattctgaat

SEQ ID NO: 2970270 - DNA, 13 bp, Homo sapiens
cagtttgaacaaa

SEQ ID NO: 2970271 - DNA, 22 bp, Homo sapiens
cagtttgcagaaaagcacctgc

SEQ ID NO: 2970272 - DNA, 17 bp, Homo sapiens
cagtttggcaaactctc

SEQ ID NO: 2970273 - DNA, 18 bp, Homo sapiens
cagtttgtctctttgcaa

SEQ ID NO: 2970274 - DNA, 12 bp, Homo sapiens
cagtttgtttcc

SEQ ID NO: 2970275 - DNA, 14 bp, Homo sapiens
cagtttgtttcctg

SEQ ID NO: 2970276 - DNA, 13 bp, Homo sapiens
cagttttccattg

SEQ ID NO: 2970277 - DNA, 15 bp, Homo sapiens
cagttttcccacttt

SEQ ID NO: 2970278 - DNA, 19 bp, Homo sapiens
cagttttcctatgctttga

SEQ ID NO: 2970279 - DNA, 13 bp, Homo sapiens
cagttttcggaaa

SEQ ID NO: 2970280 - DNA, 19 bp, Homo sapiens
cagttttcggaaacactga

SEQ ID NO: 2970281 - DNA, 18 bp, Homo sapiens
cagttttctgttcagctt

SEQ ID NO: 2970282 - DNA, 19 bp, Homo sapiens
cagttttgacatcagccag

SEQ ID NO: 2970283 - DNA, 14 bp, Homo sapiens
cagttttgtaaagg

SEQ ID NO: 2970284 - DNA, 14 bp, Homo sapiens
cagttttgtaaatg

SEQ ID NO: 2970285 - DNA, 20 bp, Homo sapiens
cagttttgtggactgagcga

SEQ ID NO: 2970286 - DNA, 16 bp, Homo sapiens
cagtttttaaaattgg

SEQ ID NO: 2970287 - DNA, 17 bp, Homo sapiens
cagtttttggagtgtta

SEQ ID NO: 2970288 - DNA, 19 bp, Homo sapiens
cagttttttcacctggaag

SEQ ID NO: 2970289 - DNA, 13 bp, Homo sapiens
cagttttttgttg

SEQ ID NO: 2970290 - DNA, 19 bp, Homo sapiens
cataaaagggtcaaacctg

SEQ ID NO: 2970291 - DNA, 21 bp, Homo sapiens
cataaaagggtcaaacctgta

SEQ ID NO: 2970292 - DNA, 12 bp, Homo sapiens
catctttgctga

SEQ ID NO: 2970293 - DNA, 23 bp, Homo sapiens
catctttgctgaatgtcattatt

SEQ ID NO: 2970294 - DNA, 13 bp, Homo sapiens
catcttttaaaga

SEQ ID NO: 2970295 - DNA, 17 bp, Homo sapiens
catcttttaatcatgag

SEQ ID NO: 2970296 - DNA, 19 bp, Homo sapiens
catcttttaatcatgagcc

SEQ ID NO: 2970297 - DNA, 22 bp, Homo sapiens
catgaaaagttatttatgctat

SEQ ID NO: 2970298 - DNA, 11 bp, Homo sapiens
catgaaacacc

SEQ ID NO: 2970299 - DNA, 13 bp, Homo sapiens
catgaaacattat

SEQ ID NO: 2970300 - DNA, 14 bp, Homo sapiens
catgaaattactta

SEQ ID NO: 2970301 - DNA, 13 bp, Homo sapiens
catgaactggctt

SEQ ID NO: 2970302 - DNA, 12 bp, Homo sapiens
catgaagaagct

SEQ ID NO: 2970303 - DNA, 14 bp, Homo sapiens
catgaagaagctgg

SEQ ID NO: 2970304 - DNA, 17 bp, Homo sapiens
catgaagcataatttgt

SEQ ID NO: 2970305 - DNA, 18 bp, Homo sapiens
catgaagcataatttgtt

SEQ ID NO: 2970306 - DNA, 20 bp, Homo sapiens
catgaagcataatttgttta

SEQ ID NO: 2970307 - DNA, 22 bp, Homo sapiens
catgaagccacagcccaggcct

SEQ ID NO: 2970308 - DNA, 19 bp, Homo sapiens
catgaagccttgctgaact

SEQ ID NO: 2970309 - DNA, 24 bp, Homo sapiens
catgaagtcttaaggacaaagtgc

SEQ ID NO: 2970310 - DNA, 15 bp, Homo sapiens
catgaatcgcttctc

SEQ ID NO: 2970311 - DNA, 17 bp, Homo sapiens
catgaatcgcttctctt

SEQ ID NO: 2970312 - DNA, 20 bp, Homo sapiens
catgaatcgcttctcttttg

SEQ ID NO: 2970313 - DNA, 14 bp, Homo sapiens
catgaatcttgaga

SEQ ID NO: 2970314 - DNA, 22 bp, Homo sapiens
catgaatcttgagagtgttcct

SEQ ID NO: 2970315 - DNA, 19 bp, Homo sapiens
catgaattcatactctgtt

SEQ ID NO: 2970316 - DNA, 20 bp, Homo sapiens
catgaattcatactctgttg

SEQ ID NO: 2970317 - DNA, 18 bp, Homo sapiens
catgaatttattgcacat

SEQ ID NO: 2970318 - DNA, 17 bp, Homo sapiens
catgacaagatgggaca

SEQ ID NO: 2970319 - DNA, 23 bp, Homo sapiens
catgacaagatgggacagcaaca

SEQ ID NO: 2970320 - DNA, 16 bp, Homo sapiens
catgacacttccaaag

SEQ ID NO: 2970321 - DNA, 13 bp, Homo sapiens
catgacatcaaaa

SEQ ID NO: 2970322 - DNA, 20 bp, Homo sapiens
catgacatttaccagcaact

SEQ ID NO: 2970323 - DNA, 12 bp, Homo sapiens
catgacattttt

SEQ ID NO: 2970324 - DNA, 17 bp, Homo sapiens
catgaccacatagcatg

SEQ ID NO: 2970325 - DNA, 16 bp, Homo sapiens
catgaccctctgtccc

SEQ ID NO: 2970326 - DNA, 17 bp, Homo sapiens
catgaccctctgtcccc

SEQ ID NO: 2970327 - DNA, 18 bp, Homo sapiens
catgaccttatccttcct

SEQ ID NO: 2970328 - DNA, 21 bp, Homo sapiens
catgactagagacgcaccttg

SEQ ID NO: 2970329 - DNA, 14 bp, Homo sapiens
catgactatggata

SEQ ID NO: 2970330 - DNA, 23 bp, Homo sapiens
catgactgagtctggcaaacatg

SEQ ID NO: 2970331 - DNA, 18 bp, Homo sapiens
catgagactcagtgcaga

SEQ ID NO: 2970332 - DNA, 18 bp, Homo sapiens
catgagataatatgcaga

SEQ ID NO: 2970333 - DNA, 22 bp, Homo sapiens
catgagatgatacatccaaagc

SEQ ID NO: 2970334 - DNA, 23 bp, Homo sapiens
catgagatgtgtggactgtggca

SEQ ID NO: 2970335 - DNA, 20 bp, Homo sapiens
catgagcattggatacagca

SEQ ID NO: 2970336 - DNA, 23 bp, Homo sapiens
catgagcattggatacagcagta

SEQ ID NO: 2970337 - DNA, 14 bp, Homo sapiens
catgagccactgtg

SEQ ID NO: 2970338 - DNA, 14 bp, Homo sapiens
catgagcctgttta

SEQ ID NO: 2970339 - DNA, 15 bp, Homo sapiens
catgagcctgtttat

SEQ ID NO: 2970340 - DNA, 16 bp, Homo sapiens
catgagcctgtttatt

SEQ ID NO: 2970341 - DNA, 22 bp, Homo sapiens
catgaggaaagcagttgaaatg

SEQ ID NO: 2970342 - DNA, 14 bp, Homo sapiens
catgaggaccaggg

SEQ ID NO: 2970343 - DNA, 19 bp, Homo sapiens
catgaggagaaaaaaagca

SEQ ID NO: 2970344 - DNA, 13 bp, Homo sapiens
catgaggaggggc

SEQ ID NO: 2970345 - DNA, 21 bp, Homo sapiens
catgaggaggggcccccctgc

SEQ ID NO: 2970346 - DNA, 22 bp, Homo sapiens
catgaggaggggcccccctgcc

SEQ ID NO: 2970347 - DNA, 23 bp, Homo sapiens
catgaggaggggcccccctgccc

SEQ ID NO: 2970348 - DNA, 18 bp, Homo sapiens
catgagttactgtgcatt

SEQ ID NO: 2970349 - DNA, 23 bp, Homo sapiens
catgagttggggtctggcagcct

SEQ ID NO: 2970350 - DNA, 16 bp, Homo sapiens
catgagtttaaatcaa

SEQ ID NO: 2970351 - DNA, 17 bp, Homo sapiens
catgatactcatttctt

SEQ ID NO: 2970352 - DNA, 21 bp, Homo sapiens
catgatattttgtttttcccc

SEQ ID NO: 2970353 - DNA, 23 bp, Homo sapiens
catgatccacccacctcagcctc

SEQ ID NO: 2970354 - DNA, 22 bp, Homo sapiens
catgatccagctgtgtgttttc

SEQ ID NO: 2970355 - DNA, 18 bp, Homo sapiens
catgatctccctgccgcc

SEQ ID NO: 2970356 - DNA, 21 bp, Homo sapiens
catgatctccctgccgcctca

SEQ ID NO: 2970357 - DNA, 18 bp, Homo sapiens
catgatgagctcctcttc

SEQ ID NO: 2970358 - DNA, 17 bp, Homo sapiens
catgatgcttttactga

SEQ ID NO: 2970359 - DNA, 15 bp, Homo sapiens
catgatggcaacaga

SEQ ID NO: 2970360 - DNA, 19 bp, Homo sapiens
catgatgggaaaatatttc

SEQ ID NO: 2970361 - DNA, 18 bp, Homo sapiens
catgatggtcacttaaaa

SEQ ID NO: 2970362 - DNA, 16 bp, Homo sapiens
catgatggtgcatgcc

SEQ ID NO: 2970363 - DNA, 22 bp, Homo sapiens
catgatggttattttcttttct

SEQ ID NO: 2970364 - DNA, 12 bp, Homo sapiens
catgattagcaa

SEQ ID NO: 2970365 - DNA, 22 bp, Homo sapiens
catgattagcagaagaaaggaa

SEQ ID NO: 2970366 - DNA, 14 bp, Homo sapiens
catgattctattta

SEQ ID NO: 2970367 - DNA, 22 bp, Homo sapiens
catgatttccctccagagaaag

SEQ ID NO: 2970368 - DNA, 14 bp, Homo sapiens
catgatttccttga

SEQ ID NO: 2970369 - DNA, 21 bp, Homo sapiens
catgcaaaagaaagcaaatta

SEQ ID NO: 2970370 - DNA, 14 bp, Homo sapiens
catgcaaatgctgt

SEQ ID NO: 2970371 - DNA, 15 bp, Homo sapiens
catgcaagcagagga

SEQ ID NO: 2970372 - DNA, 17 bp, Homo sapiens
catgcaagtgctgtttg

SEQ ID NO: 2970373 - DNA, 20 bp, Homo sapiens
catgcaagtgctgtttgggc

SEQ ID NO: 2970374 - DNA, 20 bp, Homo sapiens
catgcacacggctggtcact

SEQ ID NO: 2970375 - DNA, 22 bp, Homo sapiens
catgcaccaggactggctgtgt

SEQ ID NO: 2970376 - DNA, 20 bp, Homo sapiens
catgcaccctcatacacaga

SEQ ID NO: 2970377 - DNA, 20 bp, Homo sapiens
catgcacctgcaatcccagc

SEQ ID NO: 2970378 - DNA, 15 bp, Homo sapiens
catgcactcagctct

SEQ ID NO: 2970379 - DNA, 16 bp, Homo sapiens
catgcactgtgaagga

SEQ ID NO: 2970380 - DNA, 19 bp, Homo sapiens
catgcaggaaggaaaacta

SEQ ID NO: 2970381 - DNA, 13 bp, Homo sapiens
catgcataaaagg

SEQ ID NO: 2970382 - DNA, 11 bp, Homo sapiens
catgcatacac

SEQ ID NO: 2970383 - DNA, 14 bp, Homo sapiens
catgcatacacaca

SEQ ID NO: 2970384 - DNA, 15 bp, Homo sapiens
catgcatacacacac

SEQ ID NO: 2970385 - DNA, 23 bp, Homo sapiens
catgcatacacacacacacacag

SEQ ID NO: 2970386 - DNA, 15 bp, Homo sapiens
catgcatacatgctg

SEQ ID NO: 2970387 - DNA, 17 bp, Homo sapiens
catgcatacttcaaaag

SEQ ID NO: 2970388 - DNA, 13 bp, Homo sapiens
catgcatctgttt

SEQ ID NO: 2970389 - DNA, 16 bp, Homo sapiens
catgccaacaagaatg

SEQ ID NO: 2970390 - DNA, 20 bp, Homo sapiens
catgccaacaagaatgcatt

SEQ ID NO: 2970391 - DNA, 17 bp, Homo sapiens
catgccacaaggacttc

SEQ ID NO: 2970392 - DNA, 21 bp, Homo sapiens
catgccacaaggacttcctgt

SEQ ID NO: 2970393 - DNA, 20 bp, Homo sapiens
catgccaggacccgccagcc

SEQ ID NO: 2970394 - DNA, 23 bp, Homo sapiens
catgccaggacccgccagccccg

SEQ ID NO: 2970395 - DNA, 11 bp, Homo sapiens
catgcccacaa

SEQ ID NO: 2970396 - DNA, 18 bp, Homo sapiens
catgccccaggctctcgc

SEQ ID NO: 2970397 - DNA, 15 bp, Homo sapiens
catgcccctggctgg

SEQ ID NO: 2970398 - DNA, 16 bp, Homo sapiens
catgcccctggctggg

SEQ ID NO: 2970399 - DNA, 14 bp, Homo sapiens
catgccctcctctc

SEQ ID NO: 2970400 - DNA, 15 bp, Homo sapiens
catgccctcctctcc

SEQ ID NO: 2970401 - DNA, 17 bp, Homo sapiens
catgccctcctctccca

SEQ ID NO: 2970402 - DNA, 17 bp, Homo sapiens
catgcctgtaatcccag

SEQ ID NO: 2970403 - DNA, 23 bp, Homo sapiens
catgcctgtaatcccagaacttt

SEQ ID NO: 2970404 - DNA, 22 bp, Homo sapiens
catgcctgtagtctcagctagt

SEQ ID NO: 2970405 - DNA, 16 bp, Homo sapiens
catgcctgtggctgcg

SEQ ID NO: 2970406 - DNA, 15 bp, Homo sapiens
catgcggagccagca

SEQ ID NO: 2970407 - DNA, 15 bp, Homo sapiens
catgcgggctcgccc

SEQ ID NO: 2970408 - DNA, 13 bp, Homo sapiens
catgcggtagcca

SEQ ID NO: 2970409 - DNA, 17 bp, Homo sapiens
catgcggtagccagcac

SEQ ID NO: 2970410 - DNA, 12 bp, Homo sapiens
catgctcagtac

SEQ ID NO: 2970411 - DNA, 18 bp, Homo sapiens
catgctccagggtcaggc

SEQ ID NO: 2970412 - DNA, 14 bp, Homo sapiens
catgctcccaactc

SEQ ID NO: 2970413 - DNA, 15 bp, Homo sapiens
catgctctctgcagc

SEQ ID NO: 2970414 - DNA, 20 bp, Homo sapiens
catgctctctgcagccagcc

SEQ ID NO: 2970415 - DNA, 21 bp, Homo sapiens
catgctctctgcagccagccc

SEQ ID NO: 2970416 - DNA, 23 bp, Homo sapiens
catgctctctgcagccagcccag

SEQ ID NO: 2970417 - DNA, 21 bp, Homo sapiens
catgctcttgaccttgtagag

SEQ ID NO: 2970418 - DNA, 17 bp, Homo sapiens
catgctggaaaataata

SEQ ID NO: 2970419 - DNA, 20 bp, Homo sapiens
catgctgtccctgcactgtg

SEQ ID NO: 2970420 - DNA, 23 bp, Homo sapiens
catgctgtccctgcactgtgccc

SEQ ID NO: 2970421 - DNA, 17 bp, Homo sapiens
catgctgttgattgcta

SEQ ID NO: 2970422 - DNA, 20 bp, Homo sapiens
catgctgttgattgctaaat

SEQ ID NO: 2970423 - DNA, 16 bp, Homo sapiens
ccaaagagtctctggc

SEQ ID NO: 2970424 - DNA, 18 bp, Homo sapiens
ccaaagagtctctggctc

SEQ ID NO: 2970425 - DNA, 19 bp, Homo sapiens
ccaaagagtctctggctca

SEQ ID NO: 2970426 - DNA, 16 bp, Homo sapiens
ccaaagccactggaag

SEQ ID NO: 2970427 - DNA, 21 bp, Homo sapiens
ccaaagccactggaaggagca

SEQ ID NO: 2970428 - DNA, 16 bp, Homo sapiens
ccaaagcctgtcccag

SEQ ID NO: 2970429 - DNA, 17 bp, Homo sapiens
ccaaagcctgtcccagg

SEQ ID NO: 2970430 - DNA, 19 bp, Homo sapiens
ccaaagcctgtcccaggac

SEQ ID NO: 2970431 - DNA, 14 bp, Homo sapiens
ccaaagctgagcct

SEQ ID NO: 2970432 - DNA, 16 bp, Homo sapiens
ccaaagctttcatgta

SEQ ID NO: 2970433 - DNA, 22 bp, Homo sapiens
ccaaaggcatccaggccagggc

SEQ ID NO: 2970434 - DNA, 23 bp, Homo sapiens
ccaaaggcatccaggccagggct

SEQ ID NO: 2970435 - DNA, 22 bp, Homo sapiens
ccaaaggcattttattgcttga

SEQ ID NO: 2970436 - DNA, 14 bp, Homo sapiens
ccaaagggcctcct

SEQ ID NO: 2970437 - DNA, 21 bp, Homo sapiens
ccaaagggtgaagctatttat

SEQ ID NO: 2970438 - DNA, 18 bp, Homo sapiens
ccaaagtaaactgtgtag

SEQ ID NO: 2970439 - DNA, 14 bp, Homo sapiens
ccaaagtctctaat

SEQ ID NO: 2970440 - DNA, 15 bp, Homo sapiens
ccaaagtgctgagat

SEQ ID NO: 2970441 - DNA, 22 bp, Homo sapiens
ccaaagtgttgggattacaggc

SEQ ID NO: 2970442 - DNA, 15 bp, Homo sapiens
ccaaagttaaatgta

SEQ ID NO: 2970443 - DNA, 14 bp, Homo sapiens
ccaaagttctaata

SEQ ID NO: 2970444 - DNA, 20 bp, Homo sapiens
ccaaagttctaataatttct

SEQ ID NO: 2970445 - DNA, 23 bp, Homo sapiens
ccaaagttctaataatttctaat

SEQ ID NO: 2970446 - DNA, 16 bp, Homo sapiens
ccaaatagccaccttg

SEQ ID NO: 2970447 - DNA, 14 bp, Homo sapiens
ccaaatagccccag

SEQ ID NO: 2970448 - DNA, 19 bp, Homo sapiens
ccaaatagccccagactgg

SEQ ID NO: 2970449 - DNA, 15 bp, Homo sapiens
ccaaatcccctaagc

SEQ ID NO: 2970450 - DNA, 20 bp, Homo sapiens
ccaaatccctttcatgtctt

SEQ ID NO: 2970451 - DNA, 21 bp, Homo sapiens
ccaaatccgaacctcctctgt

SEQ ID NO: 2970452 - DNA, 18 bp, Homo sapiens
ccaaatccgccagtgttt

SEQ ID NO: 2970453 - DNA, 19 bp, Homo sapiens
ccaaatccgccagtgtttc

SEQ ID NO: 2970454 - DNA, 20 bp, Homo sapiens
ccaaatccgccagtgtttct

SEQ ID NO: 2970455 - DNA, 20 bp, Homo sapiens
ccaaatccttagatctggca

SEQ ID NO: 2970456 - DNA, 22 bp, Homo sapiens
ccaaatctgtcctctgtagtat

SEQ ID NO: 2970457 - DNA, 18 bp, Homo sapiens
ccaaatgcattcatgttt

SEQ ID NO: 2970458 - DNA, 21 bp, Homo sapiens
ccaaatgcccaaggatgcctt

SEQ ID NO: 2970459 - DNA, 19 bp, Homo sapiens
ccaaattaaacgtaaatgt

SEQ ID NO: 2970460 - DNA, 13 bp, Homo sapiens
ccaaattagccag

SEQ ID NO: 2970461 - DNA, 19 bp, Homo sapiens
ccaaattgcttctaggagt

SEQ ID NO: 2970462 - DNA, 22 bp, Homo sapiens
ccaacaactcagaatgggggct

SEQ ID NO: 2970463 - DNA, 15 bp, Homo sapiens
ccaacaagaatgcat

SEQ ID NO: 2970464 - DNA, 16 bp, Homo sapiens
ccaacaagaatgcatt

SEQ ID NO: 2970465 - DNA, 18 bp, Homo sapiens
ccaacaagaatgcattga

SEQ ID NO: 2970466 - DNA, 19 bp, Homo sapiens
ccaacaagaatgcattgat

SEQ ID NO: 2970467 - DNA, 19 bp, Homo sapiens
ccaacaccaagcacagcag

SEQ ID NO: 2970468 - DNA, 22 bp, Homo sapiens
ccaacaccaagcacagcagcct

SEQ ID NO: 2970469 - DNA, 17 bp, Homo sapiens
ccaacaccccgcctgcc

SEQ ID NO: 2970470 - DNA, 21 bp, Homo sapiens
ccaacaccccgcctgcctcct

SEQ ID NO: 2970471 - DNA, 22 bp, Homo sapiens
ccaacaccccgcctgcctcctg

SEQ ID NO: 2970472 - DNA, 16 bp, Homo sapiens
ccaacacgcacctgcc

SEQ ID NO: 2970473 - DNA, 21 bp, Homo sapiens
ccaacacgcacctgcctcagg

SEQ ID NO: 2970474 - DNA, 16 bp, Homo sapiens
ccaacactgccagcat

SEQ ID NO: 2970475 - DNA, 13 bp, Homo sapiens
ccaacagtgtgaa

SEQ ID NO: 2970476 - DNA, 16 bp, Homo sapiens
ccaacatccagtcctg

SEQ ID NO: 2970477 - DNA, 18 bp, Homo sapiens
ccaacatccagtcctgct

SEQ ID NO: 2970478 - DNA, 17 bp, Homo sapiens
ccaacatcccattgccc

SEQ ID NO: 2970479 - DNA, 21 bp, Homo sapiens
ccaacatcccattgccctggt

SEQ ID NO: 2970480 - DNA, 16 bp, Homo sapiens
ccaacatggatgtgtt

SEQ ID NO: 2970481 - DNA, 17 bp, Homo sapiens
ccaacatggatgtgttg

SEQ ID NO: 2970482 - DNA, 18 bp, Homo sapiens
ccaacattgccttgcatt

SEQ ID NO: 2970483 - DNA, 19 bp, Homo sapiens
ccaacattgccttgcattt

SEQ ID NO: 2970484 - DNA, 13 bp, Homo sapiens
ccaaccaaggaag

SEQ ID NO: 2970485 - DNA, 16 bp, Homo sapiens
ccaaccaaggaaggag

SEQ ID NO: 2970486 - DNA, 18 bp, Homo sapiens
ccaaccaaggaaggagcc

SEQ ID NO: 2970487 - DNA, 21 bp, Homo sapiens
ccaaccaaggaaggagcccct

SEQ ID NO: 2970488 - DNA, 13 bp, Homo sapiens
ccaaccagccttt

SEQ ID NO: 2970489 - DNA, 16 bp, Homo sapiens
ccaaccccacccagct

SEQ ID NO: 2970490 - DNA, 16 bp, Homo sapiens
ccaacccccagccccc

SEQ ID NO: 2970491 - DNA, 11 bp, Homo sapiens
ccaacccttct

SEQ ID NO: 2970492 - DNA, 16 bp, Homo sapiens
ccaacctctcggcccc

SEQ ID NO: 2970493 - DNA, 20 bp, Homo sapiens
ccaacctgaaggtcccctgg

SEQ ID NO: 2970494 - DNA, 16 bp, Homo sapiens
ccaacctgaccaacat

SEQ ID NO: 2970495 - DNA, 17 bp, Homo sapiens
ccaacctgcaaagatct

SEQ ID NO: 2970496 - DNA, 19 bp, Homo sapiens
ccaacctgcaaagatctgt

SEQ ID NO: 2970497 - DNA, 12 bp, Homo sapiens
ccaacctttctg

SEQ ID NO: 2970498 - DNA, 12 bp, Homo sapiens
ccaacgccgcct

SEQ ID NO: 2970499 - DNA, 20 bp, Homo sapiens
ccaacgctgaagcggtcaga

SEQ ID NO: 2970500 - DNA, 22 bp, Homo sapiens
ccaacggagagcgcctgcccct

SEQ ID NO: 2970501 - DNA, 21 bp, Homo sapiens
ccaacgtttggaagatcctgt

SEQ ID NO: 2970502 - DNA, 12 bp, Homo sapiens
ccaactccagga

SEQ ID NO: 2970503 - DNA, 22 bp, Homo sapiens
ccaactcccgggttcacgccat

SEQ ID NO: 2970504 - DNA, 19 bp, Homo sapiens
ccaactcctggaagctgtg

SEQ ID NO: 2970505 - DNA, 21 bp, Homo sapiens
ccaactctaaagccaagcact

SEQ ID NO: 2970506 - DNA, 14 bp, Homo sapiens
ccaactctagctgg

SEQ ID NO: 2970507 - DNA, 13 bp, Homo sapiens
ccaactctcccaa

SEQ ID NO: 2970508 - DNA, 18 bp, Homo sapiens
ccaactgacctgccagcc

SEQ ID NO: 2970509 - DNA, 20 bp, Homo sapiens
ccaactgacctgccagccgg

SEQ ID NO: 2970510 - DNA, 18 bp, Homo sapiens
ccaactgcctaaggccct

SEQ ID NO: 2970511 - DNA, 21 bp, Homo sapiens
ccaactgtggtagctccagcg

SEQ ID NO: 2970512 - DNA, 12 bp, Homo sapiens
ccaactttcatt

SEQ ID NO: 2970513 - DNA, 19 bp, Homo sapiens
ccaagaaacactgcctgcc

SEQ ID NO: 2970514 - DNA, 14 bp, Homo sapiens
ccaagaaacgtctt

SEQ ID NO: 2970515 - DNA, 15 bp, Homo sapiens
ccaagaaagatgtat

SEQ ID NO: 2970516 - DNA, 22 bp, Homo sapiens
ccaagaaagatgtatataggtg

SEQ ID NO: 2970517 - DNA, 19 bp, Homo sapiens
ccaagaatccacatttcta

SEQ ID NO: 2970518 - DNA, 18 bp, Homo sapiens
ccaagaatggaagcctga

SEQ ID NO: 2970519 - DNA, 23 bp, Homo sapiens
ccaagacagattttcggaacaca

SEQ ID NO: 2970520 - DNA, 14 bp, Homo sapiens
ccaagaccagactc

SEQ ID NO: 2970521 - DNA, 17 bp, Homo sapiens
ccaagacctcagggcac

SEQ ID NO: 2970522 - DNA, 14 bp, Homo sapiens
ccaagactctagag

SEQ ID NO: 2970523 - DNA, 15 bp, Homo sapiens
ccaagactctagagt

SEQ ID NO: 2970524 - DNA, 16 bp, Homo sapiens
ccaagagaggaaggac

SEQ ID NO: 2970525 - DNA, 21 bp, Homo sapiens
ccaagagaggaaggacccctc

SEQ ID NO: 2970526 - DNA, 20 bp, Homo sapiens
ccaagagattgctaattgct

SEQ ID NO: 2970527 - DNA, 13 bp, Homo sapiens
ccaagagcttcca

SEQ ID NO: 2970528 - DNA, 15 bp, Homo sapiens
ccaagagcttccaga

SEQ ID NO: 2970529 - DNA, 20 bp, Homo sapiens
ccaagagcttccagagctct

SEQ ID NO: 2970530 - DNA, 12 bp, Homo sapiens
ccaagaggctgc

SEQ ID NO: 2970531 - DNA, 14 bp, Homo sapiens
ccaagaggctgcag

SEQ ID NO: 2970532 - DNA, 11 bp, Homo sapiens
ccaagagtcta

SEQ ID NO: 2970533 - DNA, 16 bp, Homo sapiens
ccaagagtctaaagat

SEQ ID NO: 2970534 - DNA, 13 bp, Homo sapiens
ccaagattccgga

SEQ ID NO: 2970535 - DNA, 15 bp, Homo sapiens
ccaagattctagatg

SEQ ID NO: 2970536 - DNA, 16 bp, Homo sapiens
ccaagattctagatga

SEQ ID NO: 2970537 - DNA, 17 bp, Homo sapiens
ccaagcaaaatcatgga

SEQ ID NO: 2970538 - DNA, 12 bp, Homo sapiens
ccaagcacagca

SEQ ID NO: 2970539 - DNA, 19 bp, Homo sapiens
ccaagcacagtggtggcag

SEQ ID NO: 2970540 - DNA, 22 bp, Homo sapiens
ccaagcacagtggtggcagggc

SEQ ID NO: 2970541 - DNA, 18 bp, Homo sapiens
ccaagcaggaaatgaaaa

SEQ ID NO: 2970542 - DNA, 18 bp, Homo sapiens
ccaagcagtgcctgccta

SEQ ID NO: 2970543 - DNA, 16 bp, Homo sapiens
ccaagccaccgcagct

SEQ ID NO: 2970544 - DNA, 23 bp, Homo sapiens
ccaagccaccgcagctgctgcca

SEQ ID NO: 2970545 - DNA, 15 bp, Homo sapiens
ccaagcccagtgacc

SEQ ID NO: 2970546 - DNA, 18 bp, Homo sapiens
ccaagccccctggcagct

SEQ ID NO: 2970547 - DNA, 12 bp, Homo sapiens
ccaagcctctgg

SEQ ID NO: 2970548 - DNA, 13 bp, Homo sapiens
ccaagcctctgga

SEQ ID NO: 2970549 - DNA, 17 bp, Homo sapiens
ccaagctcacagttcct

SEQ ID NO: 2970550 - DNA, 22 bp, Homo sapiens
ccaagctcacagttcctcgccc

SEQ ID NO: 2970551 - DNA, 15 bp, Homo sapiens
ccaagctcccaagag

SEQ ID NO: 2970552 - DNA, 12 bp, Homo sapiens
ccaagctgttaa

SEQ ID NO: 2970553 - DNA, 17 bp, Homo sapiens
ccaagctgttaaagata

SEQ ID NO: 2970554 - DNA, 14 bp, Homo sapiens
ccaaggaaaactgc

SEQ ID NO: 2970555 - DNA, 20 bp, Homo sapiens
ccagagatccaaaagaagcc

SEQ ID NO: 2970556 - DNA, 14 bp, Homo sapiens
ccagagatgcctcc

SEQ ID NO: 2970557 - DNA, 17 bp, Homo sapiens
ccagagatgcctccacc

SEQ ID NO: 2970558 - DNA, 20 bp, Homo sapiens
ccagagatgcctccaccgct

SEQ ID NO: 2970559 - DNA, 21 bp, Homo sapiens
ccagagcaaaaatgtaaaaaa

SEQ ID NO: 2970560 - DNA, 13 bp, Homo sapiens
ccagagcaggggc

SEQ ID NO: 2970561 - DNA, 15 bp, Homo sapiens
ccagagcaggggctg

SEQ ID NO: 2970562 - DNA, 17 bp, Homo sapiens
ccagagcaggggctgct

SEQ ID NO: 2970563 - DNA, 21 bp, Homo sapiens
ccagagcaggggctgctgggg

SEQ ID NO: 2970564 - DNA, 13 bp, Homo sapiens
ccagagccaaggg

SEQ ID NO: 2970565 - DNA, 14 bp, Homo sapiens
ccagagccacacat

SEQ ID NO: 2970566 - DNA, 16 bp, Homo sapiens
ccagagccacacatgg

SEQ ID NO: 2970567 - DNA, 19 bp, Homo sapiens
ccagagccacacatgggca

SEQ ID NO: 2970568 - DNA, 12 bp, Homo sapiens
ccagagccaggg

SEQ ID NO: 2970569 - DNA, 18 bp, Homo sapiens
ccagagcccagctccaag

SEQ ID NO: 2970570 - DNA, 22 bp, Homo sapiens
ccagagcccagctcttgctctc

SEQ ID NO: 2970571 - DNA, 20 bp, Homo sapiens
ccagagctacccgcagagtt

SEQ ID NO: 2970572 - DNA, 21 bp, Homo sapiens
ccagagctacccgcagagttc

SEQ ID NO: 2970573 - DNA, 14 bp, Homo sapiens
ccagagctctgacc

SEQ ID NO: 2970574 - DNA, 16 bp, Homo sapiens
ccagagctctgaccca

SEQ ID NO: 2970575 - DNA, 23 bp, Homo sapiens
ccagagctctgacccacagcctc

SEQ ID NO: 2970576 - DNA, 18 bp, Homo sapiens
ccagagctgcctccccaa

SEQ ID NO: 2970577 - DNA, 20 bp, Homo sapiens
ccagagctgcctccccaatc

SEQ ID NO: 2970578 - DNA, 21 bp, Homo sapiens
ccagagctgcctccccaatcc

SEQ ID NO: 2970579 - DNA, 14 bp, Homo sapiens
ccagagctgcttct

SEQ ID NO: 2970580 - DNA, 17 bp, Homo sapiens
ccagaggaaggggccag

SEQ ID NO: 2970581 - DNA, 17 bp, Homo sapiens
ccagaggaatgatgggc

SEQ ID NO: 2970582 - DNA, 22 bp, Homo sapiens
ccagaggaattgattgtcagcc

SEQ ID NO: 2970583 - DNA, 23 bp, Homo sapiens
ccagaggaattgattgtcagcca

SEQ ID NO: 2970584 - DNA, 12 bp, Homo sapiens
ccagaggagccc

SEQ ID NO: 2970585 - DNA, 16 bp, Homo sapiens
ccagaggagccttttt

SEQ ID NO: 2970586 - DNA, 18 bp, Homo sapiens
ccagaggatgctctttcc

SEQ ID NO: 2970587 - DNA, 15 bp, Homo sapiens
ccagaggcagaggtt

SEQ ID NO: 2970588 - DNA, 11 bp, Homo sapiens
ccagaggctcg

SEQ ID NO: 2970589 - DNA, 21 bp, Homo sapiens
ccagagggtgggaggggccat

SEQ ID NO: 2970590 - DNA, 18 bp, Homo sapiens
ccagagtccctgcctgga

SEQ ID NO: 2970591 - DNA, 19 bp, Homo sapiens
ccagagtccctgcctggac

SEQ ID NO: 2970592 - DNA, 22 bp, Homo sapiens
ccagagtccctgcctggaccag

SEQ ID NO: 2970593 - DNA, 17 bp, Homo sapiens
ccagagtctgtattttt

SEQ ID NO: 2970594 - DNA, 15 bp, Homo sapiens
ccagagtgctgggat

SEQ ID NO: 2970595 - DNA, 16 bp, Homo sapiens
ccagagtggccacggc

SEQ ID NO: 2970596 - DNA, 17 bp, Homo sapiens
ccagagtggccacggcc

SEQ ID NO: 2970597 - DNA, 19 bp, Homo sapiens
ccagagtggccacggccca

SEQ ID NO: 2970598 - DNA, 23 bp, Homo sapiens
ccagagtggccacggcccaggga

SEQ ID NO: 2970599 - DNA, 15 bp, Homo sapiens
ccagagttaaagcat

SEQ ID NO: 2970600 - DNA, 12 bp, Homo sapiens
ccagataagtaa

SEQ ID NO: 2970601 - DNA, 21 bp, Homo sapiens
ccagatatgaacagggcccag

SEQ ID NO: 2970602 - DNA, 22 bp, Homo sapiens
ccagatatgaacagggcccagg

SEQ ID NO: 2970603 - DNA, 23 bp, Homo sapiens
ccagatatttatgtatcttgatg

SEQ ID NO: 2970604 - DNA, 15 bp, Homo sapiens
ccagatccagcctgg

SEQ ID NO: 2970605 - DNA, 15 bp, Homo sapiens
ccagatgcagggcag

SEQ ID NO: 2970606 - DNA, 18 bp, Homo sapiens
ccagatgcagggcagtca

SEQ ID NO: 2970607 - DNA, 16 bp, Homo sapiens
ccagatgcggggacag

SEQ ID NO: 2970608 - DNA, 21 bp, Homo sapiens
ccagatgcgtcccaagatgtt

SEQ ID NO: 2970609 - DNA, 15 bp, Homo sapiens
ccagatgctgatgtt

SEQ ID NO: 2970610 - DNA, 23 bp, Homo sapiens
ccagatgctgatgttcagtgtaa

SEQ ID NO: 2970611 - DNA, 14 bp, Homo sapiens
ccagatgctgcaga

SEQ ID NO: 2970612 - DNA, 19 bp, Homo sapiens
ccagatgctgcagagtcac

SEQ ID NO: 2970613 - DNA, 17 bp, Homo sapiens
ccagatggactccagcc

SEQ ID NO: 2970614 - DNA, 21 bp, Homo sapiens
ccagatgtgagggcaccacca

SEQ ID NO: 2970615 - DNA, 14 bp, Homo sapiens
ccagattataatgc

SEQ ID NO: 2970616 - DNA, 12 bp, Homo sapiens
ccagattcttca

SEQ ID NO: 2970617 - DNA, 15 bp, Homo sapiens
ccagcaaaatccaaa

SEQ ID NO: 2970618 - DNA, 17 bp, Homo sapiens
ccagcaaaatccaaact

SEQ ID NO: 2970619 - DNA, 22 bp, Homo sapiens
ccagcaagcaaacagggtggcc

SEQ ID NO: 2970620 - DNA, 16 bp, Homo sapiens
ccagcaagtcccagac

SEQ ID NO: 2970621 - DNA, 17 bp, Homo sapiens
ccagcaagtcccagaca

SEQ ID NO: 2970622 - DNA, 13 bp, Homo sapiens
ccagcacaaacac

SEQ ID NO: 2970623 - DNA, 17 bp, Homo sapiens
ccagcacaaacacaagg

SEQ ID NO: 2970624 - DNA, 20 bp, Homo sapiens
ccagcacaaacacaaggtca

SEQ ID NO: 2970625 - DNA, 15 bp, Homo sapiens
ccagcacactgggag

SEQ ID NO: 2970626 - DNA, 20 bp, Homo sapiens
ccagcacagctcctcccctg

SEQ ID NO: 2970627 - DNA, 23 bp, Homo sapiens
ccagcacccagtcctctgcctcc

SEQ ID NO: 2970628 - DNA, 19 bp, Homo sapiens
ccagcaccccctctcctgg

SEQ ID NO: 2970629 - DNA, 15 bp, Homo sapiens
ccagcaccgccggct

SEQ ID NO: 2970630 - DNA, 17 bp, Homo sapiens
ccagcacctcagcctgc

SEQ ID NO: 2970631 - DNA, 17 bp, Homo sapiens
ccagcacttccatggga

SEQ ID NO: 2970632 - DNA, 16 bp, Homo sapiens
ccagcacttgtccagc

SEQ ID NO: 2970633 - DNA, 21 bp, Homo sapiens
ccagcactttgagaggctgag

SEQ ID NO: 2970634 - DNA, 13 bp, Homo sapiens
ccagcactttggg

SEQ ID NO: 2970635 - DNA, 16 bp, Homo sapiens
ccagcactttgggagg

SEQ ID NO: 2970636 - DNA, 19 bp, Homo sapiens
ccagcagaatggaggcagg

SEQ ID NO: 2970637 - DNA, 19 bp, Homo sapiens
ccagcagcccttgtttata

SEQ ID NO: 2970638 - DNA, 21 bp, Homo sapiens
ccagcagcctcgcacaggccc

SEQ ID NO: 2970639 - DNA, 17 bp, Homo sapiens
ccagcagcctgccagca

SEQ ID NO: 2970640 - DNA, 17 bp, Homo sapiens
ccagcagcgcctttccc

SEQ ID NO: 2970641 - DNA, 19 bp, Homo sapiens
ccagcagcgcctttcccaa

SEQ ID NO: 2970642 - DNA, 23 bp, Homo sapiens
ccagcagcgcgcaggcctgcgtg

SEQ ID NO: 2970643 - DNA, 15 bp, Homo sapiens
ccagcaggcagcgcc

SEQ ID NO: 2970644 - DNA, 22 bp, Homo sapiens
ccagcaggcagcgcctgtcccc

SEQ ID NO: 2970645 - DNA, 12 bp, Homo sapiens
ccagcaggggcc

SEQ ID NO: 2970646 - DNA, 20 bp, Homo sapiens
ccagcagggtcttttcatct

SEQ ID NO: 2970647 - DNA, 15 bp, Homo sapiens
ccagcaggtgctgac

SEQ ID NO: 2970648 - DNA, 18 bp, Homo sapiens
ccagcaggtgctgacttc

SEQ ID NO: 2970649 - DNA, 17 bp, Homo sapiens
ccagcagtcacttcggc

SEQ ID NO: 2970650 - DNA, 19 bp, Homo sapiens
ccagcatatatagtattta

SEQ ID NO: 2970651 - DNA, 15 bp, Homo sapiens
ccagcatgggttagt

SEQ ID NO: 2970652 - DNA, 19 bp, Homo sapiens
ccagcatttcccgaaggcc

SEQ ID NO: 2970653 - DNA, 14 bp, Homo sapiens
ccagccacaggcca

SEQ ID NO: 2970654 - DNA, 14 bp, Homo sapiens
ccagccacccctca

SEQ ID NO: 2970655 - DNA, 18 bp, Homo sapiens
ccagccacccctgccact

SEQ ID NO: 2970656 - DNA, 20 bp, Homo sapiens
ccagccacccctgccactca

SEQ ID NO: 2970657 - DNA, 22 bp, Homo sapiens
ccagccacccctgccactcacc

SEQ ID NO: 2970658 - DNA, 12 bp, Homo sapiens
ccagccactcca

SEQ ID NO: 2970659 - DNA, 13 bp, Homo sapiens
ccagccactccaa

SEQ ID NO: 2970660 - DNA, 16 bp, Homo sapiens
ccagccactccaagcc

SEQ ID NO: 2970661 - DNA, 11 bp, Homo sapiens
ccagccactct

SEQ ID NO: 2970662 - DNA, 15 bp, Homo sapiens
ccagccactctacca

SEQ ID NO: 2970663 - DNA, 21 bp, Homo sapiens
ccagccactctaccagtgcag

SEQ ID NO: 2970664 - DNA, 12 bp, Homo sapiens
ccagccactgga

SEQ ID NO: 2970665 - DNA, 16 bp, Homo sapiens
ccagccagccacccct

SEQ ID NO: 2970666 - DNA, 23 bp, Homo sapiens
ccagccagtgacctgaggaagcg

SEQ ID NO: 2970667 - DNA, 16 bp, Homo sapiens
ccagccatcaaaatgc

SEQ ID NO: 2970668 - DNA, 16 bp, Homo sapiens
ccagccatgtctgcat

SEQ ID NO: 2970669 - DNA, 18 bp, Homo sapiens
ccagcccaaaccttgggc

SEQ ID NO: 2970670 - DNA, 23 bp, Homo sapiens
ccagcccaaaccttgggccctgg

SEQ ID NO: 2970671 - DNA, 12 bp, Homo sapiens
ccagcccaatcc

SEQ ID NO: 2970672 - DNA, 15 bp, Homo sapiens
ccagcccaatccagg

SEQ ID NO: 2970673 - DNA, 14 bp, Homo sapiens
ccagcccacagagc

SEQ ID NO: 2970674 - DNA, 16 bp, Homo sapiens
ccagcccacagagcct

SEQ ID NO: 2970675 - DNA, 12 bp, Homo sapiens
ccagcccagacc

SEQ ID NO: 2970676 - DNA, 16 bp, Homo sapiens
ccagcccagagcccgg

SEQ ID NO: 2970677 - DNA, 14 bp, Homo sapiens
ccagcccagcccag

SEQ ID NO: 2970678 - DNA, 13 bp, Homo sapiens
ccagcccagctgg

SEQ ID NO: 2970679 - DNA, 12 bp, Homo sapiens
ccagcccaggag

SEQ ID NO: 2970680 - DNA, 17 bp, Homo sapiens
ccagcccattctctctc

SEQ ID NO: 2970681 - DNA, 13 bp, Homo sapiens
ccagcccctgctg

SEQ ID NO: 2970682 - DNA, 14 bp, Homo sapiens
ccagcccctttcca

SEQ ID NO: 2970683 - DNA, 13 bp, Homo sapiens
ccagcccgcggcc

SEQ ID NO: 2970684 - DNA, 16 bp, Homo sapiens
ccagcccgcggcctgg

SEQ ID NO: 2970685 - DNA, 14 bp, Homo sapiens
ccagccctccccat

SEQ ID NO: 2970686 - DNA, 21 bp, Homo sapiens
ccagccctccccatggagcca

SEQ ID NO: 2970687 - DNA, 18 bp, Homo sapiens
ccagccctccctgtcctc

SEQ ID NO: 2970688 - DNA, 17 bp, Homo sapiens
cccaactcctggaagct

SEQ ID NO: 2970689 - DNA, 21 bp, Homo sapiens
cccaactctagctgggggtgg

SEQ ID NO: 2970690 - DNA, 18 bp, Homo sapiens
cccaagacctcagggcac

SEQ ID NO: 2970691 - DNA, 15 bp, Homo sapiens
cccaagagaggaagg

SEQ ID NO: 2970692 - DNA, 16 bp, Homo sapiens
cccaagagaggaagga

SEQ ID NO: 2970693 - DNA, 18 bp, Homo sapiens
cccaagagaggaaggacc

SEQ ID NO: 2970694 - DNA, 21 bp, Homo sapiens
cccaagagaggaaggacccct

SEQ ID NO: 2970695 - DNA, 12 bp, Homo sapiens
cccaagagggct

SEQ ID NO: 2970696 - DNA, 14 bp, Homo sapiens
cccaagcagagaag

SEQ ID NO: 2970697 - DNA, 21 bp, Homo sapiens
cccaagcgcctggctgctgct

SEQ ID NO: 2970698 - DNA, 21 bp, Homo sapiens
cccaagctttcccctctgaat

SEQ ID NO: 2970699 - DNA, 17 bp, Homo sapiens
cccaaggacttccacat

SEQ ID NO: 2970700 - DNA, 16 bp, Homo sapiens
cccaaggtacagctgt

SEQ ID NO: 2970701 - DNA, 20 bp, Homo sapiens
cccaagtaagaggctggagt

SEQ ID NO: 2970702 - DNA, 22 bp, Homo sapiens
cccaagtagctgctaccttctt

SEQ ID NO: 2970703 - DNA, 19 bp, Homo sapiens
cccaagtatacaataaagt

SEQ ID NO: 2970704 - DNA, 14 bp, Homo sapiens
cccaagtcatttcc

SEQ ID NO: 2970705 - DNA, 14 bp, Homo sapiens
cccaagtctcctag

SEQ ID NO: 2970706 - DNA, 14 bp, Homo sapiens
cccaagtcttctcc

SEQ ID NO: 2970707 - DNA, 15 bp, Homo sapiens
cccaatccatcgtat

SEQ ID NO: 2970708 - DNA, 18 bp, Homo sapiens
cccaatccatttggcaga

SEQ ID NO: 2970709 - DNA, 19 bp, Homo sapiens
cccaatccatttggcagaa

SEQ ID NO: 2970710 - DNA, 23 bp, Homo sapiens
cccaatcccagctacctcaacca

SEQ ID NO: 2970711 - DNA, 12 bp, Homo sapiens
cccaatccctca

SEQ ID NO: 2970712 - DNA, 19 bp, Homo sapiens
cccaatccctcaaaccttg

SEQ ID NO: 2970713 - DNA, 17 bp, Homo sapiens
cccaatccctttattac

SEQ ID NO: 2970714 - DNA, 19 bp, Homo sapiens
cccaatgagacttgccttc

SEQ ID NO: 2970715 - DNA, 16 bp, Homo sapiens
cccaatgcctataaaa

SEQ ID NO: 2970716 - DNA, 15 bp, Homo sapiens
cccaatttcagactc

SEQ ID NO: 2970717 - DNA, 17 bp, Homo sapiens
cccacaaggcctggtct

SEQ ID NO: 2970718 - DNA, 17 bp, Homo sapiens
cccacaatttctttaaa

SEQ ID NO: 2970719 - DNA, 18 bp, Homo sapiens
cccacaatttctttaaaa

SEQ ID NO: 2970720 - DNA, 10 bp, Homo sapiens
cccacacaca

SEQ ID NO: 2970721 - DNA, 19 bp, Homo sapiens
cccacacacacacacatgc

SEQ ID NO: 2970722 - DNA, 14 bp, Homo sapiens
cccacacacactcc

SEQ ID NO: 2970723 - DNA, 15 bp, Homo sapiens
cccacacacactcct

SEQ ID NO: 2970724 - DNA, 18 bp, Homo sapiens
cccacacacactccttcc

SEQ ID NO: 2970725 - DNA, 11 bp, Homo sapiens
cccacacacag

SEQ ID NO: 2970726 - DNA, 14 bp, Homo sapiens
cccacacacaggtg

SEQ ID NO: 2970727 - DNA, 14 bp, Homo sapiens
cccacacctgcagt

SEQ ID NO: 2970728 - DNA, 15 bp, Homo sapiens
cccacacctgcctgc

SEQ ID NO: 2970729 - DNA, 12 bp, Homo sapiens
cccacagagcct

SEQ ID NO: 2970730 - DNA, 13 bp, Homo sapiens
cccacagagcctg

SEQ ID NO: 2970731 - DNA, 16 bp, Homo sapiens
cccacagagcctgaat

SEQ ID NO: 2970732 - DNA, 21 bp, Homo sapiens
cccacagcccccaccccagca

SEQ ID NO: 2970733 - DNA, 12 bp, Homo sapiens
cccacagcccta

SEQ ID NO: 2970734 - DNA, 15 bp, Homo sapiens
cccacagctcccacc

SEQ ID NO: 2970735 - DNA, 17 bp, Homo sapiens
cccacagctcccacccc

SEQ ID NO: 2970736 - DNA, 21 bp, Homo sapiens
cccacaggcacattaactgtt

SEQ ID NO: 2970737 - DNA, 20 bp, Homo sapiens
cccacagtggagagggctac

SEQ ID NO: 2970738 - DNA, 19 bp, Homo sapiens
cccacagttcttaatacag

SEQ ID NO: 2970739 - DNA, 16 bp, Homo sapiens
cccacatctttcctca

SEQ ID NO: 2970740 - DNA, 14 bp, Homo sapiens
cccacatgtccagc

SEQ ID NO: 2970741 - DNA, 19 bp, Homo sapiens
cccacatgtggccatggcc

SEQ ID NO: 2970742 - DNA, 22 bp, Homo sapiens
cccacatgtggccatggcctct

SEQ ID NO: 2970743 - DNA, 21 bp, Homo sapiens
cccacatttgtgccgacactg

SEQ ID NO: 2970744 - DNA, 23 bp, Homo sapiens
cccacatttgtgccgacactgtt

SEQ ID NO: 2970745 - DNA, 21 bp, Homo sapiens
cccaccaaggtctcacactcc

SEQ ID NO: 2970746 - DNA, 22 bp, Homo sapiens
cccaccaaggtctcacactcct

SEQ ID NO: 2970747 - DNA, 23 bp, Homo sapiens
cccaccaaggtctcacactcctc

SEQ ID NO: 2970748 - DNA, 13 bp, Homo sapiens
cccaccacacatc

SEQ ID NO: 2970749 - DNA, 16 bp, Homo sapiens
cccaccacacatccca

SEQ ID NO: 2970750 - DNA, 22 bp, Homo sapiens
cccaccacacatcccagcccaa

SEQ ID NO: 2970751 - DNA, 13 bp, Homo sapiens
cccaccacctagg

SEQ ID NO: 2970752 - DNA, 17 bp, Homo sapiens
cccaccagagctgcctc

SEQ ID NO: 2970753 - DNA, 22 bp, Homo sapiens
cccaccagagctgcctccccaa

SEQ ID NO: 2970754 - DNA, 22 bp, Homo sapiens
cccaccaggagcacctggaccc

SEQ ID NO: 2970755 - DNA, 19 bp, Homo sapiens
cccaccatgcacccctgat

SEQ ID NO: 2970756 - DNA, 17 bp, Homo sapiens
cccacccaagagaggaa

SEQ ID NO: 2970757 - DNA, 14 bp, Homo sapiens
cccacccacatgtg

SEQ ID NO: 2970758 - DNA, 12 bp, Homo sapiens
cccacccagctc

SEQ ID NO: 2970759 - DNA, 18 bp, Homo sapiens
cccacccagctccaggcc

SEQ ID NO: 2970760 - DNA, 23 bp, Homo sapiens
cccacccagtccatgctccaggg

SEQ ID NO: 2970761 - DNA, 16 bp, Homo sapiens
cccacccagtctctgc

SEQ ID NO: 2970762 - DNA, 15 bp, Homo sapiens
cccaccccagcacag

SEQ ID NO: 2970763 - DNA, 18 bp, Homo sapiens
cccaccccagcacagctc

SEQ ID NO: 2970764 - DNA, 13 bp, Homo sapiens
cccacccccggga

SEQ ID NO: 2970765 - DNA, 17 bp, Homo sapiens
cccaccccctccccagg

SEQ ID NO: 2970766 - DNA, 19 bp, Homo sapiens
cccaccccctccccagggg

SEQ ID NO: 2970767 - DNA, 23 bp, Homo sapiens
cccacccccttcagtgcccacca

SEQ ID NO: 2970768 - DNA, 12 bp, Homo sapiens
cccacccctggg

SEQ ID NO: 2970769 - DNA, 22 bp, Homo sapiens
cccacccctgggggctctcatg

SEQ ID NO: 2970770 - DNA, 13 bp, Homo sapiens
cccaccctaaggg

SEQ ID NO: 2970771 - DNA, 19 bp, Homo sapiens
cccaccctaagggcagccc

SEQ ID NO: 2970772 - DNA, 21 bp, Homo sapiens
cccaccctaagggcagccctc

SEQ ID NO: 2970773 - DNA, 19 bp, Homo sapiens
cccaccctgggtttggccc

SEQ ID NO: 2970774 - DNA, 23 bp, Homo sapiens
cccaccctgggtttggcccctgg

SEQ ID NO: 2970775 - DNA, 13 bp, Homo sapiens
cccaccgccgggg

SEQ ID NO: 2970776 - DNA, 19 bp, Homo sapiens
cccaccgccggggtcctgg

SEQ ID NO: 2970777 - DNA, 20 bp, Homo sapiens
cccaccgccggggtcctggg

SEQ ID NO: 2970778 - DNA, 23 bp, Homo sapiens
cccaccgctgagaggctgcctcc

SEQ ID NO: 2970779 - DNA, 22 bp, Homo sapiens
cccaccggatgctgtgcctggc

SEQ ID NO: 2970780 - DNA, 17 bp, Homo sapiens
cccaccgtgggcaggga

SEQ ID NO: 2970781 - DNA, 15 bp, Homo sapiens
cccacctagtgcccc

SEQ ID NO: 2970782 - DNA, 17 bp, Homo sapiens
cccacctccctgcctcc

SEQ ID NO: 2970783 - DNA, 22 bp, Homo sapiens
cccacctgaaagcctgtctctt

SEQ ID NO: 2970784 - DNA, 14 bp, Homo sapiens
cccacctgcctggc

SEQ ID NO: 2970785 - DNA, 20 bp, Homo sapiens
cccacctgcctggccggcca

SEQ ID NO: 2970786 - DNA, 23 bp, Homo sapiens
cccacctggccccctcagctctg

SEQ ID NO: 2970787 - DNA, 21 bp, Homo sapiens
cccacgacccctgcctcgagg

SEQ ID NO: 2970788 - DNA, 13 bp, Homo sapiens
cccacgagggctg

SEQ ID NO: 2970789 - DNA, 14 bp, Homo sapiens
cccacgagggctgg

SEQ ID NO: 2970790 - DNA, 19 bp, Homo sapiens
cccacggggaccactgggc

SEQ ID NO: 2970791 - DNA, 17 bp, Homo sapiens
cccacgtcacgtgtagt

SEQ ID NO: 2970792 - DNA, 12 bp, Homo sapiens
cccacgtctctc

SEQ ID NO: 2970793 - DNA, 14 bp, Homo sapiens
cccacgtctctctg

SEQ ID NO: 2970794 - DNA, 18 bp, Homo sapiens
cccacgtctctctgcctg

SEQ ID NO: 2970795 - DNA, 20 bp, Homo sapiens
cccacgtctctctgcctgct

SEQ ID NO: 2970796 - DNA, 21 bp, Homo sapiens
cccacgtctctctgcctgctg

SEQ ID NO: 2970797 - DNA, 14 bp, Homo sapiens
cccactctgcctgc

SEQ ID NO: 2970798 - DNA, 19 bp, Homo sapiens
cccactgcccatggcatgt

SEQ ID NO: 2970799 - DNA, 13 bp, Homo sapiens
cccactgcctcct

SEQ ID NO: 2970800 - DNA, 13 bp, Homo sapiens
cccactgctcccc

SEQ ID NO: 2970801 - DNA, 14 bp, Homo sapiens
cccactggtgagac

SEQ ID NO: 2970802 - DNA, 17 bp, Homo sapiens
cccacttcccaccctgc

SEQ ID NO: 2970803 - DNA, 18 bp, Homo sapiens
cccacttctcatcacaca

SEQ ID NO: 2970804 - DNA, 22 bp, Homo sapiens
cccactttgctgttccttactt

SEQ ID NO: 2970805 - DNA, 22 bp, Homo sapiens
cccactttttggtaatatatat

SEQ ID NO: 2970806 - DNA, 14 bp, Homo sapiens
cccagaacacactc

SEQ ID NO: 2970807 - DNA, 18 bp, Homo sapiens
cccagaacacactccatc

SEQ ID NO: 2970808 - DNA, 18 bp, Homo sapiens
cccagaacatgaagaaga

SEQ ID NO: 2970809 - DNA, 21 bp, Homo sapiens
cccagaactttgggaggccaa

SEQ ID NO: 2970810 - DNA, 19 bp, Homo sapiens
cccagaataagttattgca

SEQ ID NO: 2970811 - DNA, 22 bp, Homo sapiens
cccagaataagttattgcagtt

SEQ ID NO: 2970812 - DNA, 16 bp, Homo sapiens
cccagaatgaggctgc

SEQ ID NO: 2970813 - DNA, 17 bp, Homo sapiens
cccagaatgaggctgct

SEQ ID NO: 2970814 - DNA, 19 bp, Homo sapiens
cccagacctgtcgtctctc

SEQ ID NO: 2970815 - DNA, 21 bp, Homo sapiens
cccagaccttttatccactta

SEQ ID NO: 2970816 - DNA, 13 bp, Homo sapiens
cccagactcagac

SEQ ID NO: 2970817 - DNA, 15 bp, Homo sapiens
cccagactctgccta

SEQ ID NO: 2970818 - DNA, 15 bp, Homo sapiens
cccagactgagctct

SEQ ID NO: 2970819 - DNA, 13 bp, Homo sapiens
cccagactgggcc

SEQ ID NO: 2970820 - DNA, 17 bp, Homo sapiens
cccctatccacccagcc

SEQ ID NO: 2970821 - DNA, 19 bp, Homo sapiens
cccctcacagactcttcca

SEQ ID NO: 2970822 - DNA, 14 bp, Homo sapiens
cccctcaccacccc

SEQ ID NO: 2970823 - DNA, 13 bp, Homo sapiens
cccctcaccctct

SEQ ID NO: 2970824 - DNA, 16 bp, Homo sapiens
cccctcagacagcccc

SEQ ID NO: 2970825 - DNA, 18 bp, Homo sapiens
cccctcagacagccccct

SEQ ID NO: 2970826 - DNA, 15 bp, Homo sapiens
cccctcagctctgtc

SEQ ID NO: 2970827 - DNA, 17 bp, Homo sapiens
cccctcagctctgtcct

SEQ ID NO: 2970828 - DNA, 18 bp, Homo sapiens
cccctcaggggaagctgc

SEQ ID NO: 2970829 - DNA, 21 bp, Homo sapiens
cccctcaggggaagctgctag

SEQ ID NO: 2970830 - DNA, 23 bp, Homo sapiens
cccctcaggggaagctgctaggg

SEQ ID NO: 2970831 - DNA, 22 bp, Homo sapiens
cccctcatcatagcaataacat

SEQ ID NO: 2970832 - DNA, 19 bp, Homo sapiens
cccctccatccccatcggc

SEQ ID NO: 2970833 - DNA, 21 bp, Homo sapiens
cccctcccacacccaaagctg

SEQ ID NO: 2970834 - DNA, 12 bp, Homo sapiens
cccctcccagaa

SEQ ID NO: 2970835 - DNA, 13 bp, Homo sapiens
cccctcccagaac

SEQ ID NO: 2970836 - DNA, 13 bp, Homo sapiens
cccctcccagagg

SEQ ID NO: 2970837 - DNA, 13 bp, Homo sapiens
cccctccccatct

SEQ ID NO: 2970838 - DNA, 14 bp, Homo sapiens
cccctccccatctg

SEQ ID NO: 2970839 - DNA, 19 bp, Homo sapiens
cccctccccatctgtgttc

SEQ ID NO: 2970840 - DNA, 16 bp, Homo sapiens
cccctccccctaccgc

SEQ ID NO: 2970841 - DNA, 20 bp, Homo sapiens
cccctccccctgagattcag

SEQ ID NO: 2970842 - DNA, 16 bp, Homo sapiens
cccctccctagatcca

SEQ ID NO: 2970843 - DNA, 13 bp, Homo sapiens
cccctccctctgt

SEQ ID NO: 2970844 - DNA, 19 bp, Homo sapiens
cccctcctagtttgggagg

SEQ ID NO: 2970845 - DNA, 11 bp, Homo sapiens
cccctcctctg

SEQ ID NO: 2970846 - DNA, 18 bp, Homo sapiens
cccctcctctgaaacagc

SEQ ID NO: 2970847 - DNA, 13 bp, Homo sapiens
cccctcctctgcc

SEQ ID NO: 2970848 - DNA, 18 bp, Homo sapiens
cccctcctggggccaggc

SEQ ID NO: 2970849 - DNA, 16 bp, Homo sapiens
cccctcgaccctgtgc

SEQ ID NO: 2970850 - DNA, 23 bp, Homo sapiens
cccctcgaccctgtgcaggagct

SEQ ID NO: 2970851 - DNA, 21 bp, Homo sapiens
cccctcgcttggacggctggg

SEQ ID NO: 2970852 - DNA, 17 bp, Homo sapiens
cccctcgggggcctgtg

SEQ ID NO: 2970853 - DNA, 18 bp, Homo sapiens
cccctcgggggcctgtgg

SEQ ID NO: 2970854 - DNA, 20 bp, Homo sapiens
cccctctcacgccacccccg

SEQ ID NO: 2970855 - DNA, 16 bp, Homo sapiens
cccctctcaggagcca

SEQ ID NO: 2970856 - DNA, 14 bp, Homo sapiens
cccctctcctggag

SEQ ID NO: 2970857 - DNA, 12 bp, Homo sapiens
cccctctctggg

SEQ ID NO: 2970858 - DNA, 18 bp, Homo sapiens
cccctctgcacccagaac

SEQ ID NO: 2970859 - DNA, 14 bp, Homo sapiens
cccctctgcttctc

SEQ ID NO: 2970860 - DNA, 17 bp, Homo sapiens
cccctgagtccgcctgc

SEQ ID NO: 2970861 - DNA, 19 bp, Homo sapiens
cccctgagtccgcctgcgc

SEQ ID NO: 2970862 - DNA, 20 bp, Homo sapiens
cccctgcagacgtctggccc

SEQ ID NO: 2970863 - DNA, 22 bp, Homo sapiens
cccctgcagacgtctggccctg

SEQ ID NO: 2970864 - DNA, 11 bp, Homo sapiens
cccctgcagct

SEQ ID NO: 2970865 - DNA, 12 bp, Homo sapiens
cccctgccaccg

SEQ ID NO: 2970866 - DNA, 21 bp, Homo sapiens
cccctgccaccgactgcccag

SEQ ID NO: 2970867 - DNA, 16 bp, Homo sapiens
cccctgccactcaccc

SEQ ID NO: 2970868 - DNA, 17 bp, Homo sapiens
cccctgccactcaccct

SEQ ID NO: 2970869 - DNA, 16 bp, Homo sapiens
cccctgccagtgcctt

SEQ ID NO: 2970870 - DNA, 13 bp, Homo sapiens
cccctgcccgcca

SEQ ID NO: 2970871 - DNA, 13 bp, Homo sapiens
cccctgccctgtg

SEQ ID NO: 2970872 - DNA, 20 bp, Homo sapiens
cccctgccctgtgccgcact

SEQ ID NO: 2970873 - DNA, 14 bp, Homo sapiens
cccctgccctgtgg

SEQ ID NO: 2970874 - DNA, 12 bp, Homo sapiens
cccctgcctcga

SEQ ID NO: 2970875 - DNA, 14 bp, Homo sapiens
cccctgcctcgagg

SEQ ID NO: 2970876 - DNA, 19 bp, Homo sapiens
cccctgcctcgagggccgc

SEQ ID NO: 2970877 - DNA, 21 bp, Homo sapiens
cccctgcctcgagggccgcct

SEQ ID NO: 2970878 - DNA, 18 bp, Homo sapiens
cccctgctgtctctctgg

SEQ ID NO: 2970879 - DNA, 23 bp, Homo sapiens
cccctggaaccagcaagtcccag

SEQ ID NO: 2970880 - DNA, 16 bp, Homo sapiens
cccctggaacctttcc

SEQ ID NO: 2970881 - DNA, 19 bp, Homo sapiens
cccctggagtgtgtcagag

SEQ ID NO: 2970882 - DNA, 15 bp, Homo sapiens
cccctggcagctgcc

SEQ ID NO: 2970883 - DNA, 16 bp, Homo sapiens
cccctggcagctgccc

SEQ ID NO: 2970884 - DNA, 14 bp, Homo sapiens
cccctggcagtgct

SEQ ID NO: 2970885 - DNA, 17 bp, Homo sapiens
cccctggcagtgctgag

SEQ ID NO: 2970886 - DNA, 16 bp, Homo sapiens
cccctggcccaggagg

SEQ ID NO: 2970887 - DNA, 19 bp, Homo sapiens
cccctggccccgcctgcct

SEQ ID NO: 2970888 - DNA, 12 bp, Homo sapiens
cccctggctctg

SEQ ID NO: 2970889 - DNA, 14 bp, Homo sapiens
cccctggctctggg

SEQ ID NO: 2970890 - DNA, 17 bp, Homo sapiens
cccctggctctgggccg

SEQ ID NO: 2970891 - DNA, 16 bp, Homo sapiens
cccctggctgaacagt

SEQ ID NO: 2970892 - DNA, 22 bp, Homo sapiens
cccctggctgaacagtgctctg

SEQ ID NO: 2970893 - DNA, 22 bp, Homo sapiens
cccctggctgggacgtggctca

SEQ ID NO: 2970894 - DNA, 14 bp, Homo sapiens
cccctggggaccca

SEQ ID NO: 2970895 - DNA, 15 bp, Homo sapiens
cccctggggacccac

SEQ ID NO: 2970896 - DNA, 21 bp, Homo sapiens
cccctggggctgagtctccag

SEQ ID NO: 2970897 - DNA, 22 bp, Homo sapiens
cccctggggctgagtctccagg

SEQ ID NO: 2970898 - DNA, 14 bp, Homo sapiens
cccctggggctggt

SEQ ID NO: 2970899 - DNA, 20 bp, Homo sapiens
cccctggggtggccaccagt

SEQ ID NO: 2970900 - DNA, 12 bp, Homo sapiens
cccctggtggtt

SEQ ID NO: 2970901 - DNA, 19 bp, Homo sapiens
cccctgtcccctggggctg

SEQ ID NO: 2970902 - DNA, 18 bp, Homo sapiens
cccctgtctagagaggga

SEQ ID NO: 2970903 - DNA, 17 bp, Homo sapiens
cccctgtgcctctgtcc

SEQ ID NO: 2970904 - DNA, 22 bp, Homo sapiens
cccctgtggtaactttgcaggc

SEQ ID NO: 2970905 - DNA, 19 bp, Homo sapiens
cccctgtttcaatcactgt

SEQ ID NO: 2970906 - DNA, 18 bp, Homo sapiens
ccccttcaacaaacagtg

SEQ ID NO: 2970907 - DNA, 20 bp, Homo sapiens
ccccttcaacaaacagtgta

SEQ ID NO: 2970908 - DNA, 19 bp, Homo sapiens
ccccttcaatctcgtttag

SEQ ID NO: 2970909 - DNA, 14 bp, Homo sapiens
ccccttcacaaagc

SEQ ID NO: 2970910 - DNA, 14 bp, Homo sapiens
ccccttccactgag

SEQ ID NO: 2970911 - DNA, 12 bp, Homo sapiens
ccccttcccacg

SEQ ID NO: 2970912 - DNA, 13 bp, Homo sapiens
ccccttctctgtg

SEQ ID NO: 2970913 - DNA, 14 bp, Homo sapiens
ccccttctgctcag

SEQ ID NO: 2970914 - DNA, 19 bp, Homo sapiens
ccccttctgctcagctctg

SEQ ID NO: 2970915 - DNA, 23 bp, Homo sapiens
ccccttgacaactggcaggcagg

SEQ ID NO: 2970916 - DNA, 15 bp, Homo sapiens
ccccttgcagcctgg

SEQ ID NO: 2970917 - DNA, 18 bp, Homo sapiens
ccccttgcagcctggtca

SEQ ID NO: 2970918 - DNA, 20 bp, Homo sapiens
ccccttgtccctggggcact

SEQ ID NO: 2970919 - DNA, 22 bp, Homo sapiens
ccccttgtccctggggcactcc

SEQ ID NO: 2970920 - DNA, 14 bp, Homo sapiens
cccctttccccagc

SEQ ID NO: 2970921 - DNA, 19 bp, Homo sapiens
cccctttgggccctgcatg

SEQ ID NO: 2970922 - DNA, 19 bp, Homo sapiens
cccgaacctcacctgacct

SEQ ID NO: 2970923 - DNA, 18 bp, Homo sapiens
cccgaagggcccccacat

SEQ ID NO: 2970924 - DNA, 12 bp, Homo sapiens
cccgacatggct

SEQ ID NO: 2970925 - DNA, 13 bp, Homo sapiens
cccgactgcctgt

SEQ ID NO: 2970926 - DNA, 21 bp, Homo sapiens
cccgaggaagatgctcatctg

SEQ ID NO: 2970927 - DNA, 14 bp, Homo sapiens
cccgaggctgcccc

SEQ ID NO: 2970928 - DNA, 17 bp, Homo sapiens
cccgagggttgattaag

SEQ ID NO: 2970929 - DNA, 19 bp, Homo sapiens
cccgagggttgattaaggc

SEQ ID NO: 2970930 - DNA, 22 bp, Homo sapiens
cccgaggtggctgcctggagcc

SEQ ID NO: 2970931 - DNA, 21 bp, Homo sapiens
cccgagtggtctcctctcagc

SEQ ID NO: 2970932 - DNA, 19 bp, Homo sapiens
cccgatggcggggatctgg

SEQ ID NO: 2970933 - DNA, 13 bp, Homo sapiens
cccgcaccttcct

SEQ ID NO: 2970934 - DNA, 14 bp, Homo sapiens
cccgcagacctctg

SEQ ID NO: 2970935 - DNA, 15 bp, Homo sapiens
cccgcagacctctgg

SEQ ID NO: 2970936 - DNA, 17 bp, Homo sapiens
cccgcagacctctggat

SEQ ID NO: 2970937 - DNA, 13 bp, Homo sapiens
cccgcagccctgg

SEQ ID NO: 2970938 - DNA, 20 bp, Homo sapiens
cccgcagcctggcatctgtg

SEQ ID NO: 2970939 - DNA, 18 bp, Homo sapiens
cccgcaggcctgccttct

SEQ ID NO: 2970940 - DNA, 22 bp, Homo sapiens
cccgcagtgtgcactaaggggc

SEQ ID NO: 2970941 - DNA, 13 bp, Homo sapiens
cccgccagccccg

SEQ ID NO: 2970942 - DNA, 19 bp, Homo sapiens
cccgcccagaggagcccag

SEQ ID NO: 2970943 - DNA, 18 bp, Homo sapiens
cccgcccccaccgggctg

SEQ ID NO: 2970944 - DNA, 16 bp, Homo sapiens
cccgccccgggctggc

SEQ ID NO: 2970945 - DNA, 20 bp, Homo sapiens
cccgccccgggctggccctg

SEQ ID NO: 2970946 - DNA, 15 bp, Homo sapiens
cccgcctgcccacct

SEQ ID NO: 2970947 - DNA, 17 bp, Homo sapiens
cccgcctgcccacctgc

SEQ ID NO: 2970948 - DNA, 20 bp, Homo sapiens
cccgcctgcccacctgcctg

SEQ ID NO: 2970949 - DNA, 22 bp, Homo sapiens
cccgcggcccagacccagcccg

SEQ ID NO: 2970950 - DNA, 14 bp, Homo sapiens
cccgcgtagtgtca

SEQ ID NO: 2970951 - DNA, 20 bp, Homo sapiens
cccgctccgtctctgtcctc

SEQ ID NO: 2970952 - DNA, 21 bp, Homo sapiens
cccgctccgtctctgtcctcg

SEQ ID NO: 2970953 - DNA, 16 bp, Homo sapiens
ccgagagtagccgaga

SEQ ID NO: 2970954 - DNA, 20 bp, Homo sapiens
ccgagagtccatcagcctcc

SEQ ID NO: 2970955 - DNA, 16 bp, Homo sapiens
ccgagcctggctccaa

SEQ ID NO: 2970956 - DNA, 20 bp, Homo sapiens
ccgagcttagattctgtatg

SEQ ID NO: 2970957 - DNA, 12 bp, Homo sapiens
ccgaggactgga

SEQ ID NO: 2970958 - DNA, 13 bp, Homo sapiens
ccgaggactggac

SEQ ID NO: 2970959 - DNA, 14 bp, Homo sapiens
ccgaggctgcccca

SEQ ID NO: 2970960 - DNA, 14 bp, Homo sapiens
ccgagggcgtcaga

SEQ ID NO: 2970961 - DNA, 18 bp, Homo sapiens
ccgagggctcagaagagc

SEQ ID NO: 2970962 - DNA, 14 bp, Homo sapiens
ccgaggggcctttg

SEQ ID NO: 2970963 - DNA, 12 bp, Homo sapiens
ccgaggtcccat

SEQ ID NO: 2970964 - DNA, 21 bp, Homo sapiens
ccgaggtggctgcctggagcc

SEQ ID NO: 2970965 - DNA, 15 bp, Homo sapiens
ccgaggttgtgggga

SEQ ID NO: 2970966 - DNA, 20 bp, Homo sapiens
ccgagtagctgggattacag

SEQ ID NO: 2970967 - DNA, 20 bp, Homo sapiens
ccgagtcattcgttctgtgg

SEQ ID NO: 2970968 - DNA, 12 bp, Homo sapiens
ccgagtccaagc

SEQ ID NO: 2970969 - DNA, 15 bp, Homo sapiens
ccgagtgcggcgtgg

SEQ ID NO: 2970970 - DNA, 20 bp, Homo sapiens
ccgatggtgggtggggctgc

SEQ ID NO: 2970971 - DNA, 19 bp, Homo sapiens
ccgatgttattagatgtta

SEQ ID NO: 2970972 - DNA, 15 bp, Homo sapiens
ccgcaaaccacactg

SEQ ID NO: 2970973 - DNA, 16 bp, Homo sapiens
ccgcacaaagcggctc

SEQ ID NO: 2970974 - DNA, 13 bp, Homo sapiens
ccgcaccccagag

SEQ ID NO: 2970975 - DNA, 21 bp, Homo sapiens
ccgcacctgaccgctgcccag

SEQ ID NO: 2970976 - DNA, 11 bp, Homo sapiens
ccgcagaggca

SEQ ID NO: 2970977 - DNA, 14 bp, Homo sapiens
ccgcagaggcagaa

SEQ ID NO: 2970978 - DNA, 22 bp, Homo sapiens
ccgcagcggtgggaaggaaagg

SEQ ID NO: 2970979 - DNA, 13 bp, Homo sapiens
ccgcagctgctgc

SEQ ID NO: 2970980 - DNA, 14 bp, Homo sapiens
ccgcagctgctgcc

SEQ ID NO: 2970981 - DNA, 18 bp, Homo sapiens
ccgcagctgctgccactc

SEQ ID NO: 2970982 - DNA, 14 bp, Homo sapiens
ccgcaggaaggcag

SEQ ID NO: 2970983 - DNA, 15 bp, Homo sapiens
ccgcagtgtgcacta

SEQ ID NO: 2970984 - DNA, 23 bp, Homo sapiens
ccgcagtgtgcactaaggggccc

SEQ ID NO: 2970985 - DNA, 18 bp, Homo sapiens
ccgcagtgtggccaggct

SEQ ID NO: 2970986 - DNA, 13 bp, Homo sapiens
ccgcataagaaaa

SEQ ID NO: 2970987 - DNA, 16 bp, Homo sapiens
ccgcatcctagtctct

SEQ ID NO: 2970988 - DNA, 16 bp, Homo sapiens
ccgcatcttctccatc

SEQ ID NO: 2970989 - DNA, 12 bp, Homo sapiens
ccgcatggcagc

SEQ ID NO: 2970990 - DNA, 23 bp, Homo sapiens
ccgcatggcagctgggcccacag

SEQ ID NO: 2970991 - DNA, 15 bp, Homo sapiens
ccgcattccaggctc

SEQ ID NO: 2970992 - DNA, 14 bp, Homo sapiens
ccgcattccctgag

SEQ ID NO: 2970993 - DNA, 20 bp, Homo sapiens
ccgccacatggtgtggccat

SEQ ID NO: 2970994 - DNA, 22 bp, Homo sapiens
ccgccacatggtgtggccatca

SEQ ID NO: 2970995 - DNA, 20 bp, Homo sapiens
ccgccaggcgctgcagggcc

SEQ ID NO: 2970996 - DNA, 12 bp, Homo sapiens
ccgccagggccc

SEQ ID NO: 2970997 - DNA, 23 bp, Homo sapiens
ccgccagtgtttctgaatgtttg

SEQ ID NO: 2970998 - DNA, 12 bp, Homo sapiens
ccgccatctgcg

SEQ ID NO: 2970999 - DNA, 20 bp, Homo sapiens
ccgccatctgcgcagggtgg

SEQ ID NO: 2971000 - DNA, 15 bp, Homo sapiens
ccgcccagctctccc

SEQ ID NO: 2971001 - DNA, 13 bp, Homo sapiens
ccgcccatgcact

SEQ ID NO: 2971002 - DNA, 12 bp, Homo sapiens
ccgcccccaccg

SEQ ID NO: 2971003 - DNA, 17 bp, Homo sapiens
ccgcccccaccgggctg

SEQ ID NO: 2971004 - DNA, 11 bp, Homo sapiens
ccgccccctgc

SEQ ID NO: 2971005 - DNA, 13 bp, Homo sapiens
ccgccctgagaga

SEQ ID NO: 2971006 - DNA, 18 bp, Homo sapiens
ccgccctgcgggccacag

SEQ ID NO: 2971007 - DNA, 15 bp, Homo sapiens
ccgccgctgaccctg

SEQ ID NO: 2971008 - DNA, 18 bp, Homo sapiens
ccgccggggtcctgggag

SEQ ID NO: 2971009 - DNA, 23 bp, Homo sapiens
ccgccggggtcctgggaggctgc

SEQ ID NO: 2971010 - DNA, 13 bp, Homo sapiens
ccgcctcagcctc

SEQ ID NO: 2971011 - DNA, 10 bp, Homo sapiens
ccgcctcctg

SEQ ID NO: 2971012 - DNA, 12 bp, Homo sapiens
ccgcctgcccac

SEQ ID NO: 2971013 - DNA, 17 bp, Homo sapiens
ccgcctgcccacctgcc

SEQ ID NO: 2971014 - DNA, 14 bp, Homo sapiens
ccgcctgcgcctcc

SEQ ID NO: 2971015 - DNA, 14 bp, Homo sapiens
ccgcctggtactca

SEQ ID NO: 2971016 - DNA, 22 bp, Homo sapiens
ccgccttccctcactcttcctc

SEQ ID NO: 2971017 - DNA, 21 bp, Homo sapiens
ccgccttggccttgcagctgg

SEQ ID NO: 2971018 - DNA, 16 bp, Homo sapiens
ccgcctttacaaggga

SEQ ID NO: 2971019 - DNA, 18 bp, Homo sapiens
ccgcgatgccctgggggc

SEQ ID NO: 2971020 - DNA, 17 bp, Homo sapiens
ccgcgcccccaccccag

SEQ ID NO: 2971021 - DNA, 23 bp, Homo sapiens
ccgcgccctccctccgcctccca

SEQ ID NO: 2971022 - DNA, 14 bp, Homo sapiens
ccgcgcgtccagct

SEQ ID NO: 2971023 - DNA, 17 bp, Homo sapiens
ccgcggacgtgctggcc

SEQ ID NO: 2971024 - DNA, 12 bp, Homo sapiens
ccgcggcctgga

SEQ ID NO: 2971025 - DNA, 17 bp, Homo sapiens
ccgcgtcgccctcccag

SEQ ID NO: 2971026 - DNA, 17 bp, Homo sapiens
ccgcgtgccgggccccc

SEQ ID NO: 2971027 - DNA, 18 bp, Homo sapiens
ccgcgtgccgggccccca

SEQ ID NO: 2971028 - DNA, 22 bp, Homo sapiens
ccgcgtgccgggcccccaccgc

SEQ ID NO: 2971029 - DNA, 14 bp, Homo sapiens
ccgcgtgtgcctgt

SEQ ID NO: 2971030 - DNA, 17 bp, Homo sapiens
ccgcgtgtgcctgtgtg

SEQ ID NO: 2971031 - DNA, 16 bp, Homo sapiens
ccgctacctccctccc

SEQ ID NO: 2971032 - DNA, 15 bp, Homo sapiens
ccgctccgtctctgt

SEQ ID NO: 2971033 - DNA, 17 bp, Homo sapiens
ccgctccgtctctgtcc

SEQ ID NO: 2971034 - DNA, 18 bp, Homo sapiens
ccgctccgtctctgtcct

SEQ ID NO: 2971035 - DNA, 16 bp, Homo sapiens
ccgctcgatgcctttg

SEQ ID NO: 2971036 - DNA, 14 bp, Homo sapiens
ccgctctcctgcca

SEQ ID NO: 2971037 - DNA, 14 bp, Homo sapiens
ccgctgagaggctg

SEQ ID NO: 2971038 - DNA, 16 bp, Homo sapiens
ccgctgccacccacct

SEQ ID NO: 2971039 - DNA, 12 bp, Homo sapiens
ccgctgcccagg

SEQ ID NO: 2971040 - DNA, 19 bp, Homo sapiens
ccgctgcctggaacaccag

SEQ ID NO: 2971041 - DNA, 19 bp, Homo sapiens
ccgctgcttccaggctggg

SEQ ID NO: 2971042 - DNA, 23 bp, Homo sapiens
ccgctgcttccaggctgggcagc

SEQ ID NO: 2971043 - DNA, 17 bp, Homo sapiens
ccgctgtgtcctccctc

SEQ ID NO: 2971044 - DNA, 21 bp, Homo sapiens
ccgctgttcacccacagggct

SEQ ID NO: 2971045 - DNA, 18 bp, Homo sapiens
ccgcttagcgctctggac

SEQ ID NO: 2971046 - DNA, 19 bp, Homo sapiens
ccgcttgtccagcgcctag

SEQ ID NO: 2971047 - DNA, 16 bp, Homo sapiens
ccggacctgagcccgc

SEQ ID NO: 2971048 - DNA, 23 bp, Homo sapiens
ccggacctgagcccgcagcccag

SEQ ID NO: 2971049 - DNA, 14 bp, Homo sapiens
ccggacgcaggtgc

SEQ ID NO: 2971050 - DNA, 12 bp, Homo sapiens
ccggagcccaga

SEQ ID NO: 2971051 - DNA, 14 bp, Homo sapiens
ccggagcctccagc

SEQ ID NO: 2971052 - DNA, 19 bp, Homo sapiens
ccggagctgcccctctctg

SEQ ID NO: 2971053 - DNA, 21 bp, Homo sapiens
ccggagctgcccctctctggg

SEQ ID NO: 2971054 - DNA, 19 bp, Homo sapiens
ccggagggaaactgtgaat

SEQ ID NO: 2971055 - DNA, 18 bp, Homo sapiens
ccggagggcaccagggac

SEQ ID NO: 2971056 - DNA, 15 bp, Homo sapiens
ccggatcctgggtgg

SEQ ID NO: 2971057 - DNA, 17 bp, Homo sapiens
ccggatgaaacttctca

SEQ ID NO: 2971058 - DNA, 21 bp, Homo sapiens
ccggattggccctgcccctcc

SEQ ID NO: 2971059 - DNA, 11 bp, Homo sapiens
ccggcagggcg

SEQ ID NO: 2971060 - DNA, 17 bp, Homo sapiens
ccggcagttctgggtgc

SEQ ID NO: 2971061 - DNA, 22 bp, Homo sapiens
ccggcagttctgggtgctccct

SEQ ID NO: 2971062 - DNA, 22 bp, Homo sapiens
ccggccccgagagcaggctcga

SEQ ID NO: 2971063 - DNA, 12 bp, Homo sapiens
ccggcccctcac

SEQ ID NO: 2971064 - DNA, 15 bp, Homo sapiens
ccggcccctcaccct

SEQ ID NO: 2971065 - DNA, 17 bp, Homo sapiens
ccggcccctcaccctct

SEQ ID NO: 2971066 - DNA, 20 bp, Homo sapiens
ccggcccctcaccctctgtc

SEQ ID NO: 2971067 - DNA, 21 bp, Homo sapiens
ccggccctcctaccctgcgcc

SEQ ID NO: 2971068 - DNA, 11 bp, Homo sapiens
ccggccctgcc

SEQ ID NO: 2971069 - DNA, 15 bp, Homo sapiens
ccggccctgcccctc

SEQ ID NO: 2971070 - DNA, 17 bp, Homo sapiens
ccggccctgcccctccc

SEQ ID NO: 2971071 - DNA, 18 bp, Homo sapiens
ccggccctgcccctccct

SEQ ID NO: 2971072 - DNA, 22 bp, Homo sapiens
ccggccctgcccctccctagat

SEQ ID NO: 2971073 - DNA, 12 bp, Homo sapiens
ccggccctgggg

SEQ ID NO: 2971074 - DNA, 14 bp, Homo sapiens
ccggccctgtgtgc

SEQ ID NO: 2971075 - DNA, 15 bp, Homo sapiens
ccggccctgtgtgca

SEQ ID NO: 2971076 - DNA, 17 bp, Homo sapiens
ccggccctgtgtgcagg

SEQ ID NO: 2971077 - DNA, 17 bp, Homo sapiens
ccggcgagccctgtgga

SEQ ID NO: 2971078 - DNA, 14 bp, Homo sapiens
ccggcgcctgccct

SEQ ID NO: 2971079 - DNA, 17 bp, Homo sapiens
ccggcgcctgccctgcc

SEQ ID NO: 2971080 - DNA, 15 bp, Homo sapiens
ccggcggccctgctg

SEQ ID NO: 2971081 - DNA, 14 bp, Homo sapiens
ccggcgggtgctct

SEQ ID NO: 2971082 - DNA, 22 bp, Homo sapiens
ccggcgggtgctctgaggcctc

SEQ ID NO: 2971083 - DNA, 18 bp, Homo sapiens
ccggctaatttttgtaat

SEQ ID NO: 2971084 - DNA, 19 bp, Homo sapiens
ccggctaatttttttgtat

SEQ ID NO: 2971085 - DNA, 15 bp, Homo sapiens
ccggctcggcccagc

SEQ ID NO: 2971086 - DNA, 21 bp, Homo sapiens
ccggctgaccctgtgccccag

SEQ ID NO: 2971087 - DNA, 22 bp, Homo sapiens
cctccgagtgagtcagtgatga

SEQ ID NO: 2971088 - DNA, 15 bp, Homo sapiens
cctccgatgcctggc

SEQ ID NO: 2971089 - DNA, 13 bp, Homo sapiens
cctccgcatgcca

SEQ ID NO: 2971090 - DNA, 20 bp, Homo sapiens
cctccgcctactgtccctct

SEQ ID NO: 2971091 - DNA, 17 bp, Homo sapiens
cctccgcctcccatccc

SEQ ID NO: 2971092 - DNA, 17 bp, Homo sapiens
cctccgcttatcctgct

SEQ ID NO: 2971093 - DNA, 15 bp, Homo sapiens
cctccgggcagggga

SEQ ID NO: 2971094 - DNA, 21 bp, Homo sapiens
cctccggggttcagcctcctg

SEQ ID NO: 2971095 - DNA, 13 bp, Homo sapiens
cctccgtccctct

SEQ ID NO: 2971096 - DNA, 16 bp, Homo sapiens
cctccgtccctctgtc

SEQ ID NO: 2971097 - DNA, 13 bp, Homo sapiens
cctcctacctcag

SEQ ID NO: 2971098 - DNA, 15 bp, Homo sapiens
cctcctagccaccca

SEQ ID NO: 2971099 - DNA, 18 bp, Homo sapiens
cctcctcacactccagaa

SEQ ID NO: 2971100 - DNA, 17 bp, Homo sapiens
cctcctcacccaccctg

SEQ ID NO: 2971101 - DNA, 13 bp, Homo sapiens
cctcctcactccc

SEQ ID NO: 2971102 - DNA, 17 bp, Homo sapiens
cctcctcactccctagg

SEQ ID NO: 2971103 - DNA, 17 bp, Homo sapiens
cctcctcaggcacacag

SEQ ID NO: 2971104 - DNA, 21 bp, Homo sapiens
cctcctcaggcacacagctac

SEQ ID NO: 2971105 - DNA, 19 bp, Homo sapiens
cctcctcccagtgccttct

SEQ ID NO: 2971106 - DNA, 23 bp, Homo sapiens
cctcctccccgctccgtctctgt

SEQ ID NO: 2971107 - DNA, 17 bp, Homo sapiens
cctcctccctgcatctg

SEQ ID NO: 2971108 - DNA, 15 bp, Homo sapiens
cctcctccctggctg

SEQ ID NO: 2971109 - DNA, 19 bp, Homo sapiens
cctcctccctgttattttc

SEQ ID NO: 2971110 - DNA, 15 bp, Homo sapiens
cctcctcctccctcc

SEQ ID NO: 2971111 - DNA, 13 bp, Homo sapiens
cctcctctacctc

SEQ ID NO: 2971112 - DNA, 16 bp, Homo sapiens
cctcctctacctctct

SEQ ID NO: 2971113 - DNA, 13 bp, Homo sapiens
cctcctctcagtg

SEQ ID NO: 2971114 - DNA, 16 bp, Homo sapiens
cctcctctccatgcaa

SEQ ID NO: 2971115 - DNA, 13 bp, Homo sapiens
cctcctctcccgt

SEQ ID NO: 2971116 - DNA, 17 bp, Homo sapiens
cctcctctctccctgcc

SEQ ID NO: 2971117 - DNA, 21 bp, Homo sapiens
cctcctctctccctgcctcac

SEQ ID NO: 2971118 - DNA, 13 bp, Homo sapiens
cctcctctgaaac

SEQ ID NO: 2971119 - DNA, 19 bp, Homo sapiens
cctcctctgaaacagctgc

SEQ ID NO: 2971120 - DNA, 18 bp, Homo sapiens
cctcctctgccacctccc

SEQ ID NO: 2971121 - DNA, 14 bp, Homo sapiens
cctcctgccagctc

SEQ ID NO: 2971122 - DNA, 15 bp, Homo sapiens
cctcctgccagctct

SEQ ID NO: 2971123 - DNA, 12 bp, Homo sapiens
cctcctgcccac

SEQ ID NO: 2971124 - DNA, 16 bp, Homo sapiens
cctcctgcccaggaga

SEQ ID NO: 2971125 - DNA, 23 bp, Homo sapiens
cctcctggagcagaaagtgcctt

SEQ ID NO: 2971126 - DNA, 16 bp, Homo sapiens
cctcctggctcaggcc

SEQ ID NO: 2971127 - DNA, 18 bp, Homo sapiens
cctcctggctcaggccca

SEQ ID NO: 2971128 - DNA, 21 bp, Homo sapiens
cctcctgggccctctctgctc

SEQ ID NO: 2971129 - DNA, 14 bp, Homo sapiens
cctcctggggccag

SEQ ID NO: 2971130 - DNA, 18 bp, Homo sapiens
cctcctggggccaggccg

SEQ ID NO: 2971131 - DNA, 18 bp, Homo sapiens
cctcctggtgtcacccca

SEQ ID NO: 2971132 - DNA, 23 bp, Homo sapiens
cctcctgttacttgcttctgctg

SEQ ID NO: 2971133 - DNA, 13 bp, Homo sapiens
cctccttcagaca

SEQ ID NO: 2971134 - DNA, 13 bp, Homo sapiens
cctccttgccagc

SEQ ID NO: 2971135 - DNA, 14 bp, Homo sapiens
cctccttgccagcc

SEQ ID NO: 2971136 - DNA, 17 bp, Homo sapiens
cctccttgccagcccca

SEQ ID NO: 2971137 - DNA, 12 bp, Homo sapiens
cctcctttctct

SEQ ID NO: 2971138 - DNA, 15 bp, Homo sapiens
cctcctttgtctttt

SEQ ID NO: 2971139 - DNA, 17 bp, Homo sapiens
cctccttttcctgtgtt

SEQ ID NO: 2971140 - DNA, 15 bp, Homo sapiens
cctccttttttctta

SEQ ID NO: 2971141 - DNA, 16 bp, Homo sapiens
cctcgaaacacagaaa

SEQ ID NO: 2971142 - DNA, 20 bp, Homo sapiens
cctcgaattttatctgtgga

SEQ ID NO: 2971143 - DNA, 21 bp, Homo sapiens
cctcgaattttatctgtggag

SEQ ID NO: 2971144 - DNA, 19 bp, Homo sapiens
cctcgagtactgtgggcaa

SEQ ID NO: 2971145 - DNA, 21 bp, Homo sapiens
cctcgatgggagggatggccc

SEQ ID NO: 2971146 - DNA, 14 bp, Homo sapiens
cctcgcaagctggg

SEQ ID NO: 2971147 - DNA, 17 bp, Homo sapiens
cctcgcacaggccctag

SEQ ID NO: 2971148 - DNA, 19 bp, Homo sapiens
cctcgcacttgcagaggag

SEQ ID NO: 2971149 - DNA, 22 bp, Homo sapiens
cctcgcacttgcagaggagccc

SEQ ID NO: 2971150 - DNA, 12 bp, Homo sapiens
cctcgcctgccc

SEQ ID NO: 2971151 - DNA, 15 bp, Homo sapiens
cctcgcctgccctcc

SEQ ID NO: 2971152 - DNA, 13 bp, Homo sapiens
cctcgctgccagc

SEQ ID NO: 2971153 - DNA, 18 bp, Homo sapiens
cctcggacacccagggtc

SEQ ID NO: 2971154 - DNA, 12 bp, Homo sapiens
cctcggagctgg

SEQ ID NO: 2971155 - DNA, 18 bp, Homo sapiens
cctcggaggctcctccct

SEQ ID NO: 2971156 - DNA, 22 bp, Homo sapiens
cctcggaggctcctccctctgc

SEQ ID NO: 2971157 - DNA, 23 bp, Homo sapiens
cctcggaggctcctccctctgcc

SEQ ID NO: 2971158 - DNA, 18 bp, Homo sapiens
cctcggcaggcatggctg

SEQ ID NO: 2971159 - DNA, 17 bp, Homo sapiens
cctcggccctccctgcg

SEQ ID NO: 2971160 - DNA, 22 bp, Homo sapiens
cctcggccctccctgcgcttcc

SEQ ID NO: 2971161 - DNA, 20 bp, Homo sapiens
cctcggcttttctcagctgg

SEQ ID NO: 2971162 - DNA, 15 bp, Homo sapiens
cctcgggggcctgtg

SEQ ID NO: 2971163 - DNA, 20 bp, Homo sapiens
cctcgtcctccccctgccag

SEQ ID NO: 2971164 - DNA, 17 bp, Homo sapiens
cctcgtctcttgtgact

SEQ ID NO: 2971165 - DNA, 16 bp, Homo sapiens
cctcgtcttcagctgc

SEQ ID NO: 2971166 - DNA, 17 bp, Homo sapiens
cctcgtgccagcagcct

SEQ ID NO: 2971167 - DNA, 21 bp, Homo sapiens
cctcgtgccagcagcctcgca

SEQ ID NO: 2971168 - DNA, 20 bp, Homo sapiens
cctcgtttgatagtgcttct

SEQ ID NO: 2971169 - DNA, 14 bp, Homo sapiens
cctctaactccctc

SEQ ID NO: 2971170 - DNA, 18 bp, Homo sapiens
cctctaactccctcctca

SEQ ID NO: 2971171 - DNA, 15 bp, Homo sapiens
cctctacctctctcc

SEQ ID NO: 2971172 - DNA, 14 bp, Homo sapiens
cctctactgggagc

SEQ ID NO: 2971173 - DNA, 19 bp, Homo sapiens
cctctagaaatttttcaga

SEQ ID NO: 2971174 - DNA, 16 bp, Homo sapiens
cctctagggcagggtg

SEQ ID NO: 2971175 - DNA, 13 bp, Homo sapiens
cctctcacctcag

SEQ ID NO: 2971176 - DNA, 18 bp, Homo sapiens
cctctcacgccacccccg

SEQ ID NO: 2971177 - DNA, 19 bp, Homo sapiens
cctctcacgccacccccgc

SEQ ID NO: 2971178 - DNA, 15 bp, Homo sapiens
cctctcagtactttg

SEQ ID NO: 2971179 - DNA, 15 bp, Homo sapiens
cctctcagtgccttc

SEQ ID NO: 2971180 - DNA, 17 bp, Homo sapiens
cctctcagtgccttctc

SEQ ID NO: 2971181 - DNA, 12 bp, Homo sapiens
cctctccatgca

SEQ ID NO: 2971182 - DNA, 19 bp, Homo sapiens
cctctccatgcaagtgctg

SEQ ID NO: 2971183 - DNA, 15 bp, Homo sapiens
cctctcccacgggac

SEQ ID NO: 2971184 - DNA, 18 bp, Homo sapiens
cctctccccagcccagag

SEQ ID NO: 2971185 - DNA, 12 bp, Homo sapiens
cctctccccctt

SEQ ID NO: 2971186 - DNA, 22 bp, Homo sapiens
cctctccctgcactccctcctg

SEQ ID NO: 2971187 - DNA, 17 bp, Homo sapiens
cctctccgcacacctct

SEQ ID NO: 2971188 - DNA, 17 bp, Homo sapiens
cctctccgcgccctccg

SEQ ID NO: 2971189 - DNA, 18 bp, Homo sapiens
cctctcctcatgttctgc

SEQ ID NO: 2971190 - DNA, 12 bp, Homo sapiens
cctctcctgcct

SEQ ID NO: 2971191 - DNA, 15 bp, Homo sapiens
cctctcctgcctact

SEQ ID NO: 2971192 - DNA, 17 bp, Homo sapiens
cctctcctgcctactca

SEQ ID NO: 2971193 - DNA, 13 bp, Homo sapiens
cctctcctggagg

SEQ ID NO: 2971194 - DNA, 21 bp, Homo sapiens
cctctcctggagggcgcccag

SEQ ID NO: 2971195 - DNA, 14 bp, Homo sapiens
cctctcctttgtat

SEQ ID NO: 2971196 - DNA, 21 bp, Homo sapiens
cctctcggccccatcgcccca

SEQ ID NO: 2971197 - DNA, 22 bp, Homo sapiens
cctctcggtgctccatctccgc

SEQ ID NO: 2971198 - DNA, 13 bp, Homo sapiens
cctctctccctgc

SEQ ID NO: 2971199 - DNA, 15 bp, Homo sapiens
cctctctccctgcct

SEQ ID NO: 2971200 - DNA, 17 bp, Homo sapiens
cctctctccctgcctca

SEQ ID NO: 2971201 - DNA, 20 bp, Homo sapiens
cctctctccctgcctcacat

SEQ ID NO: 2971202 - DNA, 22 bp, Homo sapiens
cctctctccctgcctcacatct

SEQ ID NO: 2971203 - DNA, 23 bp, Homo sapiens
cctctctccctgcctcacatctc

SEQ ID NO: 2971204 - DNA, 15 bp, Homo sapiens
cctctctcctctccg

SEQ ID NO: 2971205 - DNA, 15 bp, Homo sapiens
cctctctcctggact

SEQ ID NO: 2971206 - DNA, 19 bp, Homo sapiens
cctctctctccctctttct

SEQ ID NO: 2971207 - DNA, 15 bp, Homo sapiens
cctctctctctctat

SEQ ID NO: 2971208 - DNA, 11 bp, Homo sapiens
cctctctctgt

SEQ ID NO: 2971209 - DNA, 21 bp, Homo sapiens
cctctctgcagacttcccagc

SEQ ID NO: 2971210 - DNA, 22 bp, Homo sapiens
cctctctgcagacttcccagct

SEQ ID NO: 2971211 - DNA, 19 bp, Homo sapiens
cctctctgtagtttatggc

SEQ ID NO: 2971212 - DNA, 13 bp, Homo sapiens
cctctctgtccct

SEQ ID NO: 2971213 - DNA, 17 bp, Homo sapiens
cctctctgtcccttgct

SEQ ID NO: 2971214 - DNA, 18 bp, Homo sapiens
cctctctgtctttttcct

SEQ ID NO: 2971215 - DNA, 13 bp, Homo sapiens
cctctcttcactg

SEQ ID NO: 2971216 - DNA, 15 bp, Homo sapiens
cctctcttcactgct

SEQ ID NO: 2971217 - DNA, 19 bp, Homo sapiens
cctctcttcactgctacat

SEQ ID NO: 2971218 - DNA, 16 bp, Homo sapiens
cctctcttccgggagc

SEQ ID NO: 2971219 - DNA, 22 bp, Homo sapiens
cctctcttttcctctctgtctg

SEQ ID NO: 2971220 - DNA, 12 bp, Homo sapiens
cctgtctctaaa

SEQ ID NO: 2971221 - DNA, 14 bp, Homo sapiens
cctgtctctaaaaa

SEQ ID NO: 2971222 - DNA, 16 bp, Homo sapiens
cctgtctctaaaaaga

SEQ ID NO: 2971223 - DNA, 16 bp, Homo sapiens
cctgtctgaacaaaaa

SEQ ID NO: 2971224 - DNA, 15 bp, Homo sapiens
cctgtctgccagggc

SEQ ID NO: 2971225 - DNA, 17 bp, Homo sapiens
cctgtctgtccaacccc

SEQ ID NO: 2971226 - DNA, 16 bp, Homo sapiens
cctgtctgtccttctg

SEQ ID NO: 2971227 - DNA, 22 bp, Homo sapiens
cctgtctgtgacctgcatctaa

SEQ ID NO: 2971228 - DNA, 17 bp, Homo sapiens
cctgtcttcggccgagc

SEQ ID NO: 2971229 - DNA, 20 bp, Homo sapiens
cctgtctttcctaagacctg

SEQ ID NO: 2971230 - DNA, 13 bp, Homo sapiens
cctgtgaccttgg

SEQ ID NO: 2971231 - DNA, 23 bp, Homo sapiens
cctgtgaccttgggaccaaaggg

SEQ ID NO: 2971232 - DNA, 17 bp, Homo sapiens
cctgtgagcccagctgg

SEQ ID NO: 2971233 - DNA, 20 bp, Homo sapiens
cctgtgagcccagctgggtc

SEQ ID NO: 2971234 - DNA, 14 bp, Homo sapiens
cctgtgaggcaggg

SEQ ID NO: 2971235 - DNA, 17 bp, Homo sapiens
cctgtgaggcaggggcg

SEQ ID NO: 2971236 - DNA, 20 bp, Homo sapiens
cctgtgagggagtgcagaac

SEQ ID NO: 2971237 - DNA, 20 bp, Homo sapiens
cctgtgaggggcccctggcc

SEQ ID NO: 2971238 - DNA, 17 bp, Homo sapiens
cctgtgaggtttcccaa

SEQ ID NO: 2971239 - DNA, 19 bp, Homo sapiens
cctgtgaggtttcccaatg

SEQ ID NO: 2971240 - DNA, 17 bp, Homo sapiens
cctgtgatcttattttt

SEQ ID NO: 2971241 - DNA, 16 bp, Homo sapiens
cctgtgcagaccttac

SEQ ID NO: 2971242 - DNA, 18 bp, Homo sapiens
cctgtgcagccgctgagc

SEQ ID NO: 2971243 - DNA, 20 bp, Homo sapiens
cctgtgcatgtatgtcttgg

SEQ ID NO: 2971244 - DNA, 22 bp, Homo sapiens
cctgtgcccatcatctctgcct

SEQ ID NO: 2971245 - DNA, 13 bp, Homo sapiens
cctgtgccccagt

SEQ ID NO: 2971246 - DNA, 14 bp, Homo sapiens
cctgtgccgcactc

SEQ ID NO: 2971247 - DNA, 22 bp, Homo sapiens
cctgtgcctccctctcctcgga

SEQ ID NO: 2971248 - DNA, 16 bp, Homo sapiens
cctgtgcctttcctat

SEQ ID NO: 2971249 - DNA, 21 bp, Homo sapiens
cctgtgcctttcctatcacct

SEQ ID NO: 2971250 - DNA, 13 bp, Homo sapiens
cctgtgctacaga

SEQ ID NO: 2971251 - DNA, 17 bp, Homo sapiens
cctgtgctgaacataac

SEQ ID NO: 2971252 - DNA, 22 bp, Homo sapiens
cctgtgcttcgggcccttccca

SEQ ID NO: 2971253 - DNA, 13 bp, Homo sapiens
cctgtggacagga

SEQ ID NO: 2971254 - DNA, 19 bp, Homo sapiens
cctgtggcagctgcccctg

SEQ ID NO: 2971255 - DNA, 22 bp, Homo sapiens
cctgtggcagctgcccctggca

SEQ ID NO: 2971256 - DNA, 21 bp, Homo sapiens
cctgtggccctgtcctgccat

SEQ ID NO: 2971257 - DNA, 12 bp, Homo sapiens
cctgtggctccc

SEQ ID NO: 2971258 - DNA, 16 bp, Homo sapiens
cctgtggctccctctc

SEQ ID NO: 2971259 - DNA, 19 bp, Homo sapiens
cctgtggctccctctctcc

SEQ ID NO: 2971260 - DNA, 13 bp, Homo sapiens
cctgtggctgtgg

SEQ ID NO: 2971261 - DNA, 13 bp, Homo sapiens
cctgtggggagcc

SEQ ID NO: 2971262 - DNA, 19 bp, Homo sapiens
cctgtggtgatgtgcctgt

SEQ ID NO: 2971263 - DNA, 23 bp, Homo sapiens
cctgtggtggctccccctctgct

SEQ ID NO: 2971264 - DNA, 22 bp, Homo sapiens
cctgtggtgtgcggagtctcct

SEQ ID NO: 2971265 - DNA, 15 bp, Homo sapiens
cctgtgtcaatccag

SEQ ID NO: 2971266 - DNA, 13 bp, Homo sapiens
cctgtgtcccctg

SEQ ID NO: 2971267 - DNA, 18 bp, Homo sapiens
cctgtgtcccctgacctg

SEQ ID NO: 2971268 - DNA, 22 bp, Homo sapiens
cctgtgtcccctgacctgtcca

SEQ ID NO: 2971269 - DNA, 23 bp, Homo sapiens
cctgtgtcccctgacctgtccag

SEQ ID NO: 2971270 - DNA, 20 bp, Homo sapiens
cctgtgtctgcgaagtccta

SEQ ID NO: 2971271 - DNA, 14 bp, Homo sapiens
cctgtgtgactcca

SEQ ID NO: 2971272 - DNA, 22 bp, Homo sapiens
cctgtgtgattgacagctttgc

SEQ ID NO: 2971273 - DNA, 10 bp, Homo sapiens
cctgtgtgca

SEQ ID NO: 2971274 - DNA, 20 bp, Homo sapiens
cctgtgtggccacttctgtc

SEQ ID NO: 2971275 - DNA, 13 bp, Homo sapiens
cctgtgtttctag

SEQ ID NO: 2971276 - DNA, 18 bp, Homo sapiens
cctgttagctcctcactg

SEQ ID NO: 2971277 - DNA, 22 bp, Homo sapiens
cctgttagctcctcactgtggt

SEQ ID NO: 2971278 - DNA, 18 bp, Homo sapiens
cctgttaggccaactgcc

SEQ ID NO: 2971279 - DNA, 19 bp, Homo sapiens
cctgttattttcaagtagc

SEQ ID NO: 2971280 - DNA, 20 bp, Homo sapiens
cctgttcagttacagaaagt

SEQ ID NO: 2971281 - DNA, 20 bp, Homo sapiens
cctgttcatgtttttgtttt

SEQ ID NO: 2971282 - DNA, 21 bp, Homo sapiens
cctgttcatgtttttgtttta

SEQ ID NO: 2971283 - DNA, 14 bp, Homo sapiens
cctgttccaatgaa

SEQ ID NO: 2971284 - DNA, 23 bp, Homo sapiens
cctgttccccagagaaaggggag

SEQ ID NO: 2971285 - DNA, 12 bp, Homo sapiens
cctgttctgaaa

SEQ ID NO: 2971286 - DNA, 19 bp, Homo sapiens
cctgttcttgaggtctctt

SEQ ID NO: 2971287 - DNA, 19 bp, Homo sapiens
cctgttgacacaggtcttt

SEQ ID NO: 2971288 - DNA, 16 bp, Homo sapiens
cctgttgcttacaatt

SEQ ID NO: 2971289 - DNA, 24 bp, Homo sapiens
cctgttggatttgtttaaaaggat

SEQ ID NO: 2971290 - DNA, 17 bp, Homo sapiens
cctgttggctgctgcca

SEQ ID NO: 2971291 - DNA, 14 bp, Homo sapiens
cctgttgtgccaca

SEQ ID NO: 2971292 - DNA, 23 bp, Homo sapiens
cctgtttatttttaaattttctt

SEQ ID NO: 2971293 - DNA, 14 bp, Homo sapiens
cctgtttcctgctg

SEQ ID NO: 2971294 - DNA, 16 bp, Homo sapiens
cctgtttcctgctgct

SEQ ID NO: 2971295 - DNA, 17 bp, Homo sapiens
cctgtttctgaaaagaa

SEQ ID NO: 2971296 - DNA, 18 bp, Homo sapiens
cctgttttaagcagctct

SEQ ID NO: 2971297 - DNA, 19 bp, Homo sapiens
cctgttttaagcagctcta

SEQ ID NO: 2971298 - DNA, 14 bp, Homo sapiens
cctgttttttttct

SEQ ID NO: 2971299 - DNA, 23 bp, Homo sapiens
ccttaaaacagagaaggtcaatc

SEQ ID NO: 2971300 - DNA, 20 bp, Homo sapiens
ccttaaacaaaaattaaaat

SEQ ID NO: 2971301 - DNA, 15 bp, Homo sapiens
ccttaagcagcaaca

SEQ ID NO: 2971302 - DNA, 14 bp, Homo sapiens
ccttaagccctggc

SEQ ID NO: 2971303 - DNA, 18 bp, Homo sapiens
ccttaagccctggccccc

SEQ ID NO: 2971304 - DNA, 21 bp, Homo sapiens
ccttaatgtcaccatgcttgt

SEQ ID NO: 2971305 - DNA, 14 bp, Homo sapiens
ccttacagcctctg

SEQ ID NO: 2971306 - DNA, 18 bp, Homo sapiens
ccttacagcctctgactt

SEQ ID NO: 2971307 - DNA, 17 bp, Homo sapiens
ccttacagttatcctgc

SEQ ID NO: 2971308 - DNA, 12 bp, Homo sapiens
ccttacattaaa

SEQ ID NO: 2971309 - DNA, 18 bp, Homo sapiens
ccttacattaaaaagcct

SEQ ID NO: 2971310 - DNA, 23 bp, Homo sapiens
ccttaccactgtggaagtccctc

SEQ ID NO: 2971311 - DNA, 16 bp, Homo sapiens
ccttacccatcttgct

SEQ ID NO: 2971312 - DNA, 19 bp, Homo sapiens
ccttaccccaaagagaaag

SEQ ID NO: 2971313 - DNA, 19 bp, Homo sapiens
ccttaccccagttttttga

SEQ ID NO: 2971314 - DNA, 14 bp, Homo sapiens
ccttacccttagaa

SEQ ID NO: 2971315 - DNA, 14 bp, Homo sapiens
ccttacctcctgcc

SEQ ID NO: 2971316 - DNA, 17 bp, Homo sapiens
ccttacctcctgcccag

SEQ ID NO: 2971317 - DNA, 15 bp, Homo sapiens
ccttactcagagctg

SEQ ID NO: 2971318 - DNA, 12 bp, Homo sapiens
ccttactgcaga

SEQ ID NO: 2971319 - DNA, 15 bp, Homo sapiens
ccttactgtctctct

SEQ ID NO: 2971320 - DNA, 16 bp, Homo sapiens
ccttacttccagcaaa

SEQ ID NO: 2971321 - DNA, 18 bp, Homo sapiens
ccttacttccagcaaaat

SEQ ID NO: 2971322 - DNA, 16 bp, Homo sapiens
ccttacttcttgccct

SEQ ID NO: 2971323 - DNA, 22 bp, Homo sapiens
ccttactttactgcctgaataa

SEQ ID NO: 2971324 - DNA, 21 bp, Homo sapiens
ccttagcaatgggggcctccg

SEQ ID NO: 2971325 - DNA, 19 bp, Homo sapiens
ccttagccttgctgtagag

SEQ ID NO: 2971326 - DNA, 21 bp, Homo sapiens
ccttagctacaatcctacctt

SEQ ID NO: 2971327 - DNA, 22 bp, Homo sapiens
ccttagctattcccagggaacc

SEQ ID NO: 2971328 - DNA, 14 bp, Homo sapiens
ccttagcttcagga

SEQ ID NO: 2971329 - DNA, 16 bp, Homo sapiens
ccttagcttcaggaac

SEQ ID NO: 2971330 - DNA, 17 bp, Homo sapiens
ccttagcttcaggaacc

SEQ ID NO: 2971331 - DNA, 22 bp, Homo sapiens
ccttagcttggtatgagacaga

SEQ ID NO: 2971332 - DNA, 17 bp, Homo sapiens
ccttaggaatactgttt

SEQ ID NO: 2971333 - DNA, 18 bp, Homo sapiens
ccttaggaatactgtttt

SEQ ID NO: 2971334 - DNA, 13 bp, Homo sapiens
ccttaggccttcc

SEQ ID NO: 2971335 - DNA, 16 bp, Homo sapiens
ccttagtttcaagagt

SEQ ID NO: 2971336 - DNA, 17 bp, Homo sapiens
ccttatacatcacttcc

SEQ ID NO: 2971337 - DNA, 18 bp, Homo sapiens
ccttatagggaaaaatgc

SEQ ID NO: 2971338 - DNA, 16 bp, Homo sapiens
ccttatctccaagacc

SEQ ID NO: 2971339 - DNA, 15 bp, Homo sapiens
ccttatctgtgctca

SEQ ID NO: 2971340 - DNA, 17 bp, Homo sapiens
ccttatctgtgctcagg

SEQ ID NO: 2971341 - DNA, 21 bp, Homo sapiens
ccttattagagtgtctttcca

SEQ ID NO: 2971342 - DNA, 18 bp, Homo sapiens
ccttattttgataaaatg

SEQ ID NO: 2971343 - DNA, 19 bp, Homo sapiens
ccttcaaatgcgaacacta

SEQ ID NO: 2971344 - DNA, 21 bp, Homo sapiens
ccttcaatgaattaattcaga

SEQ ID NO: 2971345 - DNA, 14 bp, Homo sapiens
ccttcacatctccc

SEQ ID NO: 2971346 - DNA, 22 bp, Homo sapiens
ccttcactgtgctccaacctga

SEQ ID NO: 2971347 - DNA, 22 bp, Homo sapiens
ccttcagctttatttttcttta

SEQ ID NO: 2971348 - DNA, 12 bp, Homo sapiens
ccttcagtgccc

SEQ ID NO: 2971349 - DNA, 14 bp, Homo sapiens
ccttcagtgcccac

SEQ ID NO: 2971350 - DNA, 18 bp, Homo sapiens
ccttcagtgcccaccaac

SEQ ID NO: 2971351 - DNA, 15 bp, Homo sapiens
ccttcataccgcctc

SEQ ID NO: 2971352 - DNA, 12 bp, Homo sapiens
cgcccccacttt

SEQ ID NO: 2971353 - DNA, 13 bp, Homo sapiens
cgccccctcccta

SEQ ID NO: 2971354 - DNA, 12 bp, Homo sapiens
cgccccctgccc

SEQ ID NO: 2971355 - DNA, 15 bp, Homo sapiens
cgccccctgccctcc

SEQ ID NO: 2971356 - DNA, 23 bp, Homo sapiens
cgccccgctgtgtcctccctccc

SEQ ID NO: 2971357 - DNA, 20 bp, Homo sapiens
cgccccgggctggccctgtg

SEQ ID NO: 2971358 - DNA, 19 bp, Homo sapiens
cgcccctcccacagcgctg

SEQ ID NO: 2971359 - DNA, 21 bp, Homo sapiens
cgcccctcccacagcgctggc

SEQ ID NO: 2971360 - DNA, 11 bp, Homo sapiens
cgcccctgagg

SEQ ID NO: 2971361 - DNA, 12 bp, Homo sapiens
cgccctgagaga

SEQ ID NO: 2971362 - DNA, 23 bp, Homo sapiens
cgccctgagagagaatagagctg

SEQ ID NO: 2971363 - DNA, 12 bp, Homo sapiens
cgccctggactt

SEQ ID NO: 2971364 - DNA, 19 bp, Homo sapiens
cgcccttacttcttgccct

SEQ ID NO: 2971365 - DNA, 14 bp, Homo sapiens
cgccctttcctcct

SEQ ID NO: 2971366 - DNA, 22 bp, Homo sapiens
cgccgcaaaccacactggactc

SEQ ID NO: 2971367 - DNA, 18 bp, Homo sapiens
cgccgccttggccttgca

SEQ ID NO: 2971368 - DNA, 19 bp, Homo sapiens
cgccgcgcctggcctagac

SEQ ID NO: 2971369 - DNA, 22 bp, Homo sapiens
cgccgctgaccctgggcctgga

SEQ ID NO: 2971370 - DNA, 15 bp, Homo sapiens
cgccggggtcctggg

SEQ ID NO: 2971371 - DNA, 17 bp, Homo sapiens
cgccggggtcctgggag

SEQ ID NO: 2971372 - DNA, 19 bp, Homo sapiens
cgccggggtcctgggaggc

SEQ ID NO: 2971373 - DNA, 23 bp, Homo sapiens
cgccggggtcctgggaggctgca

SEQ ID NO: 2971374 - DNA, 16 bp, Homo sapiens
cgccgtctccatggca

SEQ ID NO: 2971375 - DNA, 14 bp, Homo sapiens
cgcctactgtccct

SEQ ID NO: 2971376 - DNA, 21 bp, Homo sapiens
cgcctagagcgcggctggctc

SEQ ID NO: 2971377 - DNA, 13 bp, Homo sapiens
cgcctaggatttc

SEQ ID NO: 2971378 - DNA, 22 bp, Homo sapiens
cgcctcaatgtggttgcaaggc

SEQ ID NO: 2971379 - DNA, 12 bp, Homo sapiens
cgcctcagcctc

SEQ ID NO: 2971380 - DNA, 15 bp, Homo sapiens
cgcctcagcctctca

SEQ ID NO: 2971381 - DNA, 16 bp, Homo sapiens
cgcctcagcctctcaa

SEQ ID NO: 2971382 - DNA, 12 bp, Homo sapiens
cgcctccatcca

SEQ ID NO: 2971383 - DNA, 15 bp, Homo sapiens
cgcctcccactgggg

SEQ ID NO: 2971384 - DNA, 15 bp, Homo sapiens
cgcctcccatcccgc

SEQ ID NO: 2971385 - DNA, 22 bp, Homo sapiens
cgcctccctagttagcatccag

SEQ ID NO: 2971386 - DNA, 16 bp, Homo sapiens
cgcctcgtgccagcag

SEQ ID NO: 2971387 - DNA, 17 bp, Homo sapiens
cgcctcgtgccagcagc

SEQ ID NO: 2971388 - DNA, 18 bp, Homo sapiens
cgcctcgtgccagcagcc

SEQ ID NO: 2971389 - DNA, 17 bp, Homo sapiens
cgcctctccctgcactc

SEQ ID NO: 2971390 - DNA, 14 bp, Homo sapiens
cgcctctggagccg

SEQ ID NO: 2971391 - DNA, 18 bp, Homo sapiens
cgcctgcaaacgctgcct

SEQ ID NO: 2971392 - DNA, 20 bp, Homo sapiens
cgcctgccatcttctccccg

SEQ ID NO: 2971393 - DNA, 12 bp, Homo sapiens
cgcctgcccacc

SEQ ID NO: 2971394 - DNA, 15 bp, Homo sapiens
cgcctgcccacctgc

SEQ ID NO: 2971395 - DNA, 17 bp, Homo sapiens
cgcctgcccacctgcct

SEQ ID NO: 2971396 - DNA, 18 bp, Homo sapiens
cgcctgcccacctgcctg

SEQ ID NO: 2971397 - DNA, 16 bp, Homo sapiens
cgcctgccctcctctc

SEQ ID NO: 2971398 - DNA, 16 bp, Homo sapiens
cgcctgccctgcccaa

SEQ ID NO: 2971399 - DNA, 17 bp, Homo sapiens
cgcctgccctgcccaag

SEQ ID NO: 2971400 - DNA, 19 bp, Homo sapiens
cgcctgccctgcccaagtg

SEQ ID NO: 2971401 - DNA, 13 bp, Homo sapiens
cgcctgcctcctg

SEQ ID NO: 2971402 - DNA, 19 bp, Homo sapiens
cgcctgcctcctggctcag

SEQ ID NO: 2971403 - DNA, 21 bp, Homo sapiens
cgcctgcctcctggctcaggc

SEQ ID NO: 2971404 - DNA, 11 bp, Homo sapiens
cgcctgccttt

SEQ ID NO: 2971405 - DNA, 12 bp, Homo sapiens
cgcctgcgcctc

SEQ ID NO: 2971406 - DNA, 12 bp, Homo sapiens
cgcctggagccc

SEQ ID NO: 2971407 - DNA, 14 bp, Homo sapiens
cgcctggagccctc

SEQ ID NO: 2971408 - DNA, 13 bp, Homo sapiens
cgcctggcctaga

SEQ ID NO: 2971409 - DNA, 19 bp, Homo sapiens
cgcctggctgcagcctgcg

SEQ ID NO: 2971410 - DNA, 15 bp, Homo sapiens
cgcctggctgctgct

SEQ ID NO: 2971411 - DNA, 17 bp, Homo sapiens
cgcctgggtccagggga

SEQ ID NO: 2971412 - DNA, 22 bp, Homo sapiens
cgccttagcactaccactcctg

SEQ ID NO: 2971413 - DNA, 15 bp, Homo sapiens
cgccttatttatatt

SEQ ID NO: 2971414 - DNA, 18 bp, Homo sapiens
cgccttccctcactcttc

SEQ ID NO: 2971415 - DNA, 22 bp, Homo sapiens
cgccttccctcactcttcctca

SEQ ID NO: 2971416 - DNA, 15 bp, Homo sapiens
cgccttcctgcagtc

SEQ ID NO: 2971417 - DNA, 18 bp, Homo sapiens
cgccttctcggagctggc

SEQ ID NO: 2971418 - DNA, 19 bp, Homo sapiens
cgccttgaccttcccaagg

SEQ ID NO: 2971419 - DNA, 15 bp, Homo sapiens
cgccttggccttgca

SEQ ID NO: 2971420 - DNA, 17 bp, Homo sapiens
cgccttggccttgcagc

SEQ ID NO: 2971421 - DNA, 20 bp, Homo sapiens
cgccttggccttgcagctgg

SEQ ID NO: 2971422 - DNA, 15 bp, Homo sapiens
cgcgactaatttcaa

SEQ ID NO: 2971423 - DNA, 17 bp, Homo sapiens
cgcgcccccctcccaga

SEQ ID NO: 2971424 - DNA, 20 bp, Homo sapiens
cgcgcccccctcccagaggc

SEQ ID NO: 2971425 - DNA, 13 bp, Homo sapiens
cgcgccctccctc

SEQ ID NO: 2971426 - DNA, 12 bp, Homo sapiens
cgcgcctgcctt

SEQ ID NO: 2971427 - DNA, 13 bp, Homo sapiens
cgcgcctgccttt

SEQ ID NO: 2971428 - DNA, 15 bp, Homo sapiens
cgcgcgctctctctc

SEQ ID NO: 2971429 - DNA, 18 bp, Homo sapiens
cgcgcggagacctcctga

SEQ ID NO: 2971430 - DNA, 14 bp, Homo sapiens
cgcgctctgctcag

SEQ ID NO: 2971431 - DNA, 18 bp, Homo sapiens
cgcggccctggggcgggc

SEQ ID NO: 2971432 - DNA, 21 bp, Homo sapiens
cgcggcctgcaccgacccgag

SEQ ID NO: 2971433 - DNA, 13 bp, Homo sapiens
cgcggcctggacc

SEQ ID NO: 2971434 - DNA, 15 bp, Homo sapiens
cgcggcggagctggc

SEQ ID NO: 2971435 - DNA, 17 bp, Homo sapiens
cgcggcggctctgccca

SEQ ID NO: 2971436 - DNA, 20 bp, Homo sapiens
cgcggcggctctgcccacct

SEQ ID NO: 2971437 - DNA, 11 bp, Homo sapiens
cgcggctggga

SEQ ID NO: 2971438 - DNA, 16 bp, Homo sapiens
cgcggctgggaggagg

SEQ ID NO: 2971439 - DNA, 18 bp, Homo sapiens
cgcgggctttgttgctgg

SEQ ID NO: 2971440 - DNA, 13 bp, Homo sapiens
cgcgtccgagaag

SEQ ID NO: 2971441 - DNA, 20 bp, Homo sapiens
cgcgtccgagaaggcggaaa

SEQ ID NO: 2971442 - DNA, 18 bp, Homo sapiens
cgcgtgccgggcccccac

SEQ ID NO: 2971443 - DNA, 20 bp, Homo sapiens
cgctacaaaacgcgcagatg

SEQ ID NO: 2971444 - DNA, 12 bp, Homo sapiens
cgctacctccct

SEQ ID NO: 2971445 - DNA, 15 bp, Homo sapiens
cgctcagcccagctg

SEQ ID NO: 2971446 - DNA, 13 bp, Homo sapiens
cgctccagctgcc

SEQ ID NO: 2971447 - DNA, 18 bp, Homo sapiens
cgctcccacctagtgccc

SEQ ID NO: 2971448 - DNA, 22 bp, Homo sapiens
cgctcccacctagtgccccaga

SEQ ID NO: 2971449 - DNA, 17 bp, Homo sapiens
cgctcccctccatcccc

SEQ ID NO: 2971450 - DNA, 21 bp, Homo sapiens
cgctccctcccaggactctga

SEQ ID NO: 2971451 - DNA, 17 bp, Homo sapiens
cgctccgtctctgtcct

SEQ ID NO: 2971452 - DNA, 14 bp, Homo sapiens
cgctcggcaggaag

SEQ ID NO: 2971453 - DNA, 16 bp, Homo sapiens
cgctcggcaggaagga

SEQ ID NO: 2971454 - DNA, 22 bp, Homo sapiens
cgctcgttccggtccccacaga

SEQ ID NO: 2971455 - DNA, 12 bp, Homo sapiens
cgctctccctac

SEQ ID NO: 2971456 - DNA, 16 bp, Homo sapiens
cgctctccctaccttg

SEQ ID NO: 2971457 - DNA, 19 bp, Homo sapiens
cgctctccctaccttgcct

SEQ ID NO: 2971458 - DNA, 20 bp, Homo sapiens
cgctctccctaccttgcctc

SEQ ID NO: 2971459 - DNA, 13 bp, Homo sapiens
cgctctcctgcca

SEQ ID NO: 2971460 - DNA, 17 bp, Homo sapiens
cgctctcctttctttct

SEQ ID NO: 2971461 - DNA, 17 bp, Homo sapiens
cgctctctctctttctc

SEQ ID NO: 2971462 - DNA, 19 bp, Homo sapiens
cgctctgccgccgcccgct

SEQ ID NO: 2971463 - DNA, 11 bp, Homo sapiens
cgctctgctgg

SEQ ID NO: 2971464 - DNA, 23 bp, Homo sapiens
cgctcttttctaagtggcgtgtg

SEQ ID NO: 2971465 - DNA, 15 bp, Homo sapiens
cgctgaataaatgtc

SEQ ID NO: 2971466 - DNA, 16 bp, Homo sapiens
cgctgaccctgggcct

SEQ ID NO: 2971467 - DNA, 13 bp, Homo sapiens
cgctgatatatgt

SEQ ID NO: 2971468 - DNA, 13 bp, Homo sapiens
cgctgcagggagc

SEQ ID NO: 2971469 - DNA, 14 bp, Homo sapiens
cgctgcagggagca

SEQ ID NO: 2971470 - DNA, 14 bp, Homo sapiens
cgctgcagggccgc

SEQ ID NO: 2971471 - DNA, 17 bp, Homo sapiens
cgctgccacccacctcc

SEQ ID NO: 2971472 - DNA, 14 bp, Homo sapiens
cgctgccctgggtc

SEQ ID NO: 2971473 - DNA, 18 bp, Homo sapiens
cgctgccgcaccccagag

SEQ ID NO: 2971474 - DNA, 20 bp, Homo sapiens
cgctgccgcaccccagagtg

SEQ ID NO: 2971475 - DNA, 20 bp, Homo sapiens
cgctgcctaagtggctgctg

SEQ ID NO: 2971476 - DNA, 12 bp, Homo sapiens
cgctgcctggcc

SEQ ID NO: 2971477 - DNA, 14 bp, Homo sapiens
cgctgcctggccag

SEQ ID NO: 2971478 - DNA, 19 bp, Homo sapiens
cgctgcggacaccgtggcc

SEQ ID NO: 2971479 - DNA, 22 bp, Homo sapiens
cgctgcggacaccgtggcctgg

SEQ ID NO: 2971480 - DNA, 22 bp, Homo sapiens
cgctggcccctttgggccctgc

SEQ ID NO: 2971481 - DNA, 18 bp, Homo sapiens
cgctggccgggaccccga

SEQ ID NO: 2971482 - DNA, 21 bp, Homo sapiens
cgctgggcacttccctgctgc

SEQ ID NO: 2971483 - DNA, 23 bp, Homo sapiens
cgctgggcacttccctgctgcct

SEQ ID NO: 2971484 - DNA, 21 bp, Homo sapiens
cgctggggaccggttcccaca

SEQ ID NO: 2971485 - DNA, 18 bp, Homo sapiens
cgctggtgaccctctgct

SEQ ID NO: 2971486 - DNA, 18 bp, Homo sapiens
cgctggttccgccaggcg

SEQ ID NO: 2971487 - DNA, 21 bp, Homo sapiens
cgctgtaccctttaagatatc

SEQ ID NO: 2971488 - DNA, 17 bp, Homo sapiens
cgctgtcctttctagag

SEQ ID NO: 2971489 - DNA, 14 bp, Homo sapiens
cgctgtgctggttc

SEQ ID NO: 2971490 - DNA, 16 bp, Homo sapiens
cgctttgaacgtgcca

SEQ ID NO: 2971491 - DNA, 21 bp, Homo sapiens
cgctttgaacgtgccagcagc

SEQ ID NO: 2971492 - DNA, 22 bp, Homo sapiens
cgctttgaacgtgccagcagcc

SEQ ID NO: 2971493 - DNA, 11 bp, Homo sapiens
cgctttggcct

SEQ ID NO: 2971494 - DNA, 17 bp, Homo sapiens
cggaaacccacagtgtt

SEQ ID NO: 2971495 - DNA, 15 bp, Homo sapiens
cggaaaccttggtgt

SEQ ID NO: 2971496 - DNA, 19 bp, Homo sapiens
cggaaactagtgtacattt

SEQ ID NO: 2971497 - DNA, 21 bp, Homo sapiens
cggaaaggtatttgggaaact

SEQ ID NO: 2971498 - DNA, 13 bp, Homo sapiens
cggaaattaaagt

SEQ ID NO: 2971499 - DNA, 15 bp, Homo sapiens
cggaacaagcctaaa

SEQ ID NO: 2971500 - DNA, 14 bp, Homo sapiens
cggaagcctgtcct

SEQ ID NO: 2971501 - DNA, 15 bp, Homo sapiens
cggaagcctgtcctc

SEQ ID NO: 2971502 - DNA, 18 bp, Homo sapiens
cggaagtacttccctcag

SEQ ID NO: 2971503 - DNA, 19 bp, Homo sapiens
cggaataaactagagaagg

SEQ ID NO: 2971504 - DNA, 20 bp, Homo sapiens
cggaataaactagagaaggg

SEQ ID NO: 2971505 - DNA, 22 bp, Homo sapiens
cggaatcctgtcgattagactg

SEQ ID NO: 2971506 - DNA, 11 bp, Homo sapiens
cggaatgaact

SEQ ID NO: 2971507 - DNA, 13 bp, Homo sapiens
cggaatttacctg

SEQ ID NO: 2971508 - DNA, 16 bp, Homo sapiens
cggacaaaagggccag

SEQ ID NO: 2971509 - DNA, 16 bp, Homo sapiens
cggacaagacccccag

SEQ ID NO: 2971510 - DNA, 12 bp, Homo sapiens
cggacaccccct

SEQ ID NO: 2971511 - DNA, 20 bp, Homo sapiens
cggacaccgtggcctgggct

SEQ ID NO: 2971512 - DNA, 16 bp, Homo sapiens
cggacacttctcagga

SEQ ID NO: 2971513 - DNA, 22 bp, Homo sapiens
cggacctgagcccgcagcccag

SEQ ID NO: 2971514 - DNA, 14 bp, Homo sapiens
cggacgcaggtgct

SEQ ID NO: 2971515 - DNA, 15 bp, Homo sapiens
cggagacctcctgac

SEQ ID NO: 2971516 - DNA, 13 bp, Homo sapiens
cggagcagccttt

SEQ ID NO: 2971517 - DNA, 11 bp, Homo sapiens
cggagccactc

SEQ ID NO: 2971518 - DNA, 13 bp, Homo sapiens
cggagccactcct

SEQ ID NO: 2971519 - DNA, 22 bp, Homo sapiens
cggagcccctgaaagcctcacg

SEQ ID NO: 2971520 - DNA, 20 bp, Homo sapiens
cggagctgcctgcagcacat

SEQ ID NO: 2971521 - DNA, 19 bp, Homo sapiens
cggagctgctgagtgacag

SEQ ID NO: 2971522 - DNA, 13 bp, Homo sapiens
cggagctggccca

SEQ ID NO: 2971523 - DNA, 14 bp, Homo sapiens
cggagctggcccag

SEQ ID NO: 2971524 - DNA, 16 bp, Homo sapiens
cggagctggcccaggg

SEQ ID NO: 2971525 - DNA, 22 bp, Homo sapiens
cggaggcatcctacccttttct

SEQ ID NO: 2971526 - DNA, 13 bp, Homo sapiens
cggaggccttggg

SEQ ID NO: 2971527 - DNA, 17 bp, Homo sapiens
cggaggctcctccctct

SEQ ID NO: 2971528 - DNA, 20 bp, Homo sapiens
cggaggctcctccctctgcc

SEQ ID NO: 2971529 - DNA, 21 bp, Homo sapiens
cggaggctcctccctctgcct

SEQ ID NO: 2971530 - DNA, 15 bp, Homo sapiens
cggatccagtttccc

SEQ ID NO: 2971531 - DNA, 12 bp, Homo sapiens
cggatgctccga

SEQ ID NO: 2971532 - DNA, 19 bp, Homo sapiens
cggatggcaggatccaagg

SEQ ID NO: 2971533 - DNA, 18 bp, Homo sapiens
cggattattatttgtact

SEQ ID NO: 2971534 - DNA, 19 bp, Homo sapiens
cggattggccctgcccctc

SEQ ID NO: 2971535 - DNA, 21 bp, Homo sapiens
cggattggccctgcccctccc

SEQ ID NO: 2971536 - DNA, 23 bp, Homo sapiens
cggattggccctgcccctccccc

SEQ ID NO: 2971537 - DNA, 22 bp, Homo sapiens
cggcactggatcccatcaaaga

SEQ ID NO: 2971538 - DNA, 16 bp, Homo sapiens
cggcagaactctctgt

SEQ ID NO: 2971539 - DNA, 22 bp, Homo sapiens
cggcagatgatgctttggaaga

SEQ ID NO: 2971540 - DNA, 16 bp, Homo sapiens
cggcagcacctctgag

SEQ ID NO: 2971541 - DNA, 22 bp, Homo sapiens
cggcaggacaacgaggaagccc

SEQ ID NO: 2971542 - DNA, 21 bp, Homo sapiens
cggcaggcgtgtggcagccac

SEQ ID NO: 2971543 - DNA, 14 bp, Homo sapiens
cggcagggccaggc

SEQ ID NO: 2971544 - DNA, 21 bp, Homo sapiens
cggcagttctgggtgctccct

SEQ ID NO: 2971545 - DNA, 19 bp, Homo sapiens
cggcatccttgcctgtcta

SEQ ID NO: 2971546 - DNA, 15 bp, Homo sapiens
cggcatgccaggacc

SEQ ID NO: 2971547 - DNA, 12 bp, Homo sapiens
cggccaagaatg

SEQ ID NO: 2971548 - DNA, 13 bp, Homo sapiens
cggccacctcacc

SEQ ID NO: 2971549 - DNA, 23 bp, Homo sapiens
cggccagaagtaacttattttgt

SEQ ID NO: 2971550 - DNA, 10 bp, Homo sapiens
cggccagcca

SEQ ID NO: 2971551 - DNA, 22 bp, Homo sapiens
cggccagcccctggccccagga

SEQ ID NO: 2971552 - DNA, 20 bp, Homo sapiens
cggccagcccgtcctcctct

SEQ ID NO: 2971553 - DNA, 22 bp, Homo sapiens
cggccagcccgtcctcctctac

SEQ ID NO: 2971554 - DNA, 16 bp, Homo sapiens
cggccagggagaagct

SEQ ID NO: 2971555 - DNA, 23 bp, Homo sapiens
cggccatgagactgatccctggc

SEQ ID NO: 2971556 - DNA, 22 bp, Homo sapiens
cggcccacacccgacaccagcc

SEQ ID NO: 2971557 - DNA, 15 bp, Homo sapiens
cggcccagacccagc

SEQ ID NO: 2971558 - DNA, 12 bp, Homo sapiens
cggcccagggcc

SEQ ID NO: 2971559 - DNA, 20 bp, Homo sapiens
cggcccatccccaggcacct

SEQ ID NO: 2971560 - DNA, 19 bp, Homo sapiens
cggcccatctgtccatcct

SEQ ID NO: 2971561 - DNA, 22 bp, Homo sapiens
cggccccagcacctcagcctgc

SEQ ID NO: 2971562 - DNA, 19 bp, Homo sapiens
cggccccgagagcaggctc

SEQ ID NO: 2971563 - DNA, 23 bp, Homo sapiens
cggcccctcaccctctgtcccca

SEQ ID NO: 2971564 - DNA, 16 bp, Homo sapiens
cggcccgcagcctggc

SEQ ID NO: 2971565 - DNA, 21 bp, Homo sapiens
cggcccgcagcctggcatctg

SEQ ID NO: 2971566 - DNA, 18 bp, Homo sapiens
cggcccggcccctcaccc

SEQ ID NO: 2971567 - DNA, 13 bp, Homo sapiens
cggccctccctgc

SEQ ID NO: 2971568 - DNA, 23 bp, Homo sapiens
cggccctcctaccctgcgcccag

SEQ ID NO: 2971569 - DNA, 15 bp, Homo sapiens
cggccctgcaggagc

SEQ ID NO: 2971570 - DNA, 18 bp, Homo sapiens
cggccctgcaggagcagg

SEQ ID NO: 2971571 - DNA, 13 bp, Homo sapiens
cggccctgcccct

SEQ ID NO: 2971572 - DNA, 15 bp, Homo sapiens
cggccctgcccctcc

SEQ ID NO: 2971573 - DNA, 17 bp, Homo sapiens
cggccctgctgaagctg

SEQ ID NO: 2971574 - DNA, 15 bp, Homo sapiens
cggccctgtcccctg

SEQ ID NO: 2971575 - DNA, 20 bp, Homo sapiens
cggccctgtcccctggagtg

SEQ ID NO: 2971576 - DNA, 15 bp, Homo sapiens
cggccctgtgtgcag

SEQ ID NO: 2971577 - DNA, 15 bp, Homo sapiens
cggccgcattccctg

SEQ ID NO: 2971578 - DNA, 16 bp, Homo sapiens
cggccgcattccctga

SEQ ID NO: 2971579 - DNA, 15 bp, Homo sapiens
cggccgctccaccag

SEQ ID NO: 2971580 - DNA, 14 bp, Homo sapiens
cggccggccagccc

SEQ ID NO: 2971581 - DNA, 23 bp, Homo sapiens
cggccggccagcccctggcccca

SEQ ID NO: 2971582 - DNA, 14 bp, Homo sapiens
cggcctcccaaagt

SEQ ID NO: 2971583 - DNA, 14 bp, Homo sapiens
cggcctccccgagg

SEQ ID NO: 2971584 - DNA, 12 bp, Homo sapiens
cggcctgagaaa

SEQ ID NO: 2971585 - DNA, 15 bp, Homo sapiens
cggcctgagaaacac

SEQ ID NO: 2971586 - DNA, 12 bp, Homo sapiens
cggcctgtcctc

SEQ ID NO: 2971587 - DNA, 18 bp, Homo sapiens
cggcctgtgcgttccctt

SEQ ID NO: 2971588 - DNA, 21 bp, Homo sapiens
cggcctgtgcgttcccttcag

SEQ ID NO: 2971589 - DNA, 22 bp, Homo sapiens
cggcctgtgcgttcccttcagt

SEQ ID NO: 2971590 - DNA, 15 bp, Homo sapiens
cggcgcctgccctgc

SEQ ID NO: 2971591 - DNA, 18 bp, Homo sapiens
cggcgcctgccctgccca

SEQ ID NO: 2971592 - DNA, 13 bp, Homo sapiens
cggcgcggtggct

SEQ ID NO: 2971593 - DNA, 20 bp, Homo sapiens
cggcgcggtggctcacgcct

SEQ ID NO: 2971594 - DNA, 13 bp, Homo sapiens
cggcggagctggc

SEQ ID NO: 2971595 - DNA, 21 bp, Homo sapiens
cggcgtggagactggcaggcg

SEQ ID NO: 2971596 - DNA, 12 bp, Homo sapiens
cggctccaactc

SEQ ID NO: 2971597 - DNA, 13 bp, Homo sapiens
cggctccagctca

SEQ ID NO: 2971598 - DNA, 15 bp, Homo sapiens
cggctcggcccagca

SEQ ID NO: 2971599 - DNA, 14 bp, Homo sapiens
cggctctgcccacc

SEQ ID NO: 2971600 - DNA, 11 bp, Homo sapiens
cggctctggag

SEQ ID NO: 2971601 - DNA, 15 bp, Homo sapiens
cggctgaccctgtgc

SEQ ID NO: 2971602 - DNA, 16 bp, Homo sapiens
cggctgaccctgtgcc

SEQ ID NO: 2971603 - DNA, 16 bp, Homo sapiens
cggctgccgactcccc

SEQ ID NO: 2971604 - DNA, 19 bp, Homo sapiens
cggctgctcgcccaggaag

SEQ ID NO: 2971605 - DNA, 13 bp, Homo sapiens
cggctggctctgt

SEQ ID NO: 2971606 - DNA, 17 bp, Homo sapiens
cggctggctctgtggag

SEQ ID NO: 2971607 - DNA, 19 bp, Homo sapiens
cggctggctctgtggaggg

SEQ ID NO: 2971608 - DNA, 20 bp, Homo sapiens
cggctggctctgtggagggg

SEQ ID NO: 2971609 - DNA, 17 bp, Homo sapiens
cggctgggcacacgcct

SEQ ID NO: 2971610 - DNA, 23 bp, Homo sapiens
cggctggtcactctgccctctgc

SEQ ID NO: 2971611 - DNA, 16 bp, Homo sapiens
cggctgtgacgcagcc

SEQ ID NO: 2971612 - DNA, 14 bp, Homo sapiens
cggctgtgctcaga

SEQ ID NO: 2971613 - DNA, 22 bp, Homo sapiens
cggctttcagggcagcccctgc

SEQ ID NO: 2971614 - DNA, 21 bp, Homo sapiens
cgggaagcatcctccccacca

SEQ ID NO: 2971615 - DNA, 22 bp, Homo sapiens
cgggaagcatcctccccaccag

SEQ ID NO: 2971616 - DNA, 23 bp, Homo sapiens
cgggaagcatcttccagaagtgt

SEQ ID NO: 2971617 - DNA, 12 bp, Homo sapiens
cgggaaggatgg

SEQ ID NO: 2971618 - DNA, 13 bp, Homo sapiens
cgggaagggaggg

SEQ ID NO: 2971619 - DNA, 23 bp, Homo sapiens
ctaccttccccagacttgcactg

SEQ ID NO: 2971620 - DNA, 13 bp, Homo sapiens
ctaccttgcctcc

SEQ ID NO: 2971621 - DNA, 14 bp, Homo sapiens
ctaccttgcctcct

SEQ ID NO: 2971622 - DNA, 20 bp, Homo sapiens
ctaccttgctagctagccag

SEQ ID NO: 2971623 - DNA, 16 bp, Homo sapiens
ctacctttcaaagctt

SEQ ID NO: 2971624 - DNA, 21 bp, Homo sapiens
ctacgctctcctttctttcta

SEQ ID NO: 2971625 - DNA, 14 bp, Homo sapiens
ctacggaccaggta

SEQ ID NO: 2971626 - DNA, 22 bp, Homo sapiens
ctacgtttgcaccgcctgccct

SEQ ID NO: 2971627 - DNA, 14 bp, Homo sapiens
ctactaaaattcaa

SEQ ID NO: 2971628 - DNA, 20 bp, Homo sapiens
ctactaaaattcaaaaacaa

SEQ ID NO: 2971629 - DNA, 20 bp, Homo sapiens
ctactaaggctttcctacct

SEQ ID NO: 2971630 - DNA, 17 bp, Homo sapiens
ctactaagttattttat

SEQ ID NO: 2971631 - DNA, 17 bp, Homo sapiens
ctactaattccacacct

SEQ ID NO: 2971632 - DNA, 18 bp, Homo sapiens
ctactagctctttgagat

SEQ ID NO: 2971633 - DNA, 13 bp, Homo sapiens
ctactatttttct

SEQ ID NO: 2971634 - DNA, 19 bp, Homo sapiens
ctactatttttctttccaa

SEQ ID NO: 2971635 - DNA, 22 bp, Homo sapiens
ctactcagaaatggacaaagaa

SEQ ID NO: 2971636 - DNA, 21 bp, Homo sapiens
ctactcagcagccctcctcac

SEQ ID NO: 2971637 - DNA, 15 bp, Homo sapiens
ctactcagcatttga

SEQ ID NO: 2971638 - DNA, 15 bp, Homo sapiens
ctactcaggaggctg

SEQ ID NO: 2971639 - DNA, 16 bp, Homo sapiens
ctactcaggaggctga

SEQ ID NO: 2971640 - DNA, 20 bp, Homo sapiens
ctactcaggaggctgagaca

SEQ ID NO: 2971641 - DNA, 23 bp, Homo sapiens
ctactcaggaggctgaggcagaa

SEQ ID NO: 2971642 - DNA, 19 bp, Homo sapiens
ctactcgagcccacccagc

SEQ ID NO: 2971643 - DNA, 21 bp, Homo sapiens
ctactcgagcccacccagcat

SEQ ID NO: 2971644 - DNA, 20 bp, Homo sapiens
ctactcgcttgctagaagta

SEQ ID NO: 2971645 - DNA, 19 bp, Homo sapiens
ctactctccccacgagggc

SEQ ID NO: 2971646 - DNA, 20 bp, Homo sapiens
ctactctgagacaaaagaaa

SEQ ID NO: 2971647 - DNA, 22 bp, Homo sapiens
ctactctgttccttcacatcct

SEQ ID NO: 2971648 - DNA, 18 bp, Homo sapiens
ctactcttaagccatctt

SEQ ID NO: 2971649 - DNA, 13 bp, Homo sapiens
ctactcttaatga

SEQ ID NO: 2971650 - DNA, 15 bp, Homo sapiens
ctactgaaccagcca

SEQ ID NO: 2971651 - DNA, 19 bp, Homo sapiens
ctactgcccctctccgaaa

SEQ ID NO: 2971652 - DNA, 17 bp, Homo sapiens
ctactggcatagtttca

SEQ ID NO: 2971653 - DNA, 15 bp, Homo sapiens
ctactgggagcctac

SEQ ID NO: 2971654 - DNA, 20 bp, Homo sapiens
ctactggtttgtatgatgta

SEQ ID NO: 2971655 - DNA, 15 bp, Homo sapiens
ctactgtactattta

SEQ ID NO: 2971656 - DNA, 20 bp, Homo sapiens
ctactgtagaactgatttta

SEQ ID NO: 2971657 - DNA, 19 bp, Homo sapiens
ctactgtattcccacaagg

SEQ ID NO: 2971658 - DNA, 15 bp, Homo sapiens
ctactgtgtgtgtga

SEQ ID NO: 2971659 - DNA, 19 bp, Homo sapiens
ctactgtgtgtgtgaatga

SEQ ID NO: 2971660 - DNA, 15 bp, Homo sapiens
ctactgttctaaagc

SEQ ID NO: 2971661 - DNA, 18 bp, Homo sapiens
ctacttagatatttcatg

SEQ ID NO: 2971662 - DNA, 14 bp, Homo sapiens
ctacttagctggcc

SEQ ID NO: 2971663 - DNA, 17 bp, Homo sapiens
ctacttcattttcagag

SEQ ID NO: 2971664 - DNA, 23 bp, Homo sapiens
ctacttcattttcagagtgacac

SEQ ID NO: 2971665 - DNA, 16 bp, Homo sapiens
ctacttcccactgtat

SEQ ID NO: 2971666 - DNA, 16 bp, Homo sapiens
ctacttctctgagtca

SEQ ID NO: 2971667 - DNA, 15 bp, Homo sapiens
ctacttctgtgtctg

SEQ ID NO: 2971668 - DNA, 20 bp, Homo sapiens
ctacttctgtgtctgtcacc

SEQ ID NO: 2971669 - DNA, 21 bp, Homo sapiens
ctacttctgtgtctgtcacca

SEQ ID NO: 2971670 - DNA, 16 bp, Homo sapiens
ctacttgggagcctga

SEQ ID NO: 2971671 - DNA, 12 bp, Homo sapiens
ctactttctctt

SEQ ID NO: 2971672 - DNA, 13 bp, Homo sapiens
ctactttctcttg

SEQ ID NO: 2971673 - DNA, 15 bp, Homo sapiens
ctactttctcttgtt

SEQ ID NO: 2971674 - DNA, 20 bp, Homo sapiens
ctactttctcttgtttaaaa

SEQ ID NO: 2971675 - DNA, 17 bp, Homo sapiens
ctactttgatatgactg

SEQ ID NO: 2971676 - DNA, 22 bp, Homo sapiens
ctacttttacttgttcatttct

SEQ ID NO: 2971677 - DNA, 14 bp, Homo sapiens
ctagaaaaaacata

SEQ ID NO: 2971678 - DNA, 16 bp, Homo sapiens
ctagaaaagcttccta

SEQ ID NO: 2971679 - DNA, 17 bp, Homo sapiens
ctagaaaagcttcctag

SEQ ID NO: 2971680 - DNA, 14 bp, Homo sapiens
ctagaaacttccaa

SEQ ID NO: 2971681 - DNA, 21 bp, Homo sapiens
ctagaaagcatccattaatta

SEQ ID NO: 2971682 - DNA, 17 bp, Homo sapiens
ctagaaatctgtcctgt

SEQ ID NO: 2971683 - DNA, 20 bp, Homo sapiens
ctagaaatgtagcagcagcc

SEQ ID NO: 2971684 - DNA, 16 bp, Homo sapiens
ctagaaattgggcagt

SEQ ID NO: 2971685 - DNA, 17 bp, Homo sapiens
ctagaagataacatttt

SEQ ID NO: 2971686 - DNA, 23 bp, Homo sapiens
ctagaagtaagaagaggagcctc

SEQ ID NO: 2971687 - DNA, 20 bp, Homo sapiens
ctagaagtgggccaggacag

SEQ ID NO: 2971688 - DNA, 13 bp, Homo sapiens
ctagaatcacagc

SEQ ID NO: 2971689 - DNA, 14 bp, Homo sapiens
ctagacaaaatcaa

SEQ ID NO: 2971690 - DNA, 13 bp, Homo sapiens
ctagacaagccag

SEQ ID NO: 2971691 - DNA, 14 bp, Homo sapiens
ctagacaagccaga

SEQ ID NO: 2971692 - DNA, 16 bp, Homo sapiens
ctagacaagccagaac

SEQ ID NO: 2971693 - DNA, 20 bp, Homo sapiens
ctagacaatgccaccagaga

SEQ ID NO: 2971694 - DNA, 15 bp, Homo sapiens
ctagacaccaaagtt

SEQ ID NO: 2971695 - DNA, 17 bp, Homo sapiens
ctagacaccaaagttct

SEQ ID NO: 2971696 - DNA, 19 bp, Homo sapiens
ctagacaccaaagttctaa

SEQ ID NO: 2971697 - DNA, 16 bp, Homo sapiens
ctagacaccttctgtg

SEQ ID NO: 2971698 - DNA, 19 bp, Homo sapiens
ctagacatggaggttctaa

SEQ ID NO: 2971699 - DNA, 20 bp, Homo sapiens
ctagacatggaggttctaag

SEQ ID NO: 2971700 - DNA, 23 bp, Homo sapiens
ctagacatggaggttctaaggcc

SEQ ID NO: 2971701 - DNA, 14 bp, Homo sapiens
ctagactggcctag

SEQ ID NO: 2971702 - DNA, 15 bp, Homo sapiens
ctagactggcctagg

SEQ ID NO: 2971703 - DNA, 22 bp, Homo sapiens
ctagactttaggctttcagctt

SEQ ID NO: 2971704 - DNA, 21 bp, Homo sapiens
ctagagaagggagacattgtt

SEQ ID NO: 2971705 - DNA, 16 bp, Homo sapiens
ctagagacgcaccttg

SEQ ID NO: 2971706 - DNA, 19 bp, Homo sapiens
ctagagacgcaccttgctg

SEQ ID NO: 2971707 - DNA, 23 bp, Homo sapiens
ctagagacgcaccttgctgcagt

SEQ ID NO: 2971708 - DNA, 20 bp, Homo sapiens
ctagagagaaaaagaaagaa

SEQ ID NO: 2971709 - DNA, 13 bp, Homo sapiens
ctagagagggagg

SEQ ID NO: 2971710 - DNA, 21 bp, Homo sapiens
ctagagatgtgcaattgattt

SEQ ID NO: 2971711 - DNA, 14 bp, Homo sapiens
ctagagcagacagg

SEQ ID NO: 2971712 - DNA, 16 bp, Homo sapiens
ctagagcatgctgcct

SEQ ID NO: 2971713 - DNA, 17 bp, Homo sapiens
ctagagcatgctgcctg

SEQ ID NO: 2971714 - DNA, 15 bp, Homo sapiens
ctagagcttctgtat

SEQ ID NO: 2971715 - DNA, 17 bp, Homo sapiens
ctagagcttctgtattt

SEQ ID NO: 2971716 - DNA, 19 bp, Homo sapiens
ctagagcttctgtattttc

SEQ ID NO: 2971717 - DNA, 14 bp, Homo sapiens
ctagaggagacagc

SEQ ID NO: 2971718 - DNA, 18 bp, Homo sapiens
ctagagggacctctccca

SEQ ID NO: 2971719 - DNA, 15 bp, Homo sapiens
ctagagtccaaggtt

SEQ ID NO: 2971720 - DNA, 17 bp, Homo sapiens
ctagagtttatacagtg

SEQ ID NO: 2971721 - DNA, 18 bp, Homo sapiens
ctagagtttatacagtgt

SEQ ID NO: 2971722 - DNA, 16 bp, Homo sapiens
ctagagttttatcaac

SEQ ID NO: 2971723 - DNA, 20 bp, Homo sapiens
ctagatcagatgctccaaga

SEQ ID NO: 2971724 - DNA, 17 bp, Homo sapiens
ctagatcataaggcttc

SEQ ID NO: 2971725 - DNA, 16 bp, Homo sapiens
ctagatcctaagggtc

SEQ ID NO: 2971726 - DNA, 17 bp, Homo sapiens
ctagatcctaagggtcg

SEQ ID NO: 2971727 - DNA, 12 bp, Homo sapiens
ctagatgacctc

SEQ ID NO: 2971728 - DNA, 20 bp, Homo sapiens
ctagatgattaaataagatt

SEQ ID NO: 2971729 - DNA, 23 bp, Homo sapiens
ctagatgattaaataagattcta

SEQ ID NO: 2971730 - DNA, 14 bp, Homo sapiens
ctagatggctcctc

SEQ ID NO: 2971731 - DNA, 22 bp, Homo sapiens
ctagatgtttattcttctagag

SEQ ID NO: 2971732 - DNA, 13 bp, Homo sapiens
ctagattaaaata

SEQ ID NO: 2971733 - DNA, 15 bp, Homo sapiens
ctagattatatcaaa

SEQ ID NO: 2971734 - DNA, 16 bp, Homo sapiens
ctagattatatcaaag

SEQ ID NO: 2971735 - DNA, 17 bp, Homo sapiens
ctagattcaaaggttct

SEQ ID NO: 2971736 - DNA, 20 bp, Homo sapiens
ctagattcaaaggttctagg

SEQ ID NO: 2971737 - DNA, 21 bp, Homo sapiens
ctagattcaaaggttctaggt

SEQ ID NO: 2971738 - DNA, 16 bp, Homo sapiens
ctagattctaacatat

SEQ ID NO: 2971739 - DNA, 22 bp, Homo sapiens
ctagattctaacatattgccat

SEQ ID NO: 2971740 - DNA, 17 bp, Homo sapiens
ctagcaaaaaaactctt

SEQ ID NO: 2971741 - DNA, 13 bp, Homo sapiens
ctagcaaaatgct

SEQ ID NO: 2971742 - DNA, 15 bp, Homo sapiens
ctagcaaattagaaa

SEQ ID NO: 2971743 - DNA, 20 bp, Homo sapiens
ctagcacatgcttcaatagt

SEQ ID NO: 2971744 - DNA, 18 bp, Homo sapiens
ctagcacggacatggtct

SEQ ID NO: 2971745 - DNA, 19 bp, Homo sapiens
ctagcagcaccgttctgtg

SEQ ID NO: 2971746 - DNA, 20 bp, Homo sapiens
ctagcagcccaccctgctgc

SEQ ID NO: 2971747 - DNA, 13 bp, Homo sapiens
ctagcatgccaac

SEQ ID NO: 2971748 - DNA, 16 bp, Homo sapiens
ctagccaacatggtga

SEQ ID NO: 2971749 - DNA, 20 bp, Homo sapiens
ctagccagcacttgtatata

SEQ ID NO: 2971750 - DNA, 17 bp, Homo sapiens
ctagcccagtgcttctc

SEQ ID NO: 2971751 - DNA, 23 bp, Homo sapiens
ctcaagaaataaaaggaagccaa

SEQ ID NO: 2971752 - DNA, 16 bp, Homo sapiens
ctcaagaggaatgaaa

SEQ ID NO: 2971753 - DNA, 14 bp, Homo sapiens
ctcaagcagcaaaa

SEQ ID NO: 2971754 - DNA, 13 bp, Homo sapiens
ctcaagcaggttt

SEQ ID NO: 2971755 - DNA, 23 bp, Homo sapiens
ctcaaggcggtgcttgatagaaa

SEQ ID NO: 2971756 - DNA, 17 bp, Homo sapiens
ctcaagggacaaggaca

SEQ ID NO: 2971757 - DNA, 20 bp, Homo sapiens
ctcaagggacaaggacacgc

SEQ ID NO: 2971758 - DNA, 14 bp, Homo sapiens
ctcaagggcatgag

SEQ ID NO: 2971759 - DNA, 14 bp, Homo sapiens
ctcaagggtggcag

SEQ ID NO: 2971760 - DNA, 23 bp, Homo sapiens
ctcaagggtggcaggtcactgtc

SEQ ID NO: 2971761 - DNA, 20 bp, Homo sapiens
ctcaaggttttaggttctaa

SEQ ID NO: 2971762 - DNA, 19 bp, Homo sapiens
ctcaagtatcttctatttt

SEQ ID NO: 2971763 - DNA, 18 bp, Homo sapiens
ctcaagtgatcctcccac

SEQ ID NO: 2971764 - DNA, 23 bp, Homo sapiens
ctcaagtgatctgtccacctcgg

SEQ ID NO: 2971765 - DNA, 17 bp, Homo sapiens
ctcaagttccagtgcag

SEQ ID NO: 2971766 - DNA, 13 bp, Homo sapiens
ctcaagttctaag

SEQ ID NO: 2971767 - DNA, 14 bp, Homo sapiens
ctcaagttctaaga

SEQ ID NO: 2971768 - DNA, 15 bp, Homo sapiens
ctcaagttctaagat

SEQ ID NO: 2971769 - DNA, 18 bp, Homo sapiens
ctcaagttctaagattct

SEQ ID NO: 2971770 - DNA, 19 bp, Homo sapiens
ctcaagttctaagattcta

SEQ ID NO: 2971771 - DNA, 14 bp, Homo sapiens
ctcaagttgaaaga

SEQ ID NO: 2971772 - DNA, 23 bp, Homo sapiens
ctcaatacagcctgaataaacca

SEQ ID NO: 2971773 - DNA, 17 bp, Homo sapiens
ctcaatactctctgagt

SEQ ID NO: 2971774 - DNA, 19 bp, Homo sapiens
ctcaatagctccaagctgt

SEQ ID NO: 2971775 - DNA, 23 bp, Homo sapiens
ctcaatagctccaagctgttaaa

SEQ ID NO: 2971776 - DNA, 21 bp, Homo sapiens
ctcaataggaccaggatccag

SEQ ID NO: 2971777 - DNA, 17 bp, Homo sapiens
ctcaatcctgcagtggg

SEQ ID NO: 2971778 - DNA, 13 bp, Homo sapiens
ctcaatgaaaaat

SEQ ID NO: 2971779 - DNA, 12 bp, Homo sapiens
ctcaatgggaga

SEQ ID NO: 2971780 - DNA, 13 bp, Homo sapiens
ctcaatgggagaa

SEQ ID NO: 2971781 - DNA, 20 bp, Homo sapiens
ctcaatgtgaatcagaccct

SEQ ID NO: 2971782 - DNA, 15 bp, Homo sapiens
ctcaatttatttggg

SEQ ID NO: 2971783 - DNA, 12 bp, Homo sapiens
ctcaatttcagc

SEQ ID NO: 2971784 - DNA, 13 bp, Homo sapiens
ctcaatttcagca

SEQ ID NO: 2971785 - DNA, 13 bp, Homo sapiens
ctcaattttgtat

SEQ ID NO: 2971786 - DNA, 19 bp, Homo sapiens
ctcaattttgtatttaatg

SEQ ID NO: 2971787 - DNA, 16 bp, Homo sapiens
ctcacaaagtgctggg

SEQ ID NO: 2971788 - DNA, 17 bp, Homo sapiens
ctcacaacctgaaccta

SEQ ID NO: 2971789 - DNA, 22 bp, Homo sapiens
ctcacaccctaccttccccaga

SEQ ID NO: 2971790 - DNA, 12 bp, Homo sapiens
ctcacactcctc

SEQ ID NO: 2971791 - DNA, 16 bp, Homo sapiens
ctcacactcctcctgc

SEQ ID NO: 2971792 - DNA, 17 bp, Homo sapiens
ctcacactcctcctgcc

SEQ ID NO: 2971793 - DNA, 18 bp, Homo sapiens
ctcacactcctcctgcca

SEQ ID NO: 2971794 - DNA, 22 bp, Homo sapiens
ctcacacttactgtaagacatt

SEQ ID NO: 2971795 - DNA, 19 bp, Homo sapiens
ctcacagactcttccacca

SEQ ID NO: 2971796 - DNA, 14 bp, Homo sapiens
ctcacagatgctgg

SEQ ID NO: 2971797 - DNA, 15 bp, Homo sapiens
ctcacagatgctggc

SEQ ID NO: 2971798 - DNA, 16 bp, Homo sapiens
ctcacagatgctggcc

SEQ ID NO: 2971799 - DNA, 18 bp, Homo sapiens
ctcacagatgctggcctc

SEQ ID NO: 2971800 - DNA, 21 bp, Homo sapiens
ctcacagatgctggcctcttg

SEQ ID NO: 2971801 - DNA, 14 bp, Homo sapiens
ctcacagcacagag

SEQ ID NO: 2971802 - DNA, 17 bp, Homo sapiens
ctcacagtggggccagc

SEQ ID NO: 2971803 - DNA, 19 bp, Homo sapiens
ctcacagttcctcgccctg

SEQ ID NO: 2971804 - DNA, 22 bp, Homo sapiens
ctcacagttcctcgccctgggt

SEQ ID NO: 2971805 - DNA, 21 bp, Homo sapiens
ctcacatggtgctacgcctgc

SEQ ID NO: 2971806 - DNA, 20 bp, Homo sapiens
ctcaccacccccactggtga

SEQ ID NO: 2971807 - DNA, 12 bp, Homo sapiens
ctcaccagctgc

SEQ ID NO: 2971808 - DNA, 17 bp, Homo sapiens
ctcaccagctgcaaagt

SEQ ID NO: 2971809 - DNA, 20 bp, Homo sapiens
ctcaccagctgcaaagtgtt

SEQ ID NO: 2971810 - DNA, 17 bp, Homo sapiens
ctcaccatatttgaatt

SEQ ID NO: 2971811 - DNA, 18 bp, Homo sapiens
ctcaccatatttgaattg

SEQ ID NO: 2971812 - DNA, 22 bp, Homo sapiens
ctcacccatgcaagcagaggac

SEQ ID NO: 2971813 - DNA, 15 bp, Homo sapiens
ctcacccccttctcc

SEQ ID NO: 2971814 - DNA, 17 bp, Homo sapiens
ctcaccccgaggccctg

SEQ ID NO: 2971815 - DNA, 20 bp, Homo sapiens
ctcaccccgaggccctgcat

SEQ ID NO: 2971816 - DNA, 18 bp, Homo sapiens
ctcacccttcctggccca

SEQ ID NO: 2971817 - DNA, 21 bp, Homo sapiens
ctcacccttcctggcccaggc

SEQ ID NO: 2971818 - DNA, 15 bp, Homo sapiens
ctcacctagcctgat

SEQ ID NO: 2971819 - DNA, 16 bp, Homo sapiens
ctcacctctgcctcaa

SEQ ID NO: 2971820 - DNA, 12 bp, Homo sapiens
ctcacctgacct

SEQ ID NO: 2971821 - DNA, 21 bp, Homo sapiens
ctcacctggggtgtgggaggc

SEQ ID NO: 2971822 - DNA, 13 bp, Homo sapiens
ctcacctggtcct

SEQ ID NO: 2971823 - DNA, 13 bp, Homo sapiens
ctcacctggttga

SEQ ID NO: 2971824 - DNA, 13 bp, Homo sapiens
ctcacctgttgct

SEQ ID NO: 2971825 - DNA, 15 bp, Homo sapiens
ctcacgccacccccg

SEQ ID NO: 2971826 - DNA, 20 bp, Homo sapiens
ctcacgccccgctgtgtcct

SEQ ID NO: 2971827 - DNA, 21 bp, Homo sapiens
ctcacgcctgtaatcccagca

SEQ ID NO: 2971828 - DNA, 22 bp, Homo sapiens
ctcacgcctgtaatcccagcac

SEQ ID NO: 2971829 - DNA, 23 bp, Homo sapiens
ctcacgcctgtaatcccagcact

SEQ ID NO: 2971830 - DNA, 14 bp, Homo sapiens
ctcacgccttggcc

SEQ ID NO: 2971831 - DNA, 19 bp, Homo sapiens
ctcacgtatttcacagagc

SEQ ID NO: 2971832 - DNA, 20 bp, Homo sapiens
ctcacgtatttcacagagca

SEQ ID NO: 2971833 - DNA, 20 bp, Homo sapiens
ctcacgtgcaggacagctct

SEQ ID NO: 2971834 - DNA, 17 bp, Homo sapiens
ctcactatgtttctcag

SEQ ID NO: 2971835 - DNA, 21 bp, Homo sapiens
ctcactcaccccagcgagctc

SEQ ID NO: 2971836 - DNA, 17 bp, Homo sapiens
ctcactccctaggccca

SEQ ID NO: 2971837 - DNA, 13 bp, Homo sapiens
ctcactcttcctc

SEQ ID NO: 2971838 - DNA, 19 bp, Homo sapiens
ctcactcttcctcatcctg

SEQ ID NO: 2971839 - DNA, 19 bp, Homo sapiens
ctcactcttgaagtccagg

SEQ ID NO: 2971840 - DNA, 22 bp, Homo sapiens
ctcactcttgaagtccaggact

SEQ ID NO: 2971841 - DNA, 24 bp, Homo sapiens
ctcactcttgaagtccaggactgg

SEQ ID NO: 2971842 - DNA, 21 bp, Homo sapiens
ctcactgaaaacatctggaag

SEQ ID NO: 2971843 - DNA, 16 bp, Homo sapiens
ctcactgcagcctcaa

SEQ ID NO: 2971844 - DNA, 20 bp, Homo sapiens
ctcactgctaagaatatttg

SEQ ID NO: 2971845 - DNA, 19 bp, Homo sapiens
ctcactggcagccccagca

SEQ ID NO: 2971846 - DNA, 16 bp, Homo sapiens
ctcactggggcctaca

SEQ ID NO: 2971847 - DNA, 18 bp, Homo sapiens
ctcactgttgcagtggcc

SEQ ID NO: 2971848 - DNA, 21 bp, Homo sapiens
ctcactgtttgtttttattta

SEQ ID NO: 2971849 - DNA, 16 bp, Homo sapiens
ctcacttatctgatac

SEQ ID NO: 2971850 - DNA, 24 bp, Homo sapiens
ctcacttctagatctcagccattc

SEQ ID NO: 2971851 - DNA, 23 bp, Homo sapiens
ctcacttgatgtttcctggaagc

SEQ ID NO: 2971852 - DNA, 18 bp, Homo sapiens
ctcacttggtctgccagg

SEQ ID NO: 2971853 - DNA, 13 bp, Homo sapiens
ctcactttaaacc

SEQ ID NO: 2971854 - DNA, 20 bp, Homo sapiens
ctcactttcctcctgaggct

SEQ ID NO: 2971855 - DNA, 14 bp, Homo sapiens
ctcacttttcactt

SEQ ID NO: 2971856 - DNA, 15 bp, Homo sapiens
ctcacttttcatctg

SEQ ID NO: 2971857 - DNA, 20 bp, Homo sapiens
ctcagaaagaagtcagttaa

SEQ ID NO: 2971858 - DNA, 14 bp, Homo sapiens
ctcagaacccttgg

SEQ ID NO: 2971859 - DNA, 21 bp, Homo sapiens
ctcagaacccttggcttgccc

SEQ ID NO: 2971860 - DNA, 22 bp, Homo sapiens
ctcagaactgtcggaggaaaga

SEQ ID NO: 2971861 - DNA, 17 bp, Homo sapiens
ctcagaagaaaacaaag

SEQ ID NO: 2971862 - DNA, 13 bp, Homo sapiens
ctcagaagagcag

SEQ ID NO: 2971863 - DNA, 17 bp, Homo sapiens
ctcagaagcctcgactg

SEQ ID NO: 2971864 - DNA, 12 bp, Homo sapiens
ctcagaaggctt

SEQ ID NO: 2971865 - DNA, 14 bp, Homo sapiens
ctcagaatatattc

SEQ ID NO: 2971866 - DNA, 17 bp, Homo sapiens
ctcagaatgggggcttt

SEQ ID NO: 2971867 - DNA, 22 bp, Homo sapiens
ctcagacagccccctgccccgc

SEQ ID NO: 2971868 - DNA, 14 bp, Homo sapiens
ctcagacccccact

SEQ ID NO: 2971869 - DNA, 15 bp, Homo sapiens
ctcagacccccactc

SEQ ID NO: 2971870 - DNA, 14 bp, Homo sapiens
ctcagactccattt

SEQ ID NO: 2971871 - DNA, 16 bp, Homo sapiens
ctcagactgcacccag

SEQ ID NO: 2971872 - DNA, 17 bp, Homo sapiens
ctcagactgcacccagg

SEQ ID NO: 2971873 - DNA, 20 bp, Homo sapiens
ctcagactgcacccaggagg

SEQ ID NO: 2971874 - DNA, 21 bp, Homo sapiens
ctcagactgcacccaggaggg

SEQ ID NO: 2971875 - DNA, 13 bp, Homo sapiens
ctcagactggtct

SEQ ID NO: 2971876 - DNA, 23 bp, Homo sapiens
ctcagagaaaagagattgagatg

SEQ ID NO: 2971877 - DNA, 17 bp, Homo sapiens
ctcagagaaggaaaaga

SEQ ID NO: 2971878 - DNA, 20 bp, Homo sapiens
ctcagagaaggaaaagactg

SEQ ID NO: 2971879 - DNA, 14 bp, Homo sapiens
ctcagagagtacac

SEQ ID NO: 2971880 - DNA, 20 bp, Homo sapiens
ctcagagagtacactgtgtc

SEQ ID NO: 2971881 - DNA, 21 bp, Homo sapiens
ctcagagagtacactgtgtct

SEQ ID NO: 2971882 - DNA, 15 bp, Homo sapiens
ctcagagccaagggg

SEQ ID NO: 2971883 - DNA, 13 bp, Homo sapiens
ctcctagagggag

SEQ ID NO: 2971884 - DNA, 19 bp, Homo sapiens
ctcctaggggcttggtcct

SEQ ID NO: 2971885 - DNA, 17 bp, Homo sapiens
ctcctagtttgggagga

SEQ ID NO: 2971886 - DNA, 17 bp, Homo sapiens
ctcctatatatttctat

SEQ ID NO: 2971887 - DNA, 15 bp, Homo sapiens
ctcctatcttttatt

SEQ ID NO: 2971888 - DNA, 19 bp, Homo sapiens
ctcctatcttttatttcat

SEQ ID NO: 2971889 - DNA, 15 bp, Homo sapiens
ctcctcacactccag

SEQ ID NO: 2971890 - DNA, 18 bp, Homo sapiens
ctcctcacactccagaat

SEQ ID NO: 2971891 - DNA, 20 bp, Homo sapiens
ctcctcacccaccctgtggc

SEQ ID NO: 2971892 - DNA, 16 bp, Homo sapiens
ctcctcagctttgctt

SEQ ID NO: 2971893 - DNA, 18 bp, Homo sapiens
ctcctcaggcacacagct

SEQ ID NO: 2971894 - DNA, 19 bp, Homo sapiens
ctcctcaggcacacagcta

SEQ ID NO: 2971895 - DNA, 13 bp, Homo sapiens
ctcctcatctgcc

SEQ ID NO: 2971896 - DNA, 18 bp, Homo sapiens
ctcctccaaaggaagtct

SEQ ID NO: 2971897 - DNA, 16 bp, Homo sapiens
ctcctccaccaccgcc

SEQ ID NO: 2971898 - DNA, 22 bp, Homo sapiens
ctcctcccccctcctctgaaac

SEQ ID NO: 2971899 - DNA, 23 bp, Homo sapiens
ctcctccccgctccgtctctgtc

SEQ ID NO: 2971900 - DNA, 12 bp, Homo sapiens
ctcctccctcct

SEQ ID NO: 2971901 - DNA, 14 bp, Homo sapiens
ctcctccctctgcc

SEQ ID NO: 2971902 - DNA, 13 bp, Homo sapiens
ctcctccctgcat

SEQ ID NO: 2971903 - DNA, 18 bp, Homo sapiens
ctcctccctgcatctgac

SEQ ID NO: 2971904 - DNA, 18 bp, Homo sapiens
ctcctccctggctgcagc

SEQ ID NO: 2971905 - DNA, 21 bp, Homo sapiens
ctcctccctggctgcagcctc

SEQ ID NO: 2971906 - DNA, 13 bp, Homo sapiens
ctcctccgtggca

SEQ ID NO: 2971907 - DNA, 15 bp, Homo sapiens
ctcctccgtggcaca

SEQ ID NO: 2971908 - DNA, 15 bp, Homo sapiens
ctcctcctgccagct

SEQ ID NO: 2971909 - DNA, 16 bp, Homo sapiens
ctcctcctgccagctc

SEQ ID NO: 2971910 - DNA, 18 bp, Homo sapiens
ctcctcctgccagctctg

SEQ ID NO: 2971911 - DNA, 17 bp, Homo sapiens
ctcctcgacatcactgt

SEQ ID NO: 2971912 - DNA, 24 bp, Homo sapiens
ctcctcgagatcccaacactgcca

SEQ ID NO: 2971913 - DNA, 17 bp, Homo sapiens
ctcctcgcaagctgggt

SEQ ID NO: 2971914 - DNA, 21 bp, Homo sapiens
ctcctcggacacccagggtct

SEQ ID NO: 2971915 - DNA, 22 bp, Homo sapiens
ctcctcgtcaatccatcagcaa

SEQ ID NO: 2971916 - DNA, 14 bp, Homo sapiens
ctcctctacctctc

SEQ ID NO: 2971917 - DNA, 17 bp, Homo sapiens
ctcctctcaactgcctc

SEQ ID NO: 2971918 - DNA, 13 bp, Homo sapiens
ctcctctcagctt

SEQ ID NO: 2971919 - DNA, 19 bp, Homo sapiens
ctcctctcagcttctaatt

SEQ ID NO: 2971920 - DNA, 13 bp, Homo sapiens
ctcctctccatgc

SEQ ID NO: 2971921 - DNA, 16 bp, Homo sapiens
ctcctctccatgcaag

SEQ ID NO: 2971922 - DNA, 22 bp, Homo sapiens
ctcctctccatgcaagtgctgt

SEQ ID NO: 2971923 - DNA, 20 bp, Homo sapiens
ctcctctccccagcccagag

SEQ ID NO: 2971924 - DNA, 12 bp, Homo sapiens
ctcctctcccgt

SEQ ID NO: 2971925 - DNA, 14 bp, Homo sapiens
ctcctctcccgtct

SEQ ID NO: 2971926 - DNA, 20 bp, Homo sapiens
ctcctctcccgtctcgcctg

SEQ ID NO: 2971927 - DNA, 13 bp, Homo sapiens
ctcctctctccct

SEQ ID NO: 2971928 - DNA, 19 bp, Homo sapiens
ctcctctctccctgcctca

SEQ ID NO: 2971929 - DNA, 22 bp, Homo sapiens
ctcctctctccctgcctcacat

SEQ ID NO: 2971930 - DNA, 12 bp, Homo sapiens
ctcctctgaaac

SEQ ID NO: 2971931 - DNA, 14 bp, Homo sapiens
ctcctctgaaacag

SEQ ID NO: 2971932 - DNA, 20 bp, Homo sapiens
ctcctctgaaacagctgcct

SEQ ID NO: 2971933 - DNA, 11 bp, Homo sapiens
ctcctctgcca

SEQ ID NO: 2971934 - DNA, 13 bp, Homo sapiens
ctcctctgtggtg

SEQ ID NO: 2971935 - DNA, 18 bp, Homo sapiens
ctcctctgtggtgtctgc

SEQ ID NO: 2971936 - DNA, 19 bp, Homo sapiens
ctcctctgtggtgtctgcc

SEQ ID NO: 2971937 - DNA, 14 bp, Homo sapiens
ctcctcttgtaaat

SEQ ID NO: 2971938 - DNA, 15 bp, Homo sapiens
ctcctctttgaacat

SEQ ID NO: 2971939 - DNA, 20 bp, Homo sapiens
ctcctgacaacgtctcttca

SEQ ID NO: 2971940 - DNA, 14 bp, Homo sapiens
ctcctgacctcaag

SEQ ID NO: 2971941 - DNA, 20 bp, Homo sapiens
ctcctgagctaggaagagtc

SEQ ID NO: 2971942 - DNA, 17 bp, Homo sapiens
ctcctgaggctttggat

SEQ ID NO: 2971943 - DNA, 17 bp, Homo sapiens
ctcctgatgtttgtatc

SEQ ID NO: 2971944 - DNA, 15 bp, Homo sapiens
ctcctgatttgagtt

SEQ ID NO: 2971945 - DNA, 21 bp, Homo sapiens
ctcctgatttttatctagaac

SEQ ID NO: 2971946 - DNA, 14 bp, Homo sapiens
ctcctgcaaagtct

SEQ ID NO: 2971947 - DNA, 13 bp, Homo sapiens
ctcctgccacatt

SEQ ID NO: 2971948 - DNA, 19 bp, Homo sapiens
ctcctgccaccagcatcca

SEQ ID NO: 2971949 - DNA, 14 bp, Homo sapiens
ctcctgccagcccg

SEQ ID NO: 2971950 - DNA, 16 bp, Homo sapiens
ctcctgccagcccggc

SEQ ID NO: 2971951 - DNA, 14 bp, Homo sapiens
ctcctgccagctct

SEQ ID NO: 2971952 - DNA, 15 bp, Homo sapiens
ctcctgccagctctg

SEQ ID NO: 2971953 - DNA, 16 bp, Homo sapiens
ctcctgccagctctgt

SEQ ID NO: 2971954 - DNA, 14 bp, Homo sapiens
ctcctgcccacctg

SEQ ID NO: 2971955 - DNA, 12 bp, Homo sapiens
ctcctgcccagc

SEQ ID NO: 2971956 - DNA, 13 bp, Homo sapiens
ctcctgcccagcc

SEQ ID NO: 2971957 - DNA, 16 bp, Homo sapiens
ctcctgcccagccacc

SEQ ID NO: 2971958 - DNA, 12 bp, Homo sapiens
ctcctgcccagg

SEQ ID NO: 2971959 - DNA, 23 bp, Homo sapiens
ctcctgcccgcagacctctggat

SEQ ID NO: 2971960 - DNA, 13 bp, Homo sapiens
ctcctgcctactc

SEQ ID NO: 2971961 - DNA, 11 bp, Homo sapiens
ctcctgcctca

SEQ ID NO: 2971962 - DNA, 15 bp, Homo sapiens
ctcctgcctttgcct

SEQ ID NO: 2971963 - DNA, 20 bp, Homo sapiens
ctcctggaagctgtgtcctt

SEQ ID NO: 2971964 - DNA, 23 bp, Homo sapiens
ctcctggaagctgtgtccttgca

SEQ ID NO: 2971965 - DNA, 17 bp, Homo sapiens
ctcctggagcagaaagt

SEQ ID NO: 2971966 - DNA, 19 bp, Homo sapiens
ctcctggagctctgtgggt

SEQ ID NO: 2971967 - DNA, 21 bp, Homo sapiens
ctcctggagggcgcccagcag

SEQ ID NO: 2971968 - DNA, 23 bp, Homo sapiens
ctcctggagggcgcccagcagcc

SEQ ID NO: 2971969 - DNA, 12 bp, Homo sapiens
ctcctggcccag

SEQ ID NO: 2971970 - DNA, 14 bp, Homo sapiens
ctcctggcccaggt

SEQ ID NO: 2971971 - DNA, 23 bp, Homo sapiens
ctcctggcctcaagccatcttcc

SEQ ID NO: 2971972 - DNA, 16 bp, Homo sapiens
ctcctggctcaggccc

SEQ ID NO: 2971973 - DNA, 14 bp, Homo sapiens
ctcctgggccctct

SEQ ID NO: 2971974 - DNA, 20 bp, Homo sapiens
ctcctgggccctctctgctc

SEQ ID NO: 2971975 - DNA, 15 bp, Homo sapiens
ctcctgggctatatt

SEQ ID NO: 2971976 - DNA, 18 bp, Homo sapiens
ctcctgggctatattcct

SEQ ID NO: 2971977 - DNA, 14 bp, Homo sapiens
ctcctggggccagg

SEQ ID NO: 2971978 - DNA, 19 bp, Homo sapiens
ctcctgggttcaagcgatt

SEQ ID NO: 2971979 - DNA, 21 bp, Homo sapiens
ctcctgggttttgtattctct

SEQ ID NO: 2971980 - DNA, 18 bp, Homo sapiens
ctcctggtgtcaccccag

SEQ ID NO: 2971981 - DNA, 23 bp, Homo sapiens
ctcctggtgtcaccccagagcca

SEQ ID NO: 2971982 - DNA, 16 bp, Homo sapiens
ctcctgtctccctcct

SEQ ID NO: 2971983 - DNA, 18 bp, Homo sapiens
ctcctgttccgtgtgggc

SEQ ID NO: 2971984 - DNA, 14 bp, Homo sapiens
ctccttacattaaa

SEQ ID NO: 2971985 - DNA, 12 bp, Homo sapiens
ctccttcagaca

SEQ ID NO: 2971986 - DNA, 13 bp, Homo sapiens
ctccttcagacac

SEQ ID NO: 2971987 - DNA, 19 bp, Homo sapiens
ctccttcagacaccctcaa

SEQ ID NO: 2971988 - DNA, 18 bp, Homo sapiens
ctccttccaacaggagct

SEQ ID NO: 2971989 - DNA, 15 bp, Homo sapiens
ctccttccatccttg

SEQ ID NO: 2971990 - DNA, 16 bp, Homo sapiens
ctccttccatccttga

SEQ ID NO: 2971991 - DNA, 14 bp, Homo sapiens
ctccttcctcttgg

SEQ ID NO: 2971992 - DNA, 19 bp, Homo sapiens
ctccttcctcttggctgag

SEQ ID NO: 2971993 - DNA, 13 bp, Homo sapiens
ctccttcctggag

SEQ ID NO: 2971994 - DNA, 13 bp, Homo sapiens
ctccttctcttct

SEQ ID NO: 2971995 - DNA, 22 bp, Homo sapiens
ctccttctgctgtgtatcatgg

SEQ ID NO: 2971996 - DNA, 15 bp, Homo sapiens
ctccttcttccactt

SEQ ID NO: 2971997 - DNA, 17 bp, Homo sapiens
ctccttcttccacttct

SEQ ID NO: 2971998 - DNA, 17 bp, Homo sapiens
ctccttgcttgttacat

SEQ ID NO: 2971999 - DNA, 12 bp, Homo sapiens
ctccttggagga

SEQ ID NO: 2972000 - DNA, 15 bp, Homo sapiens
ctccttggaggacag

SEQ ID NO: 2972001 - DNA, 17 bp, Homo sapiens
ctccttgggaggcccca

SEQ ID NO: 2972002 - DNA, 21 bp, Homo sapiens
ctccttgggaggccccactgg

SEQ ID NO: 2972003 - DNA, 17 bp, Homo sapiens
ctccttgggcagggtct

SEQ ID NO: 2972004 - DNA, 21 bp, Homo sapiens
ctccttgggcagggtctctgc

SEQ ID NO: 2972005 - DNA, 12 bp, Homo sapiens
ctccttgggccc

SEQ ID NO: 2972006 - DNA, 13 bp, Homo sapiens
ctccttgggccct

SEQ ID NO: 2972007 - DNA, 17 bp, Homo sapiens
ctccttgggccctttga

SEQ ID NO: 2972008 - DNA, 15 bp, Homo sapiens
ctccttggtgcctgg

SEQ ID NO: 2972009 - DNA, 22 bp, Homo sapiens
ctccttggtgcctggcctggca

SEQ ID NO: 2972010 - DNA, 17 bp, Homo sapiens
ctcctttctctgtatat

SEQ ID NO: 2972011 - DNA, 14 bp, Homo sapiens
ctcctttctttcta

SEQ ID NO: 2972012 - DNA, 23 bp, Homo sapiens
ctcctttgatattatgtggcttt

SEQ ID NO: 2972013 - DNA, 22 bp, Homo sapiens
ctcctttggcatgtttaattgt

SEQ ID NO: 2972014 - DNA, 17 bp, Homo sapiens
ctcctttgtactttgtg

SEQ ID NO: 2972015 - DNA, 12 bp, Homo sapiens
ctcctttgtata

SEQ ID NO: 2972016 - DNA, 13 bp, Homo sapiens
ctcgaaagtgtca

SEQ ID NO: 2972017 - DNA, 16 bp, Homo sapiens
ctcttctgtccatcag

SEQ ID NO: 2972018 - DNA, 19 bp, Homo sapiens
ctcttctgtccatcagtgc

SEQ ID NO: 2972019 - DNA, 14 bp, Homo sapiens
ctcttcttgaaaaa

SEQ ID NO: 2972020 - DNA, 20 bp, Homo sapiens
ctcttcttggggcccagtgc

SEQ ID NO: 2972021 - DNA, 21 bp, Homo sapiens
ctcttcttggggcccagtgca

SEQ ID NO: 2972022 - DNA, 12 bp, Homo sapiens
ctcttctttaga

SEQ ID NO: 2972023 - DNA, 22 bp, Homo sapiens
ctcttctttcagacttgccatg

SEQ ID NO: 2972024 - DNA, 13 bp, Homo sapiens
ctcttctttggga

SEQ ID NO: 2972025 - DNA, 16 bp, Homo sapiens
ctcttgaactgagctt

SEQ ID NO: 2972026 - DNA, 19 bp, Homo sapiens
ctcttgaactgagcttgga

SEQ ID NO: 2972027 - DNA, 15 bp, Homo sapiens
ctcttgaagtccagg

SEQ ID NO: 2972028 - DNA, 17 bp, Homo sapiens
ctcttgaagtccaggac

SEQ ID NO: 2972029 - DNA, 15 bp, Homo sapiens
ctcttgacagtctga

SEQ ID NO: 2972030 - DNA, 14 bp, Homo sapiens
ctcttgataaagga

SEQ ID NO: 2972031 - DNA, 17 bp, Homo sapiens
ctcttgataaaggagag

SEQ ID NO: 2972032 - DNA, 21 bp, Homo sapiens
ctcttgattatccatattgag

SEQ ID NO: 2972033 - DNA, 12 bp, Homo sapiens
ctcttgcaatgc

SEQ ID NO: 2972034 - DNA, 16 bp, Homo sapiens
ctcttgctattgaatt

SEQ ID NO: 2972035 - DNA, 19 bp, Homo sapiens
ctcttggataccagctcag

SEQ ID NO: 2972036 - DNA, 20 bp, Homo sapiens
ctcttggataccagctcagg

SEQ ID NO: 2972037 - DNA, 22 bp, Homo sapiens
ctcttggataccagctcagggg

SEQ ID NO: 2972038 - DNA, 17 bp, Homo sapiens
ctcttggcacctgccta

SEQ ID NO: 2972039 - DNA, 22 bp, Homo sapiens
ctcttggcacctgcctagctct

SEQ ID NO: 2972040 - DNA, 16 bp, Homo sapiens
ctcttgggcctgacct

SEQ ID NO: 2972041 - DNA, 17 bp, Homo sapiens
ctcttgggcctgacctc

SEQ ID NO: 2972042 - DNA, 22 bp, Homo sapiens
ctcttgggcctgacctccagtc

SEQ ID NO: 2972043 - DNA, 21 bp, Homo sapiens
ctcttggggagtttagggtgg

SEQ ID NO: 2972044 - DNA, 23 bp, Homo sapiens
ctcttggggagtttagggtgggg

SEQ ID NO: 2972045 - DNA, 17 bp, Homo sapiens
ctcttggtcagcttttg

SEQ ID NO: 2972046 - DNA, 19 bp, Homo sapiens
ctcttgtaaataaagccct

SEQ ID NO: 2972047 - DNA, 13 bp, Homo sapiens
ctcttgtcacatg

SEQ ID NO: 2972048 - DNA, 16 bp, Homo sapiens
ctcttgtccctgtcgc

SEQ ID NO: 2972049 - DNA, 23 bp, Homo sapiens
ctcttgtgatgtttgctcagagg

SEQ ID NO: 2972050 - DNA, 23 bp, Homo sapiens
ctcttgtgctcagtcgccctgtt

SEQ ID NO: 2972051 - DNA, 13 bp, Homo sapiens
ctcttgtggatgt

SEQ ID NO: 2972052 - DNA, 19 bp, Homo sapiens
ctcttgtttaaaaaaagaa

SEQ ID NO: 2972053 - DNA, 20 bp, Homo sapiens
ctcttgtttaaaaaaagaaa

SEQ ID NO: 2972054 - DNA, 12 bp, Homo sapiens
ctcttgtttctg

SEQ ID NO: 2972055 - DNA, 17 bp, Homo sapiens
ctcttgtttctgtttag

SEQ ID NO: 2972056 - DNA, 13 bp, Homo sapiens
ctctttaaaaaca

SEQ ID NO: 2972057 - DNA, 11 bp, Homo sapiens
ctctttaaatc

SEQ ID NO: 2972058 - DNA, 16 bp, Homo sapiens
ctctttaatgctgtct

SEQ ID NO: 2972059 - DNA, 18 bp, Homo sapiens
ctctttaatgctgtcttt

SEQ ID NO: 2972060 - DNA, 20 bp, Homo sapiens
ctctttaatgctgtctttgt

SEQ ID NO: 2972061 - DNA, 14 bp, Homo sapiens
ctctttattcctag

SEQ ID NO: 2972062 - DNA, 21 bp, Homo sapiens
ctctttattcctagttggtga

SEQ ID NO: 2972063 - DNA, 14 bp, Homo sapiens
ctctttcccaggac

SEQ ID NO: 2972064 - DNA, 14 bp, Homo sapiens
ctctttctgtatat

SEQ ID NO: 2972065 - DNA, 13 bp, Homo sapiens
ctctttcttgttt

SEQ ID NO: 2972066 - DNA, 22 bp, Homo sapiens
ctctttcttgtttgtcagcatc

SEQ ID NO: 2972067 - DNA, 20 bp, Homo sapiens
ctctttgaattttctgtgtt

SEQ ID NO: 2972068 - DNA, 13 bp, Homo sapiens
ctctttgctttgc

SEQ ID NO: 2972069 - DNA, 14 bp, Homo sapiens
ctctttgctttgct

SEQ ID NO: 2972070 - DNA, 15 bp, Homo sapiens
ctctttgctttgctt

SEQ ID NO: 2972071 - DNA, 20 bp, Homo sapiens
ctctttgctttgctttctgc

SEQ ID NO: 2972072 - DNA, 21 bp, Homo sapiens
ctctttggcgacctcctttca

SEQ ID NO: 2972073 - DNA, 17 bp, Homo sapiens
ctctttgggcagtgcca

SEQ ID NO: 2972074 - DNA, 19 bp, Homo sapiens
ctctttgggcagtgccatg

SEQ ID NO: 2972075 - DNA, 15 bp, Homo sapiens
ctctttgtaataaaa

SEQ ID NO: 2972076 - DNA, 15 bp, Homo sapiens
ctctttgtcctgaat

SEQ ID NO: 2972077 - DNA, 14 bp, Homo sapiens
ctctttgtctaaaa

SEQ ID NO: 2972078 - DNA, 16 bp, Homo sapiens
ctcttttcctctctct

SEQ ID NO: 2972079 - DNA, 18 bp, Homo sapiens
ctcttttcctctctgtct

SEQ ID NO: 2972080 - DNA, 23 bp, Homo sapiens
ctcttttctaagtggcgtgtgca

SEQ ID NO: 2972081 - DNA, 11 bp, Homo sapiens
ctcttttctct

SEQ ID NO: 2972082 - DNA, 13 bp, Homo sapiens
ctcttttctctac

SEQ ID NO: 2972083 - DNA, 21 bp, Homo sapiens
ctcttttgctttattccagaa

SEQ ID NO: 2972084 - DNA, 12 bp, Homo sapiens
ctctttttccaa

SEQ ID NO: 2972085 - DNA, 13 bp, Homo sapiens
ctctttttctctg

SEQ ID NO: 2972086 - DNA, 15 bp, Homo sapiens
ctctttttctctgta

SEQ ID NO: 2972087 - DNA, 15 bp, Homo sapiens
ctctttttgtgaagt

SEQ ID NO: 2972088 - DNA, 14 bp, Homo sapiens
ctctttttgttttt

SEQ ID NO: 2972089 - DNA, 21 bp, Homo sapiens
ctctttttttttttttttaaa

SEQ ID NO: 2972090 - DNA, 13 bp, Homo sapiens
ctgaaaaaactat

SEQ ID NO: 2972091 - DNA, 15 bp, Homo sapiens
ctgaaaaatgaatgt

SEQ ID NO: 2972092 - DNA, 17 bp, Homo sapiens
ctgaaaacactgtgcac

SEQ ID NO: 2972093 - DNA, 19 bp, Homo sapiens
ctgaaaacctaagtccttt

SEQ ID NO: 2972094 - DNA, 11 bp, Homo sapiens
ctgaaaagaaa

SEQ ID NO: 2972095 - DNA, 23 bp, Homo sapiens
ctgaaaagagagcagagaatata

SEQ ID NO: 2972096 - DNA, 22 bp, Homo sapiens
ctgaaaatataaccagccattg

SEQ ID NO: 2972097 - DNA, 20 bp, Homo sapiens
ctgaaacaaaaattgtcttt

SEQ ID NO: 2972098 - DNA, 13 bp, Homo sapiens
ctgaaacagctgc

SEQ ID NO: 2972099 - DNA, 15 bp, Homo sapiens
ctgaaacagctgcct

SEQ ID NO: 2972100 - DNA, 16 bp, Homo sapiens
ctgaaacagctgcctt

SEQ ID NO: 2972101 - DNA, 20 bp, Homo sapiens
ctgaaacagctgccttagct

SEQ ID NO: 2972102 - DNA, 22 bp, Homo sapiens
ctgaaacagctgccttagcttc

SEQ ID NO: 2972103 - DNA, 18 bp, Homo sapiens
ctgaaacccatttactta

SEQ ID NO: 2972104 - DNA, 19 bp, Homo sapiens
ctgaaacccatttacttag

SEQ ID NO: 2972105 - DNA, 15 bp, Homo sapiens
ctgaaactcccttgt

SEQ ID NO: 2972106 - DNA, 17 bp, Homo sapiens
ctgaaactcccttgtgt

SEQ ID NO: 2972107 - DNA, 21 bp, Homo sapiens
ctgaaactcccttgtgttcct

SEQ ID NO: 2972108 - DNA, 23 bp, Homo sapiens
ctgaaacttcccaacttccctgt

SEQ ID NO: 2972109 - DNA, 20 bp, Homo sapiens
ctgaaagaagaacagctgtt

SEQ ID NO: 2972110 - DNA, 20 bp, Homo sapiens
ctgaaagcattattttttgt

SEQ ID NO: 2972111 - DNA, 21 bp, Homo sapiens
ctgaaagccacgttccttact

SEQ ID NO: 2972112 - DNA, 13 bp, Homo sapiens
ctgaaagcctgtc

SEQ ID NO: 2972113 - DNA, 21 bp, Homo sapiens
ctgaaagggaaggacagctgt

SEQ ID NO: 2972114 - DNA, 22 bp, Homo sapiens
ctgaaagggaaggacagctgtg

SEQ ID NO: 2972115 - DNA, 18 bp, Homo sapiens
ctgaaataaactagggtt

SEQ ID NO: 2972116 - DNA, 22 bp, Homo sapiens
ctgaaataaatgtttcaaatgc

SEQ ID NO: 2972117 - DNA, 14 bp, Homo sapiens
ctgaaataatggga

SEQ ID NO: 2972118 - DNA, 13 bp, Homo sapiens
ctgaaattccaaa

SEQ ID NO: 2972119 - DNA, 17 bp, Homo sapiens
ctgaaattccaaagtct

SEQ ID NO: 2972120 - DNA, 18 bp, Homo sapiens
ctgaaattccaaagtctc

SEQ ID NO: 2972121 - DNA, 20 bp, Homo sapiens
ctgaacacacaccagtttac

SEQ ID NO: 2972122 - DNA, 19 bp, Homo sapiens
ctgaacacttttgttgtaa

SEQ ID NO: 2972123 - DNA, 15 bp, Homo sapiens
ctgaacagatgtaaa

SEQ ID NO: 2972124 - DNA, 17 bp, Homo sapiens
ctgaacagatgtaaatc

SEQ ID NO: 2972125 - DNA, 16 bp, Homo sapiens
ctgaacagtgctctgc

SEQ ID NO: 2972126 - DNA, 19 bp, Homo sapiens
ctgaacagtgctctgcctc

SEQ ID NO: 2972127 - DNA, 19 bp, Homo sapiens
ctgaacataacttctcatg

SEQ ID NO: 2972128 - DNA, 12 bp, Homo sapiens
ctgaacatctgg

SEQ ID NO: 2972129 - DNA, 22 bp, Homo sapiens
ctgaaccaaattgcactgaagt

SEQ ID NO: 2972130 - DNA, 12 bp, Homo sapiens
ctgaacccagct

SEQ ID NO: 2972131 - DNA, 17 bp, Homo sapiens
ctgaacccagctgtgcc

SEQ ID NO: 2972132 - DNA, 18 bp, Homo sapiens
ctgaacccagctgtgccc

SEQ ID NO: 2972133 - DNA, 22 bp, Homo sapiens
ctgaacccagctgtgcccctcc

SEQ ID NO: 2972134 - DNA, 14 bp, Homo sapiens
ctgaaccccagagg

SEQ ID NO: 2972135 - DNA, 16 bp, Homo sapiens
ctgaaccccagaggca

SEQ ID NO: 2972136 - DNA, 18 bp, Homo sapiens
ctgaaccccagaggcaga

SEQ ID NO: 2972137 - DNA, 13 bp, Homo sapiens
ctgaactgaggcc

SEQ ID NO: 2972138 - DNA, 16 bp, Homo sapiens
ctgaactttgggaagc

SEQ ID NO: 2972139 - DNA, 21 bp, Homo sapiens
ctgaagacatgtttcaagaac

SEQ ID NO: 2972140 - DNA, 12 bp, Homo sapiens
ctgaagagcaag

SEQ ID NO: 2972141 - DNA, 13 bp, Homo sapiens
ctgaagagcaagg

SEQ ID NO: 2972142 - DNA, 16 bp, Homo sapiens
ctgaagagtatttgaa

SEQ ID NO: 2972143 - DNA, 15 bp, Homo sapiens
ctgaagagtcctctg

SEQ ID NO: 2972144 - DNA, 16 bp, Homo sapiens
ctgaagagtcctctga

SEQ ID NO: 2972145 - DNA, 20 bp, Homo sapiens
ctgaagagtgggtttcacaa

SEQ ID NO: 2972146 - DNA, 12 bp, Homo sapiens
ctgaagatattc

SEQ ID NO: 2972147 - DNA, 17 bp, Homo sapiens
ctgaagatattccaact

SEQ ID NO: 2972148 - DNA, 17 bp, Homo sapiens
ctgaagatgggagcctt

SEQ ID NO: 2972149 - DNA, 19 bp, Homo sapiens
ctgaagcaggttcccaagc

SEQ ID NO: 2972150 - DNA, 20 bp, Homo sapiens
ctgcaggccccgcttgtcca

SEQ ID NO: 2972151 - DNA, 13 bp, Homo sapiens
ctgcaggctgcag

SEQ ID NO: 2972152 - DNA, 19 bp, Homo sapiens
ctgcaggctgcaggagggc

SEQ ID NO: 2972153 - DNA, 11 bp, Homo sapiens
ctgcagggcca

SEQ ID NO: 2972154 - DNA, 18 bp, Homo sapiens
ctgcaggtgagcagacag

SEQ ID NO: 2972155 - DNA, 21 bp, Homo sapiens
ctgcaggttcttcttcctgaa

SEQ ID NO: 2972156 - DNA, 19 bp, Homo sapiens
ctgcagtcgcttgccaaag

SEQ ID NO: 2972157 - DNA, 22 bp, Homo sapiens
ctgcagtcggcatgccaggacc

SEQ ID NO: 2972158 - DNA, 20 bp, Homo sapiens
ctgcagtctccgcctcctga

SEQ ID NO: 2972159 - DNA, 14 bp, Homo sapiens
ctgcatacaatctg

SEQ ID NO: 2972160 - DNA, 21 bp, Homo sapiens
ctgcatatctctagtccctgt

SEQ ID NO: 2972161 - DNA, 19 bp, Homo sapiens
ctgcatccgtagttccctg

SEQ ID NO: 2972162 - DNA, 17 bp, Homo sapiens
ctgcatctgaccagcag

SEQ ID NO: 2972163 - DNA, 14 bp, Homo sapiens
ctgcatcttgggga

SEQ ID NO: 2972164 - DNA, 18 bp, Homo sapiens
ctgcatggagacgcattt

SEQ ID NO: 2972165 - DNA, 17 bp, Homo sapiens
ctgcatgggccagcccc

SEQ ID NO: 2972166 - DNA, 19 bp, Homo sapiens
ctgcatgggccagcccctc

SEQ ID NO: 2972167 - DNA, 22 bp, Homo sapiens
ctgcatgtggcttctctgtctc

SEQ ID NO: 2972168 - DNA, 18 bp, Homo sapiens
ctgcattgggagcatcca

SEQ ID NO: 2972169 - DNA, 17 bp, Homo sapiens
ctgcatttcacatgcct

SEQ ID NO: 2972170 - DNA, 18 bp, Homo sapiens
ctgcatttcacatgcctt

SEQ ID NO: 2972171 - DNA, 21 bp, Homo sapiens
ctgcatttcacatgccttgca

SEQ ID NO: 2972172 - DNA, 18 bp, Homo sapiens
ctgcatttttagaccatt

SEQ ID NO: 2972173 - DNA, 16 bp, Homo sapiens
ctgcatttttctgcag

SEQ ID NO: 2972174 - DNA, 15 bp, Homo sapiens
ctgccaaaatgctct

SEQ ID NO: 2972175 - DNA, 15 bp, Homo sapiens
ctgccaagccccatc

SEQ ID NO: 2972176 - DNA, 17 bp, Homo sapiens
ctgccaataacattctt

SEQ ID NO: 2972177 - DNA, 15 bp, Homo sapiens
ctgccaatccttaaa

SEQ ID NO: 2972178 - DNA, 18 bp, Homo sapiens
ctgccaatctgtacaaaa

SEQ ID NO: 2972179 - DNA, 19 bp, Homo sapiens
ctgccaatctgtacaaaat

SEQ ID NO: 2972180 - DNA, 23 bp, Homo sapiens
ctgccacagcctcccctgccagg

SEQ ID NO: 2972181 - DNA, 18 bp, Homo sapiens
ctgccacattagaacttc

SEQ ID NO: 2972182 - DNA, 17 bp, Homo sapiens
ctgccaccctgggcctg

SEQ ID NO: 2972183 - DNA, 23 bp, Homo sapiens
ctgccaccctgggcctggcagct

SEQ ID NO: 2972184 - DNA, 20 bp, Homo sapiens
ctgccaccgactgcccagcc

SEQ ID NO: 2972185 - DNA, 21 bp, Homo sapiens
ctgccaccgactgcccagcca

SEQ ID NO: 2972186 - DNA, 14 bp, Homo sapiens
ctgccactcaatgg

SEQ ID NO: 2972187 - DNA, 15 bp, Homo sapiens
ctgccactctgctgc

SEQ ID NO: 2972188 - DNA, 16 bp, Homo sapiens
ctgccactctgctgcc

SEQ ID NO: 2972189 - DNA, 18 bp, Homo sapiens
ctgccactctgctgcctg

SEQ ID NO: 2972190 - DNA, 14 bp, Homo sapiens
ctgccactgggcac

SEQ ID NO: 2972191 - DNA, 16 bp, Homo sapiens
ctgccactgggcacct

SEQ ID NO: 2972192 - DNA, 17 bp, Homo sapiens
ctgccagacactgcgcc

SEQ ID NO: 2972193 - DNA, 19 bp, Homo sapiens
ctgccagaggatgctcttt

SEQ ID NO: 2972194 - DNA, 23 bp, Homo sapiens
ctgccagaggatgctctttccca

SEQ ID NO: 2972195 - DNA, 13 bp, Homo sapiens
ctgccagatgctg

SEQ ID NO: 2972196 - DNA, 17 bp, Homo sapiens
ctgccagatgctgatgt

SEQ ID NO: 2972197 - DNA, 18 bp, Homo sapiens
ctgccagatgctgatgtt

SEQ ID NO: 2972198 - DNA, 22 bp, Homo sapiens
ctgccagatgctgatgttcagt

SEQ ID NO: 2972199 - DNA, 17 bp, Homo sapiens
ctgccagctctgtatca

SEQ ID NO: 2972200 - DNA, 15 bp, Homo sapiens
ctgccagctctgtca

SEQ ID NO: 2972201 - DNA, 18 bp, Homo sapiens
ctgccagctctgtcaccc

SEQ ID NO: 2972202 - DNA, 21 bp, Homo sapiens
ctgccagctctgtcaccctgg

SEQ ID NO: 2972203 - DNA, 13 bp, Homo sapiens
ctgccagctgcac

SEQ ID NO: 2972204 - DNA, 21 bp, Homo sapiens
ctgccaggagattcagagctc

SEQ ID NO: 2972205 - DNA, 13 bp, Homo sapiens
ctgccaggccccc

SEQ ID NO: 2972206 - DNA, 19 bp, Homo sapiens
ctgccaggggttcttgagc

SEQ ID NO: 2972207 - DNA, 18 bp, Homo sapiens
ctgccagtgccttacctc

SEQ ID NO: 2972208 - DNA, 23 bp, Homo sapiens
ctgccagtgccttacctcctgcc

SEQ ID NO: 2972209 - DNA, 14 bp, Homo sapiens
ctgccatcacctgc

SEQ ID NO: 2972210 - DNA, 18 bp, Homo sapiens
ctgccatcttctccccga

SEQ ID NO: 2972211 - DNA, 18 bp, Homo sapiens
ctgccatgcatacatgct

SEQ ID NO: 2972212 - DNA, 20 bp, Homo sapiens
ctgccattggtccacccttt

SEQ ID NO: 2972213 - DNA, 14 bp, Homo sapiens
ctgcccaactgtgt

SEQ ID NO: 2972214 - DNA, 11 bp, Homo sapiens
ctgcccaagtg

SEQ ID NO: 2972215 - DNA, 17 bp, Homo sapiens
ctgcccaagtgaccagg

SEQ ID NO: 2972216 - DNA, 18 bp, Homo sapiens
ctgcccaagtgaccaggg

SEQ ID NO: 2972217 - DNA, 19 bp, Homo sapiens
ctgcccaagtgaccaggga

SEQ ID NO: 2972218 - DNA, 13 bp, Homo sapiens
ctgcccacccccg

SEQ ID NO: 2972219 - DNA, 21 bp, Homo sapiens
ctgcccacccccgggatcctg

SEQ ID NO: 2972220 - DNA, 19 bp, Homo sapiens
ctgcccaccctccctccac

SEQ ID NO: 2972221 - DNA, 11 bp, Homo sapiens
ctgcccacctg

SEQ ID NO: 2972222 - DNA, 21 bp, Homo sapiens
ctgcccacctgcctggccggc

SEQ ID NO: 2972223 - DNA, 16 bp, Homo sapiens
ctgcccagccgggcac

SEQ ID NO: 2972224 - DNA, 21 bp, Homo sapiens
ctgcccagcctcaatgtcact

SEQ ID NO: 2972225 - DNA, 18 bp, Homo sapiens
ctgcccaggagagccagc

SEQ ID NO: 2972226 - DNA, 14 bp, Homo sapiens
ctgcccaggcactg

SEQ ID NO: 2972227 - DNA, 15 bp, Homo sapiens
ctgcccaggcactgc

SEQ ID NO: 2972228 - DNA, 16 bp, Homo sapiens
ctgcccaggcactgca

SEQ ID NO: 2972229 - DNA, 21 bp, Homo sapiens
ctgcccaggcctctcggtgct

SEQ ID NO: 2972230 - DNA, 18 bp, Homo sapiens
ctgcccatttcatattct

SEQ ID NO: 2972231 - DNA, 12 bp, Homo sapiens
ctgccccaactc

SEQ ID NO: 2972232 - DNA, 16 bp, Homo sapiens
ctgccccaactcctgg

SEQ ID NO: 2972233 - DNA, 17 bp, Homo sapiens
ctgccccaactcctgga

SEQ ID NO: 2972234 - DNA, 13 bp, Homo sapiens
ctgccccaactct

SEQ ID NO: 2972235 - DNA, 21 bp, Homo sapiens
ctgccccaggccggagcccag

SEQ ID NO: 2972236 - DNA, 22 bp, Homo sapiens
ctgccccaggccggagcccaga

SEQ ID NO: 2972237 - DNA, 16 bp, Homo sapiens
ctgccccatcctccag

SEQ ID NO: 2972238 - DNA, 17 bp, Homo sapiens
ctgccccatcctccagc

SEQ ID NO: 2972239 - DNA, 18 bp, Homo sapiens
ctgccccatcctccagca

SEQ ID NO: 2972240 - DNA, 22 bp, Homo sapiens
ctgccccatcctccagcaggga

SEQ ID NO: 2972241 - DNA, 13 bp, Homo sapiens
ctgcccccaagtc

SEQ ID NO: 2972242 - DNA, 16 bp, Homo sapiens
ctgccccccagggcta

SEQ ID NO: 2972243 - DNA, 19 bp, Homo sapiens
ctgccccctcgggggcctg

SEQ ID NO: 2972244 - DNA, 15 bp, Homo sapiens
ctgcccctcagagac

SEQ ID NO: 2972245 - DNA, 13 bp, Homo sapiens
ctgcccctcccag

SEQ ID NO: 2972246 - DNA, 13 bp, Homo sapiens
ctgcccctccccc

SEQ ID NO: 2972247 - DNA, 14 bp, Homo sapiens
ctgcccctccccct

SEQ ID NO: 2972248 - DNA, 22 bp, Homo sapiens
ctgcccctccccctaccgcatg

SEQ ID NO: 2972249 - DNA, 14 bp, Homo sapiens
ctgcccctccctag

SEQ ID NO: 2972250 - DNA, 23 bp, Homo sapiens
ctgcccctccctagatccaggct

SEQ ID NO: 2972251 - DNA, 17 bp, Homo sapiens
ctgcccctccctgcctc

SEQ ID NO: 2972252 - DNA, 14 bp, Homo sapiens
ctgcccctctccga

SEQ ID NO: 2972253 - DNA, 14 bp, Homo sapiens
ctgcccctctctgg

SEQ ID NO: 2972254 - DNA, 15 bp, Homo sapiens
ctgcccctctctggg

SEQ ID NO: 2972255 - DNA, 13 bp, Homo sapiens
ctgcccctggcac

SEQ ID NO: 2972256 - DNA, 13 bp, Homo sapiens
ctgcccctgtgcc

SEQ ID NO: 2972257 - DNA, 19 bp, Homo sapiens
ctgcccctgtgcctctgtc

SEQ ID NO: 2972258 - DNA, 20 bp, Homo sapiens
ctgcccctgtgcctctgtcc

SEQ ID NO: 2972259 - DNA, 18 bp, Homo sapiens
ctgcccgcaccctggcct

SEQ ID NO: 2972260 - DNA, 19 bp, Homo sapiens
ctgcccgcaccctggcctg

SEQ ID NO: 2972261 - DNA, 20 bp, Homo sapiens
ctgcccgcaccctggcctgg

SEQ ID NO: 2972262 - DNA, 22 bp, Homo sapiens
ctgcccgcaccctggcctggtc

SEQ ID NO: 2972263 - DNA, 17 bp, Homo sapiens
ctgcccggcgcctgccc

SEQ ID NO: 2972264 - DNA, 18 bp, Homo sapiens
ctgcccggcgcctgccct

SEQ ID NO: 2972265 - DNA, 13 bp, Homo sapiens
ctgcccggctaca

SEQ ID NO: 2972266 - DNA, 13 bp, Homo sapiens
ctgcccggggtgg

SEQ ID NO: 2972267 - DNA, 22 bp, Homo sapiens
ctgcccggggtggggtgcactc

SEQ ID NO: 2972268 - DNA, 19 bp, Homo sapiens
ctgccctaacctgacagag

SEQ ID NO: 2972269 - DNA, 15 bp, Homo sapiens
ctgccctcccgcacc

SEQ ID NO: 2972270 - DNA, 17 bp, Homo sapiens
ctgccctcccgcacctt

SEQ ID NO: 2972271 - DNA, 14 bp, Homo sapiens
ctgccctccctcag

SEQ ID NO: 2972272 - DNA, 13 bp, Homo sapiens
ctgccctcctctc

SEQ ID NO: 2972273 - DNA, 15 bp, Homo sapiens
ctgccctcctctccc

SEQ ID NO: 2972274 - DNA, 22 bp, Homo sapiens
ctgccctcgcacggccccgaag

SEQ ID NO: 2972275 - DNA, 19 bp, Homo sapiens
ctgccctctgctgctgccc

SEQ ID NO: 2972276 - DNA, 18 bp, Homo sapiens
ctgccctgaggggctggg

SEQ ID NO: 2972277 - DNA, 15 bp, Homo sapiens
ctgccctgcccaagt

SEQ ID NO: 2972278 - DNA, 12 bp, Homo sapiens
ctgccctgctcc

SEQ ID NO: 2972279 - DNA, 19 bp, Homo sapiens
ctgccctgggtcctgcctg

SEQ ID NO: 2972280 - DNA, 22 bp, Homo sapiens
ctgccctgggtcctgcctgcag

SEQ ID NO: 2972281 - DNA, 13 bp, Homo sapiens
ctgccctgtgccg

SEQ ID NO: 2972282 - DNA, 17 bp, Homo sapiens
ctgctactctgttcctt

SEQ ID NO: 2972283 - DNA, 18 bp, Homo sapiens
ctgctactctgttccttc

SEQ ID NO: 2972284 - DNA, 20 bp, Homo sapiens
ctgctactgcccctctccga

SEQ ID NO: 2972285 - DNA, 20 bp, Homo sapiens
ctgctagcaggccccctagg

SEQ ID NO: 2972286 - DNA, 21 bp, Homo sapiens
ctgctagcaggccccctagga

SEQ ID NO: 2972287 - DNA, 20 bp, Homo sapiens
ctgctataattctatactgt

SEQ ID NO: 2972288 - DNA, 14 bp, Homo sapiens
ctgctattaacctt

SEQ ID NO: 2972289 - DNA, 15 bp, Homo sapiens
ctgctattaaccttg

SEQ ID NO: 2972290 - DNA, 15 bp, Homo sapiens
ctgctatttcaggcc

SEQ ID NO: 2972291 - DNA, 12 bp, Homo sapiens
ctgctcacttta

SEQ ID NO: 2972292 - DNA, 13 bp, Homo sapiens
ctgctcagagcca

SEQ ID NO: 2972293 - DNA, 22 bp, Homo sapiens
ctgctcagagccaagggggcag

SEQ ID NO: 2972294 - DNA, 16 bp, Homo sapiens
ctgctcagctctgggc

SEQ ID NO: 2972295 - DNA, 22 bp, Homo sapiens
ctgctcagctctgggccattct

SEQ ID NO: 2972296 - DNA, 18 bp, Homo sapiens
ctgctcagctctggtcca

SEQ ID NO: 2972297 - DNA, 13 bp, Homo sapiens
ctgctcagcttct

SEQ ID NO: 2972298 - DNA, 16 bp, Homo sapiens
ctgctcagcttctcct

SEQ ID NO: 2972299 - DNA, 21 bp, Homo sapiens
ctgctcaggaaaccacaacct

SEQ ID NO: 2972300 - DNA, 15 bp, Homo sapiens
ctgctcaggaattga

SEQ ID NO: 2972301 - DNA, 17 bp, Homo sapiens
ctgctcatactggtctc

SEQ ID NO: 2972302 - DNA, 17 bp, Homo sapiens
ctgctcattccacactg

SEQ ID NO: 2972303 - DNA, 14 bp, Homo sapiens
ctgctccaacagaa

SEQ ID NO: 2972304 - DNA, 21 bp, Homo sapiens
ctgctccacctttcagcccac

SEQ ID NO: 2972305 - DNA, 13 bp, Homo sapiens
ctgctccagacct

SEQ ID NO: 2972306 - DNA, 15 bp, Homo sapiens
ctgctccagacctga

SEQ ID NO: 2972307 - DNA, 21 bp, Homo sapiens
ctgctccagacctgatcctgg

SEQ ID NO: 2972308 - DNA, 20 bp, Homo sapiens
ctgctccccagcagcggaac

SEQ ID NO: 2972309 - DNA, 14 bp, Homo sapiens
ctgctcccccaccc

SEQ ID NO: 2972310 - DNA, 22 bp, Homo sapiens
ctgctcccccaccccctcccca

SEQ ID NO: 2972311 - DNA, 20 bp, Homo sapiens
ctgctccctctcccccttac

SEQ ID NO: 2972312 - DNA, 22 bp, Homo sapiens
ctgctcccttcgctctgctgga

SEQ ID NO: 2972313 - DNA, 15 bp, Homo sapiens
ctgctccgtggactg

SEQ ID NO: 2972314 - DNA, 17 bp, Homo sapiens
ctgctcctagagggagg

SEQ ID NO: 2972315 - DNA, 21 bp, Homo sapiens
ctgctcctagagggaggggcc

SEQ ID NO: 2972316 - DNA, 16 bp, Homo sapiens
ctgctcctccagggcc

SEQ ID NO: 2972317 - DNA, 17 bp, Homo sapiens
ctgctcctccagggcca

SEQ ID NO: 2972318 - DNA, 14 bp, Homo sapiens
ctgctcctttcccc

SEQ ID NO: 2972319 - DNA, 15 bp, Homo sapiens
ctgctcctttcccct

SEQ ID NO: 2972320 - DNA, 16 bp, Homo sapiens
ctgctcgcccaggaag

SEQ ID NO: 2972321 - DNA, 17 bp, Homo sapiens
ctgctcgcccaggaagg

SEQ ID NO: 2972322 - DNA, 23 bp, Homo sapiens
ctgctcgcccaggaaggcctagg

SEQ ID NO: 2972323 - DNA, 15 bp, Homo sapiens
ctgctcgccttagca

SEQ ID NO: 2972324 - DNA, 14 bp, Homo sapiens
ctgctctcccactg

SEQ ID NO: 2972325 - DNA, 16 bp, Homo sapiens
ctgctctcccactgca

SEQ ID NO: 2972326 - DNA, 20 bp, Homo sapiens
ctgctctgcgtgtcacctgt

SEQ ID NO: 2972327 - DNA, 22 bp, Homo sapiens
ctgctctgcgtgtcacctgtgc

SEQ ID NO: 2972328 - DNA, 19 bp, Homo sapiens
ctgctcttacttcccccac

SEQ ID NO: 2972329 - DNA, 21 bp, Homo sapiens
ctgctcttacttcccccaccc

SEQ ID NO: 2972330 - DNA, 22 bp, Homo sapiens
ctgctcttacttcccccaccct

SEQ ID NO: 2972331 - DNA, 19 bp, Homo sapiens
ctgctcttttatactgtac

SEQ ID NO: 2972332 - DNA, 21 bp, Homo sapiens
ctgctgaagccagttgcttct

SEQ ID NO: 2972333 - DNA, 23 bp, Homo sapiens
ctgctgaatgatttccaaagaga

SEQ ID NO: 2972334 - DNA, 19 bp, Homo sapiens
ctgctgaatttataaaaat

SEQ ID NO: 2972335 - DNA, 15 bp, Homo sapiens
ctgctgacccaccaa

SEQ ID NO: 2972336 - DNA, 18 bp, Homo sapiens
ctgctgacctccacagct

SEQ ID NO: 2972337 - DNA, 21 bp, Homo sapiens
ctgctgagagacccaaggagg

SEQ ID NO: 2972338 - DNA, 14 bp, Homo sapiens
ctgctgatgcagcc

SEQ ID NO: 2972339 - DNA, 20 bp, Homo sapiens
ctgctgatgctgaaataaac

SEQ ID NO: 2972340 - DNA, 16 bp, Homo sapiens
ctgctgcacatagcag

SEQ ID NO: 2972341 - DNA, 14 bp, Homo sapiens
ctgctgcagccctg

SEQ ID NO: 2972342 - DNA, 15 bp, Homo sapiens
ctgctgcagtagggg

SEQ ID NO: 2972343 - DNA, 21 bp, Homo sapiens
ctgctgccaccaaatctgtct

SEQ ID NO: 2972344 - DNA, 23 bp, Homo sapiens
ctgctgccaccaaatctgtctag

SEQ ID NO: 2972345 - DNA, 14 bp, Homo sapiens
ctgctgccactctg

SEQ ID NO: 2972346 - DNA, 15 bp, Homo sapiens
ctgctgccactctgc

SEQ ID NO: 2972347 - DNA, 20 bp, Homo sapiens
ctgctgccactctgctgcct

SEQ ID NO: 2972348 - DNA, 22 bp, Homo sapiens
ctgctgccactctgctgcctgt

SEQ ID NO: 2972349 - DNA, 17 bp, Homo sapiens
ctgctgccagggcttcc

SEQ ID NO: 2972350 - DNA, 16 bp, Homo sapiens
ctgctgccatccatgt

SEQ ID NO: 2972351 - DNA, 17 bp, Homo sapiens
ctgctgcccctccctgc

SEQ ID NO: 2972352 - DNA, 18 bp, Homo sapiens
ctgctgcccctccctgcc

SEQ ID NO: 2972353 - DNA, 13 bp, Homo sapiens
ctgctgcctcagc

SEQ ID NO: 2972354 - DNA, 11 bp, Homo sapiens
ctgctgcctgg

SEQ ID NO: 2972355 - DNA, 21 bp, Homo sapiens
ctgctgcctgggtaggcccca

SEQ ID NO: 2972356 - DNA, 14 bp, Homo sapiens
ctgctgctcattcc

SEQ ID NO: 2972357 - DNA, 15 bp, Homo sapiens
ctgctgctccccacc

SEQ ID NO: 2972358 - DNA, 12 bp, Homo sapiens
ctgctgctcctc

SEQ ID NO: 2972359 - DNA, 15 bp, Homo sapiens
ctgctgctcctcttt

SEQ ID NO: 2972360 - DNA, 17 bp, Homo sapiens
ctgctgctcctctttcc

SEQ ID NO: 2972361 - DNA, 19 bp, Homo sapiens
ctgctgctcctctttcccc

SEQ ID NO: 2972362 - DNA, 13 bp, Homo sapiens
ctgctgctgtgct

SEQ ID NO: 2972363 - DNA, 15 bp, Homo sapiens
ctgctggaaacagac

SEQ ID NO: 2972364 - DNA, 12 bp, Homo sapiens
ctgctggcctcc

SEQ ID NO: 2972365 - DNA, 21 bp, Homo sapiens
ctgctggctggtgcctgagcc

SEQ ID NO: 2972366 - DNA, 22 bp, Homo sapiens
ctgctggctggtgcctgagccc

SEQ ID NO: 2972367 - DNA, 23 bp, Homo sapiens
ctgctgggatggtgggcttcagg

SEQ ID NO: 2972368 - DNA, 18 bp, Homo sapiens
ctgctgggctctccacct

SEQ ID NO: 2972369 - DNA, 21 bp, Homo sapiens
ctgctgggctctccacctcag

SEQ ID NO: 2972370 - DNA, 22 bp, Homo sapiens
ctgctgggctctccacctcagc

SEQ ID NO: 2972371 - DNA, 23 bp, Homo sapiens
ctgctgggctctccacctcagcc

SEQ ID NO: 2972372 - DNA, 17 bp, Homo sapiens
ctgctggggctggtgag

SEQ ID NO: 2972373 - DNA, 18 bp, Homo sapiens
ctgctgggggcaactggc

SEQ ID NO: 2972374 - DNA, 17 bp, Homo sapiens
ctgctgggggctcccct

SEQ ID NO: 2972375 - DNA, 18 bp, Homo sapiens
ctgctgggggctcccctt

SEQ ID NO: 2972376 - DNA, 15 bp, Homo sapiens
ctgctgtaagaaatc

SEQ ID NO: 2972377 - DNA, 19 bp, Homo sapiens
ctgctgtcacctctcccac

SEQ ID NO: 2972378 - DNA, 13 bp, Homo sapiens
ctgctgtcctggt

SEQ ID NO: 2972379 - DNA, 11 bp, Homo sapiens
ctgctgtctct

SEQ ID NO: 2972380 - DNA, 14 bp, Homo sapiens
ctgctgtctctctg

SEQ ID NO: 2972381 - DNA, 16 bp, Homo sapiens
ctgctgtctctctggg

SEQ ID NO: 2972382 - DNA, 17 bp, Homo sapiens
ctgctgtctctctgggc

SEQ ID NO: 2972383 - DNA, 17 bp, Homo sapiens
ctgctgtgactgtgtcc

SEQ ID NO: 2972384 - DNA, 14 bp, Homo sapiens
ctgctgtgcaacgg

SEQ ID NO: 2972385 - DNA, 14 bp, Homo sapiens
ctgctgtgcgtgga

SEQ ID NO: 2972386 - DNA, 20 bp, Homo sapiens
ctgctgtgcgtggaaaaaga

SEQ ID NO: 2972387 - DNA, 15 bp, Homo sapiens
ctgctgtggagccca

SEQ ID NO: 2972388 - DNA, 13 bp, Homo sapiens
ctgctgttgcctc

SEQ ID NO: 2972389 - DNA, 21 bp, Homo sapiens
ctgctgttggtcctctctctg

SEQ ID NO: 2972390 - DNA, 18 bp, Homo sapiens
ctgcttaaacttgaccca

SEQ ID NO: 2972391 - DNA, 13 bp, Homo sapiens
ctgcttaattgct

SEQ ID NO: 2972392 - DNA, 23 bp, Homo sapiens
ctgcttactcatgtccctattta

SEQ ID NO: 2972393 - DNA, 21 bp, Homo sapiens
ctgcttagaacccttctgctt

SEQ ID NO: 2972394 - DNA, 22 bp, Homo sapiens
ctgcttagaacccttctgcttt

SEQ ID NO: 2972395 - DNA, 19 bp, Homo sapiens
ctgcttatgatgggctccc

SEQ ID NO: 2972396 - DNA, 20 bp, Homo sapiens
ctgcttatgatgggctcccc

SEQ ID NO: 2972397 - DNA, 23 bp, Homo sapiens
ctgcttcagatgtggagccaggc

SEQ ID NO: 2972398 - DNA, 15 bp, Homo sapiens
ctgcttcatatctct

SEQ ID NO: 2972399 - DNA, 18 bp, Homo sapiens
ctgcttcatatctctccc

SEQ ID NO: 2972400 - DNA, 22 bp, Homo sapiens
ctgcttcatatctctcccttct

SEQ ID NO: 2972401 - DNA, 14 bp, Homo sapiens
ctgcttccatggct

SEQ ID NO: 2972402 - DNA, 22 bp, Homo sapiens
ctgcttccatggcttcctgaga

SEQ ID NO: 2972403 - DNA, 18 bp, Homo sapiens
ctgcttcccatgcctgca

SEQ ID NO: 2972404 - DNA, 13 bp, Homo sapiens
ctgcttgaggaaa

SEQ ID NO: 2972405 - DNA, 16 bp, Homo sapiens
ctgcttgaggaaaaca

SEQ ID NO: 2972406 - DNA, 18 bp, Homo sapiens
ctgcttgcagccaggaga

SEQ ID NO: 2972407 - DNA, 22 bp, Homo sapiens
ctgcttgcagccaggagaaggt

SEQ ID NO: 2972408 - DNA, 17 bp, Homo sapiens
ctgcttggagctgagca

SEQ ID NO: 2972409 - DNA, 13 bp, Homo sapiens
ctgcttggccaga

SEQ ID NO: 2972410 - DNA, 15 bp, Homo sapiens
ctgcttggccagatg

SEQ ID NO: 2972411 - DNA, 20 bp, Homo sapiens
ctgcttggccagatgcgggg

SEQ ID NO: 2972412 - DNA, 18 bp, Homo sapiens
ctgcttgtactaagccag

SEQ ID NO: 2972413 - DNA, 23 bp, Homo sapiens
ctgcttgtactaagccaggaggc

SEQ ID NO: 2972414 - DNA, 14 bp, Homo sapiens
ctgggggaaaaagc

SEQ ID NO: 2972415 - DNA, 16 bp, Homo sapiens
ctgggggaagccctgg

SEQ ID NO: 2972416 - DNA, 15 bp, Homo sapiens
ctgggggagggactg

SEQ ID NO: 2972417 - DNA, 22 bp, Homo sapiens
ctgggggagggactgctgaccc

SEQ ID NO: 2972418 - DNA, 23 bp, Homo sapiens
ctgggggagggactgctgaccca

SEQ ID NO: 2972419 - DNA, 13 bp, Homo sapiens
ctgggggctcccc

SEQ ID NO: 2972420 - DNA, 23 bp, Homo sapiens
ctgggggctccccttgcccttcc

SEQ ID NO: 2972421 - DNA, 12 bp, Homo sapiens
ctgggggctggt

SEQ ID NO: 2972422 - DNA, 14 bp, Homo sapiens
ctggggggaacgga

SEQ ID NO: 2972423 - DNA, 16 bp, Homo sapiens
ctggggggaccaaata

SEQ ID NO: 2972424 - DNA, 19 bp, Homo sapiens
ctggggggaccaaatagcc

SEQ ID NO: 2972425 - DNA, 19 bp, Homo sapiens
ctggggtcaccctctccag

SEQ ID NO: 2972426 - DNA, 18 bp, Homo sapiens
ctggggtctcaggtccag

SEQ ID NO: 2972427 - DNA, 22 bp, Homo sapiens
ctggggtctggagttgatctgg

SEQ ID NO: 2972428 - DNA, 12 bp, Homo sapiens
ctggggtggcct

SEQ ID NO: 2972429 - DNA, 21 bp, Homo sapiens
ctggggtggcctgtgtggcca

SEQ ID NO: 2972430 - DNA, 20 bp, Homo sapiens
ctggggtggggtcatgccct

SEQ ID NO: 2972431 - DNA, 17 bp, Homo sapiens
ctgggtacctgcaagca

SEQ ID NO: 2972432 - DNA, 21 bp, Homo sapiens
ctgggtagaagccacccttcc

SEQ ID NO: 2972433 - DNA, 22 bp, Homo sapiens
ctgggtagaagccacccttccc

SEQ ID NO: 2972434 - DNA, 13 bp, Homo sapiens
ctgggtaggcccc

SEQ ID NO: 2972435 - DNA, 16 bp, Homo sapiens
ctgggtaggccccaca

SEQ ID NO: 2972436 - DNA, 16 bp, Homo sapiens
ctgggtcacagagtga

SEQ ID NO: 2972437 - DNA, 13 bp, Homo sapiens
ctgggtcacagga

SEQ ID NO: 2972438 - DNA, 21 bp, Homo sapiens
ctgggtcacaggaaggaaaca

SEQ ID NO: 2972439 - DNA, 18 bp, Homo sapiens
ctgggtcagacccatctc

SEQ ID NO: 2972440 - DNA, 23 bp, Homo sapiens
ctgggtcagacccatctctccct

SEQ ID NO: 2972441 - DNA, 15 bp, Homo sapiens
ctgggtcctgcctgc

SEQ ID NO: 2972442 - DNA, 17 bp, Homo sapiens
ctgggtcctgcctgcag

SEQ ID NO: 2972443 - DNA, 18 bp, Homo sapiens
ctgggtcctgcctgcagt

SEQ ID NO: 2972444 - DNA, 15 bp, Homo sapiens
ctgggtctcaggaca

SEQ ID NO: 2972445 - DNA, 16 bp, Homo sapiens
ctgggtctgacctggt

SEQ ID NO: 2972446 - DNA, 17 bp, Homo sapiens
ctgggtctgacctggtg

SEQ ID NO: 2972447 - DNA, 19 bp, Homo sapiens
ctgggtctgacctggtggg

SEQ ID NO: 2972448 - DNA, 21 bp, Homo sapiens
ctgggtgaaagggatactttt

SEQ ID NO: 2972449 - DNA, 21 bp, Homo sapiens
ctgggtggatgtgagcagaag

SEQ ID NO: 2972450 - DNA, 19 bp, Homo sapiens
ctgggtggcccctgtctcg

SEQ ID NO: 2972451 - DNA, 18 bp, Homo sapiens
ctgggtggggctgctcct

SEQ ID NO: 2972452 - DNA, 22 bp, Homo sapiens
ctgggtggggctgctcctccag

SEQ ID NO: 2972453 - DNA, 13 bp, Homo sapiens
ctgggtggtctgc

SEQ ID NO: 2972454 - DNA, 14 bp, Homo sapiens
ctgggtggtggcct

SEQ ID NO: 2972455 - DNA, 17 bp, Homo sapiens
ctgggtggtggcctggt

SEQ ID NO: 2972456 - DNA, 15 bp, Homo sapiens
ctgggtgttgaccac

SEQ ID NO: 2972457 - DNA, 14 bp, Homo sapiens
ctgggttccccact

SEQ ID NO: 2972458 - DNA, 12 bp, Homo sapiens
ctgggtttcttt

SEQ ID NO: 2972459 - DNA, 17 bp, Homo sapiens
ctgggtttggcccaaga

SEQ ID NO: 2972460 - DNA, 18 bp, Homo sapiens
ctgggtttggcccctgga

SEQ ID NO: 2972461 - DNA, 15 bp, Homo sapiens
ctggtaattgtacaa

SEQ ID NO: 2972462 - DNA, 16 bp, Homo sapiens
ctggtaattgtacaat

SEQ ID NO: 2972463 - DNA, 19 bp, Homo sapiens
ctggtacaacggaggcctg

SEQ ID NO: 2972464 - DNA, 21 bp, Homo sapiens
ctggtactccctctcaggatc

SEQ ID NO: 2972465 - DNA, 15 bp, Homo sapiens
ctggtagctgagggg

SEQ ID NO: 2972466 - DNA, 17 bp, Homo sapiens
ctggtagctgaggggac

SEQ ID NO: 2972467 - DNA, 21 bp, Homo sapiens
ctggtagctgaggggacgggc

SEQ ID NO: 2972468 - DNA, 18 bp, Homo sapiens
ctggtaggaaagggcaag

SEQ ID NO: 2972469 - DNA, 23 bp, Homo sapiens
ctggtaggaggaggcatggaaac

SEQ ID NO: 2972470 - DNA, 21 bp, Homo sapiens
ctggtatgaataattgcatca

SEQ ID NO: 2972471 - DNA, 16 bp, Homo sapiens
ctggtatggtgctaat

SEQ ID NO: 2972472 - DNA, 18 bp, Homo sapiens
ctggtattctctctatgc

SEQ ID NO: 2972473 - DNA, 21 bp, Homo sapiens
ctggtattctctctatgcaaa

SEQ ID NO: 2972474 - DNA, 23 bp, Homo sapiens
ctggtcaaacaaactctctgaac

SEQ ID NO: 2972475 - DNA, 15 bp, Homo sapiens
ctggtcaacctcctg

SEQ ID NO: 2972476 - DNA, 12 bp, Homo sapiens
ctggtcactctg

SEQ ID NO: 2972477 - DNA, 20 bp, Homo sapiens
ctggtcactctgccctctgc

SEQ ID NO: 2972478 - DNA, 21 bp, Homo sapiens
ctggtcactctgccctctgct

SEQ ID NO: 2972479 - DNA, 21 bp, Homo sapiens
ctggtcagaaccggcctggag

SEQ ID NO: 2972480 - DNA, 13 bp, Homo sapiens
ctggtccacaggg

SEQ ID NO: 2972481 - DNA, 16 bp, Homo sapiens
ctggtccacagggcac

SEQ ID NO: 2972482 - DNA, 16 bp, Homo sapiens
ctggtccaggccctgt

SEQ ID NO: 2972483 - DNA, 15 bp, Homo sapiens
ctggtcccctgtggt

SEQ ID NO: 2972484 - DNA, 15 bp, Homo sapiens
ctggtccctggtcct

SEQ ID NO: 2972485 - DNA, 19 bp, Homo sapiens
ctggtccctggtccttcac

SEQ ID NO: 2972486 - DNA, 20 bp, Homo sapiens
ctggtccctggtccttcact

SEQ ID NO: 2972487 - DNA, 21 bp, Homo sapiens
ctggtccgagctgaggactct

SEQ ID NO: 2972488 - DNA, 17 bp, Homo sapiens
ctggtcctacccatccc

SEQ ID NO: 2972489 - DNA, 20 bp, Homo sapiens
ctggtcctccgcctactgtc

SEQ ID NO: 2972490 - DNA, 17 bp, Homo sapiens
ctggtcctcggagctgg

SEQ ID NO: 2972491 - DNA, 13 bp, Homo sapiens
ctggtcctggcct

SEQ ID NO: 2972492 - DNA, 13 bp, Homo sapiens
ctggtcctggctg

SEQ ID NO: 2972493 - DNA, 19 bp, Homo sapiens
ctggtctaatttattaatc

SEQ ID NO: 2972494 - DNA, 18 bp, Homo sapiens
ctggtctcgaactcctga

SEQ ID NO: 2972495 - DNA, 15 bp, Homo sapiens
ctggtctctggctct

SEQ ID NO: 2972496 - DNA, 16 bp, Homo sapiens
ctggtctgttttctgt

SEQ ID NO: 2972497 - DNA, 14 bp, Homo sapiens
ctggtcttgaactg

SEQ ID NO: 2972498 - DNA, 18 bp, Homo sapiens
ctggtcttgaagtcctgg

SEQ ID NO: 2972499 - DNA, 22 bp, Homo sapiens
ctggtcttgaagtcctggcttc

SEQ ID NO: 2972500 - DNA, 15 bp, Homo sapiens
ctggtgacagccttg

SEQ ID NO: 2972501 - DNA, 17 bp, Homo sapiens
ctggtgacagccttggg

SEQ ID NO: 2972502 - DNA, 14 bp, Homo sapiens
ctggtgagaactga

SEQ ID NO: 2972503 - DNA, 17 bp, Homo sapiens
ctggtgaggccggccct

SEQ ID NO: 2972504 - DNA, 19 bp, Homo sapiens
ctggtgaggccggccctgc

SEQ ID NO: 2972505 - DNA, 19 bp, Homo sapiens
ctggtgattacccagagat

SEQ ID NO: 2972506 - DNA, 20 bp, Homo sapiens
ctggtgccaaatagccccag

SEQ ID NO: 2972507 - DNA, 15 bp, Homo sapiens
ctggtgcccccagac

SEQ ID NO: 2972508 - DNA, 22 bp, Homo sapiens
ctggtgcccccagacagctgct

SEQ ID NO: 2972509 - DNA, 23 bp, Homo sapiens
ctggtgcccccagacagctgctc

SEQ ID NO: 2972510 - DNA, 19 bp, Homo sapiens
ctggtgcctctcacttcgt

SEQ ID NO: 2972511 - DNA, 16 bp, Homo sapiens
ctggtgcctgctttga

SEQ ID NO: 2972512 - DNA, 23 bp, Homo sapiens
ctggtgcctgctttgacgggcca

SEQ ID NO: 2972513 - DNA, 18 bp, Homo sapiens
ctggtgctcctgcccagc

SEQ ID NO: 2972514 - DNA, 15 bp, Homo sapiens
ctggtggaggagctg

SEQ ID NO: 2972515 - DNA, 18 bp, Homo sapiens
ctggtggaggagctgagg

SEQ ID NO: 2972516 - DNA, 12 bp, Homo sapiens
ctggtggcccag

SEQ ID NO: 2972517 - DNA, 17 bp, Homo sapiens
ctggtggctacccaata

SEQ ID NO: 2972518 - DNA, 21 bp, Homo sapiens
ctggtggctcttcagaggagc

SEQ ID NO: 2972519 - DNA, 12 bp, Homo sapiens
ctggtggctggg

SEQ ID NO: 2972520 - DNA, 19 bp, Homo sapiens
ctggtggctgggcccagca

SEQ ID NO: 2972521 - DNA, 17 bp, Homo sapiens
ctggtgggagcacctgc

SEQ ID NO: 2972522 - DNA, 18 bp, Homo sapiens
ctggtgggagcacctgcc

SEQ ID NO: 2972523 - DNA, 16 bp, Homo sapiens
ctggtggttatttaac

SEQ ID NO: 2972524 - DNA, 17 bp, Homo sapiens
ctggtgtcaccccagag

SEQ ID NO: 2972525 - DNA, 20 bp, Homo sapiens
ctggtgtcaccccagagcca

SEQ ID NO: 2972526 - DNA, 23 bp, Homo sapiens
ctggtgtctgctttctccattgt

SEQ ID NO: 2972527 - DNA, 16 bp, Homo sapiens
ctggttaggatggcag

SEQ ID NO: 2972528 - DNA, 18 bp, Homo sapiens
ctggttaggatggcagga

SEQ ID NO: 2972529 - DNA, 19 bp, Homo sapiens
ctggttaggatggcaggac

SEQ ID NO: 2972530 - DNA, 21 bp, Homo sapiens
ctggttatcctgtgctacaga

SEQ ID NO: 2972531 - DNA, 13 bp, Homo sapiens
ctggttatcttgt

SEQ ID NO: 2972532 - DNA, 16 bp, Homo sapiens
ctggttatcttgttat

SEQ ID NO: 2972533 - DNA, 18 bp, Homo sapiens
ctggttccgccaggcgct

SEQ ID NO: 2972534 - DNA, 23 bp, Homo sapiens
ctggttcctgctgtcctggtggc

SEQ ID NO: 2972535 - DNA, 13 bp, Homo sapiens
ctggttctcaatg

SEQ ID NO: 2972536 - DNA, 20 bp, Homo sapiens
ctggttcttgccttcccctt

SEQ ID NO: 2972537 - DNA, 15 bp, Homo sapiens
ctggttcttttaaaa

SEQ ID NO: 2972538 - DNA, 23 bp, Homo sapiens
ctggttggcatttgctggcctgg

SEQ ID NO: 2972539 - DNA, 22 bp, Homo sapiens
ctggtttatttgttgttttctg

SEQ ID NO: 2972540 - DNA, 20 bp, Homo sapiens
ctggtttccaactctccaca

SEQ ID NO: 2972541 - DNA, 17 bp, Homo sapiens
ctggtttgaagaatgtt

SEQ ID NO: 2972542 - DNA, 17 bp, Homo sapiens
ctggttttcacattaga

SEQ ID NO: 2972543 - DNA, 18 bp, Homo sapiens
ctggttttgatggctggg

SEQ ID NO: 2972544 - DNA, 23 bp, Homo sapiens
ctggttttgatggctgggtcctt

SEQ ID NO: 2972545 - DNA, 19 bp, Homo sapiens
ctgtaaaaaaaaaaaagtt

SEQ ID NO: 2972546 - DNA, 13 bp, Homo sapiens
ctgtgtttaatca

SEQ ID NO: 2972547 - DNA, 14 bp, Homo sapiens
ctgtgtttctgtgc

SEQ ID NO: 2972548 - DNA, 15 bp, Homo sapiens
ctgtgtttctgtgct

SEQ ID NO: 2972549 - DNA, 16 bp, Homo sapiens
ctgtgtttctgtgctc

SEQ ID NO: 2972550 - DNA, 20 bp, Homo sapiens
ctgtgtttctgtgctccaag

SEQ ID NO: 2972551 - DNA, 22 bp, Homo sapiens
ctgtgtttggctttcagggagg

SEQ ID NO: 2972552 - DNA, 23 bp, Homo sapiens
ctgtgtttggctttcagggaggc

SEQ ID NO: 2972553 - DNA, 12 bp, Homo sapiens
ctgttaaccaaa

SEQ ID NO: 2972554 - DNA, 19 bp, Homo sapiens
ctgttaagaaatctgtttt

SEQ ID NO: 2972555 - DNA, 18 bp, Homo sapiens
ctgttaagaataataaaa

SEQ ID NO: 2972556 - DNA, 22 bp, Homo sapiens
ctgttacccagggtggagtgca

SEQ ID NO: 2972557 - DNA, 22 bp, Homo sapiens
ctgttacctgtcttgctcctgg

SEQ ID NO: 2972558 - DNA, 14 bp, Homo sapiens
ctgttactgggccc

SEQ ID NO: 2972559 - DNA, 15 bp, Homo sapiens
ctgttactgggccct

SEQ ID NO: 2972560 - DNA, 14 bp, Homo sapiens
ctgttacttgcttc

SEQ ID NO: 2972561 - DNA, 18 bp, Homo sapiens
ctgttaggagaagctgca

SEQ ID NO: 2972562 - DNA, 20 bp, Homo sapiens
ctgttaggccaactgcctcc

SEQ ID NO: 2972563 - DNA, 18 bp, Homo sapiens
ctgttatcagctgggcag

SEQ ID NO: 2972564 - DNA, 20 bp, Homo sapiens
ctgttatcagtaatgctaaa

SEQ ID NO: 2972565 - DNA, 17 bp, Homo sapiens
ctgttattcttgttata

SEQ ID NO: 2972566 - DNA, 14 bp, Homo sapiens
ctgttatttagact

SEQ ID NO: 2972567 - DNA, 16 bp, Homo sapiens
ctgttatttagactca

SEQ ID NO: 2972568 - DNA, 19 bp, Homo sapiens
ctgttcaacatcactgaaa

SEQ ID NO: 2972569 - DNA, 14 bp, Homo sapiens
ctgttcacccacag

SEQ ID NO: 2972570 - DNA, 17 bp, Homo sapiens
ctgttcagaaaggggct

SEQ ID NO: 2972571 - DNA, 22 bp, Homo sapiens
ctgttcagctactcccactccc

SEQ ID NO: 2972572 - DNA, 12 bp, Homo sapiens
ctgttcagttac

SEQ ID NO: 2972573 - DNA, 14 bp, Homo sapiens
ctgttcagttacag

SEQ ID NO: 2972574 - DNA, 17 bp, Homo sapiens
ctgttcagttacagaaa

SEQ ID NO: 2972575 - DNA, 14 bp, Homo sapiens
ctgttcatctcttt

SEQ ID NO: 2972576 - DNA, 15 bp, Homo sapiens
ctgttcatctctttg

SEQ ID NO: 2972577 - DNA, 19 bp, Homo sapiens
ctgttcatctctttgtcct

SEQ ID NO: 2972578 - DNA, 21 bp, Homo sapiens
ctgttcatctctttgtcctga

SEQ ID NO: 2972579 - DNA, 16 bp, Homo sapiens
ctgttccacaaagcag

SEQ ID NO: 2972580 - DNA, 13 bp, Homo sapiens
ctgttccccagag

SEQ ID NO: 2972581 - DNA, 14 bp, Homo sapiens
ctgttccccagaga

SEQ ID NO: 2972582 - DNA, 12 bp, Homo sapiens
ctgttccccctg

SEQ ID NO: 2972583 - DNA, 17 bp, Homo sapiens
ctgttcccccttcacaa

SEQ ID NO: 2972584 - DNA, 12 bp, Homo sapiens
ctgttcctgtgt

SEQ ID NO: 2972585 - DNA, 14 bp, Homo sapiens
ctgttcctgtgttc

SEQ ID NO: 2972586 - DNA, 16 bp, Homo sapiens
ctgttcctgtgttctt

SEQ ID NO: 2972587 - DNA, 21 bp, Homo sapiens
ctgttccttcacatcctgtgt

SEQ ID NO: 2972588 - DNA, 18 bp, Homo sapiens
ctgttcgaagttcatttt

SEQ ID NO: 2972589 - DNA, 18 bp, Homo sapiens
ctgttcgttcaaaagtgg

SEQ ID NO: 2972590 - DNA, 17 bp, Homo sapiens
ctgttctaaagctctga

SEQ ID NO: 2972591 - DNA, 14 bp, Homo sapiens
ctgttctacttgat

SEQ ID NO: 2972592 - DNA, 17 bp, Homo sapiens
ctgttctacttgatatt

SEQ ID NO: 2972593 - DNA, 16 bp, Homo sapiens
ctgttctcccttcggt

SEQ ID NO: 2972594 - DNA, 15 bp, Homo sapiens
ctgttctgtagcttt

SEQ ID NO: 2972595 - DNA, 17 bp, Homo sapiens
ctgttctgtagctttct

SEQ ID NO: 2972596 - DNA, 19 bp, Homo sapiens
ctgttctgtagctttctgg

SEQ ID NO: 2972597 - DNA, 22 bp, Homo sapiens
ctgttctgtagctttctggaat

SEQ ID NO: 2972598 - DNA, 22 bp, Homo sapiens
ctgttctgtggaaagtgtaaag

SEQ ID NO: 2972599 - DNA, 14 bp, Homo sapiens
ctgttctgtttcaa

SEQ ID NO: 2972600 - DNA, 15 bp, Homo sapiens
ctgttctgtttcaag

SEQ ID NO: 2972601 - DNA, 12 bp, Homo sapiens
ctgttcttgaag

SEQ ID NO: 2972602 - DNA, 17 bp, Homo sapiens
ctgttcttgaggtctct

SEQ ID NO: 2972603 - DNA, 17 bp, Homo sapiens
ctgttctttaagacttt

SEQ ID NO: 2972604 - DNA, 17 bp, Homo sapiens
ctgttgaaagcaaaaat

SEQ ID NO: 2972605 - DNA, 19 bp, Homo sapiens
ctgttgaaagcaaaaatgc

SEQ ID NO: 2972606 - DNA, 20 bp, Homo sapiens
ctgttgaaagcaaaaatgct

SEQ ID NO: 2972607 - DNA, 12 bp, Homo sapiens
ctgttgaacttt

SEQ ID NO: 2972608 - DNA, 21 bp, Homo sapiens
ctgttgacatatttaatgttt

SEQ ID NO: 2972609 - DNA, 22 bp, Homo sapiens
ctgttgacatatttaatgtttt

SEQ ID NO: 2972610 - DNA, 19 bp, Homo sapiens
ctgttgattgctaaatgta

SEQ ID NO: 2972611 - DNA, 12 bp, Homo sapiens
ctgttgcacttt

SEQ ID NO: 2972612 - DNA, 17 bp, Homo sapiens
ctgttgcacttttgaat

SEQ ID NO: 2972613 - DNA, 15 bp, Homo sapiens
ctgttgcagtggcct

SEQ ID NO: 2972614 - DNA, 18 bp, Homo sapiens
ctgttgcagtggcctggc

SEQ ID NO: 2972615 - DNA, 19 bp, Homo sapiens
ctgttgcagtggcctggcc

SEQ ID NO: 2972616 - DNA, 21 bp, Homo sapiens
ctgttgcagtggcctggccgt

SEQ ID NO: 2972617 - DNA, 12 bp, Homo sapiens
ctgttgcctcat

SEQ ID NO: 2972618 - DNA, 14 bp, Homo sapiens
ctgttgcctcatct

SEQ ID NO: 2972619 - DNA, 13 bp, Homo sapiens
ctgttgcctcctc

SEQ ID NO: 2972620 - DNA, 20 bp, Homo sapiens
ctgttgcctcctctctccct

SEQ ID NO: 2972621 - DNA, 21 bp, Homo sapiens
ctgttgcctcctctctccctg

SEQ ID NO: 2972622 - DNA, 23 bp, Homo sapiens
ctgttgcgtgacactctccttgc

SEQ ID NO: 2972623 - DNA, 17 bp, Homo sapiens
ctgttgctaacacacag

SEQ ID NO: 2972624 - DNA, 11 bp, Homo sapiens
ctgttggaagc

SEQ ID NO: 2972625 - DNA, 19 bp, Homo sapiens
ctgttggatttgtttaaaa

SEQ ID NO: 2972626 - DNA, 22 bp, Homo sapiens
ctgttggatttgtttaaaagga

SEQ ID NO: 2972627 - DNA, 19 bp, Homo sapiens
ctgttgggagaaagcaata

SEQ ID NO: 2972628 - DNA, 20 bp, Homo sapiens
ctgttgggagaaagcaatac

SEQ ID NO: 2972629 - DNA, 18 bp, Homo sapiens
ctgttgtagaaattctta

SEQ ID NO: 2972630 - DNA, 22 bp, Homo sapiens
ctgttgtctagagctcatcagt

SEQ ID NO: 2972631 - DNA, 19 bp, Homo sapiens
ctgttgtgacctgaagttc

SEQ ID NO: 2972632 - DNA, 20 bp, Homo sapiens
ctgttgtgacctgaagttca

SEQ ID NO: 2972633 - DNA, 17 bp, Homo sapiens
ctgttgtggtttttagt

SEQ ID NO: 2972634 - DNA, 19 bp, Homo sapiens
ctgttgtggtttttagtgc

SEQ ID NO: 2972635 - DNA, 17 bp, Homo sapiens
ctgttgtgttcaccaga

SEQ ID NO: 2972636 - DNA, 21 bp, Homo sapiens
ctgttgttttggctcaatttg

SEQ ID NO: 2972637 - DNA, 18 bp, Homo sapiens
ctgtttaaagctttgaat

SEQ ID NO: 2972638 - DNA, 15 bp, Homo sapiens
ctgtttacagtgttc

SEQ ID NO: 2972639 - DNA, 17 bp, Homo sapiens
ctgtttactgcaaggtt

SEQ ID NO: 2972640 - DNA, 17 bp, Homo sapiens
ctgtttagcttcctcca

SEQ ID NO: 2972641 - DNA, 23 bp, Homo sapiens
ctgtttattgaaagaattatcct

SEQ ID NO: 2972642 - DNA, 12 bp, Homo sapiens
ctgtttattgcc

SEQ ID NO: 2972643 - DNA, 18 bp, Homo sapiens
ctgtttatttttaaattt

SEQ ID NO: 2972644 - DNA, 15 bp, Homo sapiens
ctgtttcaatcactg

SEQ ID NO: 2972645 - DNA, 16 bp, Homo sapiens
ctgtttcaatcactgt

SEQ ID NO: 2972646 - DNA, 18 bp, Homo sapiens
ctgtttcataatgcagaa

SEQ ID NO: 2972647 - DNA, 17 bp, Homo sapiens
ctgtttcctgctgcttt

SEQ ID NO: 2972648 - DNA, 11 bp, Homo sapiens
ctgtttcctgt

SEQ ID NO: 2972649 - DNA, 14 bp, Homo sapiens
ctgtttccttgcct

SEQ ID NO: 2972650 - DNA, 15 bp, Homo sapiens
ctgtttccttttatg

SEQ ID NO: 2972651 - DNA, 17 bp, Homo sapiens
ctgtttcttgtctgtta

SEQ ID NO: 2972652 - DNA, 14 bp, Homo sapiens
ctgtttgctgatgg

SEQ ID NO: 2972653 - DNA, 19 bp, Homo sapiens
ctgtttgctgatggtctgg

SEQ ID NO: 2972654 - DNA, 16 bp, Homo sapiens
ctgtttgggcaggagt

SEQ ID NO: 2972655 - DNA, 21 bp, Homo sapiens
ctgtttgggcaggagtcacca

SEQ ID NO: 2972656 - DNA, 21 bp, Homo sapiens
ctgttttaaaactttaagaaa

SEQ ID NO: 2972657 - DNA, 20 bp, Homo sapiens
ctgttttaaattgcatttct

SEQ ID NO: 2972658 - DNA, 18 bp, Homo sapiens
ctgttttcttctcagtct

SEQ ID NO: 2972659 - DNA, 17 bp, Homo sapiens
ctgttttgaaggcaaaa

SEQ ID NO: 2972660 - DNA, 17 bp, Homo sapiens
ctgttttgtttggcaag

SEQ ID NO: 2972661 - DNA, 21 bp, Homo sapiens
ctgttttgtttggcaaggaaa

SEQ ID NO: 2972662 - DNA, 15 bp, Homo sapiens
ctgtttttagacacc

SEQ ID NO: 2972663 - DNA, 18 bp, Homo sapiens
ctgtttttccatagtttt

SEQ ID NO: 2972664 - DNA, 15 bp, Homo sapiens
ctgtttttcggacag

SEQ ID NO: 2972665 - DNA, 17 bp, Homo sapiens
ctgtttttcggacagtt

SEQ ID NO: 2972666 - DNA, 15 bp, Homo sapiens
ctgtttttttttcat

SEQ ID NO: 2972667 - DNA, 22 bp, Homo sapiens
cttaaaaagtggcgttgttcat

SEQ ID NO: 2972668 - DNA, 21 bp, Homo sapiens
cttaaaaatcacactgtaaat

SEQ ID NO: 2972669 - DNA, 22 bp, Homo sapiens
cttaaaaattaaattctctcta

SEQ ID NO: 2972670 - DNA, 15 bp, Homo sapiens
cttaaaacaaaagga

SEQ ID NO: 2972671 - DNA, 16 bp, Homo sapiens
cttaaaacaaaaggaa

SEQ ID NO: 2972672 - DNA, 22 bp, Homo sapiens
cttaaaacaaaaggaaagaaac

SEQ ID NO: 2972673 - DNA, 18 bp, Homo sapiens
cttaaaagctggctttca

SEQ ID NO: 2972674 - DNA, 21 bp, Homo sapiens
cttaaacatgaatgaattctt

SEQ ID NO: 2972675 - DNA, 15 bp, Homo sapiens
cttaaactctcttct

SEQ ID NO: 2972676 - DNA, 14 bp, Homo sapiens
cttaaacttcctta

SEQ ID NO: 2972677 - DNA, 16 bp, Homo sapiens
cttaaacttgacccag

SEQ ID NO: 2972678 - DNA, 19 bp, Homo sapiens
cttaaagatttatcaaatc

SEQ ID NO: 2972679 - DNA, 16 bp, Homo sapiens
cttctcattgctgccc

SEQ ID NO: 2972680 - DNA, 15 bp, Homo sapiens
cttctccaacactga

SEQ ID NO: 2972681 - DNA, 22 bp, Homo sapiens
cttctccaagaatggaagcctg

SEQ ID NO: 2972682 - DNA, 19 bp, Homo sapiens
cttctccaattctgcccaa

SEQ ID NO: 2972683 - DNA, 16 bp, Homo sapiens
cttctccatccacatg

SEQ ID NO: 2972684 - DNA, 14 bp, Homo sapiens
cttctcccggacct

SEQ ID NO: 2972685 - DNA, 15 bp, Homo sapiens
cttctcctctggctt

SEQ ID NO: 2972686 - DNA, 18 bp, Homo sapiens
cttctccttggaggacag

SEQ ID NO: 2972687 - DNA, 18 bp, Homo sapiens
cttctcctttggcatgtt

SEQ ID NO: 2972688 - DNA, 21 bp, Homo sapiens
cttctcgaccacgggaagcat

SEQ ID NO: 2972689 - DNA, 21 bp, Homo sapiens
cttctcggagctggcccaggg

SEQ ID NO: 2972690 - DNA, 18 bp, Homo sapiens
cttctcggccagcccgtc

SEQ ID NO: 2972691 - DNA, 21 bp, Homo sapiens
cttctcggcttggatcctggg

SEQ ID NO: 2972692 - DNA, 20 bp, Homo sapiens
cttctcggggtccagtgcat

SEQ ID NO: 2972693 - DNA, 14 bp, Homo sapiens
cttctctatcctct

SEQ ID NO: 2972694 - DNA, 16 bp, Homo sapiens
cttctctctgtgggat

SEQ ID NO: 2972695 - DNA, 12 bp, Homo sapiens
cttctctgtctc

SEQ ID NO: 2972696 - DNA, 16 bp, Homo sapiens
cttctcttctcttctt

SEQ ID NO: 2972697 - DNA, 17 bp, Homo sapiens
cttctcttctcttcttt

SEQ ID NO: 2972698 - DNA, 16 bp, Homo sapiens
cttctcttgctttata

SEQ ID NO: 2972699 - DNA, 19 bp, Homo sapiens
cttctcttttcctcgcaga

SEQ ID NO: 2972700 - DNA, 14 bp, Homo sapiens
cttctgaaaaatga

SEQ ID NO: 2972701 - DNA, 22 bp, Homo sapiens
cttctgaaaaatgaatgtaaaa

SEQ ID NO: 2972702 - DNA, 20 bp, Homo sapiens
cttctgaaaacccaaggcca

SEQ ID NO: 2972703 - DNA, 16 bp, Homo sapiens
cttctgaagtgtgtcc

SEQ ID NO: 2972704 - DNA, 15 bp, Homo sapiens
cttctgaatatttta

SEQ ID NO: 2972705 - DNA, 19 bp, Homo sapiens
cttctgagccttctactta

SEQ ID NO: 2972706 - DNA, 19 bp, Homo sapiens
cttctgcattcctgtaact

SEQ ID NO: 2972707 - DNA, 17 bp, Homo sapiens
cttctgccggccctggg

SEQ ID NO: 2972708 - DNA, 19 bp, Homo sapiens
cttctgcctcccactccat

SEQ ID NO: 2972709 - DNA, 14 bp, Homo sapiens
cttctgcgtccacc

SEQ ID NO: 2972710 - DNA, 24 bp, Homo sapiens
cttctgcgtccaccaggcctcact

SEQ ID NO: 2972711 - DNA, 20 bp, Homo sapiens
cttctgctactggcaaaagg

SEQ ID NO: 2972712 - DNA, 15 bp, Homo sapiens
cttctggccaggaag

SEQ ID NO: 2972713 - DNA, 22 bp, Homo sapiens
cttctggccaggaagctttggt

SEQ ID NO: 2972714 - DNA, 16 bp, Homo sapiens
cttctggcctcccaca

SEQ ID NO: 2972715 - DNA, 12 bp, Homo sapiens
cttctggctcaa

SEQ ID NO: 2972716 - DNA, 22 bp, Homo sapiens
cttctggctccctcttctttca

SEQ ID NO: 2972717 - DNA, 15 bp, Homo sapiens
cttctggctttgttc

SEQ ID NO: 2972718 - DNA, 22 bp, Homo sapiens
cttctggctttgttcttgtcat

SEQ ID NO: 2972719 - DNA, 23 bp, Homo sapiens
cttctgggagggcagcagggcta

SEQ ID NO: 2972720 - DNA, 11 bp, Homo sapiens
cttctggggtc

SEQ ID NO: 2972721 - DNA, 17 bp, Homo sapiens
cttctggggtccccagg

SEQ ID NO: 2972722 - DNA, 20 bp, Homo sapiens
cttctggggtccccagggct

SEQ ID NO: 2972723 - DNA, 17 bp, Homo sapiens
cttctggtcccctgtgg

SEQ ID NO: 2972724 - DNA, 18 bp, Homo sapiens
cttctggtgccagatcct

SEQ ID NO: 2972725 - DNA, 18 bp, Homo sapiens
cttctgtaggaattcttt

SEQ ID NO: 2972726 - DNA, 20 bp, Homo sapiens
cttctgtataactaggctgt

SEQ ID NO: 2972727 - DNA, 16 bp, Homo sapiens
cttctgtatataaatg

SEQ ID NO: 2972728 - DNA, 18 bp, Homo sapiens
cttctgtatataaatggg

SEQ ID NO: 2972729 - DNA, 21 bp, Homo sapiens
cttctgtatataaatgggaac

SEQ ID NO: 2972730 - DNA, 14 bp, Homo sapiens
cttctgtattttca

SEQ ID NO: 2972731 - DNA, 21 bp, Homo sapiens
cttctgtattttcaaagactg

SEQ ID NO: 2972732 - DNA, 16 bp, Homo sapiens
cttctgtccatcagtg

SEQ ID NO: 2972733 - DNA, 15 bp, Homo sapiens
cttctgtccctcaca

SEQ ID NO: 2972734 - DNA, 12 bp, Homo sapiens
cttctgtgaaga

SEQ ID NO: 2972735 - DNA, 20 bp, Homo sapiens
cttctgtgaagaagccctgt

SEQ ID NO: 2972736 - DNA, 12 bp, Homo sapiens
cttctgtgtctg

SEQ ID NO: 2972737 - DNA, 14 bp, Homo sapiens
cttctgtgtctgtc

SEQ ID NO: 2972738 - DNA, 15 bp, Homo sapiens
cttctgtgtctgtca

SEQ ID NO: 2972739 - DNA, 16 bp, Homo sapiens
cttctgtgtctgtcac

SEQ ID NO: 2972740 - DNA, 14 bp, Homo sapiens
cttctgtgtttata

SEQ ID NO: 2972741 - DNA, 22 bp, Homo sapiens
cttcttagctatcattgcttcc

SEQ ID NO: 2972742 - DNA, 23 bp, Homo sapiens
cttcttatggaattgatttgcat

SEQ ID NO: 2972743 - DNA, 20 bp, Homo sapiens
cttcttattctcactccacc

SEQ ID NO: 2972744 - DNA, 22 bp, Homo sapiens
cttcttattctcactccaccac

SEQ ID NO: 2972745 - DNA, 13 bp, Homo sapiens
cttcttcaccatt

SEQ ID NO: 2972746 - DNA, 17 bp, Homo sapiens
cttcttcagccacctct

SEQ ID NO: 2972747 - DNA, 14 bp, Homo sapiens
cttcttcagctgac

SEQ ID NO: 2972748 - DNA, 15 bp, Homo sapiens
cttcttcagggcctg

SEQ ID NO: 2972749 - DNA, 19 bp, Homo sapiens
cttcttccaggtgcccagc

SEQ ID NO: 2972750 - DNA, 15 bp, Homo sapiens
cttcttcctgaagct

SEQ ID NO: 2972751 - DNA, 23 bp, Homo sapiens
cttcttcctgaatactgaaacta

SEQ ID NO: 2972752 - DNA, 12 bp, Homo sapiens
cttcttgccctg

SEQ ID NO: 2972753 - DNA, 14 bp, Homo sapiens
cttcttgccctggg

SEQ ID NO: 2972754 - DNA, 24 bp, Homo sapiens
cttcttggggcccagtgcatggtg

SEQ ID NO: 2972755 - DNA, 21 bp, Homo sapiens
cttcttgggggtaagctgatt

SEQ ID NO: 2972756 - DNA, 12 bp, Homo sapiens
cttctttaaaca

SEQ ID NO: 2972757 - DNA, 20 bp, Homo sapiens
cttctttaccttcatttcat

SEQ ID NO: 2972758 - DNA, 21 bp, Homo sapiens
cttctttatactctcttccct

SEQ ID NO: 2972759 - DNA, 19 bp, Homo sapiens
cttctttgtggtctttttc

SEQ ID NO: 2972760 - DNA, 22 bp, Homo sapiens
cttctttgtggtctttttcctg

SEQ ID NO: 2972761 - DNA, 17 bp, Homo sapiens
cttcttttcacattctt

SEQ ID NO: 2972762 - DNA, 15 bp, Homo sapiens
cttcttttggcttcc

SEQ ID NO: 2972763 - DNA, 14 bp, Homo sapiens
cttgaaaaaaaata

SEQ ID NO: 2972764 - DNA, 16 bp, Homo sapiens
cttgaaaaaaaataga

SEQ ID NO: 2972765 - DNA, 20 bp, Homo sapiens
cttgaaaaaaaatagatgtt

SEQ ID NO: 2972766 - DNA, 14 bp, Homo sapiens
cttgaaaaagtaga

SEQ ID NO: 2972767 - DNA, 20 bp, Homo sapiens
cttgaaaagattctgaaacc

SEQ ID NO: 2972768 - DNA, 16 bp, Homo sapiens
cttgaaaataagaata

SEQ ID NO: 2972769 - DNA, 23 bp, Homo sapiens
cttgaaaatattttttatatata

SEQ ID NO: 2972770 - DNA, 19 bp, Homo sapiens
cttgaaacatgttcatctg

SEQ ID NO: 2972771 - DNA, 14 bp, Homo sapiens
cttgaaacctgatg

SEQ ID NO: 2972772 - DNA, 20 bp, Homo sapiens
cttgaaagattttattgtat

SEQ ID NO: 2972773 - DNA, 22 bp, Homo sapiens
cttgaaagcagttaaactgatt

SEQ ID NO: 2972774 - DNA, 19 bp, Homo sapiens
cttgaaatatcctgcttga

SEQ ID NO: 2972775 - DNA, 18 bp, Homo sapiens
cttgaacccgggggacag

SEQ ID NO: 2972776 - DNA, 19 bp, Homo sapiens
cttgaacccgggggacaga

SEQ ID NO: 2972777 - DNA, 20 bp, Homo sapiens
cttgaacctcattaaatggt

SEQ ID NO: 2972778 - DNA, 17 bp, Homo sapiens
cttgaactgagcttgga

SEQ ID NO: 2972779 - DNA, 12 bp, Homo sapiens
cttgaagaaacg

SEQ ID NO: 2972780 - DNA, 15 bp, Homo sapiens
cttgaagaaacgctt

SEQ ID NO: 2972781 - DNA, 17 bp, Homo sapiens
cttgaagaagtggctgc

SEQ ID NO: 2972782 - DNA, 14 bp, Homo sapiens
cttgaagaatattc

SEQ ID NO: 2972783 - DNA, 19 bp, Homo sapiens
cttgaagcatttcaaagcc

SEQ ID NO: 2972784 - DNA, 20 bp, Homo sapiens
cttgaagcatttcaaagccc

SEQ ID NO: 2972785 - DNA, 13 bp, Homo sapiens
cttgaagggccag

SEQ ID NO: 2972786 - DNA, 15 bp, Homo sapiens
cttgaagggccagag

SEQ ID NO: 2972787 - DNA, 18 bp, Homo sapiens
cttgaagggccagagcca

SEQ ID NO: 2972788 - DNA, 19 bp, Homo sapiens
cttgaagggccagagccag

SEQ ID NO: 2972789 - DNA, 21 bp, Homo sapiens
cttgaagggccagagccaggg

SEQ ID NO: 2972790 - DNA, 13 bp, Homo sapiens
cttgaagtaacta

SEQ ID NO: 2972791 - DNA, 17 bp, Homo sapiens
cttgaagtaggaagtag

SEQ ID NO: 2972792 - DNA, 21 bp, Homo sapiens
cttgaatcagcatctcttctt

SEQ ID NO: 2972793 - DNA, 19 bp, Homo sapiens
cttgaatgtggcttgagaa

SEQ ID NO: 2972794 - DNA, 20 bp, Homo sapiens
cttgaattgtaactgttctt

SEQ ID NO: 2972795 - DNA, 13 bp, Homo sapiens
cttgaatttgcat

SEQ ID NO: 2972796 - DNA, 17 bp, Homo sapiens
cttgaatttgcatgtct

SEQ ID NO: 2972797 - DNA, 14 bp, Homo sapiens
cttgacaacatctg

SEQ ID NO: 2972798 - DNA, 12 bp, Homo sapiens
cttgaccaagca

SEQ ID NO: 2972799 - DNA, 17 bp, Homo sapiens
cttgaccaagcaggaag

SEQ ID NO: 2972800 - DNA, 23 bp, Homo sapiens
cttgaccaagcaggaagctcaga

SEQ ID NO: 2972801 - DNA, 15 bp, Homo sapiens
cttgacctgaactct

SEQ ID NO: 2972802 - DNA, 14 bp, Homo sapiens
cttgacctttgtac

SEQ ID NO: 2972803 - DNA, 22 bp, Homo sapiens
cttgacctttgtacagcccaga

SEQ ID NO: 2972804 - DNA, 15 bp, Homo sapiens
cttgactacctactg

SEQ ID NO: 2972805 - DNA, 19 bp, Homo sapiens
cttgactacctactggtgt

SEQ ID NO: 2972806 - DNA, 21 bp, Homo sapiens
cttgactcaggtggtgtcctt

SEQ ID NO: 2972807 - DNA, 22 bp, Homo sapiens
cttgactgaagcgaacatcttc

SEQ ID NO: 2972808 - DNA, 20 bp, Homo sapiens
cttgactgtcttccctctct

SEQ ID NO: 2972809 - DNA, 14 bp, Homo sapiens
cttgagacctcagc

SEQ ID NO: 2972810 - DNA, 15 bp, Homo sapiens
cttgagacctcagcc

SEQ ID NO: 2972811 - DNA, 18 bp, Homo sapiens
ctttcctcaaaaagcaga

SEQ ID NO: 2972812 - DNA, 19 bp, Homo sapiens
ctttcctcaaatgttgaca

SEQ ID NO: 2972813 - DNA, 22 bp, Homo sapiens
ctttcctcaagtatcttctatt

SEQ ID NO: 2972814 - DNA, 20 bp, Homo sapiens
ctttcctgcccttttcctgg

SEQ ID NO: 2972815 - DNA, 16 bp, Homo sapiens
ctttcctggatgtctg

SEQ ID NO: 2972816 - DNA, 17 bp, Homo sapiens
ctttccttttttaaaaa

SEQ ID NO: 2972817 - DNA, 14 bp, Homo sapiens
ctttcgggccatgt

SEQ ID NO: 2972818 - DNA, 20 bp, Homo sapiens
ctttcgttggttgtttctct

SEQ ID NO: 2972819 - DNA, 17 bp, Homo sapiens
ctttctaagagaagcaa

SEQ ID NO: 2972820 - DNA, 17 bp, Homo sapiens
ctttctagttcagctgc

SEQ ID NO: 2972821 - DNA, 14 bp, Homo sapiens
ctttctagttgaaa

SEQ ID NO: 2972822 - DNA, 21 bp, Homo sapiens
ctttctagttgaaaataaagt

SEQ ID NO: 2972823 - DNA, 14 bp, Homo sapiens
ctttctagtttgtt

SEQ ID NO: 2972824 - DNA, 15 bp, Homo sapiens
ctttctatgctgctt

SEQ ID NO: 2972825 - DNA, 21 bp, Homo sapiens
ctttctatgctgcttttatat

SEQ ID NO: 2972826 - DNA, 19 bp, Homo sapiens
ctttctattacccctcatt

SEQ ID NO: 2972827 - DNA, 20 bp, Homo sapiens
ctttctattacccctcattt

SEQ ID NO: 2972828 - DNA, 23 bp, Homo sapiens
ctttctatttttatgatgacaat

SEQ ID NO: 2972829 - DNA, 23 bp, Homo sapiens
ctttctcctttgtactttgtgct

SEQ ID NO: 2972830 - DNA, 17 bp, Homo sapiens
ctttctctctcttttcc

SEQ ID NO: 2972831 - DNA, 11 bp, Homo sapiens
ctttctctgta

SEQ ID NO: 2972832 - DNA, 13 bp, Homo sapiens
ctttctctgtata

SEQ ID NO: 2972833 - DNA, 18 bp, Homo sapiens
ctttctctgtatattggg

SEQ ID NO: 2972834 - DNA, 14 bp, Homo sapiens
ctttctcttgttta

SEQ ID NO: 2972835 - DNA, 20 bp, Homo sapiens
ctttctcttttcctctacca

SEQ ID NO: 2972836 - DNA, 21 bp, Homo sapiens
ctttctgaaactcccttgtgt

SEQ ID NO: 2972837 - DNA, 14 bp, Homo sapiens
ctttctgaaattca

SEQ ID NO: 2972838 - DNA, 20 bp, Homo sapiens
ctttctgaagcctcacttat

SEQ ID NO: 2972839 - DNA, 18 bp, Homo sapiens
ctttctgaccttcagctc

SEQ ID NO: 2972840 - DNA, 17 bp, Homo sapiens
ctttctgagcacacttt

SEQ ID NO: 2972841 - DNA, 14 bp, Homo sapiens
ctttctgcagactg

SEQ ID NO: 2972842 - DNA, 19 bp, Homo sapiens
ctttctgccccccagggct

SEQ ID NO: 2972843 - DNA, 21 bp, Homo sapiens
ctttctgccccccagggctag

SEQ ID NO: 2972844 - DNA, 14 bp, Homo sapiens
ctttctgctcagct

SEQ ID NO: 2972845 - DNA, 14 bp, Homo sapiens
ctttctgtaaacag

SEQ ID NO: 2972846 - DNA, 20 bp, Homo sapiens
ctttctgtaaacagaataaa

SEQ ID NO: 2972847 - DNA, 19 bp, Homo sapiens
ctttctgtatatacttttt

SEQ ID NO: 2972848 - DNA, 13 bp, Homo sapiens
ctttctgttcatc

SEQ ID NO: 2972849 - DNA, 22 bp, Homo sapiens
ctttcttccaaacaggctcaga

SEQ ID NO: 2972850 - DNA, 11 bp, Homo sapiens
ctttcttcctc

SEQ ID NO: 2972851 - DNA, 15 bp, Homo sapiens
ctttcttcctccagt

SEQ ID NO: 2972852 - DNA, 13 bp, Homo sapiens
ctttcttctaaat

SEQ ID NO: 2972853 - DNA, 18 bp, Homo sapiens
ctttcttctcgcctagga

SEQ ID NO: 2972854 - DNA, 12 bp, Homo sapiens
ctttcttcttgt

SEQ ID NO: 2972855 - DNA, 15 bp, Homo sapiens
ctttcttctttcctt

SEQ ID NO: 2972856 - DNA, 11 bp, Homo sapiens
ctttcttgttt

SEQ ID NO: 2972857 - DNA, 22 bp, Homo sapiens
ctttcttgtttgtcagcatctg

SEQ ID NO: 2972858 - DNA, 17 bp, Homo sapiens
ctttctttctaactcca

SEQ ID NO: 2972859 - DNA, 22 bp, Homo sapiens
ctttctttggggaaaaattctt

SEQ ID NO: 2972860 - DNA, 22 bp, Homo sapiens
ctttgaaaaaaagtttctattt

SEQ ID NO: 2972861 - DNA, 21 bp, Homo sapiens
ctttgaaagacttccaaagaa

SEQ ID NO: 2972862 - DNA, 19 bp, Homo sapiens
ctttgaacgtgccagcagc

SEQ ID NO: 2972863 - DNA, 18 bp, Homo sapiens
ctttgaagtgggaaagca

SEQ ID NO: 2972864 - DNA, 17 bp, Homo sapiens
ctttgaataaagaatac

SEQ ID NO: 2972865 - DNA, 13 bp, Homo sapiens
ctttgaatgttaa

SEQ ID NO: 2972866 - DNA, 17 bp, Homo sapiens
ctttgaatgttaatttt

SEQ ID NO: 2972867 - DNA, 19 bp, Homo sapiens
ctttgaccatggaaagaaa

SEQ ID NO: 2972868 - DNA, 17 bp, Homo sapiens
ctttgacgggccaggcc

SEQ ID NO: 2972869 - DNA, 20 bp, Homo sapiens
ctttgacgggccaggccctg

SEQ ID NO: 2972870 - DNA, 17 bp, Homo sapiens
ctttgactgtcagcaag

SEQ ID NO: 2972871 - DNA, 17 bp, Homo sapiens
ctttgagaggctgaggt

SEQ ID NO: 2972872 - DNA, 17 bp, Homo sapiens
ctttgagcctgggaaat

SEQ ID NO: 2972873 - DNA, 22 bp, Homo sapiens
ctttgagctactgccgtcagtg

SEQ ID NO: 2972874 - DNA, 16 bp, Homo sapiens
ctttgaggccgaagct

SEQ ID NO: 2972875 - DNA, 22 bp, Homo sapiens
ctttgaggtggaagagggctgc

SEQ ID NO: 2972876 - DNA, 14 bp, Homo sapiens
ctttgatcacagga

SEQ ID NO: 2972877 - DNA, 20 bp, Homo sapiens
ctttgatcgtatatttctca

SEQ ID NO: 2972878 - DNA, 14 bp, Homo sapiens
ctttgatggaggag

SEQ ID NO: 2972879 - DNA, 16 bp, Homo sapiens
ctttgatgtgtttttg

SEQ ID NO: 2972880 - DNA, 18 bp, Homo sapiens
ctttgatgttaacacatt

SEQ ID NO: 2972881 - DNA, 20 bp, Homo sapiens
ctttgatgttaacacatttt

SEQ ID NO: 2972882 - DNA, 23 bp, Homo sapiens
ctttgattagttttcttgttgct

SEQ ID NO: 2972883 - DNA, 12 bp, Homo sapiens
ctttgattcata

SEQ ID NO: 2972884 - DNA, 14 bp, Homo sapiens
ctttgattccattt

SEQ ID NO: 2972885 - DNA, 19 bp, Homo sapiens
ctttgattccattttaagt

SEQ ID NO: 2972886 - DNA, 13 bp, Homo sapiens
ctttgattctgat

SEQ ID NO: 2972887 - DNA, 14 bp, Homo sapiens
ctttgatttaactg

SEQ ID NO: 2972888 - DNA, 22 bp, Homo sapiens
ctttgcaggcggccctcagtgc

SEQ ID NO: 2972889 - DNA, 23 bp, Homo sapiens
ctttgcagttcctcttcatctgt

SEQ ID NO: 2972890 - DNA, 15 bp, Homo sapiens
ctttgcatcatagaa

SEQ ID NO: 2972891 - DNA, 22 bp, Homo sapiens
ctttgcatttggaatttttgct

SEQ ID NO: 2972892 - DNA, 19 bp, Homo sapiens
ctttgccagtcattcagca

SEQ ID NO: 2972893 - DNA, 20 bp, Homo sapiens
ctttgccataactttatgaa

SEQ ID NO: 2972894 - DNA, 20 bp, Homo sapiens
ctttgcccacacacactcct

SEQ ID NO: 2972895 - DNA, 21 bp, Homo sapiens
ctttgcccacacacactcctt

SEQ ID NO: 2972896 - DNA, 14 bp, Homo sapiens
ctttgcccatggaa

SEQ ID NO: 2972897 - DNA, 21 bp, Homo sapiens
ctttgcctccagaagcactgg

SEQ ID NO: 2972898 - DNA, 14 bp, Homo sapiens
ctttgcctgttcag

SEQ ID NO: 2972899 - DNA, 16 bp, Homo sapiens
ctttgcctgttcagtt

SEQ ID NO: 2972900 - DNA, 16 bp, Homo sapiens
ctttgcggggcctgtc

SEQ ID NO: 2972901 - DNA, 18 bp, Homo sapiens
ctttgcggggcctgtctc

SEQ ID NO: 2972902 - DNA, 16 bp, Homo sapiens
ctttgctatgtaaggg

SEQ ID NO: 2972903 - DNA, 18 bp, Homo sapiens
ctttgctgaatgtcatta

SEQ ID NO: 2972904 - DNA, 19 bp, Homo sapiens
ctttgctgaatgtcattat

SEQ ID NO: 2972905 - DNA, 14 bp, Homo sapiens
ctttgctgctgtgg

SEQ ID NO: 2972906 - DNA, 17 bp, Homo sapiens
ctttgctgtaagatgtc

SEQ ID NO: 2972907 - DNA, 19 bp, Homo sapiens
ctttgctgtaagatgtctg

SEQ ID NO: 2972908 - DNA, 13 bp, Homo sapiens
ctttgctttctgc

SEQ ID NO: 2972909 - DNA, 15 bp, Homo sapiens
ctttgctttctgctc

SEQ ID NO: 2972910 - DNA, 16 bp, Homo sapiens
ctttgctttctgctca

SEQ ID NO: 2972911 - DNA, 11 bp, Homo sapiens
ctttgctttgc

SEQ ID NO: 2972912 - DNA, 12 bp, Homo sapiens
ctttgctttgta

SEQ ID NO: 2972913 - DNA, 14 bp, Homo sapiens
ctttgctttgtagt

SEQ ID NO: 2972914 - DNA, 20 bp, Homo sapiens
ctttggaaaatgcattgtat

SEQ ID NO: 2972915 - DNA, 16 bp, Homo sapiens
ctttggaacaagacag

SEQ ID NO: 2972916 - DNA, 18 bp, Homo sapiens
ctttggaacaagacagcc

SEQ ID NO: 2972917 - DNA, 22 bp, Homo sapiens
ctttggaacaagacagccttca

SEQ ID NO: 2972918 - DNA, 17 bp, Homo sapiens
ctttggaagatgcagaa

SEQ ID NO: 2972919 - DNA, 21 bp, Homo sapiens
ctttggaagatgcagaagcaa

SEQ ID NO: 2972920 - DNA, 13 bp, Homo sapiens
ctttggaagcact

SEQ ID NO: 2972921 - DNA, 14 bp, Homo sapiens
ctttggaagcactt

SEQ ID NO: 2972922 - DNA, 19 bp, Homo sapiens
ctttggaagcactttttct

SEQ ID NO: 2972923 - DNA, 18 bp, Homo sapiens
ctttggacagaagcagct

SEQ ID NO: 2972924 - DNA, 19 bp, Homo sapiens
ctttggacagaagcagctc

SEQ ID NO: 2972925 - DNA, 21 bp, Homo sapiens
ctttggacagaagcagctctt

SEQ ID NO: 2972926 - DNA, 12 bp, Homo sapiens
ctttggacttgt

SEQ ID NO: 2972927 - DNA, 14 bp, Homo sapiens
ctttggcagagttc

SEQ ID NO: 2972928 - DNA, 14 bp, Homo sapiens
ctttggcatgttta

SEQ ID NO: 2972929 - DNA, 16 bp, Homo sapiens
ctttggcatgtttaat

SEQ ID NO: 2972930 - DNA, 19 bp, Homo sapiens
ctttggctatgagggcctt

SEQ ID NO: 2972931 - DNA, 21 bp, Homo sapiens
ctttgggccagacatgccaca

SEQ ID NO: 2972932 - DNA, 14 bp, Homo sapiens
ctttgggccctgca

SEQ ID NO: 2972933 - DNA, 20 bp, Homo sapiens
ctttgggtcatttttaacta

SEQ ID NO: 2972934 - DNA, 20 bp, Homo sapiens
ctttgggtcctgggcaggtg

SEQ ID NO: 2972935 - DNA, 18 bp, Homo sapiens
ctttgggtttttaactca

SEQ ID NO: 2972936 - DNA, 18 bp, Homo sapiens
ctttggtgaacagttttg

SEQ ID NO: 2972937 - DNA, 14 bp, Homo sapiens
ctttggttttacta

SEQ ID NO: 2972938 - DNA, 14 bp, Homo sapiens
ctttgtaataaaat

SEQ ID NO: 2972939 - DNA, 16 bp, Homo sapiens
ctttgtacagcccaga

SEQ ID NO: 2972940 - DNA, 17 bp, Homo sapiens
ctttgtacagcccagag

SEQ ID NO: 2972941 - DNA, 18 bp, Homo sapiens
ctttgtagcactcaggct

SEQ ID NO: 2972942 - DNA, 18 bp, Homo sapiens
ctttgtagttactcaagc

SEQ ID NO: 2972943 - DNA, 16 bp, Homo sapiens
gactcagaagcctctg

SEQ ID NO: 2972944 - DNA, 12 bp, Homo sapiens
gactcagctctg

SEQ ID NO: 2972945 - DNA, 22 bp, Homo sapiens
gactcagctctgacattctgat

SEQ ID NO: 2972946 - DNA, 13 bp, Homo sapiens
gactcagctctgt

SEQ ID NO: 2972947 - DNA, 13 bp, Homo sapiens
gactcagggcagc

SEQ ID NO: 2972948 - DNA, 18 bp, Homo sapiens
gactcagggcagcgccag

SEQ ID NO: 2972949 - DNA, 23 bp, Homo sapiens
gactcagggcagcgccaggctga

SEQ ID NO: 2972950 - DNA, 12 bp, Homo sapiens
gactcagggctc

SEQ ID NO: 2972951 - DNA, 13 bp, Homo sapiens
gactcagggctcc

SEQ ID NO: 2972952 - DNA, 18 bp, Homo sapiens
gactcaggtggtgtcctt

SEQ ID NO: 2972953 - DNA, 21 bp, Homo sapiens
gactcaggtggtgtccttctt

SEQ ID NO: 2972954 - DNA, 23 bp, Homo sapiens
gactcaggtggtgtccttcttcc

SEQ ID NO: 2972955 - DNA, 14 bp, Homo sapiens
gactcagtgcagat

SEQ ID NO: 2972956 - DNA, 13 bp, Homo sapiens
gactcatgaggag

SEQ ID NO: 2972957 - DNA, 15 bp, Homo sapiens
gactcatgaggaggg

SEQ ID NO: 2972958 - DNA, 17 bp, Homo sapiens
gactccaggccagctcc

SEQ ID NO: 2972959 - DNA, 18 bp, Homo sapiens
gactccaggcccaaggct

SEQ ID NO: 2972960 - DNA, 22 bp, Homo sapiens
gactcccccaaccaaggaagga

SEQ ID NO: 2972961 - DNA, 23 bp, Homo sapiens
gactcccgccccgggctggccct

SEQ ID NO: 2972962 - DNA, 15 bp, Homo sapiens
gactccctccccacc

SEQ ID NO: 2972963 - DNA, 22 bp, Homo sapiens
gactccggccctcctaccctgc

SEQ ID NO: 2972964 - DNA, 19 bp, Homo sapiens
gactcctccccaccctcct

SEQ ID NO: 2972965 - DNA, 20 bp, Homo sapiens
gactcctccccaccctcctg

SEQ ID NO: 2972966 - DNA, 20 bp, Homo sapiens
gactcctttggtatttcact

SEQ ID NO: 2972967 - DNA, 16 bp, Homo sapiens
gactctagcaaggctc

SEQ ID NO: 2972968 - DNA, 18 bp, Homo sapiens
gactctcagtctctgagc

SEQ ID NO: 2972969 - DNA, 18 bp, Homo sapiens
gactctcctgcctcagcc

SEQ ID NO: 2972970 - DNA, 12 bp, Homo sapiens
gactctgcacat

SEQ ID NO: 2972971 - DNA, 19 bp, Homo sapiens
gactctgcacatgtcttgt

SEQ ID NO: 2972972 - DNA, 18 bp, Homo sapiens
gactctggacaatctcac

SEQ ID NO: 2972973 - DNA, 16 bp, Homo sapiens
gactctgtccagctcc

SEQ ID NO: 2972974 - DNA, 17 bp, Homo sapiens
gactcttaagttttgtt

SEQ ID NO: 2972975 - DNA, 14 bp, Homo sapiens
gactcttccaccag

SEQ ID NO: 2972976 - DNA, 17 bp, Homo sapiens
gactcttccaccagagc

SEQ ID NO: 2972977 - DNA, 22 bp, Homo sapiens
gactcttccaccagagcagggg

SEQ ID NO: 2972978 - DNA, 16 bp, Homo sapiens
gactctttatgcttgc

SEQ ID NO: 2972979 - DNA, 17 bp, Homo sapiens
gactgaaaacctctcct

SEQ ID NO: 2972980 - DNA, 18 bp, Homo sapiens
gactgaaaacctctcctc

SEQ ID NO: 2972981 - DNA, 20 bp, Homo sapiens
gactgaaagaagaacagctg

SEQ ID NO: 2972982 - DNA, 19 bp, Homo sapiens
gactgaaattacgggtacc

SEQ ID NO: 2972983 - DNA, 19 bp, Homo sapiens
gactgacctggtccacagg

SEQ ID NO: 2972984 - DNA, 20 bp, Homo sapiens
gactgacctggtccacaggg

SEQ ID NO: 2972985 - DNA, 22 bp, Homo sapiens
gactgacctggtccacagggca

SEQ ID NO: 2972986 - DNA, 17 bp, Homo sapiens
gactgagcgaggaaaaa

SEQ ID NO: 2972987 - DNA, 18 bp, Homo sapiens
gactgagctctccaggcc

SEQ ID NO: 2972988 - DNA, 19 bp, Homo sapiens
gactgagctctccaggcca

SEQ ID NO: 2972989 - DNA, 19 bp, Homo sapiens
gactgatccctggccactg

SEQ ID NO: 2972990 - DNA, 13 bp, Homo sapiens
gactgattttaat

SEQ ID NO: 2972991 - DNA, 21 bp, Homo sapiens
gactgcacagcgtcctgtcca

SEQ ID NO: 2972992 - DNA, 13 bp, Homo sapiens
gactgcaccaaca

SEQ ID NO: 2972993 - DNA, 16 bp, Homo sapiens
gactgcagtcggcatg

SEQ ID NO: 2972994 - DNA, 19 bp, Homo sapiens
gactgcagtcggcatgcca

SEQ ID NO: 2972995 - DNA, 13 bp, Homo sapiens
gactgcccagcca

SEQ ID NO: 2972996 - DNA, 14 bp, Homo sapiens
gactgcccagccac

SEQ ID NO: 2972997 - DNA, 20 bp, Homo sapiens
gactgcccagccactccaag

SEQ ID NO: 2972998 - DNA, 22 bp, Homo sapiens
gactgcccagccactccaagcc

SEQ ID NO: 2972999 - DNA, 14 bp, Homo sapiens
gactgccccagcca

SEQ ID NO: 2973000 - DNA, 12 bp, Homo sapiens
gactgcctccct

SEQ ID NO: 2973001 - DNA, 11 bp, Homo sapiens
gactgcctgtc

SEQ ID NO: 2973002 - DNA, 15 bp, Homo sapiens
gactgcctgtctcca

SEQ ID NO: 2973003 - DNA, 14 bp, Homo sapiens
gactgctgacccac

SEQ ID NO: 2973004 - DNA, 16 bp, Homo sapiens
gactgctgacccacca

SEQ ID NO: 2973005 - DNA, 15 bp, Homo sapiens
gactgctgctcccca

SEQ ID NO: 2973006 - DNA, 19 bp, Homo sapiens
gactgctgctccccacccc

SEQ ID NO: 2973007 - DNA, 13 bp, Homo sapiens
gactggacagctt

SEQ ID NO: 2973008 - DNA, 15 bp, Homo sapiens
gactggacagcttgt

SEQ ID NO: 2973009 - DNA, 14 bp, Homo sapiens
gactggaccagaca

SEQ ID NO: 2973010 - DNA, 19 bp, Homo sapiens
gactggcagtcgcacacac

SEQ ID NO: 2973011 - DNA, 12 bp, Homo sapiens
gactggccaggg

SEQ ID NO: 2973012 - DNA, 17 bp, Homo sapiens
gactggccgggcaggcg

SEQ ID NO: 2973013 - DNA, 23 bp, Homo sapiens
gactggccgggcaggcgtgactc

SEQ ID NO: 2973014 - DNA, 17 bp, Homo sapiens
gactggccgtggctcca

SEQ ID NO: 2973015 - DNA, 18 bp, Homo sapiens
gactggccgtggctccag

SEQ ID NO: 2973016 - DNA, 19 bp, Homo sapiens
gactggccgtggctccaga

SEQ ID NO: 2973017 - DNA, 23 bp, Homo sapiens
gactggcttttattaatgcactt

SEQ ID NO: 2973018 - DNA, 19 bp, Homo sapiens
gactgggccatgggtcctc

SEQ ID NO: 2973019 - DNA, 16 bp, Homo sapiens
gactgggcccaggcag

SEQ ID NO: 2973020 - DNA, 12 bp, Homo sapiens
gactgggctctg

SEQ ID NO: 2973021 - DNA, 15 bp, Homo sapiens
gactgggctctggct

SEQ ID NO: 2973022 - DNA, 14 bp, Homo sapiens
gactgggctgaggg

SEQ ID NO: 2973023 - DNA, 15 bp, Homo sapiens
gactgggctgaggga

SEQ ID NO: 2973024 - DNA, 21 bp, Homo sapiens
gactgggctgagggagcctgg

SEQ ID NO: 2973025 - DNA, 16 bp, Homo sapiens
gactgggctgggtttg

SEQ ID NO: 2973026 - DNA, 14 bp, Homo sapiens
gactgggggccaga

SEQ ID NO: 2973027 - DNA, 22 bp, Homo sapiens
gactggggtaagcggaataaac

SEQ ID NO: 2973028 - DNA, 16 bp, Homo sapiens
gactgggtctgacctg

SEQ ID NO: 2973029 - DNA, 17 bp, Homo sapiens
gactgggtctgacctgg

SEQ ID NO: 2973030 - DNA, 14 bp, Homo sapiens
gactggtaggagga

SEQ ID NO: 2973031 - DNA, 19 bp, Homo sapiens
gactggtaggaggaggcat

SEQ ID NO: 2973032 - DNA, 15 bp, Homo sapiens
gactggtgctgcagc

SEQ ID NO: 2973033 - DNA, 22 bp, Homo sapiens
gactggtgttatcaccgtgggc

SEQ ID NO: 2973034 - DNA, 16 bp, Homo sapiens
gactgtatttgtgact

SEQ ID NO: 2973035 - DNA, 17 bp, Homo sapiens
gactgtatttgtgacta

SEQ ID NO: 2973036 - DNA, 16 bp, Homo sapiens
gactgtcagggagggc

SEQ ID NO: 2973037 - DNA, 22 bp, Homo sapiens
gactgtcagggagggccaggga

SEQ ID NO: 2973038 - DNA, 22 bp, Homo sapiens
gactgtgcggcacaggaaacag

SEQ ID NO: 2973039 - DNA, 16 bp, Homo sapiens
gactgtggagctctgg

SEQ ID NO: 2973040 - DNA, 18 bp, Homo sapiens
gactgtttttcggacagt

SEQ ID NO: 2973041 - DNA, 16 bp, Homo sapiens
gacttacaaccttgtc

SEQ ID NO: 2973042 - DNA, 15 bp, Homo sapiens
gacttactctaagat

SEQ ID NO: 2973043 - DNA, 17 bp, Homo sapiens
gacttagaaacaatgtt

SEQ ID NO: 2973044 - DNA, 17 bp, Homo sapiens
gacttagatattaaaat

SEQ ID NO: 2973045 - DNA, 22 bp, Homo sapiens
gacttagttatttctgcctata

SEQ ID NO: 2973046 - DNA, 15 bp, Homo sapiens
gacttatgaaacttg

SEQ ID NO: 2973047 - DNA, 17 bp, Homo sapiens
gacttcaaagcaagctg

SEQ ID NO: 2973048 - DNA, 22 bp, Homo sapiens
gacttcacgaagtgttgcatgg

SEQ ID NO: 2973049 - DNA, 13 bp, Homo sapiens
gacttcaggtgga

SEQ ID NO: 2973050 - DNA, 18 bp, Homo sapiens
gacttcagtcctggtctg

SEQ ID NO: 2973051 - DNA, 21 bp, Homo sapiens
gacttcatcaaacatgggttt

SEQ ID NO: 2973052 - DNA, 12 bp, Homo sapiens
gacttccaaaga

SEQ ID NO: 2973053 - DNA, 16 bp, Homo sapiens
gacttccaaagaatgt

SEQ ID NO: 2973054 - DNA, 14 bp, Homo sapiens
gacttccacatttt

SEQ ID NO: 2973055 - DNA, 13 bp, Homo sapiens
gacttcccagcta

SEQ ID NO: 2973056 - DNA, 18 bp, Homo sapiens
gacttcccagctaggaag

SEQ ID NO: 2973057 - DNA, 23 bp, Homo sapiens
gacttccccgcattccaggctcc

SEQ ID NO: 2973058 - DNA, 21 bp, Homo sapiens
gacttccctaacacttacccc

SEQ ID NO: 2973059 - DNA, 16 bp, Homo sapiens
gacttccttgagacac

SEQ ID NO: 2973060 - DNA, 21 bp, Homo sapiens
gacttctcttccagtttctgt

SEQ ID NO: 2973061 - DNA, 16 bp, Homo sapiens
gacttctgaaaaatga

SEQ ID NO: 2973062 - DNA, 18 bp, Homo sapiens
gacttcttttcacattct

SEQ ID NO: 2973063 - DNA, 19 bp, Homo sapiens
gacttcttttcacattctt

SEQ ID NO: 2973064 - DNA, 21 bp, Homo sapiens
gacttcttttcacattcttat

SEQ ID NO: 2973065 - DNA, 21 bp, Homo sapiens
gacttgaaatacgtttgtgtt

SEQ ID NO: 2973066 - DNA, 17 bp, Homo sapiens
gacttgaactttcctgg

SEQ ID NO: 2973067 - DNA, 18 bp, Homo sapiens
gacttggagaatactgcc

SEQ ID NO: 2973068 - DNA, 18 bp, Homo sapiens
gacttgttcatttttctc

SEQ ID NO: 2973069 - DNA, 20 bp, Homo sapiens
gacttgttttaattttagag

SEQ ID NO: 2973070 - DNA, 13 bp, Homo sapiens
gactttactgggt

SEQ ID NO: 2973071 - DNA, 17 bp, Homo sapiens
gactttaggctttcagc

SEQ ID NO: 2973072 - DNA, 22 bp, Homo sapiens
gactttatctaatacctctgtg

SEQ ID NO: 2973073 - DNA, 20 bp, Homo sapiens
gactttgcagatggaaagag

SEQ ID NO: 2973074 - DNA, 16 bp, Homo sapiens
gactttggctgattta

SEQ ID NO: 2973075 - DNA, 19 bp, Homo sapiens
gagggctcagaagagcagc

SEQ ID NO: 2973076 - DNA, 23 bp, Homo sapiens
gagggctgatggattccaaacca

SEQ ID NO: 2973077 - DNA, 9 bp, Homo sapiens
gagggctgc

SEQ ID NO: 2973078 - DNA, 14 bp, Homo sapiens
gagggctggctggc

SEQ ID NO: 2973079 - DNA, 16 bp, Homo sapiens
gagggctggctggcct

SEQ ID NO: 2973080 - DNA, 18 bp, Homo sapiens
gaggggaaaggggagagg

SEQ ID NO: 2973081 - DNA, 15 bp, Homo sapiens
gaggggaacactgcc

SEQ ID NO: 2973082 - DNA, 15 bp, Homo sapiens
gaggggaaggggccg

SEQ ID NO: 2973083 - DNA, 19 bp, Homo sapiens
gaggggacgcaggcccctc

SEQ ID NO: 2973084 - DNA, 12 bp, Homo sapiens
gaggggagcagc

SEQ ID NO: 2973085 - DNA, 17 bp, Homo sapiens
gaggggagcagcggctc

SEQ ID NO: 2973086 - DNA, 17 bp, Homo sapiens
gaggggccggccctgtg

SEQ ID NO: 2973087 - DNA, 15 bp, Homo sapiens
gaggggcctgatgag

SEQ ID NO: 2973088 - DNA, 19 bp, Homo sapiens
gaggggcctttgctgccct

SEQ ID NO: 2973089 - DNA, 14 bp, Homo sapiens
gagggggcacggca

SEQ ID NO: 2973090 - DNA, 20 bp, Homo sapiens
gaggggtccctagcagccca

SEQ ID NO: 2973091 - DNA, 16 bp, Homo sapiens
gagggtgagctggtgc

SEQ ID NO: 2973092 - DNA, 19 bp, Homo sapiens
gagggtgaggttgcagtga

SEQ ID NO: 2973093 - DNA, 21 bp, Homo sapiens
gagggtgctaggcccctgtgt

SEQ ID NO: 2973094 - DNA, 13 bp, Homo sapiens
gagggtgctgccc

SEQ ID NO: 2973095 - DNA, 16 bp, Homo sapiens
gagggtttctctccca

SEQ ID NO: 2973096 - DNA, 13 bp, Homo sapiens
gaggtaccctggg

SEQ ID NO: 2973097 - DNA, 17 bp, Homo sapiens
gaggtactggtcccttc

SEQ ID NO: 2973098 - DNA, 20 bp, Homo sapiens
gaggtactggtcccttcctt

SEQ ID NO: 2973099 - DNA, 21 bp, Homo sapiens
gaggtaggtggatcacctgag

SEQ ID NO: 2973100 - DNA, 22 bp, Homo sapiens
gaggtcaacagagaaggcagga

SEQ ID NO: 2973101 - DNA, 19 bp, Homo sapiens
gaggtccaagattctggag

SEQ ID NO: 2973102 - DNA, 20 bp, Homo sapiens
gaggtcgggagttcgagacc

SEQ ID NO: 2973103 - DNA, 22 bp, Homo sapiens
gaggtcgtataatttagtccct

SEQ ID NO: 2973104 - DNA, 14 bp, Homo sapiens
gaggtctcttttct

SEQ ID NO: 2973105 - DNA, 17 bp, Homo sapiens
gaggtgaaagcataaca

SEQ ID NO: 2973106 - DNA, 15 bp, Homo sapiens
gaggtgccttcttca

SEQ ID NO: 2973107 - DNA, 20 bp, Homo sapiens
gaggtgcggccaccacccta

SEQ ID NO: 2973108 - DNA, 15 bp, Homo sapiens
gaggtggaagccctc

SEQ ID NO: 2973109 - DNA, 20 bp, Homo sapiens
gaggtggatcacagaggctt

SEQ ID NO: 2973110 - DNA, 22 bp, Homo sapiens
gaggtggccaccgggggtggct

SEQ ID NO: 2973111 - DNA, 20 bp, Homo sapiens
gaggtgggaggatcttttga

SEQ ID NO: 2973112 - DNA, 13 bp, Homo sapiens
gaggtgggaggcc

SEQ ID NO: 2973113 - DNA, 14 bp, Homo sapiens
gaggtgggaggcca

SEQ ID NO: 2973114 - DNA, 17 bp, Homo sapiens
gaggtgggggctggagg

SEQ ID NO: 2973115 - DNA, 23 bp, Homo sapiens
gaggtgggggttttggggtgggc

SEQ ID NO: 2973116 - DNA, 22 bp, Homo sapiens
gaggtggtaggatcacctgagg

SEQ ID NO: 2973117 - DNA, 22 bp, Homo sapiens
gaggtggtagtaaaacacagag

SEQ ID NO: 2973118 - DNA, 20 bp, Homo sapiens
gaggttcctaggttttgaga

SEQ ID NO: 2973119 - DNA, 22 bp, Homo sapiens
gaggttcttaaagtttgcagta

SEQ ID NO: 2973120 - DNA, 22 bp, Homo sapiens
gaggttggtttaatgcaataga

SEQ ID NO: 2973121 - DNA, 13 bp, Homo sapiens
gaggttgtagtga

SEQ ID NO: 2973122 - DNA, 13 bp, Homo sapiens
gaggttgtgggga

SEQ ID NO: 2973123 - DNA, 16 bp, Homo sapiens
gaggttgtggggaggc

SEQ ID NO: 2973124 - DNA, 18 bp, Homo sapiens
gagtaagaaatttcaggt

SEQ ID NO: 2973125 - DNA, 15 bp, Homo sapiens
gagtaattttctgat

SEQ ID NO: 2973126 - DNA, 20 bp, Homo sapiens
gagtacaaggacagacagca

SEQ ID NO: 2973127 - DNA, 13 bp, Homo sapiens
gagtacactgtgt

SEQ ID NO: 2973128 - DNA, 15 bp, Homo sapiens
gagtacactgtgtct

SEQ ID NO: 2973129 - DNA, 18 bp, Homo sapiens
gagtacactgtgtctcta

SEQ ID NO: 2973130 - DNA, 14 bp, Homo sapiens
gagtacagatactg

SEQ ID NO: 2973131 - DNA, 18 bp, Homo sapiens
gagtacattgaaggcctg

SEQ ID NO: 2973132 - DNA, 13 bp, Homo sapiens
gagtactgtgggc

SEQ ID NO: 2973133 - DNA, 14 bp, Homo sapiens
gagtactgtgggca

SEQ ID NO: 2973134 - DNA, 23 bp, Homo sapiens
gagtactgtgggcaatttagaaa

SEQ ID NO: 2973135 - DNA, 19 bp, Homo sapiens
gagtagccgagagcctgct

SEQ ID NO: 2973136 - DNA, 12 bp, Homo sapiens
gagtagctggat

SEQ ID NO: 2973137 - DNA, 11 bp, Homo sapiens
gagtaggccct

SEQ ID NO: 2973138 - DNA, 22 bp, Homo sapiens
gagtagggtagaaggaaagcat

SEQ ID NO: 2973139 - DNA, 17 bp, Homo sapiens
gagtataatgaacactc

SEQ ID NO: 2973140 - DNA, 15 bp, Homo sapiens
gagtatcagaattga

SEQ ID NO: 2973141 - DNA, 12 bp, Homo sapiens
gagtcagcacct

SEQ ID NO: 2973142 - DNA, 13 bp, Homo sapiens
gagtcagcacctt

SEQ ID NO: 2973143 - DNA, 20 bp, Homo sapiens
gagtcagcaccttggcccag

SEQ ID NO: 2973144 - DNA, 21 bp, Homo sapiens
gagtcagcaccttggcccagg

SEQ ID NO: 2973145 - DNA, 14 bp, Homo sapiens
gagtcagccaggag

SEQ ID NO: 2973146 - DNA, 21 bp, Homo sapiens
gagtcagccatgtctgtgctg

SEQ ID NO: 2973147 - DNA, 22 bp, Homo sapiens
gagtcagctgaccccctccccc

SEQ ID NO: 2973148 - DNA, 17 bp, Homo sapiens
gagtcagggacccctgc

SEQ ID NO: 2973149 - DNA, 18 bp, Homo sapiens
gagtcattcgttctgtgg

SEQ ID NO: 2973150 - DNA, 14 bp, Homo sapiens
gagtcattgctgta

SEQ ID NO: 2973151 - DNA, 15 bp, Homo sapiens
gagtccaagaatcca

SEQ ID NO: 2973152 - DNA, 12 bp, Homo sapiens
gagtccaagctg

SEQ ID NO: 2973153 - DNA, 13 bp, Homo sapiens
gagtccatcagcc

SEQ ID NO: 2973154 - DNA, 17 bp, Homo sapiens
gagtccatcagcctcca

SEQ ID NO: 2973155 - DNA, 18 bp, Homo sapiens
gagtccattatttgagtt

SEQ ID NO: 2973156 - DNA, 22 bp, Homo sapiens
gagtcccagagctgcacagggt

SEQ ID NO: 2973157 - DNA, 22 bp, Homo sapiens
gagtccctccatgcaaaagtgg

SEQ ID NO: 2973158 - DNA, 14 bp, Homo sapiens
gagtccctgcctgg

SEQ ID NO: 2973159 - DNA, 13 bp, Homo sapiens
gagtcctctgaat

SEQ ID NO: 2973160 - DNA, 16 bp, Homo sapiens
gagtctagatgtttat

SEQ ID NO: 2973161 - DNA, 22 bp, Homo sapiens
gagtctagattcaaaggttcta

SEQ ID NO: 2973162 - DNA, 14 bp, Homo sapiens
gagtctcaggagga

SEQ ID NO: 2973163 - DNA, 12 bp, Homo sapiens
gagtctccttct

SEQ ID NO: 2973164 - DNA, 12 bp, Homo sapiens
gagtctctccag

SEQ ID NO: 2973165 - DNA, 14 bp, Homo sapiens
gagtctctccagcc

SEQ ID NO: 2973166 - DNA, 11 bp, Homo sapiens
gagtctctggc

SEQ ID NO: 2973167 - DNA, 12 bp, Homo sapiens
gagtctctggct

SEQ ID NO: 2973168 - DNA, 20 bp, Homo sapiens
gagtctgttgtgtgtcatgc

SEQ ID NO: 2973169 - DNA, 20 bp, Homo sapiens
gagtcttgctctgtcgccca

SEQ ID NO: 2973170 - DNA, 14 bp, Homo sapiens
gagtctttggttct

SEQ ID NO: 2973171 - DNA, 21 bp, Homo sapiens
gagtgacagagcgagactcca

SEQ ID NO: 2973172 - DNA, 20 bp, Homo sapiens
gagtgacatagcctcatgtt

SEQ ID NO: 2973173 - DNA, 14 bp, Homo sapiens
gagtgacccagcta

SEQ ID NO: 2973174 - DNA, 22 bp, Homo sapiens
gagtgagacccagccctcatcc

SEQ ID NO: 2973175 - DNA, 18 bp, Homo sapiens
gagtgagaccctgtctca

SEQ ID NO: 2973176 - DNA, 22 bp, Homo sapiens
gagtgatacaacttcaagtgca

SEQ ID NO: 2973177 - DNA, 13 bp, Homo sapiens
gagtgcagagaaa

SEQ ID NO: 2973178 - DNA, 17 bp, Homo sapiens
gagtgcagtcctgatca

SEQ ID NO: 2973179 - DNA, 18 bp, Homo sapiens
gagtgcagtcctgatcag

SEQ ID NO: 2973180 - DNA, 23 bp, Homo sapiens
gagtgcctccccttcttgtgtcc

SEQ ID NO: 2973181 - DNA, 14 bp, Homo sapiens
gagtgcggcgtgga

SEQ ID NO: 2973182 - DNA, 13 bp, Homo sapiens
gagtggccacggc

SEQ ID NO: 2973183 - DNA, 17 bp, Homo sapiens
gagtggccacggcccag

SEQ ID NO: 2973184 - DNA, 18 bp, Homo sapiens
gagtggccacggcccagg

SEQ ID NO: 2973185 - DNA, 23 bp, Homo sapiens
gagtggccacggcccagggaggg

SEQ ID NO: 2973186 - DNA, 20 bp, Homo sapiens
gagtggccagcgccagggcc

SEQ ID NO: 2973187 - DNA, 14 bp, Homo sapiens
gagtggcctagagc

SEQ ID NO: 2973188 - DNA, 18 bp, Homo sapiens
gagtggcgtgagctgccc

SEQ ID NO: 2973189 - DNA, 24 bp, Homo sapiens
gagtggggtagaggaagacgagac

SEQ ID NO: 2973190 - DNA, 20 bp, Homo sapiens
gagtgtcaaccagacagagg

SEQ ID NO: 2973191 - DNA, 21 bp, Homo sapiens
gagtgtcaaccagacagaggg

SEQ ID NO: 2973192 - DNA, 23 bp, Homo sapiens
gagtgtccctttttgcaggggac

SEQ ID NO: 2973193 - DNA, 19 bp, Homo sapiens
gagtgtcctcttccctctc

SEQ ID NO: 2973194 - DNA, 13 bp, Homo sapiens
gagtgtctctgcc

SEQ ID NO: 2973195 - DNA, 15 bp, Homo sapiens
gagtgtctctgcctg

SEQ ID NO: 2973196 - DNA, 20 bp, Homo sapiens
gagtgtctctgcctggagca

SEQ ID NO: 2973197 - DNA, 22 bp, Homo sapiens
gagtgtctttccacggagccac

SEQ ID NO: 2973198 - DNA, 23 bp, Homo sapiens
gagtgtgagccacctaagatctc

SEQ ID NO: 2973199 - DNA, 17 bp, Homo sapiens
gagtgtgagggcagcac

SEQ ID NO: 2973200 - DNA, 12 bp, Homo sapiens
gagtgtgctgct

SEQ ID NO: 2973201 - DNA, 18 bp, Homo sapiens
gagtgtgggaagggagag

SEQ ID NO: 2973202 - DNA, 21 bp, Homo sapiens
gagtgtgtttttgcactgtct

SEQ ID NO: 2973203 - DNA, 15 bp, Homo sapiens
gagtgttatgtattt

SEQ ID NO: 2973204 - DNA, 15 bp, Homo sapiens
gagtgtttaataaag

SEQ ID NO: 2973205 - DNA, 23 bp, Homo sapiens
gagtgtttgggggacgtttctca

SEQ ID NO: 2973206 - DNA, 17 bp, Homo sapiens
gagttaaaatgtttact

SEQ ID NO: 2973207 - DNA, 21 bp, Homo sapiens
gattagtataatatttcttaa

SEQ ID NO: 2973208 - DNA, 12 bp, Homo sapiens
gattagtatttt

SEQ ID NO: 2973209 - DNA, 16 bp, Homo sapiens
gattagttttcttgtt

SEQ ID NO: 2973210 - DNA, 22 bp, Homo sapiens
gattagttttcttgttgctttg

SEQ ID NO: 2973211 - DNA, 23 bp, Homo sapiens
gattagttttcttgttgctttgt

SEQ ID NO: 2973212 - DNA, 15 bp, Homo sapiens
gattatagattctaa

SEQ ID NO: 2973213 - DNA, 21 bp, Homo sapiens
gattatagcaatgtgattttg

SEQ ID NO: 2973214 - DNA, 20 bp, Homo sapiens
gattatatcaaagtatttgt

SEQ ID NO: 2973215 - DNA, 13 bp, Homo sapiens
gattatctaccca

SEQ ID NO: 2973216 - DNA, 16 bp, Homo sapiens
gattatggttttgtga

SEQ ID NO: 2973217 - DNA, 14 bp, Homo sapiens
gattatgtattaac

SEQ ID NO: 2973218 - DNA, 18 bp, Homo sapiens
gattattatttgtacttt

SEQ ID NO: 2973219 - DNA, 14 bp, Homo sapiens
gattattttggaaa

SEQ ID NO: 2973220 - DNA, 16 bp, Homo sapiens
gattcaaaatatttaa

SEQ ID NO: 2973221 - DNA, 23 bp, Homo sapiens
gattcaaaatatttaaaaatgtc

SEQ ID NO: 2973222 - DNA, 14 bp, Homo sapiens
gattcaaggctcag

SEQ ID NO: 2973223 - DNA, 17 bp, Homo sapiens
gattcaggtatgttgcc

SEQ ID NO: 2973224 - DNA, 20 bp, Homo sapiens
gattcaggtgcagaggaagt

SEQ ID NO: 2973225 - DNA, 22 bp, Homo sapiens
gattcagttttcatttggttca

SEQ ID NO: 2973226 - DNA, 12 bp, Homo sapiens
gattcatgattt

SEQ ID NO: 2973227 - DNA, 11 bp, Homo sapiens
gattcatgtgg

SEQ ID NO: 2973228 - DNA, 23 bp, Homo sapiens
gattccaaagagtagaattgcat

SEQ ID NO: 2973229 - DNA, 22 bp, Homo sapiens
gattccatttggcagagcttct

SEQ ID NO: 2973230 - DNA, 20 bp, Homo sapiens
gattcccaggccagggctgg

SEQ ID NO: 2973231 - DNA, 17 bp, Homo sapiens
gattccccatctcaggc

SEQ ID NO: 2973232 - DNA, 16 bp, Homo sapiens
gattccccctgccctg

SEQ ID NO: 2973233 - DNA, 19 bp, Homo sapiens
gattccccctgccctgtgc

SEQ ID NO: 2973234 - DNA, 16 bp, Homo sapiens
gattcgaatgacactg

SEQ ID NO: 2973235 - DNA, 16 bp, Homo sapiens
gattcgatcttttcct

SEQ ID NO: 2973236 - DNA, 19 bp, Homo sapiens
gattcgtctgcgattttat

SEQ ID NO: 2973237 - DNA, 11 bp, Homo sapiens
gattctaaaat

SEQ ID NO: 2973238 - DNA, 22 bp, Homo sapiens
gattctaaaatgtgatgttcta

SEQ ID NO: 2973239 - DNA, 17 bp, Homo sapiens
gattctaaacagatgtc

SEQ ID NO: 2973240 - DNA, 16 bp, Homo sapiens
gattctagtacataat

SEQ ID NO: 2973241 - DNA, 21 bp, Homo sapiens
gattctagtacataattgatt

SEQ ID NO: 2973242 - DNA, 17 bp, Homo sapiens
gattctatagttctaga

SEQ ID NO: 2973243 - DNA, 13 bp, Homo sapiens
gattctcctgcct

SEQ ID NO: 2973244 - DNA, 23 bp, Homo sapiens
gattctctggctgtaaggctcta

SEQ ID NO: 2973245 - DNA, 18 bp, Homo sapiens
gattctctgtgtctaaga

SEQ ID NO: 2973246 - DNA, 19 bp, Homo sapiens
gattctgaaaccacagttt

SEQ ID NO: 2973247 - DNA, 15 bp, Homo sapiens
gattctgaagcttat

SEQ ID NO: 2973248 - DNA, 22 bp, Homo sapiens
gattctgaagcttatgtttctt

SEQ ID NO: 2973249 - DNA, 15 bp, Homo sapiens
gattctgaagtttta

SEQ ID NO: 2973250 - DNA, 14 bp, Homo sapiens
gattctgagagctg

SEQ ID NO: 2973251 - DNA, 18 bp, Homo sapiens
gattctgcagtaaatctt

SEQ ID NO: 2973252 - DNA, 19 bp, Homo sapiens
gattctgcagtaaatcttt

SEQ ID NO: 2973253 - DNA, 18 bp, Homo sapiens
gattctgtgtcagagccc

SEQ ID NO: 2973254 - DNA, 22 bp, Homo sapiens
gattctgtgtcagagcccagcc

SEQ ID NO: 2973255 - DNA, 16 bp, Homo sapiens
gattcttctgtgttta

SEQ ID NO: 2973256 - DNA, 23 bp, Homo sapiens
gattcttttctataatgtgcctg

SEQ ID NO: 2973257 - DNA, 21 bp, Homo sapiens
gattgaaaacttttctcagat

SEQ ID NO: 2973258 - DNA, 13 bp, Homo sapiens
gattgaaagtatg

SEQ ID NO: 2973259 - DNA, 11 bp, Homo sapiens
gattgaacttt

SEQ ID NO: 2973260 - DNA, 14 bp, Homo sapiens
gattgaatgctgcc

SEQ ID NO: 2973261 - DNA, 16 bp, Homo sapiens
gattgaatgtgtgatg

SEQ ID NO: 2973262 - DNA, 15 bp, Homo sapiens
gattgaattccatta

SEQ ID NO: 2973263 - DNA, 19 bp, Homo sapiens
gattgagtaatgggatttg

SEQ ID NO: 2973264 - DNA, 21 bp, Homo sapiens
gattgagtaatgggatttgaa

SEQ ID NO: 2973265 - DNA, 18 bp, Homo sapiens
gattgcaatatctgaagc

SEQ ID NO: 2973266 - DNA, 13 bp, Homo sapiens
gattgctaaatgt

SEQ ID NO: 2973267 - DNA, 21 bp, Homo sapiens
gattgcttttattacattagt

SEQ ID NO: 2973268 - DNA, 14 bp, Homo sapiens
gattggccctgccc

SEQ ID NO: 2973269 - DNA, 15 bp, Homo sapiens
gattggccctgcccc

SEQ ID NO: 2973270 - DNA, 18 bp, Homo sapiens
gattggccctgcccctcc

SEQ ID NO: 2973271 - DNA, 22 bp, Homo sapiens
gattggccctgcccctccccct

SEQ ID NO: 2973272 - DNA, 22 bp, Homo sapiens
gattggcgggtccacttgccag

SEQ ID NO: 2973273 - DNA, 20 bp, Homo sapiens
gattgggcagaatcctgggc

SEQ ID NO: 2973274 - DNA, 23 bp, Homo sapiens
gattgtagtatttagtatatgaa

SEQ ID NO: 2973275 - DNA, 16 bp, Homo sapiens
gattgtgccagagcat

SEQ ID NO: 2973276 - DNA, 11 bp, Homo sapiens
gattgtttcta

SEQ ID NO: 2973277 - DNA, 15 bp, Homo sapiens
gattgtttgcacaga

SEQ ID NO: 2973278 - DNA, 19 bp, Homo sapiens
gattgtttgcacagagggc

SEQ ID NO: 2973279 - DNA, 13 bp, Homo sapiens
gatttaaaaagtg

SEQ ID NO: 2973280 - DNA, 15 bp, Homo sapiens
gatttaaaagggaag

SEQ ID NO: 2973281 - DNA, 17 bp, Homo sapiens
gatttaagttacaatgt

SEQ ID NO: 2973282 - DNA, 16 bp, Homo sapiens
gatttaagttcctgct

SEQ ID NO: 2973283 - DNA, 17 bp, Homo sapiens
gatttaatagtgttaat

SEQ ID NO: 2973284 - DNA, 12 bp, Homo sapiens
gatttaattctc

SEQ ID NO: 2973285 - DNA, 13 bp, Homo sapiens
gatttaattctct

SEQ ID NO: 2973286 - DNA, 15 bp, Homo sapiens
gatttaattctcttg

SEQ ID NO: 2973287 - DNA, 20 bp, Homo sapiens
gatttagaagtgtcatgttt

SEQ ID NO: 2973288 - DNA, 19 bp, Homo sapiens
gatttagcaatgctgtgaa

SEQ ID NO: 2973289 - DNA, 13 bp, Homo sapiens
gatttagtagtgt

SEQ ID NO: 2973290 - DNA, 20 bp, Homo sapiens
gatttatattactgtctttt

SEQ ID NO: 2973291 - DNA, 12 bp, Homo sapiens
gatttatcaaat

SEQ ID NO: 2973292 - DNA, 15 bp, Homo sapiens
gatttatcaaatcag

SEQ ID NO: 2973293 - DNA, 14 bp, Homo sapiens
gatttatcactttt

SEQ ID NO: 2973294 - DNA, 15 bp, Homo sapiens
gatttattgaaattt

SEQ ID NO: 2973295 - DNA, 16 bp, Homo sapiens
gatttatttgtttgat

SEQ ID NO: 2973296 - DNA, 21 bp, Homo sapiens
gatttatttttaatatgttga

SEQ ID NO: 2973297 - DNA, 22 bp, Homo sapiens
gatttcaggtcaactctgaaga

SEQ ID NO: 2973298 - DNA, 18 bp, Homo sapiens
gatttccaagaatcggca

SEQ ID NO: 2973299 - DNA, 19 bp, Homo sapiens
gatttcccactgcactcca

SEQ ID NO: 2973300 - DNA, 20 bp, Homo sapiens
gatttcccactgcactccag

SEQ ID NO: 2973301 - DNA, 21 bp, Homo sapiens
gatttcccactgcactccagc

SEQ ID NO: 2973302 - DNA, 13 bp, Homo sapiens
gatttccttgaat

SEQ ID NO: 2973303 - DNA, 22 bp, Homo sapiens
gatttccttgaatgtggcttga

SEQ ID NO: 2973304 - DNA, 17 bp, Homo sapiens
gatttctagaaaagctt

SEQ ID NO: 2973305 - DNA, 11 bp, Homo sapiens
gatttcttagg

SEQ ID NO: 2973306 - DNA, 17 bp, Homo sapiens
gatttctttatataagg

SEQ ID NO: 2973307 - DNA, 19 bp, Homo sapiens
gatttctttgctgtaagat

SEQ ID NO: 2973308 - DNA, 13 bp, Homo sapiens
gatttgacctcct

SEQ ID NO: 2973309 - DNA, 14 bp, Homo sapiens
gatttgagtttcct

SEQ ID NO: 2973310 - DNA, 15 bp, Homo sapiens
gatttgatgcttttc

SEQ ID NO: 2973311 - DNA, 17 bp, Homo sapiens
gatttgatgcttttctc

SEQ ID NO: 2973312 - DNA, 18 bp, Homo sapiens
gatttgatgcttttctct

SEQ ID NO: 2973313 - DNA, 14 bp, Homo sapiens
gatttgcaggattt

SEQ ID NO: 2973314 - DNA, 21 bp, Homo sapiens
gatttgcattgaacacaaact

SEQ ID NO: 2973315 - DNA, 23 bp, Homo sapiens
gatttgggtggaaaacagggtgc

SEQ ID NO: 2973316 - DNA, 18 bp, Homo sapiens
gatttggtgatggaaaaa

SEQ ID NO: 2973317 - DNA, 20 bp, Homo sapiens
gatttggtgatggaaaaagc

SEQ ID NO: 2973318 - DNA, 14 bp, Homo sapiens
gatttgttttgaat

SEQ ID NO: 2973319 - DNA, 16 bp, Homo sapiens
gatttgttttgaattt

SEQ ID NO: 2973320 - DNA, 15 bp, Homo sapiens
gattttaaactagat

SEQ ID NO: 2973321 - DNA, 21 bp, Homo sapiens
gattttaaactagatgacctc

SEQ ID NO: 2973322 - DNA, 22 bp, Homo sapiens
gattttaaactagatgacctca

SEQ ID NO: 2973323 - DNA, 16 bp, Homo sapiens
gattttaactctgtct

SEQ ID NO: 2973324 - DNA, 19 bp, Homo sapiens
gattttacaattgaaatga

SEQ ID NO: 2973325 - DNA, 15 bp, Homo sapiens
gattttagagttctt

SEQ ID NO: 2973326 - DNA, 20 bp, Homo sapiens
gattttagctaggatttgaa

SEQ ID NO: 2973327 - DNA, 24 bp, Homo sapiens
gattttagctaggatttgaacact

SEQ ID NO: 2973328 - DNA, 15 bp, Homo sapiens
gattttatattttct

SEQ ID NO: 2973329 - DNA, 19 bp, Homo sapiens
gattttatattttctattt

SEQ ID NO: 2973330 - DNA, 17 bp, Homo sapiens
gattttatctgttaacc

SEQ ID NO: 2973331 - DNA, 15 bp, Homo sapiens
gattttcctaaggcc

SEQ ID NO: 2973332 - DNA, 21 bp, Homo sapiens
gattttcctgaaacactaaag

SEQ ID NO: 2973333 - DNA, 24 bp, Homo sapiens
gattttctttaaaagaatgggcag

SEQ ID NO: 2973334 - DNA, 13 bp, Homo sapiens
gattttgaaggaa

SEQ ID NO: 2973335 - DNA, 17 bp, Homo sapiens
gattttgtaagaagttt

SEQ ID NO: 2973336 - DNA, 21 bp, Homo sapiens
gatttttaaaaaatattttct

SEQ ID NO: 2973337 - DNA, 13 bp, Homo sapiens
gatttttaaaatg

SEQ ID NO: 2973338 - DNA, 14 bp, Homo sapiens
gatttttaattaaa

SEQ ID NO: 2973339 - DNA, 20 bp, Homo sapiens
gcagcaagaaaaaaaaatgc

SEQ ID NO: 2973340 - DNA, 14 bp, Homo sapiens
gcagcaatctttga

SEQ ID NO: 2973341 - DNA, 16 bp, Homo sapiens
gcagcaccgaggggcc

SEQ ID NO: 2973342 - DNA, 20 bp, Homo sapiens
gcagcaccgaggggcctttg

SEQ ID NO: 2973343 - DNA, 19 bp, Homo sapiens
gcagcaccgttctgtgcac

SEQ ID NO: 2973344 - DNA, 12 bp, Homo sapiens
gcagcacctctg

SEQ ID NO: 2973345 - DNA, 20 bp, Homo sapiens
gcagcacggcccggcccctc

SEQ ID NO: 2973346 - DNA, 17 bp, Homo sapiens
gcagcactgctgcctca

SEQ ID NO: 2973347 - DNA, 20 bp, Homo sapiens
gcagcactgctgcctcagct

SEQ ID NO: 2973348 - DNA, 21 bp, Homo sapiens
gcagcactgctgcctcagctc

SEQ ID NO: 2973349 - DNA, 21 bp, Homo sapiens
gcagcactgggaagctggagt

SEQ ID NO: 2973350 - DNA, 21 bp, Homo sapiens
gcagcagattggaaggagaca

SEQ ID NO: 2973351 - DNA, 21 bp, Homo sapiens
gcagcagcatcccagccttga

SEQ ID NO: 2973352 - DNA, 15 bp, Homo sapiens
gcagcagggatgccc

SEQ ID NO: 2973353 - DNA, 17 bp, Homo sapiens
gcagcagggctaccctg

SEQ ID NO: 2973354 - DNA, 19 bp, Homo sapiens
gcagcagggctaccctgag

SEQ ID NO: 2973355 - DNA, 20 bp, Homo sapiens
gcagcagtgtgaggccaggg

SEQ ID NO: 2973356 - DNA, 16 bp, Homo sapiens
gcagcatcccagcctt

SEQ ID NO: 2973357 - DNA, 15 bp, Homo sapiens
gcagccagcccagcc

SEQ ID NO: 2973358 - DNA, 15 bp, Homo sapiens
gcagccaggcctcgc

SEQ ID NO: 2973359 - DNA, 22 bp, Homo sapiens
gcagccaggcctcgcctgccct

SEQ ID NO: 2973360 - DNA, 16 bp, Homo sapiens
gcagccaggctgggcc

SEQ ID NO: 2973361 - DNA, 16 bp, Homo sapiens
gcagcccaacagcact

SEQ ID NO: 2973362 - DNA, 18 bp, Homo sapiens
gcagcccaacagcacttt

SEQ ID NO: 2973363 - DNA, 11 bp, Homo sapiens
gcagcccacca

SEQ ID NO: 2973364 - DNA, 17 bp, Homo sapiens
gcagcccaccaggagca

SEQ ID NO: 2973365 - DNA, 13 bp, Homo sapiens
gcagcccaccctg

SEQ ID NO: 2973366 - DNA, 17 bp, Homo sapiens
gcagcccaccctgctgc

SEQ ID NO: 2973367 - DNA, 21 bp, Homo sapiens
gcagcccccgcgccctccctc

SEQ ID NO: 2973368 - DNA, 18 bp, Homo sapiens
gcagccctccatggtcct

SEQ ID NO: 2973369 - DNA, 13 bp, Homo sapiens
gcagccctcctca

SEQ ID NO: 2973370 - DNA, 14 bp, Homo sapiens
gcagccctctgcct

SEQ ID NO: 2973371 - DNA, 19 bp, Homo sapiens
gcagccctggcagggggca

SEQ ID NO: 2973372 - DNA, 16 bp, Homo sapiens
gcagcccttgtttata

SEQ ID NO: 2973373 - DNA, 16 bp, Homo sapiens
gcagccgtccatagca

SEQ ID NO: 2973374 - DNA, 22 bp, Homo sapiens
gcagccgtttgagaagaaaaca

SEQ ID NO: 2973375 - DNA, 21 bp, Homo sapiens
gcagcctcaacctcctgggtt

SEQ ID NO: 2973376 - DNA, 21 bp, Homo sapiens
gcagcctcccatccagggccc

SEQ ID NO: 2973377 - DNA, 18 bp, Homo sapiens
gcagcctcgcacaggccc

SEQ ID NO: 2973378 - DNA, 21 bp, Homo sapiens
gcagcctcgcacaggccctag

SEQ ID NO: 2973379 - DNA, 20 bp, Homo sapiens
gcagcctctcttcactgcta

SEQ ID NO: 2973380 - DNA, 23 bp, Homo sapiens
gcagcctgcgctcggcaggaagg

SEQ ID NO: 2973381 - DNA, 14 bp, Homo sapiens
gcagcctggggctg

SEQ ID NO: 2973382 - DNA, 13 bp, Homo sapiens
gcagcctgtgagg

SEQ ID NO: 2973383 - DNA, 22 bp, Homo sapiens
gcagcctgtgagggagtgcaga

SEQ ID NO: 2973384 - DNA, 21 bp, Homo sapiens
gcagccttgggggggctgcct

SEQ ID NO: 2973385 - DNA, 13 bp, Homo sapiens
gcagcgcctttcc

SEQ ID NO: 2973386 - DNA, 15 bp, Homo sapiens
gcagcgcgcaggcct

SEQ ID NO: 2973387 - DNA, 13 bp, Homo sapiens
gcagcggcgtcag

SEQ ID NO: 2973388 - DNA, 14 bp, Homo sapiens
gcagcggctctggt

SEQ ID NO: 2973389 - DNA, 15 bp, Homo sapiens
gcagcggctctggtc

SEQ ID NO: 2973390 - DNA, 22 bp, Homo sapiens
gcagcggctctggtcctcggag

SEQ ID NO: 2973391 - DNA, 23 bp, Homo sapiens
gcagcggctctggtcctcggagc

SEQ ID NO: 2973392 - DNA, 20 bp, Homo sapiens
gcagctagtcctagtgaacc

SEQ ID NO: 2973393 - DNA, 21 bp, Homo sapiens
gcagctagtcctagtgaacct

SEQ ID NO: 2973394 - DNA, 14 bp, Homo sapiens
gcagctcaaaggca

SEQ ID NO: 2973395 - DNA, 16 bp, Homo sapiens
gcagctcaagagatcc

SEQ ID NO: 2973396 - DNA, 19 bp, Homo sapiens
gcagctcacaccctacctt

SEQ ID NO: 2973397 - DNA, 15 bp, Homo sapiens
gcagctcagcttccc

SEQ ID NO: 2973398 - DNA, 12 bp, Homo sapiens
gcagctcctcag

SEQ ID NO: 2973399 - DNA, 13 bp, Homo sapiens
gcagctcctcagc

SEQ ID NO: 2973400 - DNA, 13 bp, Homo sapiens
gcagctctgcctt

SEQ ID NO: 2973401 - DNA, 13 bp, Homo sapiens
gcagctcttctgg

SEQ ID NO: 2973402 - DNA, 19 bp, Homo sapiens
gcagctcttctgggcagag

SEQ ID NO: 2973403 - DNA, 20 bp, Homo sapiens
gcagctcttctgggcagagc

SEQ ID NO: 2973404 - DNA, 22 bp, Homo sapiens
gcagctcttctgggcagagcct

SEQ ID NO: 2973405 - DNA, 24 bp, Homo sapiens
gcagctcttctgggcagagcctgt

SEQ ID NO: 2973406 - DNA, 19 bp, Homo sapiens
gcagctgaaatatgctggc

SEQ ID NO: 2973407 - DNA, 22 bp, Homo sapiens
gcagctgaaatatgctggctgg

SEQ ID NO: 2973408 - DNA, 18 bp, Homo sapiens
gcagctgcccctcctgga

SEQ ID NO: 2973409 - DNA, 20 bp, Homo sapiens
gcagctgcccctcctggagc

SEQ ID NO: 2973410 - DNA, 16 bp, Homo sapiens
gcagctgcccctggca

SEQ ID NO: 2973411 - DNA, 22 bp, Homo sapiens
gcagctgcccctggcacctgtg

SEQ ID NO: 2973412 - DNA, 14 bp, Homo sapiens
gcagctgcctggcc

SEQ ID NO: 2973413 - DNA, 12 bp, Homo sapiens
gcagctgctgcc

SEQ ID NO: 2973414 - DNA, 14 bp, Homo sapiens
gcagctgctgccac

SEQ ID NO: 2973415 - DNA, 23 bp, Homo sapiens
gcagctggaaaagggtcttggga

SEQ ID NO: 2973416 - DNA, 23 bp, Homo sapiens
gcagctggcccactgctggctgc

SEQ ID NO: 2973417 - DNA, 18 bp, Homo sapiens
gcagcttcggtgtgcaga

SEQ ID NO: 2973418 - DNA, 19 bp, Homo sapiens
gcagcttcggtgtgcagat

SEQ ID NO: 2973419 - DNA, 21 bp, Homo sapiens
gcaggaaatgaaaatgtcttg

SEQ ID NO: 2973420 - DNA, 23 bp, Homo sapiens
gcaggaaatgaaaatgtcttgtg

SEQ ID NO: 2973421 - DNA, 18 bp, Homo sapiens
gcaggaagctcagactgg

SEQ ID NO: 2973422 - DNA, 15 bp, Homo sapiens
gcaggaaggagcggc

SEQ ID NO: 2973423 - DNA, 21 bp, Homo sapiens
gcaggaaggagcggcgccctg

SEQ ID NO: 2973424 - DNA, 16 bp, Homo sapiens
gcaggaatttcttttt

SEQ ID NO: 2973425 - DNA, 17 bp, Homo sapiens
gcaggacaacgaggaag

SEQ ID NO: 2973426 - DNA, 19 bp, Homo sapiens
gcaggacaacgaggaagcc

SEQ ID NO: 2973427 - DNA, 17 bp, Homo sapiens
gcaggacagctcttgat

SEQ ID NO: 2973428 - DNA, 12 bp, Homo sapiens
gcaggacctctg

SEQ ID NO: 2973429 - DNA, 20 bp, Homo sapiens
gcaggacctctgaaaccctg

SEQ ID NO: 2973430 - DNA, 16 bp, Homo sapiens
gcaggacctgcctgta

SEQ ID NO: 2973431 - DNA, 14 bp, Homo sapiens
gcaggactccaggc

SEQ ID NO: 2973432 - DNA, 18 bp, Homo sapiens
gcaggactccaggcccaa

SEQ ID NO: 2973433 - DNA, 23 bp, Homo sapiens
gcaggactccaggcccaaggctc

SEQ ID NO: 2973434 - DNA, 20 bp, Homo sapiens
gcaggagaggagagccagag

SEQ ID NO: 2973435 - DNA, 20 bp, Homo sapiens
gcaggagcgtgaaggactta

SEQ ID NO: 2973436 - DNA, 22 bp, Homo sapiens
gcaggagcgtgaaggacttagc

SEQ ID NO: 2973437 - DNA, 15 bp, Homo sapiens
gcaggagggcactgg

SEQ ID NO: 2973438 - DNA, 22 bp, Homo sapiens
gcaggagttgggggcaggtcag

SEQ ID NO: 2973439 - DNA, 21 bp, Homo sapiens
gcaggatgaccacgcacctcc

SEQ ID NO: 2973440 - DNA, 14 bp, Homo sapiens
gcaggatttagccc

SEQ ID NO: 2973441 - DNA, 19 bp, Homo sapiens
gcaggatttgttctctgtc

SEQ ID NO: 2973442 - DNA, 20 bp, Homo sapiens
gcaggatttttagagcatta

SEQ ID NO: 2973443 - DNA, 23 bp, Homo sapiens
gcaggatttttagagcattaaaa

SEQ ID NO: 2973444 - DNA, 19 bp, Homo sapiens
gcaggcaccgggctggctg

SEQ ID NO: 2973445 - DNA, 16 bp, Homo sapiens
gcaggcagatcacctg

SEQ ID NO: 2973446 - DNA, 20 bp, Homo sapiens
gcaggcagcgcctgtcccct

SEQ ID NO: 2973447 - DNA, 13 bp, Homo sapiens
gcaggcagggctg

SEQ ID NO: 2973448 - DNA, 13 bp, Homo sapiens
gcaggcagtgtct

SEQ ID NO: 2973449 - DNA, 22 bp, Homo sapiens
gcaggcagtgtcttaaggagac

SEQ ID NO: 2973450 - DNA, 13 bp, Homo sapiens
gcaggcatggccc

SEQ ID NO: 2973451 - DNA, 15 bp, Homo sapiens
gcaggcatggccctg

SEQ ID NO: 2973452 - DNA, 16 bp, Homo sapiens
gcaggcatggccctgg

SEQ ID NO: 2973453 - DNA, 22 bp, Homo sapiens
gcaggcatggctggtgcctgaa

SEQ ID NO: 2973454 - DNA, 16 bp, Homo sapiens
gcaggccaggccagct

SEQ ID NO: 2973455 - DNA, 17 bp, Homo sapiens
gcaggccaggccagctg

SEQ ID NO: 2973456 - DNA, 15 bp, Homo sapiens
gcaggcccctctcct

SEQ ID NO: 2973457 - DNA, 16 bp, Homo sapiens
gcaggcccctctcctc

SEQ ID NO: 2973458 - DNA, 17 bp, Homo sapiens
gcaggcccctctcctcc

SEQ ID NO: 2973459 - DNA, 18 bp, Homo sapiens
gcaggcccctctcctccg

SEQ ID NO: 2973460 - DNA, 13 bp, Homo sapiens
gcaggccctgtcc

SEQ ID NO: 2973461 - DNA, 14 bp, Homo sapiens
gcaggccctgtcca

SEQ ID NO: 2973462 - DNA, 15 bp, Homo sapiens
gcaggccctgtccag

SEQ ID NO: 2973463 - DNA, 18 bp, Homo sapiens
gcaggccctgtccagccc

SEQ ID NO: 2973464 - DNA, 13 bp, Homo sapiens
gcaggcctaggtg

SEQ ID NO: 2973465 - DNA, 16 bp, Homo sapiens
gcaggcctccctgaaa

SEQ ID NO: 2973466 - DNA, 21 bp, Homo sapiens
gcaggcctccctgaaacactg

SEQ ID NO: 2973467 - DNA, 14 bp, Homo sapiens
gcaggcctccctgc

SEQ ID NO: 2973468 - DNA, 23 bp, Homo sapiens
gcaggcctcgaaaaccatcacat

SEQ ID NO: 2973469 - DNA, 14 bp, Homo sapiens
gcaggcctttccta

SEQ ID NO: 2973470 - DNA, 14 bp, Homo sapiens
gcaggcggccaggg

SEQ ID NO: 2973471 - DNA, 16 bp, Homo sapiens
gccaccacccaacctg

SEQ ID NO: 2973472 - DNA, 20 bp, Homo sapiens
gccaccacccaacctgtcct

SEQ ID NO: 2973473 - DNA, 14 bp, Homo sapiens
gccaccagcatcca

SEQ ID NO: 2973474 - DNA, 21 bp, Homo sapiens
gccacccacctccctgcctcc

SEQ ID NO: 2973475 - DNA, 17 bp, Homo sapiens
gccacccattcttcccg

SEQ ID NO: 2973476 - DNA, 20 bp, Homo sapiens
gccacccccagccctggccc

SEQ ID NO: 2973477 - DNA, 15 bp, Homo sapiens
gccacccccgccccc

SEQ ID NO: 2973478 - DNA, 23 bp, Homo sapiens
gccacccccgcccccaccgggct

SEQ ID NO: 2973479 - DNA, 15 bp, Homo sapiens
gccacccctgccact

SEQ ID NO: 2973480 - DNA, 21 bp, Homo sapiens
gccacccctgccactcaccct

SEQ ID NO: 2973481 - DNA, 12 bp, Homo sapiens
gccacccttccc

SEQ ID NO: 2973482 - DNA, 16 bp, Homo sapiens
gccacccttccctgcc

SEQ ID NO: 2973483 - DNA, 23 bp, Homo sapiens
gccacccttccctgcctccagct

SEQ ID NO: 2973484 - DNA, 15 bp, Homo sapiens
gccaccgcagctgct

SEQ ID NO: 2973485 - DNA, 19 bp, Homo sapiens
gccaccgcagctgctgcca

SEQ ID NO: 2973486 - DNA, 23 bp, Homo sapiens
gccaccgcagctgctgccactct

SEQ ID NO: 2973487 - DNA, 16 bp, Homo sapiens
gccaccgcctcctaca

SEQ ID NO: 2973488 - DNA, 22 bp, Homo sapiens
gccaccgggcatgtctgcctgg

SEQ ID NO: 2973489 - DNA, 23 bp, Homo sapiens
gccaccggggcaagagggaaggt

SEQ ID NO: 2973490 - DNA, 20 bp, Homo sapiens
gccacctcaccctctccgca

SEQ ID NO: 2973491 - DNA, 12 bp, Homo sapiens
gccacctcccct

SEQ ID NO: 2973492 - DNA, 17 bp, Homo sapiens
gccacctcccctatcca

SEQ ID NO: 2973493 - DNA, 20 bp, Homo sapiens
gccacctcccctatccaccc

SEQ ID NO: 2973494 - DNA, 22 bp, Homo sapiens
gccacctcccctatccacccag

SEQ ID NO: 2973495 - DNA, 12 bp, Homo sapiens
gccaccttccca

SEQ ID NO: 2973496 - DNA, 16 bp, Homo sapiens
gccaccttcccacccc

SEQ ID NO: 2973497 - DNA, 17 bp, Homo sapiens
gccaccttcccacccct

SEQ ID NO: 2973498 - DNA, 22 bp, Homo sapiens
gccacgaacctcggggtggggg

SEQ ID NO: 2973499 - DNA, 15 bp, Homo sapiens
gccacgctccagctg

SEQ ID NO: 2973500 - DNA, 16 bp, Homo sapiens
gccacgctccagctgc

SEQ ID NO: 2973501 - DNA, 13 bp, Homo sapiens
gccacggcccagg

SEQ ID NO: 2973502 - DNA, 13 bp, Homo sapiens
gccacgtgccagg

SEQ ID NO: 2973503 - DNA, 14 bp, Homo sapiens
gccacgtgccaggc

SEQ ID NO: 2973504 - DNA, 17 bp, Homo sapiens
gccacgtgccttaggaa

SEQ ID NO: 2973505 - DNA, 22 bp, Homo sapiens
gccacgttccttactgcagaat

SEQ ID NO: 2973506 - DNA, 20 bp, Homo sapiens
gccactaagcagaggagggg

SEQ ID NO: 2973507 - DNA, 18 bp, Homo sapiens
gccactcacccttcctgg

SEQ ID NO: 2973508 - DNA, 20 bp, Homo sapiens
gccactccaagccccctggc

SEQ ID NO: 2973509 - DNA, 21 bp, Homo sapiens
gccactccaagccccctggca

SEQ ID NO: 2973510 - DNA, 22 bp, Homo sapiens
gccactccaagccccctggcag

SEQ ID NO: 2973511 - DNA, 22 bp, Homo sapiens
gccactccccggcatgagactc

SEQ ID NO: 2973512 - DNA, 17 bp, Homo sapiens
gccactcctctgactca

SEQ ID NO: 2973513 - DNA, 23 bp, Homo sapiens
gccactctaccagtgcaggctgg

SEQ ID NO: 2973514 - DNA, 21 bp, Homo sapiens
gccactgaaaagctttcctga

SEQ ID NO: 2973515 - DNA, 16 bp, Homo sapiens
gccactgatattcaga

SEQ ID NO: 2973516 - DNA, 12 bp, Homo sapiens
gccactggaagg

SEQ ID NO: 2973517 - DNA, 14 bp, Homo sapiens
gccactggaaggag

SEQ ID NO: 2973518 - DNA, 12 bp, Homo sapiens
gccactgggcac

SEQ ID NO: 2973519 - DNA, 21 bp, Homo sapiens
gccactgtgtttctgtgctcc

SEQ ID NO: 2973520 - DNA, 16 bp, Homo sapiens
gccacttctgtccata

SEQ ID NO: 2973521 - DNA, 13 bp, Homo sapiens
gccactttccacc

SEQ ID NO: 2973522 - DNA, 20 bp, Homo sapiens
gccagaacgtggctctgctg

SEQ ID NO: 2973523 - DNA, 12 bp, Homo sapiens
gccagaagctga

SEQ ID NO: 2973524 - DNA, 13 bp, Homo sapiens
gccagaaggaagg

SEQ ID NO: 2973525 - DNA, 16 bp, Homo sapiens
gccagacacaggccct

SEQ ID NO: 2973526 - DNA, 17 bp, Homo sapiens
gccagacacaggccctc

SEQ ID NO: 2973527 - DNA, 17 bp, Homo sapiens
gccagaccccctggaga

SEQ ID NO: 2973528 - DNA, 21 bp, Homo sapiens
gccagagaaagttggtgctgc

SEQ ID NO: 2973529 - DNA, 13 bp, Homo sapiens
gccagagaagcta

SEQ ID NO: 2973530 - DNA, 14 bp, Homo sapiens
gccagagaagtgac

SEQ ID NO: 2973531 - DNA, 15 bp, Homo sapiens
gccagagaagtgaca

SEQ ID NO: 2973532 - DNA, 18 bp, Homo sapiens
gccagagaagtgacaggg

SEQ ID NO: 2973533 - DNA, 19 bp, Homo sapiens
gccagagaagtgacaggga

SEQ ID NO: 2973534 - DNA, 16 bp, Homo sapiens
gccagagatccaaaag

SEQ ID NO: 2973535 - DNA, 12 bp, Homo sapiens
gccagagccagg

SEQ ID NO: 2973536 - DNA, 14 bp, Homo sapiens
gccagagccgggca

SEQ ID NO: 2973537 - DNA, 19 bp, Homo sapiens
gccagaggatgctctttcc

SEQ ID NO: 2973538 - DNA, 13 bp, Homo sapiens
gccagaggcacct

SEQ ID NO: 2973539 - DNA, 22 bp, Homo sapiens
gccagaggctcgttgactggct

SEQ ID NO: 2973540 - DNA, 13 bp, Homo sapiens
gccagaggtgctt

SEQ ID NO: 2973541 - DNA, 19 bp, Homo sapiens
gccagaggtgcttcaccct

SEQ ID NO: 2973542 - DNA, 19 bp, Homo sapiens
gccagagtggccacggccc

SEQ ID NO: 2973543 - DNA, 21 bp, Homo sapiens
gccagagtggccacggcccag

SEQ ID NO: 2973544 - DNA, 17 bp, Homo sapiens
gccagatgctgatgttc

SEQ ID NO: 2973545 - DNA, 19 bp, Homo sapiens
gccagatgctgatgttcag

SEQ ID NO: 2973546 - DNA, 15 bp, Homo sapiens
gccagatgctgcaga

SEQ ID NO: 2973547 - DNA, 16 bp, Homo sapiens
gccagattggccaatt

SEQ ID NO: 2973548 - DNA, 19 bp, Homo sapiens
gccagattggccaattaaa

SEQ ID NO: 2973549 - DNA, 21 bp, Homo sapiens
gccagattggccaattaaaaa

SEQ ID NO: 2973550 - DNA, 20 bp, Homo sapiens
gccagatttgtctttttgtt

SEQ ID NO: 2973551 - DNA, 12 bp, Homo sapiens
gccagatttttt

SEQ ID NO: 2973552 - DNA, 22 bp, Homo sapiens
gccagcacccagtcctctgcct

SEQ ID NO: 2973553 - DNA, 13 bp, Homo sapiens
gccagcagcctcg

SEQ ID NO: 2973554 - DNA, 14 bp, Homo sapiens
gccagcagcctcgc

SEQ ID NO: 2973555 - DNA, 19 bp, Homo sapiens
gccagcagcctcgcacagg

SEQ ID NO: 2973556 - DNA, 12 bp, Homo sapiens
gccagccacccc

SEQ ID NO: 2973557 - DNA, 17 bp, Homo sapiens
gccagccacccctgcca

SEQ ID NO: 2973558 - DNA, 15 bp, Homo sapiens
gccagccaggccctg

SEQ ID NO: 2973559 - DNA, 19 bp, Homo sapiens
gccagccagtgacctgagg

SEQ ID NO: 2973560 - DNA, 22 bp, Homo sapiens
gccagccagtgacctgaggaag

SEQ ID NO: 2973561 - DNA, 14 bp, Homo sapiens
gccagcccagccca

SEQ ID NO: 2973562 - DNA, 21 bp, Homo sapiens
gccagcccggctcggcccagc

SEQ ID NO: 2973563 - DNA, 10 bp, Homo sapiens
gccagccctc

SEQ ID NO: 2973564 - DNA, 13 bp, Homo sapiens
gccagccctccct

SEQ ID NO: 2973565 - DNA, 14 bp, Homo sapiens
gccagccctccctg

SEQ ID NO: 2973566 - DNA, 20 bp, Homo sapiens
gccagccctccctgtcctcc

SEQ ID NO: 2973567 - DNA, 21 bp, Homo sapiens
gccagccctccctgtcctcct

SEQ ID NO: 2973568 - DNA, 19 bp, Homo sapiens
gccagcccttcatatctgt

SEQ ID NO: 2973569 - DNA, 17 bp, Homo sapiens
gccagccgctctcctgc

SEQ ID NO: 2973570 - DNA, 19 bp, Homo sapiens
gccagcgccagggcccagg

SEQ ID NO: 2973571 - DNA, 20 bp, Homo sapiens
gccagcgccagggcccaggc

SEQ ID NO: 2973572 - DNA, 16 bp, Homo sapiens
gccagctccttttctg

SEQ ID NO: 2973573 - DNA, 13 bp, Homo sapiens
gccagctctgtat

SEQ ID NO: 2973574 - DNA, 23 bp, Homo sapiens
gccagctctgtatcaggacccag

SEQ ID NO: 2973575 - DNA, 14 bp, Homo sapiens
gccagctctgtcac

SEQ ID NO: 2973576 - DNA, 19 bp, Homo sapiens
gccagctctgtcaccctgg

SEQ ID NO: 2973577 - DNA, 22 bp, Homo sapiens
gccagctctgtcaccctggcca

SEQ ID NO: 2973578 - DNA, 13 bp, Homo sapiens
gccagctgcctcc

SEQ ID NO: 2973579 - DNA, 15 bp, Homo sapiens
gccagctgctcccca

SEQ ID NO: 2973580 - DNA, 16 bp, Homo sapiens
gccagctgctccccag

SEQ ID NO: 2973581 - DNA, 13 bp, Homo sapiens
gccagctggagaa

SEQ ID NO: 2973582 - DNA, 14 bp, Homo sapiens
gccagctggcagca

SEQ ID NO: 2973583 - DNA, 17 bp, Homo sapiens
gccagcttcgagctaca

SEQ ID NO: 2973584 - DNA, 18 bp, Homo sapiens
gccaggaaacaagggaag

SEQ ID NO: 2973585 - DNA, 13 bp, Homo sapiens
gccaggaagaatg

SEQ ID NO: 2973586 - DNA, 15 bp, Homo sapiens
gccaggaaggacaga

SEQ ID NO: 2973587 - DNA, 17 bp, Homo sapiens
gccaggaaggacagact

SEQ ID NO: 2973588 - DNA, 21 bp, Homo sapiens
gccaggaaggacagactggcc

SEQ ID NO: 2973589 - DNA, 16 bp, Homo sapiens
gccaggaatgtttcag

SEQ ID NO: 2973590 - DNA, 19 bp, Homo sapiens
gccaggaatgtttcagctg

SEQ ID NO: 2973591 - DNA, 23 bp, Homo sapiens
gccaggaatgtttcagctgcagt

SEQ ID NO: 2973592 - DNA, 17 bp, Homo sapiens
gccaggaatttcccagg

SEQ ID NO: 2973593 - DNA, 22 bp, Homo sapiens
gccaggaatttcccaggaccct

SEQ ID NO: 2973594 - DNA, 22 bp, Homo sapiens
gccaggaccagtcaacctgggc

SEQ ID NO: 2973595 - DNA, 20 bp, Homo sapiens
gccaggacccgccagccccg

SEQ ID NO: 2973596 - DNA, 23 bp, Homo sapiens
gccaggaggctttaagctccagc

SEQ ID NO: 2973597 - DNA, 22 bp, Homo sapiens
gccaggagggcgttcttaggct

SEQ ID NO: 2973598 - DNA, 24 bp, Homo sapiens
gccaggattggggacctgatggag

SEQ ID NO: 2973599 - DNA, 20 bp, Homo sapiens
gccaggattttgtattgcca

SEQ ID NO: 2973600 - DNA, 14 bp, Homo sapiens
gccaggcagagctg

SEQ ID NO: 2973601 - DNA, 23 bp, Homo sapiens
gccaggcagagctgagggccctg

SEQ ID NO: 2973602 - DNA, 20 bp, Homo sapiens
gccaggcccccaccacacat

SEQ ID NO: 2973603 - DNA, 16 bp, Homo sapiens
gccctccctcagccgt

SEQ ID NO: 2973604 - DNA, 14 bp, Homo sapiens
gccctccctccgcc

SEQ ID NO: 2973605 - DNA, 18 bp, Homo sapiens
gccctccctgtcctcctc

SEQ ID NO: 2973606 - DNA, 18 bp, Homo sapiens
gccctccgacctctctcg

SEQ ID NO: 2973607 - DNA, 17 bp, Homo sapiens
gccctcctaccctgcgc

SEQ ID NO: 2973608 - DNA, 13 bp, Homo sapiens
gccctcctcaccc

SEQ ID NO: 2973609 - DNA, 20 bp, Homo sapiens
gccctcctctcccattgtcc

SEQ ID NO: 2973610 - DNA, 14 bp, Homo sapiens
gccctcctctcccg

SEQ ID NO: 2973611 - DNA, 17 bp, Homo sapiens
gccctccttaccactgt

SEQ ID NO: 2973612 - DNA, 14 bp, Homo sapiens
gccctcgctgccag

SEQ ID NO: 2973613 - DNA, 15 bp, Homo sapiens
gccctctagggcagg

SEQ ID NO: 2973614 - DNA, 18 bp, Homo sapiens
gccctctagggcagggtg

SEQ ID NO: 2973615 - DNA, 21 bp, Homo sapiens
gccctctccctctaggctctg

SEQ ID NO: 2973616 - DNA, 13 bp, Homo sapiens
gccctctctcata

SEQ ID NO: 2973617 - DNA, 15 bp, Homo sapiens
gccctctgcctcctc

SEQ ID NO: 2973618 - DNA, 22 bp, Homo sapiens
gccctctgcctgcactccctgg

SEQ ID NO: 2973619 - DNA, 15 bp, Homo sapiens
gccctctgctgctgc

SEQ ID NO: 2973620 - DNA, 16 bp, Homo sapiens
gccctctggagtggcc

SEQ ID NO: 2973621 - DNA, 16 bp, Homo sapiens
gccctgaaagggccct

SEQ ID NO: 2973622 - DNA, 17 bp, Homo sapiens
gccctgaatttcttctt

SEQ ID NO: 2973623 - DNA, 14 bp, Homo sapiens
gccctgaccctgtg

SEQ ID NO: 2973624 - DNA, 17 bp, Homo sapiens
gccctgaccctgtggaa

SEQ ID NO: 2973625 - DNA, 21 bp, Homo sapiens
gccctgactgtcagggagggc

SEQ ID NO: 2973626 - DNA, 19 bp, Homo sapiens
gccctgagaaagccctgtc

SEQ ID NO: 2973627 - DNA, 13 bp, Homo sapiens
gccctgaggggct

SEQ ID NO: 2973628 - DNA, 20 bp, Homo sapiens
gccctgaggggctggggagg

SEQ ID NO: 2973629 - DNA, 18 bp, Homo sapiens
gccctgagttcctagcca

SEQ ID NO: 2973630 - DNA, 17 bp, Homo sapiens
gccctgattgtgccagt

SEQ ID NO: 2973631 - DNA, 19 bp, Homo sapiens
gccctgattgtgccagtgc

SEQ ID NO: 2973632 - DNA, 14 bp, Homo sapiens
gccctgcaaaagga

SEQ ID NO: 2973633 - DNA, 12 bp, Homo sapiens
gccctgcaggag

SEQ ID NO: 2973634 - DNA, 13 bp, Homo sapiens
gccctgcaggagc

SEQ ID NO: 2973635 - DNA, 19 bp, Homo sapiens
gccctgcaggagcagggcg

SEQ ID NO: 2973636 - DNA, 21 bp, Homo sapiens
gccctgcaggctgcaggaggg

SEQ ID NO: 2973637 - DNA, 19 bp, Homo sapiens
gccctgcatgggccagccc

SEQ ID NO: 2973638 - DNA, 20 bp, Homo sapiens
gccctgcccaagtgaccagg

SEQ ID NO: 2973639 - DNA, 13 bp, Homo sapiens
gccctgccccctc

SEQ ID NO: 2973640 - DNA, 14 bp, Homo sapiens
gccctgcccctccc

SEQ ID NO: 2973641 - DNA, 15 bp, Homo sapiens
gccctgcccctcccc

SEQ ID NO: 2973642 - DNA, 17 bp, Homo sapiens
gccctgcccctccccct

SEQ ID NO: 2973643 - DNA, 17 bp, Homo sapiens
gccctgcccctccctag

SEQ ID NO: 2973644 - DNA, 15 bp, Homo sapiens
gccctgcgggccaca

SEQ ID NO: 2973645 - DNA, 17 bp, Homo sapiens
gccctgcgggccacagg

SEQ ID NO: 2973646 - DNA, 20 bp, Homo sapiens
gccctgctatttcaggccct

SEQ ID NO: 2973647 - DNA, 21 bp, Homo sapiens
gccctgctatttcaggccctc

SEQ ID NO: 2973648 - DNA, 12 bp, Homo sapiens
gccctgctccct

SEQ ID NO: 2973649 - DNA, 17 bp, Homo sapiens
gccctgctgaagctgct

SEQ ID NO: 2973650 - DNA, 14 bp, Homo sapiens
gccctggagggcag

SEQ ID NO: 2973651 - DNA, 16 bp, Homo sapiens
gccctggagggcagag

SEQ ID NO: 2973652 - DNA, 15 bp, Homo sapiens
gccctggaggtggct

SEQ ID NO: 2973653 - DNA, 20 bp, Homo sapiens
gccctggaggtggctgagcc

SEQ ID NO: 2973654 - DNA, 18 bp, Homo sapiens
gccctggatttcagaaag

SEQ ID NO: 2973655 - DNA, 15 bp, Homo sapiens
gccctggcagggggc

SEQ ID NO: 2973656 - DNA, 16 bp, Homo sapiens
gccctggcctgctggg

SEQ ID NO: 2973657 - DNA, 22 bp, Homo sapiens
gccctgggaaaccccttctctg

SEQ ID NO: 2973658 - DNA, 23 bp, Homo sapiens
gccctgggaaaccccttctctgt

SEQ ID NO: 2973659 - DNA, 22 bp, Homo sapiens
gccctgggccccaccacctagg

SEQ ID NO: 2973660 - DNA, 14 bp, Homo sapiens
gccctgggtcctgc

SEQ ID NO: 2973661 - DNA, 18 bp, Homo sapiens
gccctgggtcctgcctgc

SEQ ID NO: 2973662 - DNA, 21 bp, Homo sapiens
gccctgggtcctgcctgcagt

SEQ ID NO: 2973663 - DNA, 19 bp, Homo sapiens
gccctggtcctggcctcct

SEQ ID NO: 2973664 - DNA, 13 bp, Homo sapiens
gccctgtccagcc

SEQ ID NO: 2973665 - DNA, 16 bp, Homo sapiens
gccctgtcgggctttg

SEQ ID NO: 2973666 - DNA, 16 bp, Homo sapiens
gccctgtggagtccag

SEQ ID NO: 2973667 - DNA, 18 bp, Homo sapiens
gccctgtggagtccagct

SEQ ID NO: 2973668 - DNA, 20 bp, Homo sapiens
gccctgtggagtccagctct

SEQ ID NO: 2973669 - DNA, 21 bp, Homo sapiens
gccctgtggatgagccctcag

SEQ ID NO: 2973670 - DNA, 18 bp, Homo sapiens
gccctgtgggaccccagg

SEQ ID NO: 2973671 - DNA, 14 bp, Homo sapiens
gccctgtgtgcagg

SEQ ID NO: 2973672 - DNA, 15 bp, Homo sapiens
gccctgtgtgcaggt

SEQ ID NO: 2973673 - DNA, 23 bp, Homo sapiens
gccctgttcctccctcccacact

SEQ ID NO: 2973674 - DNA, 17 bp, Homo sapiens
gccctgttctcctcccc

SEQ ID NO: 2973675 - DNA, 20 bp, Homo sapiens
gccctgttctcgttgcccta

SEQ ID NO: 2973676 - DNA, 19 bp, Homo sapiens
gccctgttgacacaggtct

SEQ ID NO: 2973677 - DNA, 20 bp, Homo sapiens
gccctgttgacacaggtctt

SEQ ID NO: 2973678 - DNA, 16 bp, Homo sapiens
gcccttagccttgctg

SEQ ID NO: 2973679 - DNA, 20 bp, Homo sapiens
gcccttagccttgctgtaga

SEQ ID NO: 2973680 - DNA, 20 bp, Homo sapiens
gcccttatctgtgctcagga

SEQ ID NO: 2973681 - DNA, 14 bp, Homo sapiens
gcccttcagtccct

SEQ ID NO: 2973682 - DNA, 12 bp, Homo sapiens
gcccttccagtg

SEQ ID NO: 2973683 - DNA, 22 bp, Homo sapiens
gcccttcccctcccccactcct

SEQ ID NO: 2973684 - DNA, 24 bp, Homo sapiens
gcccttcccctcccccactcctct

SEQ ID NO: 2973685 - DNA, 19 bp, Homo sapiens
gcccttcctcctccaccac

SEQ ID NO: 2973686 - DNA, 23 bp, Homo sapiens
gcccttctaggcaaaagaaaagc

SEQ ID NO: 2973687 - DNA, 16 bp, Homo sapiens
gcccttcttccccttc

SEQ ID NO: 2973688 - DNA, 12 bp, Homo sapiens
gcccttgtccca

SEQ ID NO: 2973689 - DNA, 12 bp, Homo sapiens
gcccttgtttat

SEQ ID NO: 2973690 - DNA, 22 bp, Homo sapiens
gccctttccccgacgcccaccc

SEQ ID NO: 2973691 - DNA, 18 bp, Homo sapiens
gccctttgagtgcagtcc

SEQ ID NO: 2973692 - DNA, 20 bp, Homo sapiens
gccgaactccaggctgggct

SEQ ID NO: 2973693 - DNA, 21 bp, Homo sapiens
gccgaactccaggctgggctg

SEQ ID NO: 2973694 - DNA, 19 bp, Homo sapiens
gccgaagtccagctttctg

SEQ ID NO: 2973695 - DNA, 17 bp, Homo sapiens
gccgacatccctccccc

SEQ ID NO: 2973696 - DNA, 19 bp, Homo sapiens
gccgaccagaggagccttt

SEQ ID NO: 2973697 - DNA, 13 bp, Homo sapiens
gccgacctcgtcc

SEQ ID NO: 2973698 - DNA, 20 bp, Homo sapiens
gccgacctcgtcctccccct

SEQ ID NO: 2973699 - DNA, 15 bp, Homo sapiens
gccgactcccccaac

SEQ ID NO: 2973700 - DNA, 21 bp, Homo sapiens
gccgactcccccaaccaagga

SEQ ID NO: 2973701 - DNA, 19 bp, Homo sapiens
gccgagagcctgctccccc

SEQ ID NO: 2973702 - DNA, 22 bp, Homo sapiens
gccgagagcctgctcccccacc

SEQ ID NO: 2973703 - DNA, 15 bp, Homo sapiens
gccgagggcgtcaga

SEQ ID NO: 2973704 - DNA, 21 bp, Homo sapiens
gccgatagagggacggccaag

SEQ ID NO: 2973705 - DNA, 18 bp, Homo sapiens
gccgatgggagtctccct

SEQ ID NO: 2973706 - DNA, 17 bp, Homo sapiens
gccgattcacctgagca

SEQ ID NO: 2973707 - DNA, 13 bp, Homo sapiens
gccgcactctggc

SEQ ID NO: 2973708 - DNA, 24 bp, Homo sapiens
gccgcagtggggtcaagctgagct

SEQ ID NO: 2973709 - DNA, 17 bp, Homo sapiens
gccgcatcttctccatc

SEQ ID NO: 2973710 - DNA, 15 bp, Homo sapiens
gccgccatctgcgca

SEQ ID NO: 2973711 - DNA, 14 bp, Homo sapiens
gccgcccaaggccc

SEQ ID NO: 2973712 - DNA, 19 bp, Homo sapiens
gccgccgctgaccctgggc

SEQ ID NO: 2973713 - DNA, 21 bp, Homo sapiens
gccgccgctgaccctgggcct

SEQ ID NO: 2973714 - DNA, 13 bp, Homo sapiens
gccgcctgcactc

SEQ ID NO: 2973715 - DNA, 22 bp, Homo sapiens
gccgcctgcactcctcagggca

SEQ ID NO: 2973716 - DNA, 13 bp, Homo sapiens
gccgcctggtact

SEQ ID NO: 2973717 - DNA, 18 bp, Homo sapiens
gccgccttggccttgcag

SEQ ID NO: 2973718 - DNA, 16 bp, Homo sapiens
gccgcggcccagaccc

SEQ ID NO: 2973719 - DNA, 21 bp, Homo sapiens
gccgcggccctggggcgggca

SEQ ID NO: 2973720 - DNA, 16 bp, Homo sapiens
gccgcgtggtgccatc

SEQ ID NO: 2973721 - DNA, 17 bp, Homo sapiens
gccgctacctccctccc

SEQ ID NO: 2973722 - DNA, 17 bp, Homo sapiens
gccgctgaccctgggcc

SEQ ID NO: 2973723 - DNA, 14 bp, Homo sapiens
gccgctgccaccca

SEQ ID NO: 2973724 - DNA, 17 bp, Homo sapiens
gccgctgccacccacct

SEQ ID NO: 2973725 - DNA, 14 bp, Homo sapiens
gccgctgcccgctc

SEQ ID NO: 2973726 - DNA, 15 bp, Homo sapiens
gccgctgccctgggt

SEQ ID NO: 2973727 - DNA, 18 bp, Homo sapiens
gccgctgccctgggtcct

SEQ ID NO: 2973728 - DNA, 19 bp, Homo sapiens
gccgctgcttccaggctgg

SEQ ID NO: 2973729 - DNA, 16 bp, Homo sapiens
gccggaagtggctccg

SEQ ID NO: 2973730 - DNA, 20 bp, Homo sapiens
gccggacacttctcaggaaa

SEQ ID NO: 2973731 - DNA, 17 bp, Homo sapiens
gccggacctgagcccgc

SEQ ID NO: 2973732 - DNA, 21 bp, Homo sapiens
gccggacctgagcccgcagcc

SEQ ID NO: 2973733 - DNA, 13 bp, Homo sapiens
gccggacgcaggt

SEQ ID NO: 2973734 - DNA, 15 bp, Homo sapiens
gccggagcccagata

SEQ ID NO: 2973735 - DNA, 12 bp, Homo sapiens
gcctcctggctc

SEQ ID NO: 2973736 - DNA, 17 bp, Homo sapiens
gcctcgacacagagtgg

SEQ ID NO: 2973737 - DNA, 23 bp, Homo sapiens
gcctcgcacttgcagaggagccc

SEQ ID NO: 2973738 - DNA, 16 bp, Homo sapiens
gcctcgcccccacttt

SEQ ID NO: 2973739 - DNA, 15 bp, Homo sapiens
gcctcgcctgccctc

SEQ ID NO: 2973740 - DNA, 22 bp, Homo sapiens
gcctcgcctgccctcctctccc

SEQ ID NO: 2973741 - DNA, 23 bp, Homo sapiens
gcctcgctctgttacccagggtg

SEQ ID NO: 2973742 - DNA, 20 bp, Homo sapiens
gcctcggaggctcctccctc

SEQ ID NO: 2973743 - DNA, 18 bp, Homo sapiens
gcctcggcttttctcagc

SEQ ID NO: 2973744 - DNA, 14 bp, Homo sapiens
gcctcgtgccagca

SEQ ID NO: 2973745 - DNA, 17 bp, Homo sapiens
gcctcgtgccagcagcc

SEQ ID NO: 2973746 - DNA, 19 bp, Homo sapiens
gcctcgtgccagcagcctc

SEQ ID NO: 2973747 - DNA, 24 bp, Homo sapiens
gcctcgtgccagcagcctcgcaca

SEQ ID NO: 2973748 - DNA, 19 bp, Homo sapiens
gcctctaactccctcctca

SEQ ID NO: 2973749 - DNA, 12 bp, Homo sapiens
gcctctcctcct

SEQ ID NO: 2973750 - DNA, 21 bp, Homo sapiens
gcctctcctccttgggcaggg

SEQ ID NO: 2973751 - DNA, 14 bp, Homo sapiens
gcctctcctttgta

SEQ ID NO: 2973752 - DNA, 17 bp, Homo sapiens
gcctctcctttgtatat

SEQ ID NO: 2973753 - DNA, 22 bp, Homo sapiens
gcctctcggttgaaacctgtat

SEQ ID NO: 2973754 - DNA, 18 bp, Homo sapiens
gcctctgacagcagcctg

SEQ ID NO: 2973755 - DNA, 19 bp, Homo sapiens
gcctctgacagcagcctgt

SEQ ID NO: 2973756 - DNA, 20 bp, Homo sapiens
gcctctgcaactgctcagct

SEQ ID NO: 2973757 - DNA, 12 bp, Homo sapiens
gcctctgctggt

SEQ ID NO: 2973758 - DNA, 13 bp, Homo sapiens
gcctctgctggtc

SEQ ID NO: 2973759 - DNA, 21 bp, Homo sapiens
gcctctgctggtctctggctc

SEQ ID NO: 2973760 - DNA, 13 bp, Homo sapiens
gcctctggatcta

SEQ ID NO: 2973761 - DNA, 13 bp, Homo sapiens
gcctctgggtcag

SEQ ID NO: 2973762 - DNA, 17 bp, Homo sapiens
gcctctgtcctagactc

SEQ ID NO: 2973763 - DNA, 15 bp, Homo sapiens
gcctctgtctagcat

SEQ ID NO: 2973764 - DNA, 16 bp, Homo sapiens
gcctcttgcaggctga

SEQ ID NO: 2973765 - DNA, 22 bp, Homo sapiens
gcctcttggataccagctcagg

SEQ ID NO: 2973766 - DNA, 18 bp, Homo sapiens
gcctcttggcacctgcct

SEQ ID NO: 2973767 - DNA, 19 bp, Homo sapiens
gcctctttgtctaaaacaa

SEQ ID NO: 2973768 - DNA, 23 bp, Homo sapiens
gcctctttgtctaaaacaataaa

SEQ ID NO: 2973769 - DNA, 15 bp, Homo sapiens
gcctgaaaaatggga

SEQ ID NO: 2973770 - DNA, 14 bp, Homo sapiens
gcctgaactgaggc

SEQ ID NO: 2973771 - DNA, 17 bp, Homo sapiens
gcctgaaggggcgtctg

SEQ ID NO: 2973772 - DNA, 15 bp, Homo sapiens
gcctgaataaaccaa

SEQ ID NO: 2973773 - DNA, 18 bp, Homo sapiens
gcctgaataaaccaagac

SEQ ID NO: 2973774 - DNA, 16 bp, Homo sapiens
gcctgaataaagagcc

SEQ ID NO: 2973775 - DNA, 17 bp, Homo sapiens
gcctgaccctcatcttt

SEQ ID NO: 2973776 - DNA, 15 bp, Homo sapiens
gcctgacctccagtc

SEQ ID NO: 2973777 - DNA, 16 bp, Homo sapiens
gcctgacctccagtcc

SEQ ID NO: 2973778 - DNA, 21 bp, Homo sapiens
gcctgactaatttttgtattt

SEQ ID NO: 2973779 - DNA, 22 bp, Homo sapiens
gcctgagaaacactatttgtga

SEQ ID NO: 2973780 - DNA, 18 bp, Homo sapiens
gcctgagcaactcttgat

SEQ ID NO: 2973781 - DNA, 13 bp, Homo sapiens
gcctgaggcagat

SEQ ID NO: 2973782 - DNA, 13 bp, Homo sapiens
gcctgaggcagga

SEQ ID NO: 2973783 - DNA, 10 bp, Homo sapiens
gcctgaggga

SEQ ID NO: 2973784 - DNA, 13 bp, Homo sapiens
gcctgaggtcaat

SEQ ID NO: 2973785 - DNA, 16 bp, Homo sapiens
gcctgaggtcaatggt

SEQ ID NO: 2973786 - DNA, 21 bp, Homo sapiens
gcctgaggtcaggagttcaag

SEQ ID NO: 2973787 - DNA, 23 bp, Homo sapiens
gcctgagtccacgacctaggcag

SEQ ID NO: 2973788 - DNA, 19 bp, Homo sapiens
gcctgatgagatttttaaa

SEQ ID NO: 2973789 - DNA, 19 bp, Homo sapiens
gcctgcaaacgctgcctgc

SEQ ID NO: 2973790 - DNA, 23 bp, Homo sapiens
gcctgcaccgacccgaggcccag

SEQ ID NO: 2973791 - DNA, 14 bp, Homo sapiens
gcctgcactccctg

SEQ ID NO: 2973792 - DNA, 20 bp, Homo sapiens
gcctgcagagctgcgggctg

SEQ ID NO: 2973793 - DNA, 22 bp, Homo sapiens
gcctgcagcacatgcgggctcg

SEQ ID NO: 2973794 - DNA, 21 bp, Homo sapiens
gcctgcaggacctgcctgtag

SEQ ID NO: 2973795 - DNA, 22 bp, Homo sapiens
gcctgcaggacctgcctgtagc

SEQ ID NO: 2973796 - DNA, 15 bp, Homo sapiens
gcctgcagggaagcc

SEQ ID NO: 2973797 - DNA, 13 bp, Homo sapiens
gcctgcagggcca

SEQ ID NO: 2973798 - DNA, 21 bp, Homo sapiens
gcctgcagggccatggctcag

SEQ ID NO: 2973799 - DNA, 16 bp, Homo sapiens
gcctgcatgtaaacac

SEQ ID NO: 2973800 - DNA, 23 bp, Homo sapiens
gcctgccactcaggcccaaagcc

SEQ ID NO: 2973801 - DNA, 13 bp, Homo sapiens
gcctgcccacctg

SEQ ID NO: 2973802 - DNA, 19 bp, Homo sapiens
gcctgcccacctgcctggc

SEQ ID NO: 2973803 - DNA, 21 bp, Homo sapiens
gcctgcccacctgcctggccg

SEQ ID NO: 2973804 - DNA, 14 bp, Homo sapiens
gcctgcccagcctc

SEQ ID NO: 2973805 - DNA, 15 bp, Homo sapiens
gcctgcccagcctca

SEQ ID NO: 2973806 - DNA, 18 bp, Homo sapiens
gcctgcccctcccagaac

SEQ ID NO: 2973807 - DNA, 14 bp, Homo sapiens
gcctgccctcccgc

SEQ ID NO: 2973808 - DNA, 19 bp, Homo sapiens
gcctgccctcccgcacctt

SEQ ID NO: 2973809 - DNA, 14 bp, Homo sapiens
gcctgccctcctct

SEQ ID NO: 2973810 - DNA, 14 bp, Homo sapiens
gcctgccctgccca

SEQ ID NO: 2973811 - DNA, 23 bp, Homo sapiens
gcctgccctgcccaagtgaccag

SEQ ID NO: 2973812 - DNA, 12 bp, Homo sapiens
gcctgccctgct

SEQ ID NO: 2973813 - DNA, 16 bp, Homo sapiens
gcctgccctgctattt

SEQ ID NO: 2973814 - DNA, 17 bp, Homo sapiens
gcctgccggacacagca

SEQ ID NO: 2973815 - DNA, 16 bp, Homo sapiens
gcctgccggtaaacac

SEQ ID NO: 2973816 - DNA, 20 bp, Homo sapiens
gcctgcctatgaaatttcaa

SEQ ID NO: 2973817 - DNA, 17 bp, Homo sapiens
gcctgcctcctggctca

SEQ ID NO: 2973818 - DNA, 16 bp, Homo sapiens
gcctgcctggcaggct

SEQ ID NO: 2973819 - DNA, 17 bp, Homo sapiens
gcctgcctggcaggctg

SEQ ID NO: 2973820 - DNA, 17 bp, Homo sapiens
gcctgccttctcaggga

SEQ ID NO: 2973821 - DNA, 20 bp, Homo sapiens
gcctgccttttctagtttta

SEQ ID NO: 2973822 - DNA, 17 bp, Homo sapiens
gcctgcgcctccatcca

SEQ ID NO: 2973823 - DNA, 16 bp, Homo sapiens
gcctgcgctcggcagg

SEQ ID NO: 2973824 - DNA, 14 bp, Homo sapiens
gcctgcgtgcgctg

SEQ ID NO: 2973825 - DNA, 17 bp, Homo sapiens
gcctgctccagacctga

SEQ ID NO: 2973826 - DNA, 17 bp, Homo sapiens
gcctgctcccccacccc

SEQ ID NO: 2973827 - DNA, 22 bp, Homo sapiens
gcctgctcttacttcccccacc

SEQ ID NO: 2973828 - DNA, 16 bp, Homo sapiens
gcctgctgggctctcc

SEQ ID NO: 2973829 - DNA, 17 bp, Homo sapiens
gcctgctgggctctcca

SEQ ID NO: 2973830 - DNA, 19 bp, Homo sapiens
gcctgctttgacgggccag

SEQ ID NO: 2973831 - DNA, 21 bp, Homo sapiens
gcctgctttgacgggccaggc

SEQ ID NO: 2973832 - DNA, 18 bp, Homo sapiens
gcctggaaacagaggtaa

SEQ ID NO: 2973833 - DNA, 16 bp, Homo sapiens
gcctggaacaccagca

SEQ ID NO: 2973834 - DNA, 10 bp, Homo sapiens
gcctggaagc

SEQ ID NO: 2973835 - DNA, 13 bp, Homo sapiens
gcctggaagcact

SEQ ID NO: 2973836 - DNA, 16 bp, Homo sapiens
gcctggacccctggac

SEQ ID NO: 2973837 - DNA, 13 bp, Homo sapiens
gcctggagagcga

SEQ ID NO: 2973838 - DNA, 15 bp, Homo sapiens
gcctggagagcgagg

SEQ ID NO: 2973839 - DNA, 17 bp, Homo sapiens
gcctggagagcgaggag

SEQ ID NO: 2973840 - DNA, 18 bp, Homo sapiens
gcctggagccccactgcc

SEQ ID NO: 2973841 - DNA, 19 bp, Homo sapiens
gcctggagccccactgccc

SEQ ID NO: 2973842 - DNA, 22 bp, Homo sapiens
gcctggagccctccgccttcac

SEQ ID NO: 2973843 - DNA, 16 bp, Homo sapiens
gcctggagtgctgtgc

SEQ ID NO: 2973844 - DNA, 14 bp, Homo sapiens
gcctggattccatt

SEQ ID NO: 2973845 - DNA, 18 bp, Homo sapiens
gcctggcatctgtgtgcg

SEQ ID NO: 2973846 - DNA, 20 bp, Homo sapiens
gcctggcatctgtgtgcgtg

SEQ ID NO: 2973847 - DNA, 20 bp, Homo sapiens
gcctggccaacatggcgaaa

SEQ ID NO: 2973848 - DNA, 14 bp, Homo sapiens
gcctggccagacac

SEQ ID NO: 2973849 - DNA, 20 bp, Homo sapiens
gcctggccagacacaggccc

SEQ ID NO: 2973850 - DNA, 21 bp, Homo sapiens
gcctggccagacacaggccct

SEQ ID NO: 2973851 - DNA, 21 bp, Homo sapiens
gcctggccagcctacaatggg

SEQ ID NO: 2973852 - DNA, 15 bp, Homo sapiens
gcctggccaggccct

SEQ ID NO: 2973853 - DNA, 16 bp, Homo sapiens
gcctggccaggccctg

SEQ ID NO: 2973854 - DNA, 23 bp, Homo sapiens
gcctggccaggccctgggtcttg

SEQ ID NO: 2973855 - DNA, 16 bp, Homo sapiens
gcctggccagtcctgg

SEQ ID NO: 2973856 - DNA, 13 bp, Homo sapiens
gcctggccatgct

SEQ ID NO: 2973857 - DNA, 14 bp, Homo sapiens
gcctggccggccag

SEQ ID NO: 2973858 - DNA, 15 bp, Homo sapiens
gcctggccggccagc

SEQ ID NO: 2973859 - DNA, 17 bp, Homo sapiens
gcctggccggccagcca

SEQ ID NO: 2973860 - DNA, 23 bp, Homo sapiens
gcctggccggccagccagccact

SEQ ID NO: 2973861 - DNA, 17 bp, Homo sapiens
gcctggccgttcagcct

SEQ ID NO: 2973862 - DNA, 19 bp, Homo sapiens
gcctggccgttcagcctgt

SEQ ID NO: 2973863 - DNA, 13 bp, Homo sapiens
gcctggcctccag

SEQ ID NO: 2973864 - DNA, 15 bp, Homo sapiens
gcctggcctgccaga

SEQ ID NO: 2973865 - DNA, 23 bp, Homo sapiens
gcctggccttgtcctcagccagt

SEQ ID NO: 2973866 - DNA, 13 bp, Homo sapiens
gcctggctccccg

SEQ ID NO: 2973867 - DNA, 18 bp, Homo sapiens
gctacttgggagcctgag

SEQ ID NO: 2973868 - DNA, 18 bp, Homo sapiens
gctacttttacttgttca

SEQ ID NO: 2973869 - DNA, 15 bp, Homo sapiens
gctagaaaaaacata

SEQ ID NO: 2973870 - DNA, 18 bp, Homo sapiens
gctagaaaaatgttcttt

SEQ ID NO: 2973871 - DNA, 23 bp, Homo sapiens
gctagaagaaaacaaactgtcac

SEQ ID NO: 2973872 - DNA, 14 bp, Homo sapiens
gctagagagaaaaa

SEQ ID NO: 2973873 - DNA, 16 bp, Homo sapiens
gctagagagaaaaaga

SEQ ID NO: 2973874 - DNA, 21 bp, Homo sapiens
gctagagatatggcagcgaaa

SEQ ID NO: 2973875 - DNA, 13 bp, Homo sapiens
gctagagcagaca

SEQ ID NO: 2973876 - DNA, 18 bp, Homo sapiens
gctagagcagacaggcct

SEQ ID NO: 2973877 - DNA, 19 bp, Homo sapiens
gctagagcatgctgcctga

SEQ ID NO: 2973878 - DNA, 13 bp, Homo sapiens
gctagattctaac

SEQ ID NO: 2973879 - DNA, 18 bp, Homo sapiens
gctagccagaggactgtg

SEQ ID NO: 2973880 - DNA, 14 bp, Homo sapiens
gctagcgctgccgc

SEQ ID NO: 2973881 - DNA, 15 bp, Homo sapiens
gctagcgctgccgca

SEQ ID NO: 2973882 - DNA, 21 bp, Homo sapiens
gctagcgctgccgcaccccag

SEQ ID NO: 2973883 - DNA, 23 bp, Homo sapiens
gctagcgctgccgcaccccagag

SEQ ID NO: 2973884 - DNA, 14 bp, Homo sapiens
gctagctagccagc

SEQ ID NO: 2973885 - DNA, 21 bp, Homo sapiens
gctaggaagagtctacccgac

SEQ ID NO: 2973886 - DNA, 18 bp, Homo sapiens
gctaggcccctgtgtagt

SEQ ID NO: 2973887 - DNA, 18 bp, Homo sapiens
gctagggtggggagagac

SEQ ID NO: 2973888 - DNA, 18 bp, Homo sapiens
gctagtcaagctcctcct

SEQ ID NO: 2973889 - DNA, 19 bp, Homo sapiens
gctagtcaagctcctcctc

SEQ ID NO: 2973890 - DNA, 23 bp, Homo sapiens
gctagtcactggcagcctgcacc

SEQ ID NO: 2973891 - DNA, 18 bp, Homo sapiens
gctagtcagagagagtgt

SEQ ID NO: 2973892 - DNA, 19 bp, Homo sapiens
gctagtcttgaatttctga

SEQ ID NO: 2973893 - DNA, 17 bp, Homo sapiens
gctagtgtacctcctct

SEQ ID NO: 2973894 - DNA, 22 bp, Homo sapiens
gctagtgtacctcctctcagtg

SEQ ID NO: 2973895 - DNA, 18 bp, Homo sapiens
gctataaattcctctttg

SEQ ID NO: 2973896 - DNA, 17 bp, Homo sapiens
gctataaattttttgaa

SEQ ID NO: 2973897 - DNA, 18 bp, Homo sapiens
gctataaattttttgaaa

SEQ ID NO: 2973898 - DNA, 23 bp, Homo sapiens
gctataatcattagttttagagg

SEQ ID NO: 2973899 - DNA, 15 bp, Homo sapiens
gctatacctgtgcct

SEQ ID NO: 2973900 - DNA, 19 bp, Homo sapiens
gctatagacccgaggaaac

SEQ ID NO: 2973901 - DNA, 23 bp, Homo sapiens
gctatagacccgaggaaactcag

SEQ ID NO: 2973902 - DNA, 16 bp, Homo sapiens
gctatagtatttgatt

SEQ ID NO: 2973903 - DNA, 13 bp, Homo sapiens
gctatataaaatg

SEQ ID NO: 2973904 - DNA, 20 bp, Homo sapiens
gctatgacatggaggcactg

SEQ ID NO: 2973905 - DNA, 18 bp, Homo sapiens
gctatggatggcttctaa

SEQ ID NO: 2973906 - DNA, 14 bp, Homo sapiens
gctatggtgagatg

SEQ ID NO: 2973907 - DNA, 18 bp, Homo sapiens
gctatgtgcacagcccct

SEQ ID NO: 2973908 - DNA, 20 bp, Homo sapiens
gctattagaagggctgaata

SEQ ID NO: 2973909 - DNA, 22 bp, Homo sapiens
gctatttaaaaaaaaaagagga

SEQ ID NO: 2973910 - DNA, 18 bp, Homo sapiens
gctatttatgggcccctg

SEQ ID NO: 2973911 - DNA, 15 bp, Homo sapiens
gctatttcagccaat

SEQ ID NO: 2973912 - DNA, 14 bp, Homo sapiens
gctatttcaggccc

SEQ ID NO: 2973913 - DNA, 22 bp, Homo sapiens
gctatttgtcagtagccatttt

SEQ ID NO: 2973914 - DNA, 23 bp, Homo sapiens
gctcaaaacacgataagtttact

SEQ ID NO: 2973915 - DNA, 13 bp, Homo sapiens
gctcaaaactttc

SEQ ID NO: 2973916 - DNA, 21 bp, Homo sapiens
gctcaaaggcacagtgaaggc

SEQ ID NO: 2973917 - DNA, 15 bp, Homo sapiens
gctcaagcagcaaaa

SEQ ID NO: 2973918 - DNA, 19 bp, Homo sapiens
gctcaagcattctgtttat

SEQ ID NO: 2973919 - DNA, 20 bp, Homo sapiens
gctcaagcattctgtttatc

SEQ ID NO: 2973920 - DNA, 22 bp, Homo sapiens
gctcaaggcaccgcagcctgtc

SEQ ID NO: 2973921 - DNA, 13 bp, Homo sapiens
gctcacacctgta

SEQ ID NO: 2973922 - DNA, 13 bp, Homo sapiens
gctcacagctgtg

SEQ ID NO: 2973923 - DNA, 15 bp, Homo sapiens
gctcacagttcctcg

SEQ ID NO: 2973924 - DNA, 22 bp, Homo sapiens
gctcacagttcctcgccctggg

SEQ ID NO: 2973925 - DNA, 11 bp, Homo sapiens
gctcacctggg

SEQ ID NO: 2973926 - DNA, 12 bp, Homo sapiens
gctcacctgggg

SEQ ID NO: 2973927 - DNA, 13 bp, Homo sapiens
gctcacctggggt

SEQ ID NO: 2973928 - DNA, 22 bp, Homo sapiens
gctcacctggggtgtgggaggc

SEQ ID NO: 2973929 - DNA, 19 bp, Homo sapiens
gctcacctgttgcttacaa

SEQ ID NO: 2973930 - DNA, 23 bp, Homo sapiens
gctcacctgttgcttacaatttt

SEQ ID NO: 2973931 - DNA, 22 bp, Homo sapiens
gctcacgccccgctgtgtcctc

SEQ ID NO: 2973932 - DNA, 21 bp, Homo sapiens
gctcacgcctgtaatcccagc

SEQ ID NO: 2973933 - DNA, 13 bp, Homo sapiens
gctcactcacccc

SEQ ID NO: 2973934 - DNA, 17 bp, Homo sapiens
gctcactgcaacctccg

SEQ ID NO: 2973935 - DNA, 23 bp, Homo sapiens
gctcactgcaagctccaactccc

SEQ ID NO: 2973936 - DNA, 21 bp, Homo sapiens
gctcagacatgttttccgtga

SEQ ID NO: 2973937 - DNA, 15 bp, Homo sapiens
gctcagacccccact

SEQ ID NO: 2973938 - DNA, 19 bp, Homo sapiens
gctcagagagtacactgtg

SEQ ID NO: 2973939 - DNA, 23 bp, Homo sapiens
gctcagagagtacactgtgtctc

SEQ ID NO: 2973940 - DNA, 14 bp, Homo sapiens
gctcagagccaagg

SEQ ID NO: 2973941 - DNA, 20 bp, Homo sapiens
gctcagagccaagggggcag

SEQ ID NO: 2973942 - DNA, 21 bp, Homo sapiens
gctcagaggcgcactgtgacc

SEQ ID NO: 2973943 - DNA, 21 bp, Homo sapiens
gctcagagggtgtcctgcacc

SEQ ID NO: 2973944 - DNA, 13 bp, Homo sapiens
gctcagccagcac

SEQ ID NO: 2973945 - DNA, 16 bp, Homo sapiens
gctcagctctgggcca

SEQ ID NO: 2973946 - DNA, 20 bp, Homo sapiens
gctcagctctggtccaggcc

SEQ ID NO: 2973947 - DNA, 17 bp, Homo sapiens
gctcagctgtggtccca

SEQ ID NO: 2973948 - DNA, 16 bp, Homo sapiens
gctcaggaaccgaggc

SEQ ID NO: 2973949 - DNA, 17 bp, Homo sapiens
gctcaggactcagaagc

SEQ ID NO: 2973950 - DNA, 15 bp, Homo sapiens
gctcagggcagtggc

SEQ ID NO: 2973951 - DNA, 21 bp, Homo sapiens
gctcaggtcacataaaacttt

SEQ ID NO: 2973952 - DNA, 15 bp, Homo sapiens
gctcagtcgccctgt

SEQ ID NO: 2973953 - DNA, 19 bp, Homo sapiens
gctcagtcgccctgttctt

SEQ ID NO: 2973954 - DNA, 16 bp, Homo sapiens
gctcagtctgttcact

SEQ ID NO: 2973955 - DNA, 17 bp, Homo sapiens
gctcagtgcaacctctg

SEQ ID NO: 2973956 - DNA, 22 bp, Homo sapiens
gctcagtgtctggctgcagagc

SEQ ID NO: 2973957 - DNA, 19 bp, Homo sapiens
gctcatatgctgacagctc

SEQ ID NO: 2973958 - DNA, 18 bp, Homo sapiens
gctcatcattctctgtct

SEQ ID NO: 2973959 - DNA, 17 bp, Homo sapiens
gctcattcattttatat

SEQ ID NO: 2973960 - DNA, 22 bp, Homo sapiens
gctcattcattttatattgaaa

SEQ ID NO: 2973961 - DNA, 17 bp, Homo sapiens
gctccaaaccctcgagg

SEQ ID NO: 2973962 - DNA, 19 bp, Homo sapiens
gctccaaaccctcgaggcg

SEQ ID NO: 2973963 - DNA, 20 bp, Homo sapiens
gctccaactcctttcagcca

SEQ ID NO: 2973964 - DNA, 22 bp, Homo sapiens
gctccaactcctttcagccaca

SEQ ID NO: 2973965 - DNA, 21 bp, Homo sapiens
gctccaagatgttctcctgat

SEQ ID NO: 2973966 - DNA, 13 bp, Homo sapiens
gctccaagctgtt

SEQ ID NO: 2973967 - DNA, 15 bp, Homo sapiens
gctccaagctgttaa

SEQ ID NO: 2973968 - DNA, 21 bp, Homo sapiens
gctccaaggggaatcagaact

SEQ ID NO: 2973969 - DNA, 19 bp, Homo sapiens
gctccaccctggccgagtc

SEQ ID NO: 2973970 - DNA, 18 bp, Homo sapiens
gctccagaatgtgctgcc

SEQ ID NO: 2973971 - DNA, 21 bp, Homo sapiens
gctccagaatgtgctgccttt

SEQ ID NO: 2973972 - DNA, 20 bp, Homo sapiens
gctccagacctgatcctgga

SEQ ID NO: 2973973 - DNA, 23 bp, Homo sapiens
gctccagacctgatcctggaggc

SEQ ID NO: 2973974 - DNA, 19 bp, Homo sapiens
gctccagcaccatccgcca

SEQ ID NO: 2973975 - DNA, 23 bp, Homo sapiens
gctccagcccgagtggtctcctc

SEQ ID NO: 2973976 - DNA, 21 bp, Homo sapiens
gctccagctgccccggcccct

SEQ ID NO: 2973977 - DNA, 22 bp, Homo sapiens
gctccaggatgcattctgatag

SEQ ID NO: 2973978 - DNA, 12 bp, Homo sapiens
gctccaggccca

SEQ ID NO: 2973979 - DNA, 19 bp, Homo sapiens
gctccatctccgcctccac

SEQ ID NO: 2973980 - DNA, 17 bp, Homo sapiens
gctccatgctttcacct

SEQ ID NO: 2973981 - DNA, 23 bp, Homo sapiens
gctcccacacttgtgccagcccg

SEQ ID NO: 2973982 - DNA, 18 bp, Homo sapiens
gctcccaccccaccccct

SEQ ID NO: 2973983 - DNA, 18 bp, Homo sapiens
gctcccacctagtgcccc

SEQ ID NO: 2973984 - DNA, 20 bp, Homo sapiens
gctcccacctagtgccccag

SEQ ID NO: 2973985 - DNA, 23 bp, Homo sapiens
gctcccacctagtgccccagact

SEQ ID NO: 2973986 - DNA, 22 bp, Homo sapiens
gctcccaggtgcagccagaggc

SEQ ID NO: 2973987 - DNA, 13 bp, Homo sapiens
gctccccacccct

SEQ ID NO: 2973988 - DNA, 11 bp, Homo sapiens
gctccccagga

SEQ ID NO: 2973989 - DNA, 23 bp, Homo sapiens
gctccccaggaagcccactgcct

SEQ ID NO: 2973990 - DNA, 22 bp, Homo sapiens
gctcccccaccccctccccagg

SEQ ID NO: 2973991 - DNA, 13 bp, Homo sapiens
gctccccctctgc

SEQ ID NO: 2973992 - DNA, 14 bp, Homo sapiens
gctccccctctgct

SEQ ID NO: 2973993 - DNA, 14 bp, Homo sapiens
gctcccctccatcc

SEQ ID NO: 2973994 - DNA, 23 bp, Homo sapiens
gctcccggccttgtgtgatttta

SEQ ID NO: 2973995 - DNA, 24 bp, Homo sapiens
gctcccgggactcactggcagccc

SEQ ID NO: 2973996 - DNA, 15 bp, Homo sapiens
gctcccgtggcctgt

SEQ ID NO: 2973997 - DNA, 15 bp, Homo sapiens
gctgtcccctcagcg

SEQ ID NO: 2973998 - DNA, 13 bp, Homo sapiens
gctgtcctcaggt

SEQ ID NO: 2973999 - DNA, 19 bp, Homo sapiens
gctgtcctcaggtggccat

SEQ ID NO: 2974000 - DNA, 14 bp, Homo sapiens
gctgtcctggtggc

SEQ ID NO: 2974001 - DNA, 15 bp, Homo sapiens
gctgtcctggtggct

SEQ ID NO: 2974002 - DNA, 22 bp, Homo sapiens
gctgtccttacccatctgcacc

SEQ ID NO: 2974003 - DNA, 15 bp, Homo sapiens
gctgtctctctgggc

SEQ ID NO: 2974004 - DNA, 14 bp, Homo sapiens
gctgtctgcagcct

SEQ ID NO: 2974005 - DNA, 12 bp, Homo sapiens
gctgtctggatc

SEQ ID NO: 2974006 - DNA, 14 bp, Homo sapiens
gctgtctgtcatct

SEQ ID NO: 2974007 - DNA, 18 bp, Homo sapiens
gctgtcttggggtcccac

SEQ ID NO: 2974008 - DNA, 12 bp, Homo sapiens
gctgtctttgca

SEQ ID NO: 2974009 - DNA, 21 bp, Homo sapiens
gctgtgactctgggcagggac

SEQ ID NO: 2974010 - DNA, 23 bp, Homo sapiens
gctgtgagacagtgggaaatatt

SEQ ID NO: 2974011 - DNA, 17 bp, Homo sapiens
gctgtgagccttgcatg

SEQ ID NO: 2974012 - DNA, 22 bp, Homo sapiens
gctgtgagtctttggttctaag

SEQ ID NO: 2974013 - DNA, 13 bp, Homo sapiens
gctgtgcaacgcc

SEQ ID NO: 2974014 - DNA, 23 bp, Homo sapiens
gctgtgcaacgccgtgggctgcg

SEQ ID NO: 2974015 - DNA, 15 bp, Homo sapiens
gctgtgccaggaggc

SEQ ID NO: 2974016 - DNA, 14 bp, Homo sapiens
gctgtgctgggagg

SEQ ID NO: 2974017 - DNA, 22 bp, Homo sapiens
gctgtggaaaggattctaaaca

SEQ ID NO: 2974018 - DNA, 19 bp, Homo sapiens
gctgtggcctaacctgccg

SEQ ID NO: 2974019 - DNA, 11 bp, Homo sapiens
gctgtgtaaag

SEQ ID NO: 2974020 - DNA, 12 bp, Homo sapiens
gctgtgtaaagt

SEQ ID NO: 2974021 - DNA, 13 bp, Homo sapiens
gctgtgtaaagtt

SEQ ID NO: 2974022 - DNA, 17 bp, Homo sapiens
gctgtgtaaagttagtc

SEQ ID NO: 2974023 - DNA, 19 bp, Homo sapiens
gctgtgtaaagttagtcta

SEQ ID NO: 2974024 - DNA, 16 bp, Homo sapiens
gctgtgtcctccctcc

SEQ ID NO: 2974025 - DNA, 18 bp, Homo sapiens
gctgtgtcctccctccct

SEQ ID NO: 2974026 - DNA, 14 bp, Homo sapiens
gctgtgtccttgca

SEQ ID NO: 2974027 - DNA, 19 bp, Homo sapiens
gctgtgtccttgcacctgc

SEQ ID NO: 2974028 - DNA, 20 bp, Homo sapiens
gctgtgtccttgcacctgca

SEQ ID NO: 2974029 - DNA, 21 bp, Homo sapiens
gctgtgtccttgcacctgcat

SEQ ID NO: 2974030 - DNA, 16 bp, Homo sapiens
gctgtgtgtcccaggc

SEQ ID NO: 2974031 - DNA, 19 bp, Homo sapiens
gctgtgttacttgaagtaa

SEQ ID NO: 2974032 - DNA, 21 bp, Homo sapiens
gctgtgttacttgaagtaact

SEQ ID NO: 2974033 - DNA, 12 bp, Homo sapiens
gctgtgttcatc

SEQ ID NO: 2974034 - DNA, 16 bp, Homo sapiens
gctgtgttgactgctg

SEQ ID NO: 2974035 - DNA, 22 bp, Homo sapiens
gctgtgttgttgcttcttgtga

SEQ ID NO: 2974036 - DNA, 14 bp, Homo sapiens
gctgttaaagatat

SEQ ID NO: 2974037 - DNA, 15 bp, Homo sapiens
gctgttattcttgtt

SEQ ID NO: 2974038 - DNA, 16 bp, Homo sapiens
gctgttattcttgtta

SEQ ID NO: 2974039 - DNA, 18 bp, Homo sapiens
gctgttattcttgttata

SEQ ID NO: 2974040 - DNA, 20 bp, Homo sapiens
gctgttcacccacagggcta

SEQ ID NO: 2974041 - DNA, 23 bp, Homo sapiens
gctgttcagttgccactaagaga

SEQ ID NO: 2974042 - DNA, 22 bp, Homo sapiens
gctgttcccatgtagccccctg

SEQ ID NO: 2974043 - DNA, 12 bp, Homo sapiens
gctgttcctgtg

SEQ ID NO: 2974044 - DNA, 20 bp, Homo sapiens
gctgttcctgtgttcttcgt

SEQ ID NO: 2974045 - DNA, 15 bp, Homo sapiens
gctgttctacttttt

SEQ ID NO: 2974046 - DNA, 16 bp, Homo sapiens
gctgttctcattcctg

SEQ ID NO: 2974047 - DNA, 21 bp, Homo sapiens
gctgttctcattcctgttctt

SEQ ID NO: 2974048 - DNA, 12 bp, Homo sapiens
gctgttgaaaat

SEQ ID NO: 2974049 - DNA, 20 bp, Homo sapiens
gctgttgaaagcaaaaatgc

SEQ ID NO: 2974050 - DNA, 17 bp, Homo sapiens
gctgttgacatatttaa

SEQ ID NO: 2974051 - DNA, 15 bp, Homo sapiens
gctgttgattgctaa

SEQ ID NO: 2974052 - DNA, 13 bp, Homo sapiens
gctgttgcaggca

SEQ ID NO: 2974053 - DNA, 20 bp, Homo sapiens
gctgttgcaggcagtgtctt

SEQ ID NO: 2974054 - DNA, 15 bp, Homo sapiens
gctgttgcctcatct

SEQ ID NO: 2974055 - DNA, 17 bp, Homo sapiens
gctgttgctatttgtat

SEQ ID NO: 2974056 - DNA, 19 bp, Homo sapiens
gctgttggtcctctctctg

SEQ ID NO: 2974057 - DNA, 21 bp, Homo sapiens
gctgttggtcctctctctgtg

SEQ ID NO: 2974058 - DNA, 18 bp, Homo sapiens
gctgtttagatttattag

SEQ ID NO: 2974059 - DNA, 19 bp, Homo sapiens
gctgtttatgacacaatga

SEQ ID NO: 2974060 - DNA, 19 bp, Homo sapiens
gctgtttccttgcctgctt

SEQ ID NO: 2974061 - DNA, 12 bp, Homo sapiens
gctgtttcttgt

SEQ ID NO: 2974062 - DNA, 18 bp, Homo sapiens
gctgttttcctcccttct

SEQ ID NO: 2974063 - DNA, 13 bp, Homo sapiens
gctgttttttgtt

SEQ ID NO: 2974064 - DNA, 18 bp, Homo sapiens
gctgttttttgtttttta

SEQ ID NO: 2974065 - DNA, 15 bp, Homo sapiens
gcttaaaacttttca

SEQ ID NO: 2974066 - DNA, 16 bp, Homo sapiens
gcttaaaacttttcaa

SEQ ID NO: 2974067 - DNA, 18 bp, Homo sapiens
gcttaatgacactagcta

SEQ ID NO: 2974068 - DNA, 15 bp, Homo sapiens
gcttaattcaaataa

SEQ ID NO: 2974069 - DNA, 11 bp, Homo sapiens
gcttacattga

SEQ ID NO: 2974070 - DNA, 20 bp, Homo sapiens
gcttaccacatcacaccact

SEQ ID NO: 2974071 - DNA, 13 bp, Homo sapiens
gcttaccttgttt

SEQ ID NO: 2974072 - DNA, 17 bp, Homo sapiens
gcttagattttctgtaa

SEQ ID NO: 2974073 - DNA, 22 bp, Homo sapiens
gcttagcaggagaggagagcca

SEQ ID NO: 2974074 - DNA, 18 bp, Homo sapiens
gcttagcgctctggacag

SEQ ID NO: 2974075 - DNA, 13 bp, Homo sapiens
gcttagctgccat

SEQ ID NO: 2974076 - DNA, 18 bp, Homo sapiens
gcttatctccctgcttca

SEQ ID NO: 2974077 - DNA, 19 bp, Homo sapiens
gcttatctccctgcttcat

SEQ ID NO: 2974078 - DNA, 22 bp, Homo sapiens
gcttatctcttttatatttgta

SEQ ID NO: 2974079 - DNA, 20 bp, Homo sapiens
gcttatggtaccagatgcag

SEQ ID NO: 2974080 - DNA, 20 bp, Homo sapiens
gcttatgtttcttattctct

SEQ ID NO: 2974081 - DNA, 15 bp, Homo sapiens
gcttattacatttaa

SEQ ID NO: 2974082 - DNA, 21 bp, Homo sapiens
gcttattgtgtgcgctgcctg

SEQ ID NO: 2974083 - DNA, 22 bp, Homo sapiens
gcttattgtgtgcgctgcctgg

SEQ ID NO: 2974084 - DNA, 21 bp, Homo sapiens
gcttattttgggttcaggcct

SEQ ID NO: 2974085 - DNA, 22 bp, Homo sapiens
gcttattttgggttcaggcctg

SEQ ID NO: 2974086 - DNA, 12 bp, Homo sapiens
gcttcaaaaact

SEQ ID NO: 2974087 - DNA, 16 bp, Homo sapiens
gcttcaatatttttct

SEQ ID NO: 2974088 - DNA, 22 bp, Homo sapiens
gcttcaatcggcttgtgggtga

SEQ ID NO: 2974089 - DNA, 19 bp, Homo sapiens
gcttcagatgtggagccag

SEQ ID NO: 2974090 - DNA, 22 bp, Homo sapiens
gcttcagccacagtttcctcat

SEQ ID NO: 2974091 - DNA, 14 bp, Homo sapiens
gcttcagctccagc

SEQ ID NO: 2974092 - DNA, 14 bp, Homo sapiens
gcttcaggaacctc

SEQ ID NO: 2974093 - DNA, 10 bp, Homo sapiens
gcttcagggc

SEQ ID NO: 2974094 - DNA, 13 bp, Homo sapiens
gcttcagggcagg

SEQ ID NO: 2974095 - DNA, 19 bp, Homo sapiens
gcttcagggcaggtggggt

SEQ ID NO: 2974096 - DNA, 22 bp, Homo sapiens
gcttcaggttagtgacatttaa

SEQ ID NO: 2974097 - DNA, 11 bp, Homo sapiens
gcttcatacag

SEQ ID NO: 2974098 - DNA, 22 bp, Homo sapiens
gcttcatacagggatggtgttc

SEQ ID NO: 2974099 - DNA, 12 bp, Homo sapiens
gcttcatatctc

SEQ ID NO: 2974100 - DNA, 19 bp, Homo sapiens
gcttcatatctctcccttc

SEQ ID NO: 2974101 - DNA, 17 bp, Homo sapiens
gcttcatggcagaaggc

SEQ ID NO: 2974102 - DNA, 16 bp, Homo sapiens
gcttccagagctctga

SEQ ID NO: 2974103 - DNA, 18 bp, Homo sapiens
gcttccagagctctgacc

SEQ ID NO: 2974104 - DNA, 19 bp, Homo sapiens
gcttccaggctgggcagca

SEQ ID NO: 2974105 - DNA, 14 bp, Homo sapiens
gcttccatgattct

SEQ ID NO: 2974106 - DNA, 20 bp, Homo sapiens
gcttccatggcttcctgaga

SEQ ID NO: 2974107 - DNA, 17 bp, Homo sapiens
gcttcccacacctgcct

SEQ ID NO: 2974108 - DNA, 22 bp, Homo sapiens
gcttcccacacctgcctgcgtt

SEQ ID NO: 2974109 - DNA, 13 bp, Homo sapiens
gcttcctaactta

SEQ ID NO: 2974110 - DNA, 21 bp, Homo sapiens
gcttcctagcttatctccctg

SEQ ID NO: 2974111 - DNA, 14 bp, Homo sapiens
gcttcctccagagg

SEQ ID NO: 2974112 - DNA, 21 bp, Homo sapiens
gcttcctcctccccaactgtg

SEQ ID NO: 2974113 - DNA, 18 bp, Homo sapiens
gcttcctgagcagtccct

SEQ ID NO: 2974114 - DNA, 20 bp, Homo sapiens
gcttcctgagcagtccctgc

SEQ ID NO: 2974115 - DNA, 22 bp, Homo sapiens
gcttcctgagcagtccctgctt

SEQ ID NO: 2974116 - DNA, 16 bp, Homo sapiens
gcttcctgtcctccca

SEQ ID NO: 2974117 - DNA, 21 bp, Homo sapiens
gcttcctgtcctcccagctcc

SEQ ID NO: 2974118 - DNA, 24 bp, Homo sapiens
gcttcctttcccaagccttcgggc

SEQ ID NO: 2974119 - DNA, 23 bp, Homo sapiens
gcttcctttgaccactgtctttt

SEQ ID NO: 2974120 - DNA, 20 bp, Homo sapiens
gcttcgggcccttcccacag

SEQ ID NO: 2974121 - DNA, 16 bp, Homo sapiens
gcttctaaatgcccag

SEQ ID NO: 2974122 - DNA, 20 bp, Homo sapiens
gcttctaattttgtgctctt

SEQ ID NO: 2974123 - DNA, 15 bp, Homo sapiens
gcttctaggagtcaa

SEQ ID NO: 2974124 - DNA, 20 bp, Homo sapiens
gcttctaggagtcaactggc

SEQ ID NO: 2974125 - DNA, 16 bp, Homo sapiens
gcttctagttctgcca

SEQ ID NO: 2974126 - DNA, 18 bp, Homo sapiens
gcttctagttctgccagg

SEQ ID NO: 2974127 - DNA, 19 bp, Homo sapiens
gcttctagttctgccagga

SEQ ID NO: 2974128 - DNA, 21 bp, Homo sapiens
gcttctagttctgccaggaga

SEQ ID NO: 2974129 - DNA, 22 bp, Homo sapiens
ggactacattttgctctgtgaa

SEQ ID NO: 2974130 - DNA, 20 bp, Homo sapiens
ggactatatttgggcctgct

SEQ ID NO: 2974131 - DNA, 16 bp, Homo sapiens
ggactcactggcagcc

SEQ ID NO: 2974132 - DNA, 17 bp, Homo sapiens
ggactcagaagcctctg

SEQ ID NO: 2974133 - DNA, 16 bp, Homo sapiens
ggactcagctctgtct

SEQ ID NO: 2974134 - DNA, 15 bp, Homo sapiens
ggactcagggcagcg

SEQ ID NO: 2974135 - DNA, 14 bp, Homo sapiens
ggactcatgaggag

SEQ ID NO: 2974136 - DNA, 21 bp, Homo sapiens
ggactccaggccagctccttt

SEQ ID NO: 2974137 - DNA, 15 bp, Homo sapiens
ggactccaggcccaa

SEQ ID NO: 2974138 - DNA, 17 bp, Homo sapiens
ggactccatttctttct

SEQ ID NO: 2974139 - DNA, 16 bp, Homo sapiens
ggactccggccctcct

SEQ ID NO: 2974140 - DNA, 23 bp, Homo sapiens
ggactcctccccaccctcctggc

SEQ ID NO: 2974141 - DNA, 22 bp, Homo sapiens
ggactcctgccaccagcatcca

SEQ ID NO: 2974142 - DNA, 21 bp, Homo sapiens
ggactctcagtctctgagcag

SEQ ID NO: 2974143 - DNA, 13 bp, Homo sapiens
ggactctgcacat

SEQ ID NO: 2974144 - DNA, 18 bp, Homo sapiens
ggactctggtgcctccag

SEQ ID NO: 2974145 - DNA, 19 bp, Homo sapiens
ggactgaattgtccccagt

SEQ ID NO: 2974146 - DNA, 13 bp, Homo sapiens
ggactgagatttc

SEQ ID NO: 2974147 - DNA, 13 bp, Homo sapiens
ggactgagcgagg

SEQ ID NO: 2974148 - DNA, 22 bp, Homo sapiens
ggactgcagtcggcatgccagg

SEQ ID NO: 2974149 - DNA, 22 bp, Homo sapiens
ggactgctacctttcaaagctt

SEQ ID NO: 2974150 - DNA, 17 bp, Homo sapiens
ggactgctgacccacca

SEQ ID NO: 2974151 - DNA, 15 bp, Homo sapiens
ggactggccgtggct

SEQ ID NO: 2974152 - DNA, 20 bp, Homo sapiens
ggactgggccatgggtcctc

SEQ ID NO: 2974153 - DNA, 19 bp, Homo sapiens
ggactgggtctgacctggt

SEQ ID NO: 2974154 - DNA, 21 bp, Homo sapiens
ggactggttatcttgttatta

SEQ ID NO: 2974155 - DNA, 15 bp, Homo sapiens
ggactgtatttgtga

SEQ ID NO: 2974156 - DNA, 18 bp, Homo sapiens
ggacttcctgtccagctc

SEQ ID NO: 2974157 - DNA, 18 bp, Homo sapiens
ggacttggtacagttgca

SEQ ID NO: 2974158 - DNA, 21 bp, Homo sapiens
ggacttggtacagttgcagga

SEQ ID NO: 2974159 - DNA, 20 bp, Homo sapiens
ggacttgtaggaatctgcct

SEQ ID NO: 2974160 - DNA, 17 bp, Homo sapiens
ggacttttaaacaaaag

SEQ ID NO: 2974161 - DNA, 13 bp, Homo sapiens
ggagaaaacactt

SEQ ID NO: 2974162 - DNA, 16 bp, Homo sapiens
ggagaaaatgcttaat

SEQ ID NO: 2974163 - DNA, 18 bp, Homo sapiens
ggagaaagggagagaaaa

SEQ ID NO: 2974164 - DNA, 19 bp, Homo sapiens
ggagaaagggcagaggaag

SEQ ID NO: 2974165 - DNA, 22 bp, Homo sapiens
ggagaaatctggcttctggcca

SEQ ID NO: 2974166 - DNA, 14 bp, Homo sapiens
ggagaaattgacag

SEQ ID NO: 2974167 - DNA, 23 bp, Homo sapiens
ggagaacatgaatcaaaagtgcc

SEQ ID NO: 2974168 - DNA, 14 bp, Homo sapiens
ggagaagacaacag

SEQ ID NO: 2974169 - DNA, 15 bp, Homo sapiens
ggagaagcaatgggt

SEQ ID NO: 2974170 - DNA, 19 bp, Homo sapiens
ggagaagcagtgagccgca

SEQ ID NO: 2974171 - DNA, 13 bp, Homo sapiens
ggagaagccagga

SEQ ID NO: 2974172 - DNA, 17 bp, Homo sapiens
ggagaaggcctcccctg

SEQ ID NO: 2974173 - DNA, 18 bp, Homo sapiens
ggagaagggctggggccg

SEQ ID NO: 2974174 - DNA, 20 bp, Homo sapiens
ggagaagtggggaccccacc

SEQ ID NO: 2974175 - DNA, 19 bp, Homo sapiens
ggagaagttggtcttactt

SEQ ID NO: 2974176 - DNA, 12 bp, Homo sapiens
ggagaatatgat

SEQ ID NO: 2974177 - DNA, 20 bp, Homo sapiens
ggagaatcagcagaacctgt

SEQ ID NO: 2974178 - DNA, 13 bp, Homo sapiens
ggagaatgcagcc

SEQ ID NO: 2974179 - DNA, 15 bp, Homo sapiens
ggagaatgcagccca

SEQ ID NO: 2974180 - DNA, 16 bp, Homo sapiens
ggagacaaagcaggag

SEQ ID NO: 2974181 - DNA, 21 bp, Homo sapiens
ggagacaatgtctgcagccct

SEQ ID NO: 2974182 - DNA, 12 bp, Homo sapiens
ggagacacagat

SEQ ID NO: 2974183 - DNA, 13 bp, Homo sapiens
ggagacacagatg

SEQ ID NO: 2974184 - DNA, 13 bp, Homo sapiens
ggagacagcctgt

SEQ ID NO: 2974185 - DNA, 17 bp, Homo sapiens
ggagacagcctgtctct

SEQ ID NO: 2974186 - DNA, 20 bp, Homo sapiens
ggagacagcctgtctctcct

SEQ ID NO: 2974187 - DNA, 17 bp, Homo sapiens
ggagacaggcagagctg

SEQ ID NO: 2974188 - DNA, 20 bp, Homo sapiens
ggagaccggggtatcctggg

SEQ ID NO: 2974189 - DNA, 16 bp, Homo sapiens
ggagacctgctctccg

SEQ ID NO: 2974190 - DNA, 19 bp, Homo sapiens
ggagacggtttccagggag

SEQ ID NO: 2974191 - DNA, 16 bp, Homo sapiens
ggagactcacctctgc

SEQ ID NO: 2974192 - DNA, 17 bp, Homo sapiens
ggagactcacctctgcc

SEQ ID NO: 2974193 - DNA, 18 bp, Homo sapiens
ggagactcacctctgcct

SEQ ID NO: 2974194 - DNA, 21 bp, Homo sapiens
ggagactcacctctgcctcaa

SEQ ID NO: 2974195 - DNA, 15 bp, Homo sapiens
ggagactgcccagct

SEQ ID NO: 2974196 - DNA, 13 bp, Homo sapiens
ggagactggcagg

SEQ ID NO: 2974197 - DNA, 22 bp, Homo sapiens
ggagacttggtggtctgagctg

SEQ ID NO: 2974198 - DNA, 13 bp, Homo sapiens
ggagagccagaga

SEQ ID NO: 2974199 - DNA, 15 bp, Homo sapiens
ggagagccagagaag

SEQ ID NO: 2974200 - DNA, 17 bp, Homo sapiens
ggagagcgaggaggcgc

SEQ ID NO: 2974201 - DNA, 22 bp, Homo sapiens
ggagagcgaggaggcgcggcct

SEQ ID NO: 2974202 - DNA, 18 bp, Homo sapiens
ggagagcgcctgcccctc

SEQ ID NO: 2974203 - DNA, 14 bp, Homo sapiens
ggagagcggaggag

SEQ ID NO: 2974204 - DNA, 18 bp, Homo sapiens
ggagaggaagagaagccc

SEQ ID NO: 2974205 - DNA, 15 bp, Homo sapiens
ggagaggaagagaca

SEQ ID NO: 2974206 - DNA, 16 bp, Homo sapiens
ggagaggagagccaga

SEQ ID NO: 2974207 - DNA, 20 bp, Homo sapiens
ggagaggagagccagagaag

SEQ ID NO: 2974208 - DNA, 17 bp, Homo sapiens
ggagagggcctctgcct

SEQ ID NO: 2974209 - DNA, 14 bp, Homo sapiens
ggagaggggacgca

SEQ ID NO: 2974210 - DNA, 16 bp, Homo sapiens
ggagaggggacgcagg

SEQ ID NO: 2974211 - DNA, 17 bp, Homo sapiens
ggagaggggacgcaggc

SEQ ID NO: 2974212 - DNA, 20 bp, Homo sapiens
ggagagtgtcaaccagacag

SEQ ID NO: 2974213 - DNA, 21 bp, Homo sapiens
ggagagtgtcaaccagacaga

SEQ ID NO: 2974214 - DNA, 18 bp, Homo sapiens
ggagagtttcctgaaaca

SEQ ID NO: 2974215 - DNA, 21 bp, Homo sapiens
ggagatattataagggagagc

SEQ ID NO: 2974216 - DNA, 12 bp, Homo sapiens
ggagatatttaa

SEQ ID NO: 2974217 - DNA, 23 bp, Homo sapiens
ggagatatttatggggggagaac

SEQ ID NO: 2974218 - DNA, 19 bp, Homo sapiens
ggagatctgaacccagctg

SEQ ID NO: 2974219 - DNA, 13 bp, Homo sapiens
ggagatggagaaa

SEQ ID NO: 2974220 - DNA, 16 bp, Homo sapiens
ggagatggagaaaatg

SEQ ID NO: 2974221 - DNA, 13 bp, Homo sapiens
ggagatggagttc

SEQ ID NO: 2974222 - DNA, 17 bp, Homo sapiens
ggagattgaactttccc

SEQ ID NO: 2974223 - DNA, 16 bp, Homo sapiens
ggagcaaactctgctg

SEQ ID NO: 2974224 - DNA, 16 bp, Homo sapiens
ggagcaatctgaccct

SEQ ID NO: 2974225 - DNA, 20 bp, Homo sapiens
ggagcacatactacctagaa

SEQ ID NO: 2974226 - DNA, 19 bp, Homo sapiens
ggagcaccacggccagaag

SEQ ID NO: 2974227 - DNA, 16 bp, Homo sapiens
ggagcaccagcggtcc

SEQ ID NO: 2974228 - DNA, 20 bp, Homo sapiens
ggagcacctggaccccctgc

SEQ ID NO: 2974229 - DNA, 14 bp, Homo sapiens
ggagcagagaggtg

SEQ ID NO: 2974230 - DNA, 15 bp, Homo sapiens
ggagcagagaggtgg

SEQ ID NO: 2974231 - DNA, 16 bp, Homo sapiens
ggagcagagaggtggc

SEQ ID NO: 2974232 - DNA, 16 bp, Homo sapiens
ggagcagcggctctgg

SEQ ID NO: 2974233 - DNA, 13 bp, Homo sapiens
ggagcaggggtgg

SEQ ID NO: 2974234 - DNA, 21 bp, Homo sapiens
ggagcatccctaattcttcat

SEQ ID NO: 2974235 - DNA, 18 bp, Homo sapiens
ggagcatttatgtagaca

SEQ ID NO: 2974236 - DNA, 17 bp, Homo sapiens
ggagccacatttacata

SEQ ID NO: 2974237 - DNA, 16 bp, Homo sapiens
ggagccactcctctga

SEQ ID NO: 2974238 - DNA, 19 bp, Homo sapiens
ggagccactcctctgactc

SEQ ID NO: 2974239 - DNA, 21 bp, Homo sapiens
ggagccactcctctgactcag

SEQ ID NO: 2974240 - DNA, 15 bp, Homo sapiens
ggagccaggagacct

SEQ ID NO: 2974241 - DNA, 11 bp, Homo sapiens
ggagccaggcg

SEQ ID NO: 2974242 - DNA, 12 bp, Homo sapiens
ggagccagggta

SEQ ID NO: 2974243 - DNA, 20 bp, Homo sapiens
ggagccatggaaggtgccag

SEQ ID NO: 2974244 - DNA, 21 bp, Homo sapiens
ggagccatggaaggtgccaga

SEQ ID NO: 2974245 - DNA, 14 bp, Homo sapiens
ggagccatttgaga

SEQ ID NO: 2974246 - DNA, 12 bp, Homo sapiens
ggagcccactgt

SEQ ID NO: 2974247 - DNA, 20 bp, Homo sapiens
ggagcccactgtcctgggcc

SEQ ID NO: 2974248 - DNA, 16 bp, Homo sapiens
ggagcccagctctgaa

SEQ ID NO: 2974249 - DNA, 18 bp, Homo sapiens
ggagccccttctgctcag

SEQ ID NO: 2974250 - DNA, 18 bp, Homo sapiens
ggagcccgcactgtccca

SEQ ID NO: 2974251 - DNA, 23 bp, Homo sapiens
ggagcccgtgccctaccacacat

SEQ ID NO: 2974252 - DNA, 18 bp, Homo sapiens
ggagccctccgccttcac

SEQ ID NO: 2974253 - DNA, 22 bp, Homo sapiens
ggagccgaccaattagtcactg

SEQ ID NO: 2974254 - DNA, 14 bp, Homo sapiens
ggagccgctggcag

SEQ ID NO: 2974255 - DNA, 20 bp, Homo sapiens
ggagccgctggcagaaggga

SEQ ID NO: 2974256 - DNA, 18 bp, Homo sapiens
ggagccgggtctgcctct

SEQ ID NO: 2974257 - DNA, 19 bp, Homo sapiens
ggagcctcagaagaaaaca

SEQ ID NO: 2974258 - DNA, 13 bp, Homo sapiens
ggagcctgaggca

SEQ ID NO: 2974259 - DNA, 16 bp, Homo sapiens
ggagcctgaggcagga

SEQ ID NO: 2974260 - DNA, 17 bp, Homo sapiens
ggagcctgaggcaggag

SEQ ID NO: 2974261 - DNA, 17 bp, Homo sapiens
ggagcctgcagagctgc

SEQ ID NO: 2974262 - DNA, 14 bp, Homo sapiens
ggccaccttttcag

SEQ ID NO: 2974263 - DNA, 17 bp, Homo sapiens
ggccacggcccagggag

SEQ ID NO: 2974264 - DNA, 17 bp, Homo sapiens
ggccacgtgccaggccc

SEQ ID NO: 2974265 - DNA, 19 bp, Homo sapiens
ggccactcaacagagagga

SEQ ID NO: 2974266 - DNA, 13 bp, Homo sapiens
ggccactcctcca

SEQ ID NO: 2974267 - DNA, 16 bp, Homo sapiens
ggccactgtgtttctg

SEQ ID NO: 2974268 - DNA, 21 bp, Homo sapiens
ggccactgtgtttctgtgctc

SEQ ID NO: 2974269 - DNA, 13 bp, Homo sapiens
ggccacttctgtc

SEQ ID NO: 2974270 - DNA, 14 bp, Homo sapiens
ggccacttctgtcc

SEQ ID NO: 2974271 - DNA, 15 bp, Homo sapiens
ggccacttctgtcca

SEQ ID NO: 2974272 - DNA, 22 bp, Homo sapiens
ggccagaagtaacttattttgt

SEQ ID NO: 2974273 - DNA, 16 bp, Homo sapiens
ggccagacacaggccc

SEQ ID NO: 2974274 - DNA, 18 bp, Homo sapiens
ggccagacacaggccctc

SEQ ID NO: 2974275 - DNA, 15 bp, Homo sapiens
ggccagacatgccac

SEQ ID NO: 2974276 - DNA, 18 bp, Homo sapiens
ggccagacatgccacaag

SEQ ID NO: 2974277 - DNA, 12 bp, Homo sapiens
ggccagagccag

SEQ ID NO: 2974278 - DNA, 13 bp, Homo sapiens
ggccagatccagc

SEQ ID NO: 2974279 - DNA, 16 bp, Homo sapiens
ggccagatccagcctg

SEQ ID NO: 2974280 - DNA, 20 bp, Homo sapiens
ggccagatgcacatccctgg

SEQ ID NO: 2974281 - DNA, 21 bp, Homo sapiens
ggccagatgcacatccctgga

SEQ ID NO: 2974282 - DNA, 23 bp, Homo sapiens
ggccagatgcacatccctggaag

SEQ ID NO: 2974283 - DNA, 13 bp, Homo sapiens
ggccagccagcca

SEQ ID NO: 2974284 - DNA, 16 bp, Homo sapiens
ggccagccagccactc

SEQ ID NO: 2974285 - DNA, 14 bp, Homo sapiens
ggccagctcctttt

SEQ ID NO: 2974286 - DNA, 18 bp, Homo sapiens
ggccagctccttttctgt

SEQ ID NO: 2974287 - DNA, 20 bp, Homo sapiens
ggccagctgccccagccaga

SEQ ID NO: 2974288 - DNA, 18 bp, Homo sapiens
ggccagctggcagcagag

SEQ ID NO: 2974289 - DNA, 17 bp, Homo sapiens
ggccaggccagctgcct

SEQ ID NO: 2974290 - DNA, 23 bp, Homo sapiens
ggccaggccctgggtcttgccat

SEQ ID NO: 2974291 - DNA, 10 bp, Homo sapiens
ggccaggcct

SEQ ID NO: 2974292 - DNA, 19 bp, Homo sapiens
ggccaggctggtctaaaac

SEQ ID NO: 2974293 - DNA, 17 bp, Homo sapiens
ggccagggagaagctcc

SEQ ID NO: 2974294 - DNA, 18 bp, Homo sapiens
ggccagggagaagctcct

SEQ ID NO: 2974295 - DNA, 14 bp, Homo sapiens
ggccagggaggcag

SEQ ID NO: 2974296 - DNA, 19 bp, Homo sapiens
ggccaggtagcagcaaata

SEQ ID NO: 2974297 - DNA, 23 bp, Homo sapiens
ggccaggtgcggcctggggggaa

SEQ ID NO: 2974298 - DNA, 21 bp, Homo sapiens
ggccaggttggaaaagaaatc

SEQ ID NO: 2974299 - DNA, 22 bp, Homo sapiens
ggccagtcttcctcttagcctc

SEQ ID NO: 2974300 - DNA, 15 bp, Homo sapiens
ggccagtgctgccca

SEQ ID NO: 2974301 - DNA, 15 bp, Homo sapiens
ggccatcactcagcc

SEQ ID NO: 2974302 - DNA, 17 bp, Homo sapiens
ggccatcactcagcccc

SEQ ID NO: 2974303 - DNA, 18 bp, Homo sapiens
ggccatcactcagcccct

SEQ ID NO: 2974304 - DNA, 20 bp, Homo sapiens
ggccatccttccctgtctgc

SEQ ID NO: 2974305 - DNA, 22 bp, Homo sapiens
ggccatctggttaggatggcag

SEQ ID NO: 2974306 - DNA, 14 bp, Homo sapiens
ggccatgcctcagc

SEQ ID NO: 2974307 - DNA, 14 bp, Homo sapiens
ggccatggctcagg

SEQ ID NO: 2974308 - DNA, 22 bp, Homo sapiens
ggccatggctttcatcctgtgt

SEQ ID NO: 2974309 - DNA, 17 bp, Homo sapiens
ggccatgtggcctgccc

SEQ ID NO: 2974310 - DNA, 18 bp, Homo sapiens
ggccatgtggcctgccca

SEQ ID NO: 2974311 - DNA, 20 bp, Homo sapiens
ggccatgtggcctgcccagc

SEQ ID NO: 2974312 - DNA, 20 bp, Homo sapiens
ggccattctttcccaacacc

SEQ ID NO: 2974313 - DNA, 17 bp, Homo sapiens
ggcccaagtctcctagg

SEQ ID NO: 2974314 - DNA, 11 bp, Homo sapiens
ggcccacacac

SEQ ID NO: 2974315 - DNA, 12 bp, Homo sapiens
ggcccacacaca

SEQ ID NO: 2974316 - DNA, 12 bp, Homo sapiens
ggcccacagccc

SEQ ID NO: 2974317 - DNA, 22 bp, Homo sapiens
ggcccacagcccccaccccagc

SEQ ID NO: 2974318 - DNA, 18 bp, Homo sapiens
ggcccacagctcccaccc

SEQ ID NO: 2974319 - DNA, 20 bp, Homo sapiens
ggcccacagctcccacccca

SEQ ID NO: 2974320 - DNA, 23 bp, Homo sapiens
ggcccacccagtccatgctccag

SEQ ID NO: 2974321 - DNA, 18 bp, Homo sapiens
ggcccacccggtgggacc

SEQ ID NO: 2974322 - DNA, 15 bp, Homo sapiens
ggcccagagcccagc

SEQ ID NO: 2974323 - DNA, 19 bp, Homo sapiens
ggcccagagcccagctcca

SEQ ID NO: 2974324 - DNA, 20 bp, Homo sapiens
ggcccagagtgaaccgtcct

SEQ ID NO: 2974325 - DNA, 12 bp, Homo sapiens
ggcccagcaccc

SEQ ID NO: 2974326 - DNA, 15 bp, Homo sapiens
ggcccagcgctctcc

SEQ ID NO: 2974327 - DNA, 17 bp, Homo sapiens
ggcccagcgctctcctg

SEQ ID NO: 2974328 - DNA, 16 bp, Homo sapiens
ggcccaggcaggtctg

SEQ ID NO: 2974329 - DNA, 18 bp, Homo sapiens
ggcccaggcaggtctgca

SEQ ID NO: 2974330 - DNA, 15 bp, Homo sapiens
ggcccaggcctggag

SEQ ID NO: 2974331 - DNA, 19 bp, Homo sapiens
ggcccaggcctggagcgtt

SEQ ID NO: 2974332 - DNA, 16 bp, Homo sapiens
ggcccagggcccagag

SEQ ID NO: 2974333 - DNA, 17 bp, Homo sapiens
ggcccagggcccagagc

SEQ ID NO: 2974334 - DNA, 18 bp, Homo sapiens
ggcccagggcccagagcc

SEQ ID NO: 2974335 - DNA, 16 bp, Homo sapiens
ggcccagggggcctgg

SEQ ID NO: 2974336 - DNA, 18 bp, Homo sapiens
ggcccagggggcctggag

SEQ ID NO: 2974337 - DNA, 15 bp, Homo sapiens
ggcccaggtgagtcc

SEQ ID NO: 2974338 - DNA, 22 bp, Homo sapiens
ggcccagtgcatggtggccaga

SEQ ID NO: 2974339 - DNA, 14 bp, Homo sapiens
ggcccatctgtcca

SEQ ID NO: 2974340 - DNA, 19 bp, Homo sapiens
ggcccatctgtccatcctc

SEQ ID NO: 2974341 - DNA, 20 bp, Homo sapiens
ggcccatctgtccatcctcc

SEQ ID NO: 2974342 - DNA, 22 bp, Homo sapiens
ggcccatctgtccatcctcctc

SEQ ID NO: 2974343 - DNA, 23 bp, Homo sapiens
ggcccatctgtccatcctcctct

SEQ ID NO: 2974344 - DNA, 18 bp, Homo sapiens
ggcccatggaggagacag

SEQ ID NO: 2974345 - DNA, 22 bp, Homo sapiens
ggccccacaggagttgtgagcc

SEQ ID NO: 2974346 - DNA, 15 bp, Homo sapiens
ggccccaccacctag

SEQ ID NO: 2974347 - DNA, 14 bp, Homo sapiens
ggccccaggaagcc

SEQ ID NO: 2974348 - DNA, 15 bp, Homo sapiens
ggccccaggaagccg

SEQ ID NO: 2974349 - DNA, 24 bp, Homo sapiens
ggcccccacatttgtgccgacact

SEQ ID NO: 2974350 - DNA, 14 bp, Homo sapiens
ggcccccatctcat

SEQ ID NO: 2974351 - DNA, 15 bp, Homo sapiens
ggcccccatctcatg

SEQ ID NO: 2974352 - DNA, 21 bp, Homo sapiens
ggcccccatctcatgcccctg

SEQ ID NO: 2974353 - DNA, 22 bp, Homo sapiens
ggccccctaggattccccctgc

SEQ ID NO: 2974354 - DNA, 20 bp, Homo sapiens
ggccccctcaccccagctcc

SEQ ID NO: 2974355 - DNA, 14 bp, Homo sapiens
ggccccctcagctc

SEQ ID NO: 2974356 - DNA, 14 bp, Homo sapiens
ggccccgagctcag

SEQ ID NO: 2974357 - DNA, 15 bp, Homo sapiens
ggccccgccgcctgg

SEQ ID NO: 2974358 - DNA, 18 bp, Homo sapiens
ggccccgccgcctggtac

SEQ ID NO: 2974359 - DNA, 16 bp, Homo sapiens
ggcccctcaccctctg

SEQ ID NO: 2974360 - DNA, 17 bp, Homo sapiens
ggcccctcaccctctgt

SEQ ID NO: 2974361 - DNA, 17 bp, Homo sapiens
ggcccctcaggggaagc

SEQ ID NO: 2974362 - DNA, 14 bp, Homo sapiens
ggcccctcccacac

SEQ ID NO: 2974363 - DNA, 23 bp, Homo sapiens
ggcccctcccacacccaaagctg

SEQ ID NO: 2974364 - DNA, 19 bp, Homo sapiens
ggcccctcgaccctgtgca

SEQ ID NO: 2974365 - DNA, 19 bp, Homo sapiens
ggcccctgccagaccccct

SEQ ID NO: 2974366 - DNA, 18 bp, Homo sapiens
ggcccctggcccaggagg

SEQ ID NO: 2974367 - DNA, 16 bp, Homo sapiens
ggccccttgctggagt

SEQ ID NO: 2974368 - DNA, 13 bp, Homo sapiens
ggcccgacatggc

SEQ ID NO: 2974369 - DNA, 18 bp, Homo sapiens
ggcccgcagcctggcatc

SEQ ID NO: 2974370 - DNA, 12 bp, Homo sapiens
ggcccgcggcct

SEQ ID NO: 2974371 - DNA, 13 bp, Homo sapiens
ggcccgcggcctg

SEQ ID NO: 2974372 - DNA, 14 bp, Homo sapiens
ggcccggcagggcg

SEQ ID NO: 2974373 - DNA, 18 bp, Homo sapiens
ggcccggcagggcgggca

SEQ ID NO: 2974374 - DNA, 12 bp, Homo sapiens
ggcccggccagc

SEQ ID NO: 2974375 - DNA, 20 bp, Homo sapiens
ggcccggccagccatgtctg

SEQ ID NO: 2974376 - DNA, 15 bp, Homo sapiens
ggcccggcccctcac

SEQ ID NO: 2974377 - DNA, 18 bp, Homo sapiens
ggcccggcccctcaccct

SEQ ID NO: 2974378 - DNA, 16 bp, Homo sapiens
ggcccggctgggcccc

SEQ ID NO: 2974379 - DNA, 18 bp, Homo sapiens
ggcccggtggcggcaggg

SEQ ID NO: 2974380 - DNA, 19 bp, Homo sapiens
ggcccgtcggagctgcctg

SEQ ID NO: 2974381 - DNA, 21 bp, Homo sapiens
ggcccgtctgtccatctgccc

SEQ ID NO: 2974382 - DNA, 13 bp, Homo sapiens
ggcccgtgacaga

SEQ ID NO: 2974383 - DNA, 21 bp, Homo sapiens
ggcccgtggcttggcatctgt

SEQ ID NO: 2974384 - DNA, 23 bp, Homo sapiens
ggccctaagaggtttttcctctt

SEQ ID NO: 2974385 - DNA, 19 bp, Homo sapiens
ggccctccctgcgcttcct

SEQ ID NO: 2974386 - DNA, 22 bp, Homo sapiens
ggccctccctgttccccagaga

SEQ ID NO: 2974387 - DNA, 16 bp, Homo sapiens
ggccctcctaccctgc

SEQ ID NO: 2974388 - DNA, 15 bp, Homo sapiens
ggccctcgctgccag

SEQ ID NO: 2974389 - DNA, 16 bp, Homo sapiens
ggccctcgctgccagc

SEQ ID NO: 2974390 - DNA, 16 bp, Homo sapiens
ggccctctctgcaccg

SEQ ID NO: 2974391 - DNA, 15 bp, Homo sapiens
ggccctctctgctct

SEQ ID NO: 2974392 - DNA, 23 bp, Homo sapiens
ggccctctgcctgcactccctgg

SEQ ID NO: 2974393 - DNA, 21 bp, Homo sapiens
ggccctgactgtcagggaggg

SEQ ID NO: 2974394 - DNA, 19 bp, Homo sapiens
ggcttgaatttgcatgtct

SEQ ID NO: 2974395 - DNA, 15 bp, Homo sapiens
ggcttgactttggct

SEQ ID NO: 2974396 - DNA, 21 bp, Homo sapiens
ggcttgagaaatatggacact

SEQ ID NO: 2974397 - DNA, 22 bp, Homo sapiens
ggcttgcctgggctgggcagcc

SEQ ID NO: 2974398 - DNA, 18 bp, Homo sapiens
ggcttggcatctgtgtgc

SEQ ID NO: 2974399 - DNA, 18 bp, Homo sapiens
ggcttggcccgcggcctg

SEQ ID NO: 2974400 - DNA, 16 bp, Homo sapiens
ggcttggcctatctcc

SEQ ID NO: 2974401 - DNA, 19 bp, Homo sapiens
ggctttaaccgtttttcaa

SEQ ID NO: 2974402 - DNA, 22 bp, Homo sapiens
ggctttatgataatagattctc

SEQ ID NO: 2974403 - DNA, 17 bp, Homo sapiens
ggctttcacgggcccca

SEQ ID NO: 2974404 - DNA, 15 bp, Homo sapiens
ggctttcagcgcccc

SEQ ID NO: 2974405 - DNA, 18 bp, Homo sapiens
ggctttcagcgcccccag

SEQ ID NO: 2974406 - DNA, 19 bp, Homo sapiens
ggctttcagcgcccccagg

SEQ ID NO: 2974407 - DNA, 12 bp, Homo sapiens
ggctttcagctt

SEQ ID NO: 2974408 - DNA, 15 bp, Homo sapiens
ggctttcatcctgtg

SEQ ID NO: 2974409 - DNA, 16 bp, Homo sapiens
ggctttcatcctgtgt

SEQ ID NO: 2974410 - DNA, 22 bp, Homo sapiens
ggctttcattattagtactgct

SEQ ID NO: 2974411 - DNA, 16 bp, Homo sapiens
ggctttcccttatcaa

SEQ ID NO: 2974412 - DNA, 21 bp, Homo sapiens
ggctttcgtccacagcttcct

SEQ ID NO: 2974413 - DNA, 22 bp, Homo sapiens
ggctttcgtccacagcttcctg

SEQ ID NO: 2974414 - DNA, 21 bp, Homo sapiens
ggctttggagactttctttaa

SEQ ID NO: 2974415 - DNA, 17 bp, Homo sapiens
ggctttggcaacagaaa

SEQ ID NO: 2974416 - DNA, 14 bp, Homo sapiens
ggcttttctcagct

SEQ ID NO: 2974417 - DNA, 12 bp, Homo sapiens
gggaaaaaataa

SEQ ID NO: 2974418 - DNA, 17 bp, Homo sapiens
gggaaaaactgcagtca

SEQ ID NO: 2974419 - DNA, 13 bp, Homo sapiens
gggaaaatatttc

SEQ ID NO: 2974420 - DNA, 22 bp, Homo sapiens
gggaaactgtgaatgcttctga

SEQ ID NO: 2974421 - DNA, 18 bp, Homo sapiens
gggaaagacactgcctgg

SEQ ID NO: 2974422 - DNA, 13 bp, Homo sapiens
gggaacactgccc

SEQ ID NO: 2974423 - DNA, 18 bp, Homo sapiens
gggaacatatttaaggaa

SEQ ID NO: 2974424 - DNA, 21 bp, Homo sapiens
gggaacatttattttatgaga

SEQ ID NO: 2974425 - DNA, 14 bp, Homo sapiens
gggaacgcagcctc

SEQ ID NO: 2974426 - DNA, 14 bp, Homo sapiens
gggaacgtgactgc

SEQ ID NO: 2974427 - DNA, 17 bp, Homo sapiens
gggaacgtgactgcccc

SEQ ID NO: 2974428 - DNA, 13 bp, Homo sapiens
gggaactcctgga

SEQ ID NO: 2974429 - DNA, 16 bp, Homo sapiens
gggaagagatccaaag

SEQ ID NO: 2974430 - DNA, 17 bp, Homo sapiens
gggaagagatccaaaga

SEQ ID NO: 2974431 - DNA, 14 bp, Homo sapiens
gggaagagggggcg

SEQ ID NO: 2974432 - DNA, 12 bp, Homo sapiens
gggaagccctgg

SEQ ID NO: 2974433 - DNA, 12 bp, Homo sapiens
gggaagccttta

SEQ ID NO: 2974434 - DNA, 16 bp, Homo sapiens
gggaagctacaggtta

SEQ ID NO: 2974435 - DNA, 13 bp, Homo sapiens
gggaagggagagc

SEQ ID NO: 2974436 - DNA, 14 bp, Homo sapiens
gggaaggggaggac

SEQ ID NO: 2974437 - DNA, 13 bp, Homo sapiens
gggaaggggtgca

SEQ ID NO: 2974438 - DNA, 19 bp, Homo sapiens
gggaaggtttttaagggcc

SEQ ID NO: 2974439 - DNA, 22 bp, Homo sapiens
gggaagtacgtcccagcggcct

SEQ ID NO: 2974440 - DNA, 14 bp, Homo sapiens
gggaagtccccagg

SEQ ID NO: 2974441 - DNA, 23 bp, Homo sapiens
gggaagtgaagactggaagctaa

SEQ ID NO: 2974442 - DNA, 12 bp, Homo sapiens
gggaatacaaaa

SEQ ID NO: 2974443 - DNA, 16 bp, Homo sapiens
gggaatattgtttctt

SEQ ID NO: 2974444 - DNA, 12 bp, Homo sapiens
gggaatcaagat

SEQ ID NO: 2974445 - DNA, 12 bp, Homo sapiens
gggaatcacatc

SEQ ID NO: 2974446 - DNA, 22 bp, Homo sapiens
gggaatctaagagagctgccat

SEQ ID NO: 2974447 - DNA, 14 bp, Homo sapiens
gggaatgaagcttg

SEQ ID NO: 2974448 - DNA, 15 bp, Homo sapiens
gggaatgatatgcat

SEQ ID NO: 2974449 - DNA, 22 bp, Homo sapiens
gggaattctttacaataaacat

SEQ ID NO: 2974450 - DNA, 17 bp, Homo sapiens
gggaattttgtttttag

SEQ ID NO: 2974451 - DNA, 14 bp, Homo sapiens
gggacaaagaaatc

SEQ ID NO: 2974452 - DNA, 19 bp, Homo sapiens
gggacaccgtggggaaggg

SEQ ID NO: 2974453 - DNA, 22 bp, Homo sapiens
gggacacctaggctagggtggg

SEQ ID NO: 2974454 - DNA, 14 bp, Homo sapiens
gggacacctgccca

SEQ ID NO: 2974455 - DNA, 20 bp, Homo sapiens
gggacagaaaccaaggcccc

SEQ ID NO: 2974456 - DNA, 17 bp, Homo sapiens
gggacagaggccccagc

SEQ ID NO: 2974457 - DNA, 13 bp, Homo sapiens
gggacagccttca

SEQ ID NO: 2974458 - DNA, 17 bp, Homo sapiens
gggacaggggcaggagg

SEQ ID NO: 2974459 - DNA, 21 bp, Homo sapiens
gggacagggtgtctcctgaag

SEQ ID NO: 2974460 - DNA, 22 bp, Homo sapiens
gggacagtaataagaatggaaa

SEQ ID NO: 2974461 - DNA, 18 bp, Homo sapiens
gggacatcacagggtggg

SEQ ID NO: 2974462 - DNA, 19 bp, Homo sapiens
gggacatcaggagactggg

SEQ ID NO: 2974463 - DNA, 14 bp, Homo sapiens
gggacatgctaaat

SEQ ID NO: 2974464 - DNA, 11 bp, Homo sapiens
gggaccaaata

SEQ ID NO: 2974465 - DNA, 15 bp, Homo sapiens
gggaccactgggccc

SEQ ID NO: 2974466 - DNA, 19 bp, Homo sapiens
gggaccactgggcccctca

SEQ ID NO: 2974467 - DNA, 22 bp, Homo sapiens
gggaccagaaacctgggagaga

SEQ ID NO: 2974468 - DNA, 15 bp, Homo sapiens
gggaccagagggatg

SEQ ID NO: 2974469 - DNA, 16 bp, Homo sapiens
gggaccataagaggag

SEQ ID NO: 2974470 - DNA, 21 bp, Homo sapiens
gggacccaatgtaggagctgc

SEQ ID NO: 2974471 - DNA, 18 bp, Homo sapiens
gggaccccacccctcatc

SEQ ID NO: 2974472 - DNA, 23 bp, Homo sapiens
gggaccccacccctcatcaggag

SEQ ID NO: 2974473 - DNA, 23 bp, Homo sapiens
gggacccccgtggggcagggagc

SEQ ID NO: 2974474 - DNA, 20 bp, Homo sapiens
gggaccccgagcctggctcc

SEQ ID NO: 2974475 - DNA, 16 bp, Homo sapiens
gggaccctttccttcc

SEQ ID NO: 2974476 - DNA, 13 bp, Homo sapiens
gggaccttggtct

SEQ ID NO: 2974477 - DNA, 15 bp, Homo sapiens
gggacctttaaaaag

SEQ ID NO: 2974478 - DNA, 12 bp, Homo sapiens
gggacgcaggcc

SEQ ID NO: 2974479 - DNA, 14 bp, Homo sapiens
gggacgcaggcccc

SEQ ID NO: 2974480 - DNA, 16 bp, Homo sapiens
gggacgcaggcccctc

SEQ ID NO: 2974481 - DNA, 18 bp, Homo sapiens
gggacgtggctcagccag

SEQ ID NO: 2974482 - DNA, 19 bp, Homo sapiens
gggactgaaaacctctcct

SEQ ID NO: 2974483 - DNA, 15 bp, Homo sapiens
gggactgctggctca

SEQ ID NO: 2974484 - DNA, 12 bp, Homo sapiens
gggactgggcca

SEQ ID NO: 2974485 - DNA, 17 bp, Homo sapiens
gggactgggccatgggt

SEQ ID NO: 2974486 - DNA, 14 bp, Homo sapiens
gggactggtcccgg

SEQ ID NO: 2974487 - DNA, 18 bp, Homo sapiens
gggagaaagaggggcctg

SEQ ID NO: 2974488 - DNA, 13 bp, Homo sapiens
gggagaaggcctc

SEQ ID NO: 2974489 - DNA, 17 bp, Homo sapiens
gggagaaggcctcccct

SEQ ID NO: 2974490 - DNA, 17 bp, Homo sapiens
gggagaatcagcagaac

SEQ ID NO: 2974491 - DNA, 20 bp, Homo sapiens
gggagacggtttccagggag

SEQ ID NO: 2974492 - DNA, 16 bp, Homo sapiens
gggagactgggctgag

SEQ ID NO: 2974493 - DNA, 14 bp, Homo sapiens
gggagagccaggct

SEQ ID NO: 2974494 - DNA, 12 bp, Homo sapiens
gggagaggctgt

SEQ ID NO: 2974495 - DNA, 21 bp, Homo sapiens
gggagagggcctctgcctggg

SEQ ID NO: 2974496 - DNA, 21 bp, Homo sapiens
gggagagtgtcaaccagacag

SEQ ID NO: 2974497 - DNA, 18 bp, Homo sapiens
gggagccacatttacata

SEQ ID NO: 2974498 - DNA, 14 bp, Homo sapiens
gggagccgagggcg

SEQ ID NO: 2974499 - DNA, 17 bp, Homo sapiens
gggagcctgaggcagga

SEQ ID NO: 2974500 - DNA, 22 bp, Homo sapiens
gggagcctttggttctggccag

SEQ ID NO: 2974501 - DNA, 22 bp, Homo sapiens
gggagctcaggaaccgaggcag

SEQ ID NO: 2974502 - DNA, 21 bp, Homo sapiens
gggagctccaactcagaaggg

SEQ ID NO: 2974503 - DNA, 12 bp, Homo sapiens
gggagctgaggc

SEQ ID NO: 2974504 - DNA, 15 bp, Homo sapiens
gggagctgaggcctc

SEQ ID NO: 2974505 - DNA, 16 bp, Homo sapiens
gggagctgaggcctcc

SEQ ID NO: 2974506 - DNA, 20 bp, Homo sapiens
gggaggaaagggcctggcca

SEQ ID NO: 2974507 - DNA, 21 bp, Homo sapiens
gggaggaccagggcagggcca

SEQ ID NO: 2974508 - DNA, 16 bp, Homo sapiens
gggaggagggcaggca

SEQ ID NO: 2974509 - DNA, 20 bp, Homo sapiens
gggaggatcctgagctgctg

SEQ ID NO: 2974510 - DNA, 18 bp, Homo sapiens
gggaggcacttcctcccc

SEQ ID NO: 2974511 - DNA, 20 bp, Homo sapiens
gggaggccaaggtgggcgga

SEQ ID NO: 2974512 - DNA, 14 bp, Homo sapiens
gggaggccccaggg

SEQ ID NO: 2974513 - DNA, 15 bp, Homo sapiens
gggaggctcaggtcc

SEQ ID NO: 2974514 - DNA, 16 bp, Homo sapiens
gggaggctgcagccag

SEQ ID NO: 2974515 - DNA, 20 bp, Homo sapiens
gggaggctgcagccaggcct

SEQ ID NO: 2974516 - DNA, 13 bp, Homo sapiens
gggagggagccat

SEQ ID NO: 2974517 - DNA, 22 bp, Homo sapiens
gggagggagtctcaggaggagg

SEQ ID NO: 2974518 - DNA, 11 bp, Homo sapiens
gggagggcagc

SEQ ID NO: 2974519 - DNA, 13 bp, Homo sapiens
gggagggccaggg

SEQ ID NO: 2974520 - DNA, 21 bp, Homo sapiens
gggaggtctcgtcccagccct

SEQ ID NO: 2974521 - DNA, 14 bp, Homo sapiens
gggaggtgggaggc

SEQ ID NO: 2974522 - DNA, 19 bp, Homo sapiens
gggaggtgggaggccaggc

SEQ ID NO: 2974523 - DNA, 19 bp, Homo sapiens
gggagtctcaggaggaggc

SEQ ID NO: 2974524 - DNA, 20 bp, Homo sapiens
gggagtctccctccgactcc

SEQ ID NO: 2974525 - DNA, 17 bp, Homo sapiens
gggagtctgaagcagat

SEQ ID NO: 2974526 - DNA, 20 bp, Homo sapiens
gggagttaagacctggcagc

SEQ ID NO: 2974527 - DNA, 18 bp, Homo sapiens
ggtgagctggtgcctgct

SEQ ID NO: 2974528 - DNA, 21 bp, Homo sapiens
ggtgaggcgttctcctgcttg

SEQ ID NO: 2974529 - DNA, 19 bp, Homo sapiens
ggtgagttttaaagaagtc

SEQ ID NO: 2974530 - DNA, 15 bp, Homo sapiens
ggtgatggccagagg

SEQ ID NO: 2974531 - DNA, 21 bp, Homo sapiens
ggtgatttcttgctaagctcc

SEQ ID NO: 2974532 - DNA, 19 bp, Homo sapiens
ggtgcaattaactctggac

SEQ ID NO: 2974533 - DNA, 13 bp, Homo sapiens
ggtgcaatttcaa

SEQ ID NO: 2974534 - DNA, 21 bp, Homo sapiens
ggtgcacacatcaccaggtgc

SEQ ID NO: 2974535 - DNA, 15 bp, Homo sapiens
ggtgcactttgtaaa

SEQ ID NO: 2974536 - DNA, 13 bp, Homo sapiens
ggtgcagaggaag

SEQ ID NO: 2974537 - DNA, 13 bp, Homo sapiens
ggtgcagctgcgt

SEQ ID NO: 2974538 - DNA, 22 bp, Homo sapiens
ggtgcagtttgaggggcctgtg

SEQ ID NO: 2974539 - DNA, 16 bp, Homo sapiens
ggtgcatctgcaggca

SEQ ID NO: 2974540 - DNA, 17 bp, Homo sapiens
ggtgcatctgcaggcac

SEQ ID NO: 2974541 - DNA, 16 bp, Homo sapiens
ggtgccagatcctctt

SEQ ID NO: 2974542 - DNA, 16 bp, Homo sapiens
ggtgccccaggaccag

SEQ ID NO: 2974543 - DNA, 20 bp, Homo sapiens
ggtgcccccagacagctgct

SEQ ID NO: 2974544 - DNA, 23 bp, Homo sapiens
ggtgcccccagacagctgctcag

SEQ ID NO: 2974545 - DNA, 22 bp, Homo sapiens
ggtgcctgggtggggctgctcc

SEQ ID NO: 2974546 - DNA, 17 bp, Homo sapiens
ggtgcgggcacctgtag

SEQ ID NO: 2974547 - DNA, 12 bp, Homo sapiens
ggtgctaaatct

SEQ ID NO: 2974548 - DNA, 22 bp, Homo sapiens
ggtgctacacccttttccagct

SEQ ID NO: 2974549 - DNA, 16 bp, Homo sapiens
ggtgctaggcccctgt

SEQ ID NO: 2974550 - DNA, 17 bp, Homo sapiens
ggtgctgacggccaggg

SEQ ID NO: 2974551 - DNA, 22 bp, Homo sapiens
ggtgctgagtagatgcgcagcc

SEQ ID NO: 2974552 - DNA, 21 bp, Homo sapiens
ggtgctgcagcaccgaggggc

SEQ ID NO: 2974553 - DNA, 20 bp, Homo sapiens
ggtgctggtagctgagggga

SEQ ID NO: 2974554 - DNA, 19 bp, Homo sapiens
ggtgctgtcctcaggtggc

SEQ ID NO: 2974555 - DNA, 13 bp, Homo sapiens
ggtggacccaggg

SEQ ID NO: 2974556 - DNA, 21 bp, Homo sapiens
ggtggagaagatcgcatggca

SEQ ID NO: 2974557 - DNA, 12 bp, Homo sapiens
ggtggagaagcc

SEQ ID NO: 2974558 - DNA, 20 bp, Homo sapiens
ggtggaggttgcagtgagct

SEQ ID NO: 2974559 - DNA, 15 bp, Homo sapiens
ggtggatcacagagg

SEQ ID NO: 2974560 - DNA, 23 bp, Homo sapiens
ggtggattctccctgggcctcag

SEQ ID NO: 2974561 - DNA, 17 bp, Homo sapiens
ggtggcacatctgtcct

SEQ ID NO: 2974562 - DNA, 14 bp, Homo sapiens
ggtggcaggtcact

SEQ ID NO: 2974563 - DNA, 20 bp, Homo sapiens
ggtggcaggtcactgtcact

SEQ ID NO: 2974564 - DNA, 11 bp, Homo sapiens
ggtggccacag

SEQ ID NO: 2974565 - DNA, 12 bp, Homo sapiens
ggtggcccaggt

SEQ ID NO: 2974566 - DNA, 22 bp, Homo sapiens
ggtggcccaggtggctattttg

SEQ ID NO: 2974567 - DNA, 11 bp, Homo sapiens
ggtggccctga

SEQ ID NO: 2974568 - DNA, 14 bp, Homo sapiens
ggtggccgcccctg

SEQ ID NO: 2974569 - DNA, 23 bp, Homo sapiens
ggtggccgcccctgaggcttcac

SEQ ID NO: 2974570 - DNA, 19 bp, Homo sapiens
ggtggcctctgctggtctc

SEQ ID NO: 2974571 - DNA, 17 bp, Homo sapiens
ggtggcgcgcctgcctt

SEQ ID NO: 2974572 - DNA, 14 bp, Homo sapiens
ggtggcggcagggc

SEQ ID NO: 2974573 - DNA, 19 bp, Homo sapiens
ggtggcggcagggccaggc

SEQ ID NO: 2974574 - DNA, 16 bp, Homo sapiens
ggtggcggccccagca

SEQ ID NO: 2974575 - DNA, 19 bp, Homo sapiens
ggtggctaagggggaccat

SEQ ID NO: 2974576 - DNA, 21 bp, Homo sapiens
ggtggctagtcaagctcctcc

SEQ ID NO: 2974577 - DNA, 17 bp, Homo sapiens
ggtggctagtcagagag

SEQ ID NO: 2974578 - DNA, 14 bp, Homo sapiens
ggtggctcacgcct

SEQ ID NO: 2974579 - DNA, 19 bp, Homo sapiens
ggtggctccccctctgctt

SEQ ID NO: 2974580 - DNA, 21 bp, Homo sapiens
ggtggctgacccagtccctgg

SEQ ID NO: 2974581 - DNA, 14 bp, Homo sapiens
ggtggctgcctttg

SEQ ID NO: 2974582 - DNA, 22 bp, Homo sapiens
ggtggctgtttcttgtctgtta

SEQ ID NO: 2974583 - DNA, 14 bp, Homo sapiens
ggtggcttcagctc

SEQ ID NO: 2974584 - DNA, 18 bp, Homo sapiens
ggtgggaaggaaaggcag

SEQ ID NO: 2974585 - DNA, 15 bp, Homo sapiens
ggtgggaaggggagc

SEQ ID NO: 2974586 - DNA, 20 bp, Homo sapiens
ggtgggacccccgtggggca

SEQ ID NO: 2974587 - DNA, 20 bp, Homo sapiens
ggtgggagaattgcttgagc

SEQ ID NO: 2974588 - DNA, 16 bp, Homo sapiens
ggtgggaggaaagggc

SEQ ID NO: 2974589 - DNA, 16 bp, Homo sapiens
ggtgggaggccaggcg

SEQ ID NO: 2974590 - DNA, 12 bp, Homo sapiens
ggtgggaggggc

SEQ ID NO: 2974591 - DNA, 13 bp, Homo sapiens
ggtgggaggggcc

SEQ ID NO: 2974592 - DNA, 20 bp, Homo sapiens
ggtgggcagcagcatcccag

SEQ ID NO: 2974593 - DNA, 14 bp, Homo sapiens
ggtgggcagtgagt

SEQ ID NO: 2974594 - DNA, 12 bp, Homo sapiens
ggtgggccaggc

SEQ ID NO: 2974595 - DNA, 17 bp, Homo sapiens
ggtgggcggacaaaagg

SEQ ID NO: 2974596 - DNA, 23 bp, Homo sapiens
ggtgggcggacaaaagggccagg

SEQ ID NO: 2974597 - DNA, 21 bp, Homo sapiens
ggtggggagagacgggccctg

SEQ ID NO: 2974598 - DNA, 20 bp, Homo sapiens
ggtggggcccatggaggaga

SEQ ID NO: 2974599 - DNA, 22 bp, Homo sapiens
ggtggggcccatggaggagaca

SEQ ID NO: 2974600 - DNA, 18 bp, Homo sapiens
ggtggggctgctcctcca

SEQ ID NO: 2974601 - DNA, 12 bp, Homo sapiens
ggtgggggccag

SEQ ID NO: 2974602 - DNA, 16 bp, Homo sapiens
ggtgggggctggaggt

SEQ ID NO: 2974603 - DNA, 22 bp, Homo sapiens
ggtggggggggggcgcggctgg

SEQ ID NO: 2974604 - DNA, 19 bp, Homo sapiens
ggtggggtcatgccctcct

SEQ ID NO: 2974605 - DNA, 23 bp, Homo sapiens
ggtggggtcatgccctcctctcc

SEQ ID NO: 2974606 - DNA, 14 bp, Homo sapiens
ggtggggtgggggt

SEQ ID NO: 2974607 - DNA, 17 bp, Homo sapiens
ggtgggttttcttccca

SEQ ID NO: 2974608 - DNA, 16 bp, Homo sapiens
ggtggtattctgtcat

SEQ ID NO: 2974609 - DNA, 22 bp, Homo sapiens
ggtggtctgagctgtcccaagt

SEQ ID NO: 2974610 - DNA, 18 bp, Homo sapiens
ggtggtctgcaggcaggg

SEQ ID NO: 2974611 - DNA, 15 bp, Homo sapiens
ggtggtggctcggga

SEQ ID NO: 2974612 - DNA, 19 bp, Homo sapiens
ggtggtggtattctgtcat

SEQ ID NO: 2974613 - DNA, 13 bp, Homo sapiens
ggtggtgttttta

SEQ ID NO: 2974614 - DNA, 23 bp, Homo sapiens
ggtggttcactcttggagcctgc

SEQ ID NO: 2974615 - DNA, 19 bp, Homo sapiens
ggtggttcattccacagga

SEQ ID NO: 2974616 - DNA, 23 bp, Homo sapiens
ggtggttgctgttttcctccctt

SEQ ID NO: 2974617 - DNA, 21 bp, Homo sapiens
ggtgtaaccatttgttaactg

SEQ ID NO: 2974618 - DNA, 17 bp, Homo sapiens
ggtgtaatctcaatgca

SEQ ID NO: 2974619 - DNA, 18 bp, Homo sapiens
ggtgtatatcatgaagcc

SEQ ID NO: 2974620 - DNA, 21 bp, Homo sapiens
ggtgtcacccaaaccggcagg

SEQ ID NO: 2974621 - DNA, 15 bp, Homo sapiens
ggtgtcaccccagag

SEQ ID NO: 2974622 - DNA, 17 bp, Homo sapiens
ggtgtcaccccagagcc

SEQ ID NO: 2974623 - DNA, 21 bp, Homo sapiens
ggtgtcaccccagagccacac

SEQ ID NO: 2974624 - DNA, 22 bp, Homo sapiens
ggtgtcaccccagagccacaca

SEQ ID NO: 2974625 - DNA, 13 bp, Homo sapiens
ggtgtcaggcccg

SEQ ID NO: 2974626 - DNA, 15 bp, Homo sapiens
ggtgtctggcctgag

SEQ ID NO: 2974627 - DNA, 20 bp, Homo sapiens
ggtgtctggcctgaggtcaa

SEQ ID NO: 2974628 - DNA, 17 bp, Homo sapiens
ggtgtgatagagccttt

SEQ ID NO: 2974629 - DNA, 17 bp, Homo sapiens
ggtgtgcaccagggttg

SEQ ID NO: 2974630 - DNA, 13 bp, Homo sapiens
ggtgtgctacaga

SEQ ID NO: 2974631 - DNA, 16 bp, Homo sapiens
ggtgtggtggcctgtg

SEQ ID NO: 2974632 - DNA, 23 bp, Homo sapiens
ggtgtgtccccctctgtccaggc

SEQ ID NO: 2974633 - DNA, 14 bp, Homo sapiens
ggtgtgtgaagttt

SEQ ID NO: 2974634 - DNA, 16 bp, Homo sapiens
ggtgtgtgtctctgac

SEQ ID NO: 2974635 - DNA, 21 bp, Homo sapiens
ggtgtgttggacagagaaggg

SEQ ID NO: 2974636 - DNA, 20 bp, Homo sapiens
ggtgttatgtttatgtaaca

SEQ ID NO: 2974637 - DNA, 13 bp, Homo sapiens
ggtgttctaagat

SEQ ID NO: 2974638 - DNA, 10 bp, Homo sapiens
ggtgtttcta

SEQ ID NO: 2974639 - DNA, 23 bp, Homo sapiens
ggtgtttctccctctcactgtct

SEQ ID NO: 2974640 - DNA, 13 bp, Homo sapiens
ggtgttttctgtg

SEQ ID NO: 2974641 - DNA, 17 bp, Homo sapiens
ggtgttttctgtgtaac

SEQ ID NO: 2974642 - DNA, 17 bp, Homo sapiens
ggttaagaaagcactta

SEQ ID NO: 2974643 - DNA, 14 bp, Homo sapiens
ggttaagtagcagg

SEQ ID NO: 2974644 - DNA, 16 bp, Homo sapiens
ggttaatttttccttc

SEQ ID NO: 2974645 - DNA, 22 bp, Homo sapiens
ggttacagtatgcttgctctaa

SEQ ID NO: 2974646 - DNA, 17 bp, Homo sapiens
ggttactcagcagcaga

SEQ ID NO: 2974647 - DNA, 16 bp, Homo sapiens
ggttagaaccagcaga

SEQ ID NO: 2974648 - DNA, 17 bp, Homo sapiens
ggttattttagtttctg

SEQ ID NO: 2974649 - DNA, 19 bp, Homo sapiens
ggttattttagtttctgtt

SEQ ID NO: 2974650 - DNA, 23 bp, Homo sapiens
ggttattttagtttctgttctgt

SEQ ID NO: 2974651 - DNA, 16 bp, Homo sapiens
ggttattttatatttg

SEQ ID NO: 2974652 - DNA, 19 bp, Homo sapiens
ggttcaagtgactctcctg

SEQ ID NO: 2974653 - DNA, 23 bp, Homo sapiens
ggttcaagtgactctcctgcctc

SEQ ID NO: 2974654 - DNA, 14 bp, Homo sapiens
ggttcagcccctcc

SEQ ID NO: 2974655 - DNA, 18 bp, Homo sapiens
ggttcagcccctcctctg

SEQ ID NO: 2974656 - DNA, 16 bp, Homo sapiens
ggttcagcctcctgtc

SEQ ID NO: 2974657 - DNA, 17 bp, Homo sapiens
ggttcagcctcctgtct

SEQ ID NO: 2974658 - DNA, 12 bp, Homo sapiens
ggttcaggcccg

SEQ ID NO: 2974659 - DNA, 13 bp, Homo sapiens
gtatgctgatcat

SEQ ID NO: 2974660 - DNA, 12 bp, Homo sapiens
gtatgcttcata

SEQ ID NO: 2974661 - DNA, 12 bp, Homo sapiens
gtatggaatcaa

SEQ ID NO: 2974662 - DNA, 19 bp, Homo sapiens
gtatgggttaaatcaaaga

SEQ ID NO: 2974663 - DNA, 13 bp, Homo sapiens
gtatgtatataca

SEQ ID NO: 2974664 - DNA, 18 bp, Homo sapiens
gtatgtatggaaacacat

SEQ ID NO: 2974665 - DNA, 15 bp, Homo sapiens
gtatgtggatacagt

SEQ ID NO: 2974666 - DNA, 17 bp, Homo sapiens
gtatgtgtttgtgtgtg

SEQ ID NO: 2974667 - DNA, 18 bp, Homo sapiens
gtatgttgtccaattgtt

SEQ ID NO: 2974668 - DNA, 15 bp, Homo sapiens
gtatgttttacactg

SEQ ID NO: 2974669 - DNA, 17 bp, Homo sapiens
gtattaaacctttccat

SEQ ID NO: 2974670 - DNA, 18 bp, Homo sapiens
gtattaaactctcctttg

SEQ ID NO: 2974671 - DNA, 22 bp, Homo sapiens
gtattaactatcttctttggac

SEQ ID NO: 2974672 - DNA, 15 bp, Homo sapiens
gtattaataaataga

SEQ ID NO: 2974673 - DNA, 14 bp, Homo sapiens
gtattaatttagaa

SEQ ID NO: 2974674 - DNA, 16 bp, Homo sapiens
gtattaatttagaatg

SEQ ID NO: 2974675 - DNA, 14 bp, Homo sapiens
gtattactgctgct

SEQ ID NO: 2974676 - DNA, 20 bp, Homo sapiens
gtattagccagtcattgtaa

SEQ ID NO: 2974677 - DNA, 22 bp, Homo sapiens
gtattagtgatatttctctagt

SEQ ID NO: 2974678 - DNA, 20 bp, Homo sapiens
gtattatgccccagttcaga

SEQ ID NO: 2974679 - DNA, 18 bp, Homo sapiens
gtattcaatatcctttgc

SEQ ID NO: 2974680 - DNA, 16 bp, Homo sapiens
gtattccccttcccac

SEQ ID NO: 2974681 - DNA, 13 bp, Homo sapiens
gtattctgtcatt

SEQ ID NO: 2974682 - DNA, 22 bp, Homo sapiens
gtattcttctcttccttttatc

SEQ ID NO: 2974683 - DNA, 11 bp, Homo sapiens
gtattctttga

SEQ ID NO: 2974684 - DNA, 14 bp, Homo sapiens
gtattctttgatgt

SEQ ID NO: 2974685 - DNA, 21 bp, Homo sapiens
gtattctttgatgttaacaca

SEQ ID NO: 2974686 - DNA, 23 bp, Homo sapiens
gtattctttgatgttaacacatt

SEQ ID NO: 2974687 - DNA, 14 bp, Homo sapiens
gtattgaatcatgt

SEQ ID NO: 2974688 - DNA, 17 bp, Homo sapiens
gtattgaatcatgtagt

SEQ ID NO: 2974689 - DNA, 19 bp, Homo sapiens
gtattgccatcgggtgcca

SEQ ID NO: 2974690 - DNA, 20 bp, Homo sapiens
gtattgccatcgggtgccaa

SEQ ID NO: 2974691 - DNA, 15 bp, Homo sapiens
gtattgctccatttt

SEQ ID NO: 2974692 - DNA, 11 bp, Homo sapiens
gtattgctgct

SEQ ID NO: 2974693 - DNA, 14 bp, Homo sapiens
gtattgctgctgtg

SEQ ID NO: 2974694 - DNA, 17 bp, Homo sapiens
gtattggaattgcaata

SEQ ID NO: 2974695 - DNA, 12 bp, Homo sapiens
gtattgtaaatt

SEQ ID NO: 2974696 - DNA, 13 bp, Homo sapiens
gtattgtaaatta

SEQ ID NO: 2974697 - DNA, 16 bp, Homo sapiens
gtatttaaaaatagaa

SEQ ID NO: 2974698 - DNA, 19 bp, Homo sapiens
gtatttaaaaatagaaaca

SEQ ID NO: 2974699 - DNA, 17 bp, Homo sapiens
gtatttaaggaatcaaa

SEQ ID NO: 2974700 - DNA, 20 bp, Homo sapiens
gtatttaatgatttttgtgt

SEQ ID NO: 2974701 - DNA, 21 bp, Homo sapiens
gtatttaatgatttttgtgta

SEQ ID NO: 2974702 - DNA, 23 bp, Homo sapiens
gtatttaatgatttttgtgtatc

SEQ ID NO: 2974703 - DNA, 21 bp, Homo sapiens
gtatttatttaaaagattcat

SEQ ID NO: 2974704 - DNA, 12 bp, Homo sapiens
gtatttctctgt

SEQ ID NO: 2974705 - DNA, 16 bp, Homo sapiens
gtatttctctgtgaat

SEQ ID NO: 2974706 - DNA, 17 bp, Homo sapiens
gtatttctctgtgaatc

SEQ ID NO: 2974707 - DNA, 19 bp, Homo sapiens
gtatttgattcaaaatatt

SEQ ID NO: 2974708 - DNA, 13 bp, Homo sapiens
gtatttgcagttc

SEQ ID NO: 2974709 - DNA, 12 bp, Homo sapiens
gtatttgctgtc

SEQ ID NO: 2974710 - DNA, 23 bp, Homo sapiens
gtatttggaagcaacgtgttaat

SEQ ID NO: 2974711 - DNA, 15 bp, Homo sapiens
gtatttgggaaactt

SEQ ID NO: 2974712 - DNA, 16 bp, Homo sapiens
gtatttgtttgtagct

SEQ ID NO: 2974713 - DNA, 17 bp, Homo sapiens
gtattttaagtctacaa

SEQ ID NO: 2974714 - DNA, 20 bp, Homo sapiens
gtattttagtgaacttgaaa

SEQ ID NO: 2974715 - DNA, 14 bp, Homo sapiens
gtattttcatacaa

SEQ ID NO: 2974716 - DNA, 12 bp, Homo sapiens
gtattttccacc

SEQ ID NO: 2974717 - DNA, 23 bp, Homo sapiens
gtattttctgtcactgtaggtat

SEQ ID NO: 2974718 - DNA, 17 bp, Homo sapiens
gtattttgaaaacactt

SEQ ID NO: 2974719 - DNA, 18 bp, Homo sapiens
gtattttgtattgtttca

SEQ ID NO: 2974720 - DNA, 16 bp, Homo sapiens
gtattttgtgatgaat

SEQ ID NO: 2974721 - DNA, 13 bp, Homo sapiens
gtatttttcagat

SEQ ID NO: 2974722 - DNA, 16 bp, Homo sapiens
gtcaaaaggtgcctgt

SEQ ID NO: 2974723 - DNA, 12 bp, Homo sapiens
gtcaaacaaata

SEQ ID NO: 2974724 - DNA, 15 bp, Homo sapiens
gtcaaacatgaagtg

SEQ ID NO: 2974725 - DNA, 16 bp, Homo sapiens
gtcaaacatgaagtgt

SEQ ID NO: 2974726 - DNA, 11 bp, Homo sapiens
gtcaaagaagg

SEQ ID NO: 2974727 - DNA, 22 bp, Homo sapiens
gtcaaatggtaggcatttccta

SEQ ID NO: 2974728 - DNA, 16 bp, Homo sapiens
gtcaacagaatgaaaa

SEQ ID NO: 2974729 - DNA, 12 bp, Homo sapiens
gtcaacattgtg

SEQ ID NO: 2974730 - DNA, 13 bp, Homo sapiens
gtcaacctcctgg

SEQ ID NO: 2974731 - DNA, 15 bp, Homo sapiens
gtcaacctcctggac

SEQ ID NO: 2974732 - DNA, 14 bp, Homo sapiens
gtcaactggctggc

SEQ ID NO: 2974733 - DNA, 15 bp, Homo sapiens
gtcaactggctggcc

SEQ ID NO: 2974734 - DNA, 19 bp, Homo sapiens
gtcaactggctggccagtc

SEQ ID NO: 2974735 - DNA, 18 bp, Homo sapiens
gtcaactttcatttgaaa

SEQ ID NO: 2974736 - DNA, 16 bp, Homo sapiens
gtcaagaaattctgct

SEQ ID NO: 2974737 - DNA, 13 bp, Homo sapiens
gtcaagctcctcc

SEQ ID NO: 2974738 - DNA, 15 bp, Homo sapiens
gtcaagctgagctgg

SEQ ID NO: 2974739 - DNA, 21 bp, Homo sapiens
gtcaagctgagctggcttcgg

SEQ ID NO: 2974740 - DNA, 21 bp, Homo sapiens
gtcaaggaaagggcagtggac

SEQ ID NO: 2974741 - DNA, 14 bp, Homo sapiens
gtcaagtataaagt

SEQ ID NO: 2974742 - DNA, 16 bp, Homo sapiens
gtcaagtataaagtca

SEQ ID NO: 2974743 - DNA, 17 bp, Homo sapiens
gtcaataaaaataaatc

SEQ ID NO: 2974744 - DNA, 20 bp, Homo sapiens
gtcaatacagtacaggcagc

SEQ ID NO: 2974745 - DNA, 21 bp, Homo sapiens
gtcaatacagtacaggcagca

SEQ ID NO: 2974746 - DNA, 21 bp, Homo sapiens
gtcaatctagttccagagggt

SEQ ID NO: 2974747 - DNA, 15 bp, Homo sapiens
gtcaattcagtgatg

SEQ ID NO: 2974748 - DNA, 18 bp, Homo sapiens
gtcaatttatgaatataa

SEQ ID NO: 2974749 - DNA, 17 bp, Homo sapiens
gtcacaatgttctttat

SEQ ID NO: 2974750 - DNA, 14 bp, Homo sapiens
gtcacacatttcta

SEQ ID NO: 2974751 - DNA, 12 bp, Homo sapiens
gtcacagccacc

SEQ ID NO: 2974752 - DNA, 16 bp, Homo sapiens
gtcacaggaaggaaac

SEQ ID NO: 2974753 - DNA, 19 bp, Homo sapiens
gtcacatcacgaaggaaaa

SEQ ID NO: 2974754 - DNA, 13 bp, Homo sapiens
gtcacatggagct

SEQ ID NO: 2974755 - DNA, 14 bp, Homo sapiens
gtcaccaccttccc

SEQ ID NO: 2974756 - DNA, 16 bp, Homo sapiens
gtcaccaccttcccag

SEQ ID NO: 2974757 - DNA, 19 bp, Homo sapiens
gtcaccaccttcccagctc

SEQ ID NO: 2974758 - DNA, 13 bp, Homo sapiens
gtcaccatgcaag

SEQ ID NO: 2974759 - DNA, 17 bp, Homo sapiens
gtcacccaaagcctgtc

SEQ ID NO: 2974760 - DNA, 21 bp, Homo sapiens
gtcaccccagagccacacatg

SEQ ID NO: 2974761 - DNA, 22 bp, Homo sapiens
gtcaccctagccctctccctct

SEQ ID NO: 2974762 - DNA, 16 bp, Homo sapiens
gtcaccctggccacca

SEQ ID NO: 2974763 - DNA, 18 bp, Homo sapiens
gtcaccctggccaccacc

SEQ ID NO: 2974764 - DNA, 19 bp, Homo sapiens
gtcaccctgtgaccctctc

SEQ ID NO: 2974765 - DNA, 15 bp, Homo sapiens
gtcaccgacagcggc

SEQ ID NO: 2974766 - DNA, 17 bp, Homo sapiens
gtcaccgacagcggcct

SEQ ID NO: 2974767 - DNA, 17 bp, Homo sapiens
gtcaccgcggacgtgct

SEQ ID NO: 2974768 - DNA, 20 bp, Homo sapiens
gtcaccgcggacgtgctggc

SEQ ID NO: 2974769 - DNA, 16 bp, Homo sapiens
gtcaccggatcctggg

SEQ ID NO: 2974770 - DNA, 17 bp, Homo sapiens
gtcaccggatcctgggt

SEQ ID NO: 2974771 - DNA, 19 bp, Homo sapiens
gtcacctaaccctctgtca

SEQ ID NO: 2974772 - DNA, 23 bp, Homo sapiens
gtcactcagatggaaccgcagga

SEQ ID NO: 2974773 - DNA, 18 bp, Homo sapiens
gtcactcattgctgagcc

SEQ ID NO: 2974774 - DNA, 21 bp, Homo sapiens
gtcactcattgctgagcctct

SEQ ID NO: 2974775 - DNA, 24 bp, Homo sapiens
gtcactcattgctgagcctctgct

SEQ ID NO: 2974776 - DNA, 18 bp, Homo sapiens
gtcactctgccctctgct

SEQ ID NO: 2974777 - DNA, 19 bp, Homo sapiens
gtcactctgccctctgctg

SEQ ID NO: 2974778 - DNA, 12 bp, Homo sapiens
gtcactgccaaa

SEQ ID NO: 2974779 - DNA, 12 bp, Homo sapiens
gtcactgtacag

SEQ ID NO: 2974780 - DNA, 17 bp, Homo sapiens
gtcactgtacagttttg

SEQ ID NO: 2974781 - DNA, 21 bp, Homo sapiens
gtcactgtccaggtaggaaac

SEQ ID NO: 2974782 - DNA, 23 bp, Homo sapiens
gtcactgtccaggtaggaaacaa

SEQ ID NO: 2974783 - DNA, 17 bp, Homo sapiens
gtcagaaccggcctgga

SEQ ID NO: 2974784 - DNA, 14 bp, Homo sapiens
gtcagacccatctc

SEQ ID NO: 2974785 - DNA, 18 bp, Homo sapiens
gtcagacgcctgaggaac

SEQ ID NO: 2974786 - DNA, 14 bp, Homo sapiens
gtcagactggaggt

SEQ ID NO: 2974787 - DNA, 15 bp, Homo sapiens
gtcagagaaaacact

SEQ ID NO: 2974788 - DNA, 23 bp, Homo sapiens
gtcagagagacccgggaaggaag

SEQ ID NO: 2974789 - DNA, 12 bp, Homo sapiens
gtcagagcccag

SEQ ID NO: 2974790 - DNA, 13 bp, Homo sapiens
gtcagagcccagg

SEQ ID NO: 2974791 - DNA, 22 bp, Homo sapiens
gtcagaggagagatagcctgtg

SEQ ID NO: 2974792 - DNA, 22 bp, Homo sapiens
gtcagagtggcgtgagctgccc

SEQ ID NO: 2974793 - DNA, 21 bp, Homo sapiens
gtctggagcggctgctcgccc

SEQ ID NO: 2974794 - DNA, 15 bp, Homo sapiens
gtctggatccttccc

SEQ ID NO: 2974795 - DNA, 20 bp, Homo sapiens
gtctggatccttcccaaggt

SEQ ID NO: 2974796 - DNA, 22 bp, Homo sapiens
gtctggatctgggaccctttcc

SEQ ID NO: 2974797 - DNA, 17 bp, Homo sapiens
gtctggcatctcccaca

SEQ ID NO: 2974798 - DNA, 14 bp, Homo sapiens
gtctggccctggcg

SEQ ID NO: 2974799 - DNA, 19 bp, Homo sapiens
gtctggctagagggcccaa

SEQ ID NO: 2974800 - DNA, 20 bp, Homo sapiens
gtctggctagagggcccaaa

SEQ ID NO: 2974801 - DNA, 13 bp, Homo sapiens
gtctggctgcaga

SEQ ID NO: 2974802 - DNA, 22 bp, Homo sapiens
gtctgggaaatgagcagggatg

SEQ ID NO: 2974803 - DNA, 23 bp, Homo sapiens
gtctggggttcagcccctcctct

SEQ ID NO: 2974804 - DNA, 19 bp, Homo sapiens
gtctgggtcagacccatct

SEQ ID NO: 2974805 - DNA, 20 bp, Homo sapiens
gtctgggtggatgtgagcag

SEQ ID NO: 2974806 - DNA, 16 bp, Homo sapiens
gtctgggtttggccca

SEQ ID NO: 2974807 - DNA, 19 bp, Homo sapiens
gtctgtacacgtgtcctgt

SEQ ID NO: 2974808 - DNA, 20 bp, Homo sapiens
gtctgtacacgtgtcctgta

SEQ ID NO: 2974809 - DNA, 18 bp, Homo sapiens
gtctgtacctaaagcaat

SEQ ID NO: 2974810 - DNA, 15 bp, Homo sapiens
gtctgtactaaaaat

SEQ ID NO: 2974811 - DNA, 23 bp, Homo sapiens
gtctgtatagtctagactttaaa

SEQ ID NO: 2974812 - DNA, 13 bp, Homo sapiens
gtctgtccatctg

SEQ ID NO: 2974813 - DNA, 23 bp, Homo sapiens
gtctgtccttctgaagtgtgtcc

SEQ ID NO: 2974814 - DNA, 14 bp, Homo sapiens
gtctgtctagtgtc

SEQ ID NO: 2974815 - DNA, 15 bp, Homo sapiens
gtctgtcttctgtat

SEQ ID NO: 2974816 - DNA, 18 bp, Homo sapiens
gtctgttctgtttcaagg

SEQ ID NO: 2974817 - DNA, 13 bp, Homo sapiens
gtctgttcttgaa

SEQ ID NO: 2974818 - DNA, 13 bp, Homo sapiens
gtctgtttactgc

SEQ ID NO: 2974819 - DNA, 21 bp, Homo sapiens
gtctgtttgctgatggtctgg

SEQ ID NO: 2974820 - DNA, 22 bp, Homo sapiens
gtcttaaaatgggtattcaaaa

SEQ ID NO: 2974821 - DNA, 14 bp, Homo sapiens
gtcttaaactaggt

SEQ ID NO: 2974822 - DNA, 22 bp, Homo sapiens
gtcttaacaaaccaacatcttt

SEQ ID NO: 2974823 - DNA, 19 bp, Homo sapiens
gtcttaaggacaaagtgcc

SEQ ID NO: 2974824 - DNA, 19 bp, Homo sapiens
gtcttaatttatttcttaa

SEQ ID NO: 2974825 - DNA, 20 bp, Homo sapiens
gtcttacaaggcaggccttt

SEQ ID NO: 2974826 - DNA, 23 bp, Homo sapiens
gtcttagaagtggaccaggacag

SEQ ID NO: 2974827 - DNA, 23 bp, Homo sapiens
gtcttagctgaggctgagaaagc

SEQ ID NO: 2974828 - DNA, 21 bp, Homo sapiens
gtcttaggtcttcctgtggct

SEQ ID NO: 2974829 - DNA, 19 bp, Homo sapiens
gtcttatatattgtagata

SEQ ID NO: 2974830 - DNA, 17 bp, Homo sapiens
gtcttcaaattaaagtg

SEQ ID NO: 2974831 - DNA, 15 bp, Homo sapiens
gtcttcacggcagga

SEQ ID NO: 2974832 - DNA, 12 bp, Homo sapiens
gtcttcactctt

SEQ ID NO: 2974833 - DNA, 14 bp, Homo sapiens
gtcttccctctcta

SEQ ID NO: 2974834 - DNA, 13 bp, Homo sapiens
gtcttcctcttag

SEQ ID NO: 2974835 - DNA, 18 bp, Homo sapiens
gtcttcctgtggctccct

SEQ ID NO: 2974836 - DNA, 20 bp, Homo sapiens
gtcttcctgtggctccctct

SEQ ID NO: 2974837 - DNA, 13 bp, Homo sapiens
gtcttccttctca

SEQ ID NO: 2974838 - DNA, 23 bp, Homo sapiens
gtcttctaaacttccccatcttc

SEQ ID NO: 2974839 - DNA, 16 bp, Homo sapiens
gtcttctccttcaaaa

SEQ ID NO: 2974840 - DNA, 20 bp, Homo sapiens
gtcttctccttcaaaacatt

SEQ ID NO: 2974841 - DNA, 19 bp, Homo sapiens
gtcttctctatcctctctc

SEQ ID NO: 2974842 - DNA, 14 bp, Homo sapiens
gtcttctctccact

SEQ ID NO: 2974843 - DNA, 15 bp, Homo sapiens
gtcttctctccactt

SEQ ID NO: 2974844 - DNA, 17 bp, Homo sapiens
gtcttgaaaaaaaatag

SEQ ID NO: 2974845 - DNA, 15 bp, Homo sapiens
gtcttgaagtcctgg

SEQ ID NO: 2974846 - DNA, 16 bp, Homo sapiens
gtcttgaagtcctggc

SEQ ID NO: 2974847 - DNA, 17 bp, Homo sapiens
gtcttgaatgtcttttg

SEQ ID NO: 2974848 - DNA, 12 bp, Homo sapiens
gtcttgaatttc

SEQ ID NO: 2974849 - DNA, 17 bp, Homo sapiens
gtcttgacctgaactct

SEQ ID NO: 2974850 - DNA, 18 bp, Homo sapiens
gtcttgatgaccaaagtc

SEQ ID NO: 2974851 - DNA, 14 bp, Homo sapiens
gtcttgctcctggg

SEQ ID NO: 2974852 - DNA, 17 bp, Homo sapiens
gtcttgctcctggggag

SEQ ID NO: 2974853 - DNA, 15 bp, Homo sapiens
gtcttggacactgta

SEQ ID NO: 2974854 - DNA, 18 bp, Homo sapiens
gtcttggacactgtacaa

SEQ ID NO: 2974855 - DNA, 21 bp, Homo sapiens
gtcttgggaaatatgaatgcc

SEQ ID NO: 2974856 - DNA, 18 bp, Homo sapiens
gtcttggggtcccactgc

SEQ ID NO: 2974857 - DNA, 17 bp, Homo sapiens
gtcttgtgtatttctct

SEQ ID NO: 2974858 - DNA, 20 bp, Homo sapiens
gtcttgtgtatttctctgtg

SEQ ID NO: 2974859 - DNA, 16 bp, Homo sapiens
gtcttgttctgtcact

SEQ ID NO: 2974860 - DNA, 16 bp, Homo sapiens
gtctttaagagactca

SEQ ID NO: 2974861 - DNA, 12 bp, Homo sapiens
gtctttaatcat

SEQ ID NO: 2974862 - DNA, 21 bp, Homo sapiens
gtctttatgagctaaaaatat

SEQ ID NO: 2974863 - DNA, 15 bp, Homo sapiens
gtctttcaagaatga

SEQ ID NO: 2974864 - DNA, 11 bp, Homo sapiens
gtctttcagta

SEQ ID NO: 2974865 - DNA, 16 bp, Homo sapiens
gtctttcagtactttt

SEQ ID NO: 2974866 - DNA, 18 bp, Homo sapiens
gtctttccacttctctgg

SEQ ID NO: 2974867 - DNA, 18 bp, Homo sapiens
gtctttcccccaggaaaa

SEQ ID NO: 2974868 - DNA, 16 bp, Homo sapiens
gtctttctttgctgct

SEQ ID NO: 2974869 - DNA, 17 bp, Homo sapiens
gtctttgcggggcctgt

SEQ ID NO: 2974870 - DNA, 18 bp, Homo sapiens
gtctttgcggggcctgtc

SEQ ID NO: 2974871 - DNA, 23 bp, Homo sapiens
gtctttgcggggcctgtctcagt

SEQ ID NO: 2974872 - DNA, 15 bp, Homo sapiens
gtctttggttctaag

SEQ ID NO: 2974873 - DNA, 17 bp, Homo sapiens
gtcttttcccctcattg

SEQ ID NO: 2974874 - DNA, 17 bp, Homo sapiens
gtcttttctctgaaaag

SEQ ID NO: 2974875 - DNA, 14 bp, Homo sapiens
gtcttttgaatatt

SEQ ID NO: 2974876 - DNA, 19 bp, Homo sapiens
gtcttttgaatattcccaa

SEQ ID NO: 2974877 - DNA, 14 bp, Homo sapiens
gtctttttaagaat

SEQ ID NO: 2974878 - DNA, 15 bp, Homo sapiens
gtctttttctcttct

SEQ ID NO: 2974879 - DNA, 16 bp, Homo sapiens
gtctttttctcttctg

SEQ ID NO: 2974880 - DNA, 18 bp, Homo sapiens
gtcttttttaaggctctg

SEQ ID NO: 2974881 - DNA, 18 bp, Homo sapiens
gtcttttttttaatgtgc

SEQ ID NO: 2974882 - DNA, 15 bp, Homo sapiens
gtcttttttttcatc

SEQ ID NO: 2974883 - DNA, 15 bp, Homo sapiens
gtgaaaacggagctg

SEQ ID NO: 2974884 - DNA, 17 bp, Homo sapiens
gtgaaacccccatctct

SEQ ID NO: 2974885 - DNA, 17 bp, Homo sapiens
gtgaaacctacagcata

SEQ ID NO: 2974886 - DNA, 19 bp, Homo sapiens
gtgaaagaaaataacaata

SEQ ID NO: 2974887 - DNA, 21 bp, Homo sapiens
gtgaaagtttttaattcatat

SEQ ID NO: 2974888 - DNA, 22 bp, Homo sapiens
gtgaaataccaacctgaagaca

SEQ ID NO: 2974889 - DNA, 20 bp, Homo sapiens
gtgaaatatgatgagattca

SEQ ID NO: 2974890 - DNA, 21 bp, Homo sapiens
gtgaaatattgtaaatgctat

SEQ ID NO: 2974891 - DNA, 13 bp, Homo sapiens
gtgaaatctgtct

SEQ ID NO: 2974892 - DNA, 14 bp, Homo sapiens
gtgaaatgaagcaa

SEQ ID NO: 2974893 - DNA, 14 bp, Homo sapiens
gtgaaatttttcca

SEQ ID NO: 2974894 - DNA, 23 bp, Homo sapiens
gtgaaatttttccacactatgtg

SEQ ID NO: 2974895 - DNA, 13 bp, Homo sapiens
gtgaacacagcag

SEQ ID NO: 2974896 - DNA, 16 bp, Homo sapiens
gtgaacacagcagacc

SEQ ID NO: 2974897 - DNA, 18 bp, Homo sapiens
gtgaacacagcagaccta

SEQ ID NO: 2974898 - DNA, 20 bp, Homo sapiens
gtgaaccaacccccatctcc

SEQ ID NO: 2974899 - DNA, 16 bp, Homo sapiens
gtgaaccgtcctttca

SEQ ID NO: 2974900 - DNA, 22 bp, Homo sapiens
gtgaacctcaccccgaggccct

SEQ ID NO: 2974901 - DNA, 23 bp, Homo sapiens
gtgaacctcaccccgaggccctg

SEQ ID NO: 2974902 - DNA, 23 bp, Homo sapiens
gtgaactaatttggtttttactc

SEQ ID NO: 2974903 - DNA, 17 bp, Homo sapiens
gtgaactagggaagctc

SEQ ID NO: 2974904 - DNA, 18 bp, Homo sapiens
gtgaactcagccaagcac

SEQ ID NO: 2974905 - DNA, 20 bp, Homo sapiens
gtgaactctcccctccccat

SEQ ID NO: 2974906 - DNA, 13 bp, Homo sapiens
gtgaactgaaatt

SEQ ID NO: 2974907 - DNA, 20 bp, Homo sapiens
gtgaacttcaaaagcttttt

SEQ ID NO: 2974908 - DNA, 15 bp, Homo sapiens
gtgaagaagccctgt

SEQ ID NO: 2974909 - DNA, 19 bp, Homo sapiens
gtgaagatctcactctgcc

SEQ ID NO: 2974910 - DNA, 20 bp, Homo sapiens
gtgaagccaattcagacagg

SEQ ID NO: 2974911 - DNA, 22 bp, Homo sapiens
gtgaagccaattcagacaggca

SEQ ID NO: 2974912 - DNA, 12 bp, Homo sapiens
gtgaagccctgt

SEQ ID NO: 2974913 - DNA, 22 bp, Homo sapiens
gtgaaggacttagccgactgcg

SEQ ID NO: 2974914 - DNA, 13 bp, Homo sapiens
gtgaaggctggca

SEQ ID NO: 2974915 - DNA, 20 bp, Homo sapiens
gtgaaggtcctgctattact

SEQ ID NO: 2974916 - DNA, 19 bp, Homo sapiens
gtgaagtatactgtatttt

SEQ ID NO: 2974917 - DNA, 21 bp, Homo sapiens
gtgaagtcatgacctccaggg

SEQ ID NO: 2974918 - DNA, 16 bp, Homo sapiens
gtgaagtccttcacct

SEQ ID NO: 2974919 - DNA, 12 bp, Homo sapiens
gtgaagttaggt

SEQ ID NO: 2974920 - DNA, 16 bp, Homo sapiens
gtgaagttaggttctt

SEQ ID NO: 2974921 - DNA, 20 bp, Homo sapiens
gtgaagttaggttcttaaaa

SEQ ID NO: 2974922 - DNA, 18 bp, Homo sapiens
gtgaataaaaagaaagat

SEQ ID NO: 2974923 - DNA, 22 bp, Homo sapiens
gtgaataaaaagaaagatttta

SEQ ID NO: 2974924 - DNA, 18 bp, Homo sapiens
gtgaataaaaattgatga

SEQ ID NO: 2974925 - DNA, 14 bp, Homo sapiens
gtgttttgtaccag

SEQ ID NO: 2974926 - DNA, 16 bp, Homo sapiens
gtgttttgtttattaa

SEQ ID NO: 2974927 - DNA, 15 bp, Homo sapiens
gtgtttttgaaatat

SEQ ID NO: 2974928 - DNA, 20 bp, Homo sapiens
gtgttttttaggaaaagcat

SEQ ID NO: 2974929 - DNA, 19 bp, Homo sapiens
gttaaaaaaaaaaaaagga

SEQ ID NO: 2974930 - DNA, 20 bp, Homo sapiens
gttaaaaaaaggcattgttt

SEQ ID NO: 2974931 - DNA, 15 bp, Homo sapiens
gttaaaagtgtacaa

SEQ ID NO: 2974932 - DNA, 19 bp, Homo sapiens
gttaaaatgtttactgtaa

SEQ ID NO: 2974933 - DNA, 14 bp, Homo sapiens
gttaaacattgaag

SEQ ID NO: 2974934 - DNA, 17 bp, Homo sapiens
gttaaactcgctcactg

SEQ ID NO: 2974935 - DNA, 19 bp, Homo sapiens
gttaaaggcagtccagagc

SEQ ID NO: 2974936 - DNA, 13 bp, Homo sapiens
gttaaagtttaag

SEQ ID NO: 2974937 - DNA, 23 bp, Homo sapiens
gttaacacattttgtataattgt

SEQ ID NO: 2974938 - DNA, 12 bp, Homo sapiens
gttaacagattt

SEQ ID NO: 2974939 - DNA, 18 bp, Homo sapiens
gttaacatcatgaattta

SEQ ID NO: 2974940 - DNA, 23 bp, Homo sapiens
gttaacattccaagactctagag

SEQ ID NO: 2974941 - DNA, 21 bp, Homo sapiens
gttaacgtcacccaaaagcac

SEQ ID NO: 2974942 - DNA, 22 bp, Homo sapiens
gttaagacatgatttccttgaa

SEQ ID NO: 2974943 - DNA, 13 bp, Homo sapiens
gttaagacctggc

SEQ ID NO: 2974944 - DNA, 17 bp, Homo sapiens
gttaagacttgacagtg

SEQ ID NO: 2974945 - DNA, 19 bp, Homo sapiens
gttaagatactcaagcagg

SEQ ID NO: 2974946 - DNA, 14 bp, Homo sapiens
gttaagattcctaa

SEQ ID NO: 2974947 - DNA, 17 bp, Homo sapiens
gttaaggttcaagacag

SEQ ID NO: 2974948 - DNA, 16 bp, Homo sapiens
gttaagtacccgaggc

SEQ ID NO: 2974949 - DNA, 14 bp, Homo sapiens
gttaagttctattg

SEQ ID NO: 2974950 - DNA, 14 bp, Homo sapiens
gttaataaactgca

SEQ ID NO: 2974951 - DNA, 17 bp, Homo sapiens
gttaataaactgcaaat

SEQ ID NO: 2974952 - DNA, 19 bp, Homo sapiens
gttaataagcaaaatcctg

SEQ ID NO: 2974953 - DNA, 18 bp, Homo sapiens
gttaataagttgatgttt

SEQ ID NO: 2974954 - DNA, 22 bp, Homo sapiens
gttaataagttgatgttttcta

SEQ ID NO: 2974955 - DNA, 12 bp, Homo sapiens
gttaatactagt

SEQ ID NO: 2974956 - DNA, 17 bp, Homo sapiens
gttaatcaatttaaacc

SEQ ID NO: 2974957 - DNA, 22 bp, Homo sapiens
gttaatcaatttaaacccattt

SEQ ID NO: 2974958 - DNA, 13 bp, Homo sapiens
gttaatcagtgtt

SEQ ID NO: 2974959 - DNA, 20 bp, Homo sapiens
gttaatcagtgttgattcta

SEQ ID NO: 2974960 - DNA, 20 bp, Homo sapiens
gttaatccaatcaatttaaa

SEQ ID NO: 2974961 - DNA, 20 bp, Homo sapiens
gttaatgaaggtgtgctaca

SEQ ID NO: 2974962 - DNA, 19 bp, Homo sapiens
gttaatgcttaagagggaa

SEQ ID NO: 2974963 - DNA, 15 bp, Homo sapiens
gttaatgttatatca

SEQ ID NO: 2974964 - DNA, 14 bp, Homo sapiens
gttaattagcattc

SEQ ID NO: 2974965 - DNA, 21 bp, Homo sapiens
gttaattataaacagcagggt

SEQ ID NO: 2974966 - DNA, 12 bp, Homo sapiens
gttaatttaaag

SEQ ID NO: 2974967 - DNA, 18 bp, Homo sapiens
gttaattttattcaagaa

SEQ ID NO: 2974968 - DNA, 18 bp, Homo sapiens
gttaattttttggtacaa

SEQ ID NO: 2974969 - DNA, 19 bp, Homo sapiens
gttacaacagatttgtgaa

SEQ ID NO: 2974970 - DNA, 22 bp, Homo sapiens
gttacaacagatttgtgaactc

SEQ ID NO: 2974971 - DNA, 21 bp, Homo sapiens
gttacaataaaactaaatgtg

SEQ ID NO: 2974972 - DNA, 19 bp, Homo sapiens
gttacaatcagtgtgaatg

SEQ ID NO: 2974973 - DNA, 22 bp, Homo sapiens
gttacactggaggagagaagaa

SEQ ID NO: 2974974 - DNA, 23 bp, Homo sapiens
gttacactggaggagagaagaat

SEQ ID NO: 2974975 - DNA, 13 bp, Homo sapiens
gttacagaaagtg

SEQ ID NO: 2974976 - DNA, 21 bp, Homo sapiens
gttacagaaagtggtgctcag

SEQ ID NO: 2974977 - DNA, 17 bp, Homo sapiens
gttacagagacctatgt

SEQ ID NO: 2974978 - DNA, 16 bp, Homo sapiens
gttacagtatgcttgc

SEQ ID NO: 2974979 - DNA, 18 bp, Homo sapiens
gttacagtatgcttgctc

SEQ ID NO: 2974980 - DNA, 16 bp, Homo sapiens
gttacatgtttgcacc

SEQ ID NO: 2974981 - DNA, 18 bp, Homo sapiens
gttacattaatgcccagc

SEQ ID NO: 2974982 - DNA, 19 bp, Homo sapiens
gttacattaatgcccagcc

SEQ ID NO: 2974983 - DNA, 14 bp, Homo sapiens
gttaccaaatacac

SEQ ID NO: 2974984 - DNA, 23 bp, Homo sapiens
gttaccaaatacacatttcacat

SEQ ID NO: 2974985 - DNA, 21 bp, Homo sapiens
gttaccatttttctggattta

SEQ ID NO: 2974986 - DNA, 15 bp, Homo sapiens
gttacccaggctgga

SEQ ID NO: 2974987 - DNA, 14 bp, Homo sapiens
gttaccctgctttg

SEQ ID NO: 2974988 - DNA, 17 bp, Homo sapiens
gttactgggccctgagt

SEQ ID NO: 2974989 - DNA, 15 bp, Homo sapiens
gttacttaaacatca

SEQ ID NO: 2974990 - DNA, 14 bp, Homo sapiens
gttacttaagattc

SEQ ID NO: 2974991 - DNA, 13 bp, Homo sapiens
gttacttgaagta

SEQ ID NO: 2974992 - DNA, 15 bp, Homo sapiens
gttacttgaagtaac

SEQ ID NO: 2974993 - DNA, 19 bp, Homo sapiens
gttactttaaaaatcagtt

SEQ ID NO: 2974994 - DNA, 14 bp, Homo sapiens
gttactttgaatag

SEQ ID NO: 2974995 - DNA, 15 bp, Homo sapiens
gttactttgaatagt

SEQ ID NO: 2974996 - DNA, 11 bp, Homo sapiens
gttagaagaac

SEQ ID NO: 2974997 - DNA, 13 bp, Homo sapiens
gttagcagacagg

SEQ ID NO: 2974998 - DNA, 17 bp, Homo sapiens
gttagcatccaggctgg

SEQ ID NO: 2974999 - DNA, 22 bp, Homo sapiens
gttagtctactcttaagccatc

SEQ ID NO: 2975000 - DNA, 15 bp, Homo sapiens
gttagtttagtgtgt

SEQ ID NO: 2975001 - DNA, 12 bp, Homo sapiens
gttataaaagtg

SEQ ID NO: 2975002 - DNA, 14 bp, Homo sapiens
gttataaagataca

SEQ ID NO: 2975003 - DNA, 17 bp, Homo sapiens
gttataaagtgtgccac

SEQ ID NO: 2975004 - DNA, 20 bp, Homo sapiens
gttatacatcaatatgtata

SEQ ID NO: 2975005 - DNA, 22 bp, Homo sapiens
gttatagtgacagctttccatg

SEQ ID NO: 2975006 - DNA, 13 bp, Homo sapiens
gttatataggttt

SEQ ID NO: 2975007 - DNA, 12 bp, Homo sapiens
gttatatttcag

SEQ ID NO: 2975008 - DNA, 18 bp, Homo sapiens
gttatcagtaatgctaaa

SEQ ID NO: 2975009 - DNA, 13 bp, Homo sapiens
gttatccagaagt

SEQ ID NO: 2975010 - DNA, 19 bp, Homo sapiens
gttatccatttaaaaatgg

SEQ ID NO: 2975011 - DNA, 15 bp, Homo sapiens
gttatcctgcaaggg

SEQ ID NO: 2975012 - DNA, 17 bp, Homo sapiens
gttatcctgtgctacag

SEQ ID NO: 2975013 - DNA, 17 bp, Homo sapiens
gttatctgttcttttga

SEQ ID NO: 2975014 - DNA, 17 bp, Homo sapiens
gttatcttaacactgaa

SEQ ID NO: 2975015 - DNA, 22 bp, Homo sapiens
gttatcttctcaagttctaaga

SEQ ID NO: 2975016 - DNA, 23 bp, Homo sapiens
gttatcttctcaagttctaagat

SEQ ID NO: 2975017 - DNA, 14 bp, Homo sapiens
gttatcttgttatt

SEQ ID NO: 2975018 - DNA, 17 bp, Homo sapiens
gttatcttgttattatt

SEQ ID NO: 2975019 - DNA, 18 bp, Homo sapiens
gttatcttgttattattg

SEQ ID NO: 2975020 - DNA, 18 bp, Homo sapiens
gttatgaacacttaaatt

SEQ ID NO: 2975021 - DNA, 21 bp, Homo sapiens
gttatgtaaaaggccaaacct

SEQ ID NO: 2975022 - DNA, 18 bp, Homo sapiens
gttatgtgggtggcttct

SEQ ID NO: 2975023 - DNA, 17 bp, Homo sapiens
gttatgtgtctggaaga

SEQ ID NO: 2975024 - DNA, 22 bp, Homo sapiens
gttattaaacgtatgcatgtga

SEQ ID NO: 2975025 - DNA, 21 bp, Homo sapiens
gttattagggtggtatttagt

SEQ ID NO: 2975026 - DNA, 14 bp, Homo sapiens
gttattataaatgt

SEQ ID NO: 2975027 - DNA, 21 bp, Homo sapiens
gttattataaatgttagttct

SEQ ID NO: 2975028 - DNA, 15 bp, Homo sapiens
gttattatatttgac

SEQ ID NO: 2975029 - DNA, 13 bp, Homo sapiens
gttattattgtta

SEQ ID NO: 2975030 - DNA, 19 bp, Homo sapiens
gttattttagtttctgttc

SEQ ID NO: 2975031 - DNA, 22 bp, Homo sapiens
gttattttatatctgagcaagg

SEQ ID NO: 2975032 - DNA, 16 bp, Homo sapiens
gttattttatatttga

SEQ ID NO: 2975033 - DNA, 21 bp, Homo sapiens
gttattttctttatcattgct

SEQ ID NO: 2975034 - DNA, 12 bp, Homo sapiens
gttcaaagccag

SEQ ID NO: 2975035 - DNA, 14 bp, Homo sapiens
gttcaaattaaaaa

SEQ ID NO: 2975036 - DNA, 12 bp, Homo sapiens
gttcaaattctc

SEQ ID NO: 2975037 - DNA, 20 bp, Homo sapiens
gttcaaattctcttcttttt

SEQ ID NO: 2975038 - DNA, 14 bp, Homo sapiens
gttcaactatttta

SEQ ID NO: 2975039 - DNA, 12 bp, Homo sapiens
gttcaactccac

SEQ ID NO: 2975040 - DNA, 22 bp, Homo sapiens
gttcaaggaacttgaaaaatac

SEQ ID NO: 2975041 - DNA, 18 bp, Homo sapiens
gttcaaggccatccttcc

SEQ ID NO: 2975042 - DNA, 17 bp, Homo sapiens
gttcacagaaaaagcat

SEQ ID NO: 2975043 - DNA, 18 bp, Homo sapiens
gttcacatatgattctct

SEQ ID NO: 2975044 - DNA, 19 bp, Homo sapiens
gttcacatgattctcctgc

SEQ ID NO: 2975045 - DNA, 15 bp, Homo sapiens
gttcacctttgtagc

SEQ ID NO: 2975046 - DNA, 23 bp, Homo sapiens
gttcacctttgtagcactcaggc

SEQ ID NO: 2975047 - DNA, 17 bp, Homo sapiens
gttcacgccattctcct

SEQ ID NO: 2975048 - DNA, 20 bp, Homo sapiens
gttcacgccattctcctgcc

SEQ ID NO: 2975049 - DNA, 17 bp, Homo sapiens
gttcactcttggagcct

SEQ ID NO: 2975050 - DNA, 18 bp, Homo sapiens
gttcactcttggagcctg

SEQ ID NO: 2975051 - DNA, 20 bp, Homo sapiens
gttcactcttggagcctgca

SEQ ID NO: 2975052 - DNA, 14 bp, Homo sapiens
gttcactgaagacg

SEQ ID NO: 2975053 - DNA, 21 bp, Homo sapiens
gttcacttctttgcagagcct

SEQ ID NO: 2975054 - DNA, 16 bp, Homo sapiens
gttcacttttgacaaa

SEQ ID NO: 2975055 - DNA, 16 bp, Homo sapiens
gttcagaaaaccactt

SEQ ID NO: 2975056 - DNA, 22 bp, Homo sapiens
gttcagaaatttggcattgatc

SEQ ID NO: 2975057 - DNA, 20 bp, Homo sapiens
gttttattcaccatcatgta

SEQ ID NO: 2975058 - DNA, 23 bp, Homo sapiens
gttttattttggaattggtgtat

SEQ ID NO: 2975059 - DNA, 19 bp, Homo sapiens
gttttcagcaaattccaga

SEQ ID NO: 2975060 - DNA, 16 bp, Homo sapiens
gttttcatcatttcag

SEQ ID NO: 2975061 - DNA, 18 bp, Homo sapiens
gttttcatcatttcagcc

SEQ ID NO: 2975062 - DNA, 20 bp, Homo sapiens
gttttcatcatttcagccaa

SEQ ID NO: 2975063 - DNA, 12 bp, Homo sapiens
gttttcatttgc

SEQ ID NO: 2975064 - DNA, 14 bp, Homo sapiens
gttttccaaaagta

SEQ ID NO: 2975065 - DNA, 15 bp, Homo sapiens
gttttccactgtgct

SEQ ID NO: 2975066 - DNA, 17 bp, Homo sapiens
gttttcgtcatcttccc

SEQ ID NO: 2975067 - DNA, 14 bp, Homo sapiens
gttttctaaaaaaa

SEQ ID NO: 2975068 - DNA, 19 bp, Homo sapiens
gttttctaaaaaaaaaaac

SEQ ID NO: 2975069 - DNA, 21 bp, Homo sapiens
gttttctaaaaaaaaaaactg

SEQ ID NO: 2975070 - DNA, 18 bp, Homo sapiens
gttttctagatgacataa

SEQ ID NO: 2975071 - DNA, 15 bp, Homo sapiens
gttttctgtgcactg

SEQ ID NO: 2975072 - DNA, 18 bp, Homo sapiens
gttttctgtgtaaccatt

SEQ ID NO: 2975073 - DNA, 13 bp, Homo sapiens
gttttctgttcag

SEQ ID NO: 2975074 - DNA, 15 bp, Homo sapiens
gttttcttcccatca

SEQ ID NO: 2975075 - DNA, 20 bp, Homo sapiens
gttttcttcccatcactgga

SEQ ID NO: 2975076 - DNA, 18 bp, Homo sapiens
gttttcttgttgctttgt

SEQ ID NO: 2975077 - DNA, 17 bp, Homo sapiens
gttttctttatgtcttt

SEQ ID NO: 2975078 - DNA, 20 bp, Homo sapiens
gttttctttgcaaagtattg

SEQ ID NO: 2975079 - DNA, 15 bp, Homo sapiens
gttttgaaactagaa

SEQ ID NO: 2975080 - DNA, 20 bp, Homo sapiens
gttttgaaactagaaatctg

SEQ ID NO: 2975081 - DNA, 15 bp, Homo sapiens
gttttgaaggcaaaa

SEQ ID NO: 2975082 - DNA, 12 bp, Homo sapiens
gttttgaatttt

SEQ ID NO: 2975083 - DNA, 19 bp, Homo sapiens
gttttgacaggttttccaa

SEQ ID NO: 2975084 - DNA, 17 bp, Homo sapiens
gttttgacatcagccag

SEQ ID NO: 2975085 - DNA, 19 bp, Homo sapiens
gttttgataaagtagtaaa

SEQ ID NO: 2975086 - DNA, 20 bp, Homo sapiens
gttttgataaagtagtaaaa

SEQ ID NO: 2975087 - DNA, 15 bp, Homo sapiens
gttttgatggctggg

SEQ ID NO: 2975088 - DNA, 18 bp, Homo sapiens
gttttgatggctgggtcc

SEQ ID NO: 2975089 - DNA, 19 bp, Homo sapiens
gttttgatggctgggtcct

SEQ ID NO: 2975090 - DNA, 20 bp, Homo sapiens
gttttgccatgtagcagaca

SEQ ID NO: 2975091 - DNA, 11 bp, Homo sapiens
gttttggcctg

SEQ ID NO: 2975092 - DNA, 22 bp, Homo sapiens
gttttgtaaatgtactggtaat

SEQ ID NO: 2975093 - DNA, 11 bp, Homo sapiens
gttttgtaagc

SEQ ID NO: 2975094 - DNA, 14 bp, Homo sapiens
gttttgtaagccct

SEQ ID NO: 2975095 - DNA, 15 bp, Homo sapiens
gttttgtaccagtga

SEQ ID NO: 2975096 - DNA, 17 bp, Homo sapiens
gttttgtaccagtgaat

SEQ ID NO: 2975097 - DNA, 12 bp, Homo sapiens
gttttgtattct

SEQ ID NO: 2975098 - DNA, 17 bp, Homo sapiens
gttttgtcaaactgtag

SEQ ID NO: 2975099 - DNA, 24 bp, Homo sapiens
gttttgtcaaactgtagaaatgat

SEQ ID NO: 2975100 - DNA, 14 bp, Homo sapiens
gttttgtcttgaat

SEQ ID NO: 2975101 - DNA, 18 bp, Homo sapiens
gttttgtttgctatctta

SEQ ID NO: 2975102 - DNA, 20 bp, Homo sapiens
gttttgtttggcaaggaaag

SEQ ID NO: 2975103 - DNA, 17 bp, Homo sapiens
gttttgttttaaaatta

SEQ ID NO: 2975104 - DNA, 13 bp, Homo sapiens
gtttttaactcat

SEQ ID NO: 2975105 - DNA, 16 bp, Homo sapiens
gtttttattttcaaga

SEQ ID NO: 2975106 - DNA, 16 bp, Homo sapiens
gtttttcagtttaatt

SEQ ID NO: 2975107 - DNA, 18 bp, Homo sapiens
gtttttccactactgcta

SEQ ID NO: 2975108 - DNA, 18 bp, Homo sapiens
gtttttccagttccagga

SEQ ID NO: 2975109 - DNA, 11 bp, Homo sapiens
gtttttctcac

SEQ ID NO: 2975110 - DNA, 18 bp, Homo sapiens
gtttttctttttccacaa

SEQ ID NO: 2975111 - DNA, 17 bp, Homo sapiens
gtttttgacatttatat

SEQ ID NO: 2975112 - DNA, 16 bp, Homo sapiens
gtttttgagttttctt

SEQ ID NO: 2975113 - DNA, 17 bp, Homo sapiens
gtttttgcactgtctgt

SEQ ID NO: 2975114 - DNA, 12 bp, Homo sapiens
gtttttgctctc

SEQ ID NO: 2975115 - DNA, 11 bp, Homo sapiens
gtttttgcttt

SEQ ID NO: 2975116 - DNA, 15 bp, Homo sapiens
gtttttgctttctga

SEQ ID NO: 2975117 - DNA, 15 bp, Homo sapiens
gtttttggtgtttct

SEQ ID NO: 2975118 - DNA, 13 bp, Homo sapiens
gtttttgttgagt

SEQ ID NO: 2975119 - DNA, 23 bp, Homo sapiens
gtttttgttgagtctctgaacat

SEQ ID NO: 2975120 - DNA, 14 bp, Homo sapiens
gtttttgttttaag

SEQ ID NO: 2975121 - DNA, 18 bp, Homo sapiens
gttttttaggaaaagcat

SEQ ID NO: 2975122 - DNA, 13 bp, Homo sapiens
gttttttcatagt

SEQ ID NO: 2975123 - DNA, 15 bp, Homo sapiens
gttttttcatagtgc

SEQ ID NO: 2975124 - DNA, 14 bp, Homo sapiens
gttttttgtaccaa

SEQ ID NO: 2975125 - DNA, 23 bp, Homo sapiens
gtttttttcattgccaaaaacta

SEQ ID NO: 2975126 - DNA, 23 bp, Homo sapiens
taaaaaaaaaaaaaggaaaaaaa

SEQ ID NO: 2975127 - DNA, 20 bp, Homo sapiens
taaaaaaaaaaaagttatat

SEQ ID NO: 2975128 - DNA, 22 bp, Homo sapiens
taaaaaaaaaaaccaaaactgt

SEQ ID NO: 2975129 - DNA, 12 bp, Homo sapiens
taaaaaaaagaa

SEQ ID NO: 2975130 - DNA, 13 bp, Homo sapiens
taaaaaaaagaag

SEQ ID NO: 2975131 - DNA, 14 bp, Homo sapiens
taaaaaaaagaagt

SEQ ID NO: 2975132 - DNA, 17 bp, Homo sapiens
taaaaaaaatgtgaaat

SEQ ID NO: 2975133 - DNA, 18 bp, Homo sapiens
taaaaaaaatgtgaaatt

SEQ ID NO: 2975134 - DNA, 20 bp, Homo sapiens
taaaaaaaatgtgaaatttt

SEQ ID NO: 2975135 - DNA, 11 bp, Homo sapiens
taaaaaaagaa

SEQ ID NO: 2975136 - DNA, 17 bp, Homo sapiens
taaaaaaagaagagaaa

SEQ ID NO: 2975137 - DNA, 18 bp, Homo sapiens
taaaaaaaggcattgttt

SEQ ID NO: 2975138 - DNA, 20 bp, Homo sapiens
taaaaaaataataataatgt

SEQ ID NO: 2975139 - DNA, 12 bp, Homo sapiens
taaaaaacaaaa

SEQ ID NO: 2975140 - DNA, 19 bp, Homo sapiens
taaaaaacaaagaagacaa

SEQ ID NO: 2975141 - DNA, 16 bp, Homo sapiens
taaaaaacagaaaccg

SEQ ID NO: 2975142 - DNA, 11 bp, Homo sapiens
taaaaaagaaa

SEQ ID NO: 2975143 - DNA, 15 bp, Homo sapiens
taaaaaagaaaacat

SEQ ID NO: 2975144 - DNA, 15 bp, Homo sapiens
taaaaaagcaaagga

SEQ ID NO: 2975145 - DNA, 18 bp, Homo sapiens
taaaaaagcatacttcta

SEQ ID NO: 2975146 - DNA, 11 bp, Homo sapiens
taaaaaatgga

SEQ ID NO: 2975147 - DNA, 16 bp, Homo sapiens
taaaaacagcattgct

SEQ ID NO: 2975148 - DNA, 19 bp, Homo sapiens
taaaaacagcattgctttc

SEQ ID NO: 2975149 - DNA, 14 bp, Homo sapiens
taaaaaccaagaag

SEQ ID NO: 2975150 - DNA, 20 bp, Homo sapiens
taaaaactagtagttctctt

SEQ ID NO: 2975151 - DNA, 23 bp, Homo sapiens
taaaaagaaaaaaaaagaattac

SEQ ID NO: 2975152 - DNA, 16 bp, Homo sapiens
taaaaagaaagatttt

SEQ ID NO: 2975153 - DNA, 18 bp, Homo sapiens
taaaaagcagaattttaa

SEQ ID NO: 2975154 - DNA, 15 bp, Homo sapiens
taaaaaggaactgca

SEQ ID NO: 2975155 - DNA, 18 bp, Homo sapiens
taaaaaggaactgcagca

SEQ ID NO: 2975156 - DNA, 22 bp, Homo sapiens
taaaaagggagaaagaaaactg

SEQ ID NO: 2975157 - DNA, 16 bp, Homo sapiens
taaaaagggcagccct

SEQ ID NO: 2975158 - DNA, 18 bp, Homo sapiens
taaaaagggcagccctcc

SEQ ID NO: 2975159 - DNA, 13 bp, Homo sapiens
taaaaagttaaaa

SEQ ID NO: 2975160 - DNA, 17 bp, Homo sapiens
taaaaagttaaaaagtt

SEQ ID NO: 2975161 - DNA, 18 bp, Homo sapiens
taaaaagtttgccctgga

SEQ ID NO: 2975162 - DNA, 14 bp, Homo sapiens
taaaaataaatccc

SEQ ID NO: 2975163 - DNA, 14 bp, Homo sapiens
taaaaatacaatta

SEQ ID NO: 2975164 - DNA, 14 bp, Homo sapiens
taaaaatagaaaca

SEQ ID NO: 2975165 - DNA, 22 bp, Homo sapiens
taaaaatatactgattttgaaa

SEQ ID NO: 2975166 - DNA, 21 bp, Homo sapiens
taaaaatatttcagatatcaa

SEQ ID NO: 2975167 - DNA, 13 bp, Homo sapiens
taaaaatcaaaca

SEQ ID NO: 2975168 - DNA, 13 bp, Homo sapiens
taaaaatcaactt

SEQ ID NO: 2975169 - DNA, 19 bp, Homo sapiens
taaaaatcctaaaatatgt

SEQ ID NO: 2975170 - DNA, 17 bp, Homo sapiens
taaaaatgatactgatg

SEQ ID NO: 2975171 - DNA, 16 bp, Homo sapiens
taaaaatgatattgct

SEQ ID NO: 2975172 - DNA, 16 bp, Homo sapiens
taaaaatgcaaatcct

SEQ ID NO: 2975173 - DNA, 19 bp, Homo sapiens
taaaaatgggacttctttt

SEQ ID NO: 2975174 - DNA, 12 bp, Homo sapiens
taaaaatggtgg

SEQ ID NO: 2975175 - DNA, 23 bp, Homo sapiens
taaaaatggtggcttcagctcca

SEQ ID NO: 2975176 - DNA, 14 bp, Homo sapiens
taaaacaaaatttg

SEQ ID NO: 2975177 - DNA, 15 bp, Homo sapiens
taaaacaaaatttga

SEQ ID NO: 2975178 - DNA, 17 bp, Homo sapiens
taaaacaaaatttgact

SEQ ID NO: 2975179 - DNA, 23 bp, Homo sapiens
taaaacaataaaattttttttca

SEQ ID NO: 2975180 - DNA, 18 bp, Homo sapiens
taaaacaatattgtttct

SEQ ID NO: 2975181 - DNA, 12 bp, Homo sapiens
taaaacacagag

SEQ ID NO: 2975182 - DNA, 22 bp, Homo sapiens
taaaacacctctgctttctgat

SEQ ID NO: 2975183 - DNA, 15 bp, Homo sapiens
taaaacacctttcct

SEQ ID NO: 2975184 - DNA, 14 bp, Homo sapiens
taaaacacttctgt

SEQ ID NO: 2975185 - DNA, 16 bp, Homo sapiens
taaaacataatagaat

SEQ ID NO: 2975186 - DNA, 17 bp, Homo sapiens
taaaacatcattactat

SEQ ID NO: 2975187 - DNA, 11 bp, Homo sapiens
taaaaccacta

SEQ ID NO: 2975188 - DNA, 16 bp, Homo sapiens
taaaaccagttttgct

SEQ ID NO: 2975189 - DNA, 17 bp, Homo sapiens
taaaacgtgtaaatgaa

SEQ ID NO: 2975190 - DNA, 18 bp, Homo sapiens
taaaactaaatgtgtaca

SEQ ID NO: 2975191 - DNA, 19 bp, Homo sapiens
taagtagaacaaaaaaccc

SEQ ID NO: 2975192 - DNA, 16 bp, Homo sapiens
taagtagataagcaga

SEQ ID NO: 2975193 - DNA, 15 bp, Homo sapiens
taagtagatctgctt

SEQ ID NO: 2975194 - DNA, 14 bp, Homo sapiens
taagtaggtgatga

SEQ ID NO: 2975195 - DNA, 16 bp, Homo sapiens
taagtataaaatacaa

SEQ ID NO: 2975196 - DNA, 14 bp, Homo sapiens
taagtataacaaac

SEQ ID NO: 2975197 - DNA, 15 bp, Homo sapiens
taagtataacaaact

SEQ ID NO: 2975198 - DNA, 13 bp, Homo sapiens
taagtatttcaaa

SEQ ID NO: 2975199 - DNA, 13 bp, Homo sapiens
taagtatttctga

SEQ ID NO: 2975200 - DNA, 15 bp, Homo sapiens
taagtcaaaaggaac

SEQ ID NO: 2975201 - DNA, 16 bp, Homo sapiens
taagtcaaaaggaaca

SEQ ID NO: 2975202 - DNA, 14 bp, Homo sapiens
taagtcagaacagc

SEQ ID NO: 2975203 - DNA, 17 bp, Homo sapiens
taagtcctttatgtgga

SEQ ID NO: 2975204 - DNA, 18 bp, Homo sapiens
taagtcgttgagggaatg

SEQ ID NO: 2975205 - DNA, 20 bp, Homo sapiens
taagtcgttgagggaatgac

SEQ ID NO: 2975206 - DNA, 13 bp, Homo sapiens
taagtctcaactg

SEQ ID NO: 2975207 - DNA, 19 bp, Homo sapiens
taagtgaaagtgaggaaat

SEQ ID NO: 2975208 - DNA, 20 bp, Homo sapiens
taagtgacagtttaactttt

SEQ ID NO: 2975209 - DNA, 15 bp, Homo sapiens
taagtgaccttctga

SEQ ID NO: 2975210 - DNA, 17 bp, Homo sapiens
taagtgatttccacagg

SEQ ID NO: 2975211 - DNA, 19 bp, Homo sapiens
taagtgggacattagtaac

SEQ ID NO: 2975212 - DNA, 18 bp, Homo sapiens
taagtgggcattttgaca

SEQ ID NO: 2975213 - DNA, 20 bp, Homo sapiens
taagtgggcattttgacaac

SEQ ID NO: 2975214 - DNA, 18 bp, Homo sapiens
taagtgggcccacccggt

SEQ ID NO: 2975215 - DNA, 14 bp, Homo sapiens
taagttaatttaaa

SEQ ID NO: 2975216 - DNA, 14 bp, Homo sapiens
taagttataagact

SEQ ID NO: 2975217 - DNA, 14 bp, Homo sapiens
taagttcacttttt

SEQ ID NO: 2975218 - DNA, 16 bp, Homo sapiens
taagttgatgttttct

SEQ ID NO: 2975219 - DNA, 18 bp, Homo sapiens
taagttgatgttttctaa

SEQ ID NO: 2975220 - DNA, 13 bp, Homo sapiens
taagttgctttcc

SEQ ID NO: 2975221 - DNA, 15 bp, Homo sapiens
taagttgtaaaatgt

SEQ ID NO: 2975222 - DNA, 21 bp, Homo sapiens
taagtttcactcacatagcca

SEQ ID NO: 2975223 - DNA, 17 bp, Homo sapiens
taagtttcagttgattt

SEQ ID NO: 2975224 - DNA, 19 bp, Homo sapiens
taagtttccttccagccca

SEQ ID NO: 2975225 - DNA, 12 bp, Homo sapiens
taagtttccttt

SEQ ID NO: 2975226 - DNA, 16 bp, Homo sapiens
taagtttctaagattc

SEQ ID NO: 2975227 - DNA, 12 bp, Homo sapiens
taagtttgaagg

SEQ ID NO: 2975228 - DNA, 20 bp, Homo sapiens
taagttttactgataatttg

SEQ ID NO: 2975229 - DNA, 14 bp, Homo sapiens
taagttttatttaa

SEQ ID NO: 2975230 - DNA, 21 bp, Homo sapiens
taagttttatttaacttttct

SEQ ID NO: 2975231 - DNA, 18 bp, Homo sapiens
taagttttgtgtgtatat

SEQ ID NO: 2975232 - DNA, 17 bp, Homo sapiens
taagtttttctttaata

SEQ ID NO: 2975233 - DNA, 15 bp, Homo sapiens
taataaaaagaaaga

SEQ ID NO: 2975234 - DNA, 13 bp, Homo sapiens
taataaaaattgt

SEQ ID NO: 2975235 - DNA, 18 bp, Homo sapiens
taataaaaatttattatt

SEQ ID NO: 2975236 - DNA, 19 bp, Homo sapiens
taataaaaatttattattt

SEQ ID NO: 2975237 - DNA, 12 bp, Homo sapiens
taataaaacatt

SEQ ID NO: 2975238 - DNA, 19 bp, Homo sapiens
taataaaatactttttgtg

SEQ ID NO: 2975239 - DNA, 18 bp, Homo sapiens
taataaacgaagataaat

SEQ ID NO: 2975240 - DNA, 16 bp, Homo sapiens
taataaactgcaaatg

SEQ ID NO: 2975241 - DNA, 13 bp, Homo sapiens
taataaagtactt

SEQ ID NO: 2975242 - DNA, 18 bp, Homo sapiens
taataaagtttttttcca

SEQ ID NO: 2975243 - DNA, 18 bp, Homo sapiens
taataaatacacaatgaa

SEQ ID NO: 2975244 - DNA, 19 bp, Homo sapiens
taataagttgatgttttct

SEQ ID NO: 2975245 - DNA, 14 bp, Homo sapiens
taataataatgttt

SEQ ID NO: 2975246 - DNA, 16 bp, Homo sapiens
taataatgtaacatga

SEQ ID NO: 2975247 - DNA, 17 bp, Homo sapiens
taataatgtaacatgat

SEQ ID NO: 2975248 - DNA, 15 bp, Homo sapiens
taataatgtttaata

SEQ ID NO: 2975249 - DNA, 20 bp, Homo sapiens
taataattggccttcgattt

SEQ ID NO: 2975250 - DNA, 22 bp, Homo sapiens
taataatttacaggttcttagg

SEQ ID NO: 2975251 - DNA, 13 bp, Homo sapiens
taataatttctaa

SEQ ID NO: 2975252 - DNA, 20 bp, Homo sapiens
taataatttttaagaaataa

SEQ ID NO: 2975253 - DNA, 18 bp, Homo sapiens
taatacacttgccctgct

SEQ ID NO: 2975254 - DNA, 14 bp, Homo sapiens
taatacaggagacc

SEQ ID NO: 2975255 - DNA, 15 bp, Homo sapiens
taatacctgggtgat

SEQ ID NO: 2975256 - DNA, 15 bp, Homo sapiens
taatactaccttgaa

SEQ ID NO: 2975257 - DNA, 23 bp, Homo sapiens
taatactagttgtgaccttagtg

SEQ ID NO: 2975258 - DNA, 15 bp, Homo sapiens
taatactgaatttct

SEQ ID NO: 2975259 - DNA, 20 bp, Homo sapiens
taatactgaatttctttgat

SEQ ID NO: 2975260 - DNA, 16 bp, Homo sapiens
taatactggttatcct

SEQ ID NO: 2975261 - DNA, 21 bp, Homo sapiens
taatactggttatcctgtgct

SEQ ID NO: 2975262 - DNA, 13 bp, Homo sapiens
taatagaatttcc

SEQ ID NO: 2975263 - DNA, 18 bp, Homo sapiens
taatagataactgctctt

SEQ ID NO: 2975264 - DNA, 12 bp, Homo sapiens
taatagattctc

SEQ ID NO: 2975265 - DNA, 20 bp, Homo sapiens
taatagctttagtgaattaa

SEQ ID NO: 2975266 - DNA, 14 bp, Homo sapiens
taatagggaatata

SEQ ID NO: 2975267 - DNA, 14 bp, Homo sapiens
taatataatgaatt

SEQ ID NO: 2975268 - DNA, 19 bp, Homo sapiens
taatatatttgtgtattta

SEQ ID NO: 2975269 - DNA, 12 bp, Homo sapiens
taatatgagaat

SEQ ID NO: 2975270 - DNA, 13 bp, Homo sapiens
taatatgttgact

SEQ ID NO: 2975271 - DNA, 12 bp, Homo sapiens
taatattatata

SEQ ID NO: 2975272 - DNA, 11 bp, Homo sapiens
taatattatta

SEQ ID NO: 2975273 - DNA, 12 bp, Homo sapiens
taatatttctta

SEQ ID NO: 2975274 - DNA, 22 bp, Homo sapiens
taatatttcttaatttggataa

SEQ ID NO: 2975275 - DNA, 20 bp, Homo sapiens
taatatttgctaaatatttc

SEQ ID NO: 2975276 - DNA, 13 bp, Homo sapiens
taatcaagatttt

SEQ ID NO: 2975277 - DNA, 23 bp, Homo sapiens
taatcaagtacctatattgattt

SEQ ID NO: 2975278 - DNA, 16 bp, Homo sapiens
taatcaataaacgatt

SEQ ID NO: 2975279 - DNA, 15 bp, Homo sapiens
taatcacatgtgctg

SEQ ID NO: 2975280 - DNA, 20 bp, Homo sapiens
taatcagcaagaatttgatc

SEQ ID NO: 2975281 - DNA, 12 bp, Homo sapiens
taatcagctgtt

SEQ ID NO: 2975282 - DNA, 14 bp, Homo sapiens
taatcatatttgaa

SEQ ID NO: 2975283 - DNA, 16 bp, Homo sapiens
taatcatgagcctgtt

SEQ ID NO: 2975284 - DNA, 17 bp, Homo sapiens
taatcatgagcctgttt

SEQ ID NO: 2975285 - DNA, 19 bp, Homo sapiens
taatcatgagcctgtttat

SEQ ID NO: 2975286 - DNA, 21 bp, Homo sapiens
taatcatgagcctgtttattg

SEQ ID NO: 2975287 - DNA, 23 bp, Homo sapiens
taatcatgagcctgtttattgcc

SEQ ID NO: 2975288 - DNA, 21 bp, Homo sapiens
taatcatttgtttacatttga

SEQ ID NO: 2975289 - DNA, 17 bp, Homo sapiens
taatcattttagaatta

SEQ ID NO: 2975290 - DNA, 14 bp, Homo sapiens
taatcattttcatt

SEQ ID NO: 2975291 - DNA, 18 bp, Homo sapiens
taatcattttcattccta

SEQ ID NO: 2975292 - DNA, 22 bp, Homo sapiens
taatccaggcagatccaggact

SEQ ID NO: 2975293 - DNA, 20 bp, Homo sapiens
taatccaggtaactttgaag

SEQ ID NO: 2975294 - DNA, 12 bp, Homo sapiens
taatccagtaaa

SEQ ID NO: 2975295 - DNA, 16 bp, Homo sapiens
taatccctatgtttgt

SEQ ID NO: 2975296 - DNA, 20 bp, Homo sapiens
taatccctgggcattgcttt

SEQ ID NO: 2975297 - DNA, 15 bp, Homo sapiens
taatcggcccacagc

SEQ ID NO: 2975298 - DNA, 22 bp, Homo sapiens
taatcggcccacagctcccacc

SEQ ID NO: 2975299 - DNA, 16 bp, Homo sapiens
taatcgtttttgtttt

SEQ ID NO: 2975300 - DNA, 14 bp, Homo sapiens
taatctatgtttat

SEQ ID NO: 2975301 - DNA, 14 bp, Homo sapiens
taatctcaatgcaa

SEQ ID NO: 2975302 - DNA, 21 bp, Homo sapiens
taatctggtgttcttgctaac

SEQ ID NO: 2975303 - DNA, 19 bp, Homo sapiens
taatctgtgtacaaagaaa

SEQ ID NO: 2975304 - DNA, 15 bp, Homo sapiens
taatctgttgtttga

SEQ ID NO: 2975305 - DNA, 16 bp, Homo sapiens
taatctgttgtttgaa

SEQ ID NO: 2975306 - DNA, 16 bp, Homo sapiens
taatcttaaatcagaa

SEQ ID NO: 2975307 - DNA, 16 bp, Homo sapiens
taatcttgaattgtaa

SEQ ID NO: 2975308 - DNA, 17 bp, Homo sapiens
taatctttcacttgaaa

SEQ ID NO: 2975309 - DNA, 21 bp, Homo sapiens
taatctttcacttgaaagatt

SEQ ID NO: 2975310 - DNA, 23 bp, Homo sapiens
taatctttcacttgaaagatttt

SEQ ID NO: 2975311 - DNA, 19 bp, Homo sapiens
taatctttttctccaccca

SEQ ID NO: 2975312 - DNA, 15 bp, Homo sapiens
taatgaaataatcag

SEQ ID NO: 2975313 - DNA, 19 bp, Homo sapiens
taatgaaataatcagtgac

SEQ ID NO: 2975314 - DNA, 13 bp, Homo sapiens
taatgaactttat

SEQ ID NO: 2975315 - DNA, 17 bp, Homo sapiens
taatgaagaaagtggaa

SEQ ID NO: 2975316 - DNA, 19 bp, Homo sapiens
taatgaaggtgtgctacag

SEQ ID NO: 2975317 - DNA, 20 bp, Homo sapiens
taatgaaggttttcatttgc

SEQ ID NO: 2975318 - DNA, 20 bp, Homo sapiens
taatgaatcgtaatgaagtt

SEQ ID NO: 2975319 - DNA, 16 bp, Homo sapiens
taatgaatttttatga

SEQ ID NO: 2975320 - DNA, 16 bp, Homo sapiens
taatgatgttgataat

SEQ ID NO: 2975321 - DNA, 17 bp, Homo sapiens
taatgatgttgataatt

SEQ ID NO: 2975322 - DNA, 18 bp, Homo sapiens
taatgatgttgataattt

SEQ ID NO: 2975323 - DNA, 13 bp, Homo sapiens
taatgattctgaa

SEQ ID NO: 2975324 - DNA, 14 bp, Homo sapiens
taatgattctgaag

SEQ ID NO: 2975325 - DNA, 12 bp, Homo sapiens
tacctttgtagt

SEQ ID NO: 2975326 - DNA, 13 bp, Homo sapiens
taccttttatttt

SEQ ID NO: 2975327 - DNA, 22 bp, Homo sapiens
taccttttgataaaatgttcct

SEQ ID NO: 2975328 - DNA, 23 bp, Homo sapiens
taccttttgataaaatgttcctt

SEQ ID NO: 2975329 - DNA, 13 bp, Homo sapiens
taccttttgttac

SEQ ID NO: 2975330 - DNA, 19 bp, Homo sapiens
taccttttgttaccacaga

SEQ ID NO: 2975331 - DNA, 22 bp, Homo sapiens
taccttttttgttttttcaaaa

SEQ ID NO: 2975332 - DNA, 13 bp, Homo sapiens
tacgaagaggggt

SEQ ID NO: 2975333 - DNA, 21 bp, Homo sapiens
tacgaataaacgcagaagagg

SEQ ID NO: 2975334 - DNA, 14 bp, Homo sapiens
tacgaatacttttg

SEQ ID NO: 2975335 - DNA, 19 bp, Homo sapiens
tacgatatttcgtttggtc

SEQ ID NO: 2975336 - DNA, 17 bp, Homo sapiens
tacgcacagacaggttt

SEQ ID NO: 2975337 - DNA, 22 bp, Homo sapiens
tacgcactttgcaggatgacct

SEQ ID NO: 2975338 - DNA, 12 bp, Homo sapiens
tacgcttttctt

SEQ ID NO: 2975339 - DNA, 13 bp, Homo sapiens
tacggacaccccc

SEQ ID NO: 2975340 - DNA, 17 bp, Homo sapiens
tacggtgtacagtttaa

SEQ ID NO: 2975341 - DNA, 22 bp, Homo sapiens
tacgtagccacaggagccctgc

SEQ ID NO: 2975342 - DNA, 21 bp, Homo sapiens
tacgtcccagcggcctcaggg

SEQ ID NO: 2975343 - DNA, 13 bp, Homo sapiens
tacgtctgggaga

SEQ ID NO: 2975344 - DNA, 21 bp, Homo sapiens
tacgtgtggttcatccatcat

SEQ ID NO: 2975345 - DNA, 13 bp, Homo sapiens
tacgttgtttctt

SEQ ID NO: 2975346 - DNA, 14 bp, Homo sapiens
tacgtttgtgcaga

SEQ ID NO: 2975347 - DNA, 14 bp, Homo sapiens
tacgtttgtgtttc

SEQ ID NO: 2975348 - DNA, 17 bp, Homo sapiens
tactaaagcaaagcaaa

SEQ ID NO: 2975349 - DNA, 13 bp, Homo sapiens
tactaaggagaat

SEQ ID NO: 2975350 - DNA, 13 bp, Homo sapiens
tactaccctcacc

SEQ ID NO: 2975351 - DNA, 23 bp, Homo sapiens
tactacctacgtttgcaccgcct

SEQ ID NO: 2975352 - DNA, 16 bp, Homo sapiens
tactaccttgaaaata

SEQ ID NO: 2975353 - DNA, 20 bp, Homo sapiens
tactaccttgaaaataagaa

SEQ ID NO: 2975354 - DNA, 14 bp, Homo sapiens
tactactttaagtg

SEQ ID NO: 2975355 - DNA, 12 bp, Homo sapiens
tactactttgtt

SEQ ID NO: 2975356 - DNA, 19 bp, Homo sapiens
tactactttgttaggattt

SEQ ID NO: 2975357 - DNA, 23 bp, Homo sapiens
tactactttgttaggattttcac

SEQ ID NO: 2975358 - DNA, 23 bp, Homo sapiens
tactaggcttaatacctgggtga

SEQ ID NO: 2975359 - DNA, 19 bp, Homo sapiens
tactagggagccatttgag

SEQ ID NO: 2975360 - DNA, 12 bp, Homo sapiens
tactattaaaaa

SEQ ID NO: 2975361 - DNA, 13 bp, Homo sapiens
tactcaaagtgga

SEQ ID NO: 2975362 - DNA, 21 bp, Homo sapiens
tactcaaagtggaaaggatca

SEQ ID NO: 2975363 - DNA, 15 bp, Homo sapiens
tactcaagcccgcgg

SEQ ID NO: 2975364 - DNA, 19 bp, Homo sapiens
tactcaccatatttgaatt

SEQ ID NO: 2975365 - DNA, 21 bp, Homo sapiens
tactcagaaatggacaaagaa

SEQ ID NO: 2975366 - DNA, 11 bp, Homo sapiens
tactcagagct

SEQ ID NO: 2975367 - DNA, 12 bp, Homo sapiens
tactcagagctg

SEQ ID NO: 2975368 - DNA, 16 bp, Homo sapiens
tactcagagctgcggg

SEQ ID NO: 2975369 - DNA, 21 bp, Homo sapiens
tactcagcagcagagagccct

SEQ ID NO: 2975370 - DNA, 16 bp, Homo sapiens
tactcagcagccctcc

SEQ ID NO: 2975371 - DNA, 23 bp, Homo sapiens
tactcagcagccctcctcacccc

SEQ ID NO: 2975372 - DNA, 14 bp, Homo sapiens
tactcagccctggg

SEQ ID NO: 2975373 - DNA, 15 bp, Homo sapiens
tactcagccctgggc

SEQ ID NO: 2975374 - DNA, 21 bp, Homo sapiens
tactcaggaggctgagacagg

SEQ ID NO: 2975375 - DNA, 21 bp, Homo sapiens
tactcataatgtgaagtgtta

SEQ ID NO: 2975376 - DNA, 11 bp, Homo sapiens
tactcatgtgt

SEQ ID NO: 2975377 - DNA, 13 bp, Homo sapiens
tactcatgtgtat

SEQ ID NO: 2975378 - DNA, 16 bp, Homo sapiens
tactccagcctgggtg

SEQ ID NO: 2975379 - DNA, 17 bp, Homo sapiens
tactccatggttctcaa

SEQ ID NO: 2975380 - DNA, 22 bp, Homo sapiens
tactcccactcccggcctgtca

SEQ ID NO: 2975381 - DNA, 23 bp, Homo sapiens
tactccccttcccctatgattga

SEQ ID NO: 2975382 - DNA, 16 bp, Homo sapiens
tactcccctttcttcc

SEQ ID NO: 2975383 - DNA, 20 bp, Homo sapiens
tactcccctttcttccaaac

SEQ ID NO: 2975384 - DNA, 15 bp, Homo sapiens
tactccctacactga

SEQ ID NO: 2975385 - DNA, 14 bp, Homo sapiens
tactccctctcagg

SEQ ID NO: 2975386 - DNA, 9 bp, Homo sapiens
tactcctgg

SEQ ID NO: 2975387 - DNA, 19 bp, Homo sapiens
tactcgagcccacccagca

SEQ ID NO: 2975388 - DNA, 15 bp, Homo sapiens
tactctaagatctta

SEQ ID NO: 2975389 - DNA, 21 bp, Homo sapiens
tactctaagatcttagattct

SEQ ID NO: 2975390 - DNA, 14 bp, Homo sapiens
tactctccaacctg

SEQ ID NO: 2975391 - DNA, 18 bp, Homo sapiens
tactctccaacctggaca

SEQ ID NO: 2975392 - DNA, 19 bp, Homo sapiens
tactctctgagtacattgt

SEQ ID NO: 2975393 - DNA, 22 bp, Homo sapiens
tactctgagacaaaagaaaaaa

SEQ ID NO: 2975394 - DNA, 22 bp, Homo sapiens
tactctggagcaacctactgtc

SEQ ID NO: 2975395 - DNA, 14 bp, Homo sapiens
tactctgttccttc

SEQ ID NO: 2975396 - DNA, 15 bp, Homo sapiens
tactctgttgaatat

SEQ ID NO: 2975397 - DNA, 15 bp, Homo sapiens
tactctgttgcctcc

SEQ ID NO: 2975398 - DNA, 19 bp, Homo sapiens
tactctgttgcctcctctc

SEQ ID NO: 2975399 - DNA, 17 bp, Homo sapiens
tactcttaagccatctt

SEQ ID NO: 2975400 - DNA, 22 bp, Homo sapiens
tactcttaatgatgttatctta

SEQ ID NO: 2975401 - DNA, 14 bp, Homo sapiens
tactctttgctttg

SEQ ID NO: 2975402 - DNA, 16 bp, Homo sapiens
tactcttttgaagtgt

SEQ ID NO: 2975403 - DNA, 15 bp, Homo sapiens
tactgaaccagccac

SEQ ID NO: 2975404 - DNA, 16 bp, Homo sapiens
tactgaatttctttga

SEQ ID NO: 2975405 - DNA, 17 bp, Homo sapiens
tactgacaatgtatttt

SEQ ID NO: 2975406 - DNA, 17 bp, Homo sapiens
tactgaccctggggctg

SEQ ID NO: 2975407 - DNA, 22 bp, Homo sapiens
tactgaccctggggctggcttt

SEQ ID NO: 2975408 - DNA, 20 bp, Homo sapiens
tactgagcgcaagccacagc

SEQ ID NO: 2975409 - DNA, 16 bp, Homo sapiens
tactgagtaaacccta

SEQ ID NO: 2975410 - DNA, 22 bp, Homo sapiens
tactgagtccctggcaagactg

SEQ ID NO: 2975411 - DNA, 19 bp, Homo sapiens
tactgatcatctgctgtga

SEQ ID NO: 2975412 - DNA, 19 bp, Homo sapiens
tactgatggaagcacacaa

SEQ ID NO: 2975413 - DNA, 15 bp, Homo sapiens
tactgattgtttcat

SEQ ID NO: 2975414 - DNA, 21 bp, Homo sapiens
tactgcaacttaacttaaaat

SEQ ID NO: 2975415 - DNA, 14 bp, Homo sapiens
tactgcaatcactg

SEQ ID NO: 2975416 - DNA, 15 bp, Homo sapiens
tactgcaatcactgt

SEQ ID NO: 2975417 - DNA, 19 bp, Homo sapiens
tactgcagttgaaagggca

SEQ ID NO: 2975418 - DNA, 22 bp, Homo sapiens
tactgcatgtttgctgttccac

SEQ ID NO: 2975419 - DNA, 24 bp, Homo sapiens
tactgccagatgctgatgttcagt

SEQ ID NO: 2975420 - DNA, 22 bp, Homo sapiens
tactgccgtcagtgctgtgctg

SEQ ID NO: 2975421 - DNA, 20 bp, Homo sapiens
tactgctgagatacatacag

SEQ ID NO: 2975422 - DNA, 21 bp, Homo sapiens
tactgctgagatacatacaga

SEQ ID NO: 2975423 - DNA, 21 bp, Homo sapiens
tactgctgatgctgaaataaa

SEQ ID NO: 2975424 - DNA, 13 bp, Homo sapiens
tactgctgctgtg

SEQ ID NO: 2975425 - DNA, 16 bp, Homo sapiens
tactgctgctgtgctt

SEQ ID NO: 2975426 - DNA, 20 bp, Homo sapiens
tactgcttaattcaaataat

SEQ ID NO: 2975427 - DNA, 17 bp, Homo sapiens
tactgcttaattgctga

SEQ ID NO: 2975428 - DNA, 23 bp, Homo sapiens
tactgcttgcttacaatctttat

SEQ ID NO: 2975429 - DNA, 24 bp, Homo sapiens
tactgcttggagctgagcaaatca

SEQ ID NO: 2975430 - DNA, 23 bp, Homo sapiens
tactggaaacctagccagcttca

SEQ ID NO: 2975431 - DNA, 18 bp, Homo sapiens
tactggcaaaaggatctt

SEQ ID NO: 2975432 - DNA, 15 bp, Homo sapiens
tactggcgtggatta

SEQ ID NO: 2975433 - DNA, 14 bp, Homo sapiens
tactgggctaagga

SEQ ID NO: 2975434 - DNA, 19 bp, Homo sapiens
tactggggaggctgaggca

SEQ ID NO: 2975435 - DNA, 19 bp, Homo sapiens
tactggtgcagtcattatg

SEQ ID NO: 2975436 - DNA, 22 bp, Homo sapiens
tactggtgtcaccctttgccta

SEQ ID NO: 2975437 - DNA, 22 bp, Homo sapiens
tactggttatcctgtgctacag

SEQ ID NO: 2975438 - DNA, 23 bp, Homo sapiens
tactggttatcctgtgctacaga

SEQ ID NO: 2975439 - DNA, 12 bp, Homo sapiens
tactgtaaagaa

SEQ ID NO: 2975440 - DNA, 13 bp, Homo sapiens
tactgtaaagaaa

SEQ ID NO: 2975441 - DNA, 17 bp, Homo sapiens
tactgtaaagaaagaga

SEQ ID NO: 2975442 - DNA, 18 bp, Homo sapiens
tactgtaagaataattta

SEQ ID NO: 2975443 - DNA, 13 bp, Homo sapiens
tactgtaagacat

SEQ ID NO: 2975444 - DNA, 14 bp, Homo sapiens
tactgtacaataaa

SEQ ID NO: 2975445 - DNA, 15 bp, Homo sapiens
tactgtacaataaaa

SEQ ID NO: 2975446 - DNA, 16 bp, Homo sapiens
tactgtagaactgatt

SEQ ID NO: 2975447 - DNA, 18 bp, Homo sapiens
tactgtagaactgatttt

SEQ ID NO: 2975448 - DNA, 23 bp, Homo sapiens
tactgtagaagaagtgaacactt

SEQ ID NO: 2975449 - DNA, 14 bp, Homo sapiens
tactgtatgtgatg

SEQ ID NO: 2975450 - DNA, 22 bp, Homo sapiens
tactgtatttttacctttttcc

SEQ ID NO: 2975451 - DNA, 23 bp, Homo sapiens
tactgtccctctcagtgccttct

SEQ ID NO: 2975452 - DNA, 11 bp, Homo sapiens
tactgtctaag

SEQ ID NO: 2975453 - DNA, 22 bp, Homo sapiens
tactgtctcactgaaacattta

SEQ ID NO: 2975454 - DNA, 19 bp, Homo sapiens
tactgtcttaaatcagttt

SEQ ID NO: 2975455 - DNA, 23 bp, Homo sapiens
tactgtgaagttacatgcataaa

SEQ ID NO: 2975456 - DNA, 18 bp, Homo sapiens
tactgtggaaaagaaaca

SEQ ID NO: 2975457 - DNA, 13 bp, Homo sapiens
tagttgtctttct

SEQ ID NO: 2975458 - DNA, 18 bp, Homo sapiens
tagtttaaaatcttgcat

SEQ ID NO: 2975459 - DNA, 22 bp, Homo sapiens
tagtttacctgaataaatggta

SEQ ID NO: 2975460 - DNA, 16 bp, Homo sapiens
tagtttctgttctgtg

SEQ ID NO: 2975461 - DNA, 17 bp, Homo sapiens
tagtttgatcagacagc

SEQ ID NO: 2975462 - DNA, 21 bp, Homo sapiens
tagtttgattattcagtgtca

SEQ ID NO: 2975463 - DNA, 11 bp, Homo sapiens
tagtttgcatt

SEQ ID NO: 2975464 - DNA, 16 bp, Homo sapiens
tagtttggcatttgca

SEQ ID NO: 2975465 - DNA, 16 bp, Homo sapiens
tagtttgggcttcagc

SEQ ID NO: 2975466 - DNA, 23 bp, Homo sapiens
tagtttgttatgtgtctggaaga

SEQ ID NO: 2975467 - DNA, 14 bp, Homo sapiens
tagttttcttgttg

SEQ ID NO: 2975468 - DNA, 19 bp, Homo sapiens
tagttttcttgttgctttg

SEQ ID NO: 2975469 - DNA, 15 bp, Homo sapiens
tagttttgtcaaact

SEQ ID NO: 2975470 - DNA, 17 bp, Homo sapiens
tagttttttcttttaac

SEQ ID NO: 2975471 - DNA, 17 bp, Homo sapiens
tataaaacaggtcaata

SEQ ID NO: 2975472 - DNA, 23 bp, Homo sapiens
tataaaataaaaagtcacaatga

SEQ ID NO: 2975473 - DNA, 19 bp, Homo sapiens
tataaaatataaacaaaga

SEQ ID NO: 2975474 - DNA, 21 bp, Homo sapiens
tataaaatgcagtaacattct

SEQ ID NO: 2975475 - DNA, 21 bp, Homo sapiens
tataaaatgcccatttcgaag

SEQ ID NO: 2975476 - DNA, 17 bp, Homo sapiens
tataaaatgctgatatt

SEQ ID NO: 2975477 - DNA, 21 bp, Homo sapiens
tataaaatgctgatatttact

SEQ ID NO: 2975478 - DNA, 18 bp, Homo sapiens
tataaacaaagattcatg

SEQ ID NO: 2975479 - DNA, 23 bp, Homo sapiens
tataaagaaggttggtgaatttc

SEQ ID NO: 2975480 - DNA, 15 bp, Homo sapiens
tataaagccaagaat

SEQ ID NO: 2975481 - DNA, 17 bp, Homo sapiens
tataaagctgttattct

SEQ ID NO: 2975482 - DNA, 14 bp, Homo sapiens
tataaagtagaaat

SEQ ID NO: 2975483 - DNA, 18 bp, Homo sapiens
tataaagttttatttgaa

SEQ ID NO: 2975484 - DNA, 12 bp, Homo sapiens
tataaataataa

SEQ ID NO: 2975485 - DNA, 20 bp, Homo sapiens
tataaatacaaatctgtata

SEQ ID NO: 2975486 - DNA, 21 bp, Homo sapiens
tataaatatattttctttcta

SEQ ID NO: 2975487 - DNA, 14 bp, Homo sapiens
tataaatgtctatt

SEQ ID NO: 2975488 - DNA, 17 bp, Homo sapiens
tataaatgtttggaaag

SEQ ID NO: 2975489 - DNA, 17 bp, Homo sapiens
tataaattaagaagagt

SEQ ID NO: 2975490 - DNA, 15 bp, Homo sapiens
tataaattaatttgt

SEQ ID NO: 2975491 - DNA, 20 bp, Homo sapiens
tataaattcctctttgcttt

SEQ ID NO: 2975492 - DNA, 22 bp, Homo sapiens
tataaattctactaagttattt

SEQ ID NO: 2975493 - DNA, 15 bp, Homo sapiens
tataaattttttgaa

SEQ ID NO: 2975494 - DNA, 17 bp, Homo sapiens
tataacaaactatgtaa

SEQ ID NO: 2975495 - DNA, 21 bp, Homo sapiens
tataacaggttattttagttt

SEQ ID NO: 2975496 - DNA, 22 bp, Homo sapiens
tataacctgatgccataaatac

SEQ ID NO: 2975497 - DNA, 18 bp, Homo sapiens
tataactagtcctttact

SEQ ID NO: 2975498 - DNA, 12 bp, Homo sapiens
tataagacatta

SEQ ID NO: 2975499 - DNA, 12 bp, Homo sapiens
tataagactctc

SEQ ID NO: 2975500 - DNA, 18 bp, Homo sapiens
tataagagggcatataca

SEQ ID NO: 2975501 - DNA, 20 bp, Homo sapiens
tataaggtgttttctgtgta

SEQ ID NO: 2975502 - DNA, 23 bp, Homo sapiens
tataaggtgttttctgtgtaacc

SEQ ID NO: 2975503 - DNA, 21 bp, Homo sapiens
tataagtagatctgctttctg

SEQ ID NO: 2975504 - DNA, 16 bp, Homo sapiens
tataatatatttgtgt

SEQ ID NO: 2975505 - DNA, 14 bp, Homo sapiens
tataatatctaaag

SEQ ID NO: 2975506 - DNA, 18 bp, Homo sapiens
tataatatttgaagcagc

SEQ ID NO: 2975507 - DNA, 23 bp, Homo sapiens
tataatatttgaagcagctctgc

SEQ ID NO: 2975508 - DNA, 18 bp, Homo sapiens
tataatgacttttaaaat

SEQ ID NO: 2975509 - DNA, 23 bp, Homo sapiens
tataatgacttttaaaatttgta

SEQ ID NO: 2975510 - DNA, 23 bp, Homo sapiens
tataatgatcagcaaaaagactg

SEQ ID NO: 2975511 - DNA, 20 bp, Homo sapiens
tataatggacagattaatat

SEQ ID NO: 2975512 - DNA, 17 bp, Homo sapiens
tataatgtttttaatat

SEQ ID NO: 2975513 - DNA, 13 bp, Homo sapiens
tataattcagtat

SEQ ID NO: 2975514 - DNA, 22 bp, Homo sapiens
tataattcagtatgttttacac

SEQ ID NO: 2975515 - DNA, 23 bp, Homo sapiens
tataattcagtatgttttacact

SEQ ID NO: 2975516 - DNA, 16 bp, Homo sapiens
tataattctatactgt

SEQ ID NO: 2975517 - DNA, 12 bp, Homo sapiens
tataattctgga

SEQ ID NO: 2975518 - DNA, 13 bp, Homo sapiens
tataattgtatcg

SEQ ID NO: 2975519 - DNA, 20 bp, Homo sapiens
tataattgttccctatgaaa

SEQ ID NO: 2975520 - DNA, 18 bp, Homo sapiens
tataatttgatagatgtt

SEQ ID NO: 2975521 - DNA, 15 bp, Homo sapiens
tataattttttaaag

SEQ ID NO: 2975522 - DNA, 21 bp, Homo sapiens
tatacaaagacagccactttt

SEQ ID NO: 2975523 - DNA, 12 bp, Homo sapiens
tatacaaatata

SEQ ID NO: 2975524 - DNA, 20 bp, Homo sapiens
tatacaaattttcagaaggt

SEQ ID NO: 2975525 - DNA, 23 bp, Homo sapiens
tatacaaattttcagaaggttat

SEQ ID NO: 2975526 - DNA, 12 bp, Homo sapiens
tatacaacagtg

SEQ ID NO: 2975527 - DNA, 20 bp, Homo sapiens
tatacaacagtgctaaaaat

SEQ ID NO: 2975528 - DNA, 21 bp, Homo sapiens
tatacaacagtgctaaaaatg

SEQ ID NO: 2975529 - DNA, 20 bp, Homo sapiens
tatacaactgtaaagcaaat

SEQ ID NO: 2975530 - DNA, 15 bp, Homo sapiens
tatacacacacacac

SEQ ID NO: 2975531 - DNA, 21 bp, Homo sapiens
tatacacgggacagttgctgg

SEQ ID NO: 2975532 - DNA, 16 bp, Homo sapiens
tatacagtaactttat

SEQ ID NO: 2975533 - DNA, 21 bp, Homo sapiens
tatacagtaactttatgtgta

SEQ ID NO: 2975534 - DNA, 14 bp, Homo sapiens
tatacatacagaga

SEQ ID NO: 2975535 - DNA, 22 bp, Homo sapiens
tatacatagcatgacatttctt

SEQ ID NO: 2975536 - DNA, 20 bp, Homo sapiens
tatacatcaatatgtatata

SEQ ID NO: 2975537 - DNA, 23 bp, Homo sapiens
tataccatttcaaatatttacag

SEQ ID NO: 2975538 - DNA, 19 bp, Homo sapiens
tatacctgtgcctcggctt

SEQ ID NO: 2975539 - DNA, 21 bp, Homo sapiens
tataccttttgttaccacaga

SEQ ID NO: 2975540 - DNA, 20 bp, Homo sapiens
tatacgcagcgtgctttaaa

SEQ ID NO: 2975541 - DNA, 22 bp, Homo sapiens
tatacgtatgcatttttttagt

SEQ ID NO: 2975542 - DNA, 22 bp, Homo sapiens
tatacgtgaaaattatttgaaa

SEQ ID NO: 2975543 - DNA, 18 bp, Homo sapiens
tatactctagatgaagtt

SEQ ID NO: 2975544 - DNA, 10 bp, Homo sapiens
tatactgtaa

SEQ ID NO: 2975545 - DNA, 11 bp, Homo sapiens
tatactgtaaa

SEQ ID NO: 2975546 - DNA, 12 bp, Homo sapiens
tatactgtaaag

SEQ ID NO: 2975547 - DNA, 17 bp, Homo sapiens
tatactgtaaagaaaga

SEQ ID NO: 2975548 - DNA, 23 bp, Homo sapiens
tatactgtaaagaaagagagaaa

SEQ ID NO: 2975549 - DNA, 17 bp, Homo sapiens
tatactgtacaataaaa

SEQ ID NO: 2975550 - DNA, 14 bp, Homo sapiens
tatactgttatcca

SEQ ID NO: 2975551 - DNA, 17 bp, Homo sapiens
tatactgttatccatat

SEQ ID NO: 2975552 - DNA, 19 bp, Homo sapiens
tatactgttatccatatta

SEQ ID NO: 2975553 - DNA, 15 bp, Homo sapiens
tatacttaaacagct

SEQ ID NO: 2975554 - DNA, 17 bp, Homo sapiens
tatacttaaacagcttt

SEQ ID NO: 2975555 - DNA, 16 bp, Homo sapiens
tatacttaataaaaca

SEQ ID NO: 2975556 - DNA, 18 bp, Homo sapiens
tatacttaataaaacatt

SEQ ID NO: 2975557 - DNA, 19 bp, Homo sapiens
tatacttaatactgaattt

SEQ ID NO: 2975558 - DNA, 17 bp, Homo sapiens
tatacttttaaattatg

SEQ ID NO: 2975559 - DNA, 22 bp, Homo sapiens
tatagaaaaataaaaatctctt

SEQ ID NO: 2975560 - DNA, 23 bp, Homo sapiens
tatagaaaaataaaaatctcttt

SEQ ID NO: 2975561 - DNA, 11 bp, Homo sapiens
tatagaagaaa

SEQ ID NO: 2975562 - DNA, 20 bp, Homo sapiens
tatagaataaaagctgtgga

SEQ ID NO: 2975563 - DNA, 22 bp, Homo sapiens
tatagaattagctttttcatcc

SEQ ID NO: 2975564 - DNA, 16 bp, Homo sapiens
tatagacaccctggca

SEQ ID NO: 2975565 - DNA, 19 bp, Homo sapiens
tatagacattgaggacctc

SEQ ID NO: 2975566 - DNA, 13 bp, Homo sapiens
tatagacgctctt

SEQ ID NO: 2975567 - DNA, 19 bp, Homo sapiens
tatagatgggaatgaagct

SEQ ID NO: 2975568 - DNA, 15 bp, Homo sapiens
tatagattctaaaga

SEQ ID NO: 2975569 - DNA, 18 bp, Homo sapiens
tatagattttttaaaaaa

SEQ ID NO: 2975570 - DNA, 23 bp, Homo sapiens
tatagattttttaaaaaaaatgt

SEQ ID NO: 2975571 - DNA, 19 bp, Homo sapiens
tatagcaaaacttttaaac

SEQ ID NO: 2975572 - DNA, 22 bp, Homo sapiens
tatagcaaaacttttaaactac

SEQ ID NO: 2975573 - DNA, 23 bp, Homo sapiens
tatagcaaaacttttaaactaca

SEQ ID NO: 2975574 - DNA, 14 bp, Homo sapiens
tatagcaaagatat

SEQ ID NO: 2975575 - DNA, 15 bp, Homo sapiens
tatagcaaagatata

SEQ ID NO: 2975576 - DNA, 15 bp, Homo sapiens
tatagcgcctgtata

SEQ ID NO: 2975577 - DNA, 22 bp, Homo sapiens
tatagcgcctgtataagtagat

SEQ ID NO: 2975578 - DNA, 21 bp, Homo sapiens
tatagctagctatttctatgt

SEQ ID NO: 2975579 - DNA, 19 bp, Homo sapiens
tataggaacatatgaaaat

SEQ ID NO: 2975580 - DNA, 17 bp, Homo sapiens
tataggactttcttcta

SEQ ID NO: 2975581 - DNA, 16 bp, Homo sapiens
tataggcatgagccac

SEQ ID NO: 2975582 - DNA, 18 bp, Homo sapiens
tataggttttaaagacct

SEQ ID NO: 2975583 - DNA, 17 bp, Homo sapiens
tataggttttgtttgct

SEQ ID NO: 2975584 - DNA, 22 bp, Homo sapiens
tatagtatttaattgtttcaaa

SEQ ID NO: 2975585 - DNA, 20 bp, Homo sapiens
tatagtcgctgaaattaaat

SEQ ID NO: 2975586 - DNA, 18 bp, Homo sapiens
tatagtgatgtaatcttg

SEQ ID NO: 2975587 - DNA, 22 bp, Homo sapiens
tatagtgtgtgttgcaaatcac

SEQ ID NO: 2975588 - DNA, 17 bp, Homo sapiens
tatttctgcatatgttg

SEQ ID NO: 2975589 - DNA, 14 bp, Homo sapiens
tatttctgcctata

SEQ ID NO: 2975590 - DNA, 17 bp, Homo sapiens
tatttctgcctataaat

SEQ ID NO: 2975591 - DNA, 19 bp, Homo sapiens
tatttctgcctataaattt

SEQ ID NO: 2975592 - DNA, 13 bp, Homo sapiens
tatttcttaaaca

SEQ ID NO: 2975593 - DNA, 15 bp, Homo sapiens
tatttcttaatttgg

SEQ ID NO: 2975594 - DNA, 17 bp, Homo sapiens
tatttcttcaagtgagt

SEQ ID NO: 2975595 - DNA, 20 bp, Homo sapiens
tatttcttttgtgcagatca

SEQ ID NO: 2975596 - DNA, 19 bp, Homo sapiens
tatttgaaaacatataaag

SEQ ID NO: 2975597 - DNA, 13 bp, Homo sapiens
tatttgaagcagc

SEQ ID NO: 2975598 - DNA, 20 bp, Homo sapiens
tatttgaagcagctctgcct

SEQ ID NO: 2975599 - DNA, 21 bp, Homo sapiens
tatttgaagcagctctgcctt

SEQ ID NO: 2975600 - DNA, 17 bp, Homo sapiens
tatttgacagacatcct

SEQ ID NO: 2975601 - DNA, 19 bp, Homo sapiens
tatttgagagagagaacct

SEQ ID NO: 2975602 - DNA, 19 bp, Homo sapiens
tatttgagtttgacattta

SEQ ID NO: 2975603 - DNA, 15 bp, Homo sapiens
tatttgataacattt

SEQ ID NO: 2975604 - DNA, 18 bp, Homo sapiens
tatttgataacattttgt

SEQ ID NO: 2975605 - DNA, 17 bp, Homo sapiens
tatttgattcaaaatat

SEQ ID NO: 2975606 - DNA, 22 bp, Homo sapiens
tatttgcataacaattcctcta

SEQ ID NO: 2975607 - DNA, 22 bp, Homo sapiens
tatttggaagcaacgtgttaat

SEQ ID NO: 2975608 - DNA, 11 bp, Homo sapiens
tatttggaatt

SEQ ID NO: 2975609 - DNA, 17 bp, Homo sapiens
tatttggaattgacatt

SEQ ID NO: 2975610 - DNA, 21 bp, Homo sapiens
tatttggaattgacattctct

SEQ ID NO: 2975611 - DNA, 14 bp, Homo sapiens
tatttggcttgttt

SEQ ID NO: 2975612 - DNA, 15 bp, Homo sapiens
tatttggtccaaaaa

SEQ ID NO: 2975613 - DNA, 13 bp, Homo sapiens
tatttgtaaagct

SEQ ID NO: 2975614 - DNA, 14 bp, Homo sapiens
tatttgtaaagcta

SEQ ID NO: 2975615 - DNA, 15 bp, Homo sapiens
tatttgtaggagaaa

SEQ ID NO: 2975616 - DNA, 12 bp, Homo sapiens
tatttgtgacta

SEQ ID NO: 2975617 - DNA, 17 bp, Homo sapiens
tatttgtgactaattgt

SEQ ID NO: 2975618 - DNA, 20 bp, Homo sapiens
tatttgtgactaattgtata

SEQ ID NO: 2975619 - DNA, 22 bp, Homo sapiens
tatttgtgactaattgtataac

SEQ ID NO: 2975620 - DNA, 17 bp, Homo sapiens
tatttgtgctatagtat

SEQ ID NO: 2975621 - DNA, 14 bp, Homo sapiens
tatttgtgctttga

SEQ ID NO: 2975622 - DNA, 16 bp, Homo sapiens
tatttgtgctttgaaa

SEQ ID NO: 2975623 - DNA, 16 bp, Homo sapiens
tatttgttatggcaga

SEQ ID NO: 2975624 - DNA, 15 bp, Homo sapiens
tatttgttgttttct

SEQ ID NO: 2975625 - DNA, 20 bp, Homo sapiens
tattttaaaatagaggcttt

SEQ ID NO: 2975626 - DNA, 18 bp, Homo sapiens
tattttaaaatctgtcac

SEQ ID NO: 2975627 - DNA, 16 bp, Homo sapiens
tattttaagaattgtt

SEQ ID NO: 2975628 - DNA, 21 bp, Homo sapiens
tattttaagccctatcactga

SEQ ID NO: 2975629 - DNA, 13 bp, Homo sapiens
tattttaatagaa

SEQ ID NO: 2975630 - DNA, 18 bp, Homo sapiens
tattttacacagaaacac

SEQ ID NO: 2975631 - DNA, 23 bp, Homo sapiens
tattttacacagaaacactgcct

SEQ ID NO: 2975632 - DNA, 24 bp, Homo sapiens
tattttacacagaaacactgcctt

SEQ ID NO: 2975633 - DNA, 21 bp, Homo sapiens
tattttacacagcaattttgt

SEQ ID NO: 2975634 - DNA, 21 bp, Homo sapiens
tattttagtttctgttctgtg

SEQ ID NO: 2975635 - DNA, 15 bp, Homo sapiens
tattttatattaaaa

SEQ ID NO: 2975636 - DNA, 14 bp, Homo sapiens
tattttatatttga

SEQ ID NO: 2975637 - DNA, 12 bp, Homo sapiens
tattttatgaga

SEQ ID NO: 2975638 - DNA, 14 bp, Homo sapiens
tattttatgagaaa

SEQ ID NO: 2975639 - DNA, 18 bp, Homo sapiens
tattttatgagaaatgta

SEQ ID NO: 2975640 - DNA, 20 bp, Homo sapiens
tattttattatcctagatta

SEQ ID NO: 2975641 - DNA, 14 bp, Homo sapiens
tattttattcagta

SEQ ID NO: 2975642 - DNA, 17 bp, Homo sapiens
tattttatttatttaat

SEQ ID NO: 2975643 - DNA, 16 bp, Homo sapiens
tattttatttgaaaaa

SEQ ID NO: 2975644 - DNA, 23 bp, Homo sapiens
tattttcaaagactgccacgtgc

SEQ ID NO: 2975645 - DNA, 15 bp, Homo sapiens
tattttcacaggttt

SEQ ID NO: 2975646 - DNA, 16 bp, Homo sapiens
tattttcatacaaatt

SEQ ID NO: 2975647 - DNA, 22 bp, Homo sapiens
tattttccaagtgtgcatattg

SEQ ID NO: 2975648 - DNA, 18 bp, Homo sapiens
tattttccaccttttgtt

SEQ ID NO: 2975649 - DNA, 14 bp, Homo sapiens
tattttcctgtaaa

SEQ ID NO: 2975650 - DNA, 14 bp, Homo sapiens
tattttccttccat

SEQ ID NO: 2975651 - DNA, 18 bp, Homo sapiens
tattttccttccatgctc

SEQ ID NO: 2975652 - DNA, 22 bp, Homo sapiens
tattttccttccatgctcccaa

SEQ ID NO: 2975653 - DNA, 19 bp, Homo sapiens
tattttctattttaagact

SEQ ID NO: 2975654 - DNA, 22 bp, Homo sapiens
tattttctttctagtttgttta

SEQ ID NO: 2975655 - DNA, 18 bp, Homo sapiens
tattttgaaatgaacttt

SEQ ID NO: 2975656 - DNA, 16 bp, Homo sapiens
tattttgaatcaataa

SEQ ID NO: 2975657 - DNA, 14 bp, Homo sapiens
tattttgctcttgt

SEQ ID NO: 2975658 - DNA, 15 bp, Homo sapiens
tattttggaaagttt

SEQ ID NO: 2975659 - DNA, 19 bp, Homo sapiens
tattttgggttcaggcctg

SEQ ID NO: 2975660 - DNA, 17 bp, Homo sapiens
tattttgtggaggcagt

SEQ ID NO: 2975661 - DNA, 15 bp, Homo sapiens
tatttttaaaagaaa

SEQ ID NO: 2975662 - DNA, 16 bp, Homo sapiens
tatttttaaattttct

SEQ ID NO: 2975663 - DNA, 14 bp, Homo sapiens
tatttttaatatgt

SEQ ID NO: 2975664 - DNA, 17 bp, Homo sapiens
tatttttaatatgttga

SEQ ID NO: 2975665 - DNA, 22 bp, Homo sapiens
tatttttatataatatctaaag

SEQ ID NO: 2975666 - DNA, 18 bp, Homo sapiens
tatttttatcatgaattc

SEQ ID NO: 2975667 - DNA, 23 bp, Homo sapiens
tatttttcaaaacatacaagcaa

SEQ ID NO: 2975668 - DNA, 15 bp, Homo sapiens
tatttttcagatata

SEQ ID NO: 2975669 - DNA, 14 bp, Homo sapiens
tatttttccttttt

SEQ ID NO: 2975670 - DNA, 12 bp, Homo sapiens
tatttttctcca

SEQ ID NO: 2975671 - DNA, 16 bp, Homo sapiens
tattttttatatatac

SEQ ID NO: 2975672 - DNA, 16 bp, Homo sapiens
tattttttccttttgt

SEQ ID NO: 2975673 - DNA, 18 bp, Homo sapiens
tatttttttaaagtgatt

SEQ ID NO: 2975674 - DNA, 17 bp, Homo sapiens
tatttttttcactgttt

SEQ ID NO: 2975675 - DNA, 20 bp, Homo sapiens
tattttttttttccattagt

SEQ ID NO: 2975676 - DNA, 21 bp, Homo sapiens
tattttttttttccattagta

SEQ ID NO: 2975677 - DNA, 20 bp, Homo sapiens
tcaaaaaactctctcccagg

SEQ ID NO: 2975678 - DNA, 14 bp, Homo sapiens
tcaaaaacttttgc

SEQ ID NO: 2975679 - DNA, 16 bp, Homo sapiens
tcaaaaagtataaatt

SEQ ID NO: 2975680 - DNA, 23 bp, Homo sapiens
tcaaaaagtctacgctctccttt

SEQ ID NO: 2975681 - DNA, 15 bp, Homo sapiens
tcaaaaataagtcat

SEQ ID NO: 2975682 - DNA, 19 bp, Homo sapiens
tcaaaaattacactacaag

SEQ ID NO: 2975683 - DNA, 19 bp, Homo sapiens
tcaaaacacttccagtctg

SEQ ID NO: 2975684 - DNA, 14 bp, Homo sapiens
tcaaaacagattgt

SEQ ID NO: 2975685 - DNA, 14 bp, Homo sapiens
tcaaaactacctgt

SEQ ID NO: 2975686 - DNA, 12 bp, Homo sapiens
tcaaaagacaat

SEQ ID NO: 2975687 - DNA, 23 bp, Homo sapiens
tcaaaagacaattctttatacaa

SEQ ID NO: 2975688 - DNA, 14 bp, Homo sapiens
tcaaaaggaacaaa

SEQ ID NO: 2975689 - DNA, 22 bp, Homo sapiens
tcaaaaggaacaaaaattacaa

SEQ ID NO: 2975690 - DNA, 19 bp, Homo sapiens
tcaaaagtgatcagcaatg

SEQ ID NO: 2975691 - DNA, 16 bp, Homo sapiens
tcaaaagtgcctcaag

SEQ ID NO: 2975692 - DNA, 13 bp, Homo sapiens
tcaaaagttccaa

SEQ ID NO: 2975693 - DNA, 14 bp, Homo sapiens
tcaaaagttccaag

SEQ ID NO: 2975694 - DNA, 15 bp, Homo sapiens
tcaaaagttgaaatt

SEQ ID NO: 2975695 - DNA, 14 bp, Homo sapiens
tcaaaatagaaaag

SEQ ID NO: 2975696 - DNA, 15 bp, Homo sapiens
tcaaaatagaaaagt

SEQ ID NO: 2975697 - DNA, 14 bp, Homo sapiens
tcaaaatatttaaa

SEQ ID NO: 2975698 - DNA, 15 bp, Homo sapiens
tcaaaatatttaaaa

SEQ ID NO: 2975699 - DNA, 20 bp, Homo sapiens
tcaaaatatttaaaaatgtc

SEQ ID NO: 2975700 - DNA, 20 bp, Homo sapiens
tcaaaatatttttaaaagat

SEQ ID NO: 2975701 - DNA, 20 bp, Homo sapiens
tcaaaatgatgcaaccaaaa

SEQ ID NO: 2975702 - DNA, 22 bp, Homo sapiens
tcaaaatgttatcttctcaagt

SEQ ID NO: 2975703 - DNA, 16 bp, Homo sapiens
tcaaaattacttttct

SEQ ID NO: 2975704 - DNA, 17 bp, Homo sapiens
tcaaaattctagctgta

SEQ ID NO: 2975705 - DNA, 18 bp, Homo sapiens
tcaaaattgcctttttct

SEQ ID NO: 2975706 - DNA, 21 bp, Homo sapiens
tcaaacaaagccagaagctga

SEQ ID NO: 2975707 - DNA, 18 bp, Homo sapiens
tcaaacaaccttcagctt

SEQ ID NO: 2975708 - DNA, 15 bp, Homo sapiens
tcaaacatgaaaaca

SEQ ID NO: 2975709 - DNA, 16 bp, Homo sapiens
tcaaacatgaaaacat

SEQ ID NO: 2975710 - DNA, 11 bp, Homo sapiens
tcaaacctgta

SEQ ID NO: 2975711 - DNA, 17 bp, Homo sapiens
tcaaactacctatattc

SEQ ID NO: 2975712 - DNA, 22 bp, Homo sapiens
tcaaactacctatattccttgt

SEQ ID NO: 2975713 - DNA, 16 bp, Homo sapiens
tcaaactggggcctcc

SEQ ID NO: 2975714 - DNA, 20 bp, Homo sapiens
tcaaactggggcctccagaa

SEQ ID NO: 2975715 - DNA, 14 bp, Homo sapiens
tcaaactgtagaaa

SEQ ID NO: 2975716 - DNA, 20 bp, Homo sapiens
tcaaactgtagaaatgatga

SEQ ID NO: 2975717 - DNA, 20 bp, Homo sapiens
tcaaacttctggctccctct

SEQ ID NO: 2975718 - DNA, 23 bp, Homo sapiens
tcaaagaaggtttgtgtttttct

SEQ ID NO: 2975719 - DNA, 15 bp, Homo sapiens
tcaaagaatgtgtat

SEQ ID NO: 2975720 - DNA, 16 bp, Homo sapiens
tcaaagatctttcgtt

SEQ ID NO: 2975721 - DNA, 22 bp, Homo sapiens
tcagaaacatcagttactctga

SEQ ID NO: 2975722 - DNA, 15 bp, Homo sapiens
tcagaaacttgtgaa

SEQ ID NO: 2975723 - DNA, 18 bp, Homo sapiens
tcagaaacttgtgaagtg

SEQ ID NO: 2975724 - DNA, 18 bp, Homo sapiens
tcagaaaggggctcttct

SEQ ID NO: 2975725 - DNA, 18 bp, Homo sapiens
tcagaaagtgtaaatgtt

SEQ ID NO: 2975726 - DNA, 14 bp, Homo sapiens
tcagaaatttaatt

SEQ ID NO: 2975727 - DNA, 23 bp, Homo sapiens
tcagaaatttaattcatgtttct

SEQ ID NO: 2975728 - DNA, 22 bp, Homo sapiens
tcagaactcaaatggggccaga

SEQ ID NO: 2975729 - DNA, 21 bp, Homo sapiens
tcagaactcacattggcaagt

SEQ ID NO: 2975730 - DNA, 21 bp, Homo sapiens
tcagaactgaaataaaaaatt

SEQ ID NO: 2975731 - DNA, 18 bp, Homo sapiens
tcagaagaaaggccaagg

SEQ ID NO: 2975732 - DNA, 23 bp, Homo sapiens
tcagaagaaaggccaaggtgctg

SEQ ID NO: 2975733 - DNA, 16 bp, Homo sapiens
tcagaagcctctgggt

SEQ ID NO: 2975734 - DNA, 13 bp, Homo sapiens
tcagaaggacggc

SEQ ID NO: 2975735 - DNA, 18 bp, Homo sapiens
tcagaaggacggcaggag

SEQ ID NO: 2975736 - DNA, 13 bp, Homo sapiens
tcagaaggagaag

SEQ ID NO: 2975737 - DNA, 14 bp, Homo sapiens
tcagaaggagaagg

SEQ ID NO: 2975738 - DNA, 17 bp, Homo sapiens
tcagaaggatgcccaga

SEQ ID NO: 2975739 - DNA, 20 bp, Homo sapiens
tcagaaggggatggtgttgt

SEQ ID NO: 2975740 - DNA, 23 bp, Homo sapiens
tcagaaggggatggtgttgtcac

SEQ ID NO: 2975741 - DNA, 22 bp, Homo sapiens
tcagaagtaactcccactccta

SEQ ID NO: 2975742 - DNA, 23 bp, Homo sapiens
tcagaagtatggaattttctgcc

SEQ ID NO: 2975743 - DNA, 12 bp, Homo sapiens
tcagaataaatt

SEQ ID NO: 2975744 - DNA, 22 bp, Homo sapiens
tcagaataaattaatattgtat

SEQ ID NO: 2975745 - DNA, 21 bp, Homo sapiens
tcagaatagccacatttggaa

SEQ ID NO: 2975746 - DNA, 16 bp, Homo sapiens
tcagaatatattcact

SEQ ID NO: 2975747 - DNA, 22 bp, Homo sapiens
tcagaatatattcactttcatt

SEQ ID NO: 2975748 - DNA, 15 bp, Homo sapiens
tcagaatcaaacctt

SEQ ID NO: 2975749 - DNA, 22 bp, Homo sapiens
tcagaatcaaacctttttatat

SEQ ID NO: 2975750 - DNA, 17 bp, Homo sapiens
tcagaatgggggctttc

SEQ ID NO: 2975751 - DNA, 13 bp, Homo sapiens
tcagaattatgat

SEQ ID NO: 2975752 - DNA, 14 bp, Homo sapiens
tcagaattatgatg

SEQ ID NO: 2975753 - DNA, 16 bp, Homo sapiens
tcagaattgaaacact

SEQ ID NO: 2975754 - DNA, 13 bp, Homo sapiens
tcagacaccaagg

SEQ ID NO: 2975755 - DNA, 17 bp, Homo sapiens
tcagacaccctcaacct

SEQ ID NO: 2975756 - DNA, 23 bp, Homo sapiens
tcagacaccctcaacctcttctg

SEQ ID NO: 2975757 - DNA, 19 bp, Homo sapiens
tcagacacctgttcacaga

SEQ ID NO: 2975758 - DNA, 20 bp, Homo sapiens
tcagacactagggaaaggta

SEQ ID NO: 2975759 - DNA, 15 bp, Homo sapiens
tcagacatgttttcc

SEQ ID NO: 2975760 - DNA, 20 bp, Homo sapiens
tcagacatgttttccgtgaa

SEQ ID NO: 2975761 - DNA, 14 bp, Homo sapiens
tcagacatttatgt

SEQ ID NO: 2975762 - DNA, 14 bp, Homo sapiens
tcagaccacggctc

SEQ ID NO: 2975763 - DNA, 18 bp, Homo sapiens
tcagacccatctctccct

SEQ ID NO: 2975764 - DNA, 18 bp, Homo sapiens
tcagaccctaccccacca

SEQ ID NO: 2975765 - DNA, 21 bp, Homo sapiens
tcagactcccattcctgaaga

SEQ ID NO: 2975766 - DNA, 14 bp, Homo sapiens
tcagactgcaccca

SEQ ID NO: 2975767 - DNA, 18 bp, Homo sapiens
tcagactgcacccaggag

SEQ ID NO: 2975768 - DNA, 20 bp, Homo sapiens
tcagactgcacccaggaggg

SEQ ID NO: 2975769 - DNA, 13 bp, Homo sapiens
tcagactggaggt

SEQ ID NO: 2975770 - DNA, 18 bp, Homo sapiens
tcagactggaggtcgaag

SEQ ID NO: 2975771 - DNA, 22 bp, Homo sapiens
tcagactggaggtcgaagcaat

SEQ ID NO: 2975772 - DNA, 13 bp, Homo sapiens
tcagacttgtcaa

SEQ ID NO: 2975773 - DNA, 20 bp, Homo sapiens
tcagactttggaaaatgcat

SEQ ID NO: 2975774 - DNA, 14 bp, Homo sapiens
tcagagaaaacact

SEQ ID NO: 2975775 - DNA, 15 bp, Homo sapiens
tcagagaaaacactt

SEQ ID NO: 2975776 - DNA, 17 bp, Homo sapiens
tcagagaaaacactttc

SEQ ID NO: 2975777 - DNA, 21 bp, Homo sapiens
tcagagaaggaaaagactgaa

SEQ ID NO: 2975778 - DNA, 15 bp, Homo sapiens
tcagagaccattgca

SEQ ID NO: 2975779 - DNA, 20 bp, Homo sapiens
tcagagagacccgggaagga

SEQ ID NO: 2975780 - DNA, 21 bp, Homo sapiens
tcagagagacccgggaaggaa

SEQ ID NO: 2975781 - DNA, 15 bp, Homo sapiens
tcagagatttttgtt

SEQ ID NO: 2975782 - DNA, 22 bp, Homo sapiens
tcagagcactgtgttcacactt

SEQ ID NO: 2975783 - DNA, 21 bp, Homo sapiens
tcagagccaagggggcagagg

SEQ ID NO: 2975784 - DNA, 12 bp, Homo sapiens
tcagagcccagc

SEQ ID NO: 2975785 - DNA, 14 bp, Homo sapiens
tcagagcccatggt

SEQ ID NO: 2975786 - DNA, 16 bp, Homo sapiens
tcagaggtgaattaat

SEQ ID NO: 2975787 - DNA, 20 bp, Homo sapiens
tcagagttctatactgtaaa

SEQ ID NO: 2975788 - DNA, 22 bp, Homo sapiens
tcagagttctatactgtaaagc

SEQ ID NO: 2975789 - DNA, 14 bp, Homo sapiens
tcagagttttctgg

SEQ ID NO: 2975790 - DNA, 15 bp, Homo sapiens
tcagagttttctggg

SEQ ID NO: 2975791 - DNA, 20 bp, Homo sapiens
tcagataaggtaaaatgcca

SEQ ID NO: 2975792 - DNA, 15 bp, Homo sapiens
tcagatataaatact

SEQ ID NO: 2975793 - DNA, 15 bp, Homo sapiens
tcagatatcaaaatt

SEQ ID NO: 2975794 - DNA, 15 bp, Homo sapiens
tcagatattctgctc

SEQ ID NO: 2975795 - DNA, 15 bp, Homo sapiens
tcagatccagggaca

SEQ ID NO: 2975796 - DNA, 20 bp, Homo sapiens
tcagatcctgatcttaagag

SEQ ID NO: 2975797 - DNA, 22 bp, Homo sapiens
tcagatgcgttcgcctctggcc

SEQ ID NO: 2975798 - DNA, 16 bp, Homo sapiens
tcagatgctccaagat

SEQ ID NO: 2975799 - DNA, 18 bp, Homo sapiens
tcagatgctccaagattc

SEQ ID NO: 2975800 - DNA, 19 bp, Homo sapiens
tcagatgctccaagattct

SEQ ID NO: 2975801 - DNA, 14 bp, Homo sapiens
tcagatgcttctgg

SEQ ID NO: 2975802 - DNA, 18 bp, Homo sapiens
tcagatgcttctgggaga

SEQ ID NO: 2975803 - DNA, 16 bp, Homo sapiens
tcagatgtaatgtttt

SEQ ID NO: 2975804 - DNA, 17 bp, Homo sapiens
tcagatgtaatgttttc

SEQ ID NO: 2975805 - DNA, 14 bp, Homo sapiens
tcagatgtggagcc

SEQ ID NO: 2975806 - DNA, 16 bp, Homo sapiens
tcagatgtggagccag

SEQ ID NO: 2975807 - DNA, 24 bp, Homo sapiens
tcagatgtgttgacgtaagctcta

SEQ ID NO: 2975808 - DNA, 23 bp, Homo sapiens
tcagatgttttacgcaaggaagg

SEQ ID NO: 2975809 - DNA, 16 bp, Homo sapiens
tcagattattaaaatt

SEQ ID NO: 2975810 - DNA, 18 bp, Homo sapiens
tcagattgcatgtgactc

SEQ ID NO: 2975811 - DNA, 22 bp, Homo sapiens
tcagattgcatgtgactctgaa

SEQ ID NO: 2975812 - DNA, 14 bp, Homo sapiens
tcagatttaccata

SEQ ID NO: 2975813 - DNA, 22 bp, Homo sapiens
tcagatttatttgtttgatttt

SEQ ID NO: 2975814 - DNA, 21 bp, Homo sapiens
tcagatttggtgatggaaaaa

SEQ ID NO: 2975815 - DNA, 14 bp, Homo sapiens
tcagcaaaaagact

SEQ ID NO: 2975816 - DNA, 15 bp, Homo sapiens
tcagcaaacacaata

SEQ ID NO: 2975817 - DNA, 17 bp, Homo sapiens
tcagcaaacacaataag

SEQ ID NO: 2975818 - DNA, 18 bp, Homo sapiens
tcagcaaacacaataaga

SEQ ID NO: 2975819 - DNA, 16 bp, Homo sapiens
tcagcaagagagaacc

SEQ ID NO: 2975820 - DNA, 13 bp, Homo sapiens
tcagcaccttggc

SEQ ID NO: 2975821 - DNA, 18 bp, Homo sapiens
tcagcagaacctgtagga

SEQ ID NO: 2975822 - DNA, 20 bp, Homo sapiens
tcagcagaggcagtggccac

SEQ ID NO: 2975823 - DNA, 18 bp, Homo sapiens
tcagcagcaaattttcag

SEQ ID NO: 2975824 - DNA, 14 bp, Homo sapiens
tcagcagccctcct

SEQ ID NO: 2975825 - DNA, 23 bp, Homo sapiens
tcagcagcctgcgctcggcagga

SEQ ID NO: 2975826 - DNA, 16 bp, Homo sapiens
tcagcataaatgggaa

SEQ ID NO: 2975827 - DNA, 20 bp, Homo sapiens
tcagcatcaaacatgaaaac

SEQ ID NO: 2975828 - DNA, 21 bp, Homo sapiens
tcagcatcaaacatgaaaaca

SEQ ID NO: 2975829 - DNA, 15 bp, Homo sapiens
tcagcatctgaccat

SEQ ID NO: 2975830 - DNA, 19 bp, Homo sapiens
tcagcatctgaccatctgt

SEQ ID NO: 2975831 - DNA, 20 bp, Homo sapiens
tcagcatctgaccatctgtg

SEQ ID NO: 2975832 - DNA, 23 bp, Homo sapiens
tcagcatctgaccatctgtgact

SEQ ID NO: 2975833 - DNA, 16 bp, Homo sapiens
tcagcatgttttctgc

SEQ ID NO: 2975834 - DNA, 14 bp, Homo sapiens
tcagccaaacagta

SEQ ID NO: 2975835 - DNA, 15 bp, Homo sapiens
tcagccaaagtccta

SEQ ID NO: 2975836 - DNA, 18 bp, Homo sapiens
tcagccaatctggacact

SEQ ID NO: 2975837 - DNA, 17 bp, Homo sapiens
tcagccaatttgtctcc

SEQ ID NO: 2975838 - DNA, 23 bp, Homo sapiens
tcagccaccatcctattgcaaag

SEQ ID NO: 2975839 - DNA, 15 bp, Homo sapiens
tcagccacctccctc

SEQ ID NO: 2975840 - DNA, 16 bp, Homo sapiens
tcagccacctccctct

SEQ ID NO: 2975841 - DNA, 20 bp, Homo sapiens
tcagccacctccctctgcca

SEQ ID NO: 2975842 - DNA, 22 bp, Homo sapiens
tcagccacctccctctgccagt

SEQ ID NO: 2975843 - DNA, 10 bp, Homo sapiens
tcagccagac

SEQ ID NO: 2975844 - DNA, 14 bp, Homo sapiens
tcagccagagaagc

SEQ ID NO: 2975845 - DNA, 12 bp, Homo sapiens
tcagccagcact

SEQ ID NO: 2975846 - DNA, 12 bp, Homo sapiens
tcagccagctgc

SEQ ID NO: 2975847 - DNA, 19 bp, Homo sapiens
tcagccaggagctgtcacc

SEQ ID NO: 2975848 - DNA, 15 bp, Homo sapiens
tcagccatgtacaga

SEQ ID NO: 2975849 - DNA, 15 bp, Homo sapiens
tcagccatgtctgtg

SEQ ID NO: 2975850 - DNA, 11 bp, Homo sapiens
tcagcccagct

SEQ ID NO: 2975851 - DNA, 15 bp, Homo sapiens
tcagccccatcgccc

SEQ ID NO: 2975852 - DNA, 16 bp, Homo sapiens
tcagccccgcgtggaa

SEQ ID NO: 2975853 - DNA, 19 bp, Homo sapiens
tcatttccgtcccccccca

SEQ ID NO: 2975854 - DNA, 23 bp, Homo sapiens
tcatttccgttttgcctgtgact

SEQ ID NO: 2975855 - DNA, 22 bp, Homo sapiens
tcatttcctttgttgtctacat

SEQ ID NO: 2975856 - DNA, 13 bp, Homo sapiens
tcatttgaaagtg

SEQ ID NO: 2975857 - DNA, 15 bp, Homo sapiens
tcatttgagtctctt

SEQ ID NO: 2975858 - DNA, 16 bp, Homo sapiens
tcatttgagtctctta

SEQ ID NO: 2975859 - DNA, 18 bp, Homo sapiens
tcatttggttcattaatt

SEQ ID NO: 2975860 - DNA, 21 bp, Homo sapiens
tcatttgtggtgatatagaat

SEQ ID NO: 2975861 - DNA, 18 bp, Homo sapiens
tcattttatattgaaaaa

SEQ ID NO: 2975862 - DNA, 20 bp, Homo sapiens
tcattttggcatctgcaaag

SEQ ID NO: 2975863 - DNA, 12 bp, Homo sapiens
tcatttttaatc

SEQ ID NO: 2975864 - DNA, 18 bp, Homo sapiens
tcatttttccatgacatt

SEQ ID NO: 2975865 - DNA, 20 bp, Homo sapiens
tcatttttccatgacatttt

SEQ ID NO: 2975866 - DNA, 12 bp, Homo sapiens
tcatttttgaat

SEQ ID NO: 2975867 - DNA, 14 bp, Homo sapiens
tcatttttgagact

SEQ ID NO: 2975868 - DNA, 23 bp, Homo sapiens
tccaaaaaaaggaaaaataatca

SEQ ID NO: 2975869 - DNA, 13 bp, Homo sapiens
tccaaaaaaatac

SEQ ID NO: 2975870 - DNA, 21 bp, Homo sapiens
tccaaaaaagcaaacacaaga

SEQ ID NO: 2975871 - DNA, 15 bp, Homo sapiens
tccaaaaagacaagt

SEQ ID NO: 2975872 - DNA, 15 bp, Homo sapiens
tccaaaacacaaact

SEQ ID NO: 2975873 - DNA, 14 bp, Homo sapiens
tccaaaagaagccc

SEQ ID NO: 2975874 - DNA, 16 bp, Homo sapiens
tccaaaagtaaagatg

SEQ ID NO: 2975875 - DNA, 17 bp, Homo sapiens
tccaaaatttatatttt

SEQ ID NO: 2975876 - DNA, 19 bp, Homo sapiens
tccaaaatttttcaacccc

SEQ ID NO: 2975877 - DNA, 18 bp, Homo sapiens
tccaaacaggtgctggcc

SEQ ID NO: 2975878 - DNA, 12 bp, Homo sapiens
tccaaactgctg

SEQ ID NO: 2975879 - DNA, 13 bp, Homo sapiens
tccaaactgctgt

SEQ ID NO: 2975880 - DNA, 23 bp, Homo sapiens
tccaaagaattatgcatctgcta

SEQ ID NO: 2975881 - DNA, 13 bp, Homo sapiens
tccaaagagaaaa

SEQ ID NO: 2975882 - DNA, 23 bp, Homo sapiens
tccaaagagagttaaaagcagca

SEQ ID NO: 2975883 - DNA, 22 bp, Homo sapiens
tccaaagagtagaattgcattg

SEQ ID NO: 2975884 - DNA, 23 bp, Homo sapiens
tccaaagagtagaattgcattga

SEQ ID NO: 2975885 - DNA, 17 bp, Homo sapiens
tccaaagccaatgtgaa

SEQ ID NO: 2975886 - DNA, 23 bp, Homo sapiens
tccaaaggaagtctaggagctgg

SEQ ID NO: 2975887 - DNA, 21 bp, Homo sapiens
tccaaaggcattttattgctt

SEQ ID NO: 2975888 - DNA, 14 bp, Homo sapiens
tccaaagtctctaa

SEQ ID NO: 2975889 - DNA, 17 bp, Homo sapiens
tccaaagtctctaattc

SEQ ID NO: 2975890 - DNA, 18 bp, Homo sapiens
tccaaagtctctaattct

SEQ ID NO: 2975891 - DNA, 16 bp, Homo sapiens
tccaaatccctttcat

SEQ ID NO: 2975892 - DNA, 17 bp, Homo sapiens
tccaaatctgtcctctg

SEQ ID NO: 2975893 - DNA, 18 bp, Homo sapiens
tccaaatctgtcctctgt

SEQ ID NO: 2975894 - DNA, 20 bp, Homo sapiens
tccaaatctgtcctctgtag

SEQ ID NO: 2975895 - DNA, 21 bp, Homo sapiens
tccaaatctgtcctctgtagt

SEQ ID NO: 2975896 - DNA, 16 bp, Homo sapiens
tccaaatgcattcatg

SEQ ID NO: 2975897 - DNA, 17 bp, Homo sapiens
tccaaatgctgtgcaaa

SEQ ID NO: 2975898 - DNA, 18 bp, Homo sapiens
tccaaatggcgtctggaa

SEQ ID NO: 2975899 - DNA, 13 bp, Homo sapiens
tccaaattcacaa

SEQ ID NO: 2975900 - DNA, 16 bp, Homo sapiens
tccaaatttaatgtag

SEQ ID NO: 2975901 - DNA, 17 bp, Homo sapiens
tccaacaccaagcacag

SEQ ID NO: 2975902 - DNA, 21 bp, Homo sapiens
tccaacaccaagcacagcagc

SEQ ID NO: 2975903 - DNA, 18 bp, Homo sapiens
tccaacactgaagtgctt

SEQ ID NO: 2975904 - DNA, 17 bp, Homo sapiens
tccaacagacacaattt

SEQ ID NO: 2975905 - DNA, 16 bp, Homo sapiens
tccaacaggagctggg

SEQ ID NO: 2975906 - DNA, 15 bp, Homo sapiens
tccaacccatgatga

SEQ ID NO: 2975907 - DNA, 16 bp, Homo sapiens
tccaacccctccccca

SEQ ID NO: 2975908 - DNA, 17 bp, Homo sapiens
tccaacccctcccccac

SEQ ID NO: 2975909 - DNA, 21 bp, Homo sapiens
tccaaccggctttgtggcact

SEQ ID NO: 2975910 - DNA, 16 bp, Homo sapiens
tccaacctaacctgtg

SEQ ID NO: 2975911 - DNA, 18 bp, Homo sapiens
tccaacctaacctgtgtc

SEQ ID NO: 2975912 - DNA, 21 bp, Homo sapiens
tccaacctaacctgtgtctgc

SEQ ID NO: 2975913 - DNA, 16 bp, Homo sapiens
tccaacctctcggccc

SEQ ID NO: 2975914 - DNA, 20 bp, Homo sapiens
tccaacctgaaggtcccctg

SEQ ID NO: 2975915 - DNA, 14 bp, Homo sapiens
tccaacctggacaa

SEQ ID NO: 2975916 - DNA, 14 bp, Homo sapiens
tccaacgccgcctt

SEQ ID NO: 2975917 - DNA, 23 bp, Homo sapiens
tccaacgccgccttggccttgca

SEQ ID NO: 2975918 - DNA, 19 bp, Homo sapiens
tccaactcctttcagccac

SEQ ID NO: 2975919 - DNA, 18 bp, Homo sapiens
tccaagaatagcatctgt

SEQ ID NO: 2975920 - DNA, 14 bp, Homo sapiens
tccaagaatccaca

SEQ ID NO: 2975921 - DNA, 17 bp, Homo sapiens
tccaagaatggaagcct

SEQ ID NO: 2975922 - DNA, 19 bp, Homo sapiens
tccaagaccatttgtagtg

SEQ ID NO: 2975923 - DNA, 16 bp, Homo sapiens
tccaagactctagagt

SEQ ID NO: 2975924 - DNA, 22 bp, Homo sapiens
tccaagagaaggtggacctggc

SEQ ID NO: 2975925 - DNA, 23 bp, Homo sapiens
tccaagagaaggtggacctggca

SEQ ID NO: 2975926 - DNA, 14 bp, Homo sapiens
tccaagagcctgag

SEQ ID NO: 2975927 - DNA, 15 bp, Homo sapiens
tccaagagtctaaag

SEQ ID NO: 2975928 - DNA, 22 bp, Homo sapiens
tccaagatattttaaaatctgt

SEQ ID NO: 2975929 - DNA, 19 bp, Homo sapiens
tccaagatgttctcctgat

SEQ ID NO: 2975930 - DNA, 16 bp, Homo sapiens
tccaagattctagatg

SEQ ID NO: 2975931 - DNA, 20 bp, Homo sapiens
tccaagattctagatgatta

SEQ ID NO: 2975932 - DNA, 13 bp, Homo sapiens
tccaagcagaagg

SEQ ID NO: 2975933 - DNA, 15 bp, Homo sapiens
tccaagccccctggc

SEQ ID NO: 2975934 - DNA, 18 bp, Homo sapiens
tccaagccccctggcagc

SEQ ID NO: 2975935 - DNA, 21 bp, Homo sapiens
tccaagcgaggtcaacagaga

SEQ ID NO: 2975936 - DNA, 12 bp, Homo sapiens
tccaagctggga

SEQ ID NO: 2975937 - DNA, 14 bp, Homo sapiens
tccaagctgttaaa

SEQ ID NO: 2975938 - DNA, 13 bp, Homo sapiens
tccaaggagcaga

SEQ ID NO: 2975939 - DNA, 18 bp, Homo sapiens
tccaaggagcagagaggt

SEQ ID NO: 2975940 - DNA, 19 bp, Homo sapiens
tccaaggccgcggcccaga

SEQ ID NO: 2975941 - DNA, 21 bp, Homo sapiens
tccaaggggaatcagaactca

SEQ ID NO: 2975942 - DNA, 16 bp, Homo sapiens
tccaaggtttaaagag

SEQ ID NO: 2975943 - DNA, 20 bp, Homo sapiens
tccaaggtttaaagagtcta

SEQ ID NO: 2975944 - DNA, 17 bp, Homo sapiens
tccaagtctctgtgtaa

SEQ ID NO: 2975945 - DNA, 13 bp, Homo sapiens
tccaagtgtgcat

SEQ ID NO: 2975946 - DNA, 19 bp, Homo sapiens
tccaagtgtgcatattgta

SEQ ID NO: 2975947 - DNA, 18 bp, Homo sapiens
tccaagtttgacttgtat

SEQ ID NO: 2975948 - DNA, 20 bp, Homo sapiens
tccaagtttgacttgtataa

SEQ ID NO: 2975949 - DNA, 22 bp, Homo sapiens
tccaataaaggaacataaagat

SEQ ID NO: 2975950 - DNA, 16 bp, Homo sapiens
tccaatacctcttgga

SEQ ID NO: 2975951 - DNA, 18 bp, Homo sapiens
tccaatatgactcagaga

SEQ ID NO: 2975952 - DNA, 22 bp, Homo sapiens
tccaatcaatttaaatgtttac

SEQ ID NO: 2975953 - DNA, 20 bp, Homo sapiens
tccaatcagagaccaggccc

SEQ ID NO: 2975954 - DNA, 13 bp, Homo sapiens
tccaatcctcccc

SEQ ID NO: 2975955 - DNA, 16 bp, Homo sapiens
tccaatcctccccgct

SEQ ID NO: 2975956 - DNA, 17 bp, Homo sapiens
tccaatgggtgtgagta

SEQ ID NO: 2975957 - DNA, 22 bp, Homo sapiens
tccaatgtgaaagattatttaa

SEQ ID NO: 2975958 - DNA, 18 bp, Homo sapiens
tccaatgtggcaaggaaa

SEQ ID NO: 2975959 - DNA, 23 bp, Homo sapiens
tccaattatttgactttaattta

SEQ ID NO: 2975960 - DNA, 16 bp, Homo sapiens
tccaattgttgacagt

SEQ ID NO: 2975961 - DNA, 17 bp, Homo sapiens
tccaattttaatttagt

SEQ ID NO: 2975962 - DNA, 23 bp, Homo sapiens
tccaattttaatttagtaaatgt

SEQ ID NO: 2975963 - DNA, 21 bp, Homo sapiens
tccacaagattcccagagaca

SEQ ID NO: 2975964 - DNA, 22 bp, Homo sapiens
tccacacccaggcatagcctgg

SEQ ID NO: 2975965 - DNA, 15 bp, Homo sapiens
tccacaccttttatt

SEQ ID NO: 2975966 - DNA, 21 bp, Homo sapiens
tccacaccttttattgacaca

SEQ ID NO: 2975967 - DNA, 16 bp, Homo sapiens
tccacactatgtgtgt

SEQ ID NO: 2975968 - DNA, 23 bp, Homo sapiens
tccacactatgtgtgttgtttcc

SEQ ID NO: 2975969 - DNA, 13 bp, Homo sapiens
tccacactgacca

SEQ ID NO: 2975970 - DNA, 15 bp, Homo sapiens
tccacactgaccaag

SEQ ID NO: 2975971 - DNA, 17 bp, Homo sapiens
tccacactgccggcagg

SEQ ID NO: 2975972 - DNA, 14 bp, Homo sapiens
tccacactgtcaaa

SEQ ID NO: 2975973 - DNA, 22 bp, Homo sapiens
tccacagattgtttctatacaa

SEQ ID NO: 2975974 - DNA, 16 bp, Homo sapiens
tccacaggacgaatgc

SEQ ID NO: 2975975 - DNA, 21 bp, Homo sapiens
tccacaggacgaatgcatatt

SEQ ID NO: 2975976 - DNA, 23 bp, Homo sapiens
tccacaggatcatcatttaaaaa

SEQ ID NO: 2975977 - DNA, 15 bp, Homo sapiens
tccacatccccagag

SEQ ID NO: 2975978 - DNA, 20 bp, Homo sapiens
tccacatccccagagcccag

SEQ ID NO: 2975979 - DNA, 21 bp, Homo sapiens
tccacatccccagagcccagc

SEQ ID NO: 2975980 - DNA, 22 bp, Homo sapiens
tccacatccccagagcccagct

SEQ ID NO: 2975981 - DNA, 23 bp, Homo sapiens
tccacatccccagagcccagctc

SEQ ID NO: 2975982 - DNA, 14 bp, Homo sapiens
tccacattgtttta

SEQ ID NO: 2975983 - DNA, 15 bp, Homo sapiens
tccacattttaacag

SEQ ID NO: 2975984 - DNA, 18 bp, Homo sapiens
tccctggtccttcactgg

SEQ ID NO: 2975985 - DNA, 14 bp, Homo sapiens
tccctgtaacctct

SEQ ID NO: 2975986 - DNA, 16 bp, Homo sapiens
tccctgtaggattttt

SEQ ID NO: 2975987 - DNA, 15 bp, Homo sapiens
tccctgtcctcctcg

SEQ ID NO: 2975988 - DNA, 17 bp, Homo sapiens
tccctgtctttcctaag

SEQ ID NO: 2975989 - DNA, 20 bp, Homo sapiens
tccctgtctttcctaagacc

SEQ ID NO: 2975990 - DNA, 13 bp, Homo sapiens
tccctgttatttt

SEQ ID NO: 2975991 - DNA, 17 bp, Homo sapiens
tccctgttattttcaag

SEQ ID NO: 2975992 - DNA, 15 bp, Homo sapiens
tccctgttccccaga

SEQ ID NO: 2975993 - DNA, 14 bp, Homo sapiens
tccctgttctttaa

SEQ ID NO: 2975994 - DNA, 15 bp, Homo sapiens
tcccttaaacaaaaa

SEQ ID NO: 2975995 - DNA, 14 bp, Homo sapiens
tcccttaagcagca

SEQ ID NO: 2975996 - DNA, 14 bp, Homo sapiens
tcccttacccatct

SEQ ID NO: 2975997 - DNA, 19 bp, Homo sapiens
tcccttacccatcttgctt

SEQ ID NO: 2975998 - DNA, 17 bp, Homo sapiens
tcccttcagtactgcag

SEQ ID NO: 2975999 - DNA, 17 bp, Homo sapiens
tcccttccacctcacaa

SEQ ID NO: 2976000 - DNA, 15 bp, Homo sapiens
tcccttcccagtggg

SEQ ID NO: 2976001 - DNA, 22 bp, Homo sapiens
tcccttcccagtgggctgtgtt

SEQ ID NO: 2976002 - DNA, 16 bp, Homo sapiens
tcccttcccataagct

SEQ ID NO: 2976003 - DNA, 14 bp, Homo sapiens
tcccttccctcacc

SEQ ID NO: 2976004 - DNA, 17 bp, Homo sapiens
tcccttcctgcttcctg

SEQ ID NO: 2976005 - DNA, 14 bp, Homo sapiens
tcccttcctgtctg

SEQ ID NO: 2976006 - DNA, 17 bp, Homo sapiens
tcccttccttgggcaga

SEQ ID NO: 2976007 - DNA, 20 bp, Homo sapiens
tcccttcggtggaagagctc

SEQ ID NO: 2976008 - DNA, 19 bp, Homo sapiens
tcccttctctcacccccac

SEQ ID NO: 2976009 - DNA, 14 bp, Homo sapiens
tcccttctgctact

SEQ ID NO: 2976010 - DNA, 12 bp, Homo sapiens
tcccttctgctt

SEQ ID NO: 2976011 - DNA, 17 bp, Homo sapiens
tcccttctttaccttca

SEQ ID NO: 2976012 - DNA, 18 bp, Homo sapiens
tcccttgagacctcagcc

SEQ ID NO: 2976013 - DNA, 19 bp, Homo sapiens
tcccttgagacctcagcca

SEQ ID NO: 2976014 - DNA, 19 bp, Homo sapiens
tcccttgagtaggccctgc

SEQ ID NO: 2976015 - DNA, 20 bp, Homo sapiens
tcccttgagtaggccctgct

SEQ ID NO: 2976016 - DNA, 14 bp, Homo sapiens
tcccttgcttgcct

SEQ ID NO: 2976017 - DNA, 23 bp, Homo sapiens
tcccttgcttgcctgcagggcca

SEQ ID NO: 2976018 - DNA, 15 bp, Homo sapiens
tcccttggcccagag

SEQ ID NO: 2976019 - DNA, 16 bp, Homo sapiens
tcccttggcccagaga

SEQ ID NO: 2976020 - DNA, 12 bp, Homo sapiens
tcccttgggctc

SEQ ID NO: 2976021 - DNA, 22 bp, Homo sapiens
tcccttgtgtgtaccacaccct

SEQ ID NO: 2976022 - DNA, 15 bp, Homo sapiens
tcccttgtgttcctt

SEQ ID NO: 2976023 - DNA, 20 bp, Homo sapiens
tcccttgtgttccttctgtg

SEQ ID NO: 2976024 - DNA, 13 bp, Homo sapiens
tccctttcatgtt

SEQ ID NO: 2976025 - DNA, 20 bp, Homo sapiens
tcccttttacatactgctgt

SEQ ID NO: 2976026 - DNA, 20 bp, Homo sapiens
tcccttttacattctgtgtg

SEQ ID NO: 2976027 - DNA, 20 bp, Homo sapiens
tcccttttcattctcctcct

SEQ ID NO: 2976028 - DNA, 13 bp, Homo sapiens
tccctttttttct

SEQ ID NO: 2976029 - DNA, 16 bp, Homo sapiens
tcccttttttttctgg

SEQ ID NO: 2976030 - DNA, 15 bp, Homo sapiens
tccgaacctcctctg

SEQ ID NO: 2976031 - DNA, 18 bp, Homo sapiens
tccgaacctcctctgtga

SEQ ID NO: 2976032 - DNA, 24 bp, Homo sapiens
tccgaagaattccatagtggacca

SEQ ID NO: 2976033 - DNA, 15 bp, Homo sapiens
tccgacctctctcag

SEQ ID NO: 2976034 - DNA, 17 bp, Homo sapiens
tccgacctctctcagcc

SEQ ID NO: 2976035 - DNA, 20 bp, Homo sapiens
tccgacctctctcagcccca

SEQ ID NO: 2976036 - DNA, 18 bp, Homo sapiens
tccgacctctctcggccc

SEQ ID NO: 2976037 - DNA, 14 bp, Homo sapiens
tccgagagcagtgg

SEQ ID NO: 2976038 - DNA, 18 bp, Homo sapiens
tccgagctgaggactctg

SEQ ID NO: 2976039 - DNA, 16 bp, Homo sapiens
tccgaggactggactg

SEQ ID NO: 2976040 - DNA, 16 bp, Homo sapiens
tccgcaggtgctggtc

SEQ ID NO: 2976041 - DNA, 14 bp, Homo sapiens
tccgcatccctgct

SEQ ID NO: 2976042 - DNA, 16 bp, Homo sapiens
tccgccaggcgctgca

SEQ ID NO: 2976043 - DNA, 17 bp, Homo sapiens
tccgccagtgtttctga

SEQ ID NO: 2976044 - DNA, 13 bp, Homo sapiens
tccgcctgcgcct

SEQ ID NO: 2976045 - DNA, 22 bp, Homo sapiens
tccgccttctcccttctctcac

SEQ ID NO: 2976046 - DNA, 15 bp, Homo sapiens
tccgcggcctgcacc

SEQ ID NO: 2976047 - DNA, 18 bp, Homo sapiens
tccgcgtgtgcctgtgtg

SEQ ID NO: 2976048 - DNA, 12 bp, Homo sapiens
tccgctgcctgg

SEQ ID NO: 2976049 - DNA, 23 bp, Homo sapiens
tccggccctcctaccctgcgccc

SEQ ID NO: 2976050 - DNA, 14 bp, Homo sapiens
tccggcctctgcct

SEQ ID NO: 2976051 - DNA, 19 bp, Homo sapiens
tccggcctctgcctttgca

SEQ ID NO: 2976052 - DNA, 22 bp, Homo sapiens
tccggcctgggtgacagagtga

SEQ ID NO: 2976053 - DNA, 22 bp, Homo sapiens
tccggcgcagacaggcggggcc

SEQ ID NO: 2976054 - DNA, 12 bp, Homo sapiens
tccgggagctgg

SEQ ID NO: 2976055 - DNA, 21 bp, Homo sapiens
tccgggagctggtgacagcct

SEQ ID NO: 2976056 - DNA, 14 bp, Homo sapiens
tccgggcaggggag

SEQ ID NO: 2976057 - DNA, 17 bp, Homo sapiens
tccgggcaggggagcca

SEQ ID NO: 2976058 - DNA, 16 bp, Homo sapiens
tccggtgttctaagat

SEQ ID NO: 2976059 - DNA, 13 bp, Homo sapiens
tccgtaaaaatga

SEQ ID NO: 2976060 - DNA, 15 bp, Homo sapiens
tccgtaaaaatgatt

SEQ ID NO: 2976061 - DNA, 20 bp, Homo sapiens
tccgtagccagctgctcccc

SEQ ID NO: 2976062 - DNA, 21 bp, Homo sapiens
tccgtagccagctgctcccca

SEQ ID NO: 2976063 - DNA, 15 bp, Homo sapiens
tccgtagttccctga

SEQ ID NO: 2976064 - DNA, 20 bp, Homo sapiens
tccgtcacccttggtagagt

SEQ ID NO: 2976065 - DNA, 18 bp, Homo sapiens
tccgtccccccccaggcc

SEQ ID NO: 2976066 - DNA, 18 bp, Homo sapiens
tccgtccctctgtccact

SEQ ID NO: 2976067 - DNA, 18 bp, Homo sapiens
tccgtgaaaacggagctg

SEQ ID NO: 2976068 - DNA, 15 bp, Homo sapiens
tccgtgaggctgctg

SEQ ID NO: 2976069 - DNA, 18 bp, Homo sapiens
tccgtgctgacagctgct

SEQ ID NO: 2976070 - DNA, 19 bp, Homo sapiens
tccgtgctgacagctgctc

SEQ ID NO: 2976071 - DNA, 24 bp, Homo sapiens
tccgtgcttgtttgctcacctggg

SEQ ID NO: 2976072 - DNA, 20 bp, Homo sapiens
tccgtggccccgccctcagg

SEQ ID NO: 2976073 - DNA, 20 bp, Homo sapiens
tccgtgggttgctaactgaa

SEQ ID NO: 2976074 - DNA, 18 bp, Homo sapiens
tccgtgtcaccgccaccc

SEQ ID NO: 2976075 - DNA, 23 bp, Homo sapiens
tcctaaagaaaaatatcttggcc

SEQ ID NO: 2976076 - DNA, 21 bp, Homo sapiens
tcctaaatattttcaagaaaa

SEQ ID NO: 2976077 - DNA, 22 bp, Homo sapiens
tcctaaatattttcaagaaaag

SEQ ID NO: 2976078 - DNA, 16 bp, Homo sapiens
tcctaagacctggggt

SEQ ID NO: 2976079 - DNA, 18 bp, Homo sapiens
tcctaagacctggggttg

SEQ ID NO: 2976080 - DNA, 18 bp, Homo sapiens
tcctaagacttcagtcct

SEQ ID NO: 2976081 - DNA, 20 bp, Homo sapiens
tcctaagacttcagtcctgg

SEQ ID NO: 2976082 - DNA, 13 bp, Homo sapiens
tcctaagcatcta

SEQ ID NO: 2976083 - DNA, 17 bp, Homo sapiens
tcctaagcatctaagtt

SEQ ID NO: 2976084 - DNA, 21 bp, Homo sapiens
tcctaaggccactgttttaaa

SEQ ID NO: 2976085 - DNA, 21 bp, Homo sapiens
tcctaagggtcgaaagctcta

SEQ ID NO: 2976086 - DNA, 23 bp, Homo sapiens
tcctaagggtcgaaagctctaga

SEQ ID NO: 2976087 - DNA, 21 bp, Homo sapiens
tcctaatcaagagtctctcca

SEQ ID NO: 2976088 - DNA, 23 bp, Homo sapiens
tcctaatcaagagtctctccagc

SEQ ID NO: 2976089 - DNA, 17 bp, Homo sapiens
tcctacaaccaggtctt

SEQ ID NO: 2976090 - DNA, 17 bp, Homo sapiens
tcctacaatattttatt

SEQ ID NO: 2976091 - DNA, 13 bp, Homo sapiens
tcctaccccctgt

SEQ ID NO: 2976092 - DNA, 14 bp, Homo sapiens
tcctacctattatc

SEQ ID NO: 2976093 - DNA, 22 bp, Homo sapiens
tcctacctattatccttctact

SEQ ID NO: 2976094 - DNA, 17 bp, Homo sapiens
tcctactcccagacacc

SEQ ID NO: 2976095 - DNA, 18 bp, Homo sapiens
tcctactcccagacaccc

SEQ ID NO: 2976096 - DNA, 17 bp, Homo sapiens
tcctactcctcatagca

SEQ ID NO: 2976097 - DNA, 22 bp, Homo sapiens
tcctactctcacactggttctc

SEQ ID NO: 2976098 - DNA, 13 bp, Homo sapiens
tcctactttctat

SEQ ID NO: 2976099 - DNA, 17 bp, Homo sapiens
tcctagaggagacagcc

SEQ ID NO: 2976100 - DNA, 23 bp, Homo sapiens
tcctagatcctaagggtcgaaag

SEQ ID NO: 2976101 - DNA, 20 bp, Homo sapiens
tcctagattatatcaaagta

SEQ ID NO: 2976102 - DNA, 17 bp, Homo sapiens
tcctagcacatgcttca

SEQ ID NO: 2976103 - DNA, 12 bp, Homo sapiens
tcctagcccctt

SEQ ID NO: 2976104 - DNA, 14 bp, Homo sapiens
tcctagctcctcct

SEQ ID NO: 2976105 - DNA, 20 bp, Homo sapiens
tcctagctcctcctcctggg

SEQ ID NO: 2976106 - DNA, 14 bp, Homo sapiens
tcctagctgacgcc

SEQ ID NO: 2976107 - DNA, 19 bp, Homo sapiens
tcctagcttatctccctgc

SEQ ID NO: 2976108 - DNA, 21 bp, Homo sapiens
tcctagcttatctccctgctt

SEQ ID NO: 2976109 - DNA, 17 bp, Homo sapiens
tcctaggggcttggtcc

SEQ ID NO: 2976110 - DNA, 21 bp, Homo sapiens
tcctagttggtgagaaacctg

SEQ ID NO: 2976111 - DNA, 16 bp, Homo sapiens
tcctagttttcctact

SEQ ID NO: 2976112 - DNA, 13 bp, Homo sapiens
tcctatatgcact

SEQ ID NO: 2976113 - DNA, 19 bp, Homo sapiens
tcctatcacctatttccat

SEQ ID NO: 2976114 - DNA, 17 bp, Homo sapiens
tcctatcttttatttca

SEQ ID NO: 2976115 - DNA, 14 bp, Homo sapiens
tcctatgctttgaa

SEQ ID NO: 2976116 - DNA, 11 bp, Homo sapiens
tcgcagcctga

SEQ ID NO: 2976117 - DNA, 13 bp, Homo sapiens
tcgcagcctgagt

SEQ ID NO: 2976118 - DNA, 14 bp, Homo sapiens
tcgcatcaaaagac

SEQ ID NO: 2976119 - DNA, 22 bp, Homo sapiens
tcgcatcaaaagacaattcttt

SEQ ID NO: 2976120 - DNA, 23 bp, Homo sapiens
tcgcatcaaaagacaattcttta

SEQ ID NO: 2976121 - DNA, 16 bp, Homo sapiens
tcgcatccagacagtc

SEQ ID NO: 2976122 - DNA, 20 bp, Homo sapiens
tcgcatcccggctgaccctg

SEQ ID NO: 2976123 - DNA, 14 bp, Homo sapiens
tcgcatcttcccaa

SEQ ID NO: 2976124 - DNA, 13 bp, Homo sapiens
tcgccacaaactc

SEQ ID NO: 2976125 - DNA, 15 bp, Homo sapiens
tcgccataggccaag

SEQ ID NO: 2976126 - DNA, 15 bp, Homo sapiens
tcgccatctcctggg

SEQ ID NO: 2976127 - DNA, 16 bp, Homo sapiens
tcgccatctcctgggc

SEQ ID NO: 2976128 - DNA, 14 bp, Homo sapiens
tcgcccaggaaggc

SEQ ID NO: 2976129 - DNA, 20 bp, Homo sapiens
tcgcccatcagtgccagccc

SEQ ID NO: 2976130 - DNA, 14 bp, Homo sapiens
tcgcccccactttt

SEQ ID NO: 2976131 - DNA, 17 bp, Homo sapiens
tcgccctcccaggctct

SEQ ID NO: 2976132 - DNA, 13 bp, Homo sapiens
tcgccctgttctt

SEQ ID NO: 2976133 - DNA, 15 bp, Homo sapiens
tcgccctgttcttga

SEQ ID NO: 2976134 - DNA, 20 bp, Homo sapiens
tcgcccttacttcttgccct

SEQ ID NO: 2976135 - DNA, 15 bp, Homo sapiens
tcgccgtctgtgaat

SEQ ID NO: 2976136 - DNA, 18 bp, Homo sapiens
tcgcctaggatttcagcc

SEQ ID NO: 2976137 - DNA, 20 bp, Homo sapiens
tcgcctaggatttcagccat

SEQ ID NO: 2976138 - DNA, 14 bp, Homo sapiens
tcgcctgccctcct

SEQ ID NO: 2976139 - DNA, 16 bp, Homo sapiens
tcgcctgccctcctct

SEQ ID NO: 2976140 - DNA, 17 bp, Homo sapiens
tcgcctggaaacagagg

SEQ ID NO: 2976141 - DNA, 19 bp, Homo sapiens
tcgcctggaaacagaggta

SEQ ID NO: 2976142 - DNA, 20 bp, Homo sapiens
tcgccttcctgcagtctccg

SEQ ID NO: 2976143 - DNA, 13 bp, Homo sapiens
tcgctcagtctgt

SEQ ID NO: 2976144 - DNA, 17 bp, Homo sapiens
tcgctcccgccagcagc

SEQ ID NO: 2976145 - DNA, 13 bp, Homo sapiens
tcgctctgctgga

SEQ ID NO: 2976146 - DNA, 21 bp, Homo sapiens
tcgctctgttgcccaggctgg

SEQ ID NO: 2976147 - DNA, 15 bp, Homo sapiens
tcgctgaaattaaat

SEQ ID NO: 2976148 - DNA, 19 bp, Homo sapiens
tcgctgatatatgtgtttt

SEQ ID NO: 2976149 - DNA, 19 bp, Homo sapiens
tcgctgccagctctgtatc

SEQ ID NO: 2976150 - DNA, 20 bp, Homo sapiens
tcgctgccagctctgtatca

SEQ ID NO: 2976151 - DNA, 22 bp, Homo sapiens
tcgctggactctcagtctctga

SEQ ID NO: 2976152 - DNA, 18 bp, Homo sapiens
tcgctgtaccctttaaga

SEQ ID NO: 2976153 - DNA, 11 bp, Homo sapiens
tcgctgtcctt

SEQ ID NO: 2976154 - DNA, 15 bp, Homo sapiens
tcgcttccgcatcct

SEQ ID NO: 2976155 - DNA, 15 bp, Homo sapiens
tcgcttgaacctggg

SEQ ID NO: 2976156 - DNA, 22 bp, Homo sapiens
tcggaaaagcgtctttaagaga

SEQ ID NO: 2976157 - DNA, 16 bp, Homo sapiens
tcggaaacactgactt

SEQ ID NO: 2976158 - DNA, 19 bp, Homo sapiens
tcggaacccaagcttagaa

SEQ ID NO: 2976159 - DNA, 20 bp, Homo sapiens
tcggaacccaagcttagaac

SEQ ID NO: 2976160 - DNA, 12 bp, Homo sapiens
tcggaagcctgt

SEQ ID NO: 2976161 - DNA, 17 bp, Homo sapiens
tcggaagcctgtcctca

SEQ ID NO: 2976162 - DNA, 21 bp, Homo sapiens
tcggacaagacccccagcact

SEQ ID NO: 2976163 - DNA, 18 bp, Homo sapiens
tcggagaaattctcttta

SEQ ID NO: 2976164 - DNA, 14 bp, Homo sapiens
tcggagctggccca

SEQ ID NO: 2976165 - DNA, 22 bp, Homo sapiens
tcggaggctcctccctctgcct

SEQ ID NO: 2976166 - DNA, 16 bp, Homo sapiens
tcggcagaactctctg

SEQ ID NO: 2976167 - DNA, 18 bp, Homo sapiens
tcggcaggaaggagcggc

SEQ ID NO: 2976168 - DNA, 23 bp, Homo sapiens
tcggccagttttcggaaacactg

SEQ ID NO: 2976169 - DNA, 16 bp, Homo sapiens
tcggcccacagctccc

SEQ ID NO: 2976170 - DNA, 19 bp, Homo sapiens
tcggcccacagctcccacc

SEQ ID NO: 2976171 - DNA, 11 bp, Homo sapiens
tcggcccagca

SEQ ID NO: 2976172 - DNA, 21 bp, Homo sapiens
tcggccccatcgccccaccgc

SEQ ID NO: 2976173 - DNA, 19 bp, Homo sapiens
tcggccccctcaccccagc

SEQ ID NO: 2976174 - DNA, 20 bp, Homo sapiens
tcggccccctcaccccagct

SEQ ID NO: 2976175 - DNA, 15 bp, Homo sapiens
tcggccgagctggtt

SEQ ID NO: 2976176 - DNA, 18 bp, Homo sapiens
tcggccgagctggtttcc

SEQ ID NO: 2976177 - DNA, 19 bp, Homo sapiens
tcggcttggatcctgggct

SEQ ID NO: 2976178 - DNA, 18 bp, Homo sapiens
tcgggaaggatgggaaaa

SEQ ID NO: 2976179 - DNA, 14 bp, Homo sapiens
tcgggaagggaggg

SEQ ID NO: 2976180 - DNA, 15 bp, Homo sapiens
tcgggaagggagggg

SEQ ID NO: 2976181 - DNA, 16 bp, Homo sapiens
tcgggaagggagggga

SEQ ID NO: 2976182 - DNA, 11 bp, Homo sapiens
tcgggaccagg

SEQ ID NO: 2976183 - DNA, 23 bp, Homo sapiens
tcgggagaggggacgcaggcccc

SEQ ID NO: 2976184 - DNA, 19 bp, Homo sapiens
tcgggaggctgaggcacaa

SEQ ID NO: 2976185 - DNA, 15 bp, Homo sapiens
tcggggaactcctgg

SEQ ID NO: 2976186 - DNA, 11 bp, Homo sapiens
tcggggagggc

SEQ ID NO: 2976187 - DNA, 14 bp, Homo sapiens
tcggggctgctgtg

SEQ ID NO: 2976188 - DNA, 16 bp, Homo sapiens
tcgggggcctgtggtg

SEQ ID NO: 2976189 - DNA, 12 bp, Homo sapiens
tcggtcaccttg

SEQ ID NO: 2976190 - DNA, 16 bp, Homo sapiens
tcggtgaccccatcac

SEQ ID NO: 2976191 - DNA, 14 bp, Homo sapiens
tcggtgctccatct

SEQ ID NO: 2976192 - DNA, 20 bp, Homo sapiens
tcggtgtggacgctgtgctg

SEQ ID NO: 2976193 - DNA, 22 bp, Homo sapiens
tcggtttgccaaaattcatttc

SEQ ID NO: 2976194 - DNA, 19 bp, Homo sapiens
tcggtttttttcctgtttc

SEQ ID NO: 2976195 - DNA, 15 bp, Homo sapiens
tcgtaatagctcaga

SEQ ID NO: 2976196 - DNA, 13 bp, Homo sapiens
tcgtaatgactta

SEQ ID NO: 2976197 - DNA, 19 bp, Homo sapiens
tcgtataccgtgccacttt

SEQ ID NO: 2976198 - DNA, 20 bp, Homo sapiens
tcgtatatacacacaaaaag

SEQ ID NO: 2976199 - DNA, 16 bp, Homo sapiens
tcgtcatcttccctgc

SEQ ID NO: 2976200 - DNA, 17 bp, Homo sapiens
tcgtcatcttccctgcc

SEQ ID NO: 2976201 - DNA, 15 bp, Homo sapiens
tcgtccacagcttcc

SEQ ID NO: 2976202 - DNA, 20 bp, Homo sapiens
tcgtcgaaaggtgcagctgc

SEQ ID NO: 2976203 - DNA, 12 bp, Homo sapiens
tcgtcttcactc

SEQ ID NO: 2976204 - DNA, 14 bp, Homo sapiens
tcgtcttcactctt

SEQ ID NO: 2976205 - DNA, 15 bp, Homo sapiens
tcgtcttcagctgca

SEQ ID NO: 2976206 - DNA, 17 bp, Homo sapiens
tcgtcttcagctgcatt

SEQ ID NO: 2976207 - DNA, 19 bp, Homo sapiens
tcgtcttttagttccaaca

SEQ ID NO: 2976208 - DNA, 20 bp, Homo sapiens
tcgtgacgctgaataaatgt

SEQ ID NO: 2976209 - DNA, 15 bp, Homo sapiens
tcgtgataaactttg

SEQ ID NO: 2976210 - DNA, 14 bp, Homo sapiens
tcgtgccagcagcc

SEQ ID NO: 2976211 - DNA, 18 bp, Homo sapiens
tcgtgccagcagcctcgc

SEQ ID NO: 2976212 - DNA, 17 bp, Homo sapiens
tcgtgcgtgggcttctt

SEQ ID NO: 2976213 - DNA, 20 bp, Homo sapiens
tcgtgtaattacttatccct

SEQ ID NO: 2976214 - DNA, 15 bp, Homo sapiens
tcgtgtgtagaaaaa

SEQ ID NO: 2976215 - DNA, 17 bp, Homo sapiens
tcgttattataaatgtt

SEQ ID NO: 2976216 - DNA, 15 bp, Homo sapiens
tcgttcaaagcatga

SEQ ID NO: 2976217 - DNA, 14 bp, Homo sapiens
tcgttcaactccac

SEQ ID NO: 2976218 - DNA, 14 bp, Homo sapiens
tcgttccccacccc

SEQ ID NO: 2976219 - DNA, 21 bp, Homo sapiens
tcgttgccgcagcggtgggaa

SEQ ID NO: 2976220 - DNA, 20 bp, Homo sapiens
tcgttggtgaccagtttctt

SEQ ID NO: 2976221 - DNA, 16 bp, Homo sapiens
tcgttggttcatgtgt

SEQ ID NO: 2976222 - DNA, 15 bp, Homo sapiens
tcgttggttgtttct

SEQ ID NO: 2976223 - DNA, 16 bp, Homo sapiens
tcgtttaatgtttata

SEQ ID NO: 2976224 - DNA, 20 bp, Homo sapiens
tcgtttagtgccaatgttgt

SEQ ID NO: 2976225 - DNA, 22 bp, Homo sapiens
tcgtttatatttttttaactgt

SEQ ID NO: 2976226 - DNA, 12 bp, Homo sapiens
tcgtttcaaaaa

SEQ ID NO: 2976227 - DNA, 21 bp, Homo sapiens
tcgtttcaaaaacacagtgtt

SEQ ID NO: 2976228 - DNA, 13 bp, Homo sapiens
tcgtttctgtata

SEQ ID NO: 2976229 - DNA, 21 bp, Homo sapiens
tctaaaaaaggagaattgaat

SEQ ID NO: 2976230 - DNA, 15 bp, Homo sapiens
tctaaaaagaagcca

SEQ ID NO: 2976231 - DNA, 17 bp, Homo sapiens
tctaaaaatgaagatga

SEQ ID NO: 2976232 - DNA, 11 bp, Homo sapiens
tctaaaactcc

SEQ ID NO: 2976233 - DNA, 16 bp, Homo sapiens
tctaaaagcagaaaat

SEQ ID NO: 2976234 - DNA, 21 bp, Homo sapiens
tctaaaagtgtcaccttttct

SEQ ID NO: 2976235 - DNA, 19 bp, Homo sapiens
tctaaacgtaagcactgtt

SEQ ID NO: 2976236 - DNA, 17 bp, Homo sapiens
tctaaacttccccatct

SEQ ID NO: 2976237 - DNA, 21 bp, Homo sapiens
tctaaagagtttattttaaga

SEQ ID NO: 2976238 - DNA, 22 bp, Homo sapiens
tctaaagatggagtttctaagg

SEQ ID NO: 2976239 - DNA, 23 bp, Homo sapiens
tctaaagatggagtttctaaggt

SEQ ID NO: 2976240 - DNA, 15 bp, Homo sapiens
tctaaagattctata

SEQ ID NO: 2976241 - DNA, 16 bp, Homo sapiens
tctaaagattctatag

SEQ ID NO: 2976242 - DNA, 17 bp, Homo sapiens
tctaaaggtccacaggt

SEQ ID NO: 2976243 - DNA, 12 bp, Homo sapiens
tctaaagttata

SEQ ID NO: 2976244 - DNA, 14 bp, Homo sapiens
tctaaagttatatt

SEQ ID NO: 2976245 - DNA, 13 bp, Homo sapiens
tctaaagttctaa

SEQ ID NO: 2976246 - DNA, 14 bp, Homo sapiens
tctaaagttctaag

SEQ ID NO: 2976247 - DNA, 17 bp, Homo sapiens
tctaaatagatactttt

SEQ ID NO: 2976248 - DNA, 21 bp, Homo sapiens
tctaaataggatcctggaggc

SEQ ID NO: 2976249 - DNA, 17 bp, Homo sapiens
tctctcatatcactgaa

SEQ ID NO: 2976250 - DNA, 19 bp, Homo sapiens
tctctcatatcactgaagg

SEQ ID NO: 2976251 - DNA, 23 bp, Homo sapiens
tctctcatcctccagtaccttgc

SEQ ID NO: 2976252 - DNA, 22 bp, Homo sapiens
tctctccaaggtgtttctagat

SEQ ID NO: 2976253 - DNA, 16 bp, Homo sapiens
tctctccagatgtttc

SEQ ID NO: 2976254 - DNA, 11 bp, Homo sapiens
tctctccagcc

SEQ ID NO: 2976255 - DNA, 16 bp, Homo sapiens
tctctccagcctcaca

SEQ ID NO: 2976256 - DNA, 24 bp, Homo sapiens
tctctccagcctcacagatgctgg

SEQ ID NO: 2976257 - DNA, 12 bp, Homo sapiens
tctctcccagga

SEQ ID NO: 2976258 - DNA, 15 bp, Homo sapiens
tctctccccctctgt

SEQ ID NO: 2976259 - DNA, 19 bp, Homo sapiens
tctctccccctctgtcttc

SEQ ID NO: 2976260 - DNA, 16 bp, Homo sapiens
tctctccctctttcta

SEQ ID NO: 2976261 - DNA, 13 bp, Homo sapiens
tctctccctgcct

SEQ ID NO: 2976262 - DNA, 15 bp, Homo sapiens
tctctccctgcctca

SEQ ID NO: 2976263 - DNA, 16 bp, Homo sapiens
tctctccctgcctcac

SEQ ID NO: 2976264 - DNA, 19 bp, Homo sapiens
tctctcctggactggttat

SEQ ID NO: 2976265 - DNA, 22 bp, Homo sapiens
tctctcctggactggttatctt

SEQ ID NO: 2976266 - DNA, 15 bp, Homo sapiens
tctctcggccccctc

SEQ ID NO: 2976267 - DNA, 16 bp, Homo sapiens
tctctctaacataaca

SEQ ID NO: 2976268 - DNA, 13 bp, Homo sapiens
tctctctatgcaa

SEQ ID NO: 2976269 - DNA, 13 bp, Homo sapiens
tctctctccctct

SEQ ID NO: 2976270 - DNA, 13 bp, Homo sapiens
tctctctctttct

SEQ ID NO: 2976271 - DNA, 16 bp, Homo sapiens
tctctctgcccaaccc

SEQ ID NO: 2976272 - DNA, 11 bp, Homo sapiens
tctctctgcct

SEQ ID NO: 2976273 - DNA, 12 bp, Homo sapiens
tctctctgcctg

SEQ ID NO: 2976274 - DNA, 19 bp, Homo sapiens
tctctctgcctgctgggct

SEQ ID NO: 2976275 - DNA, 11 bp, Homo sapiens
tctctctggag

SEQ ID NO: 2976276 - DNA, 13 bp, Homo sapiens
tctctctggagcc

SEQ ID NO: 2976277 - DNA, 19 bp, Homo sapiens
tctctcttcctgcagtgtt

SEQ ID NO: 2976278 - DNA, 19 bp, Homo sapiens
tctctcttttcctctctct

SEQ ID NO: 2976279 - DNA, 22 bp, Homo sapiens
tctctgaagagtgggtttcaca

SEQ ID NO: 2976280 - DNA, 22 bp, Homo sapiens
tctctgaaggtaagatcattta

SEQ ID NO: 2976281 - DNA, 22 bp, Homo sapiens
tctctgaattcctgtcttccaa

SEQ ID NO: 2976282 - DNA, 14 bp, Homo sapiens
tctctgagtacatt

SEQ ID NO: 2976283 - DNA, 16 bp, Homo sapiens
tctctgagtacattgt

SEQ ID NO: 2976284 - DNA, 16 bp, Homo sapiens
tctctgagtgtctctg

SEQ ID NO: 2976285 - DNA, 19 bp, Homo sapiens
tctctgagtgtctctgcct

SEQ ID NO: 2976286 - DNA, 19 bp, Homo sapiens
tctctgcaccggacagtcg

SEQ ID NO: 2976287 - DNA, 15 bp, Homo sapiens
tctctgcagacttcc

SEQ ID NO: 2976288 - DNA, 20 bp, Homo sapiens
tctctgcagacttcccagct

SEQ ID NO: 2976289 - DNA, 17 bp, Homo sapiens
tctctgcagccagccca

SEQ ID NO: 2976290 - DNA, 19 bp, Homo sapiens
tctctgcagccagcccagc

SEQ ID NO: 2976291 - DNA, 20 bp, Homo sapiens
tctctgcaggcagcctgcct

SEQ ID NO: 2976292 - DNA, 18 bp, Homo sapiens
tctctgccatatcagtga

SEQ ID NO: 2976293 - DNA, 12 bp, Homo sapiens
tctctgcccaac

SEQ ID NO: 2976294 - DNA, 16 bp, Homo sapiens
tctctgccttgccttt

SEQ ID NO: 2976295 - DNA, 13 bp, Homo sapiens
tctctgctccagc

SEQ ID NO: 2976296 - DNA, 18 bp, Homo sapiens
tctctgctctgcgtgtca

SEQ ID NO: 2976297 - DNA, 13 bp, Homo sapiens
tctctgcttccat

SEQ ID NO: 2976298 - DNA, 14 bp, Homo sapiens
tctctgcttccatg

SEQ ID NO: 2976299 - DNA, 22 bp, Homo sapiens
tctctggcgacagttttccttc

SEQ ID NO: 2976300 - DNA, 15 bp, Homo sapiens
tctctgggcctcaga

SEQ ID NO: 2976301 - DNA, 12 bp, Homo sapiens
tctctgggctgc

SEQ ID NO: 2976302 - DNA, 16 bp, Homo sapiens
tctctgggtcccgggg

SEQ ID NO: 2976303 - DNA, 13 bp, Homo sapiens
tctctgtcagtgt

SEQ ID NO: 2976304 - DNA, 16 bp, Homo sapiens
tctctgtcccttgctg

SEQ ID NO: 2976305 - DNA, 14 bp, Homo sapiens
tctctgtctcatcc

SEQ ID NO: 2976306 - DNA, 23 bp, Homo sapiens
tctctgtctgtctctccccctct

SEQ ID NO: 2976307 - DNA, 13 bp, Homo sapiens
tctctgtgaccca

SEQ ID NO: 2976308 - DNA, 21 bp, Homo sapiens
tctctgtggtggttcattcca

SEQ ID NO: 2976309 - DNA, 22 bp, Homo sapiens
tctctgtggtggttcattccac

SEQ ID NO: 2976310 - DNA, 23 bp, Homo sapiens
tctctgtggtggttcattccaca

SEQ ID NO: 2976311 - DNA, 20 bp, Homo sapiens
tctctgtggttttttttgaa

SEQ ID NO: 2976312 - DNA, 19 bp, Homo sapiens
tctctgtgtatttatataa

SEQ ID NO: 2976313 - DNA, 20 bp, Homo sapiens
tctctgtgtctaagattcta

SEQ ID NO: 2976314 - DNA, 14 bp, Homo sapiens
tctctgttccatgt

SEQ ID NO: 2976315 - DNA, 22 bp, Homo sapiens
tctctgttccatgtctccttta

SEQ ID NO: 2976316 - DNA, 15 bp, Homo sapiens
tctctgttcttcatc

SEQ ID NO: 2976317 - DNA, 14 bp, Homo sapiens
tctctgttcttttc

SEQ ID NO: 2976318 - DNA, 13 bp, Homo sapiens
tctctgtttgctt

SEQ ID NO: 2976319 - DNA, 17 bp, Homo sapiens
tctctgtttgcttttga

SEQ ID NO: 2976320 - DNA, 14 bp, Homo sapiens
tctcttaaatctct

SEQ ID NO: 2976321 - DNA, 22 bp, Homo sapiens
tctcttaaatctcttaaactct

SEQ ID NO: 2976322 - DNA, 22 bp, Homo sapiens
tctcttagctactgtatgcaaa

SEQ ID NO: 2976323 - DNA, 13 bp, Homo sapiens
tctcttcaatgaa

SEQ ID NO: 2976324 - DNA, 17 bp, Homo sapiens
tctcttcaatgaaaaaa

SEQ ID NO: 2976325 - DNA, 12 bp, Homo sapiens
tctcttcccttt

SEQ ID NO: 2976326 - DNA, 19 bp, Homo sapiens
tctcttcctccgaggccag

SEQ ID NO: 2976327 - DNA, 15 bp, Homo sapiens
tctcttctcttcttt

SEQ ID NO: 2976328 - DNA, 12 bp, Homo sapiens
tctcttcttgtt

SEQ ID NO: 2976329 - DNA, 13 bp, Homo sapiens
tctcttgataaag

SEQ ID NO: 2976330 - DNA, 12 bp, Homo sapiens
tctcttgccctt

SEQ ID NO: 2976331 - DNA, 14 bp, Homo sapiens
tctcttgctttata

SEQ ID NO: 2976332 - DNA, 13 bp, Homo sapiens
tctcttggtgtta

SEQ ID NO: 2976333 - DNA, 22 bp, Homo sapiens
tctcttgtataagatcctagat

SEQ ID NO: 2976334 - DNA, 12 bp, Homo sapiens
tctcttgtttaa

SEQ ID NO: 2976335 - DNA, 16 bp, Homo sapiens
tctcttgtttaaaaaa

SEQ ID NO: 2976336 - DNA, 14 bp, Homo sapiens
tctctttaaaatgc

SEQ ID NO: 2976337 - DNA, 12 bp, Homo sapiens
tctctttcagta

SEQ ID NO: 2976338 - DNA, 13 bp, Homo sapiens
tctctttgtcctg

SEQ ID NO: 2976339 - DNA, 19 bp, Homo sapiens
tctcttttcctctctgtct

SEQ ID NO: 2976340 - DNA, 13 bp, Homo sapiens
tctctttttcagt

SEQ ID NO: 2976341 - DNA, 18 bp, Homo sapiens
tctctttttgctttcgaa

SEQ ID NO: 2976342 - DNA, 22 bp, Homo sapiens
tctgaaaagaggagccagagaa

SEQ ID NO: 2976343 - DNA, 13 bp, Homo sapiens
tctgaaaatataa

SEQ ID NO: 2976344 - DNA, 18 bp, Homo sapiens
tctgaaaatataaccagc

SEQ ID NO: 2976345 - DNA, 14 bp, Homo sapiens
tctgaaacagctgc

SEQ ID NO: 2976346 - DNA, 15 bp, Homo sapiens
tctgaaacagctgcc

SEQ ID NO: 2976347 - DNA, 22 bp, Homo sapiens
tctgaaacagctgccttagctt

SEQ ID NO: 2976348 - DNA, 21 bp, Homo sapiens
tctgaaaccacagtttcatta

SEQ ID NO: 2976349 - DNA, 15 bp, Homo sapiens
tctgaaaccttagtt

SEQ ID NO: 2976350 - DNA, 15 bp, Homo sapiens
tctgaaactcccttg

SEQ ID NO: 2976351 - DNA, 22 bp, Homo sapiens
tctgaaactcccttgtgttcct

SEQ ID NO: 2976352 - DNA, 20 bp, Homo sapiens
tctgaaacttcccaacttcc

SEQ ID NO: 2976353 - DNA, 22 bp, Homo sapiens
tctgaaaggtaatacagcttgt

SEQ ID NO: 2976354 - DNA, 21 bp, Homo sapiens
tctgaaagtattcacatcatt

SEQ ID NO: 2976355 - DNA, 13 bp, Homo sapiens
tctgaaatgaaga

SEQ ID NO: 2976356 - DNA, 13 bp, Homo sapiens
tctgaacccagct

SEQ ID NO: 2976357 - DNA, 14 bp, Homo sapiens
tctgaactttggga

SEQ ID NO: 2976358 - DNA, 21 bp, Homo sapiens
tctgaactttgggaagccttt

SEQ ID NO: 2976359 - DNA, 22 bp, Homo sapiens
tctgaagagtgggtttcacaag

SEQ ID NO: 2976360 - DNA, 16 bp, Homo sapiens
tctgaagccctcccag

SEQ ID NO: 2976361 - DNA, 18 bp, Homo sapiens
tctgaagccctcccaggt

SEQ ID NO: 2976362 - DNA, 21 bp, Homo sapiens
tctgaagcgtgattttaaaat

SEQ ID NO: 2976363 - DNA, 21 bp, Homo sapiens
tctgaagctgacgaacttcca

SEQ ID NO: 2976364 - DNA, 17 bp, Homo sapiens
tctgaagcttatgtttc

SEQ ID NO: 2976365 - DNA, 23 bp, Homo sapiens
tctgaagtggttcagtctagaag

SEQ ID NO: 2976366 - DNA, 18 bp, Homo sapiens
tctgaagttttattttaa

SEQ ID NO: 2976367 - DNA, 22 bp, Homo sapiens
tctgaagttttattttaaatta

SEQ ID NO: 2976368 - DNA, 14 bp, Homo sapiens
tctgaataaatacc

SEQ ID NO: 2976369 - DNA, 20 bp, Homo sapiens
tctgaatgaaaataactgaa

SEQ ID NO: 2976370 - DNA, 22 bp, Homo sapiens
tctgaatgaaaataactgaacc

SEQ ID NO: 2976371 - DNA, 12 bp, Homo sapiens
tctgaatgtttg

SEQ ID NO: 2976372 - DNA, 22 bp, Homo sapiens
tctgaatgtttgtgtctgtggt

SEQ ID NO: 2976373 - DNA, 14 bp, Homo sapiens
tctgaatttgcaaa

SEQ ID NO: 2976374 - DNA, 15 bp, Homo sapiens
tctgaatttgcaaag

SEQ ID NO: 2976375 - DNA, 17 bp, Homo sapiens
tctgaatttgcaaagta

SEQ ID NO: 2976376 - DNA, 18 bp, Homo sapiens
tctgaatttgccctggga

SEQ ID NO: 2976377 - DNA, 14 bp, Homo sapiens
tctgacaaagtgtg

SEQ ID NO: 2976378 - DNA, 15 bp, Homo sapiens
tctgacaaattcaaa

SEQ ID NO: 2976379 - DNA, 16 bp, Homo sapiens
tctgacaaattcaaaa

SEQ ID NO: 2976380 - DNA, 19 bp, Homo sapiens
tctgacaatgcgtggcaca

SEQ ID NO: 2976381 - DNA, 16 bp, Homo sapiens
tctgacagcagcctgt

SEQ ID NO: 2976382 - DNA, 19 bp, Homo sapiens
tcttagctctttctctatt

SEQ ID NO: 2976383 - DNA, 14 bp, Homo sapiens
tcttaggcactttg

SEQ ID NO: 2976384 - DNA, 22 bp, Homo sapiens
tcttataaaccttgtcaataaa

SEQ ID NO: 2976385 - DNA, 17 bp, Homo sapiens
tcttataaagtggactt

SEQ ID NO: 2976386 - DNA, 14 bp, Homo sapiens
tcttataaatatga

SEQ ID NO: 2976387 - DNA, 16 bp, Homo sapiens
tcttatacgcttttct

SEQ ID NO: 2976388 - DNA, 18 bp, Homo sapiens
tcttatacgtctagccta

SEQ ID NO: 2976389 - DNA, 14 bp, Homo sapiens
tcttatactgtaca

SEQ ID NO: 2976390 - DNA, 21 bp, Homo sapiens
tcttatactgtacaataaaaa

SEQ ID NO: 2976391 - DNA, 13 bp, Homo sapiens
tcttatagaaagt

SEQ ID NO: 2976392 - DNA, 14 bp, Homo sapiens
tcttatagaataaa

SEQ ID NO: 2976393 - DNA, 22 bp, Homo sapiens
tcttatagaataaaagctgtgg

SEQ ID NO: 2976394 - DNA, 17 bp, Homo sapiens
tcttatagttctaggca

SEQ ID NO: 2976395 - DNA, 14 bp, Homo sapiens
tcttatggaattga

SEQ ID NO: 2976396 - DNA, 17 bp, Homo sapiens
tcttatggattcattta

SEQ ID NO: 2976397 - DNA, 21 bp, Homo sapiens
tcttattaggcctcagaaaga

SEQ ID NO: 2976398 - DNA, 15 bp, Homo sapiens
tcttattcctttaaa

SEQ ID NO: 2976399 - DNA, 14 bp, Homo sapiens
tcttattctctgtt

SEQ ID NO: 2976400 - DNA, 13 bp, Homo sapiens
tcttattctgtat

SEQ ID NO: 2976401 - DNA, 12 bp, Homo sapiens
tcttatttttct

SEQ ID NO: 2976402 - DNA, 18 bp, Homo sapiens
tcttatttttctaaacgt

SEQ ID NO: 2976403 - DNA, 21 bp, Homo sapiens
tcttcaaaagtaatgcctctg

SEQ ID NO: 2976404 - DNA, 22 bp, Homo sapiens
tcttcaaaagtaatgcctctgt

SEQ ID NO: 2976405 - DNA, 15 bp, Homo sapiens
tcttcaaacacaagt

SEQ ID NO: 2976406 - DNA, 14 bp, Homo sapiens
tcttcaaatgcctg

SEQ ID NO: 2976407 - DNA, 14 bp, Homo sapiens
tcttcaaattaaag

SEQ ID NO: 2976408 - DNA, 14 bp, Homo sapiens
tcttcaagaaatct

SEQ ID NO: 2976409 - DNA, 11 bp, Homo sapiens
tcttcaagaga

SEQ ID NO: 2976410 - DNA, 17 bp, Homo sapiens
tcttcaaggcttcagtc

SEQ ID NO: 2976411 - DNA, 16 bp, Homo sapiens
tcttcaagtgagtggc

SEQ ID NO: 2976412 - DNA, 20 bp, Homo sapiens
tcttcaatttgttaacagag

SEQ ID NO: 2976413 - DNA, 23 bp, Homo sapiens
tcttcacccaggcctatgttgat

SEQ ID NO: 2976414 - DNA, 22 bp, Homo sapiens
tcttcacgcagagattttcatc

SEQ ID NO: 2976415 - DNA, 16 bp, Homo sapiens
tcttcacttttgcaag

SEQ ID NO: 2976416 - DNA, 13 bp, Homo sapiens
tcttcagagatca

SEQ ID NO: 2976417 - DNA, 14 bp, Homo sapiens
tcttcagaggccct

SEQ ID NO: 2976418 - DNA, 20 bp, Homo sapiens
tcttcagctggtggatggtg

SEQ ID NO: 2976419 - DNA, 16 bp, Homo sapiens
tcttcagcttcttcat

SEQ ID NO: 2976420 - DNA, 16 bp, Homo sapiens
tcttcaggctctgccc

SEQ ID NO: 2976421 - DNA, 19 bp, Homo sapiens
tcttcagtgtaatgtgact

SEQ ID NO: 2976422 - DNA, 14 bp, Homo sapiens
tcttcatataaact

SEQ ID NO: 2976423 - DNA, 13 bp, Homo sapiens
tcttcatctccct

SEQ ID NO: 2976424 - DNA, 18 bp, Homo sapiens
tcttcatctccctgccat

SEQ ID NO: 2976425 - DNA, 14 bp, Homo sapiens
tcttcatctgccca

SEQ ID NO: 2976426 - DNA, 16 bp, Homo sapiens
tcttcatctgcccaac

SEQ ID NO: 2976427 - DNA, 21 bp, Homo sapiens
tcttcatgtacatttggaact

SEQ ID NO: 2976428 - DNA, 22 bp, Homo sapiens
tcttcattggctatataaaatg

SEQ ID NO: 2976429 - DNA, 14 bp, Homo sapiens
tcttccaccagagc

SEQ ID NO: 2976430 - DNA, 17 bp, Homo sapiens
tcttccaccagagcagg

SEQ ID NO: 2976431 - DNA, 19 bp, Homo sapiens
tcttccagaagtgtgattg

SEQ ID NO: 2976432 - DNA, 18 bp, Homo sapiens
tcttccaggtgcccagct

SEQ ID NO: 2976433 - DNA, 22 bp, Homo sapiens
tcttccagtttctgtaaggtct

SEQ ID NO: 2976434 - DNA, 14 bp, Homo sapiens
tcttccatgatttt

SEQ ID NO: 2976435 - DNA, 16 bp, Homo sapiens
tcttccattagaatgc

SEQ ID NO: 2976436 - DNA, 20 bp, Homo sapiens
tcttccattagaatgctaca

SEQ ID NO: 2976437 - DNA, 15 bp, Homo sapiens
tcttccattcagttt

SEQ ID NO: 2976438 - DNA, 14 bp, Homo sapiens
tcttccatttgcaa

SEQ ID NO: 2976439 - DNA, 17 bp, Homo sapiens
tcttcccatcactggag

SEQ ID NO: 2976440 - DNA, 21 bp, Homo sapiens
tcttcccgcctcagcctctca

SEQ ID NO: 2976441 - DNA, 16 bp, Homo sapiens
tcttccctctctgcag

SEQ ID NO: 2976442 - DNA, 17 bp, Homo sapiens
tcttccctgtcagcctg

SEQ ID NO: 2976443 - DNA, 19 bp, Homo sapiens
tcttcccttttacatactg

SEQ ID NO: 2976444 - DNA, 19 bp, Homo sapiens
tcttcccttttttttctgg

SEQ ID NO: 2976445 - DNA, 16 bp, Homo sapiens
tcttcctatttctgga

SEQ ID NO: 2976446 - DNA, 17 bp, Homo sapiens
tcttcctccgaggccag

SEQ ID NO: 2976447 - DNA, 20 bp, Homo sapiens
tcttcctcttagcctctgga

SEQ ID NO: 2976448 - DNA, 13 bp, Homo sapiens
tcttcctggcttt

SEQ ID NO: 2976449 - DNA, 22 bp, Homo sapiens
tcttcctggctttttaactccc

SEQ ID NO: 2976450 - DNA, 14 bp, Homo sapiens
tcttcctgtggctc

SEQ ID NO: 2976451 - DNA, 20 bp, Homo sapiens
tcttcctgtggctccctctc

SEQ ID NO: 2976452 - DNA, 18 bp, Homo sapiens
tcttcctgttctgtgact

SEQ ID NO: 2976453 - DNA, 23 bp, Homo sapiens
tcttccttctcattgctgcccgt

SEQ ID NO: 2976454 - DNA, 21 bp, Homo sapiens
tcttccttggccaagagaagg

SEQ ID NO: 2976455 - DNA, 13 bp, Homo sapiens
tcttcgaggtgga

SEQ ID NO: 2976456 - DNA, 14 bp, Homo sapiens
tcttcggaaacctt

SEQ ID NO: 2976457 - DNA, 22 bp, Homo sapiens
tcttctaaatgagctaaataag

SEQ ID NO: 2976458 - DNA, 24 bp, Homo sapiens
tcttctaatcataacatagttgaa

SEQ ID NO: 2976459 - DNA, 14 bp, Homo sapiens
tcttctagaagata

SEQ ID NO: 2976460 - DNA, 12 bp, Homo sapiens
tcttctagagtt

SEQ ID NO: 2976461 - DNA, 17 bp, Homo sapiens
tcttctagagttcagag

SEQ ID NO: 2976462 - DNA, 15 bp, Homo sapiens
tcttctcaaaagaac

SEQ ID NO: 2976463 - DNA, 19 bp, Homo sapiens
tcttctcaagttctaagat

SEQ ID NO: 2976464 - DNA, 12 bp, Homo sapiens
tcttctccacca

SEQ ID NO: 2976465 - DNA, 14 bp, Homo sapiens
tcttctccatctgg

SEQ ID NO: 2976466 - DNA, 20 bp, Homo sapiens
tcttctccccgaggctgccc

SEQ ID NO: 2976467 - DNA, 19 bp, Homo sapiens
tcttctccttcaaaacatt

SEQ ID NO: 2976468 - DNA, 15 bp, Homo sapiens
tcttctccttgattt

SEQ ID NO: 2976469 - DNA, 19 bp, Homo sapiens
tcttctctatcctctctct

SEQ ID NO: 2976470 - DNA, 16 bp, Homo sapiens
tcttctctccacttct

SEQ ID NO: 2976471 - DNA, 18 bp, Homo sapiens
tcttctgccggccctggg

SEQ ID NO: 2976472 - DNA, 19 bp, Homo sapiens
tcttctgccggccctgggg

SEQ ID NO: 2976473 - DNA, 13 bp, Homo sapiens
tcttctgcctccc

SEQ ID NO: 2976474 - DNA, 21 bp, Homo sapiens
tcttctggctcaaaaagagaa

SEQ ID NO: 2976475 - DNA, 21 bp, Homo sapiens
tcttctgggcagagcctgtcc

SEQ ID NO: 2976476 - DNA, 20 bp, Homo sapiens
tcttctgtatataaatggga

SEQ ID NO: 2976477 - DNA, 22 bp, Homo sapiens
tcttctgtatataaatgggaac

SEQ ID NO: 2976478 - DNA, 24 bp, Homo sapiens
tcttctgtatataaatgggaacat

SEQ ID NO: 2976479 - DNA, 22 bp, Homo sapiens
tcttctgtattttttttttcca

SEQ ID NO: 2976480 - DNA, 22 bp, Homo sapiens
tcttctgtttcataatgcagaa

SEQ ID NO: 2976481 - DNA, 13 bp, Homo sapiens
tcttcttaaacca

SEQ ID NO: 2976482 - DNA, 14 bp, Homo sapiens
tcttcttcaccatt

SEQ ID NO: 2976483 - DNA, 21 bp, Homo sapiens
tcttcttggggcccagtgcat

SEQ ID NO: 2976484 - DNA, 14 bp, Homo sapiens
tcttcttgtttctc

SEQ ID NO: 2976485 - DNA, 18 bp, Homo sapiens
tcttctttcctttactcc

SEQ ID NO: 2976486 - DNA, 19 bp, Homo sapiens
tcttctttcctttactcct

SEQ ID NO: 2976487 - DNA, 13 bp, Homo sapiens
tcttctttgtggt

SEQ ID NO: 2976488 - DNA, 16 bp, Homo sapiens
tcttgaaaaaaaatag

SEQ ID NO: 2976489 - DNA, 21 bp, Homo sapiens
tcttgaaattaagaaggcaaa

SEQ ID NO: 2976490 - DNA, 21 bp, Homo sapiens
tcttgaagcatttcaaagccc

SEQ ID NO: 2976491 - DNA, 13 bp, Homo sapiens
tcttgaagtcctg

SEQ ID NO: 2976492 - DNA, 19 bp, Homo sapiens
tcttgaagtcctggcttca

SEQ ID NO: 2976493 - DNA, 16 bp, Homo sapiens
tcttgaatgtcttttg

SEQ ID NO: 2976494 - DNA, 14 bp, Homo sapiens
tcttgaatttctga

SEQ ID NO: 2976495 - DNA, 21 bp, Homo sapiens
tcttgaccaagcaggaagctc

SEQ ID NO: 2976496 - DNA, 20 bp, Homo sapiens
tcttgacctgaactctgcaa

SEQ ID NO: 2976497 - DNA, 20 bp, Homo sapiens
tcttgacgagtgtgaagctt

SEQ ID NO: 2976498 - DNA, 23 bp, Homo sapiens
tcttgactgtcttccctctctat

SEQ ID NO: 2976499 - DNA, 16 bp, Homo sapiens
tcttgagagtgttcct

SEQ ID NO: 2976500 - DNA, 21 bp, Homo sapiens
tcttgagccagccaggccctg

SEQ ID NO: 2976501 - DNA, 17 bp, Homo sapiens
tcttgaggtctcttttc

SEQ ID NO: 2976502 - DNA, 22 bp, Homo sapiens
tcttgaggtctcttttctctac

SEQ ID NO: 2976503 - DNA, 23 bp, Homo sapiens
tcttgaggtggtagtaaaacaca

SEQ ID NO: 2976504 - DNA, 14 bp, Homo sapiens
tcttgattataaat

SEQ ID NO: 2976505 - DNA, 16 bp, Homo sapiens
tcttgattataaatgt

SEQ ID NO: 2976506 - DNA, 22 bp, Homo sapiens
tcttgcagttttgtaagccctc

SEQ ID NO: 2976507 - DNA, 19 bp, Homo sapiens
tcttgccaaatataaataa

SEQ ID NO: 2976508 - DNA, 22 bp, Homo sapiens
tcttgcccttcctaactaaagg

SEQ ID NO: 2976509 - DNA, 14 bp, Homo sapiens
tcttgcctccaggt

SEQ ID NO: 2976510 - DNA, 14 bp, Homo sapiens
tcttgctaactttg

SEQ ID NO: 2976511 - DNA, 19 bp, Homo sapiens
tcttgctaagctccagccc

SEQ ID NO: 2976512 - DNA, 19 bp, Homo sapiens
tcttgctatattgcccagg

SEQ ID NO: 2976513 - DNA, 18 bp, Homo sapiens
tcttgctccaataaagga

SEQ ID NO: 2976514 - DNA, 14 bp, Homo sapiens
tgaaataaatgttc

SEQ ID NO: 2976515 - DNA, 14 bp, Homo sapiens
tgaaataaatgttt

SEQ ID NO: 2976516 - DNA, 18 bp, Homo sapiens
tgaaataaatgtttcaaa

SEQ ID NO: 2976517 - DNA, 22 bp, Homo sapiens
tgaaataaatgtttcaaatgca

SEQ ID NO: 2976518 - DNA, 20 bp, Homo sapiens
tgaaataactggaacaaatt

SEQ ID NO: 2976519 - DNA, 15 bp, Homo sapiens
tgaaataatgatctt

SEQ ID NO: 2976520 - DNA, 15 bp, Homo sapiens
tgaaatacctttgta

SEQ ID NO: 2976521 - DNA, 23 bp, Homo sapiens
tgaaatacctttgtagttactca

SEQ ID NO: 2976522 - DNA, 17 bp, Homo sapiens
tgaaatatcctgcttga

SEQ ID NO: 2976523 - DNA, 23 bp, Homo sapiens
tgaaatatgagaagatcctgtca

SEQ ID NO: 2976524 - DNA, 21 bp, Homo sapiens
tgaaatatgctcttttgtttg

SEQ ID NO: 2976525 - DNA, 18 bp, Homo sapiens
tgaaatatgtgaagccca

SEQ ID NO: 2976526 - DNA, 13 bp, Homo sapiens
tgaaatattgtaa

SEQ ID NO: 2976527 - DNA, 14 bp, Homo sapiens
tgaaatattgtaaa

SEQ ID NO: 2976528 - DNA, 19 bp, Homo sapiens
tgaaatattgtaaatgcta

SEQ ID NO: 2976529 - DNA, 18 bp, Homo sapiens
tgaaatattttgaataca

SEQ ID NO: 2976530 - DNA, 20 bp, Homo sapiens
tgaaatattttgaatacaca

SEQ ID NO: 2976531 - DNA, 15 bp, Homo sapiens
tgaaatctgtcaaga

SEQ ID NO: 2976532 - DNA, 17 bp, Homo sapiens
tgaaatgaactttgtca

SEQ ID NO: 2976533 - DNA, 22 bp, Homo sapiens
tgaaatgaactttgtcagtgtt

SEQ ID NO: 2976534 - DNA, 16 bp, Homo sapiens
tgaaatgaatatttaa

SEQ ID NO: 2976535 - DNA, 14 bp, Homo sapiens
tgaaatgccaagtg

SEQ ID NO: 2976536 - DNA, 22 bp, Homo sapiens
tgaaatgccaagtgcctgctta

SEQ ID NO: 2976537 - DNA, 17 bp, Homo sapiens
tgaaatgctctcctttc

SEQ ID NO: 2976538 - DNA, 17 bp, Homo sapiens
tgaaatggatacttata

SEQ ID NO: 2976539 - DNA, 14 bp, Homo sapiens
tgaaatgtaatttc

SEQ ID NO: 2976540 - DNA, 17 bp, Homo sapiens
tgaaatgtggttttcct

SEQ ID NO: 2976541 - DNA, 19 bp, Homo sapiens
tgaaatgtggttttcctga

SEQ ID NO: 2976542 - DNA, 20 bp, Homo sapiens
tgaaatgtttggattctctt

SEQ ID NO: 2976543 - DNA, 17 bp, Homo sapiens
tgaaattaacctctcac

SEQ ID NO: 2976544 - DNA, 19 bp, Homo sapiens
tgaaattaagaaggcaaaa

SEQ ID NO: 2976545 - DNA, 19 bp, Homo sapiens
tgaaattacgggtacctga

SEQ ID NO: 2976546 - DNA, 22 bp, Homo sapiens
tgaaattacgggtacctgaaga

SEQ ID NO: 2976547 - DNA, 12 bp, Homo sapiens
tgaaattccaaa

SEQ ID NO: 2976548 - DNA, 15 bp, Homo sapiens
tgaaattccaaagtc

SEQ ID NO: 2976549 - DNA, 22 bp, Homo sapiens
tgaaattctgaatttgcaaagt

SEQ ID NO: 2976550 - DNA, 13 bp, Homo sapiens
tgaaattgcctga

SEQ ID NO: 2976551 - DNA, 21 bp, Homo sapiens
tgaaattttatttattttaat

SEQ ID NO: 2976552 - DNA, 15 bp, Homo sapiens
tgaaatttttgtaaa

SEQ ID NO: 2976553 - DNA, 18 bp, Homo sapiens
tgaaatttttgtaaatca

SEQ ID NO: 2976554 - DNA, 16 bp, Homo sapiens
tgaacaaaaactgtat

SEQ ID NO: 2976555 - DNA, 14 bp, Homo sapiens
tgaacaaagcagcc

SEQ ID NO: 2976556 - DNA, 15 bp, Homo sapiens
tgaacaaatggcctt

SEQ ID NO: 2976557 - DNA, 23 bp, Homo sapiens
tgaacaagcaaacccagacggct

SEQ ID NO: 2976558 - DNA, 23 bp, Homo sapiens
tgaacaagtgggccattagccag

SEQ ID NO: 2976559 - DNA, 19 bp, Homo sapiens
tgaacacaaactgtaaata

SEQ ID NO: 2976560 - DNA, 17 bp, Homo sapiens
tgaacacagcagaccta

SEQ ID NO: 2976561 - DNA, 20 bp, Homo sapiens
tgaacagaaaacattctgat

SEQ ID NO: 2976562 - DNA, 15 bp, Homo sapiens
tgaacagatgtaaat

SEQ ID NO: 2976563 - DNA, 23 bp, Homo sapiens
tgaacagcatggcactccctcca

SEQ ID NO: 2976564 - DNA, 21 bp, Homo sapiens
tgaacagcggctggacttgga

SEQ ID NO: 2976565 - DNA, 19 bp, Homo sapiens
tgaacagggcccaggcctg

SEQ ID NO: 2976566 - DNA, 23 bp, Homo sapiens
tgaacagggcccaggcctggagc

SEQ ID NO: 2976567 - DNA, 19 bp, Homo sapiens
tgaacagtgctctgcctct

SEQ ID NO: 2976568 - DNA, 23 bp, Homo sapiens
tgaaccaaattgcactgaagttt

SEQ ID NO: 2976569 - DNA, 16 bp, Homo sapiens
tgaaccaacccccatc

SEQ ID NO: 2976570 - DNA, 22 bp, Homo sapiens
tgaaccaggaatatttcctcca

SEQ ID NO: 2976571 - DNA, 23 bp, Homo sapiens
tgaaccaggaatatttcctccat

SEQ ID NO: 2976572 - DNA, 12 bp, Homo sapiens
tgaacccaggag

SEQ ID NO: 2976573 - DNA, 14 bp, Homo sapiens
tgaacccccatgat

SEQ ID NO: 2976574 - DNA, 17 bp, Homo sapiens
tgaacccgggaggcaga

SEQ ID NO: 2976575 - DNA, 19 bp, Homo sapiens
tgaacccgggggacagagg

SEQ ID NO: 2976576 - DNA, 20 bp, Homo sapiens
tgaacccgggggacagaggt

SEQ ID NO: 2976577 - DNA, 22 bp, Homo sapiens
tgaacctaggagtgccccattc

SEQ ID NO: 2976578 - DNA, 23 bp, Homo sapiens
tgaacctgaaaagggtcagaagg

SEQ ID NO: 2976579 - DNA, 12 bp, Homo sapiens
tgaacctgccct

SEQ ID NO: 2976580 - DNA, 14 bp, Homo sapiens
tgaacctgggaggt

SEQ ID NO: 2976581 - DNA, 17 bp, Homo sapiens
tgaacgtgccagcagcc

SEQ ID NO: 2976582 - DNA, 15 bp, Homo sapiens
tgaactaatttctgt

SEQ ID NO: 2976583 - DNA, 19 bp, Homo sapiens
tgaactcagccaagcacag

SEQ ID NO: 2976584 - DNA, 21 bp, Homo sapiens
tgaactcagccaagcacagtg

SEQ ID NO: 2976585 - DNA, 23 bp, Homo sapiens
tgaactcagccaagcacagtggt

SEQ ID NO: 2976586 - DNA, 18 bp, Homo sapiens
tgaactccttccccactt

SEQ ID NO: 2976587 - DNA, 18 bp, Homo sapiens
tgaactctcccctcccca

SEQ ID NO: 2976588 - DNA, 20 bp, Homo sapiens
tgaactctcccctccccatc

SEQ ID NO: 2976589 - DNA, 17 bp, Homo sapiens
tgaactctgcaactgaa

SEQ ID NO: 2976590 - DNA, 15 bp, Homo sapiens
tgaactcttcactct

SEQ ID NO: 2976591 - DNA, 12 bp, Homo sapiens
tgaactgagctt

SEQ ID NO: 2976592 - DNA, 19 bp, Homo sapiens
tgaactgatagttactgtt

SEQ ID NO: 2976593 - DNA, 12 bp, Homo sapiens
tgaactgattca

SEQ ID NO: 2976594 - DNA, 17 bp, Homo sapiens
tgaactgattcacatct

SEQ ID NO: 2976595 - DNA, 17 bp, Homo sapiens
tgaactggcttgtacat

SEQ ID NO: 2976596 - DNA, 22 bp, Homo sapiens
tgaactgggcgaatgtcttatt

SEQ ID NO: 2976597 - DNA, 14 bp, Homo sapiens
tgaactgtattatt

SEQ ID NO: 2976598 - DNA, 19 bp, Homo sapiens
tgaactgtattattgcaat

SEQ ID NO: 2976599 - DNA, 15 bp, Homo sapiens
tgaacttaaaatgaa

SEQ ID NO: 2976600 - DNA, 21 bp, Homo sapiens
tgaacttgaaatatcctgctt

SEQ ID NO: 2976601 - DNA, 11 bp, Homo sapiens
tgaacttgtca

SEQ ID NO: 2976602 - DNA, 12 bp, Homo sapiens
tgaactttggaa

SEQ ID NO: 2976603 - DNA, 14 bp, Homo sapiens
tgaactttgtcagt

SEQ ID NO: 2976604 - DNA, 18 bp, Homo sapiens
tgaactttgtcagtgttg

SEQ ID NO: 2976605 - DNA, 19 bp, Homo sapiens
tgaactttttaaagaagtg

SEQ ID NO: 2976606 - DNA, 15 bp, Homo sapiens
tgaagaaagagaagt

SEQ ID NO: 2976607 - DNA, 22 bp, Homo sapiens
tgaagaaagcctcagtgaaaca

SEQ ID NO: 2976608 - DNA, 20 bp, Homo sapiens
tgaagaaagggaggcccagc

SEQ ID NO: 2976609 - DNA, 20 bp, Homo sapiens
tgaagaaagggtgtttttct

SEQ ID NO: 2976610 - DNA, 19 bp, Homo sapiens
tgaagaaatactgcactta

SEQ ID NO: 2976611 - DNA, 18 bp, Homo sapiens
tgaagaaccgcattttga

SEQ ID NO: 2976612 - DNA, 10 bp, Homo sapiens
tgaagaagcc

SEQ ID NO: 2976613 - DNA, 16 bp, Homo sapiens
tgaagaagccctgttc

SEQ ID NO: 2976614 - DNA, 16 bp, Homo sapiens
tgaagaaggaagctgt

SEQ ID NO: 2976615 - DNA, 21 bp, Homo sapiens
tgaagaatataccatttcaaa

SEQ ID NO: 2976616 - DNA, 13 bp, Homo sapiens
tgaagacagaagt

SEQ ID NO: 2976617 - DNA, 14 bp, Homo sapiens
tgaagacagagcaa

SEQ ID NO: 2976618 - DNA, 19 bp, Homo sapiens
tgaagacattttttgctat

SEQ ID NO: 2976619 - DNA, 16 bp, Homo sapiens
tgaagaccaaatgata

SEQ ID NO: 2976620 - DNA, 13 bp, Homo sapiens
tgaagactccctg

SEQ ID NO: 2976621 - DNA, 13 bp, Homo sapiens
tgaagacttgccc

SEQ ID NO: 2976622 - DNA, 16 bp, Homo sapiens
tgaagagggacataag

SEQ ID NO: 2976623 - DNA, 20 bp, Homo sapiens
tgaagagggacataagataa

SEQ ID NO: 2976624 - DNA, 21 bp, Homo sapiens
tgaagagggacataagataaa

SEQ ID NO: 2976625 - DNA, 23 bp, Homo sapiens
tgaagagtcctctgaatgaacct

SEQ ID NO: 2976626 - DNA, 17 bp, Homo sapiens
tgaagatctttatattt

SEQ ID NO: 2976627 - DNA, 21 bp, Homo sapiens
tgaagatctttatatttcaat

SEQ ID NO: 2976628 - DNA, 15 bp, Homo sapiens
tgaagatgttgagaa

SEQ ID NO: 2976629 - DNA, 18 bp, Homo sapiens
tgaagattatttcattcg

SEQ ID NO: 2976630 - DNA, 21 bp, Homo sapiens
tgaagattctttcccaattca

SEQ ID NO: 2976631 - DNA, 16 bp, Homo sapiens
tgaagcaagctgtgtt

SEQ ID NO: 2976632 - DNA, 17 bp, Homo sapiens
tgaagcaagctgtgtta

SEQ ID NO: 2976633 - DNA, 18 bp, Homo sapiens
tgaagcaagctgtgttac

SEQ ID NO: 2976634 - DNA, 20 bp, Homo sapiens
tgaagcaaggcggtggactt

SEQ ID NO: 2976635 - DNA, 22 bp, Homo sapiens
tgaagcagatgcaaagaggcaa

SEQ ID NO: 2976636 - DNA, 15 bp, Homo sapiens
tgaagcagctctgcc

SEQ ID NO: 2976637 - DNA, 19 bp, Homo sapiens
tgaagcagctctgccttct

SEQ ID NO: 2976638 - DNA, 20 bp, Homo sapiens
tgaagcagtcttgctctgtt

SEQ ID NO: 2976639 - DNA, 19 bp, Homo sapiens
tgaagcataatttgtttaa

SEQ ID NO: 2976640 - DNA, 19 bp, Homo sapiens
tgaagccaattcagacagg

SEQ ID NO: 2976641 - DNA, 13 bp, Homo sapiens
tgaagccctttgc

SEQ ID NO: 2976642 - DNA, 15 bp, Homo sapiens
tgaagccctttgcct

SEQ ID NO: 2976643 - DNA, 21 bp, Homo sapiens
tgaagcggtcagactggaggt

SEQ ID NO: 2976644 - DNA, 17 bp, Homo sapiens
tgaagcgtgattttaaa

SEQ ID NO: 2976645 - DNA, 21 bp, Homo sapiens
tgagaaagccctgtcgggctt

SEQ ID NO: 2976646 - DNA, 23 bp, Homo sapiens
tgagaaaggacagagccagcggc

SEQ ID NO: 2976647 - DNA, 16 bp, Homo sapiens
tgagaaagggagagga

SEQ ID NO: 2976648 - DNA, 22 bp, Homo sapiens
tgagaaagggagaggaagagaa

SEQ ID NO: 2976649 - DNA, 15 bp, Homo sapiens
tgagaaatatggaca

SEQ ID NO: 2976650 - DNA, 21 bp, Homo sapiens
tgagaaatatggacacttaat

SEQ ID NO: 2976651 - DNA, 14 bp, Homo sapiens
tgagaaatgtaatg

SEQ ID NO: 2976652 - DNA, 23 bp, Homo sapiens
tgagaacatggtgtgtgtctctg

SEQ ID NO: 2976653 - DNA, 24 bp, Homo sapiens
tgagaacatggtgtgtgtctctga

SEQ ID NO: 2976654 - DNA, 12 bp, Homo sapiens
tgagaacctggg

SEQ ID NO: 2976655 - DNA, 21 bp, Homo sapiens
tgagaacctgggttgcagaca

SEQ ID NO: 2976656 - DNA, 22 bp, Homo sapiens
tgagaacctgggttgcagacag

SEQ ID NO: 2976657 - DNA, 21 bp, Homo sapiens
tgagaacgtaaagaacttttt

SEQ ID NO: 2976658 - DNA, 18 bp, Homo sapiens
tgagaactgaggagcgga

SEQ ID NO: 2976659 - DNA, 20 bp, Homo sapiens
tgagaactgcatatgtttcg

SEQ ID NO: 2976660 - DNA, 20 bp, Homo sapiens
tgagaactggttcttgcctt

SEQ ID NO: 2976661 - DNA, 18 bp, Homo sapiens
tgagaacttaagtggcta

SEQ ID NO: 2976662 - DNA, 14 bp, Homo sapiens
tgagaagaaaacat

SEQ ID NO: 2976663 - DNA, 23 bp, Homo sapiens
tgagaagaaaacatctattctct

SEQ ID NO: 2976664 - DNA, 23 bp, Homo sapiens
tgagaaggccaatagttttagat

SEQ ID NO: 2976665 - DNA, 12 bp, Homo sapiens
tgagaagtatac

SEQ ID NO: 2976666 - DNA, 17 bp, Homo sapiens
tgagaatcagatcattt

SEQ ID NO: 2976667 - DNA, 22 bp, Homo sapiens
tgagaatcccaaatttgattga

SEQ ID NO: 2976668 - DNA, 12 bp, Homo sapiens
tgagaatctacc

SEQ ID NO: 2976669 - DNA, 21 bp, Homo sapiens
tgagaatctacccccagatcc

SEQ ID NO: 2976670 - DNA, 19 bp, Homo sapiens
tgagaattgggcggctctg

SEQ ID NO: 2976671 - DNA, 17 bp, Homo sapiens
tgagacaaaagaaaaaa

SEQ ID NO: 2976672 - DNA, 14 bp, Homo sapiens
tgagacagaaacta

SEQ ID NO: 2976673 - DNA, 12 bp, Homo sapiens
tgagacagagtc

SEQ ID NO: 2976674 - DNA, 18 bp, Homo sapiens
tgagacagtgcacatgaa

SEQ ID NO: 2976675 - DNA, 13 bp, Homo sapiens
tgagacagtggga

SEQ ID NO: 2976676 - DNA, 21 bp, Homo sapiens
tgagacagtttactttgccaa

SEQ ID NO: 2976677 - DNA, 17 bp, Homo sapiens
tgagaccaggggaccag

SEQ ID NO: 2976678 - DNA, 18 bp, Homo sapiens
tgagacccagccctcatc

SEQ ID NO: 2976679 - DNA, 20 bp, Homo sapiens
tgagacccagccctcatccc

SEQ ID NO: 2976680 - DNA, 12 bp, Homo sapiens
tgagacccagga

SEQ ID NO: 2976681 - DNA, 13 bp, Homo sapiens
tgagacccaggac

SEQ ID NO: 2976682 - DNA, 16 bp, Homo sapiens
tgagacccaggactcc

SEQ ID NO: 2976683 - DNA, 15 bp, Homo sapiens
tgagaccctgtctca

SEQ ID NO: 2976684 - DNA, 14 bp, Homo sapiens
tgagacctcagcca

SEQ ID NO: 2976685 - DNA, 23 bp, Homo sapiens
tgagacgaatgccattggaacct

SEQ ID NO: 2976686 - DNA, 14 bp, Homo sapiens
tgagacggtgtctc

SEQ ID NO: 2976687 - DNA, 17 bp, Homo sapiens
tgagactcagtgcagat

SEQ ID NO: 2976688 - DNA, 18 bp, Homo sapiens
tgagactcagtgcagatg

SEQ ID NO: 2976689 - DNA, 13 bp, Homo sapiens
tgagactccatct

SEQ ID NO: 2976690 - DNA, 14 bp, Homo sapiens
tgagactccatctc

SEQ ID NO: 2976691 - DNA, 12 bp, Homo sapiens
tgagactcttaa

SEQ ID NO: 2976692 - DNA, 21 bp, Homo sapiens
tgagactgatccctggccact

SEQ ID NO: 2976693 - DNA, 22 bp, Homo sapiens
tgagactgatccctggccactg

SEQ ID NO: 2976694 - DNA, 17 bp, Homo sapiens
tgagacttgccttccta

SEQ ID NO: 2976695 - DNA, 22 bp, Homo sapiens
tgagagaaaatactatttcaag

SEQ ID NO: 2976696 - DNA, 18 bp, Homo sapiens
tgagagacagtaacacaa

SEQ ID NO: 2976697 - DNA, 20 bp, Homo sapiens
tgagagacccaaggaggaaa

SEQ ID NO: 2976698 - DNA, 18 bp, Homo sapiens
tgagagacggtgtcttgt

SEQ ID NO: 2976699 - DNA, 14 bp, Homo sapiens
tgagagcacccact

SEQ ID NO: 2976700 - DNA, 17 bp, Homo sapiens
tgagagctttctgcctt

SEQ ID NO: 2976701 - DNA, 22 bp, Homo sapiens
tgagagctttctgccttagcct

SEQ ID NO: 2976702 - DNA, 20 bp, Homo sapiens
tgagaggaggacttggttga

SEQ ID NO: 2976703 - DNA, 15 bp, Homo sapiens
tgagaggggagggag

SEQ ID NO: 2976704 - DNA, 19 bp, Homo sapiens
tgagagtatattatgtatt

SEQ ID NO: 2976705 - DNA, 22 bp, Homo sapiens
tgagagtgtcttcacggcagga

SEQ ID NO: 2976706 - DNA, 16 bp, Homo sapiens
tgagagtgttcctgag

SEQ ID NO: 2976707 - DNA, 22 bp, Homo sapiens
tgagagttcgtgaagagggaag

SEQ ID NO: 2976708 - DNA, 15 bp, Homo sapiens
tgagataacttcctt

SEQ ID NO: 2976709 - DNA, 14 bp, Homo sapiens
tgagatacatacag

SEQ ID NO: 2976710 - DNA, 16 bp, Homo sapiens
tgagatagcattgtga

SEQ ID NO: 2976711 - DNA, 18 bp, Homo sapiens
tgagatagcattgtgaac

SEQ ID NO: 2976712 - DNA, 19 bp, Homo sapiens
tgagatagcattgtgaact

SEQ ID NO: 2976713 - DNA, 15 bp, Homo sapiens
tgagatattaaattc

SEQ ID NO: 2976714 - DNA, 18 bp, Homo sapiens
tgagatcgtgccactgca

SEQ ID NO: 2976715 - DNA, 20 bp, Homo sapiens
tgagatcgtgccactgcact

SEQ ID NO: 2976716 - DNA, 23 bp, Homo sapiens
tgagatctgcacagtcagaagga

SEQ ID NO: 2976717 - DNA, 15 bp, Homo sapiens
tgagatgatttgtac

SEQ ID NO: 2976718 - DNA, 17 bp, Homo sapiens
tgagatgatttgtactt

SEQ ID NO: 2976719 - DNA, 16 bp, Homo sapiens
tgagatgcagctggaa

SEQ ID NO: 2976720 - DNA, 16 bp, Homo sapiens
tgagattctgaagtat

SEQ ID NO: 2976721 - DNA, 17 bp, Homo sapiens
tgagattctgaagtatg

SEQ ID NO: 2976722 - DNA, 22 bp, Homo sapiens
tgagatttaagttcctgctgcc

SEQ ID NO: 2976723 - DNA, 18 bp, Homo sapiens
tgagatttcttaaatctt

SEQ ID NO: 2976724 - DNA, 22 bp, Homo sapiens
tgagatttttaaaaaatatttt

SEQ ID NO: 2976725 - DNA, 20 bp, Homo sapiens
tgagatttttgttttccact

SEQ ID NO: 2976726 - DNA, 23 bp, Homo sapiens
tgagcaaagcatcggtcatgtgt

SEQ ID NO: 2976727 - DNA, 17 bp, Homo sapiens
tgagcaatgtataaccc

SEQ ID NO: 2976728 - DNA, 22 bp, Homo sapiens
tgagcacaactttaagaggaca

SEQ ID NO: 2976729 - DNA, 13 bp, Homo sapiens
tgagcaccagggg

SEQ ID NO: 2976730 - DNA, 21 bp, Homo sapiens
tgagcaccttacagatatttt

SEQ ID NO: 2976731 - DNA, 20 bp, Homo sapiens
tgagcactcctgatttttat

SEQ ID NO: 2976732 - DNA, 15 bp, Homo sapiens
tgagcagaagactat

SEQ ID NO: 2976733 - DNA, 19 bp, Homo sapiens
tgagcagaagactatttac

SEQ ID NO: 2976734 - DNA, 15 bp, Homo sapiens
tgagcagtccctgct

SEQ ID NO: 2976735 - DNA, 17 bp, Homo sapiens
tgagcagtctacttctg

SEQ ID NO: 2976736 - DNA, 18 bp, Homo sapiens
tgagcagtctacttctgt

SEQ ID NO: 2976737 - DNA, 12 bp, Homo sapiens
tgagcatcacag

SEQ ID NO: 2976738 - DNA, 15 bp, Homo sapiens
tgagcatcacagaat

SEQ ID NO: 2976739 - DNA, 16 bp, Homo sapiens
tgagcatctcaaatgt

SEQ ID NO: 2976740 - DNA, 18 bp, Homo sapiens
tgagcatctcaaatgttt

SEQ ID NO: 2976741 - DNA, 19 bp, Homo sapiens
tgagcatggccagactatt

SEQ ID NO: 2976742 - DNA, 14 bp, Homo sapiens
tgagcattcaggca

SEQ ID NO: 2976743 - DNA, 20 bp, Homo sapiens
tgagcattggatacagcagt

SEQ ID NO: 2976744 - DNA, 13 bp, Homo sapiens
tgagccaaagcca

SEQ ID NO: 2976745 - DNA, 21 bp, Homo sapiens
tgagccagccaggccctgcca

SEQ ID NO: 2976746 - DNA, 22 bp, Homo sapiens
tgagccagccaggccctgccag

SEQ ID NO: 2976747 - DNA, 21 bp, Homo sapiens
tgagccaggctagctggagcc

SEQ ID NO: 2976748 - DNA, 22 bp, Homo sapiens
tgagccataggtctaaatagga

SEQ ID NO: 2976749 - DNA, 21 bp, Homo sapiens
tgagccatgatttcccactgc

SEQ ID NO: 2976750 - DNA, 22 bp, Homo sapiens
tgagccatgatttcccactgca

SEQ ID NO: 2976751 - DNA, 12 bp, Homo sapiens
tgagccccatct

SEQ ID NO: 2976752 - DNA, 14 bp, Homo sapiens
tgagccccatcttc

SEQ ID NO: 2976753 - DNA, 21 bp, Homo sapiens
tgagcccctgtctagagaggg

SEQ ID NO: 2976754 - DNA, 12 bp, Homo sapiens
tgagccctcaga

SEQ ID NO: 2976755 - DNA, 17 bp, Homo sapiens
tgagccctcagaaccct

SEQ ID NO: 2976756 - DNA, 20 bp, Homo sapiens
tgagccctcagaacccttgg

SEQ ID NO: 2976757 - DNA, 13 bp, Homo sapiens
tgagccctctagg

SEQ ID NO: 2976758 - DNA, 18 bp, Homo sapiens
tgagccctctagggcagg

SEQ ID NO: 2976759 - DNA, 21 bp, Homo sapiens
tgagccgcatcttctccatct

SEQ ID NO: 2976760 - DNA, 22 bp, Homo sapiens
tgagccgccgcgcctggcctag

SEQ ID NO: 2976761 - DNA, 16 bp, Homo sapiens
tgagcctagccctggg

SEQ ID NO: 2976762 - DNA, 17 bp, Homo sapiens
tgagcctctgctcccca

SEQ ID NO: 2976763 - DNA, 12 bp, Homo sapiens
tgagcctctttg

SEQ ID NO: 2976764 - DNA, 19 bp, Homo sapiens
tgagcctgtgaccttggga

SEQ ID NO: 2976765 - DNA, 12 bp, Homo sapiens
tgagcctgttta

SEQ ID NO: 2976766 - DNA, 18 bp, Homo sapiens
tgagccttgctgccaagt

SEQ ID NO: 2976767 - DNA, 17 bp, Homo sapiens
tgagcgacaaagatgat

SEQ ID NO: 2976768 - DNA, 18 bp, Homo sapiens
tgagcgaggaaaaacaac

SEQ ID NO: 2976769 - DNA, 21 bp, Homo sapiens
tgagcgaggaaaaacaacaaa

SEQ ID NO: 2976770 - DNA, 16 bp, Homo sapiens
tgagcgagtggatgct

SEQ ID NO: 2976771 - DNA, 20 bp, Homo sapiens
tgagcgagtggatgctgtgc

SEQ ID NO: 2976772 - DNA, 13 bp, Homo sapiens
tgagcgcaagcca

SEQ ID NO: 2976773 - DNA, 18 bp, Homo sapiens
tgagcgcaagccacagcc

SEQ ID NO: 2976774 - DNA, 20 bp, Homo sapiens
tgagcgcaagccacagcctg

SEQ ID NO: 2976775 - DNA, 19 bp, Homo sapiens
tgagcggccgcagagactg

SEQ ID NO: 2976776 - DNA, 16 bp, Homo sapiens
tgcagttcttgagttg

SEQ ID NO: 2976777 - DNA, 19 bp, Homo sapiens
tgcagtttaagagcagaac

SEQ ID NO: 2976778 - DNA, 16 bp, Homo sapiens
tgcagtttgaaattct

SEQ ID NO: 2976779 - DNA, 19 bp, Homo sapiens
tgcagtttgaaattctgaa

SEQ ID NO: 2976780 - DNA, 22 bp, Homo sapiens
tgcagtttgaaattctgaattt

SEQ ID NO: 2976781 - DNA, 23 bp, Homo sapiens
tgcagtttgaaattctgaatttg

SEQ ID NO: 2976782 - DNA, 14 bp, Homo sapiens
tgcagttttgtaag

SEQ ID NO: 2976783 - DNA, 23 bp, Homo sapiens
tgcataaaagggtcaaacctgta

SEQ ID NO: 2976784 - DNA, 17 bp, Homo sapiens
tgcataaagtcagtgcc

SEQ ID NO: 2976785 - DNA, 18 bp, Homo sapiens
tgcataacaaattctgaa

SEQ ID NO: 2976786 - DNA, 14 bp, Homo sapiens
tgcataagtgaaaa

SEQ ID NO: 2976787 - DNA, 16 bp, Homo sapiens
tgcatacacacacaca

SEQ ID NO: 2976788 - DNA, 22 bp, Homo sapiens
tgcatacacacacacacacagc

SEQ ID NO: 2976789 - DNA, 23 bp, Homo sapiens
tgcatacacacacacacacagcc

SEQ ID NO: 2976790 - DNA, 14 bp, Homo sapiens
tgcatacttcaaaa

SEQ ID NO: 2976791 - DNA, 18 bp, Homo sapiens
tgcatagaacaaaagatt

SEQ ID NO: 2976792 - DNA, 14 bp, Homo sapiens
tgcatagcagctgc

SEQ ID NO: 2976793 - DNA, 16 bp, Homo sapiens
tgcatagcgtcctgcc

SEQ ID NO: 2976794 - DNA, 20 bp, Homo sapiens
tgcatagcgtcctgccctgc

SEQ ID NO: 2976795 - DNA, 16 bp, Homo sapiens
tgcatatagaaaacaa

SEQ ID NO: 2976796 - DNA, 20 bp, Homo sapiens
tgcatatctctagtccctgt

SEQ ID NO: 2976797 - DNA, 19 bp, Homo sapiens
tgcatatgttgaatacttt

SEQ ID NO: 2976798 - DNA, 22 bp, Homo sapiens
tgcatatttatccaaaatgtgt

SEQ ID NO: 2976799 - DNA, 13 bp, Homo sapiens
tgcatcaaggggt

SEQ ID NO: 2976800 - DNA, 13 bp, Homo sapiens
tgcatcacccagg

SEQ ID NO: 2976801 - DNA, 21 bp, Homo sapiens
tgcatcatagaacagaaatat

SEQ ID NO: 2976802 - DNA, 22 bp, Homo sapiens
tgcatcatagaacagaaatata

SEQ ID NO: 2976803 - DNA, 13 bp, Homo sapiens
tgcatccaactcc

SEQ ID NO: 2976804 - DNA, 17 bp, Homo sapiens
tgcatccaactccagga

SEQ ID NO: 2976805 - DNA, 19 bp, Homo sapiens
tgcatccattcctcaggga

SEQ ID NO: 2976806 - DNA, 17 bp, Homo sapiens
tgcatcccccccacctc

SEQ ID NO: 2976807 - DNA, 19 bp, Homo sapiens
tgcatccgtagttccctga

SEQ ID NO: 2976808 - DNA, 20 bp, Homo sapiens
tgcatccgtagttccctgaa

SEQ ID NO: 2976809 - DNA, 18 bp, Homo sapiens
tgcatctcccagataatg

SEQ ID NO: 2976810 - DNA, 18 bp, Homo sapiens
tgcatctgaccagcagcg

SEQ ID NO: 2976811 - DNA, 22 bp, Homo sapiens
tgcatctgaccagcagcgcctt

SEQ ID NO: 2976812 - DNA, 18 bp, Homo sapiens
tgcatcttactgaaggta

SEQ ID NO: 2976813 - DNA, 20 bp, Homo sapiens
tgcatcttggggacatctct

SEQ ID NO: 2976814 - DNA, 19 bp, Homo sapiens
tgcatgcactgttccccct

SEQ ID NO: 2976815 - DNA, 21 bp, Homo sapiens
tgcatgcaggtctccatgaag

SEQ ID NO: 2976816 - DNA, 17 bp, Homo sapiens
tgcatgctctctgcagc

SEQ ID NO: 2976817 - DNA, 19 bp, Homo sapiens
tgcatgctctctgcagcca

SEQ ID NO: 2976818 - DNA, 16 bp, Homo sapiens
tgcatggtggcaccag

SEQ ID NO: 2976819 - DNA, 15 bp, Homo sapiens
tgcatggtggccaga

SEQ ID NO: 2976820 - DNA, 19 bp, Homo sapiens
tgcatgtaaaatcttcagc

SEQ ID NO: 2976821 - DNA, 21 bp, Homo sapiens
tgcatgtaaaatcttcagctg

SEQ ID NO: 2976822 - DNA, 23 bp, Homo sapiens
tgcatgtaaaatcttcagctggt

SEQ ID NO: 2976823 - DNA, 14 bp, Homo sapiens
tgcatgtatgtctt

SEQ ID NO: 2976824 - DNA, 16 bp, Homo sapiens
tgcatgtatgtcttgg

SEQ ID NO: 2976825 - DNA, 13 bp, Homo sapiens
tgcatgtctaatt

SEQ ID NO: 2976826 - DNA, 20 bp, Homo sapiens
tgcatgtgactctgaagctg

SEQ ID NO: 2976827 - DNA, 15 bp, Homo sapiens
tgcatgtggcttctc

SEQ ID NO: 2976828 - DNA, 23 bp, Homo sapiens
tgcatgtggcttctctgtctctg

SEQ ID NO: 2976829 - DNA, 13 bp, Homo sapiens
tgcatgtgtatat

SEQ ID NO: 2976830 - DNA, 17 bp, Homo sapiens
tgcatgtgttttttccc

SEQ ID NO: 2976831 - DNA, 18 bp, Homo sapiens
tgcatgttgaccatgtct

SEQ ID NO: 2976832 - DNA, 13 bp, Homo sapiens
tgcattaaattca

SEQ ID NO: 2976833 - DNA, 16 bp, Homo sapiens
tgcattaaattcacaa

SEQ ID NO: 2976834 - DNA, 19 bp, Homo sapiens
tgcattaaattcacaaact

SEQ ID NO: 2976835 - DNA, 17 bp, Homo sapiens
tgcattaataatagtta

SEQ ID NO: 2976836 - DNA, 19 bp, Homo sapiens
tgcattagggatgcctcct

SEQ ID NO: 2976837 - DNA, 21 bp, Homo sapiens
tgcattattgacgaactggct

SEQ ID NO: 2976838 - DNA, 23 bp, Homo sapiens
tgcattcctgatatgatttaaaa

SEQ ID NO: 2976839 - DNA, 15 bp, Homo sapiens
tgcattcctgtaact

SEQ ID NO: 2976840 - DNA, 22 bp, Homo sapiens
tgcattctatcgttattataaa

SEQ ID NO: 2976841 - DNA, 23 bp, Homo sapiens
tgcattctatcgttattataaat

SEQ ID NO: 2976842 - DNA, 19 bp, Homo sapiens
tgcattctgcctctctagg

SEQ ID NO: 2976843 - DNA, 12 bp, Homo sapiens
tgcattctggag

SEQ ID NO: 2976844 - DNA, 17 bp, Homo sapiens
tgcattctggagacaga

SEQ ID NO: 2976845 - DNA, 19 bp, Homo sapiens
tgcattcttaacaaactct

SEQ ID NO: 2976846 - DNA, 15 bp, Homo sapiens
tgcattgaacacaaa

SEQ ID NO: 2976847 - DNA, 18 bp, Homo sapiens
tgcattgaacacaaactg

SEQ ID NO: 2976848 - DNA, 19 bp, Homo sapiens
tgcattgaacacaaactgt

SEQ ID NO: 2976849 - DNA, 19 bp, Homo sapiens
tgcattgaatttagtcatt

SEQ ID NO: 2976850 - DNA, 17 bp, Homo sapiens
tgcattgattcagtatt

SEQ ID NO: 2976851 - DNA, 15 bp, Homo sapiens
tgcattgggagcatc

SEQ ID NO: 2976852 - DNA, 18 bp, Homo sapiens
tgcattgtatcgatgtta

SEQ ID NO: 2976853 - DNA, 13 bp, Homo sapiens
tgcattgtttctg

SEQ ID NO: 2976854 - DNA, 14 bp, Homo sapiens
tgcattgtttctgt

SEQ ID NO: 2976855 - DNA, 16 bp, Homo sapiens
tgcatttaaatacagt

SEQ ID NO: 2976856 - DNA, 18 bp, Homo sapiens
tgcatttgggtggttttt

SEQ ID NO: 2976857 - DNA, 19 bp, Homo sapiens
tgcattttgatattgctgt

SEQ ID NO: 2976858 - DNA, 14 bp, Homo sapiens
tgcattttgtgtac

SEQ ID NO: 2976859 - DNA, 17 bp, Homo sapiens
tgcattttgtgtacagt

SEQ ID NO: 2976860 - DNA, 19 bp, Homo sapiens
tgcattttgtgtacagtaa

SEQ ID NO: 2976861 - DNA, 17 bp, Homo sapiens
tgcatttttaaaggaca

SEQ ID NO: 2976862 - DNA, 17 bp, Homo sapiens
tgcatttttcaagagaa

SEQ ID NO: 2976863 - DNA, 20 bp, Homo sapiens
tgcatttttggatcattttt

SEQ ID NO: 2976864 - DNA, 20 bp, Homo sapiens
tgccaaaaaggatacataat

SEQ ID NO: 2976865 - DNA, 16 bp, Homo sapiens
tgccaaagccattctc

SEQ ID NO: 2976866 - DNA, 13 bp, Homo sapiens
tgccaaataaatg

SEQ ID NO: 2976867 - DNA, 15 bp, Homo sapiens
tgccaaataaatgct

SEQ ID NO: 2976868 - DNA, 19 bp, Homo sapiens
tgccaaatagccccagact

SEQ ID NO: 2976869 - DNA, 20 bp, Homo sapiens
tgccaaatagccccagactg

SEQ ID NO: 2976870 - DNA, 21 bp, Homo sapiens
tgccaacaatcctagtgcttt

SEQ ID NO: 2976871 - DNA, 18 bp, Homo sapiens
tgccaaccccacccagct

SEQ ID NO: 2976872 - DNA, 16 bp, Homo sapiens
tgccaactgtggctgg

SEQ ID NO: 2976873 - DNA, 17 bp, Homo sapiens
tgccaactgttggaatt

SEQ ID NO: 2976874 - DNA, 14 bp, Homo sapiens
tgccaagaaaatga

SEQ ID NO: 2976875 - DNA, 15 bp, Homo sapiens
tgccaagtcctgcct

SEQ ID NO: 2976876 - DNA, 15 bp, Homo sapiens
tgccaagtgcctgct

SEQ ID NO: 2976877 - DNA, 18 bp, Homo sapiens
tgccaatattaaatctgc

SEQ ID NO: 2976878 - DNA, 17 bp, Homo sapiens
tgccaatcttgttttaa

SEQ ID NO: 2976879 - DNA, 13 bp, Homo sapiens
tgccaatgttgtg

SEQ ID NO: 2976880 - DNA, 19 bp, Homo sapiens
tgccaattacggtgtacag

SEQ ID NO: 2976881 - DNA, 19 bp, Homo sapiens
tgccacaacgcctggctaa

SEQ ID NO: 2976882 - DNA, 15 bp, Homo sapiens
tgccacaaggacttc

SEQ ID NO: 2976883 - DNA, 22 bp, Homo sapiens
tgccacacaaggatagatgctg

SEQ ID NO: 2976884 - DNA, 17 bp, Homo sapiens
tgccacagagtgtagcc

SEQ ID NO: 2976885 - DNA, 17 bp, Homo sapiens
tgccacagtatattttt

SEQ ID NO: 2976886 - DNA, 15 bp, Homo sapiens
tgccaccagcatcca

SEQ ID NO: 2976887 - DNA, 17 bp, Homo sapiens
tgccacccacctccctg

SEQ ID NO: 2976888 - DNA, 13 bp, Homo sapiens
tgccacccccagc

SEQ ID NO: 2976889 - DNA, 21 bp, Homo sapiens
tgccacccccagccctggccc

SEQ ID NO: 2976890 - DNA, 20 bp, Homo sapiens
tgccaccgactgcccagcca

SEQ ID NO: 2976891 - DNA, 13 bp, Homo sapiens
tgccactcaccct

SEQ ID NO: 2976892 - DNA, 19 bp, Homo sapiens
tgccactcacccttcctgg

SEQ ID NO: 2976893 - DNA, 22 bp, Homo sapiens
tgccactcacccttcctggccc

SEQ ID NO: 2976894 - DNA, 15 bp, Homo sapiens
tgccactcctccctc

SEQ ID NO: 2976895 - DNA, 18 bp, Homo sapiens
tgccactctgctgcctgt

SEQ ID NO: 2976896 - DNA, 14 bp, Homo sapiens
tgccactttccacc

SEQ ID NO: 2976897 - DNA, 15 bp, Homo sapiens
tgccactttccacca

SEQ ID NO: 2976898 - DNA, 18 bp, Homo sapiens
tgccagaatataatgtgc

SEQ ID NO: 2976899 - DNA, 17 bp, Homo sapiens
tgccagaccccctggag

SEQ ID NO: 2976900 - DNA, 22 bp, Homo sapiens
tgccagagaaagttggtgctgc

SEQ ID NO: 2976901 - DNA, 17 bp, Homo sapiens
tgccagagataaactaa

SEQ ID NO: 2976902 - DNA, 17 bp, Homo sapiens
tgccagaggatgctctt

SEQ ID NO: 2976903 - DNA, 22 bp, Homo sapiens
tgccagaggatgctctttccca

SEQ ID NO: 2976904 - DNA, 23 bp, Homo sapiens
tgccagaggatgctctttcccag

SEQ ID NO: 2976905 - DNA, 15 bp, Homo sapiens
tgccagatgctgcag

SEQ ID NO: 2976906 - DNA, 22 bp, Homo sapiens
tgccagcacccagtcctctgcc

SEQ ID NO: 2976907 - DNA, 13 bp, Homo sapiens
tgccagcagcctc

SEQ ID NO: 2976908 - DNA, 17 bp, Homo sapiens
tgctaagaatatttgaa

SEQ ID NO: 2976909 - DNA, 19 bp, Homo sapiens
tgctaaggagaagctaata

SEQ ID NO: 2976910 - DNA, 13 bp, Homo sapiens
tgctaaggttcta

SEQ ID NO: 2976911 - DNA, 18 bp, Homo sapiens
tgctaaggttctaaggcc

SEQ ID NO: 2976912 - DNA, 16 bp, Homo sapiens
tgctaatattaaaagt

SEQ ID NO: 2976913 - DNA, 15 bp, Homo sapiens
tgctaattgctgttg

SEQ ID NO: 2976914 - DNA, 18 bp, Homo sapiens
tgctaattgctgttgaaa

SEQ ID NO: 2976915 - DNA, 12 bp, Homo sapiens
tgctacaaagaa

SEQ ID NO: 2976916 - DNA, 17 bp, Homo sapiens
tgctacaaagaagacat

SEQ ID NO: 2976917 - DNA, 18 bp, Homo sapiens
tgctacaaagaagacatg

SEQ ID NO: 2976918 - DNA, 21 bp, Homo sapiens
tgctacaaagaagacatgttt

SEQ ID NO: 2976919 - DNA, 14 bp, Homo sapiens
tgctacagaaaata

SEQ ID NO: 2976920 - DNA, 15 bp, Homo sapiens
tgctacagagaaaat

SEQ ID NO: 2976921 - DNA, 13 bp, Homo sapiens
tgctacccagcca

SEQ ID NO: 2976922 - DNA, 17 bp, Homo sapiens
tgctacctttcaaagct

SEQ ID NO: 2976923 - DNA, 18 bp, Homo sapiens
tgctacctttcaaagctt

SEQ ID NO: 2976924 - DNA, 16 bp, Homo sapiens
tgctacgcctgcatgt

SEQ ID NO: 2976925 - DNA, 19 bp, Homo sapiens
tgctactagaaataaataa

SEQ ID NO: 2976926 - DNA, 14 bp, Homo sapiens
tgctactagctctt

SEQ ID NO: 2976927 - DNA, 20 bp, Homo sapiens
tgctactgattgtttcattg

SEQ ID NO: 2976928 - DNA, 19 bp, Homo sapiens
tgctacttcccactgtatg

SEQ ID NO: 2976929 - DNA, 14 bp, Homo sapiens
tgctacttgctctg

SEQ ID NO: 2976930 - DNA, 18 bp, Homo sapiens
tgctactttgtatcctct

SEQ ID NO: 2976931 - DNA, 14 bp, Homo sapiens
tgctagaaattttc

SEQ ID NO: 2976932 - DNA, 14 bp, Homo sapiens
tgctagagcagaca

SEQ ID NO: 2976933 - DNA, 18 bp, Homo sapiens
tgctagcgcgttgcctgt

SEQ ID NO: 2976934 - DNA, 17 bp, Homo sapiens
tgctagtcactggcagc

SEQ ID NO: 2976935 - DNA, 19 bp, Homo sapiens
tgctataaaattaacagta

SEQ ID NO: 2976936 - DNA, 20 bp, Homo sapiens
tgctataaagctagatgctt

SEQ ID NO: 2976937 - DNA, 19 bp, Homo sapiens
tgctatactggaaatgtaa

SEQ ID NO: 2976938 - DNA, 14 bp, Homo sapiens
tgctatagtatttg

SEQ ID NO: 2976939 - DNA, 16 bp, Homo sapiens
tgctatattgcccagg

SEQ ID NO: 2976940 - DNA, 22 bp, Homo sapiens
tgctatccatttctcatgtttt

SEQ ID NO: 2976941 - DNA, 17 bp, Homo sapiens
tgctatcggcagatgat

SEQ ID NO: 2976942 - DNA, 17 bp, Homo sapiens
tgctatctactaagttt

SEQ ID NO: 2976943 - DNA, 17 bp, Homo sapiens
tgctatcttaattttgg

SEQ ID NO: 2976944 - DNA, 16 bp, Homo sapiens
tgctatgaaaggaata

SEQ ID NO: 2976945 - DNA, 13 bp, Homo sapiens
tgctatgtaaggg

SEQ ID NO: 2976946 - DNA, 16 bp, Homo sapiens
tgctatgtgcacagcc

SEQ ID NO: 2976947 - DNA, 22 bp, Homo sapiens
tgctatgtgtttggtttataat

SEQ ID NO: 2976948 - DNA, 19 bp, Homo sapiens
tgctattatactgttatcc

SEQ ID NO: 2976949 - DNA, 22 bp, Homo sapiens
tgctattgtaaggtctttgtaa

SEQ ID NO: 2976950 - DNA, 20 bp, Homo sapiens
tgctatttcagccaatctgg

SEQ ID NO: 2976951 - DNA, 17 bp, Homo sapiens
tgctcaaagatgtaatg

SEQ ID NO: 2976952 - DNA, 16 bp, Homo sapiens
tgctcaagcagcaaaa

SEQ ID NO: 2976953 - DNA, 18 bp, Homo sapiens
tgctcaagcagcaaaatc

SEQ ID NO: 2976954 - DNA, 23 bp, Homo sapiens
tgctcaagcagcaaaatccttac

SEQ ID NO: 2976955 - DNA, 20 bp, Homo sapiens
tgctcaataaatatttgttt

SEQ ID NO: 2976956 - DNA, 15 bp, Homo sapiens
tgctcaatttcagca

SEQ ID NO: 2976957 - DNA, 13 bp, Homo sapiens
tgctcacctgggg

SEQ ID NO: 2976958 - DNA, 23 bp, Homo sapiens
tgctcacctggggtgtgggaggc

SEQ ID NO: 2976959 - DNA, 15 bp, Homo sapiens
tgctcactttaaacc

SEQ ID NO: 2976960 - DNA, 17 bp, Homo sapiens
tgctcaggaattgaaga

SEQ ID NO: 2976961 - DNA, 14 bp, Homo sapiens
tgctcaggactcag

SEQ ID NO: 2976962 - DNA, 17 bp, Homo sapiens
tgctcaggtacttgtaa

SEQ ID NO: 2976963 - DNA, 23 bp, Homo sapiens
tgctcagtgggtaaaattagatg

SEQ ID NO: 2976964 - DNA, 15 bp, Homo sapiens
tgctcagttgtagaa

SEQ ID NO: 2976965 - DNA, 21 bp, Homo sapiens
tgctcagttgtagaatgtatt

SEQ ID NO: 2976966 - DNA, 15 bp, Homo sapiens
tgctcatcattctct

SEQ ID NO: 2976967 - DNA, 17 bp, Homo sapiens
tgctcatcattctctgt

SEQ ID NO: 2976968 - DNA, 21 bp, Homo sapiens
tgctcatcattctctgtctca

SEQ ID NO: 2976969 - DNA, 11 bp, Homo sapiens
tgctcatctga

SEQ ID NO: 2976970 - DNA, 19 bp, Homo sapiens
tgctcatgggctgtgtgat

SEQ ID NO: 2976971 - DNA, 13 bp, Homo sapiens
tgctccaacctga

SEQ ID NO: 2976972 - DNA, 16 bp, Homo sapiens
tgctccaacctgaagg

SEQ ID NO: 2976973 - DNA, 15 bp, Homo sapiens
tgctccaagattcta

SEQ ID NO: 2976974 - DNA, 21 bp, Homo sapiens
tgctccacctttcagcccacg

SEQ ID NO: 2976975 - DNA, 12 bp, Homo sapiens
tgctccagacct

SEQ ID NO: 2976976 - DNA, 21 bp, Homo sapiens
tgctccagacctgatcctgga

SEQ ID NO: 2976977 - DNA, 17 bp, Homo sapiens
tgctcccaaaacatttt

SEQ ID NO: 2976978 - DNA, 22 bp, Homo sapiens
tgctcccaactcccttctgctt

SEQ ID NO: 2976979 - DNA, 23 bp, Homo sapiens
tgctcccaactcccttctgcttg

SEQ ID NO: 2976980 - DNA, 18 bp, Homo sapiens
tgctcccacacttgtgcc

SEQ ID NO: 2976981 - DNA, 19 bp, Homo sapiens
tgctcccacacttgtgcca

SEQ ID NO: 2976982 - DNA, 20 bp, Homo sapiens
tgctcccacacttgtgccag

SEQ ID NO: 2976983 - DNA, 16 bp, Homo sapiens
tgctcccccaccccct

SEQ ID NO: 2976984 - DNA, 15 bp, Homo sapiens
tgctcccctctgaaa

SEQ ID NO: 2976985 - DNA, 15 bp, Homo sapiens
tgctccctctccccc

SEQ ID NO: 2976986 - DNA, 14 bp, Homo sapiens
tgctccctctgtca

SEQ ID NO: 2976987 - DNA, 12 bp, Homo sapiens
tgctccctttta

SEQ ID NO: 2976988 - DNA, 19 bp, Homo sapiens
tgctccgaggactggactg

SEQ ID NO: 2976989 - DNA, 20 bp, Homo sapiens
tgctccgaggactggactgt

SEQ ID NO: 2976990 - DNA, 13 bp, Homo sapiens
tgctccgtgcttg

SEQ ID NO: 2976991 - DNA, 11 bp, Homo sapiens
tgctcctccag

SEQ ID NO: 2976992 - DNA, 15 bp, Homo sapiens
tgctcctgcccagcc

SEQ ID NO: 2976993 - DNA, 17 bp, Homo sapiens
tgctcctggccttgctg

SEQ ID NO: 2976994 - DNA, 19 bp, Homo sapiens
tgctcctggccttgctgac

SEQ ID NO: 2976995 - DNA, 12 bp, Homo sapiens
tgctcctgggga

SEQ ID NO: 2976996 - DNA, 13 bp, Homo sapiens
tgctcctggggag

SEQ ID NO: 2976997 - DNA, 15 bp, Homo sapiens
tgctccttgggccct

SEQ ID NO: 2976998 - DNA, 18 bp, Homo sapiens
tgctccttgggccctttg

SEQ ID NO: 2976999 - DNA, 14 bp, Homo sapiens
tgctcctttcccct

SEQ ID NO: 2977000 - DNA, 19 bp, Homo sapiens
tgctcgcccaggaaggcct

SEQ ID NO: 2977001 - DNA, 14 bp, Homo sapiens
tgctcgccccagca

SEQ ID NO: 2977002 - DNA, 16 bp, Homo sapiens
tgctcgccccagcagg

SEQ ID NO: 2977003 - DNA, 13 bp, Homo sapiens
tgctcgccctgcg

SEQ ID NO: 2977004 - DNA, 14 bp, Homo sapiens
tgctcgccctgcgg

SEQ ID NO: 2977005 - DNA, 19 bp, Homo sapiens
tgctctagatgagctgggc

SEQ ID NO: 2977006 - DNA, 21 bp, Homo sapiens
tgctctagatgagctgggccg

SEQ ID NO: 2977007 - DNA, 19 bp, Homo sapiens
tgctctaggaagacatttt

SEQ ID NO: 2977008 - DNA, 13 bp, Homo sapiens
tgctctagtgcct

SEQ ID NO: 2977009 - DNA, 14 bp, Homo sapiens
tgctctagtgcctt

SEQ ID NO: 2977010 - DNA, 20 bp, Homo sapiens
tgctctatcttgctctgtaa

SEQ ID NO: 2977011 - DNA, 20 bp, Homo sapiens
tgctctccagcctgggaggc

SEQ ID NO: 2977012 - DNA, 12 bp, Homo sapiens
tgctctcctttc

SEQ ID NO: 2977013 - DNA, 22 bp, Homo sapiens
tgctctcgcacctttccaaagt

SEQ ID NO: 2977014 - DNA, 14 bp, Homo sapiens
tgctctctgcagcc

SEQ ID NO: 2977015 - DNA, 21 bp, Homo sapiens
tgctctgaccatgaggtgggg

SEQ ID NO: 2977016 - DNA, 20 bp, Homo sapiens
tgctctgaccctgggctttc

SEQ ID NO: 2977017 - DNA, 14 bp, Homo sapiens
tgctctgatccctc

SEQ ID NO: 2977018 - DNA, 22 bp, Homo sapiens
tgctctgcgtgtcacctgtgct

SEQ ID NO: 2977019 - DNA, 21 bp, Homo sapiens
tgctctgcttgacaacatctg

SEQ ID NO: 2977020 - DNA, 22 bp, Homo sapiens
tgctctgtaatctcgtttcaaa

SEQ ID NO: 2977021 - DNA, 22 bp, Homo sapiens
tgctctgtgaactatcccctgc

SEQ ID NO: 2977022 - DNA, 17 bp, Homo sapiens
tgctctgttacccaggc

SEQ ID NO: 2977023 - DNA, 15 bp, Homo sapiens
tgctcttataaagtg

SEQ ID NO: 2977024 - DNA, 14 bp, Homo sapiens
tgctcttgtagccc

SEQ ID NO: 2977025 - DNA, 14 bp, Homo sapiens
tgctctttcctgcc

SEQ ID NO: 2977026 - DNA, 19 bp, Homo sapiens
tgctgaacacacaccagtt

SEQ ID NO: 2977027 - DNA, 17 bp, Homo sapiens
tgctgaagacatgtttc

SEQ ID NO: 2977028 - DNA, 13 bp, Homo sapiens
tgctgaatgtcat

SEQ ID NO: 2977029 - DNA, 16 bp, Homo sapiens
tgctgaatgtcattat

SEQ ID NO: 2977030 - DNA, 13 bp, Homo sapiens
tgctgacagctct

SEQ ID NO: 2977031 - DNA, 21 bp, Homo sapiens
tgctgacctcacctggtcctc

SEQ ID NO: 2977032 - DNA, 15 bp, Homo sapiens
tgctgacctccacag

SEQ ID NO: 2977033 - DNA, 16 bp, Homo sapiens
tgctgactctctgagc

SEQ ID NO: 2977034 - DNA, 23 bp, Homo sapiens
tgctgagggtgtttcttcctgca

SEQ ID NO: 2977035 - DNA, 18 bp, Homo sapiens
tgctgagtttcccttcct

SEQ ID NO: 2977036 - DNA, 23 bp, Homo sapiens
tgctgatcatcgccagaggtgct

SEQ ID NO: 2977037 - DNA, 16 bp, Homo sapiens
tgctgatgctgaaata

SEQ ID NO: 2977038 - DNA, 19 bp, Homo sapiens
tgctgatggtctggtctat

SEQ ID NO: 2977039 - DNA, 13 bp, Homo sapiens
tgctgatgttcag

SEQ ID NO: 2977040 - DNA, 16 bp, Homo sapiens
tgctgatgttcagtgt

SEQ ID NO: 2977041 - DNA, 17 bp, Homo sapiens
tggagagtttcctgaaa

SEQ ID NO: 2977042 - DNA, 14 bp, Homo sapiens
tggagatgcagcct

SEQ ID NO: 2977043 - DNA, 17 bp, Homo sapiens
tggagcaaagtggtagg

SEQ ID NO: 2977044 - DNA, 13 bp, Homo sapiens
tggagcaatcaga

SEQ ID NO: 2977045 - DNA, 17 bp, Homo sapiens
tggagcaccaggcacga

SEQ ID NO: 2977046 - DNA, 13 bp, Homo sapiens
tggagcagagggg

SEQ ID NO: 2977047 - DNA, 17 bp, Homo sapiens
tggagccacaggcaggg

SEQ ID NO: 2977048 - DNA, 13 bp, Homo sapiens
tggagccagctcc

SEQ ID NO: 2977049 - DNA, 11 bp, Homo sapiens
tggagccaggc

SEQ ID NO: 2977050 - DNA, 16 bp, Homo sapiens
tggagccccactgccc

SEQ ID NO: 2977051 - DNA, 18 bp, Homo sapiens
tggagccccactgccctt

SEQ ID NO: 2977052 - DNA, 18 bp, Homo sapiens
tggagcccgcactgtccc

SEQ ID NO: 2977053 - DNA, 17 bp, Homo sapiens
tggagccctccgccttc

SEQ ID NO: 2977054 - DNA, 20 bp, Homo sapiens
tggagccgccattctgcaga

SEQ ID NO: 2977055 - DNA, 22 bp, Homo sapiens
tggagcggctcatcagaactga

SEQ ID NO: 2977056 - DNA, 14 bp, Homo sapiens
tggagcggctgctc

SEQ ID NO: 2977057 - DNA, 22 bp, Homo sapiens
tggagcgtttgctgtgccagga

SEQ ID NO: 2977058 - DNA, 19 bp, Homo sapiens
tggaggaacacttgatgga

SEQ ID NO: 2977059 - DNA, 13 bp, Homo sapiens
tggaggacagtgg

SEQ ID NO: 2977060 - DNA, 16 bp, Homo sapiens
tggaggaccttaaatg

SEQ ID NO: 2977061 - DNA, 17 bp, Homo sapiens
tggaggagacaggaagc

SEQ ID NO: 2977062 - DNA, 19 bp, Homo sapiens
tggaggagctgagggaggg

SEQ ID NO: 2977063 - DNA, 20 bp, Homo sapiens
tggaggcagatgtggggctg

SEQ ID NO: 2977064 - DNA, 21 bp, Homo sapiens
tggaggcagatgtggggctga

SEQ ID NO: 2977065 - DNA, 15 bp, Homo sapiens
tggaggccagccagt

SEQ ID NO: 2977066 - DNA, 12 bp, Homo sapiens
tggaggcccagg

SEQ ID NO: 2977067 - DNA, 14 bp, Homo sapiens
tggaggcccaggct

SEQ ID NO: 2977068 - DNA, 12 bp, Homo sapiens
tggaggcccagt

SEQ ID NO: 2977069 - DNA, 21 bp, Homo sapiens
tggaggctcagcccaccctcc

SEQ ID NO: 2977070 - DNA, 22 bp, Homo sapiens
tggagggacaagtggactcagg

SEQ ID NO: 2977071 - DNA, 11 bp, Homo sapiens
tggagggaggc

SEQ ID NO: 2977072 - DNA, 13 bp, Homo sapiens
tggagggaggccc

SEQ ID NO: 2977073 - DNA, 18 bp, Homo sapiens
tggagggaggccccaggg

SEQ ID NO: 2977074 - DNA, 19 bp, Homo sapiens
tggagggaggccccagggg

SEQ ID NO: 2977075 - DNA, 23 bp, Homo sapiens
tggagggattcggccgcggctcc

SEQ ID NO: 2977076 - DNA, 22 bp, Homo sapiens
tggagggcgcccagcagcctgc

SEQ ID NO: 2977077 - DNA, 14 bp, Homo sapiens
tggaggggccctcc

SEQ ID NO: 2977078 - DNA, 16 bp, Homo sapiens
tggaggggccctccga

SEQ ID NO: 2977079 - DNA, 17 bp, Homo sapiens
tggagggttggagaagg

SEQ ID NO: 2977080 - DNA, 14 bp, Homo sapiens
tggaggtcgaagca

SEQ ID NO: 2977081 - DNA, 17 bp, Homo sapiens
tggaggtcgaagcaatc

SEQ ID NO: 2977082 - DNA, 22 bp, Homo sapiens
tggaggtcgaagcaatcagcaa

SEQ ID NO: 2977083 - DNA, 22 bp, Homo sapiens
tggaggtgggcattggcggggc

SEQ ID NO: 2977084 - DNA, 20 bp, Homo sapiens
tggaggttaaggctgaggaa

SEQ ID NO: 2977085 - DNA, 21 bp, Homo sapiens
tggaggttaaggctgaggaaa

SEQ ID NO: 2977086 - DNA, 16 bp, Homo sapiens
tggaggttctaaggcc

SEQ ID NO: 2977087 - DNA, 20 bp, Homo sapiens
tggaggttgagtgagccggg

SEQ ID NO: 2977088 - DNA, 20 bp, Homo sapiens
tggaggttgataactttgct

SEQ ID NO: 2977089 - DNA, 22 bp, Homo sapiens
tggagtcatgtgcctctgtcct

SEQ ID NO: 2977090 - DNA, 13 bp, Homo sapiens
tggagtccagctc

SEQ ID NO: 2977091 - DNA, 14 bp, Homo sapiens
tggagtccagctct

SEQ ID NO: 2977092 - DNA, 13 bp, Homo sapiens
tggagtcccagag

SEQ ID NO: 2977093 - DNA, 21 bp, Homo sapiens
tggagtcccaggggcagccac

SEQ ID NO: 2977094 - DNA, 22 bp, Homo sapiens
tggagtgctgcttgtgcctccc

SEQ ID NO: 2977095 - DNA, 22 bp, Homo sapiens
tggagtgtgtcagagcccaggg

SEQ ID NO: 2977096 - DNA, 22 bp, Homo sapiens
tggagtgttccccttccactga

SEQ ID NO: 2977097 - DNA, 16 bp, Homo sapiens
tggagttcctgctccg

SEQ ID NO: 2977098 - DNA, 19 bp, Homo sapiens
tggagttgatctggaaccc

SEQ ID NO: 2977099 - DNA, 16 bp, Homo sapiens
tggagttgttttaaca

SEQ ID NO: 2977100 - DNA, 17 bp, Homo sapiens
tggagttgttttaacag

SEQ ID NO: 2977101 - DNA, 20 bp, Homo sapiens
tggagttgttttaacagatg

SEQ ID NO: 2977102 - DNA, 13 bp, Homo sapiens
tggagtttctaag

SEQ ID NO: 2977103 - DNA, 17 bp, Homo sapiens
tggagtttctaaggtcc

SEQ ID NO: 2977104 - DNA, 16 bp, Homo sapiens
tggagtttctctcttg

SEQ ID NO: 2977105 - DNA, 17 bp, Homo sapiens
tggataacaaagatatc

SEQ ID NO: 2977106 - DNA, 20 bp, Homo sapiens
tggataacaaagatatcttt

SEQ ID NO: 2977107 - DNA, 15 bp, Homo sapiens
tggatacatatttca

SEQ ID NO: 2977108 - DNA, 17 bp, Homo sapiens
tggatagccttgaaaac

SEQ ID NO: 2977109 - DNA, 21 bp, Homo sapiens
tggatatttgtactgtttaat

SEQ ID NO: 2977110 - DNA, 23 bp, Homo sapiens
tggatcacagaggcttcttcaga

SEQ ID NO: 2977111 - DNA, 19 bp, Homo sapiens
tggatcacctgaggtcagg

SEQ ID NO: 2977112 - DNA, 23 bp, Homo sapiens
tggatcacctgaggtcaggagtt

SEQ ID NO: 2977113 - DNA, 14 bp, Homo sapiens
tggatcagccaagg

SEQ ID NO: 2977114 - DNA, 14 bp, Homo sapiens
tggatcccaaagca

SEQ ID NO: 2977115 - DNA, 14 bp, Homo sapiens
tggatcctgggctg

SEQ ID NO: 2977116 - DNA, 13 bp, Homo sapiens
tggatctcagttt

SEQ ID NO: 2977117 - DNA, 19 bp, Homo sapiens
tggatctcagtttttaaga

SEQ ID NO: 2977118 - DNA, 18 bp, Homo sapiens
tggatctcattggaccct

SEQ ID NO: 2977119 - DNA, 20 bp, Homo sapiens
tggatctgggaccctttcct

SEQ ID NO: 2977120 - DNA, 16 bp, Homo sapiens
tggatcttgagctctg

SEQ ID NO: 2977121 - DNA, 12 bp, Homo sapiens
tggatcttttct

SEQ ID NO: 2977122 - DNA, 17 bp, Homo sapiens
tggatgacttgttcatt

SEQ ID NO: 2977123 - DNA, 17 bp, Homo sapiens
tggatgatacagtgttt

SEQ ID NO: 2977124 - DNA, 12 bp, Homo sapiens
tggatgatgttt

SEQ ID NO: 2977125 - DNA, 22 bp, Homo sapiens
tggatgccagggccgaccagag

SEQ ID NO: 2977126 - DNA, 12 bp, Homo sapiens
tggatgccttga

SEQ ID NO: 2977127 - DNA, 15 bp, Homo sapiens
tggatgctctttcaa

SEQ ID NO: 2977128 - DNA, 15 bp, Homo sapiens
tggatgctgtgctac

SEQ ID NO: 2977129 - DNA, 18 bp, Homo sapiens
tggatgggggaactcaga

SEQ ID NO: 2977130 - DNA, 22 bp, Homo sapiens
tggatgggggaactcagatcca

SEQ ID NO: 2977131 - DNA, 23 bp, Homo sapiens
tggatgggggaactcagatccag

SEQ ID NO: 2977132 - DNA, 13 bp, Homo sapiens
tggatgtcattgt

SEQ ID NO: 2977133 - DNA, 15 bp, Homo sapiens
tggatgtctgaactt

SEQ ID NO: 2977134 - DNA, 18 bp, Homo sapiens
tggattaaacttatgaat

SEQ ID NO: 2977135 - DNA, 13 bp, Homo sapiens
tggattagccttt

SEQ ID NO: 2977136 - DNA, 15 bp, Homo sapiens
tggattaggtctctg

SEQ ID NO: 2977137 - DNA, 17 bp, Homo sapiens
tggattctgagagctgt

SEQ ID NO: 2977138 - DNA, 12 bp, Homo sapiens
tggattgagtaa

SEQ ID NO: 2977139 - DNA, 19 bp, Homo sapiens
tggattgcaatatctgaag

SEQ ID NO: 2977140 - DNA, 19 bp, Homo sapiens
tggatttaaaaatgccaaa

SEQ ID NO: 2977141 - DNA, 15 bp, Homo sapiens
tggatttcctttata

SEQ ID NO: 2977142 - DNA, 18 bp, Homo sapiens
tggatttcctttatactg

SEQ ID NO: 2977143 - DNA, 18 bp, Homo sapiens
tggatttctttatataag

SEQ ID NO: 2977144 - DNA, 16 bp, Homo sapiens
tggatttcttttgtaa

SEQ ID NO: 2977145 - DNA, 13 bp, Homo sapiens
tggatttgacatt

SEQ ID NO: 2977146 - DNA, 13 bp, Homo sapiens
tggatttgatgct

SEQ ID NO: 2977147 - DNA, 14 bp, Homo sapiens
tggatttgcagaag

SEQ ID NO: 2977148 - DNA, 15 bp, Homo sapiens
tggatttgcagaagt

SEQ ID NO: 2977149 - DNA, 16 bp, Homo sapiens
tggatttgtccaaaca

SEQ ID NO: 2977150 - DNA, 23 bp, Homo sapiens
tggatttgtccaaacaggtgctg

SEQ ID NO: 2977151 - DNA, 20 bp, Homo sapiens
tggcaaaaggatctttgtgg

SEQ ID NO: 2977152 - DNA, 23 bp, Homo sapiens
tggcaaatgtaactgtgccagtt

SEQ ID NO: 2977153 - DNA, 12 bp, Homo sapiens
tggcaactttct

SEQ ID NO: 2977154 - DNA, 13 bp, Homo sapiens
tggcaactttctt

SEQ ID NO: 2977155 - DNA, 17 bp, Homo sapiens
tggcaagataaacactt

SEQ ID NO: 2977156 - DNA, 12 bp, Homo sapiens
tggcaaggaaag

SEQ ID NO: 2977157 - DNA, 14 bp, Homo sapiens
tggcaagtgaattt

SEQ ID NO: 2977158 - DNA, 20 bp, Homo sapiens
tggcaatagtcattaaaaac

SEQ ID NO: 2977159 - DNA, 22 bp, Homo sapiens
tggcacagcctggctgtggcct

SEQ ID NO: 2977160 - DNA, 17 bp, Homo sapiens
tggcacagtgcttacat

SEQ ID NO: 2977161 - DNA, 23 bp, Homo sapiens
tggcacatcctatgcaatatatc

SEQ ID NO: 2977162 - DNA, 17 bp, Homo sapiens
tggcaccagacacccag

SEQ ID NO: 2977163 - DNA, 13 bp, Homo sapiens
tggcaccagcgaa

SEQ ID NO: 2977164 - DNA, 23 bp, Homo sapiens
tggcacccaagacctcagggcac

SEQ ID NO: 2977165 - DNA, 13 bp, Homo sapiens
tggcacctgccta

SEQ ID NO: 2977166 - DNA, 17 bp, Homo sapiens
tggcacgatctcagctc

SEQ ID NO: 2977167 - DNA, 14 bp, Homo sapiens
tggcacgcacctgt

SEQ ID NO: 2977168 - DNA, 21 bp, Homo sapiens
tggcactccctccagcacaaa

SEQ ID NO: 2977169 - DNA, 17 bp, Homo sapiens
tggcacttgcctgggtc

SEQ ID NO: 2977170 - DNA, 22 bp, Homo sapiens
tggcactttagtgattgctttt

SEQ ID NO: 2977171 - DNA, 23 bp, Homo sapiens
tggcagaactgctggggctggtg

SEQ ID NO: 2977172 - DNA, 21 bp, Homo sapiens
tggcagaagggaattgctcag

SEQ ID NO: 2977173 - DNA, 23 bp, Homo sapiens
tggcagatgacaagatggtacaa

SEQ ID NO: 2977174 - DNA, 18 bp, Homo sapiens
tgggctctccacctcagc

SEQ ID NO: 2977175 - DNA, 23 bp, Homo sapiens
tgggctctccacctcagccttgg

SEQ ID NO: 2977176 - DNA, 19 bp, Homo sapiens
tgggctcttaactgttgct

SEQ ID NO: 2977177 - DNA, 21 bp, Homo sapiens
tgggctgaccccggtggcggc

SEQ ID NO: 2977178 - DNA, 20 bp, Homo sapiens
tgggctgagccaaagccaga

SEQ ID NO: 2977179 - DNA, 12 bp, Homo sapiens
tgggctgaggga

SEQ ID NO: 2977180 - DNA, 16 bp, Homo sapiens
tgggctgcagagtctg

SEQ ID NO: 2977181 - DNA, 20 bp, Homo sapiens
tgggctgcagagtctgcccc

SEQ ID NO: 2977182 - DNA, 13 bp, Homo sapiens
tgggctgggcagc

SEQ ID NO: 2977183 - DNA, 19 bp, Homo sapiens
tgggctgggcagccttggg

SEQ ID NO: 2977184 - DNA, 16 bp, Homo sapiens
tgggctgggcccacaa

SEQ ID NO: 2977185 - DNA, 14 bp, Homo sapiens
tgggctgtgcctgg

SEQ ID NO: 2977186 - DNA, 20 bp, Homo sapiens
tgggctgtgttgactgctgc

SEQ ID NO: 2977187 - DNA, 21 bp, Homo sapiens
tgggctgttttagtgccaggc

SEQ ID NO: 2977188 - DNA, 14 bp, Homo sapiens
tgggcttaagaaat

SEQ ID NO: 2977189 - DNA, 15 bp, Homo sapiens
tgggcttcagggcag

SEQ ID NO: 2977190 - DNA, 18 bp, Homo sapiens
tgggcttcagggcaggtg

SEQ ID NO: 2977191 - DNA, 22 bp, Homo sapiens
tgggcttctgcgtccaccaggc

SEQ ID NO: 2977192 - DNA, 24 bp, Homo sapiens
tgggcttggcccgcggcctgcacc

SEQ ID NO: 2977193 - DNA, 16 bp, Homo sapiens
tgggctttaaaagaaa

SEQ ID NO: 2977194 - DNA, 17 bp, Homo sapiens
tggggaatgggcaggtg

SEQ ID NO: 2977195 - DNA, 20 bp, Homo sapiens
tggggacaggggcaggagga

SEQ ID NO: 2977196 - DNA, 22 bp, Homo sapiens
tggggacaggggcaggaggaag

SEQ ID NO: 2977197 - DNA, 11 bp, Homo sapiens
tggggacccac

SEQ ID NO: 2977198 - DNA, 14 bp, Homo sapiens
tggggaccccaccc

SEQ ID NO: 2977199 - DNA, 20 bp, Homo sapiens
tggggaccggttcccacaag

SEQ ID NO: 2977200 - DNA, 14 bp, Homo sapiens
tggggacctcagcc

SEQ ID NO: 2977201 - DNA, 18 bp, Homo sapiens
tggggacctgatggagag

SEQ ID NO: 2977202 - DNA, 12 bp, Homo sapiens
tggggagctaag

SEQ ID NO: 2977203 - DNA, 23 bp, Homo sapiens
tggggagcttggctgagggtctg

SEQ ID NO: 2977204 - DNA, 14 bp, Homo sapiens
tggggaggaagaga

SEQ ID NO: 2977205 - DNA, 19 bp, Homo sapiens
tggggaggctgaggcagga

SEQ ID NO: 2977206 - DNA, 22 bp, Homo sapiens
tggggaggctgcactggagcca

SEQ ID NO: 2977207 - DNA, 21 bp, Homo sapiens
tggggaggggcctttgctgcc

SEQ ID NO: 2977208 - DNA, 18 bp, Homo sapiens
tggggagttaagacctgg

SEQ ID NO: 2977209 - DNA, 20 bp, Homo sapiens
tggggagtttagggtggggg

SEQ ID NO: 2977210 - DNA, 16 bp, Homo sapiens
tggggatagtctgggt

SEQ ID NO: 2977211 - DNA, 19 bp, Homo sapiens
tggggatagtctgggtcag

SEQ ID NO: 2977212 - DNA, 19 bp, Homo sapiens
tggggcaaacctagccgga

SEQ ID NO: 2977213 - DNA, 20 bp, Homo sapiens
tggggcaaacctagccggaa

SEQ ID NO: 2977214 - DNA, 21 bp, Homo sapiens
tggggcagggagctgggcccg

SEQ ID NO: 2977215 - DNA, 19 bp, Homo sapiens
tggggccagatccagcctg

SEQ ID NO: 2977216 - DNA, 21 bp, Homo sapiens
tggggccagatccagcctggg

SEQ ID NO: 2977217 - DNA, 14 bp, Homo sapiens
tggggccagcatac

SEQ ID NO: 2977218 - DNA, 22 bp, Homo sapiens
tggggcccagtccttggctgta

SEQ ID NO: 2977219 - DNA, 22 bp, Homo sapiens
tggggcccagtgcatggtggcc

SEQ ID NO: 2977220 - DNA, 19 bp, Homo sapiens
tggggccctaattcagcca

SEQ ID NO: 2977221 - DNA, 21 bp, Homo sapiens
tggggccctaattcagccatg

SEQ ID NO: 2977222 - DNA, 14 bp, Homo sapiens
tggggcctccagaa

SEQ ID NO: 2977223 - DNA, 20 bp, Homo sapiens
tggggctagggggagcccct

SEQ ID NO: 2977224 - DNA, 22 bp, Homo sapiens
tggggctctctgagtcctggcc

SEQ ID NO: 2977225 - DNA, 16 bp, Homo sapiens
tggggctgctcctcca

SEQ ID NO: 2977226 - DNA, 21 bp, Homo sapiens
tggggctgctcctccagggcc

SEQ ID NO: 2977227 - DNA, 18 bp, Homo sapiens
tggggctggcttttctgt

SEQ ID NO: 2977228 - DNA, 19 bp, Homo sapiens
tggggctggggaaggaagc

SEQ ID NO: 2977229 - DNA, 15 bp, Homo sapiens
tggggctggtgaggc

SEQ ID NO: 2977230 - DNA, 13 bp, Homo sapiens
tgggggaaaaagc

SEQ ID NO: 2977231 - DNA, 15 bp, Homo sapiens
tgggggacagccttc

SEQ ID NO: 2977232 - DNA, 22 bp, Homo sapiens
tgggggacatgctaaataacta

SEQ ID NO: 2977233 - DNA, 16 bp, Homo sapiens
tgggggagccaggaga

SEQ ID NO: 2977234 - DNA, 19 bp, Homo sapiens
tgggggagggactgctgac

SEQ ID NO: 2977235 - DNA, 19 bp, Homo sapiens
tgggggagtctgaagcaga

SEQ ID NO: 2977236 - DNA, 16 bp, Homo sapiens
tgggggcacaggaggc

SEQ ID NO: 2977237 - DNA, 13 bp, Homo sapiens
tgggggcagaggg

SEQ ID NO: 2977238 - DNA, 16 bp, Homo sapiens
tgggggcagagggcag

SEQ ID NO: 2977239 - DNA, 17 bp, Homo sapiens
tgggggcagagggcaga

SEQ ID NO: 2977240 - DNA, 18 bp, Homo sapiens
tgggggcagagggcagag

SEQ ID NO: 2977241 - DNA, 19 bp, Homo sapiens
tgggggcaggtcaggacca

SEQ ID NO: 2977242 - DNA, 13 bp, Homo sapiens
tgggggccaggcc

SEQ ID NO: 2977243 - DNA, 22 bp, Homo sapiens
tgggggctgtctttgcagggca

SEQ ID NO: 2977244 - DNA, 23 bp, Homo sapiens
tggggggaaataccttgagcaga

SEQ ID NO: 2977245 - DNA, 13 bp, Homo sapiens
tggggggcagggc

SEQ ID NO: 2977246 - DNA, 20 bp, Homo sapiens
tgggggggagaaggcctccc

SEQ ID NO: 2977247 - DNA, 21 bp, Homo sapiens
tgggggggagaaggcctcccc

SEQ ID NO: 2977248 - DNA, 16 bp, Homo sapiens
tgggggggctgccttt

SEQ ID NO: 2977249 - DNA, 14 bp, Homo sapiens
tgggggtgggcagc

SEQ ID NO: 2977250 - DNA, 17 bp, Homo sapiens
tgggggtgggcagcagc

SEQ ID NO: 2977251 - DNA, 18 bp, Homo sapiens
tgggggtgggcagcagca

SEQ ID NO: 2977252 - DNA, 13 bp, Homo sapiens
tgggggtgggcca

SEQ ID NO: 2977253 - DNA, 14 bp, Homo sapiens
tgggggtttttgaa

SEQ ID NO: 2977254 - DNA, 17 bp, Homo sapiens
tggggtaagcggaataa

SEQ ID NO: 2977255 - DNA, 20 bp, Homo sapiens
tggggtagctagaggaacca

SEQ ID NO: 2977256 - DNA, 16 bp, Homo sapiens
tggggtcaagctgagc

SEQ ID NO: 2977257 - DNA, 13 bp, Homo sapiens
tggggtccctcta

SEQ ID NO: 2977258 - DNA, 22 bp, Homo sapiens
tggggtctccctctcctgccta

SEQ ID NO: 2977259 - DNA, 21 bp, Homo sapiens
tggggtctggagttgatctgg

SEQ ID NO: 2977260 - DNA, 17 bp, Homo sapiens
tggggtgatggccagag

SEQ ID NO: 2977261 - DNA, 19 bp, Homo sapiens
tggggtgatggccagagga

SEQ ID NO: 2977262 - DNA, 22 bp, Homo sapiens
tggggtgcactcgccatttcct

SEQ ID NO: 2977263 - DNA, 17 bp, Homo sapiens
tggggtggcctgtgtgg

SEQ ID NO: 2977264 - DNA, 20 bp, Homo sapiens
tggggtggcctgtgtggcca

SEQ ID NO: 2977265 - DNA, 11 bp, Homo sapiens
tggggtggggg

SEQ ID NO: 2977266 - DNA, 16 bp, Homo sapiens
tggggtgggggccagg

SEQ ID NO: 2977267 - DNA, 17 bp, Homo sapiens
tggggtgggggccaggc

SEQ ID NO: 2977268 - DNA, 19 bp, Homo sapiens
tggggtgggggccaggcct

SEQ ID NO: 2977269 - DNA, 19 bp, Homo sapiens
tggggttcagcccctcctc

SEQ ID NO: 2977270 - DNA, 21 bp, Homo sapiens
tggggttcagcccctcctctg

SEQ ID NO: 2977271 - DNA, 18 bp, Homo sapiens
tggggttcataggggcag

SEQ ID NO: 2977272 - DNA, 14 bp, Homo sapiens
tggggtttcctgca

SEQ ID NO: 2977273 - DNA, 20 bp, Homo sapiens
tggggtttcctgcatggaca

SEQ ID NO: 2977274 - DNA, 22 bp, Homo sapiens
tgggtacctgcaagcagaactt

SEQ ID NO: 2977275 - DNA, 21 bp, Homo sapiens
tgggtagaaagagatacagag

SEQ ID NO: 2977276 - DNA, 21 bp, Homo sapiens
tgggtaggccccacaaggcct

SEQ ID NO: 2977277 - DNA, 23 bp, Homo sapiens
tgggtaggccccacaaggcctgg

SEQ ID NO: 2977278 - DNA, 20 bp, Homo sapiens
tgggtatagttcatgtctgc

SEQ ID NO: 2977279 - DNA, 14 bp, Homo sapiens
tgggtatcaagaca

SEQ ID NO: 2977280 - DNA, 18 bp, Homo sapiens
tgggtcacaggaaggaaa

SEQ ID NO: 2977281 - DNA, 18 bp, Homo sapiens
tgggtcacccctccagga

SEQ ID NO: 2977282 - DNA, 20 bp, Homo sapiens
tgggtcagacccatctctcc

SEQ ID NO: 2977283 - DNA, 21 bp, Homo sapiens
tgggtcagacccatctctccc

SEQ ID NO: 2977284 - DNA, 18 bp, Homo sapiens
tgggtcagatttatttgt

SEQ ID NO: 2977285 - DNA, 13 bp, Homo sapiens
tgggtcaggcagg

SEQ ID NO: 2977286 - DNA, 14 bp, Homo sapiens
tgggtcatagaaat

SEQ ID NO: 2977287 - DNA, 17 bp, Homo sapiens
tgggtcatttagaagcc

SEQ ID NO: 2977288 - DNA, 21 bp, Homo sapiens
tgggtccaggggatgggaggt

SEQ ID NO: 2977289 - DNA, 14 bp, Homo sapiens
tgggtccatgggca

SEQ ID NO: 2977290 - DNA, 17 bp, Homo sapiens
tgggtccatgggcagag

SEQ ID NO: 2977291 - DNA, 18 bp, Homo sapiens
tgggtccatgggcagagc

SEQ ID NO: 2977292 - DNA, 17 bp, Homo sapiens
tgggtccgcatccctgc

SEQ ID NO: 2977293 - DNA, 22 bp, Homo sapiens
tgggtccgcatccctgcttctg

SEQ ID NO: 2977294 - DNA, 15 bp, Homo sapiens
tgggtcctcggccca

SEQ ID NO: 2977295 - DNA, 17 bp, Homo sapiens
tgggtcctcggcccatc

SEQ ID NO: 2977296 - DNA, 13 bp, Homo sapiens
tgggtcctgcctg

SEQ ID NO: 2977297 - DNA, 17 bp, Homo sapiens
tgggtcctgcctgcagt

SEQ ID NO: 2977298 - DNA, 14 bp, Homo sapiens
tgggtcctgggcag

SEQ ID NO: 2977299 - DNA, 13 bp, Homo sapiens
tgggtcgggagag

SEQ ID NO: 2977300 - DNA, 14 bp, Homo sapiens
tgggtcgggagagg

SEQ ID NO: 2977301 - DNA, 16 bp, Homo sapiens
tgggtcgggagagggg

SEQ ID NO: 2977302 - DNA, 17 bp, Homo sapiens
tgggtcgggagagggga

SEQ ID NO: 2977303 - DNA, 12 bp, Homo sapiens
tgggtctctgga

SEQ ID NO: 2977304 - DNA, 21 bp, Homo sapiens
tgggtctgggagtcacacagt

SEQ ID NO: 2977305 - DNA, 16 bp, Homo sapiens
tgtcactgtacagttt

SEQ ID NO: 2977306 - DNA, 17 bp, Homo sapiens
tgtcactgtacagtttt

SEQ ID NO: 2977307 - DNA, 14 bp, Homo sapiens
tgtcacttgcatgt

SEQ ID NO: 2977308 - DNA, 15 bp, Homo sapiens
tgtcacttggtggcg

SEQ ID NO: 2977309 - DNA, 12 bp, Homo sapiens
tgtcagagccca

SEQ ID NO: 2977310 - DNA, 14 bp, Homo sapiens
tgtcagagcccagg

SEQ ID NO: 2977311 - DNA, 21 bp, Homo sapiens
tgtcagcatctgaccatctgt

SEQ ID NO: 2977312 - DNA, 14 bp, Homo sapiens
tgtcagccacctcc

SEQ ID NO: 2977313 - DNA, 11 bp, Homo sapiens
tgtcagcctga

SEQ ID NO: 2977314 - DNA, 19 bp, Homo sapiens
tgtcaggcccgtcggagct

SEQ ID NO: 2977315 - DNA, 20 bp, Homo sapiens
tgtcaggccctctgcctgca

SEQ ID NO: 2977316 - DNA, 23 bp, Homo sapiens
tgtcaggccctctgcctgcactc

SEQ ID NO: 2977317 - DNA, 16 bp, Homo sapiens
tgtcagggagggccag

SEQ ID NO: 2977318 - DNA, 18 bp, Homo sapiens
tgtcagggagggccaggg

SEQ ID NO: 2977319 - DNA, 22 bp, Homo sapiens
tgtcagggagggccagggaggc

SEQ ID NO: 2977320 - DNA, 21 bp, Homo sapiens
tgtcaggtggaccctgtaaat

SEQ ID NO: 2977321 - DNA, 14 bp, Homo sapiens
tgtcagtcacagcc

SEQ ID NO: 2977322 - DNA, 13 bp, Homo sapiens
tgtcagtgtgaaa

SEQ ID NO: 2977323 - DNA, 15 bp, Homo sapiens
tgtcagtgtgaaaat

SEQ ID NO: 2977324 - DNA, 22 bp, Homo sapiens
tgtcagttggccctttaatatt

SEQ ID NO: 2977325 - DNA, 19 bp, Homo sapiens
tgtcatcaacattcttgtg

SEQ ID NO: 2977326 - DNA, 20 bp, Homo sapiens
tgtcatcaacattcttgtgt

SEQ ID NO: 2977327 - DNA, 22 bp, Homo sapiens
tgtcatcaacattcttgtgtct

SEQ ID NO: 2977328 - DNA, 17 bp, Homo sapiens
tgtcatcaatttgtaat

SEQ ID NO: 2977329 - DNA, 20 bp, Homo sapiens
tgtcatcagaggggagcagc

SEQ ID NO: 2977330 - DNA, 21 bp, Homo sapiens
tgtcatcagccaccatcctat

SEQ ID NO: 2977331 - DNA, 19 bp, Homo sapiens
tgtcatcgttccccacccc

SEQ ID NO: 2977332 - DNA, 21 bp, Homo sapiens
tgtcatcgttccccacccctt

SEQ ID NO: 2977333 - DNA, 20 bp, Homo sapiens
tgtcatctgaatttgccctg

SEQ ID NO: 2977334 - DNA, 15 bp, Homo sapiens
tgtcatctgctgcga

SEQ ID NO: 2977335 - DNA, 13 bp, Homo sapiens
tgtcatgcatgaa

SEQ ID NO: 2977336 - DNA, 17 bp, Homo sapiens
tgtcatgcttcatcatt

SEQ ID NO: 2977337 - DNA, 18 bp, Homo sapiens
tgtcatgtgtatgagaag

SEQ ID NO: 2977338 - DNA, 21 bp, Homo sapiens
tgtcattattccatcttctcc

SEQ ID NO: 2977339 - DNA, 18 bp, Homo sapiens
tgtcattatttgataaca

SEQ ID NO: 2977340 - DNA, 15 bp, Homo sapiens
tgtcattcagaaaaa

SEQ ID NO: 2977341 - DNA, 24 bp, Homo sapiens
tgtcatttactcaaaatctgtcat

SEQ ID NO: 2977342 - DNA, 13 bp, Homo sapiens
tgtcatttgttaa

SEQ ID NO: 2977343 - DNA, 16 bp, Homo sapiens
tgtcatttgttaaaat

SEQ ID NO: 2977344 - DNA, 21 bp, Homo sapiens
tgtcatttttgaatgcctcat

SEQ ID NO: 2977345 - DNA, 16 bp, Homo sapiens
tgtccaaaactgcctc

SEQ ID NO: 2977346 - DNA, 18 bp, Homo sapiens
tgtccaaaataataacat

SEQ ID NO: 2977347 - DNA, 17 bp, Homo sapiens
tgtccaaatttaatgta

SEQ ID NO: 2977348 - DNA, 21 bp, Homo sapiens
tgtccaaatttaatgtagaca

SEQ ID NO: 2977349 - DNA, 14 bp, Homo sapiens
tgtccaacatggtg

SEQ ID NO: 2977350 - DNA, 15 bp, Homo sapiens
tgtccaacccctccc

SEQ ID NO: 2977351 - DNA, 22 bp, Homo sapiens
tgtccaacccctcccccacgtc

SEQ ID NO: 2977352 - DNA, 21 bp, Homo sapiens
tgtccaacctaacccctttcc

SEQ ID NO: 2977353 - DNA, 22 bp, Homo sapiens
tgtccaacctaacccctttcct

SEQ ID NO: 2977354 - DNA, 23 bp, Homo sapiens
tgtccaattgttgacagttctga

SEQ ID NO: 2977355 - DNA, 17 bp, Homo sapiens
tgtccacatccccagag

SEQ ID NO: 2977356 - DNA, 20 bp, Homo sapiens
tgtccacatccccagagccc

SEQ ID NO: 2977357 - DNA, 23 bp, Homo sapiens
tgtccacatccccagagcccagc

SEQ ID NO: 2977358 - DNA, 14 bp, Homo sapiens
tgtccacctggccc

SEQ ID NO: 2977359 - DNA, 16 bp, Homo sapiens
tgtccacgactgtctc

SEQ ID NO: 2977360 - DNA, 17 bp, Homo sapiens
tgtccacgactgtctcc

SEQ ID NO: 2977361 - DNA, 13 bp, Homo sapiens
tgtccactgtgta

SEQ ID NO: 2977362 - DNA, 23 bp, Homo sapiens
tgtccagaagcggcctgtgcgtt

SEQ ID NO: 2977363 - DNA, 19 bp, Homo sapiens
tgtccagcatggatgaaac

SEQ ID NO: 2977364 - DNA, 11 bp, Homo sapiens
tgtccagcccc

SEQ ID NO: 2977365 - DNA, 20 bp, Homo sapiens
tgtccagctccaacctgcaa

SEQ ID NO: 2977366 - DNA, 17 bp, Homo sapiens
tgtccagctgagcgcca

SEQ ID NO: 2977367 - DNA, 21 bp, Homo sapiens
tgtccagctgagcgccaggat

SEQ ID NO: 2977368 - DNA, 18 bp, Homo sapiens
tgtccaggctggagtgca

SEQ ID NO: 2977369 - DNA, 20 bp, Homo sapiens
tgtccaggtgagtgtgaggg

SEQ ID NO: 2977370 - DNA, 15 bp, Homo sapiens
tgtccatcatattaa

SEQ ID NO: 2977371 - DNA, 22 bp, Homo sapiens
tgtccatcctcctctccatgca

SEQ ID NO: 2977372 - DNA, 11 bp, Homo sapiens
tgtccatgtgt

SEQ ID NO: 2977373 - DNA, 17 bp, Homo sapiens
tgtccattgtccaatcc

SEQ ID NO: 2977374 - DNA, 15 bp, Homo sapiens
tgtccattttgtgaa

SEQ ID NO: 2977375 - DNA, 21 bp, Homo sapiens
tgtccattttgtgaagccctg

SEQ ID NO: 2977376 - DNA, 15 bp, Homo sapiens
tgtcccactatctgg

SEQ ID NO: 2977377 - DNA, 14 bp, Homo sapiens
tgtcccagctacca

SEQ ID NO: 2977378 - DNA, 21 bp, Homo sapiens
tgtcccagctaccaagtcaga

SEQ ID NO: 2977379 - DNA, 18 bp, Homo sapiens
tgtcccagttgtggcaac

SEQ ID NO: 2977380 - DNA, 14 bp, Homo sapiens
tgtccccaaatccg

SEQ ID NO: 2977381 - DNA, 20 bp, Homo sapiens
tgtcccccaggttccgaaga

SEQ ID NO: 2977382 - DNA, 18 bp, Homo sapiens
tgtccccgctgctgtgca

SEQ ID NO: 2977383 - DNA, 17 bp, Homo sapiens
tgtcccctcacagactc

SEQ ID NO: 2977384 - DNA, 12 bp, Homo sapiens
tgtcccctccca

SEQ ID NO: 2977385 - DNA, 17 bp, Homo sapiens
tgtcccctgacctgtcc

SEQ ID NO: 2977386 - DNA, 15 bp, Homo sapiens
tgtcccctggggctg

SEQ ID NO: 2977387 - DNA, 17 bp, Homo sapiens
tgtccctatgcatatca

SEQ ID NO: 2977388 - DNA, 17 bp, Homo sapiens
tgtccctctcagtgcct

SEQ ID NO: 2977389 - DNA, 20 bp, Homo sapiens
tgtccctgaagtcttgcatt

SEQ ID NO: 2977390 - DNA, 14 bp, Homo sapiens
tgtccctgcactgt

SEQ ID NO: 2977391 - DNA, 16 bp, Homo sapiens
tgtccctgcactgtgc

SEQ ID NO: 2977392 - DNA, 14 bp, Homo sapiens
tgtccctgctgggg

SEQ ID NO: 2977393 - DNA, 15 bp, Homo sapiens
tgtccctgctttctg

SEQ ID NO: 2977394 - DNA, 18 bp, Homo sapiens
tgtccctgctttctggta

SEQ ID NO: 2977395 - DNA, 14 bp, Homo sapiens
tgtccctggggcac

SEQ ID NO: 2977396 - DNA, 15 bp, Homo sapiens
tgtccctggggcact

SEQ ID NO: 2977397 - DNA, 16 bp, Homo sapiens
tgtcccttaaacaaaa

SEQ ID NO: 2977398 - DNA, 18 bp, Homo sapiens
tgtcccttctgtccctca

SEQ ID NO: 2977399 - DNA, 12 bp, Homo sapiens
tgtcccttgctg

SEQ ID NO: 2977400 - DNA, 22 bp, Homo sapiens
tgtccctttttgcaggggactg

SEQ ID NO: 2977401 - DNA, 17 bp, Homo sapiens
tgtccggaatgccaccc

SEQ ID NO: 2977402 - DNA, 21 bp, Homo sapiens
tgtcctaagtgtcaagtcctg

SEQ ID NO: 2977403 - DNA, 22 bp, Homo sapiens
tgtcctaagtgtcaagtcctga

SEQ ID NO: 2977404 - DNA, 19 bp, Homo sapiens
tgtcctagaagttctttga

SEQ ID NO: 2977405 - DNA, 20 bp, Homo sapiens
tgtcctaggagtatcctcat

SEQ ID NO: 2977406 - DNA, 23 bp, Homo sapiens
tgtcctcaagaagaaagtgttca

SEQ ID NO: 2977407 - DNA, 14 bp, Homo sapiens
tgtcctcagcagct

SEQ ID NO: 2977408 - DNA, 13 bp, Homo sapiens
tgtcctcagcctt

SEQ ID NO: 2977409 - DNA, 20 bp, Homo sapiens
tgtcctcagccttgccagag

SEQ ID NO: 2977410 - DNA, 21 bp, Homo sapiens
tgtcctcagccttgccagaga

SEQ ID NO: 2977411 - DNA, 19 bp, Homo sapiens
tgtcctcaggtggccatgc

SEQ ID NO: 2977412 - DNA, 18 bp, Homo sapiens
tgtcctcatttctccaga

SEQ ID NO: 2977413 - DNA, 10 bp, Homo sapiens
tgtcctcctc

SEQ ID NO: 2977414 - DNA, 11 bp, Homo sapiens
tgtcctcctcg

SEQ ID NO: 2977415 - DNA, 21 bp, Homo sapiens
tgtcctcctcggatcaccgag

SEQ ID NO: 2977416 - DNA, 23 bp, Homo sapiens
tgtcctcttctgcatcttgggga

SEQ ID NO: 2977417 - DNA, 15 bp, Homo sapiens
tgtcctgatgctttt

SEQ ID NO: 2977418 - DNA, 22 bp, Homo sapiens
tgtcctgttaggccaactgcct

SEQ ID NO: 2977419 - DNA, 18 bp, Homo sapiens
tgtccttaaaatgtggtc

SEQ ID NO: 2977420 - DNA, 17 bp, Homo sapiens
tgtccttactcagagct

SEQ ID NO: 2977421 - DNA, 18 bp, Homo sapiens
tgtccttactcagagctg

SEQ ID NO: 2977422 - DNA, 19 bp, Homo sapiens
tgtccttactcagagctgc

SEQ ID NO: 2977423 - DNA, 18 bp, Homo sapiens
tgtccttggcaactttct

SEQ ID NO: 2977424 - DNA, 21 bp, Homo sapiens
tgtccttggcaactttcttct

SEQ ID NO: 2977425 - DNA, 15 bp, Homo sapiens
tgtccttgtgtgttt

SEQ ID NO: 2977426 - DNA, 23 bp, Homo sapiens
tgtcgattagactggacagcttg

SEQ ID NO: 2977427 - DNA, 18 bp, Homo sapiens
tgtcgctttcccttggat

SEQ ID NO: 2977428 - DNA, 22 bp, Homo sapiens
tgtcgtttcattcattttgtgt

SEQ ID NO: 2977429 - DNA, 17 bp, Homo sapiens
tgtctaaacaatgctga

SEQ ID NO: 2977430 - DNA, 20 bp, Homo sapiens
tgtctaaacaatgctgattt

SEQ ID NO: 2977431 - DNA, 22 bp, Homo sapiens
tgtctaaacaatgctgatttgg

SEQ ID NO: 2977432 - DNA, 24 bp, Homo sapiens
tgtctaaagccttaactaagactc

SEQ ID NO: 2977433 - DNA, 21 bp, Homo sapiens
tgtctaacttttgtgaagaac

SEQ ID NO: 2977434 - DNA, 22 bp, Homo sapiens
tgtctaagcagttttgtaaatg

SEQ ID NO: 2977435 - DNA, 23 bp, Homo sapiens
tgtctaagcagttttgtaaatgt

SEQ ID NO: 2977436 - DNA, 20 bp, Homo sapiens
tgttgcactcaagttgttta

SEQ ID NO: 2977437 - DNA, 13 bp, Homo sapiens
tgttgcaggcagt

SEQ ID NO: 2977438 - DNA, 17 bp, Homo sapiens
tgttgcagtggcctggc

SEQ ID NO: 2977439 - DNA, 16 bp, Homo sapiens
tgttgcatagaattca

SEQ ID NO: 2977440 - DNA, 17 bp, Homo sapiens
tgttgcatggatgtttt

SEQ ID NO: 2977441 - DNA, 20 bp, Homo sapiens
tgttgcatgggctaatgaag

SEQ ID NO: 2977442 - DNA, 23 bp, Homo sapiens
tgttgcccaactactatctcaga

SEQ ID NO: 2977443 - DNA, 15 bp, Homo sapiens
tgttgcccaggctgg

SEQ ID NO: 2977444 - DNA, 12 bp, Homo sapiens
tgttgcctcctc

SEQ ID NO: 2977445 - DNA, 17 bp, Homo sapiens
tgttgcctcctctctcc

SEQ ID NO: 2977446 - DNA, 23 bp, Homo sapiens
tgttgcctcctctctccctgcct

SEQ ID NO: 2977447 - DNA, 16 bp, Homo sapiens
tgttgccttcatcttc

SEQ ID NO: 2977448 - DNA, 20 bp, Homo sapiens
tgttgctctaggaagacatt

SEQ ID NO: 2977449 - DNA, 17 bp, Homo sapiens
tgttgctctctgtgtct

SEQ ID NO: 2977450 - DNA, 15 bp, Homo sapiens
tgttgctgctgctgc

SEQ ID NO: 2977451 - DNA, 19 bp, Homo sapiens
tgttgcttaattgtgaaca

SEQ ID NO: 2977452 - DNA, 15 bp, Homo sapiens
tgttgcttacaattt

SEQ ID NO: 2977453 - DNA, 16 bp, Homo sapiens
tgttgcttacaatttt

SEQ ID NO: 2977454 - DNA, 16 bp, Homo sapiens
tgttggacaaatgtga

SEQ ID NO: 2977455 - DNA, 20 bp, Homo sapiens
tgttggacaaatgtgaagat

SEQ ID NO: 2977456 - DNA, 21 bp, Homo sapiens
tgttggacacctttaggttct

SEQ ID NO: 2977457 - DNA, 19 bp, Homo sapiens
tgttggataaatcagtggt

SEQ ID NO: 2977458 - DNA, 14 bp, Homo sapiens
tgttggccaggctg

SEQ ID NO: 2977459 - DNA, 23 bp, Homo sapiens
tgttggccaggctggtctaaaac

SEQ ID NO: 2977460 - DNA, 14 bp, Homo sapiens
tgttggcccttcca

SEQ ID NO: 2977461 - DNA, 17 bp, Homo sapiens
tgttggcccttccagtg

SEQ ID NO: 2977462 - DNA, 15 bp, Homo sapiens
tgttggcgctgaggt

SEQ ID NO: 2977463 - DNA, 19 bp, Homo sapiens
tgttgggaagctatttcct

SEQ ID NO: 2977464 - DNA, 14 bp, Homo sapiens
tgttgggactgcta

SEQ ID NO: 2977465 - DNA, 19 bp, Homo sapiens
tgttgggactgctaaataa

SEQ ID NO: 2977466 - DNA, 22 bp, Homo sapiens
tgttgggatgcgggcattttga

SEQ ID NO: 2977467 - DNA, 21 bp, Homo sapiens
tgttggtgcaattaactctgg

SEQ ID NO: 2977468 - DNA, 23 bp, Homo sapiens
tgttggtgcaattaactctggac

SEQ ID NO: 2977469 - DNA, 17 bp, Homo sapiens
tgttggttttgactgga

SEQ ID NO: 2977470 - DNA, 17 bp, Homo sapiens
tgttgtaaaacaaaatt

SEQ ID NO: 2977471 - DNA, 22 bp, Homo sapiens
tgttgtacatttcaccatggcc

SEQ ID NO: 2977472 - DNA, 13 bp, Homo sapiens
tgttgtacccttg

SEQ ID NO: 2977473 - DNA, 13 bp, Homo sapiens
tgttgtcaagtat

SEQ ID NO: 2977474 - DNA, 15 bp, Homo sapiens
tgttgtcaagtataa

SEQ ID NO: 2977475 - DNA, 16 bp, Homo sapiens
tgttgtcttgaaagat

SEQ ID NO: 2977476 - DNA, 12 bp, Homo sapiens
tgttgtgccaca

SEQ ID NO: 2977477 - DNA, 22 bp, Homo sapiens
tgttgtgggttctatgtttact

SEQ ID NO: 2977478 - DNA, 16 bp, Homo sapiens
tgttgtgtacagactt

SEQ ID NO: 2977479 - DNA, 13 bp, Homo sapiens
tgttgtgtgttgc

SEQ ID NO: 2977480 - DNA, 16 bp, Homo sapiens
tgttgtgtttgtagtc

SEQ ID NO: 2977481 - DNA, 18 bp, Homo sapiens
tgttgtttatatgaaaac

SEQ ID NO: 2977482 - DNA, 21 bp, Homo sapiens
tgttgtttcctaatatcaaat

SEQ ID NO: 2977483 - DNA, 15 bp, Homo sapiens
tgttgttttctgggg

SEQ ID NO: 2977484 - DNA, 16 bp, Homo sapiens
tgttgttttctggggg

SEQ ID NO: 2977485 - DNA, 22 bp, Homo sapiens
tgttgttttctgggggaaaaag

SEQ ID NO: 2977486 - DNA, 23 bp, Homo sapiens
tgttgtttttaaaaagaaaatca

SEQ ID NO: 2977487 - DNA, 13 bp, Homo sapiens
tgtttaaaattct

SEQ ID NO: 2977488 - DNA, 14 bp, Homo sapiens
tgtttaaaattctc

SEQ ID NO: 2977489 - DNA, 12 bp, Homo sapiens
tgtttaaataaa

SEQ ID NO: 2977490 - DNA, 14 bp, Homo sapiens
tgtttaactgtgca

SEQ ID NO: 2977491 - DNA, 21 bp, Homo sapiens
tgtttaactgtgcatgtgcgt

SEQ ID NO: 2977492 - DNA, 13 bp, Homo sapiens
tgtttaagcacca

SEQ ID NO: 2977493 - DNA, 16 bp, Homo sapiens
tgtttaatattgagaa

SEQ ID NO: 2977494 - DNA, 23 bp, Homo sapiens
tgtttaatgtgaactctcccctc

SEQ ID NO: 2977495 - DNA, 19 bp, Homo sapiens
tgtttactagggatccctc

SEQ ID NO: 2977496 - DNA, 21 bp, Homo sapiens
tgtttactatagaccaaaagg

SEQ ID NO: 2977497 - DNA, 12 bp, Homo sapiens
tgtttactgtaa

SEQ ID NO: 2977498 - DNA, 13 bp, Homo sapiens
tgtttagaagcct

SEQ ID NO: 2977499 - DNA, 15 bp, Homo sapiens
tgtttagaagcctaa

SEQ ID NO: 2977500 - DNA, 23 bp, Homo sapiens
tgtttagaagcctaattgtcaca

SEQ ID NO: 2977501 - DNA, 24 bp, Homo sapiens
tgtttagaagcctaattgtcacat

SEQ ID NO: 2977502 - DNA, 11 bp, Homo sapiens
tgtttagatgt

SEQ ID NO: 2977503 - DNA, 16 bp, Homo sapiens
tgtttagcaatgtgtt

SEQ ID NO: 2977504 - DNA, 18 bp, Homo sapiens
tgtttaggggatctggaa

SEQ ID NO: 2977505 - DNA, 16 bp, Homo sapiens
tgtttagtaaatacat

SEQ ID NO: 2977506 - DNA, 22 bp, Homo sapiens
tgtttataaaatataaacaaag

SEQ ID NO: 2977507 - DNA, 19 bp, Homo sapiens
tgtttataaatcttatgct

SEQ ID NO: 2977508 - DNA, 20 bp, Homo sapiens
tgtttataactattcagttg

SEQ ID NO: 2977509 - DNA, 22 bp, Homo sapiens
tgtttatgacacaatgacacat

SEQ ID NO: 2977510 - DNA, 14 bp, Homo sapiens
tgtttattaaatag

SEQ ID NO: 2977511 - DNA, 21 bp, Homo sapiens
tgtttattaatagaatgataa

SEQ ID NO: 2977512 - DNA, 14 bp, Homo sapiens
tgtttattagatga

SEQ ID NO: 2977513 - DNA, 14 bp, Homo sapiens
tgtttattccaaag

SEQ ID NO: 2977514 - DNA, 18 bp, Homo sapiens
tgtttattccaaagagtg

SEQ ID NO: 2977515 - DNA, 18 bp, Homo sapiens
tgtttattctaatatcca

SEQ ID NO: 2977516 - DNA, 16 bp, Homo sapiens
tgtttattgccattat

SEQ ID NO: 2977517 - DNA, 20 bp, Homo sapiens
tgtttattgttgctggttat

SEQ ID NO: 2977518 - DNA, 17 bp, Homo sapiens
tgtttatttttaaattt

SEQ ID NO: 2977519 - DNA, 20 bp, Homo sapiens
tgtttatttttaaattttct

SEQ ID NO: 2977520 - DNA, 23 bp, Homo sapiens
tgtttcaaaataagtatttctga

SEQ ID NO: 2977521 - DNA, 15 bp, Homo sapiens
tgtttcaaactgtaa

SEQ ID NO: 2977522 - DNA, 19 bp, Homo sapiens
tgtttcaaggcactctaga

SEQ ID NO: 2977523 - DNA, 16 bp, Homo sapiens
tgtttcaatcactgtc

SEQ ID NO: 2977524 - DNA, 16 bp, Homo sapiens
tgtttcacaaggtctt

SEQ ID NO: 2977525 - DNA, 16 bp, Homo sapiens
tgtttcagctgcagtt

SEQ ID NO: 2977526 - DNA, 17 bp, Homo sapiens
tgtttcagctgcagttg

SEQ ID NO: 2977527 - DNA, 22 bp, Homo sapiens
tgtttcagctgcagttgaagag

SEQ ID NO: 2977528 - DNA, 22 bp, Homo sapiens
tgtttcaggttcagtattatgt

SEQ ID NO: 2977529 - DNA, 23 bp, Homo sapiens
tgtttcataatgcagaagtattc

SEQ ID NO: 2977530 - DNA, 14 bp, Homo sapiens
tgtttcctcatctt

SEQ ID NO: 2977531 - DNA, 12 bp, Homo sapiens
tgtttcctggaa

SEQ ID NO: 2977532 - DNA, 11 bp, Homo sapiens
tgtttcctttt

SEQ ID NO: 2977533 - DNA, 19 bp, Homo sapiens
tgtttcgtgaagtatactg

SEQ ID NO: 2977534 - DNA, 23 bp, Homo sapiens
tgtttctagatagcacaggagag

SEQ ID NO: 2977535 - DNA, 15 bp, Homo sapiens
tgtttctagggaaat

SEQ ID NO: 2977536 - DNA, 15 bp, Homo sapiens
tgtttctccctctca

SEQ ID NO: 2977537 - DNA, 15 bp, Homo sapiens
tgtttctcctgagct

SEQ ID NO: 2977538 - DNA, 19 bp, Homo sapiens
tgtttctctataaagtatg

SEQ ID NO: 2977539 - DNA, 24 bp, Homo sapiens
tgtttctctataaagtatggtaat

SEQ ID NO: 2977540 - DNA, 21 bp, Homo sapiens
tgtttctgaatgtttgtgtct

SEQ ID NO: 2977541 - DNA, 16 bp, Homo sapiens
tgtttctgtaagaaac

SEQ ID NO: 2977542 - DNA, 14 bp, Homo sapiens
tgtttctgtgctcc

SEQ ID NO: 2977543 - DNA, 13 bp, Homo sapiens
tgtttctgtgggc

SEQ ID NO: 2977544 - DNA, 11 bp, Homo sapiens
tgtttcttgat

SEQ ID NO: 2977545 - DNA, 17 bp, Homo sapiens
tgtttctttctgaagtg

SEQ ID NO: 2977546 - DNA, 16 bp, Homo sapiens
tgtttgactttaaaga

SEQ ID NO: 2977547 - DNA, 20 bp, Homo sapiens
tgtttgactttaaagatgat

SEQ ID NO: 2977548 - DNA, 14 bp, Homo sapiens
tgtttgagctcaga

SEQ ID NO: 2977549 - DNA, 12 bp, Homo sapiens
tgtttgattttc

SEQ ID NO: 2977550 - DNA, 18 bp, Homo sapiens
tgtttgattttcatatcc

SEQ ID NO: 2977551 - DNA, 18 bp, Homo sapiens
tgtttgcacagagggcgc

SEQ ID NO: 2977552 - DNA, 16 bp, Homo sapiens
tgtttgctcagaggaa

SEQ ID NO: 2977553 - DNA, 12 bp, Homo sapiens
tgtttgctgttt

SEQ ID NO: 2977554 - DNA, 13 bp, Homo sapiens
tgtttgcttggtg

SEQ ID NO: 2977555 - DNA, 21 bp, Homo sapiens
tgtttgcttggtgctggttta

SEQ ID NO: 2977556 - DNA, 12 bp, Homo sapiens
tgtttgctttct

SEQ ID NO: 2977557 - DNA, 22 bp, Homo sapiens
tgtttgctttctgatcaaggcc

SEQ ID NO: 2977558 - DNA, 18 bp, Homo sapiens
tgtttggaatattgtcca

SEQ ID NO: 2977559 - DNA, 18 bp, Homo sapiens
tgtttggatttcctttat

SEQ ID NO: 2977560 - DNA, 16 bp, Homo sapiens
tgtttggcaaggaaag

SEQ ID NO: 2977561 - DNA, 17 bp, Homo sapiens
tgtttggcaaggaaagg

SEQ ID NO: 2977562 - DNA, 18 bp, Homo sapiens
tgtttgggggacgtttct

SEQ ID NO: 2977563 - DNA, 15 bp, Homo sapiens
tgtttggtataaatt

SEQ ID NO: 2977564 - DNA, 21 bp, Homo sapiens
tgtttggtataaattaatttg

SEQ ID NO: 2977565 - DNA, 19 bp, Homo sapiens
tgtttggtttactttcaaa

SEQ ID NO: 2977566 - DNA, 14 bp, Homo sapiens
tgtttgtagctttc

SEQ ID NO: 2977567 - DNA, 21 bp, Homo sapiens
tgtttgtataccatgatgcat

SEQ ID NO: 2977568 - DNA, 18 bp, Homo sapiens
ttaccttgttttgccagt

SEQ ID NO: 2977569 - DNA, 23 bp, Homo sapiens
ttaccttttttgataaagtttct

SEQ ID NO: 2977570 - DNA, 16 bp, Homo sapiens
ttacgataaggaagaa

SEQ ID NO: 2977571 - DNA, 18 bp, Homo sapiens
ttacgataaggaagaaac

SEQ ID NO: 2977572 - DNA, 13 bp, Homo sapiens
ttacgatatttcg

SEQ ID NO: 2977573 - DNA, 22 bp, Homo sapiens
ttacgatcaggcacaggtcagg

SEQ ID NO: 2977574 - DNA, 15 bp, Homo sapiens
ttacgcaaggaagga

SEQ ID NO: 2977575 - DNA, 13 bp, Homo sapiens
ttacgctttgatt

SEQ ID NO: 2977576 - DNA, 16 bp, Homo sapiens
ttacgctttgattcat

SEQ ID NO: 2977577 - DNA, 16 bp, Homo sapiens
ttacggtagttaggat

SEQ ID NO: 2977578 - DNA, 14 bp, Homo sapiens
ttacggtgtacagt

SEQ ID NO: 2977579 - DNA, 18 bp, Homo sapiens
ttactaaagaaaatatct

SEQ ID NO: 2977580 - DNA, 23 bp, Homo sapiens
ttactaaagaaaatatctgaaat

SEQ ID NO: 2977581 - DNA, 20 bp, Homo sapiens
ttactacccaaatctaaata

SEQ ID NO: 2977582 - DNA, 16 bp, Homo sapiens
ttactagggatccctc

SEQ ID NO: 2977583 - DNA, 20 bp, Homo sapiens
ttactagggatccctcatct

SEQ ID NO: 2977584 - DNA, 20 bp, Homo sapiens
ttactataagaactttgagc

SEQ ID NO: 2977585 - DNA, 14 bp, Homo sapiens
ttactatgcctgtg

SEQ ID NO: 2977586 - DNA, 19 bp, Homo sapiens
ttactcaccatatttgaat

SEQ ID NO: 2977587 - DNA, 19 bp, Homo sapiens
ttactcagagctgcgggct

SEQ ID NO: 2977588 - DNA, 20 bp, Homo sapiens
ttactcagagctgcgggctg

SEQ ID NO: 2977589 - DNA, 21 bp, Homo sapiens
ttactcagcagcagagagccc

SEQ ID NO: 2977590 - DNA, 13 bp, Homo sapiens
ttactcagccctg

SEQ ID NO: 2977591 - DNA, 21 bp, Homo sapiens
ttactcaggggatgtttacct

SEQ ID NO: 2977592 - DNA, 19 bp, Homo sapiens
ttactccctacactgatgc

SEQ ID NO: 2977593 - DNA, 21 bp, Homo sapiens
ttactccctacactgatgcaa

SEQ ID NO: 2977594 - DNA, 11 bp, Homo sapiens
ttactcctggc

SEQ ID NO: 2977595 - DNA, 16 bp, Homo sapiens
ttactctccaacctgg

SEQ ID NO: 2977596 - DNA, 23 bp, Homo sapiens
ttactgaaatcttgtaagtattt

SEQ ID NO: 2977597 - DNA, 17 bp, Homo sapiens
ttactgatcatctgctg

SEQ ID NO: 2977598 - DNA, 23 bp, Homo sapiens
ttactggggctggggaaggaagc

SEQ ID NO: 2977599 - DNA, 13 bp, Homo sapiens
ttactgtacctgt

SEQ ID NO: 2977600 - DNA, 12 bp, Homo sapiens
ttactgtcttaa

SEQ ID NO: 2977601 - DNA, 16 bp, Homo sapiens
ttactgtcttttctat

SEQ ID NO: 2977602 - DNA, 21 bp, Homo sapiens
ttactgtgcattgggatttta

SEQ ID NO: 2977603 - DNA, 15 bp, Homo sapiens
ttactgttgtgacct

SEQ ID NO: 2977604 - DNA, 15 bp, Homo sapiens
ttactgtttgttatg

SEQ ID NO: 2977605 - DNA, 19 bp, Homo sapiens
ttacttaaagatttatcaa

SEQ ID NO: 2977606 - DNA, 22 bp, Homo sapiens
ttacttaaagatttatcaaatc

SEQ ID NO: 2977607 - DNA, 11 bp, Homo sapiens
ttacttacaaa

SEQ ID NO: 2977608 - DNA, 14 bp, Homo sapiens
ttacttacaaaaat

SEQ ID NO: 2977609 - DNA, 17 bp, Homo sapiens
ttacttatccctgccca

SEQ ID NO: 2977610 - DNA, 21 bp, Homo sapiens
ttacttcactatacaaacaaa

SEQ ID NO: 2977611 - DNA, 16 bp, Homo sapiens
ttacttccagcaaaat

SEQ ID NO: 2977612 - DNA, 17 bp, Homo sapiens
ttacttccagcaaaatc

SEQ ID NO: 2977613 - DNA, 14 bp, Homo sapiens
ttacttcccccacc

SEQ ID NO: 2977614 - DNA, 15 bp, Homo sapiens
ttacttcccccaccc

SEQ ID NO: 2977615 - DNA, 20 bp, Homo sapiens
ttacttctaatcttaaatca

SEQ ID NO: 2977616 - DNA, 11 bp, Homo sapiens
ttacttctaga

SEQ ID NO: 2977617 - DNA, 14 bp, Homo sapiens
ttacttcttgccct

SEQ ID NO: 2977618 - DNA, 19 bp, Homo sapiens
ttacttgtgttacttgcca

SEQ ID NO: 2977619 - DNA, 13 bp, Homo sapiens
ttactttgtgaat

SEQ ID NO: 2977620 - DNA, 18 bp, Homo sapiens
ttactttttaaacagtgt

SEQ ID NO: 2977621 - DNA, 23 bp, Homo sapiens
ttacttttttttttttttggtag

SEQ ID NO: 2977622 - DNA, 19 bp, Homo sapiens
ttagaaaacccaagttttt

SEQ ID NO: 2977623 - DNA, 15 bp, Homo sapiens
ttagaaacacataaa

SEQ ID NO: 2977624 - DNA, 16 bp, Homo sapiens
ttagaaacaccattca

SEQ ID NO: 2977625 - DNA, 23 bp, Homo sapiens
ttagaaataataaaaagaaagat

SEQ ID NO: 2977626 - DNA, 17 bp, Homo sapiens
ttagaaatcacaacaaa

SEQ ID NO: 2977627 - DNA, 17 bp, Homo sapiens
ttagaacgagcctggaa

SEQ ID NO: 2977628 - DNA, 17 bp, Homo sapiens
ttagaagacaattgaca

SEQ ID NO: 2977629 - DNA, 16 bp, Homo sapiens
ttagaagcctgacaac

SEQ ID NO: 2977630 - DNA, 17 bp, Homo sapiens
ttagaagcgacttttgt

SEQ ID NO: 2977631 - DNA, 12 bp, Homo sapiens
ttagaagtgtca

SEQ ID NO: 2977632 - DNA, 12 bp, Homo sapiens
ttagaatgtgat

SEQ ID NO: 2977633 - DNA, 17 bp, Homo sapiens
ttagaattaaaaaagca

SEQ ID NO: 2977634 - DNA, 19 bp, Homo sapiens
ttagacaaatactcatgtg

SEQ ID NO: 2977635 - DNA, 22 bp, Homo sapiens
ttagacaaatactcatgtgtat

SEQ ID NO: 2977636 - DNA, 14 bp, Homo sapiens
ttagactacattta

SEQ ID NO: 2977637 - DNA, 21 bp, Homo sapiens
ttagactcatggtgtgttaca

SEQ ID NO: 2977638 - DNA, 16 bp, Homo sapiens
ttagactggaacttga

SEQ ID NO: 2977639 - DNA, 17 bp, Homo sapiens
ttagactggaacttgaa

SEQ ID NO: 2977640 - DNA, 15 bp, Homo sapiens
ttagactggacagct

SEQ ID NO: 2977641 - DNA, 16 bp, Homo sapiens
ttagactggacagctt

SEQ ID NO: 2977642 - DNA, 20 bp, Homo sapiens
ttagactgtagcctggatat

SEQ ID NO: 2977643 - DNA, 19 bp, Homo sapiens
ttagagaactgaaaagaga

SEQ ID NO: 2977644 - DNA, 18 bp, Homo sapiens
ttagagagatttttcatt

SEQ ID NO: 2977645 - DNA, 15 bp, Homo sapiens
ttagagcattaaaat

SEQ ID NO: 2977646 - DNA, 16 bp, Homo sapiens
ttagaggaaaatgagt

SEQ ID NO: 2977647 - DNA, 12 bp, Homo sapiens
ttagaggaattt

SEQ ID NO: 2977648 - DNA, 15 bp, Homo sapiens
ttagagtaagaaatt

SEQ ID NO: 2977649 - DNA, 17 bp, Homo sapiens
ttagagtgtctttccac

SEQ ID NO: 2977650 - DNA, 15 bp, Homo sapiens
ttagagttcttttgg

SEQ ID NO: 2977651 - DNA, 14 bp, Homo sapiens
ttagataaaggaaa

SEQ ID NO: 2977652 - DNA, 18 bp, Homo sapiens
ttagataatcttttacat

SEQ ID NO: 2977653 - DNA, 20 bp, Homo sapiens
ttagatacactaaaaatctg

SEQ ID NO: 2977654 - DNA, 21 bp, Homo sapiens
ttagatctggtgtccagcatg

SEQ ID NO: 2977655 - DNA, 23 bp, Homo sapiens
ttagatggattctccactcagtt

SEQ ID NO: 2977656 - DNA, 21 bp, Homo sapiens
ttagatgtgatttaatagtgt

SEQ ID NO: 2977657 - DNA, 21 bp, Homo sapiens
ttagatgttccagtaatctaa

SEQ ID NO: 2977658 - DNA, 22 bp, Homo sapiens
ttagatgttccagtaatctaat

SEQ ID NO: 2977659 - DNA, 20 bp, Homo sapiens
ttagatgttctaagtctttc

SEQ ID NO: 2977660 - DNA, 22 bp, Homo sapiens
ttagatgttctaagtctttcca

SEQ ID NO: 2977661 - DNA, 16 bp, Homo sapiens
ttagatgttgccatgt

SEQ ID NO: 2977662 - DNA, 16 bp, Homo sapiens
ttagattggttctgtt

SEQ ID NO: 2977663 - DNA, 18 bp, Homo sapiens
ttagattgtattaactat

SEQ ID NO: 2977664 - DNA, 19 bp, Homo sapiens
ttagattttctggttctaa

SEQ ID NO: 2977665 - DNA, 20 bp, Homo sapiens
ttagattttctggttctaac

SEQ ID NO: 2977666 - DNA, 15 bp, Homo sapiens
ttagcagacagaagt

SEQ ID NO: 2977667 - DNA, 13 bp, Homo sapiens
ttagcagcccagc

SEQ ID NO: 2977668 - DNA, 13 bp, Homo sapiens
ttagccacaaaat

SEQ ID NO: 2977669 - DNA, 19 bp, Homo sapiens
ttagcccttccttgccagt

SEQ ID NO: 2977670 - DNA, 22 bp, Homo sapiens
ttagcctggatagccttgaaaa

SEQ ID NO: 2977671 - DNA, 21 bp, Homo sapiens
ttagccttgctgtagagactt

SEQ ID NO: 2977672 - DNA, 13 bp, Homo sapiens
ttagcgctctgga

SEQ ID NO: 2977673 - DNA, 21 bp, Homo sapiens
ttagctacaatcctacctttt

SEQ ID NO: 2977674 - DNA, 23 bp, Homo sapiens
ttagctacaatcctaccttttga

SEQ ID NO: 2977675 - DNA, 12 bp, Homo sapiens
ttagctccttga

SEQ ID NO: 2977676 - DNA, 20 bp, Homo sapiens
ttagctctggacgtgaaata

SEQ ID NO: 2977677 - DNA, 22 bp, Homo sapiens
ttagctctggacgtgaaatact

SEQ ID NO: 2977678 - DNA, 13 bp, Homo sapiens
ttagctctttctc

SEQ ID NO: 2977679 - DNA, 12 bp, Homo sapiens
ttagctgaaggg

SEQ ID NO: 2977680 - DNA, 16 bp, Homo sapiens
ttagctggccaaggag

SEQ ID NO: 2977681 - DNA, 12 bp, Homo sapiens
ttagcttcagga

SEQ ID NO: 2977682 - DNA, 14 bp, Homo sapiens
ttagcttcaggaac

SEQ ID NO: 2977683 - DNA, 15 bp, Homo sapiens
ttagcttggggccag

SEQ ID NO: 2977684 - DNA, 16 bp, Homo sapiens
ttagctttactgtttg

SEQ ID NO: 2977685 - DNA, 13 bp, Homo sapiens
ttaggaaaagcat

SEQ ID NO: 2977686 - DNA, 18 bp, Homo sapiens
ttaggaaggcagcattcc

SEQ ID NO: 2977687 - DNA, 14 bp, Homo sapiens
ttaggaatgagaag

SEQ ID NO: 2977688 - DNA, 19 bp, Homo sapiens
ttaggactacattttgctc

SEQ ID NO: 2977689 - DNA, 12 bp, Homo sapiens
ttaggagaagcc

SEQ ID NO: 2977690 - DNA, 17 bp, Homo sapiens
ttaggagctaaggctct

SEQ ID NO: 2977691 - DNA, 18 bp, Homo sapiens
ttaggatctcgcctggaa

SEQ ID NO: 2977692 - DNA, 17 bp, Homo sapiens
ttaggatggtaaagtta

SEQ ID NO: 2977693 - DNA, 17 bp, Homo sapiens
ttaggattgcagatttc

SEQ ID NO: 2977694 - DNA, 14 bp, Homo sapiens
ttaggcagggaagt

SEQ ID NO: 2977695 - DNA, 15 bp, Homo sapiens
ttaggctattcacaa

SEQ ID NO: 2977696 - DNA, 17 bp, Homo sapiens
ttaggctgctgggatgg

SEQ ID NO: 2977697 - DNA, 17 bp, Homo sapiens
ttaggctggtggcccag

SEQ ID NO: 2977698 - DNA, 14 bp, Homo sapiens
ttagggcttttatt

SEQ ID NO: 2977699 - DNA, 17 bp, Homo sapiens
ttagggcttttattttt

SEQ ID NO: 2977700 - DNA, 16 bp, Homo sapiens
ttaggggatggggagg

SEQ ID NO: 2977701 - DNA, 18 bp, Homo sapiens
ttccagagctctgaccca

SEQ ID NO: 2977702 - DNA, 16 bp, Homo sapiens
ttccagagctgcttct

SEQ ID NO: 2977703 - DNA, 20 bp, Homo sapiens
ttccagagctgcttctgtct

SEQ ID NO: 2977704 - DNA, 14 bp, Homo sapiens
ttccagatgtgatg

SEQ ID NO: 2977705 - DNA, 14 bp, Homo sapiens
ttccagcaaaatcc

SEQ ID NO: 2977706 - DNA, 20 bp, Homo sapiens
ttccagcatttagctggcca

SEQ ID NO: 2977707 - DNA, 16 bp, Homo sapiens
ttccagcctgccactc

SEQ ID NO: 2977708 - DNA, 14 bp, Homo sapiens
ttccaggatggtgt

SEQ ID NO: 2977709 - DNA, 11 bp, Homo sapiens
ttccaggctcc

SEQ ID NO: 2977710 - DNA, 19 bp, Homo sapiens
ttccaggcttccctgactt

SEQ ID NO: 2977711 - DNA, 17 bp, Homo sapiens
ttccagtcctaacaaat

SEQ ID NO: 2977712 - DNA, 16 bp, Homo sapiens
ttccagtgtccatgtt

SEQ ID NO: 2977713 - DNA, 21 bp, Homo sapiens
ttccagttaacctattttgtg

SEQ ID NO: 2977714 - DNA, 17 bp, Homo sapiens
ttccagttttgttttga

SEQ ID NO: 2977715 - DNA, 22 bp, Homo sapiens
ttccatagctcttcacttcctc

SEQ ID NO: 2977716 - DNA, 22 bp, Homo sapiens
ttccataggacaaatgataagt

SEQ ID NO: 2977717 - DNA, 22 bp, Homo sapiens
ttccatagttttgatgactggc

SEQ ID NO: 2977718 - DNA, 15 bp, Homo sapiens
ttccatatccctctt

SEQ ID NO: 2977719 - DNA, 15 bp, Homo sapiens
ttccatcctgtgtcc

SEQ ID NO: 2977720 - DNA, 17 bp, Homo sapiens
ttccatccttgactgaa

SEQ ID NO: 2977721 - DNA, 15 bp, Homo sapiens
ttccatgacattttt

SEQ ID NO: 2977722 - DNA, 16 bp, Homo sapiens
ttccatgacttcagag

SEQ ID NO: 2977723 - DNA, 17 bp, Homo sapiens
ttccatggcttcctgag

SEQ ID NO: 2977724 - DNA, 16 bp, Homo sapiens
ttccatgtttagcaga

SEQ ID NO: 2977725 - DNA, 11 bp, Homo sapiens
ttccatgtttt

SEQ ID NO: 2977726 - DNA, 15 bp, Homo sapiens
ttccattagcatttg

SEQ ID NO: 2977727 - DNA, 13 bp, Homo sapiens
ttccattccttca

SEQ ID NO: 2977728 - DNA, 16 bp, Homo sapiens
ttccattcttggcatc

SEQ ID NO: 2977729 - DNA, 16 bp, Homo sapiens
ttccattggtccaaga

SEQ ID NO: 2977730 - DNA, 20 bp, Homo sapiens
ttccattgtagtggcctgtg

SEQ ID NO: 2977731 - DNA, 15 bp, Homo sapiens
ttccattgtttgaaa

SEQ ID NO: 2977732 - DNA, 23 bp, Homo sapiens
ttccatttatgttttttctgatt

SEQ ID NO: 2977733 - DNA, 22 bp, Homo sapiens
ttccatttgaggatttagaagt

SEQ ID NO: 2977734 - DNA, 23 bp, Homo sapiens
ttccattttctataagaaaaagg

SEQ ID NO: 2977735 - DNA, 17 bp, Homo sapiens
ttcccaaaacaatggtg

SEQ ID NO: 2977736 - DNA, 19 bp, Homo sapiens
ttcccaacccccagccccc

SEQ ID NO: 2977737 - DNA, 23 bp, Homo sapiens
ttcccaacccccagcccccaccc

SEQ ID NO: 2977738 - DNA, 21 bp, Homo sapiens
ttcccaaccccttaagccctg

SEQ ID NO: 2977739 - DNA, 15 bp, Homo sapiens
ttcccaactctagct

SEQ ID NO: 2977740 - DNA, 16 bp, Homo sapiens
ttcccaacttccctgt

SEQ ID NO: 2977741 - DNA, 19 bp, Homo sapiens
ttcccaacttccctgttct

SEQ ID NO: 2977742 - DNA, 11 bp, Homo sapiens
ttcccaagctc

SEQ ID NO: 2977743 - DNA, 22 bp, Homo sapiens
ttcccaatggtgtttttcttgt

SEQ ID NO: 2977744 - DNA, 14 bp, Homo sapiens
ttcccaattcacat

SEQ ID NO: 2977745 - DNA, 15 bp, Homo sapiens
ttcccacacctgcct

SEQ ID NO: 2977746 - DNA, 18 bp, Homo sapiens
ttcccacaggacatttct

SEQ ID NO: 2977747 - DNA, 13 bp, Homo sapiens
ttcccacatcttt

SEQ ID NO: 2977748 - DNA, 11 bp, Homo sapiens
ttcccaccctg

SEQ ID NO: 2977749 - DNA, 21 bp, Homo sapiens
ttcccactgcactccagcctg

SEQ ID NO: 2977750 - DNA, 17 bp, Homo sapiens
ttcccactttcccaccc

SEQ ID NO: 2977751 - DNA, 22 bp, Homo sapiens
ttcccagagacaggaaaatcct

SEQ ID NO: 2977752 - DNA, 16 bp, Homo sapiens
ttcccagctctccctc

SEQ ID NO: 2977753 - DNA, 20 bp, Homo sapiens
ttcccaggaccctgaagggg

SEQ ID NO: 2977754 - DNA, 16 bp, Homo sapiens
ttcccaggccagggct

SEQ ID NO: 2977755 - DNA, 22 bp, Homo sapiens
ttcccatttcgtgtaatattct

SEQ ID NO: 2977756 - DNA, 15 bp, Homo sapiens
ttccccaaaaattga

SEQ ID NO: 2977757 - DNA, 15 bp, Homo sapiens
ttccccaacagtgtg

SEQ ID NO: 2977758 - DNA, 16 bp, Homo sapiens
ttccccaacagtgtga

SEQ ID NO: 2977759 - DNA, 14 bp, Homo sapiens
ttccccaccccttc

SEQ ID NO: 2977760 - DNA, 17 bp, Homo sapiens
ttccccagacttgcact

SEQ ID NO: 2977761 - DNA, 12 bp, Homo sapiens
ttccccagagaa

SEQ ID NO: 2977762 - DNA, 14 bp, Homo sapiens
ttccccagccacag

SEQ ID NO: 2977763 - DNA, 19 bp, Homo sapiens
ttccccatctcaggccaga

SEQ ID NO: 2977764 - DNA, 17 bp, Homo sapiens
ttccccatcttctaaac

SEQ ID NO: 2977765 - DNA, 16 bp, Homo sapiens
ttcccccaccctgggt

SEQ ID NO: 2977766 - DNA, 16 bp, Homo sapiens
ttcccccaggcgcctg

SEQ ID NO: 2977767 - DNA, 15 bp, Homo sapiens
ttccccctgccctgt

SEQ ID NO: 2977768 - DNA, 17 bp, Homo sapiens
ttccccggtcccttgag

SEQ ID NO: 2977769 - DNA, 22 bp, Homo sapiens
ttcccctcagaaaaaaattcat

SEQ ID NO: 2977770 - DNA, 17 bp, Homo sapiens
ttcccctcctttgtctt

SEQ ID NO: 2977771 - DNA, 17 bp, Homo sapiens
ttcccctcttttgtctt

SEQ ID NO: 2977772 - DNA, 19 bp, Homo sapiens
ttccccttgaacctcatta

SEQ ID NO: 2977773 - DNA, 20 bp, Homo sapiens
ttccccttgaacctcattaa

SEQ ID NO: 2977774 - DNA, 17 bp, Homo sapiens
ttccccttgtccctggg

SEQ ID NO: 2977775 - DNA, 19 bp, Homo sapiens
ttccccttgtccctggggc

SEQ ID NO: 2977776 - DNA, 14 bp, Homo sapiens
ttcccgaaggccga

SEQ ID NO: 2977777 - DNA, 15 bp, Homo sapiens
ttcccgcctcagcct

SEQ ID NO: 2977778 - DNA, 16 bp, Homo sapiens
ttcccgcctcagcctc

SEQ ID NO: 2977779 - DNA, 17 bp, Homo sapiens
ttcccgggcccttcagt

SEQ ID NO: 2977780 - DNA, 14 bp, Homo sapiens
ttccctaacactta

SEQ ID NO: 2977781 - DNA, 13 bp, Homo sapiens
ttccctcactctt

SEQ ID NO: 2977782 - DNA, 19 bp, Homo sapiens
ttccctcactcttcctcat

SEQ ID NO: 2977783 - DNA, 24 bp, Homo sapiens
ttccctccagagaaagcacaattt

SEQ ID NO: 2977784 - DNA, 19 bp, Homo sapiens
ttccctccgggcaggggag

SEQ ID NO: 2977785 - DNA, 14 bp, Homo sapiens
ttccctctcatctc

SEQ ID NO: 2977786 - DNA, 12 bp, Homo sapiens
ttccctcttgtg

SEQ ID NO: 2977787 - DNA, 19 bp, Homo sapiens
ttccctcttgtgctcagtc

SEQ ID NO: 2977788 - DNA, 17 bp, Homo sapiens
ttccctgaaaacccaga

SEQ ID NO: 2977789 - DNA, 19 bp, Homo sapiens
ttccctgaaaacccagaga

SEQ ID NO: 2977790 - DNA, 20 bp, Homo sapiens
ttccctgaaaacccagagag

SEQ ID NO: 2977791 - DNA, 20 bp, Homo sapiens
ttccctgacctcccaactct

SEQ ID NO: 2977792 - DNA, 16 bp, Homo sapiens
ttccctgactcattct

SEQ ID NO: 2977793 - DNA, 12 bp, Homo sapiens
ttccctgaggtg

SEQ ID NO: 2977794 - DNA, 18 bp, Homo sapiens
ttccctgagtcaccagga

SEQ ID NO: 2977795 - DNA, 16 bp, Homo sapiens
ttccctgcccctgtgc

SEQ ID NO: 2977796 - DNA, 15 bp, Homo sapiens
ttccctgcctccagc

SEQ ID NO: 2977797 - DNA, 15 bp, Homo sapiens
ttccctgtcagcctg

SEQ ID NO: 2977798 - DNA, 22 bp, Homo sapiens
ttcccttagactttagtagttt

SEQ ID NO: 2977799 - DNA, 15 bp, Homo sapiens
ttcccttccctcacc

SEQ ID NO: 2977800 - DNA, 16 bp, Homo sapiens
ttcccttccctcaccc

SEQ ID NO: 2977801 - DNA, 17 bp, Homo sapiens
ttcccttccggtgcgtg

SEQ ID NO: 2977802 - DNA, 17 bp, Homo sapiens
ttcccttttacatactg

SEQ ID NO: 2977803 - DNA, 22 bp, Homo sapiens
ttccgaagaagatgctccagca

SEQ ID NO: 2977804 - DNA, 13 bp, Homo sapiens
ttccgcttggagc

SEQ ID NO: 2977805 - DNA, 19 bp, Homo sapiens
ttccgcttggagcagaggg

SEQ ID NO: 2977806 - DNA, 22 bp, Homo sapiens
ttccgggcagaaacaataaaac

SEQ ID NO: 2977807 - DNA, 15 bp, Homo sapiens
ttccgtcagaaagtg

SEQ ID NO: 2977808 - DNA, 17 bp, Homo sapiens
ttccgtcagaaagtgta

SEQ ID NO: 2977809 - DNA, 18 bp, Homo sapiens
ttccgtccccccccaggc

SEQ ID NO: 2977810 - DNA, 14 bp, Homo sapiens
ttcctaaactccct

SEQ ID NO: 2977811 - DNA, 13 bp, Homo sapiens
ttcctaaagaaaa

SEQ ID NO: 2977812 - DNA, 17 bp, Homo sapiens
ttcctaagcctgtggct

SEQ ID NO: 2977813 - DNA, 14 bp, Homo sapiens
ttcctaaggctgca

SEQ ID NO: 2977814 - DNA, 22 bp, Homo sapiens
ttcctaagtagctgggtttaca

SEQ ID NO: 2977815 - DNA, 16 bp, Homo sapiens
ttcctaatatcaaatg

SEQ ID NO: 2977816 - DNA, 19 bp, Homo sapiens
ttcctaatatcaaatgcag

SEQ ID NO: 2977817 - DNA, 23 bp, Homo sapiens
ttcctacgtaggatgaaaagatt

SEQ ID NO: 2977818 - DNA, 14 bp, Homo sapiens
ttcctactttctat

SEQ ID NO: 2977819 - DNA, 22 bp, Homo sapiens
ttcctagcttatctccctgctt

SEQ ID NO: 2977820 - DNA, 15 bp, Homo sapiens
ttcctagtgaggaaa

SEQ ID NO: 2977821 - DNA, 22 bp, Homo sapiens
ttcctatcacctcgagaagtaa

SEQ ID NO: 2977822 - DNA, 14 bp, Homo sapiens
ttcctatgctttga

SEQ ID NO: 2977823 - DNA, 22 bp, Homo sapiens
ttcctcaagtatcttctatttt

SEQ ID NO: 2977824 - DNA, 14 bp, Homo sapiens
ttcctcatcctcag

SEQ ID NO: 2977825 - DNA, 16 bp, Homo sapiens
ttcctcatcctcagat

SEQ ID NO: 2977826 - DNA, 19 bp, Homo sapiens
ttcctcatcctcagatgct

SEQ ID NO: 2977827 - DNA, 16 bp, Homo sapiens
ttcctcatcctgcttc

SEQ ID NO: 2977828 - DNA, 15 bp, Homo sapiens
ttcctccagaagcct

SEQ ID NO: 2977829 - DNA, 22 bp, Homo sapiens
ttcctccagaagcctccttaca

SEQ ID NO: 2977830 - DNA, 12 bp, Homo sapiens
ttcctcccctcg

SEQ ID NO: 2977831 - DNA, 22 bp, Homo sapiens
ttcctccctcccacactcgcca

SEQ ID NO: 2977832 - DNA, 11 bp, Homo sapiens
ttcctcccttc

SEQ ID NO: 2977833 - DNA, 12 bp, Homo sapiens
ttcctcccttct

SEQ ID NO: 2977834 - DNA, 19 bp, Homo sapiens
ttcttgtattggtgaaaga

SEQ ID NO: 2977835 - DNA, 14 bp, Homo sapiens
ttcttgtctgtgtg

SEQ ID NO: 2977836 - DNA, 15 bp, Homo sapiens
ttcttgtgtctcctt

SEQ ID NO: 2977837 - DNA, 16 bp, Homo sapiens
ttcttgtgtctgtttt

SEQ ID NO: 2977838 - DNA, 11 bp, Homo sapiens
ttcttgtttct

SEQ ID NO: 2977839 - DNA, 12 bp, Homo sapiens
ttcttgtttctt

SEQ ID NO: 2977840 - DNA, 19 bp, Homo sapiens
ttcttgtttgtcagcatct

SEQ ID NO: 2977841 - DNA, 21 bp, Homo sapiens
ttcttgtttgtcagcatctga

SEQ ID NO: 2977842 - DNA, 23 bp, Homo sapiens
ttctttaaaaaacaactatggat

SEQ ID NO: 2977843 - DNA, 21 bp, Homo sapiens
ttctttaaagccagtcatcat

SEQ ID NO: 2977844 - DNA, 14 bp, Homo sapiens
ttctttagagaact

SEQ ID NO: 2977845 - DNA, 23 bp, Homo sapiens
ttctttagagaactgaaaagaga

SEQ ID NO: 2977846 - DNA, 15 bp, Homo sapiens
ttctttatactctct

SEQ ID NO: 2977847 - DNA, 23 bp, Homo sapiens
ttctttatatacaataatggaaa

SEQ ID NO: 2977848 - DNA, 15 bp, Homo sapiens
ttctttcaattctgt

SEQ ID NO: 2977849 - DNA, 12 bp, Homo sapiens
ttctttcttcct

SEQ ID NO: 2977850 - DNA, 13 bp, Homo sapiens
ttctttgatgtta

SEQ ID NO: 2977851 - DNA, 16 bp, Homo sapiens
ttctttgatttaactg

SEQ ID NO: 2977852 - DNA, 23 bp, Homo sapiens
ttctttgctgcagtcatctactt

SEQ ID NO: 2977853 - DNA, 14 bp, Homo sapiens
ttctttgctgtaag

SEQ ID NO: 2977854 - DNA, 17 bp, Homo sapiens
ttctttggacaacagga

SEQ ID NO: 2977855 - DNA, 21 bp, Homo sapiens
ttctttggggaaaaattcttg

SEQ ID NO: 2977856 - DNA, 20 bp, Homo sapiens
ttctttggtaggtaaatcta

SEQ ID NO: 2977857 - DNA, 22 bp, Homo sapiens
ttctttggtggagataaagatt

SEQ ID NO: 2977858 - DNA, 20 bp, Homo sapiens
ttcttttaaaaatacaatta

SEQ ID NO: 2977859 - DNA, 22 bp, Homo sapiens
ttcttttataataatgaatgtg

SEQ ID NO: 2977860 - DNA, 15 bp, Homo sapiens
ttcttttcacattct

SEQ ID NO: 2977861 - DNA, 14 bp, Homo sapiens
ttcttttcttttgt

SEQ ID NO: 2977862 - DNA, 15 bp, Homo sapiens
ttctttttcaaaaat

SEQ ID NO: 2977863 - DNA, 21 bp, Homo sapiens
ttcttttttttttttttgaga

SEQ ID NO: 2977864 - DNA, 22 bp, Homo sapiens
ttcttttttttttttttgagac

SEQ ID NO: 2977865 - DNA, 14 bp, Homo sapiens
ttgaaaaaaaatag

SEQ ID NO: 2977866 - DNA, 17 bp, Homo sapiens
ttgaaaaaaagtttcta

SEQ ID NO: 2977867 - DNA, 12 bp, Homo sapiens
ttgaaaaaagaa

SEQ ID NO: 2977868 - DNA, 16 bp, Homo sapiens
ttgaaaaaagaagttt

SEQ ID NO: 2977869 - DNA, 13 bp, Homo sapiens
ttgaaaaaattaa

SEQ ID NO: 2977870 - DNA, 19 bp, Homo sapiens
ttgaaaaaattaaaatctt

SEQ ID NO: 2977871 - DNA, 12 bp, Homo sapiens
ttgaaaacactt

SEQ ID NO: 2977872 - DNA, 13 bp, Homo sapiens
ttgaaaacactta

SEQ ID NO: 2977873 - DNA, 21 bp, Homo sapiens
ttgaaaacacttattttacac

SEQ ID NO: 2977874 - DNA, 15 bp, Homo sapiens
ttgaaaacccctggc

SEQ ID NO: 2977875 - DNA, 13 bp, Homo sapiens
ttgaaaacttttc

SEQ ID NO: 2977876 - DNA, 14 bp, Homo sapiens
ttgaaaacttttct

SEQ ID NO: 2977877 - DNA, 18 bp, Homo sapiens
ttgaaaagacaatagccc

SEQ ID NO: 2977878 - DNA, 19 bp, Homo sapiens
ttgaaaaggtctaagcaag

SEQ ID NO: 2977879 - DNA, 23 bp, Homo sapiens
ttgaaaagtatcaggaatataaa

SEQ ID NO: 2977880 - DNA, 21 bp, Homo sapiens
ttgaaaataagaatagaaata

SEQ ID NO: 2977881 - DNA, 16 bp, Homo sapiens
ttgaaacaaagaaggt

SEQ ID NO: 2977882 - DNA, 13 bp, Homo sapiens
ttgaaacagaaaa

SEQ ID NO: 2977883 - DNA, 18 bp, Homo sapiens
ttgaaagcaaaaatgcta

SEQ ID NO: 2977884 - DNA, 19 bp, Homo sapiens
ttgaaagcaaaaatgctaa

SEQ ID NO: 2977885 - DNA, 21 bp, Homo sapiens
ttgaaagcaaaaatgctaata

SEQ ID NO: 2977886 - DNA, 22 bp, Homo sapiens
ttgaaagtgcttcaagggtaat

SEQ ID NO: 2977887 - DNA, 22 bp, Homo sapiens
ttgaaatacgtttgtgtttcta

SEQ ID NO: 2977888 - DNA, 15 bp, Homo sapiens
ttgaaatctgtatct

SEQ ID NO: 2977889 - DNA, 14 bp, Homo sapiens
ttgaaatgaacttt

SEQ ID NO: 2977890 - DNA, 18 bp, Homo sapiens
ttgaaatgaactttgtca

SEQ ID NO: 2977891 - DNA, 13 bp, Homo sapiens
ttgaaatgtaatt

SEQ ID NO: 2977892 - DNA, 19 bp, Homo sapiens
ttgaaatgtggttttcctg

SEQ ID NO: 2977893 - DNA, 15 bp, Homo sapiens
ttgaaattctgaatt

SEQ ID NO: 2977894 - DNA, 16 bp, Homo sapiens
ttgaaattctgaattt

SEQ ID NO: 2977895 - DNA, 17 bp, Homo sapiens
ttgaaattctgaatttg

SEQ ID NO: 2977896 - DNA, 16 bp, Homo sapiens
ttgaaatttactgtga

SEQ ID NO: 2977897 - DNA, 20 bp, Homo sapiens
ttgaacacaaactgtaaata

SEQ ID NO: 2977898 - DNA, 17 bp, Homo sapiens
ttgaacccaggagttca

SEQ ID NO: 2977899 - DNA, 18 bp, Homo sapiens
ttgaacccgggaggcaga

SEQ ID NO: 2977900 - DNA, 12 bp, Homo sapiens
ttgaacctcatt

SEQ ID NO: 2977901 - DNA, 20 bp, Homo sapiens
ttgaaccttaaaaggtactg

SEQ ID NO: 2977902 - DNA, 15 bp, Homo sapiens
ttgaacgtatgtgct

SEQ ID NO: 2977903 - DNA, 18 bp, Homo sapiens
ttgaacgtgccagcagcc

SEQ ID NO: 2977904 - DNA, 14 bp, Homo sapiens
ttgaactctgggct

SEQ ID NO: 2977905 - DNA, 16 bp, Homo sapiens
ttgaactctgggctca

SEQ ID NO: 2977906 - DNA, 15 bp, Homo sapiens
ttgaactctggtggc

SEQ ID NO: 2977907 - DNA, 15 bp, Homo sapiens
ttgaactgagcttgg

SEQ ID NO: 2977908 - DNA, 21 bp, Homo sapiens
ttgaactgatagttactgttg

SEQ ID NO: 2977909 - DNA, 13 bp, Homo sapiens
ttgaactttggaa

SEQ ID NO: 2977910 - DNA, 18 bp, Homo sapiens
ttgaagaacaaaaggctt

SEQ ID NO: 2977911 - DNA, 19 bp, Homo sapiens
ttgaagaacaaaaggcttt

SEQ ID NO: 2977912 - DNA, 18 bp, Homo sapiens
ttgaagagcctgacaagt

SEQ ID NO: 2977913 - DNA, 18 bp, Homo sapiens
ttgaagcacgtacatttt

SEQ ID NO: 2977914 - DNA, 16 bp, Homo sapiens
ttgaagcatttcaaag

SEQ ID NO: 2977915 - DNA, 22 bp, Homo sapiens
ttgaagcatttcaaagccctgc

SEQ ID NO: 2977916 - DNA, 23 bp, Homo sapiens
ttgaagcatttcaaagccctgcc

SEQ ID NO: 2977917 - DNA, 13 bp, Homo sapiens
ttgaaggaaacag

SEQ ID NO: 2977918 - DNA, 14 bp, Homo sapiens
ttgaaggaaacagt

SEQ ID NO: 2977919 - DNA, 12 bp, Homo sapiens
ttgaaggcaaaa

SEQ ID NO: 2977920 - DNA, 17 bp, Homo sapiens
ttgaaggcaaaattgca

SEQ ID NO: 2977921 - DNA, 13 bp, Homo sapiens
ttgaaggcctgga

SEQ ID NO: 2977922 - DNA, 17 bp, Homo sapiens
ttgaagggaaatttcag

SEQ ID NO: 2977923 - DNA, 20 bp, Homo sapiens
ttgaagggaggggctgtgtt

SEQ ID NO: 2977924 - DNA, 19 bp, Homo sapiens
ttgaagggccagagccagg

SEQ ID NO: 2977925 - DNA, 15 bp, Homo sapiens
ttgaagtaaactgca

SEQ ID NO: 2977926 - DNA, 18 bp, Homo sapiens
ttgaagtaactataacaa

SEQ ID NO: 2977927 - DNA, 12 bp, Homo sapiens
ttgaagtaatga

SEQ ID NO: 2977928 - DNA, 17 bp, Homo sapiens
ttgaagtaatgaatttt

SEQ ID NO: 2977929 - DNA, 21 bp, Homo sapiens
ttgaagtacttgccagaagtt

SEQ ID NO: 2977930 - DNA, 18 bp, Homo sapiens
ttgaataaagaatacttg

SEQ ID NO: 2977931 - DNA, 22 bp, Homo sapiens
ttgaataaagaatacttgaact

SEQ ID NO: 2977932 - DNA, 22 bp, Homo sapiens
ttgaataatggtaccagataaa

SEQ ID NO: 2977933 - DNA, 20 bp, Homo sapiens
ttgaatataatatatttgtg

SEQ ID NO: 2977934 - DNA, 21 bp, Homo sapiens
ttgaatatttagcataaattt

SEQ ID NO: 2977935 - DNA, 14 bp, Homo sapiens
ttgaatcaataata

SEQ ID NO: 2977936 - DNA, 23 bp, Homo sapiens
ttgaatcatgtagtatcaaatat

SEQ ID NO: 2977937 - DNA, 17 bp, Homo sapiens
ttgaatctatttaagta

SEQ ID NO: 2977938 - DNA, 22 bp, Homo sapiens
ttgaatgtccaaaatttatatt

SEQ ID NO: 2977939 - DNA, 23 bp, Homo sapiens
ttgaatgtccaaaatttatattt

SEQ ID NO: 2977940 - DNA, 12 bp, Homo sapiens
ttgaatgtgatc

SEQ ID NO: 2977941 - DNA, 16 bp, Homo sapiens
ttgaatgtgatcatct

SEQ ID NO: 2977942 - DNA, 21 bp, Homo sapiens
ttgaatgtgatcatctttgct

SEQ ID NO: 2977943 - DNA, 21 bp, Homo sapiens
ttgaatgtggcttgagaaata

SEQ ID NO: 2977944 - DNA, 23 bp, Homo sapiens
ttgaattaaattaggaataaata

SEQ ID NO: 2977945 - DNA, 19 bp, Homo sapiens
ttgaattccaagtgtattt

SEQ ID NO: 2977946 - DNA, 15 bp, Homo sapiens
ttgaattgtaactgt

SEQ ID NO: 2977947 - DNA, 13 bp, Homo sapiens
ttgaattgttaca

SEQ ID NO: 2977948 - DNA, 19 bp, Homo sapiens
ttgacaaagtcaagccaca

SEQ ID NO: 2977949 - DNA, 12 bp, Homo sapiens
ttgacaacatct

SEQ ID NO: 2977950 - DNA, 13 bp, Homo sapiens
ttgacaacatggc

SEQ ID NO: 2977951 - DNA, 23 bp, Homo sapiens
ttgacaacatggcttctcctttg

SEQ ID NO: 2977952 - DNA, 17 bp, Homo sapiens
ttgacacaagtggacct

SEQ ID NO: 2977953 - DNA, 18 bp, Homo sapiens
ttgacacaagtggacctt

SEQ ID NO: 2977954 - DNA, 16 bp, Homo sapiens
ttgacacagaaaatgt

SEQ ID NO: 2977955 - DNA, 19 bp, Homo sapiens
ttgacagatcaagctgtga

SEQ ID NO: 2977956 - DNA, 18 bp, Homo sapiens
ttgacaggtacttggagg

SEQ ID NO: 2977957 - DNA, 17 bp, Homo sapiens
ttgacaggttttccaaa

SEQ ID NO: 2977958 - DNA, 17 bp, Homo sapiens
ttgacagttctgaagaa

SEQ ID NO: 2977959 - DNA, 19 bp, Homo sapiens
ttgacagtttttgacattt

SEQ ID NO: 2977960 - DNA, 17 bp, Homo sapiens
ttgacatatttaatgtt

SEQ ID NO: 2977961 - DNA, 15 bp, Homo sapiens
ttgacatgaccctct

SEQ ID NO: 2977962 - DNA, 15 bp, Homo sapiens
ttgacattctctatt

SEQ ID NO: 2977963 - DNA, 19 bp, Homo sapiens
ttgacattctctattgtaa

SEQ ID NO: 2977964 - DNA, 20 bp, Homo sapiens
ttgaccaagcaggaagctca

SEQ ID NO: 2977965 - DNA, 13 bp, Homo sapiens
ttgaccactccag

SEQ ID NO: 2977966 - DNA, 12 bp, Homo sapiens
ttgtcttgaaaa

SEQ ID NO: 2977967 - DNA, 14 bp, Homo sapiens
ttgtcttgaaagat

SEQ ID NO: 2977968 - DNA, 13 bp, Homo sapiens
ttgtctttctttg

SEQ ID NO: 2977969 - DNA, 15 bp, Homo sapiens
ttgtctttctttgct

SEQ ID NO: 2977970 - DNA, 17 bp, Homo sapiens
ttgtctttctttgctgc

SEQ ID NO: 2977971 - DNA, 14 bp, Homo sapiens
ttgtcttttcccct

SEQ ID NO: 2977972 - DNA, 13 bp, Homo sapiens
ttgtctttttaga

SEQ ID NO: 2977973 - DNA, 21 bp, Homo sapiens
ttgtgaaataaaactggcttt

SEQ ID NO: 2977974 - DNA, 19 bp, Homo sapiens
ttgtgaagaactattttat

SEQ ID NO: 2977975 - DNA, 15 bp, Homo sapiens
ttgtgaccaatacat

SEQ ID NO: 2977976 - DNA, 19 bp, Homo sapiens
ttgtgaccaatacatttgt

SEQ ID NO: 2977977 - DNA, 22 bp, Homo sapiens
ttgtgaccaatacatttgtatt

SEQ ID NO: 2977978 - DNA, 20 bp, Homo sapiens
ttgtgactaattgtataaca

SEQ ID NO: 2977979 - DNA, 20 bp, Homo sapiens
ttgtgactcagcagaggcag

SEQ ID NO: 2977980 - DNA, 12 bp, Homo sapiens
ttgtgagccctc

SEQ ID NO: 2977981 - DNA, 20 bp, Homo sapiens
ttgtgagccttgctgccaag

SEQ ID NO: 2977982 - DNA, 22 bp, Homo sapiens
ttgtgataagttctagttgctt

SEQ ID NO: 2977983 - DNA, 16 bp, Homo sapiens
ttgtgatatatgtatt

SEQ ID NO: 2977984 - DNA, 20 bp, Homo sapiens
ttgtgatgaatctacatttg

SEQ ID NO: 2977985 - DNA, 19 bp, Homo sapiens
ttgtgatgtatattccttt

SEQ ID NO: 2977986 - DNA, 20 bp, Homo sapiens
ttgtgatgtatattcctttg

SEQ ID NO: 2977987 - DNA, 21 bp, Homo sapiens
ttgtgattgaaagtatgttgt

SEQ ID NO: 2977988 - DNA, 14 bp, Homo sapiens
ttgtgcaaaagcag

SEQ ID NO: 2977989 - DNA, 18 bp, Homo sapiens
ttgtgcaaaagcaggctt

SEQ ID NO: 2977990 - DNA, 19 bp, Homo sapiens
ttgtgcaatagtcagagtg

SEQ ID NO: 2977991 - DNA, 11 bp, Homo sapiens
ttgtgcagaga

SEQ ID NO: 2977992 - DNA, 13 bp, Homo sapiens
ttgtgcagctttt

SEQ ID NO: 2977993 - DNA, 16 bp, Homo sapiens
ttgtgccaaactatat

SEQ ID NO: 2977994 - DNA, 10 bp, Homo sapiens
ttgtgccagc

SEQ ID NO: 2977995 - DNA, 11 bp, Homo sapiens
ttgtgcctccc

SEQ ID NO: 2977996 - DNA, 13 bp, Homo sapiens
ttgtgcctggggt

SEQ ID NO: 2977997 - DNA, 14 bp, Homo sapiens
ttgtgctcatgtgt

SEQ ID NO: 2977998 - DNA, 16 bp, Homo sapiens
ttgtgctctttcctgc

SEQ ID NO: 2977999 - DNA, 22 bp, Homo sapiens
ttgtgctttataccccatttga

SEQ ID NO: 2978000 - DNA, 15 bp, Homo sapiens
ttgtggataacaaag

SEQ ID NO: 2978001 - DNA, 23 bp, Homo sapiens
ttgtggatgttttaattccatga

SEQ ID NO: 2978002 - DNA, 18 bp, Homo sapiens
ttgtggcaagtgaatttg

SEQ ID NO: 2978003 - DNA, 22 bp, Homo sapiens
ttgtggcaagtgaatttgcctg

SEQ ID NO: 2978004 - DNA, 19 bp, Homo sapiens
ttgtggcccccgccccctc

SEQ ID NO: 2978005 - DNA, 13 bp, Homo sapiens
ttgtgggtcctgg

SEQ ID NO: 2978006 - DNA, 13 bp, Homo sapiens
ttgtgggtgggag

SEQ ID NO: 2978007 - DNA, 13 bp, Homo sapiens
ttgtggtgtctta

SEQ ID NO: 2978008 - DNA, 15 bp, Homo sapiens
ttgtgtaaaaaatgg

SEQ ID NO: 2978009 - DNA, 15 bp, Homo sapiens
ttgtgtaatatgaaa

SEQ ID NO: 2978010 - DNA, 23 bp, Homo sapiens
ttgtgtacagacttgttgtgact

SEQ ID NO: 2978011 - DNA, 21 bp, Homo sapiens
ttgtgtatcttcgtaacttca

SEQ ID NO: 2978012 - DNA, 22 bp, Homo sapiens
ttgtgtatcttcgtaacttcat

SEQ ID NO: 2978013 - DNA, 13 bp, Homo sapiens
ttgtgtatttaac

SEQ ID NO: 2978014 - DNA, 21 bp, Homo sapiens
ttgtgtatttaacagggaggg

SEQ ID NO: 2978015 - DNA, 20 bp, Homo sapiens
ttgtgtatttacgctttgat

SEQ ID NO: 2978016 - DNA, 18 bp, Homo sapiens
ttgtgtatttctctgtga

SEQ ID NO: 2978017 - DNA, 18 bp, Homo sapiens
ttgtgtcttaaactaggt

SEQ ID NO: 2978018 - DNA, 11 bp, Homo sapiens
ttgtgtgaccc

SEQ ID NO: 2978019 - DNA, 10 bp, Homo sapiens
ttgtgtgtgt

SEQ ID NO: 2978020 - DNA, 17 bp, Homo sapiens
ttgtgtgttgcactcaa

SEQ ID NO: 2978021 - DNA, 22 bp, Homo sapiens
ttgtgtgttgcactcaagttgt

SEQ ID NO: 2978022 - DNA, 23 bp, Homo sapiens
ttgtgtgttgcactcaagttgtt

SEQ ID NO: 2978023 - DNA, 21 bp, Homo sapiens
ttgtgttcagttccagctttt

SEQ ID NO: 2978024 - DNA, 14 bp, Homo sapiens
ttgtgttccttctg

SEQ ID NO: 2978025 - DNA, 16 bp, Homo sapiens
ttgtgtttgcttggtg

SEQ ID NO: 2978026 - DNA, 17 bp, Homo sapiens
ttgtgtttgtgtattta

SEQ ID NO: 2978027 - DNA, 13 bp, Homo sapiens
ttgttaaaaataa

SEQ ID NO: 2978028 - DNA, 22 bp, Homo sapiens
ttgttaccaaatacacatttca

SEQ ID NO: 2978029 - DNA, 12 bp, Homo sapiens
ttgttacccatg

SEQ ID NO: 2978030 - DNA, 18 bp, Homo sapiens
ttgttacccatgaaaaac

SEQ ID NO: 2978031 - DNA, 22 bp, Homo sapiens
ttgttactcatcgggcccaggg

SEQ ID NO: 2978032 - DNA, 12 bp, Homo sapiens
ttgttactttga

SEQ ID NO: 2978033 - DNA, 19 bp, Homo sapiens
ttgttagagaaaaatgctt

SEQ ID NO: 2978034 - DNA, 16 bp, Homo sapiens
ttgttagtttagtgtg

SEQ ID NO: 2978035 - DNA, 19 bp, Homo sapiens
ttgttataacttcataaaa

SEQ ID NO: 2978036 - DNA, 19 bp, Homo sapiens
ttgttatgtgtctggaaga

SEQ ID NO: 2978037 - DNA, 16 bp, Homo sapiens
ttgttattattgttaa

SEQ ID NO: 2978038 - DNA, 14 bp, Homo sapiens
ttgttattgcctct

SEQ ID NO: 2978039 - DNA, 15 bp, Homo sapiens
ttgttatttttaatc

SEQ ID NO: 2978040 - DNA, 13 bp, Homo sapiens
ttgttcaactatt

SEQ ID NO: 2978041 - DNA, 15 bp, Homo sapiens
ttgttcacctttgta

SEQ ID NO: 2978042 - DNA, 13 bp, Homo sapiens
ttgttcatattca

SEQ ID NO: 2978043 - DNA, 12 bp, Homo sapiens
ttgttcatttgg

SEQ ID NO: 2978044 - DNA, 15 bp, Homo sapiens
ttgttcatttttctc

SEQ ID NO: 2978045 - DNA, 19 bp, Homo sapiens
ttgttccagagctgcttct

SEQ ID NO: 2978046 - DNA, 17 bp, Homo sapiens
ttgttccctatgaaaga

SEQ ID NO: 2978047 - DNA, 14 bp, Homo sapiens
ttgttcctgctttc

SEQ ID NO: 2978048 - DNA, 17 bp, Homo sapiens
ttgttcgtttcatcagg

SEQ ID NO: 2978049 - DNA, 22 bp, Homo sapiens
ttgttctgactttttgtttctt

SEQ ID NO: 2978050 - DNA, 12 bp, Homo sapiens
ttgttctgagca

SEQ ID NO: 2978051 - DNA, 13 bp, Homo sapiens
ttgttctgagggg

SEQ ID NO: 2978052 - DNA, 11 bp, Homo sapiens
ttgttcttgtt

SEQ ID NO: 2978053 - DNA, 16 bp, Homo sapiens
ttgttcttttgtttca

SEQ ID NO: 2978054 - DNA, 17 bp, Homo sapiens
ttgttcttttgtttcat

SEQ ID NO: 2978055 - DNA, 13 bp, Homo sapiens
ttgttctttttat

SEQ ID NO: 2978056 - DNA, 16 bp, Homo sapiens
ttgttgagtctctgaa

SEQ ID NO: 2978057 - DNA, 19 bp, Homo sapiens
ttgttgcaagtactgctgt

SEQ ID NO: 2978058 - DNA, 19 bp, Homo sapiens
ttgttgcaccaattaagtg

SEQ ID NO: 2978059 - DNA, 15 bp, Homo sapiens
ttgttgctgctgctg

SEQ ID NO: 2978060 - DNA, 14 bp, Homo sapiens
ttgttgcttcttgt

SEQ ID NO: 2978061 - DNA, 18 bp, Homo sapiens
ttgttggagatgcagcct

SEQ ID NO: 2978062 - DNA, 20 bp, Homo sapiens
ttgttggagtgtaaaccaaa

SEQ ID NO: 2978063 - DNA, 15 bp, Homo sapiens
ttgttgtcaagtata

SEQ ID NO: 2978064 - DNA, 12 bp, Homo sapiens
ttgttgtctaca

SEQ ID NO: 2978065 - DNA, 14 bp, Homo sapiens
ttgttgtctacatt

SEQ ID NO: 2978066 - DNA, 16 bp, Homo sapiens
ttgttgtctacattaa

SEQ ID NO: 2978067 - DNA, 14 bp, Homo sapiens
ttgttgtttcagtg

SEQ ID NO: 2978068 - DNA, 12 bp, Homo sapiens
ttgttgttttct

SEQ ID NO: 2978069 - DNA, 18 bp, Homo sapiens
ttgtttaaaaaaagaaaa

SEQ ID NO: 2978070 - DNA, 14 bp, Homo sapiens
ttgtttaaaattct

SEQ ID NO: 2978071 - DNA, 15 bp, Homo sapiens
ttgtttaaaattctc

SEQ ID NO: 2978072 - DNA, 16 bp, Homo sapiens
ttgtttaatagatttg

SEQ ID NO: 2978073 - DNA, 11 bp, Homo sapiens
ttgtttagttt

SEQ ID NO: 2978074 - DNA, 12 bp, Homo sapiens
ttgtttattcca

SEQ ID NO: 2978075 - DNA, 14 bp, Homo sapiens
ttgtttattccaaa

SEQ ID NO: 2978076 - DNA, 16 bp, Homo sapiens
ttgtttcaattgcatc

SEQ ID NO: 2978077 - DNA, 12 bp, Homo sapiens
ttgtttccatag

SEQ ID NO: 2978078 - DNA, 15 bp, Homo sapiens
ttgtttctatacaaa

SEQ ID NO: 2978079 - DNA, 13 bp, Homo sapiens
ttgtttctgtcaa

SEQ ID NO: 2978080 - DNA, 17 bp, Homo sapiens
ttgtttctgtcaagcat

SEQ ID NO: 2978081 - DNA, 21 bp, Homo sapiens
ttgtttgaaacaaagaaggtt

SEQ ID NO: 2978082 - DNA, 15 bp, Homo sapiens
ttgtttgccatactt

SEQ ID NO: 2978083 - DNA, 20 bp, Homo sapiens
ttgtttggagggatcatttt

SEQ ID NO: 2978084 - DNA, 14 bp, Homo sapiens
ttgtttgtagcttt

SEQ ID NO: 2978085 - DNA, 20 bp, Homo sapiens
ttgtttgtagctttcctgga

SEQ ID NO: 2978086 - DNA, 21 bp, Homo sapiens
ttgtttgtcagcatctgacca

SEQ ID NO: 2978087 - DNA, 14 bp, Homo sapiens
ttgtttgttcacac

SEQ ID NO: 2978088 - DNA, 13 bp, Homo sapiens
ttgttttaaaact

SEQ ID NO: 2978089 - DNA, 15 bp, Homo sapiens
ttgttttaacacagt

SEQ ID NO: 2978090 - DNA, 15 bp, Homo sapiens
ttgttttaagcaaat

SEQ ID NO: 2978091 - DNA, 14 bp, Homo sapiens
ttgttttaatttta

SEQ ID NO: 2978092 - DNA, 12 bp, Homo sapiens
ttgttttattca

SEQ ID NO: 2978093 - DNA, 16 bp, Homo sapiens
ttgttttgtgcagaga

SEQ ID NO: 2978094 - DNA, 19 bp, Homo sapiens
ttgtttttcattcagtctt

SEQ ID NO: 2978095 - DNA, 18 bp, Homo sapiens
ttgtttttccatgtgttt

SEQ ID NO: 2978096 - DNA, 16 bp, Homo sapiens
ttgtttttggtttctt

SEQ ID NO: 2978097 - DNA, 21 bp, Homo sapiens
ttgttttttacttttttacac

SEQ ID NO: 2978098 - DNA, 21 bp, Homo sapiens
ttgttttttcaaaatagaaaa

SEQ ID NO: 2978099 - DNA, 13 bp, Homo sapiens
ttgttttttcata

SEQ ID NO: 2978100 - DNA, 17 bp, Homo sapiens
tttaaaaaaaatgtgaa

SEQ ID NO: 2978101 - DNA, 20 bp, Homo sapiens
tttattacaaattttcactg

SEQ ID NO: 2978102 - DNA, 12 bp, Homo sapiens
tttattacatta

SEQ ID NO: 2978103 - DNA, 23 bp, Homo sapiens
tttattaccccctccttcagaca

SEQ ID NO: 2978104 - DNA, 22 bp, Homo sapiens
tttattagccagtgaaacactt

SEQ ID NO: 2978105 - DNA, 22 bp, Homo sapiens
tttattagtcagagtttcagct

SEQ ID NO: 2978106 - DNA, 22 bp, Homo sapiens
tttattataaattctactaagt

SEQ ID NO: 2978107 - DNA, 14 bp, Homo sapiens
tttattcaaactac

SEQ ID NO: 2978108 - DNA, 15 bp, Homo sapiens
tttattcaaactacc

SEQ ID NO: 2978109 - DNA, 16 bp, Homo sapiens
tttattcctgtatgtt

SEQ ID NO: 2978110 - DNA, 14 bp, Homo sapiens
tttattcttctaga

SEQ ID NO: 2978111 - DNA, 15 bp, Homo sapiens
tttattcttctagag

SEQ ID NO: 2978112 - DNA, 16 bp, Homo sapiens
tttattcttctagagt

SEQ ID NO: 2978113 - DNA, 13 bp, Homo sapiens
tttattgacacag

SEQ ID NO: 2978114 - DNA, 16 bp, Homo sapiens
tttattgcaatgcaga

SEQ ID NO: 2978115 - DNA, 13 bp, Homo sapiens
tttattgcagttt

SEQ ID NO: 2978116 - DNA, 13 bp, Homo sapiens
tttattgccttct

SEQ ID NO: 2978117 - DNA, 23 bp, Homo sapiens
tttattggatgatacagtgtttt

SEQ ID NO: 2978118 - DNA, 18 bp, Homo sapiens
tttattgtattttgatga

SEQ ID NO: 2978119 - DNA, 19 bp, Homo sapiens
tttattgtattttgatgag

SEQ ID NO: 2978120 - DNA, 21 bp, Homo sapiens
tttattgtcttggttgccagt

SEQ ID NO: 2978121 - DNA, 17 bp, Homo sapiens
tttatttaaaagattca

SEQ ID NO: 2978122 - DNA, 20 bp, Homo sapiens
tttatttacagatgaatgta

SEQ ID NO: 2978123 - DNA, 15 bp, Homo sapiens
tttatttatgtactt

SEQ ID NO: 2978124 - DNA, 16 bp, Homo sapiens
tttatttattgtgtgt

SEQ ID NO: 2978125 - DNA, 14 bp, Homo sapiens
tttatttatttaca

SEQ ID NO: 2978126 - DNA, 11 bp, Homo sapiens
tttatttcatt

SEQ ID NO: 2978127 - DNA, 16 bp, Homo sapiens
tttatttctgagcaaa

SEQ ID NO: 2978128 - DNA, 12 bp, Homo sapiens
tttatttgttga

SEQ ID NO: 2978129 - DNA, 14 bp, Homo sapiens
tttatttgttgaga

SEQ ID NO: 2978130 - DNA, 21 bp, Homo sapiens
tttattttacacagaaacact

SEQ ID NO: 2978131 - DNA, 17 bp, Homo sapiens
tttattttataaattta

SEQ ID NO: 2978132 - DNA, 22 bp, Homo sapiens
tttattttggaattggtgtata

SEQ ID NO: 2978133 - DNA, 23 bp, Homo sapiens
tttattttggaattggtgtatat

SEQ ID NO: 2978134 - DNA, 12 bp, Homo sapiens
tttatttttcat

SEQ ID NO: 2978135 - DNA, 14 bp, Homo sapiens
tttatttttgcaaa

SEQ ID NO: 2978136 - DNA, 17 bp, Homo sapiens
tttattttttggacttc

SEQ ID NO: 2978137 - DNA, 11 bp, Homo sapiens
tttcaaaatag

SEQ ID NO: 2978138 - DNA, 21 bp, Homo sapiens
tttcaaaatagaaaagttatt

SEQ ID NO: 2978139 - DNA, 13 bp, Homo sapiens
tttcaaaatgctt

SEQ ID NO: 2978140 - DNA, 15 bp, Homo sapiens
tttcaaaatgctttt

SEQ ID NO: 2978141 - DNA, 14 bp, Homo sapiens
tttcaaaattaata

SEQ ID NO: 2978142 - DNA, 16 bp, Homo sapiens
tttcaaacacaaatgc

SEQ ID NO: 2978143 - DNA, 17 bp, Homo sapiens
tttcaaacacaaatgca

SEQ ID NO: 2978144 - DNA, 16 bp, Homo sapiens
tttcaaagactgccac

SEQ ID NO: 2978145 - DNA, 20 bp, Homo sapiens
tttcaaagccctgcctctgt

SEQ ID NO: 2978146 - DNA, 15 bp, Homo sapiens
tttcaaatcattttt

SEQ ID NO: 2978147 - DNA, 21 bp, Homo sapiens
tttcaaatcatttttgagact

SEQ ID NO: 2978148 - DNA, 21 bp, Homo sapiens
tttcaaatctgtaattaccat

SEQ ID NO: 2978149 - DNA, 21 bp, Homo sapiens
tttcaaattggagcttcatgg

SEQ ID NO: 2978150 - DNA, 14 bp, Homo sapiens
tttcaaatttagaa

SEQ ID NO: 2978151 - DNA, 23 bp, Homo sapiens
tttcaaatttagaaactaattga

SEQ ID NO: 2978152 - DNA, 20 bp, Homo sapiens
tttcaacactgaaaaaatac

SEQ ID NO: 2978153 - DNA, 19 bp, Homo sapiens
tttcaacagtgaagacaga

SEQ ID NO: 2978154 - DNA, 20 bp, Homo sapiens
tttcaacagtgaagacagaa

SEQ ID NO: 2978155 - DNA, 14 bp, Homo sapiens
tttcaaccccaccc

SEQ ID NO: 2978156 - DNA, 15 bp, Homo sapiens
tttcaactactcttt

SEQ ID NO: 2978157 - DNA, 16 bp, Homo sapiens
tttcaacttggatcat

SEQ ID NO: 2978158 - DNA, 12 bp, Homo sapiens
tttcaagaatga

SEQ ID NO: 2978159 - DNA, 19 bp, Homo sapiens
tttcaaggcactctagatt

SEQ ID NO: 2978160 - DNA, 21 bp, Homo sapiens
tttcaaggcactctagattcc

SEQ ID NO: 2978161 - DNA, 16 bp, Homo sapiens
tttcaagtagctggga

SEQ ID NO: 2978162 - DNA, 21 bp, Homo sapiens
tttcaagttaaataaattatg

SEQ ID NO: 2978163 - DNA, 14 bp, Homo sapiens
tttcaataaatgat

SEQ ID NO: 2978164 - DNA, 23 bp, Homo sapiens
tttcaatcactgtcctccacaca

SEQ ID NO: 2978165 - DNA, 20 bp, Homo sapiens
tttcaattgcatctcccaga

SEQ ID NO: 2978166 - DNA, 18 bp, Homo sapiens
tttcaatttactttttaa

SEQ ID NO: 2978167 - DNA, 18 bp, Homo sapiens
tttcacacatctgggtgc

SEQ ID NO: 2978168 - DNA, 15 bp, Homo sapiens
tttcacatgccttgc

SEQ ID NO: 2978169 - DNA, 15 bp, Homo sapiens
tttcacattcttata

SEQ ID NO: 2978170 - DNA, 17 bp, Homo sapiens
tttcacctccttcaatt

SEQ ID NO: 2978171 - DNA, 14 bp, Homo sapiens
tttcactgctgctc

SEQ ID NO: 2978172 - DNA, 17 bp, Homo sapiens
tttcactggaaaggaaa

SEQ ID NO: 2978173 - DNA, 23 bp, Homo sapiens
tttcactggaaaggaaagatgat

SEQ ID NO: 2978174 - DNA, 22 bp, Homo sapiens
tttcactggcataaatctgaag

SEQ ID NO: 2978175 - DNA, 13 bp, Homo sapiens
tttcactgtcttt

SEQ ID NO: 2978176 - DNA, 15 bp, Homo sapiens
tttcacttaaggaga

SEQ ID NO: 2978177 - DNA, 23 bp, Homo sapiens
tttcacttagaacctttctgtgt

SEQ ID NO: 2978178 - DNA, 15 bp, Homo sapiens
tttcacttgaaagat

SEQ ID NO: 2978179 - DNA, 20 bp, Homo sapiens
tttcacttgtcttgctctta

SEQ ID NO: 2978180 - DNA, 13 bp, Homo sapiens
tttcacttttaaa

SEQ ID NO: 2978181 - DNA, 10 bp, Homo sapiens
tttcagaccc

SEQ ID NO: 2978182 - DNA, 17 bp, Homo sapiens
tttcagagaccattgca

SEQ ID NO: 2978183 - DNA, 14 bp, Homo sapiens
tttcagcagactga

SEQ ID NO: 2978184 - DNA, 19 bp, Homo sapiens
tttcagcatcaaacatgaa

SEQ ID NO: 2978185 - DNA, 21 bp, Homo sapiens
tttcagcatcaaacatgaaaa

SEQ ID NO: 2978186 - DNA, 22 bp, Homo sapiens
tttcagcatcaaacatgaaaac

SEQ ID NO: 2978187 - DNA, 16 bp, Homo sapiens
tttcagccaaagtcct

SEQ ID NO: 2978188 - DNA, 14 bp, Homo sapiens
tttcagccaatctg

SEQ ID NO: 2978189 - DNA, 15 bp, Homo sapiens
tttcagccaatttgt

SEQ ID NO: 2978190 - DNA, 21 bp, Homo sapiens
tttcagcgatgtatgcagcta

SEQ ID NO: 2978191 - DNA, 16 bp, Homo sapiens
tttcagggaaattaat

SEQ ID NO: 2978192 - DNA, 15 bp, Homo sapiens
tttcagtaatgtctt

SEQ ID NO: 2978193 - DNA, 16 bp, Homo sapiens
tttcagtactttttta

SEQ ID NO: 2978194 - DNA, 21 bp, Homo sapiens
tttcagtcatataaaagctat

SEQ ID NO: 2978195 - DNA, 21 bp, Homo sapiens
tttcagtggggcagtcattat

SEQ ID NO: 2978196 - DNA, 14 bp, Homo sapiens
tttcagttttggtg

SEQ ID NO: 2978197 - DNA, 21 bp, Homo sapiens
tttcataatgcagaagtattc

SEQ ID NO: 2978198 - DNA, 21 bp, Homo sapiens
tttcatagtgcctttttcctt

SEQ ID NO: 2978199 - DNA, 17 bp, Homo sapiens
tttcatatctacagata

SEQ ID NO: 2978200 - DNA, 13 bp, Homo sapiens
tttcatattcttt

SEQ ID NO: 2978201 - DNA, 19 bp, Homo sapiens
tttcatctgggaaagacat

SEQ ID NO: 2978202 - DNA, 12 bp, Homo sapiens
tttcatgtacaa

SEQ ID NO: 2978203 - DNA, 16 bp, Homo sapiens
tttcatgttttaacaa

SEQ ID NO: 2978204 - DNA, 19 bp, Homo sapiens
tttcatgttttaacaaaaa

SEQ ID NO: 2978205 - DNA, 14 bp, Homo sapiens
tttcattaaacttg

SEQ ID NO: 2978206 - DNA, 21 bp, Homo sapiens
tttcattattagtactgctct

SEQ ID NO: 2978207 - DNA, 12 bp, Homo sapiens
tttcattcattt

SEQ ID NO: 2978208 - DNA, 17 bp, Homo sapiens
tttcattccaaagggga

SEQ ID NO: 2978209 - DNA, 14 bp, Homo sapiens
tttcattgcaaagt

SEQ ID NO: 2978210 - DNA, 20 bp, Homo sapiens
tttcatttttccatgacatt

SEQ ID NO: 2978211 - DNA, 12 bp, Homo sapiens
tttccaaaagta

SEQ ID NO: 2978212 - DNA, 13 bp, Homo sapiens
tttccaaaggcat

SEQ ID NO: 2978213 - DNA, 19 bp, Homo sapiens
tttccaaccggctttgtgg

SEQ ID NO: 2978214 - DNA, 16 bp, Homo sapiens
tttccaagtcctttaa

SEQ ID NO: 2978215 - DNA, 15 bp, Homo sapiens
tttccacactatgtg

SEQ ID NO: 2978216 - DNA, 22 bp, Homo sapiens
tttccaccttttgtttttccag

SEQ ID NO: 2978217 - DNA, 15 bp, Homo sapiens
tttccacgaaatcct

SEQ ID NO: 2978218 - DNA, 23 bp, Homo sapiens
tttccacggagccactcctctga

SEQ ID NO: 2978219 - DNA, 16 bp, Homo sapiens
tttccactcccactgc

SEQ ID NO: 2978220 - DNA, 19 bp, Homo sapiens
tttccactcctcctagcca

SEQ ID NO: 2978221 - DNA, 18 bp, Homo sapiens
tttccagaaggatttctt

SEQ ID NO: 2978222 - DNA, 18 bp, Homo sapiens
tttccagacttccttgag

SEQ ID NO: 2978223 - DNA, 11 bp, Homo sapiens
tttccagggag

SEQ ID NO: 2978224 - DNA, 18 bp, Homo sapiens
tttccagtctcttgtaca

SEQ ID NO: 2978225 - DNA, 22 bp, Homo sapiens
tttccatgacatttttcctctc

SEQ ID NO: 2978226 - DNA, 21 bp, Homo sapiens
tttccatggcaggaaggcttg

SEQ ID NO: 2978227 - DNA, 10 bp, Homo sapiens
tttcccaagc

SEQ ID NO: 2978228 - DNA, 14 bp, Homo sapiens
tttcccacatcttt

SEQ ID NO: 2978229 - DNA, 15 bp, Homo sapiens
tttcccacatctttc

SEQ ID NO: 2978230 - DNA, 17 bp, Homo sapiens
tttcccactttcttcta

SEQ ID NO: 2978231 - DNA, 11 bp, Homo sapiens
tttcccaggac

SEQ ID NO: 2978232 - DNA, 19 bp, Homo sapiens
tttcccatttgttgctgct

SEQ ID NO: 2978233 - DNA, 21 bp, Homo sapiens
tttcccatttgttgctgctgc

SEQ ID NO: 2978234 - DNA, 20 bp, Homo sapiens
tttgaaaaaattaaaatctt

SEQ ID NO: 2978235 - DNA, 21 bp, Homo sapiens
tttgaaaaaattaaaatcttt

SEQ ID NO: 2978236 - DNA, 14 bp, Homo sapiens
tttgaaaacactta

SEQ ID NO: 2978237 - DNA, 19 bp, Homo sapiens
tttgaaaacacttatttta

SEQ ID NO: 2978238 - DNA, 19 bp, Homo sapiens
tttgaaaaccatattttat

SEQ ID NO: 2978239 - DNA, 17 bp, Homo sapiens
tttgaaacacaatacct

SEQ ID NO: 2978240 - DNA, 23 bp, Homo sapiens
tttgaaagacttccaaagaatgt

SEQ ID NO: 2978241 - DNA, 21 bp, Homo sapiens
tttgaaagtgggtttcaattt

SEQ ID NO: 2978242 - DNA, 14 bp, Homo sapiens
tttgaaatgaactt

SEQ ID NO: 2978243 - DNA, 16 bp, Homo sapiens
tttgaaatgaactttg

SEQ ID NO: 2978244 - DNA, 18 bp, Homo sapiens
tttgaaattaacctctca

SEQ ID NO: 2978245 - DNA, 15 bp, Homo sapiens
tttgaaattctgaat

SEQ ID NO: 2978246 - DNA, 13 bp, Homo sapiens
tttgaaccaataa

SEQ ID NO: 2978247 - DNA, 14 bp, Homo sapiens
tttgaactttggaa

SEQ ID NO: 2978248 - DNA, 18 bp, Homo sapiens
tttgaagaacatgtgaga

SEQ ID NO: 2978249 - DNA, 20 bp, Homo sapiens
tttgaagatctgatttatac

SEQ ID NO: 2978250 - DNA, 13 bp, Homo sapiens
tttgaagcagctc

SEQ ID NO: 2978251 - DNA, 13 bp, Homo sapiens
tttgaaggaaaca

SEQ ID NO: 2978252 - DNA, 18 bp, Homo sapiens
tttgaatcaatgtattaa

SEQ ID NO: 2978253 - DNA, 22 bp, Homo sapiens
tttgaatgtatgcttcatacag

SEQ ID NO: 2978254 - DNA, 19 bp, Homo sapiens
tttgaatgtgatcatcttt

SEQ ID NO: 2978255 - DNA, 12 bp, Homo sapiens
tttgaatgttaa

SEQ ID NO: 2978256 - DNA, 13 bp, Homo sapiens
tttgaatgttaat

SEQ ID NO: 2978257 - DNA, 17 bp, Homo sapiens
tttgaattggcctgaac

SEQ ID NO: 2978258 - DNA, 14 bp, Homo sapiens
tttgaattgttaca

SEQ ID NO: 2978259 - DNA, 15 bp, Homo sapiens
tttgaattgttacat

SEQ ID NO: 2978260 - DNA, 16 bp, Homo sapiens
tttgaattttctgtgt

SEQ ID NO: 2978261 - DNA, 15 bp, Homo sapiens
tttgaattttgtttt

SEQ ID NO: 2978262 - DNA, 16 bp, Homo sapiens
tttgacagacatcctt

SEQ ID NO: 2978263 - DNA, 19 bp, Homo sapiens
tttgacatttaataacttt

SEQ ID NO: 2978264 - DNA, 20 bp, Homo sapiens
tttgacatttaataactttg

SEQ ID NO: 2978265 - DNA, 15 bp, Homo sapiens
tttgacatttatatt

SEQ ID NO: 2978266 - DNA, 14 bp, Homo sapiens
tttgaccaggaaag

SEQ ID NO: 2978267 - DNA, 19 bp, Homo sapiens
tttgaccttttatgtagta

SEQ ID NO: 2978268 - DNA, 15 bp, Homo sapiens
tttgacgggccaggc

SEQ ID NO: 2978269 - DNA, 14 bp, Homo sapiens
tttgactaatttta

SEQ ID NO: 2978270 - DNA, 16 bp, Homo sapiens
tttgactaattttaca

SEQ ID NO: 2978271 - DNA, 18 bp, Homo sapiens
tttgactcttgcaatcca

SEQ ID NO: 2978272 - DNA, 13 bp, Homo sapiens
tttgactttaatt

SEQ ID NO: 2978273 - DNA, 18 bp, Homo sapiens
tttgactttcttctgaat

SEQ ID NO: 2978274 - DNA, 19 bp, Homo sapiens
tttgagaactccagctggt

SEQ ID NO: 2978275 - DNA, 18 bp, Homo sapiens
tttgagaagaaaacatct

SEQ ID NO: 2978276 - DNA, 22 bp, Homo sapiens
tttgagatactattttcatttt

SEQ ID NO: 2978277 - DNA, 20 bp, Homo sapiens
tttgagatggagtttctctc

SEQ ID NO: 2978278 - DNA, 23 bp, Homo sapiens
tttgaggggaggagttccacaga

SEQ ID NO: 2978279 - DNA, 21 bp, Homo sapiens
tttgaggggcctgtgtggagg

SEQ ID NO: 2978280 - DNA, 15 bp, Homo sapiens
tttgagtaattttct

SEQ ID NO: 2978281 - DNA, 14 bp, Homo sapiens
tttgagtgctctga

SEQ ID NO: 2978282 - DNA, 21 bp, Homo sapiens
tttgagtggatgatgtttcgt

SEQ ID NO: 2978283 - DNA, 17 bp, Homo sapiens
tttgagtttgctgtttt

SEQ ID NO: 2978284 - DNA, 21 bp, Homo sapiens
tttgataaagtagtaaaaatt

SEQ ID NO: 2978285 - DNA, 13 bp, Homo sapiens
tttgataaagttt

SEQ ID NO: 2978286 - DNA, 18 bp, Homo sapiens
tttgataaagtttctcag

SEQ ID NO: 2978287 - DNA, 17 bp, Homo sapiens
tttgataccttcaatga

SEQ ID NO: 2978288 - DNA, 19 bp, Homo sapiens
tttgatagatgtttgactt

SEQ ID NO: 2978289 - DNA, 17 bp, Homo sapiens
tttgatatccaaagctg

SEQ ID NO: 2978290 - DNA, 23 bp, Homo sapiens
tttgatatccaaagctgaataca

SEQ ID NO: 2978291 - DNA, 15 bp, Homo sapiens
tttgatattatgtgg

SEQ ID NO: 2978292 - DNA, 21 bp, Homo sapiens
tttgatgaggtattttttcct

SEQ ID NO: 2978293 - DNA, 16 bp, Homo sapiens
tttgatgcatgtcttt

SEQ ID NO: 2978294 - DNA, 13 bp, Homo sapiens
tttgatggaggag

SEQ ID NO: 2978295 - DNA, 11 bp, Homo sapiens
tttgatgttaa

SEQ ID NO: 2978296 - DNA, 16 bp, Homo sapiens
tttgatgttaacacat

SEQ ID NO: 2978297 - DNA, 17 bp, Homo sapiens
tttgatgttaacacatt

SEQ ID NO: 2978298 - DNA, 16 bp, Homo sapiens
tttgattaacaatgta

SEQ ID NO: 2978299 - DNA, 20 bp, Homo sapiens
tttgattaacaatgtatttt

SEQ ID NO: 2978300 - DNA, 22 bp, Homo sapiens
tttgattagttttcttgttgct

SEQ ID NO: 2978301 - DNA, 14 bp, Homo sapiens
tttgatttaatgtt

SEQ ID NO: 2978302 - DNA, 13 bp, Homo sapiens
tttgcaaagtact

SEQ ID NO: 2978303 - DNA, 17 bp, Homo sapiens
tttgcaaagtactgtaa

SEQ ID NO: 2978304 - DNA, 14 bp, Homo sapiens
tttgcaacctcgct

SEQ ID NO: 2978305 - DNA, 20 bp, Homo sapiens
tttgcaagggaaaagtctct

SEQ ID NO: 2978306 - DNA, 14 bp, Homo sapiens
tttgcacagagggc

SEQ ID NO: 2978307 - DNA, 17 bp, Homo sapiens
tttgcaccccatgctgt

SEQ ID NO: 2978308 - DNA, 18 bp, Homo sapiens
tttgcaccccatgctgtt

SEQ ID NO: 2978309 - DNA, 20 bp, Homo sapiens
tttgcaccccatgctgttga

SEQ ID NO: 2978310 - DNA, 17 bp, Homo sapiens
tttgcacctttctagtt

SEQ ID NO: 2978311 - DNA, 20 bp, Homo sapiens
tttgcacctttctagttgaa

SEQ ID NO: 2978312 - DNA, 20 bp, Homo sapiens
tttgcacggtttggataatc

SEQ ID NO: 2978313 - DNA, 19 bp, Homo sapiens
tttgcagaaaagcacctgc

SEQ ID NO: 2978314 - DNA, 20 bp, Homo sapiens
tttgcagaaaagcacctgcc

SEQ ID NO: 2978315 - DNA, 22 bp, Homo sapiens
tttgcagaaaagcacctgccga

SEQ ID NO: 2978316 - DNA, 17 bp, Homo sapiens
tttgcagaagagggtgt

SEQ ID NO: 2978317 - DNA, 20 bp, Homo sapiens
tttgcaggggactgggccat

SEQ ID NO: 2978318 - DNA, 16 bp, Homo sapiens
tttgcatgtctaattc

SEQ ID NO: 2978319 - DNA, 17 bp, Homo sapiens
tttgcatgtctaattca

SEQ ID NO: 2978320 - DNA, 21 bp, Homo sapiens
tttgcatgtctaattcattta

SEQ ID NO: 2978321 - DNA, 21 bp, Homo sapiens
tttgcattaaattcacaaact

SEQ ID NO: 2978322 - DNA, 22 bp, Homo sapiens
tttgcattaaattcacaaactt

SEQ ID NO: 2978323 - DNA, 20 bp, Homo sapiens
tttgccagtgataagagcag

SEQ ID NO: 2978324 - DNA, 14 bp, Homo sapiens
tttgcccatcctcc

SEQ ID NO: 2978325 - DNA, 15 bp, Homo sapiens
tttgcccatcctccc

SEQ ID NO: 2978326 - DNA, 12 bp, Homo sapiens
tttgccctttga

SEQ ID NO: 2978327 - DNA, 18 bp, Homo sapiens
tttgcctcgaaagtgtca

SEQ ID NO: 2978328 - DNA, 14 bp, Homo sapiens
tttgcctgtaacaa

SEQ ID NO: 2978329 - DNA, 21 bp, Homo sapiens
tttgcctgtaacaagccagat

SEQ ID NO: 2978330 - DNA, 14 bp, Homo sapiens
tttgcctgttcagt

SEQ ID NO: 2978331 - DNA, 16 bp, Homo sapiens
tttgcgaaaagataaa

SEQ ID NO: 2978332 - DNA, 15 bp, Homo sapiens
tttgcgcaaacttta

SEQ ID NO: 2978333 - DNA, 22 bp, Homo sapiens
tttgcggggcctgtctcagtga

SEQ ID NO: 2978334 - DNA, 14 bp, Homo sapiens
tttgctataatcat

SEQ ID NO: 2978335 - DNA, 22 bp, Homo sapiens
tttgctataatcattagtttta

SEQ ID NO: 2978336 - DNA, 12 bp, Homo sapiens
tttgctatgtaa

SEQ ID NO: 2978337 - DNA, 23 bp, Homo sapiens
tttgctcagtgtctggctgcaga

SEQ ID NO: 2978338 - DNA, 20 bp, Homo sapiens
tttgctcttcaagaaatctg

SEQ ID NO: 2978339 - DNA, 15 bp, Homo sapiens
tttgctgctgtggaa

SEQ ID NO: 2978340 - DNA, 22 bp, Homo sapiens
tttgctggagggaagatcttga

SEQ ID NO: 2978341 - DNA, 15 bp, Homo sapiens
tttgctggcctggca

SEQ ID NO: 2978342 - DNA, 19 bp, Homo sapiens
tttgctgtaagatgtctgt

SEQ ID NO: 2978343 - DNA, 23 bp, Homo sapiens
tttgcttaccttgttttgccagt

SEQ ID NO: 2978344 - DNA, 12 bp, Homo sapiens
tttgcttagaaa

SEQ ID NO: 2978345 - DNA, 21 bp, Homo sapiens
tttgcttccttgcttttatgt

SEQ ID NO: 2978346 - DNA, 20 bp, Homo sapiens
tttgcttggtgctggtttat

SEQ ID NO: 2978347 - DNA, 17 bp, Homo sapiens
tttgctttctgaaattc

SEQ ID NO: 2978348 - DNA, 17 bp, Homo sapiens
tttgcttttcactggca

SEQ ID NO: 2978349 - DNA, 20 bp, Homo sapiens
tttgcttttgaacgtatgtg

SEQ ID NO: 2978350 - DNA, 21 bp, Homo sapiens
tttggaaagctgaaagggaag

SEQ ID NO: 2978351 - DNA, 14 bp, Homo sapiens
tttggaaccaaagt

SEQ ID NO: 2978352 - DNA, 19 bp, Homo sapiens
tttggaagcactttttctg

SEQ ID NO: 2978353 - DNA, 16 bp, Homo sapiens
tttggaattggtgtat

SEQ ID NO: 2978354 - DNA, 18 bp, Homo sapiens
tttggacttctgaagaga

SEQ ID NO: 2978355 - DNA, 22 bp, Homo sapiens
tttggagtgttatgtatttcct

SEQ ID NO: 2978356 - DNA, 16 bp, Homo sapiens
tttggataataaaaat

SEQ ID NO: 2978357 - DNA, 21 bp, Homo sapiens
tttggatcatttttaactgat

SEQ ID NO: 2978358 - DNA, 18 bp, Homo sapiens
tttggattcttatgtagc

SEQ ID NO: 2978359 - DNA, 17 bp, Homo sapiens
tttggatttcctttata

SEQ ID NO: 2978360 - DNA, 18 bp, Homo sapiens
tttggcaaactctccacc

SEQ ID NO: 2978361 - DNA, 23 bp, Homo sapiens
tttggcaaactctccaccacacg

SEQ ID NO: 2978362 - DNA, 18 bp, Homo sapiens
tttggcagaactgctggg

SEQ ID NO: 2978363 - DNA, 16 bp, Homo sapiens
tttggcatctgcaaag

SEQ ID NO: 2978364 - DNA, 14 bp, Homo sapiens
tttggcatgtttaa

SEQ ID NO: 2978365 - DNA, 16 bp, Homo sapiens
tttggcatgtttaatt

SEQ ID NO: 2978366 - DNA, 19 bp, Homo sapiens
aaaatgtaaaggagtcaaa

SEQ ID NO: 2978367 - DNA, 23 bp, Homo sapiens
aaaatgtaagattatagattcta

SEQ ID NO: 2978368 - DNA, 17 bp, Homo sapiens
aaaatgtcctgcctttt

SEQ ID NO: 2978369 - DNA, 15 bp, Homo sapiens
aaaatgtcttgtgta

SEQ ID NO: 2978370 - DNA, 19 bp, Homo sapiens
aaaatgtgaaatttttcca

SEQ ID NO: 2978371 - DNA, 21 bp, Homo sapiens
aaaatgtgaaatttttccaca

SEQ ID NO: 2978372 - DNA, 17 bp, Homo sapiens
aaaatgtgatgttctaa

SEQ ID NO: 2978373 - DNA, 22 bp, Homo sapiens
aaaatgtggtctgccaatctgt

SEQ ID NO: 2978374 - DNA, 20 bp, Homo sapiens
aaaatgtgtctgcaacatgg

SEQ ID NO: 2978375 - DNA, 20 bp, Homo sapiens
aaaatgttaaacccttacca

SEQ ID NO: 2978376 - DNA, 18 bp, Homo sapiens
aaaatgttatcttctcaa

SEQ ID NO: 2978377 - DNA, 16 bp, Homo sapiens
aaaatgtttactgtaa

SEQ ID NO: 2978378 - DNA, 16 bp, Homo sapiens
aaaatgtttcatttac

SEQ ID NO: 2978379 - DNA, 18 bp, Homo sapiens
aaaatgttttagcaattt

SEQ ID NO: 2978380 - DNA, 18 bp, Homo sapiens
aaaattaagctgtaatca

SEQ ID NO: 2978381 - DNA, 17 bp, Homo sapiens
aaaattaagtagaacaa

SEQ ID NO: 2978382 - DNA, 19 bp, Homo sapiens
aaaattacactacaagttt

SEQ ID NO: 2978383 - DNA, 18 bp, Homo sapiens
aaaattagatgcatgttg

SEQ ID NO: 2978384 - DNA, 22 bp, Homo sapiens
aaaattatagatgggaatgaag

SEQ ID NO: 2978385 - DNA, 23 bp, Homo sapiens
aaaattatgcaattcagtgttcc

SEQ ID NO: 2978386 - DNA, 21 bp, Homo sapiens
aaaattatttgaaaacatata

SEQ ID NO: 2978387 - DNA, 13 bp, Homo sapiens
aaaattatttgca

SEQ ID NO: 2978388 - DNA, 15 bp, Homo sapiens
aaaattcagcggcag

SEQ ID NO: 2978389 - DNA, 22 bp, Homo sapiens
aaaattcatgatactcatttct

SEQ ID NO: 2978390 - DNA, 14 bp, Homo sapiens
aaaattcatttcta

SEQ ID NO: 2978391 - DNA, 17 bp, Homo sapiens
aaaattctctttggtca

SEQ ID NO: 2978392 - DNA, 16 bp, Homo sapiens
aaaattgaaaatatgt

SEQ ID NO: 2978393 - DNA, 15 bp, Homo sapiens
aaaattgcctttaaa

SEQ ID NO: 2978394 - DNA, 21 bp, Homo sapiens
aaaattgtataaattactttg

SEQ ID NO: 2978395 - DNA, 20 bp, Homo sapiens
aaaatttatattgtaaatat

SEQ ID NO: 2978396 - DNA, 13 bp, Homo sapiens
aaaatttattatt

SEQ ID NO: 2978397 - DNA, 12 bp, Homo sapiens
aaaatttattct

SEQ ID NO: 2978398 - DNA, 14 bp, Homo sapiens
aaaatttgtttgac

SEQ ID NO: 2978399 - DNA, 12 bp, Homo sapiens
aaaattttatga

SEQ ID NO: 2978400 - DNA, 16 bp, Homo sapiens
aaaattttttttcatg

SEQ ID NO: 2978401 - DNA, 14 bp, Homo sapiens
aaacaaaaaaaaca

SEQ ID NO: 2978402 - DNA, 11 bp, Homo sapiens
aaacaaagaag

SEQ ID NO: 2978403 - DNA, 15 bp, Homo sapiens
aaacaaagcttagca

SEQ ID NO: 2978404 - DNA, 17 bp, Homo sapiens
aaacaaataatttgaac

SEQ ID NO: 2978405 - DNA, 14 bp, Homo sapiens
aaacaacaaataat

SEQ ID NO: 2978406 - DNA, 22 bp, Homo sapiens
aaacaacattttgagaacaaag

SEQ ID NO: 2978407 - DNA, 14 bp, Homo sapiens
aaacaaccttcagc

SEQ ID NO: 2978408 - DNA, 19 bp, Homo sapiens
aaacaagatgctggatgtc

SEQ ID NO: 2978409 - DNA, 23 bp, Homo sapiens
aaacaagcttcaaagccatatgg

SEQ ID NO: 2978410 - DNA, 16 bp, Homo sapiens
aaacaataattttaac

SEQ ID NO: 2978411 - DNA, 15 bp, Homo sapiens
aaacaatattgtttc

SEQ ID NO: 2978412 - DNA, 16 bp, Homo sapiens
aaacaatattgtttct

SEQ ID NO: 2978413 - DNA, 17 bp, Homo sapiens
aaacaatattgtttcta

SEQ ID NO: 2978414 - DNA, 22 bp, Homo sapiens
aaacaatggtgtggtgaatgtg

SEQ ID NO: 2978415 - DNA, 18 bp, Homo sapiens
aaacaattctttcaactg

SEQ ID NO: 2978416 - DNA, 15 bp, Homo sapiens
aaacaatttaaattg

SEQ ID NO: 2978417 - DNA, 14 bp, Homo sapiens
aaacacaacacaag

SEQ ID NO: 2978418 - DNA, 17 bp, Homo sapiens
aaacacactgaggcagg

SEQ ID NO: 2978419 - DNA, 19 bp, Homo sapiens
aaacacactgaggcaggga

SEQ ID NO: 2978420 - DNA, 21 bp, Homo sapiens
aaacacagacattctgccagg

SEQ ID NO: 2978421 - DNA, 11 bp, Homo sapiens
aaacacagagg

SEQ ID NO: 2978422 - DNA, 17 bp, Homo sapiens
aaacacatacaaaagaa

SEQ ID NO: 2978423 - DNA, 23 bp, Homo sapiens
aaacacatacaaaagaattaaac

SEQ ID NO: 2978424 - DNA, 16 bp, Homo sapiens
aaacacattgttattt

SEQ ID NO: 2978425 - DNA, 20 bp, Homo sapiens
aaacacattgttattttcag

SEQ ID NO: 2978426 - DNA, 14 bp, Homo sapiens
aaacactccttgca

SEQ ID NO: 2978427 - DNA, 13 bp, Homo sapiens
aaacactgccttt

SEQ ID NO: 2978428 - DNA, 18 bp, Homo sapiens
aaacactgcctttttatt

SEQ ID NO: 2978429 - DNA, 12 bp, Homo sapiens
aaacactgcttc

SEQ ID NO: 2978430 - DNA, 13 bp, Homo sapiens
aaacactttcaaa

SEQ ID NO: 2978431 - DNA, 14 bp, Homo sapiens
aaacactttcaaaa

SEQ ID NO: 2978432 - DNA, 21 bp, Homo sapiens
aaacactttctcttcttgttt

SEQ ID NO: 2978433 - DNA, 13 bp, Homo sapiens
aaacacttttttg

SEQ ID NO: 2978434 - DNA, 12 bp, Homo sapiens
aaacagaagcct

SEQ ID NO: 2978435 - DNA, 13 bp, Homo sapiens
aaacagaataaaa

SEQ ID NO: 2978436 - DNA, 18 bp, Homo sapiens
aaacagaataaaagttcc

SEQ ID NO: 2978437 - DNA, 19 bp, Homo sapiens
aaacagaggtaaaaaaaag

SEQ ID NO: 2978438 - DNA, 21 bp, Homo sapiens
aaacagaggtaaaaaaaagaa

SEQ ID NO: 2978439 - DNA, 13 bp, Homo sapiens
aaacagcaaacca

SEQ ID NO: 2978440 - DNA, 14 bp, Homo sapiens
aaacagcaaaccaa

SEQ ID NO: 2978441 - DNA, 19 bp, Homo sapiens
aaacagcaaaccaagagat

SEQ ID NO: 2978442 - DNA, 14 bp, Homo sapiens
aaacagcattgctt

SEQ ID NO: 2978443 - DNA, 21 bp, Homo sapiens
aaacagcattgctttctgaaa

SEQ ID NO: 2978444 - DNA, 14 bp, Homo sapiens
aaacagctgcctta

SEQ ID NO: 2978445 - DNA, 18 bp, Homo sapiens
aaacagggacaaagaaat

SEQ ID NO: 2978446 - DNA, 19 bp, Homo sapiens
aaacaggttaagtagcagg

SEQ ID NO: 2978447 - DNA, 17 bp, Homo sapiens
aaacagtctaaagaaga

SEQ ID NO: 2978448 - DNA, 12 bp, Homo sapiens
aaacagtgcctg

SEQ ID NO: 2978449 - DNA, 13 bp, Homo sapiens
aaacagtgtaaca

SEQ ID NO: 2978450 - DNA, 22 bp, Homo sapiens
aaacataaaaagcagaatttta

SEQ ID NO: 2978451 - DNA, 19 bp, Homo sapiens
aaacataactttgtaaata

SEQ ID NO: 2978452 - DNA, 17 bp, Homo sapiens
aaacataagatcactgc

SEQ ID NO: 2978453 - DNA, 23 bp, Homo sapiens
aaacataatagaatttcctaatg

SEQ ID NO: 2978454 - DNA, 17 bp, Homo sapiens
aaacataccaacatgtt

SEQ ID NO: 2978455 - DNA, 21 bp, Homo sapiens
aaacatagaaatggaaatttt

SEQ ID NO: 2978456 - DNA, 14 bp, Homo sapiens
aaacatagactgaa

SEQ ID NO: 2978457 - DNA, 15 bp, Homo sapiens
aaacatattttacat

SEQ ID NO: 2978458 - DNA, 22 bp, Homo sapiens
aaacatcagttactctgaaggg

SEQ ID NO: 2978459 - DNA, 23 bp, Homo sapiens
aaacatcagttactctgaagggc

SEQ ID NO: 2978460 - DNA, 12 bp, Homo sapiens
aaacatgaaaac

SEQ ID NO: 2978461 - DNA, 19 bp, Homo sapiens
aaacatgaccctaaatctt

SEQ ID NO: 2978462 - DNA, 21 bp, Homo sapiens
aaacatgaccctaaatcttga

SEQ ID NO: 2978463 - DNA, 14 bp, Homo sapiens
aaacatgctgttta

SEQ ID NO: 2978464 - DNA, 16 bp, Homo sapiens
aaacatgggtttagtt

SEQ ID NO: 2978465 - DNA, 13 bp, Homo sapiens
aaacatgtatgtg

SEQ ID NO: 2978466 - DNA, 23 bp, Homo sapiens
aaacatgtgcaactcttgtattg

SEQ ID NO: 2978467 - DNA, 12 bp, Homo sapiens
aaacatgtttcc

SEQ ID NO: 2978468 - DNA, 14 bp, Homo sapiens
aaacattcatcacc

SEQ ID NO: 2978469 - DNA, 15 bp, Homo sapiens
aaacattgatgaatg

SEQ ID NO: 2978470 - DNA, 22 bp, Homo sapiens
aaacatttatgacaagctgtat

SEQ ID NO: 2978471 - DNA, 20 bp, Homo sapiens
aaacatttcattatgaggtc

SEQ ID NO: 2978472 - DNA, 18 bp, Homo sapiens
aaacatttgctggagaaa

SEQ ID NO: 2978473 - DNA, 20 bp, Homo sapiens
aaacatttgtcagagaagaa

SEQ ID NO: 2978474 - DNA, 21 bp, Homo sapiens
aaacatttgtcagagaagaaa

SEQ ID NO: 2978475 - DNA, 19 bp, Homo sapiens
aaacattttaaatgaaagt

SEQ ID NO: 2978476 - DNA, 20 bp, Homo sapiens
aaacattttttaaggaggga

SEQ ID NO: 2978477 - DNA, 20 bp, Homo sapiens
aaaccaaaaggccgtgtgtt

SEQ ID NO: 2978478 - DNA, 12 bp, Homo sapiens
aaaccaagaaga

SEQ ID NO: 2978479 - DNA, 17 bp, Homo sapiens
aaaccaagagattgcta

SEQ ID NO: 2978480 - DNA, 20 bp, Homo sapiens
aaaccaagagattgctaatt

SEQ ID NO: 2978481 - DNA, 21 bp, Homo sapiens
aaaccaagattttgaaggaaa

SEQ ID NO: 2978482 - DNA, 16 bp, Homo sapiens
aaaccaagtgggctgg

SEQ ID NO: 2978483 - DNA, 14 bp, Homo sapiens
aaaccacaactttt

SEQ ID NO: 2978484 - DNA, 20 bp, Homo sapiens
aaaccacaaggctgttgcat

SEQ ID NO: 2978485 - DNA, 21 bp, Homo sapiens
aaaccacaaggctgttgcatg

SEQ ID NO: 2978486 - DNA, 13 bp, Homo sapiens
aaaccaggaaaaa

SEQ ID NO: 2978487 - DNA, 18 bp, Homo sapiens
aaaccaggaaaaaataaa

SEQ ID NO: 2978488 - DNA, 23 bp, Homo sapiens
aaaccaggacactaccctgagat

SEQ ID NO: 2978489 - DNA, 12 bp, Homo sapiens
aaaccatgtgac

SEQ ID NO: 2978490 - DNA, 18 bp, Homo sapiens
aaaccattggacagattt

SEQ ID NO: 2978491 - DNA, 21 bp, Homo sapiens
aaaccattggacagatttcag

SEQ ID NO: 2978492 - DNA, 22 bp, Homo sapiens
aaaccattggacagatttcagt

SEQ ID NO: 2978493 - DNA, 20 bp, Homo sapiens
aaaccattttcccatcatcc

SEQ ID NO: 2978494 - DNA, 15 bp, Homo sapiens
aaaccatttttgaac

SEQ ID NO: 2978495 - DNA, 15 bp, Homo sapiens
aaacccaagttttta

SEQ ID NO: 2978496 - DNA, 12 bp, Homo sapiens
aaacccagagag

SEQ ID NO: 2978497 - DNA, 19 bp, Homo sapiens
aaacccataggcccacaca

SEQ ID NO: 2978498 - DNA, 18 bp, Homo sapiens
aaatactgccagatgctg

SEQ ID NO: 2978499 - DNA, 14 bp, Homo sapiens
aaatactgttggtg

SEQ ID NO: 2978500 - DNA, 16 bp, Homo sapiens
aaatactttttctaat

SEQ ID NO: 2978501 - DNA, 18 bp, Homo sapiens
aaatagaggctttgagca

SEQ ID NO: 2978502 - DNA, 21 bp, Homo sapiens
aaatagagtgtttttcatgga

SEQ ID NO: 2978503 - DNA, 21 bp, Homo sapiens
aaatagataagagtagaaact

SEQ ID NO: 2978504 - DNA, 15 bp, Homo sapiens
aaatagataattaaa

SEQ ID NO: 2978505 - DNA, 18 bp, Homo sapiens
aaatagatacttttgata

SEQ ID NO: 2978506 - DNA, 13 bp, Homo sapiens
aaatagattttaa

SEQ ID NO: 2978507 - DNA, 20 bp, Homo sapiens
aaatagctatggttgtaaca

SEQ ID NO: 2978508 - DNA, 14 bp, Homo sapiens
aaataggaaacaag

SEQ ID NO: 2978509 - DNA, 15 bp, Homo sapiens
aaataggatcctgga

SEQ ID NO: 2978510 - DNA, 15 bp, Homo sapiens
aaataggatttctta

SEQ ID NO: 2978511 - DNA, 18 bp, Homo sapiens
aaataggatttcttaaat

SEQ ID NO: 2978512 - DNA, 19 bp, Homo sapiens
aaatagggtccttgaaaca

SEQ ID NO: 2978513 - DNA, 13 bp, Homo sapiens
aaatataaaatat

SEQ ID NO: 2978514 - DNA, 22 bp, Homo sapiens
aaatataaacaaagattcatga

SEQ ID NO: 2978515 - DNA, 13 bp, Homo sapiens
aaatatactgtaa

SEQ ID NO: 2978516 - DNA, 14 bp, Homo sapiens
aaatatactgtaaa

SEQ ID NO: 2978517 - DNA, 18 bp, Homo sapiens
aaatatacttaaatggaa

SEQ ID NO: 2978518 - DNA, 11 bp, Homo sapiens
aaatatatgta

SEQ ID NO: 2978519 - DNA, 22 bp, Homo sapiens
aaatatatgtatttttatataa

SEQ ID NO: 2978520 - DNA, 20 bp, Homo sapiens
aaatatcagttactcagccc

SEQ ID NO: 2978521 - DNA, 14 bp, Homo sapiens
aaatatctgctcaa

SEQ ID NO: 2978522 - DNA, 20 bp, Homo sapiens
aaatatgaagacataaaccc

SEQ ID NO: 2978523 - DNA, 13 bp, Homo sapiens
aaatatgaatgaa

SEQ ID NO: 2978524 - DNA, 22 bp, Homo sapiens
aaatatgcctctcctttgtata

SEQ ID NO: 2978525 - DNA, 23 bp, Homo sapiens
aaatatgcctctcctttgtatat

SEQ ID NO: 2978526 - DNA, 16 bp, Homo sapiens
aaatatggacacttaa

SEQ ID NO: 2978527 - DNA, 17 bp, Homo sapiens
aaatattaactactgta

SEQ ID NO: 2978528 - DNA, 13 bp, Homo sapiens
aaatattactgat

SEQ ID NO: 2978529 - DNA, 18 bp, Homo sapiens
aaatattagatgtgattt

SEQ ID NO: 2978530 - DNA, 22 bp, Homo sapiens
aaatattagatgtgatttaata

SEQ ID NO: 2978531 - DNA, 15 bp, Homo sapiens
aaatattagcaaaga

SEQ ID NO: 2978532 - DNA, 17 bp, Homo sapiens
aaatattatgagatgct

SEQ ID NO: 2978533 - DNA, 19 bp, Homo sapiens
aaatattccctagaaactt

SEQ ID NO: 2978534 - DNA, 20 bp, Homo sapiens
aaatattggtgttgtcagta

SEQ ID NO: 2978535 - DNA, 17 bp, Homo sapiens
aaatattgtaaatgcta

SEQ ID NO: 2978536 - DNA, 18 bp, Homo sapiens
aaatattgtaaatgctat

SEQ ID NO: 2978537 - DNA, 14 bp, Homo sapiens
aaatatttaaaaat

SEQ ID NO: 2978538 - DNA, 16 bp, Homo sapiens
aaatatttagcaaata

SEQ ID NO: 2978539 - DNA, 16 bp, Homo sapiens
aaatatttcagatatc

SEQ ID NO: 2978540 - DNA, 20 bp, Homo sapiens
aaatatttcctgacttgagt

SEQ ID NO: 2978541 - DNA, 21 bp, Homo sapiens
aaatatttcctgacttgagtg

SEQ ID NO: 2978542 - DNA, 21 bp, Homo sapiens
aaatatttgttcttataaacc

SEQ ID NO: 2978543 - DNA, 13 bp, Homo sapiens
aaatattttctat

SEQ ID NO: 2978544 - DNA, 19 bp, Homo sapiens
aaatattttctattttaag

SEQ ID NO: 2978545 - DNA, 21 bp, Homo sapiens
aaatattttctctgtactttt

SEQ ID NO: 2978546 - DNA, 22 bp, Homo sapiens
aaatattttgaatacacatctc

SEQ ID NO: 2978547 - DNA, 18 bp, Homo sapiens
aaatcaacctatcaaagc

SEQ ID NO: 2978548 - DNA, 18 bp, Homo sapiens
aaatcaacttgcttatca

SEQ ID NO: 2978549 - DNA, 23 bp, Homo sapiens
aaatcaagtatttgggaagtgaa

SEQ ID NO: 2978550 - DNA, 23 bp, Homo sapiens
aaatcaagtttgaccagtgcagt

SEQ ID NO: 2978551 - DNA, 12 bp, Homo sapiens
aaatcaagtttt

SEQ ID NO: 2978552 - DNA, 17 bp, Homo sapiens
aaatcaataaatgaata

SEQ ID NO: 2978553 - DNA, 20 bp, Homo sapiens
aaatcaccacaaactgtaat

SEQ ID NO: 2978554 - DNA, 15 bp, Homo sapiens
aaatcagaagtgcaa

SEQ ID NO: 2978555 - DNA, 17 bp, Homo sapiens
aaatcagaagtgcaaag

SEQ ID NO: 2978556 - DNA, 23 bp, Homo sapiens
aaatcagaataaattaatattgt

SEQ ID NO: 2978557 - DNA, 22 bp, Homo sapiens
aaatcagatgttgaattctttt

SEQ ID NO: 2978558 - DNA, 22 bp, Homo sapiens
aaatcagtgtttaaataaagac

SEQ ID NO: 2978559 - DNA, 19 bp, Homo sapiens
aaatcagttgattaagtta

SEQ ID NO: 2978560 - DNA, 15 bp, Homo sapiens
aaatcatgttttttc

SEQ ID NO: 2978561 - DNA, 23 bp, Homo sapiens
aaatccccatgcctgtggctgcg

SEQ ID NO: 2978562 - DNA, 17 bp, Homo sapiens
aaatccccccttcagaa

SEQ ID NO: 2978563 - DNA, 18 bp, Homo sapiens
aaatccctttcatgtctt

SEQ ID NO: 2978564 - DNA, 20 bp, Homo sapiens
aaatccgaacctcctctgtg

SEQ ID NO: 2978565 - DNA, 21 bp, Homo sapiens
aaatccgaacctcctctgtga

SEQ ID NO: 2978566 - DNA, 19 bp, Homo sapiens
aaatccgccagtgtttctg

SEQ ID NO: 2978567 - DNA, 20 bp, Homo sapiens
aaatccgccagtgtttctga

SEQ ID NO: 2978568 - DNA, 11 bp, Homo sapiens
aaatcctaatt

SEQ ID NO: 2978569 - DNA, 22 bp, Homo sapiens
aaatcctgactattatgttgtt

SEQ ID NO: 2978570 - DNA, 21 bp, Homo sapiens
aaatccttagatctggcatgt

SEQ ID NO: 2978571 - DNA, 16 bp, Homo sapiens
aaatccttccatgaaa

SEQ ID NO: 2978572 - DNA, 16 bp, Homo sapiens
aaatcctttctgcccc

SEQ ID NO: 2978573 - DNA, 23 bp, Homo sapiens
aaatcgccataggccaaggtgca

SEQ ID NO: 2978574 - DNA, 22 bp, Homo sapiens
aaatcgccttatgagaacatgg

SEQ ID NO: 2978575 - DNA, 17 bp, Homo sapiens
aaatcgtttaatgttta

SEQ ID NO: 2978576 - DNA, 18 bp, Homo sapiens
aaatcgtttaatgtttat

SEQ ID NO: 2978577 - DNA, 14 bp, Homo sapiens
aaatctacagtaca

SEQ ID NO: 2978578 - DNA, 18 bp, Homo sapiens
aaatctagagtttataca

SEQ ID NO: 2978579 - DNA, 20 bp, Homo sapiens
aaatctagagtttatacagt

SEQ ID NO: 2978580 - DNA, 19 bp, Homo sapiens
aaatctatttaattaggaa

SEQ ID NO: 2978581 - DNA, 22 bp, Homo sapiens
aaatctatttaattaggaaaaa

SEQ ID NO: 2978582 - DNA, 14 bp, Homo sapiens
aaatctcttccttc

SEQ ID NO: 2978583 - DNA, 19 bp, Homo sapiens
aaatctcttgattataaat

SEQ ID NO: 2978584 - DNA, 14 bp, Homo sapiens
aaatctgaatttta

SEQ ID NO: 2978585 - DNA, 19 bp, Homo sapiens
aaatctgaattttaaaaca

SEQ ID NO: 2978586 - DNA, 20 bp, Homo sapiens
aaatctgctggagtttcatg

SEQ ID NO: 2978587 - DNA, 22 bp, Homo sapiens
aaatctgctggagtttcatgta

SEQ ID NO: 2978588 - DNA, 23 bp, Homo sapiens
aaatctggtctaatttattaatc

SEQ ID NO: 2978589 - DNA, 18 bp, Homo sapiens
aaatctgtcataagcatt

SEQ ID NO: 2978590 - DNA, 20 bp, Homo sapiens
aaatctgtcataagcattac

SEQ ID NO: 2978591 - DNA, 14 bp, Homo sapiens
aaatctgtcctctg

SEQ ID NO: 2978592 - DNA, 21 bp, Homo sapiens
aaatctgtcctgtggcatgca

SEQ ID NO: 2978593 - DNA, 22 bp, Homo sapiens
aaatctgtcctgtggcatgcaa

SEQ ID NO: 2978594 - DNA, 13 bp, Homo sapiens
aaatctgtctttg

SEQ ID NO: 2978595 - DNA, 22 bp, Homo sapiens
aaatcttaatgaatgagtctgt

SEQ ID NO: 2978596 - DNA, 14 bp, Homo sapiens
aaatcttacaaaat

SEQ ID NO: 2978597 - DNA, 18 bp, Homo sapiens
aaatcttatagttctagg

SEQ ID NO: 2978598 - DNA, 19 bp, Homo sapiens
aaatcttatagttctaggc

SEQ ID NO: 2978599 - DNA, 18 bp, Homo sapiens
aaatcttgcagttttgta

SEQ ID NO: 2978600 - DNA, 19 bp, Homo sapiens
aaatcttgcagttttgtaa

SEQ ID NO: 2978601 - DNA, 20 bp, Homo sapiens
aaatctttcttcaaatctcc

SEQ ID NO: 2978602 - DNA, 15 bp, Homo sapiens
aaatgaaaatgaata

SEQ ID NO: 2978603 - DNA, 15 bp, Homo sapiens
aaatgaaaatgtctt

SEQ ID NO: 2978604 - DNA, 15 bp, Homo sapiens
aaatgaaagatgatt

SEQ ID NO: 2978605 - DNA, 13 bp, Homo sapiens
aaatgaaaggagt

SEQ ID NO: 2978606 - DNA, 23 bp, Homo sapiens
aaatgaaaggagtttaaaaacat

SEQ ID NO: 2978607 - DNA, 18 bp, Homo sapiens
aaatgaaagtattggcat

SEQ ID NO: 2978608 - DNA, 12 bp, Homo sapiens
aaatgaaatgag

SEQ ID NO: 2978609 - DNA, 13 bp, Homo sapiens
aaatgaactgtat

SEQ ID NO: 2978610 - DNA, 22 bp, Homo sapiens
aaatgaactgtattattgcaat

SEQ ID NO: 2978611 - DNA, 12 bp, Homo sapiens
aaatgaactttg

SEQ ID NO: 2978612 - DNA, 13 bp, Homo sapiens
aaatgaactttgt

SEQ ID NO: 2978613 - DNA, 14 bp, Homo sapiens
aaatgaaggtcttt

SEQ ID NO: 2978614 - DNA, 18 bp, Homo sapiens
aaatgaatagcttgtttc

SEQ ID NO: 2978615 - DNA, 14 bp, Homo sapiens
aaatgaatgtaaaa

SEQ ID NO: 2978616 - DNA, 21 bp, Homo sapiens
aaatgaatgtgcaaaaaaaga

SEQ ID NO: 2978617 - DNA, 18 bp, Homo sapiens
aaatgacactttataact

SEQ ID NO: 2978618 - DNA, 15 bp, Homo sapiens
aaatgacagactgaa

SEQ ID NO: 2978619 - DNA, 22 bp, Homo sapiens
aaatgactaaaaaacaaagaag

SEQ ID NO: 2978620 - DNA, 15 bp, Homo sapiens
aaatgagagcagaaa

SEQ ID NO: 2978621 - DNA, 20 bp, Homo sapiens
aaatgagcatctcaaatgtt

SEQ ID NO: 2978622 - DNA, 15 bp, Homo sapiens
aaatgaggaggatgc

SEQ ID NO: 2978623 - DNA, 9 bp, Homo sapiens
aaatgaggg

SEQ ID NO: 2978624 - DNA, 17 bp, Homo sapiens
aaatgaggtagctgaca

SEQ ID NO: 2978625 - DNA, 19 bp, Homo sapiens
aaatgatagatttgacctc

SEQ ID NO: 2978626 - DNA, 22 bp, Homo sapiens
aaatgatgatgtggaagaactt

SEQ ID NO: 2978627 - DNA, 23 bp, Homo sapiens
aaatgattgtttcttcttcatgc

SEQ ID NO: 2978628 - DNA, 14 bp, Homo sapiens
aaatgcaaatccta

SEQ ID NO: 2978629 - DNA, 21 bp, Homo sapiens
aacagaatgaaaaatgaaaga

SEQ ID NO: 2978630 - DNA, 15 bp, Homo sapiens
aacagagaaggcagg

SEQ ID NO: 2978631 - DNA, 23 bp, Homo sapiens
aacagagggaccaaattgcttct

SEQ ID NO: 2978632 - DNA, 22 bp, Homo sapiens
aacagagggaggaatgtgtgcc

SEQ ID NO: 2978633 - DNA, 22 bp, Homo sapiens
aacagaggtaaaaaaaagaagt

SEQ ID NO: 2978634 - DNA, 16 bp, Homo sapiens
aacagagttttctgtt

SEQ ID NO: 2978635 - DNA, 13 bp, Homo sapiens
aacagatctggaa

SEQ ID NO: 2978636 - DNA, 14 bp, Homo sapiens
aacagatcttttac

SEQ ID NO: 2978637 - DNA, 22 bp, Homo sapiens
aacagatgcaatgtgctactga

SEQ ID NO: 2978638 - DNA, 23 bp, Homo sapiens
aacagatgcaatgtgctactgat

SEQ ID NO: 2978639 - DNA, 16 bp, Homo sapiens
aacagattgtttgcaa

SEQ ID NO: 2978640 - DNA, 13 bp, Homo sapiens
aacagatttgtga

SEQ ID NO: 2978641 - DNA, 16 bp, Homo sapiens
aacagattttggggtt

SEQ ID NO: 2978642 - DNA, 15 bp, Homo sapiens
aacagcaaaccaaga

SEQ ID NO: 2978643 - DNA, 19 bp, Homo sapiens
aacagcagactcagctctg

SEQ ID NO: 2978644 - DNA, 21 bp, Homo sapiens
aacagcagggtacctgaaaga

SEQ ID NO: 2978645 - DNA, 12 bp, Homo sapiens
aacagcattgct

SEQ ID NO: 2978646 - DNA, 20 bp, Homo sapiens
aacagcattgctttctgaaa

SEQ ID NO: 2978647 - DNA, 12 bp, Homo sapiens
aacagccaacag

SEQ ID NO: 2978648 - DNA, 15 bp, Homo sapiens
aacagccactcccct

SEQ ID NO: 2978649 - DNA, 14 bp, Homo sapiens
aacagcctcacaga

SEQ ID NO: 2978650 - DNA, 13 bp, Homo sapiens
aacagcgctgggt

SEQ ID NO: 2978651 - DNA, 20 bp, Homo sapiens
aacagcggctggacttggag

SEQ ID NO: 2978652 - DNA, 19 bp, Homo sapiens
aacagctacaacagcctca

SEQ ID NO: 2978653 - DNA, 21 bp, Homo sapiens
aacagctacaacagcctcact

SEQ ID NO: 2978654 - DNA, 20 bp, Homo sapiens
aacagctctgcaggcttaat

SEQ ID NO: 2978655 - DNA, 21 bp, Homo sapiens
aacagctctgcaggcttaata

SEQ ID NO: 2978656 - DNA, 12 bp, Homo sapiens
aacagctgcctt

SEQ ID NO: 2978657 - DNA, 13 bp, Homo sapiens
aacagctgtggct

SEQ ID NO: 2978658 - DNA, 18 bp, Homo sapiens
aacagcttttcccaggag

SEQ ID NO: 2978659 - DNA, 19 bp, Homo sapiens
aacagcttttcccaggaga

SEQ ID NO: 2978660 - DNA, 22 bp, Homo sapiens
aacaggaggacaattcatgaac

SEQ ID NO: 2978661 - DNA, 10 bp, Homo sapiens
aacaggctgt

SEQ ID NO: 2978662 - DNA, 16 bp, Homo sapiens
aacagggcccaggcct

SEQ ID NO: 2978663 - DNA, 17 bp, Homo sapiens
aacagggcccaggcctg

SEQ ID NO: 2978664 - DNA, 15 bp, Homo sapiens
aacagggttggcatt

SEQ ID NO: 2978665 - DNA, 15 bp, Homo sapiens
aacaggtaatataaa

SEQ ID NO: 2978666 - DNA, 15 bp, Homo sapiens
aacaggtgctggccc

SEQ ID NO: 2978667 - DNA, 16 bp, Homo sapiens
aacaggtgctggccca

SEQ ID NO: 2978668 - DNA, 21 bp, Homo sapiens
aacaggttttcttctaatcat

SEQ ID NO: 2978669 - DNA, 22 bp, Homo sapiens
aacagtaattattatttaactc

SEQ ID NO: 2978670 - DNA, 21 bp, Homo sapiens
aacagtattctgtaaagctta

SEQ ID NO: 2978671 - DNA, 13 bp, Homo sapiens
aacagtcatgttt

SEQ ID NO: 2978672 - DNA, 21 bp, Homo sapiens
aacagtcatgttttaaatgta

SEQ ID NO: 2978673 - DNA, 23 bp, Homo sapiens
aacagtgctaaaaatgggacttc

SEQ ID NO: 2978674 - DNA, 14 bp, Homo sapiens
aacagtgctctgcc

SEQ ID NO: 2978675 - DNA, 15 bp, Homo sapiens
aacagtgctctgcct

SEQ ID NO: 2978676 - DNA, 23 bp, Homo sapiens
aacagtggccttgcttcttagac

SEQ ID NO: 2978677 - DNA, 14 bp, Homo sapiens
aacagtgtgaagtt

SEQ ID NO: 2978678 - DNA, 16 bp, Homo sapiens
aacagtgtgaagttag

SEQ ID NO: 2978679 - DNA, 18 bp, Homo sapiens
aacagtgtgaagttagaa

SEQ ID NO: 2978680 - DNA, 18 bp, Homo sapiens
aacagttttcctatgctt

SEQ ID NO: 2978681 - DNA, 21 bp, Homo sapiens
aacagttttcctatgctttga

SEQ ID NO: 2978682 - DNA, 23 bp, Homo sapiens
aacataaaaagcagaattttaat

SEQ ID NO: 2978683 - DNA, 15 bp, Homo sapiens
aacataatagaattt

SEQ ID NO: 2978684 - DNA, 23 bp, Homo sapiens
aacatagaaaaatgatgtcttta

SEQ ID NO: 2978685 - DNA, 16 bp, Homo sapiens
aacatagactgaagat

SEQ ID NO: 2978686 - DNA, 12 bp, Homo sapiens
aacatatctaaa

SEQ ID NO: 2978687 - DNA, 16 bp, Homo sapiens
aacatatctaaagtca

SEQ ID NO: 2978688 - DNA, 17 bp, Homo sapiens
aacatatgaaaatacaa

SEQ ID NO: 2978689 - DNA, 14 bp, Homo sapiens
aacatatggtctcc

SEQ ID NO: 2978690 - DNA, 15 bp, Homo sapiens
aacatattttacatc

SEQ ID NO: 2978691 - DNA, 16 bp, Homo sapiens
aacatccaaccttccc

SEQ ID NO: 2978692 - DNA, 18 bp, Homo sapiens
aacatcccattgccctgg

SEQ ID NO: 2978693 - DNA, 12 bp, Homo sapiens
aacatctagaaa

SEQ ID NO: 2978694 - DNA, 14 bp, Homo sapiens
aacatcttcatata

SEQ ID NO: 2978695 - DNA, 15 bp, Homo sapiens
aacatcttcatataa

SEQ ID NO: 2978696 - DNA, 12 bp, Homo sapiens
aacatgaaatga

SEQ ID NO: 2978697 - DNA, 14 bp, Homo sapiens
aacatgaaatgata

SEQ ID NO: 2978698 - DNA, 18 bp, Homo sapiens
aacatgaaatgatagatt

SEQ ID NO: 2978699 - DNA, 20 bp, Homo sapiens
aacatgaatcaaaagtgcct

SEQ ID NO: 2978700 - DNA, 17 bp, Homo sapiens
aacatgagtcaagagca

SEQ ID NO: 2978701 - DNA, 17 bp, Homo sapiens
aacatgcagtttgaaat

SEQ ID NO: 2978702 - DNA, 18 bp, Homo sapiens
aacatgcagtttgaaatt

SEQ ID NO: 2978703 - DNA, 19 bp, Homo sapiens
aacatgcagtttgaaattc

SEQ ID NO: 2978704 - DNA, 20 bp, Homo sapiens
aacatgcttttactttattg

SEQ ID NO: 2978705 - DNA, 17 bp, Homo sapiens
aacatgggctgtgatta

SEQ ID NO: 2978706 - DNA, 20 bp, Homo sapiens
aacatgggctgtgattactg

SEQ ID NO: 2978707 - DNA, 21 bp, Homo sapiens
aacatgggctgtgattactgc

SEQ ID NO: 2978708 - DNA, 18 bp, Homo sapiens
aacatggtctagtgacac

SEQ ID NO: 2978709 - DNA, 15 bp, Homo sapiens
aacatgtaggaagta

SEQ ID NO: 2978710 - DNA, 15 bp, Homo sapiens
aacatgtatctgtct

SEQ ID NO: 2978711 - DNA, 19 bp, Homo sapiens
aacatgtgttttcatcatt

SEQ ID NO: 2978712 - DNA, 20 bp, Homo sapiens
aacatgtgttttcatcattt

SEQ ID NO: 2978713 - DNA, 14 bp, Homo sapiens
aacatgtttcactt

SEQ ID NO: 2978714 - DNA, 16 bp, Homo sapiens
aacattattttaattg

SEQ ID NO: 2978715 - DNA, 19 bp, Homo sapiens
aacattctacttgcttatt

SEQ ID NO: 2978716 - DNA, 17 bp, Homo sapiens
aacattgccttgcattt

SEQ ID NO: 2978717 - DNA, 18 bp, Homo sapiens
aacattgcctttgaatgt

SEQ ID NO: 2978718 - DNA, 20 bp, Homo sapiens
aacatttaggagaagttggt

SEQ ID NO: 2978719 - DNA, 23 bp, Homo sapiens
aacatttatatattgtctgtaaa

SEQ ID NO: 2978720 - DNA, 18 bp, Homo sapiens
aacatttatctaaaagaa

SEQ ID NO: 2978721 - DNA, 20 bp, Homo sapiens
aacatttattttatgagaaa

SEQ ID NO: 2978722 - DNA, 16 bp, Homo sapiens
aacatttctcaataat

SEQ ID NO: 2978723 - DNA, 23 bp, Homo sapiens
aacatttgtgtcactgtacagtt

SEQ ID NO: 2978724 - DNA, 17 bp, Homo sapiens
aacatttgtgtgttata

SEQ ID NO: 2978725 - DNA, 16 bp, Homo sapiens
aacattttaaatgaaa

SEQ ID NO: 2978726 - DNA, 13 bp, Homo sapiens
aacattttcaata

SEQ ID NO: 2978727 - DNA, 21 bp, Homo sapiens
aacattttgaaaacccctggc

SEQ ID NO: 2978728 - DNA, 15 bp, Homo sapiens
aaccaaaagggaaaa

SEQ ID NO: 2978729 - DNA, 18 bp, Homo sapiens
aaccaaaagggaaaaaat

SEQ ID NO: 2978730 - DNA, 19 bp, Homo sapiens
aaccaaaagggaaaaaata

SEQ ID NO: 2978731 - DNA, 21 bp, Homo sapiens
aaccaaaagggaaaaaataaa

SEQ ID NO: 2978732 - DNA, 14 bp, Homo sapiens
aaccaaaatgatac

SEQ ID NO: 2978733 - DNA, 21 bp, Homo sapiens
aaccaaagagtctctggctca

SEQ ID NO: 2978734 - DNA, 21 bp, Homo sapiens
aaccaaagtacttttggtgtc

SEQ ID NO: 2978735 - DNA, 22 bp, Homo sapiens
aaccaaagtacttttggtgtca

SEQ ID NO: 2978736 - DNA, 15 bp, Homo sapiens
aaccaaagtctaaac

SEQ ID NO: 2978737 - DNA, 23 bp, Homo sapiens
aaccaaatatgttaaagtttaag

SEQ ID NO: 2978738 - DNA, 19 bp, Homo sapiens
aaccaaattaaaaattttt

SEQ ID NO: 2978739 - DNA, 16 bp, Homo sapiens
aaccaaattgcactga

SEQ ID NO: 2978740 - DNA, 18 bp, Homo sapiens
aaccaaattgcactgaag

SEQ ID NO: 2978741 - DNA, 20 bp, Homo sapiens
aaccaaattgcactgaagtt

SEQ ID NO: 2978742 - DNA, 13 bp, Homo sapiens
aaccaacatcttt

SEQ ID NO: 2978743 - DNA, 15 bp, Homo sapiens
aaccaacccatgtat

SEQ ID NO: 2978744 - DNA, 22 bp, Homo sapiens
aaccaagagattgctaattgct

SEQ ID NO: 2978745 - DNA, 19 bp, Homo sapiens
aaccaaggaaggagcccct

SEQ ID NO: 2978746 - DNA, 17 bp, Homo sapiens
aaccaatcgcaaagcaa

SEQ ID NO: 2978747 - DNA, 17 bp, Homo sapiens
aaccaattcctcatcct

SEQ ID NO: 2978748 - DNA, 22 bp, Homo sapiens
aaccaattcctcatcctcagat

SEQ ID NO: 2978749 - DNA, 23 bp, Homo sapiens
aaccacaccacatctaagcctga

SEQ ID NO: 2978750 - DNA, 21 bp, Homo sapiens
aaccacctaggcaatgaagaa

SEQ ID NO: 2978751 - DNA, 22 bp, Homo sapiens
aaccactaatgcttgccaagaa

SEQ ID NO: 2978752 - DNA, 18 bp, Homo sapiens
aaccactaatgttagaat

SEQ ID NO: 2978753 - DNA, 17 bp, Homo sapiens
aaccactgtctagagca

SEQ ID NO: 2978754 - DNA, 13 bp, Homo sapiens
aaccagacagagg

SEQ ID NO: 2978755 - DNA, 15 bp, Homo sapiens
aaccagactttgaaa

SEQ ID NO: 2978756 - DNA, 23 bp, Homo sapiens
aaccagcaagtcccagacaagga

SEQ ID NO: 2978757 - DNA, 13 bp, Homo sapiens
aaccagcctcagc

SEQ ID NO: 2978758 - DNA, 20 bp, Homo sapiens
aaccagcctcatgctctgat

SEQ ID NO: 2978759 - DNA, 16 bp, Homo sapiens
aaccaggtttgcacct

SEQ ID NO: 2978760 - DNA, 19 bp, Homo sapiens
aaccagtaggatatttcta

SEQ ID NO: 2978761 - DNA, 19 bp, Homo sapiens
aagacaattctttatacaa

SEQ ID NO: 2978762 - DNA, 16 bp, Homo sapiens
aagacaccaaatataa

SEQ ID NO: 2978763 - DNA, 18 bp, Homo sapiens
aagacaccgttcattcag

SEQ ID NO: 2978764 - DNA, 13 bp, Homo sapiens
aagacactgcctg

SEQ ID NO: 2978765 - DNA, 19 bp, Homo sapiens
aagacagagcaaagcgccc

SEQ ID NO: 2978766 - DNA, 12 bp, Homo sapiens
aagacagagtct

SEQ ID NO: 2978767 - DNA, 17 bp, Homo sapiens
aagacagattttcggaa

SEQ ID NO: 2978768 - DNA, 19 bp, Homo sapiens
aagacagccacttttagct

SEQ ID NO: 2978769 - DNA, 12 bp, Homo sapiens
aagacagccttc

SEQ ID NO: 2978770 - DNA, 17 bp, Homo sapiens
aagacagtgccctgaga

SEQ ID NO: 2978771 - DNA, 20 bp, Homo sapiens
aagacatgatttccttgaat

SEQ ID NO: 2978772 - DNA, 21 bp, Homo sapiens
aagacattagtaacataataa

SEQ ID NO: 2978773 - DNA, 15 bp, Homo sapiens
aagacattttttgct

SEQ ID NO: 2978774 - DNA, 17 bp, Homo sapiens
aagacattttttgctat

SEQ ID NO: 2978775 - DNA, 17 bp, Homo sapiens
aagaccagcctgtccaa

SEQ ID NO: 2978776 - DNA, 15 bp, Homo sapiens
aagacccctgactca

SEQ ID NO: 2978777 - DNA, 20 bp, Homo sapiens
aagacctactgttctaaagc

SEQ ID NO: 2978778 - DNA, 21 bp, Homo sapiens
aagacctactgttctaaagct

SEQ ID NO: 2978779 - DNA, 19 bp, Homo sapiens
aagacctggggttgtcagc

SEQ ID NO: 2978780 - DNA, 15 bp, Homo sapiens
aagacgatgtttatg

SEQ ID NO: 2978781 - DNA, 23 bp, Homo sapiens
aagacgtgtttgtgtttgtgtgt

SEQ ID NO: 2978782 - DNA, 16 bp, Homo sapiens
aagactaatgctttct

SEQ ID NO: 2978783 - DNA, 14 bp, Homo sapiens
aagactatttacca

SEQ ID NO: 2978784 - DNA, 18 bp, Homo sapiens
aagactcaaatgttctaa

SEQ ID NO: 2978785 - DNA, 19 bp, Homo sapiens
aagactcaaatgttctaag

SEQ ID NO: 2978786 - DNA, 22 bp, Homo sapiens
aagactccctgatcccagacct

SEQ ID NO: 2978787 - DNA, 12 bp, Homo sapiens
aagactctagag

SEQ ID NO: 2978788 - DNA, 19 bp, Homo sapiens
aagactctagagtccaagg

SEQ ID NO: 2978789 - DNA, 22 bp, Homo sapiens
aagactctttttggttgtcctc

SEQ ID NO: 2978790 - DNA, 15 bp, Homo sapiens
aagactgaagatggc

SEQ ID NO: 2978791 - DNA, 23 bp, Homo sapiens
aagactggaagctaatttgcatt

SEQ ID NO: 2978792 - DNA, 11 bp, Homo sapiens
aagactggctt

SEQ ID NO: 2978793 - DNA, 23 bp, Homo sapiens
aagactggcttttattaatgcac

SEQ ID NO: 2978794 - DNA, 12 bp, Homo sapiens
aagactgggctg

SEQ ID NO: 2978795 - DNA, 19 bp, Homo sapiens
aagactgtcttacctggca

SEQ ID NO: 2978796 - DNA, 16 bp, Homo sapiens
aagacttactctaaga

SEQ ID NO: 2978797 - DNA, 21 bp, Homo sapiens
aagacttgatactgcaataaa

SEQ ID NO: 2978798 - DNA, 20 bp, Homo sapiens
aagacttgcatttaaatgtg

SEQ ID NO: 2978799 - DNA, 12 bp, Homo sapiens
aagagaaaaaaa

SEQ ID NO: 2978800 - DNA, 18 bp, Homo sapiens
aagagaaaaaaaaacaca

SEQ ID NO: 2978801 - DNA, 23 bp, Homo sapiens
aagagaaaaaaaaacacacaaaa

SEQ ID NO: 2978802 - DNA, 15 bp, Homo sapiens
aagagaaagaggcca

SEQ ID NO: 2978803 - DNA, 21 bp, Homo sapiens
aagagaacaaagagtgaaata

SEQ ID NO: 2978804 - DNA, 15 bp, Homo sapiens
aagagaagggcttac

SEQ ID NO: 2978805 - DNA, 22 bp, Homo sapiens
aagagaaggggacttctcttcc

SEQ ID NO: 2978806 - DNA, 20 bp, Homo sapiens
aagagaaggtggacctggca

SEQ ID NO: 2978807 - DNA, 17 bp, Homo sapiens
aagagaagtcacaacaa

SEQ ID NO: 2978808 - DNA, 19 bp, Homo sapiens
aagagaagtcacaacaaaa

SEQ ID NO: 2978809 - DNA, 20 bp, Homo sapiens
aagagaatattagctttact

SEQ ID NO: 2978810 - DNA, 20 bp, Homo sapiens
aagagacatgagaaagggag

SEQ ID NO: 2978811 - DNA, 19 bp, Homo sapiens
aagagacctgttttaaaaa

SEQ ID NO: 2978812 - DNA, 14 bp, Homo sapiens
aagagactcagcct

SEQ ID NO: 2978813 - DNA, 19 bp, Homo sapiens
aagagactcagcctgcagt

SEQ ID NO: 2978814 - DNA, 12 bp, Homo sapiens
aagagagaaaat

SEQ ID NO: 2978815 - DNA, 18 bp, Homo sapiens
aagagagaaaataaaaag

SEQ ID NO: 2978816 - DNA, 19 bp, Homo sapiens
aagagagaaaataaaaagt

SEQ ID NO: 2978817 - DNA, 11 bp, Homo sapiens
aagagagaacc

SEQ ID NO: 2978818 - DNA, 20 bp, Homo sapiens
aagagagaacctaactgtat

SEQ ID NO: 2978819 - DNA, 23 bp, Homo sapiens
aagagagaacctaactgtatctt

SEQ ID NO: 2978820 - DNA, 22 bp, Homo sapiens
aagagagaatttgctttatctg

SEQ ID NO: 2978821 - DNA, 17 bp, Homo sapiens
aagagagttaaaagcag

SEQ ID NO: 2978822 - DNA, 14 bp, Homo sapiens
aagagatacagagg

SEQ ID NO: 2978823 - DNA, 14 bp, Homo sapiens
aagagatccaaaga

SEQ ID NO: 2978824 - DNA, 16 bp, Homo sapiens
aagagatccaaagact

SEQ ID NO: 2978825 - DNA, 20 bp, Homo sapiens
aagagatgatgaaaatattt

SEQ ID NO: 2978826 - DNA, 20 bp, Homo sapiens
aagagccatataagtttgaa

SEQ ID NO: 2978827 - DNA, 18 bp, Homo sapiens
aagagcccgtgccacccc

SEQ ID NO: 2978828 - DNA, 14 bp, Homo sapiens
aagagccggagcct

SEQ ID NO: 2978829 - DNA, 19 bp, Homo sapiens
aagagccggagcctccagc

SEQ ID NO: 2978830 - DNA, 15 bp, Homo sapiens
aagagcctttccaaa

SEQ ID NO: 2978831 - DNA, 20 bp, Homo sapiens
aagagctagcgctgccgcac

SEQ ID NO: 2978832 - DNA, 23 bp, Homo sapiens
aagagctgatgtgagtgtgtgtg

SEQ ID NO: 2978833 - DNA, 20 bp, Homo sapiens
aagagctgggatcccacagc

SEQ ID NO: 2978834 - DNA, 21 bp, Homo sapiens
aagagctgggatcccacagcc

SEQ ID NO: 2978835 - DNA, 14 bp, Homo sapiens
aagagcttccagag

SEQ ID NO: 2978836 - DNA, 21 bp, Homo sapiens
aagagcttccagagctctgac

SEQ ID NO: 2978837 - DNA, 23 bp, Homo sapiens
aagaggaaaaccctcaagggcat

SEQ ID NO: 2978838 - DNA, 18 bp, Homo sapiens
aagaggagccagagaagg

SEQ ID NO: 2978839 - DNA, 22 bp, Homo sapiens
aagaggagtaggccctggttcc

SEQ ID NO: 2978840 - DNA, 16 bp, Homo sapiens
aagaggcagaaaattg

SEQ ID NO: 2978841 - DNA, 13 bp, Homo sapiens
aagaggcagagtt

SEQ ID NO: 2978842 - DNA, 16 bp, Homo sapiens
aagaggctgagacagg

SEQ ID NO: 2978843 - DNA, 23 bp, Homo sapiens
aagagggacataagataaaatga

SEQ ID NO: 2978844 - DNA, 18 bp, Homo sapiens
aagagtaaaggaaatgat

SEQ ID NO: 2978845 - DNA, 23 bp, Homo sapiens
aagagtacaagctcttgtttctg

SEQ ID NO: 2978846 - DNA, 15 bp, Homo sapiens
aagagtagaattgca

SEQ ID NO: 2978847 - DNA, 22 bp, Homo sapiens
aagagtcattttcacttttaaa

SEQ ID NO: 2978848 - DNA, 22 bp, Homo sapiens
aagagtctaaaccccagattct

SEQ ID NO: 2978849 - DNA, 24 bp, Homo sapiens
aagagtctaaagatggagtttcta

SEQ ID NO: 2978850 - DNA, 21 bp, Homo sapiens
aagagtctacccgacataagt

SEQ ID NO: 2978851 - DNA, 15 bp, Homo sapiens
aagagtctccttctc

SEQ ID NO: 2978852 - DNA, 15 bp, Homo sapiens
aagagtctctccagc

SEQ ID NO: 2978853 - DNA, 19 bp, Homo sapiens
aagagtctctccagcctca

SEQ ID NO: 2978854 - DNA, 19 bp, Homo sapiens
aagagttattcaaatgaag

SEQ ID NO: 2978855 - DNA, 20 bp, Homo sapiens
aagagttattcaaatgaagg

SEQ ID NO: 2978856 - DNA, 22 bp, Homo sapiens
aagagttgccccgtctctgttc

SEQ ID NO: 2978857 - DNA, 17 bp, Homo sapiens
aagataacattttcaat

SEQ ID NO: 2978858 - DNA, 17 bp, Homo sapiens
aagatactcaagcaggt

SEQ ID NO: 2978859 - DNA, 10 bp, Homo sapiens
aagatactgc

SEQ ID NO: 2978860 - DNA, 17 bp, Homo sapiens
aagatactgctgatgct

SEQ ID NO: 2978861 - DNA, 19 bp, Homo sapiens
aagataggactaaagttgt

SEQ ID NO: 2978862 - DNA, 13 bp, Homo sapiens
aagatatatattc

SEQ ID NO: 2978863 - DNA, 13 bp, Homo sapiens
aagatatcttttc

SEQ ID NO: 2978864 - DNA, 12 bp, Homo sapiens
aagatatggaca

SEQ ID NO: 2978865 - DNA, 16 bp, Homo sapiens
aagatatttttattca

SEQ ID NO: 2978866 - DNA, 17 bp, Homo sapiens
aagatatttttattcaa

SEQ ID NO: 2978867 - DNA, 17 bp, Homo sapiens
aagatcatagttgcaaa

SEQ ID NO: 2978868 - DNA, 22 bp, Homo sapiens
aagatcattgaagaccagcttt

SEQ ID NO: 2978869 - DNA, 11 bp, Homo sapiens
aagatcctgtg

SEQ ID NO: 2978870 - DNA, 16 bp, Homo sapiens
aagatcgttctctgcc

SEQ ID NO: 2978871 - DNA, 19 bp, Homo sapiens
aagatctacctgcaacaca

SEQ ID NO: 2978872 - DNA, 12 bp, Homo sapiens
aagatctgattt

SEQ ID NO: 2978873 - DNA, 13 bp, Homo sapiens
aagatcttagatt

SEQ ID NO: 2978874 - DNA, 23 bp, Homo sapiens
aagatcttcaaaagtaatgcctc

SEQ ID NO: 2978875 - DNA, 23 bp, Homo sapiens
aagatctttcgttggttgtttct

SEQ ID NO: 2978876 - DNA, 15 bp, Homo sapiens
aagatgacactttta

SEQ ID NO: 2978877 - DNA, 13 bp, Homo sapiens
aagatgacattgc

SEQ ID NO: 2978878 - DNA, 17 bp, Homo sapiens
aagatgacattgctaag

SEQ ID NO: 2978879 - DNA, 20 bp, Homo sapiens
aagatgacattgctaagatg

SEQ ID NO: 2978880 - DNA, 21 bp, Homo sapiens
aagatgacattgctaagatgc

SEQ ID NO: 2978881 - DNA, 22 bp, Homo sapiens
aagatgacattgctaagatgct

SEQ ID NO: 2978882 - DNA, 22 bp, Homo sapiens
aagatgacttaaggtgaagtga

SEQ ID NO: 2978883 - DNA, 15 bp, Homo sapiens
aagatgatgctcagt

SEQ ID NO: 2978884 - DNA, 23 bp, Homo sapiens
aagatgattgttcttttgtttca

SEQ ID NO: 2978885 - DNA, 16 bp, Homo sapiens
aagatgatttgcaatg

SEQ ID NO: 2978886 - DNA, 17 bp, Homo sapiens
aagatgcattgtagttt

SEQ ID NO: 2978887 - DNA, 15 bp, Homo sapiens
aagatgctctatctt

SEQ ID NO: 2978888 - DNA, 22 bp, Homo sapiens
aagatgctctatcttgctctgt

SEQ ID NO: 2978889 - DNA, 15 bp, Homo sapiens
aagatgctcttctgt

SEQ ID NO: 2978890 - DNA, 17 bp, Homo sapiens
aagatgctcttctgtgg

SEQ ID NO: 2978891 - DNA, 22 bp, Homo sapiens
aagatgcttttaacagagtctg

SEQ ID NO: 2978892 - DNA, 14 bp, Homo sapiens
aagggggaaggctg

SEQ ID NO: 2978893 - DNA, 20 bp, Homo sapiens
aagggggcggggactgctgg

SEQ ID NO: 2978894 - DNA, 21 bp, Homo sapiens
aaggggtaggattactaggtg

SEQ ID NO: 2978895 - DNA, 16 bp, Homo sapiens
aaggggtctgaaattt

SEQ ID NO: 2978896 - DNA, 13 bp, Homo sapiens
aaggggtgtgcat

SEQ ID NO: 2978897 - DNA, 16 bp, Homo sapiens
aagggtcttgggaaat

SEQ ID NO: 2978898 - DNA, 21 bp, Homo sapiens
aagggttaatcatatttgaaa

SEQ ID NO: 2978899 - DNA, 22 bp, Homo sapiens
aagggttaatcatatttgaaaa

SEQ ID NO: 2978900 - DNA, 22 bp, Homo sapiens
aagggttgtgagccccttgggg

SEQ ID NO: 2978901 - DNA, 16 bp, Homo sapiens
aagggttttaatgtag

SEQ ID NO: 2978902 - DNA, 18 bp, Homo sapiens
aaggtaaaatgccatgat

SEQ ID NO: 2978903 - DNA, 20 bp, Homo sapiens
aaggtaacatttatagaaga

SEQ ID NO: 2978904 - DNA, 20 bp, Homo sapiens
aaggtactgaaataatgatc

SEQ ID NO: 2978905 - DNA, 16 bp, Homo sapiens
aaggtatctttttatt

SEQ ID NO: 2978906 - DNA, 16 bp, Homo sapiens
aaggtcagcgagaagg

SEQ ID NO: 2978907 - DNA, 17 bp, Homo sapiens
aaggtcagcgagaagga

SEQ ID NO: 2978908 - DNA, 18 bp, Homo sapiens
aaggtcagcgagaaggag

SEQ ID NO: 2978909 - DNA, 13 bp, Homo sapiens
aaggtcatcatcg

SEQ ID NO: 2978910 - DNA, 19 bp, Homo sapiens
aaggtccacaggtctagac

SEQ ID NO: 2978911 - DNA, 14 bp, Homo sapiens
aaggtcccctggca

SEQ ID NO: 2978912 - DNA, 18 bp, Homo sapiens
aaggtcctgaaagtaact

SEQ ID NO: 2978913 - DNA, 20 bp, Homo sapiens
aaggtctcacactcctcctg

SEQ ID NO: 2978914 - DNA, 12 bp, Homo sapiens
aaggtctgggtc

SEQ ID NO: 2978915 - DNA, 18 bp, Homo sapiens
aaggtcttacattgcctg

SEQ ID NO: 2978916 - DNA, 14 bp, Homo sapiens
aaggtgaagtgagg

SEQ ID NO: 2978917 - DNA, 14 bp, Homo sapiens
aaggtgactttctg

SEQ ID NO: 2978918 - DNA, 18 bp, Homo sapiens
aaggtgaggcctgtctgt

SEQ ID NO: 2978919 - DNA, 21 bp, Homo sapiens
aaggtgaggcctgtctgtgac

SEQ ID NO: 2978920 - DNA, 21 bp, Homo sapiens
aaggtgcatatagaaaacaaa

SEQ ID NO: 2978921 - DNA, 16 bp, Homo sapiens
aaggtgccagaaggaa

SEQ ID NO: 2978922 - DNA, 17 bp, Homo sapiens
aaggtgccatgtcttta

SEQ ID NO: 2978923 - DNA, 15 bp, Homo sapiens
aaggtgctaaatctg

SEQ ID NO: 2978924 - DNA, 13 bp, Homo sapiens
aaggtgtgctaca

SEQ ID NO: 2978925 - DNA, 18 bp, Homo sapiens
aaggtgttttctgtgtaa

SEQ ID NO: 2978926 - DNA, 22 bp, Homo sapiens
aaggttaatttttccttcctct

SEQ ID NO: 2978927 - DNA, 18 bp, Homo sapiens
aaggttaccaagaagcct

SEQ ID NO: 2978928 - DNA, 18 bp, Homo sapiens
aaggttactcagcagcag

SEQ ID NO: 2978929 - DNA, 21 bp, Homo sapiens
aaggttactcagcagcagaga

SEQ ID NO: 2978930 - DNA, 19 bp, Homo sapiens
aaggttccaactgtatata

SEQ ID NO: 2978931 - DNA, 21 bp, Homo sapiens
aaggttccacagagtaagaca

SEQ ID NO: 2978932 - DNA, 23 bp, Homo sapiens
aaggttccgcttggagcagaggg

SEQ ID NO: 2978933 - DNA, 12 bp, Homo sapiens
aaggttctaggt

SEQ ID NO: 2978934 - DNA, 22 bp, Homo sapiens
aaggtttaggctggtggcccag

SEQ ID NO: 2978935 - DNA, 16 bp, Homo sapiens
aaggtttcgtttctgt

SEQ ID NO: 2978936 - DNA, 22 bp, Homo sapiens
aaggtttcgtttctgtatacaa

SEQ ID NO: 2978937 - DNA, 20 bp, Homo sapiens
aaggttttaggttctaaagt

SEQ ID NO: 2978938 - DNA, 23 bp, Homo sapiens
aaggttttaggttctaaagttct

SEQ ID NO: 2978939 - DNA, 20 bp, Homo sapiens
aaggtttttaagggccgggg

SEQ ID NO: 2978940 - DNA, 13 bp, Homo sapiens
aagtaaaagaaac

SEQ ID NO: 2978941 - DNA, 16 bp, Homo sapiens
aagtaaaagtagtgtt

SEQ ID NO: 2978942 - DNA, 12 bp, Homo sapiens
aagtaaagatgc

SEQ ID NO: 2978943 - DNA, 17 bp, Homo sapiens
aagtaaatccacaggct

SEQ ID NO: 2978944 - DNA, 21 bp, Homo sapiens
aagtaactcagtgaaggccca

SEQ ID NO: 2978945 - DNA, 19 bp, Homo sapiens
aagtaactcccactcctaa

SEQ ID NO: 2978946 - DNA, 18 bp, Homo sapiens
aagtaagaaagtgaagca

SEQ ID NO: 2978947 - DNA, 20 bp, Homo sapiens
aagtaagaagaggagcctca

SEQ ID NO: 2978948 - DNA, 22 bp, Homo sapiens
aagtaagaagaggagcctcaga

SEQ ID NO: 2978949 - DNA, 15 bp, Homo sapiens
aagtaagatggtttt

SEQ ID NO: 2978950 - DNA, 21 bp, Homo sapiens
aagtaatccacctgcctcggc

SEQ ID NO: 2978951 - DNA, 21 bp, Homo sapiens
aagtaatgaatttttatgata

SEQ ID NO: 2978952 - DNA, 17 bp, Homo sapiens
aagtaatgcctctgtct

SEQ ID NO: 2978953 - DNA, 21 bp, Homo sapiens
aagtacctatattgatttaaa

SEQ ID NO: 2978954 - DNA, 22 bp, Homo sapiens
aagtacctatattgatttaaaa

SEQ ID NO: 2978955 - DNA, 23 bp, Homo sapiens
aagtactgctgtaaataaatgct

SEQ ID NO: 2978956 - DNA, 17 bp, Homo sapiens
aagtacttggtcccgtg

SEQ ID NO: 2978957 - DNA, 20 bp, Homo sapiens
aagtacttttggtgtcatta

SEQ ID NO: 2978958 - DNA, 17 bp, Homo sapiens
aagtagaacaaaaacta

SEQ ID NO: 2978959 - DNA, 16 bp, Homo sapiens
aagtagacctcttttt

SEQ ID NO: 2978960 - DNA, 16 bp, Homo sapiens
aagtagagaacagtca

SEQ ID NO: 2978961 - DNA, 22 bp, Homo sapiens
aagtagatctgctttctgttca

SEQ ID NO: 2978962 - DNA, 20 bp, Homo sapiens
aagtagcaccaaataaatta

SEQ ID NO: 2978963 - DNA, 18 bp, Homo sapiens
aagtagcactgactattt

SEQ ID NO: 2978964 - DNA, 21 bp, Homo sapiens
aagtagctgtcagatgtcaca

SEQ ID NO: 2978965 - DNA, 13 bp, Homo sapiens
aagtaggaagtaa

SEQ ID NO: 2978966 - DNA, 23 bp, Homo sapiens
aagtaggactttcctaaatgttt

SEQ ID NO: 2978967 - DNA, 19 bp, Homo sapiens
aagtagtaaaaattaaaaa

SEQ ID NO: 2978968 - DNA, 15 bp, Homo sapiens
aagtataaaatacaa

SEQ ID NO: 2978969 - DNA, 12 bp, Homo sapiens
aagtataacaaa

SEQ ID NO: 2978970 - DNA, 12 bp, Homo sapiens
aagtatactgta

SEQ ID NO: 2978971 - DNA, 18 bp, Homo sapiens
aagtatatacttttaaat

SEQ ID NO: 2978972 - DNA, 19 bp, Homo sapiens
aagtatatacttttaaatt

SEQ ID NO: 2978973 - DNA, 13 bp, Homo sapiens
aagtatatgtcat

SEQ ID NO: 2978974 - DNA, 16 bp, Homo sapiens
aagtatatgtcattta

SEQ ID NO: 2978975 - DNA, 15 bp, Homo sapiens
aagtatccagacctt

SEQ ID NO: 2978976 - DNA, 21 bp, Homo sapiens
aagtatcttctatttttatca

SEQ ID NO: 2978977 - DNA, 23 bp, Homo sapiens
aagtattcttttcaattatattg

SEQ ID NO: 2978978 - DNA, 22 bp, Homo sapiens
aagtattgggacgtagagcaca

SEQ ID NO: 2978979 - DNA, 21 bp, Homo sapiens
aagtattgtaaattatatttg

SEQ ID NO: 2978980 - DNA, 14 bp, Homo sapiens
aagtattgtttaca

SEQ ID NO: 2978981 - DNA, 15 bp, Homo sapiens
aagtattgtttacat

SEQ ID NO: 2978982 - DNA, 11 bp, Homo sapiens
aagtatttctg

SEQ ID NO: 2978983 - DNA, 13 bp, Homo sapiens
aagtatttgggaa

SEQ ID NO: 2978984 - DNA, 17 bp, Homo sapiens
aagtattttcataagta

SEQ ID NO: 2978985 - DNA, 22 bp, Homo sapiens
aagtattttcataagtatttca

SEQ ID NO: 2978986 - DNA, 14 bp, Homo sapiens
aagtattttcctgt

SEQ ID NO: 2978987 - DNA, 22 bp, Homo sapiens
aagtatttttgattaacaatgt

SEQ ID NO: 2978988 - DNA, 13 bp, Homo sapiens
aagtcaaaaggaa

SEQ ID NO: 2978989 - DNA, 14 bp, Homo sapiens
aagtcaaaaggaac

SEQ ID NO: 2978990 - DNA, 17 bp, Homo sapiens
aagtcaaaaggaacaaa

SEQ ID NO: 2978991 - DNA, 19 bp, Homo sapiens
aagtcaaaaggtgcctgtg

SEQ ID NO: 2978992 - DNA, 17 bp, Homo sapiens
aagtcaaataaatgttt

SEQ ID NO: 2978993 - DNA, 21 bp, Homo sapiens
aagtcacaacaaaaggaagac

SEQ ID NO: 2978994 - DNA, 22 bp, Homo sapiens
aagtcacagtcgtatctctaga

SEQ ID NO: 2978995 - DNA, 16 bp, Homo sapiens
aagtcaccctagccct

SEQ ID NO: 2978996 - DNA, 23 bp, Homo sapiens
aagtcaccctagccctctccctc

SEQ ID NO: 2978997 - DNA, 14 bp, Homo sapiens
aagtcacttctcca

SEQ ID NO: 2978998 - DNA, 15 bp, Homo sapiens
aagtcacttctccat

SEQ ID NO: 2978999 - DNA, 16 bp, Homo sapiens
aagtcagctgaaggat

SEQ ID NO: 2979000 - DNA, 18 bp, Homo sapiens
aagtcaggacctggcttg

SEQ ID NO: 2979001 - DNA, 14 bp, Homo sapiens
aagtcaggccaggt

SEQ ID NO: 2979002 - DNA, 16 bp, Homo sapiens
aagtcaggccaggtgg

SEQ ID NO: 2979003 - DNA, 16 bp, Homo sapiens
aagtcaggtccaattt

SEQ ID NO: 2979004 - DNA, 18 bp, Homo sapiens
aagtcagtatcatattat

SEQ ID NO: 2979005 - DNA, 18 bp, Homo sapiens
aagtcatcatgaactggc

SEQ ID NO: 2979006 - DNA, 17 bp, Homo sapiens
aagtcatgtaaatactg

SEQ ID NO: 2979007 - DNA, 16 bp, Homo sapiens
aagtcattaaactggt

SEQ ID NO: 2979008 - DNA, 18 bp, Homo sapiens
aagtccaggactgggtct

SEQ ID NO: 2979009 - DNA, 22 bp, Homo sapiens
aagtccccaggccccaggaagc

SEQ ID NO: 2979010 - DNA, 22 bp, Homo sapiens
aagtcccccaagacctaagggt

SEQ ID NO: 2979011 - DNA, 21 bp, Homo sapiens
aagtcctagctcctcctcctg

SEQ ID NO: 2979012 - DNA, 15 bp, Homo sapiens
aagtcctatggaaac

SEQ ID NO: 2979013 - DNA, 13 bp, Homo sapiens
aagtcctgccttt

SEQ ID NO: 2979014 - DNA, 15 bp, Homo sapiens
aagtcctgcctttgg

SEQ ID NO: 2979015 - DNA, 12 bp, Homo sapiens
aagtcctggctt

SEQ ID NO: 2979016 - DNA, 17 bp, Homo sapiens
aagtcctggcttcaggc

SEQ ID NO: 2979017 - DNA, 13 bp, Homo sapiens
aagtcctttatgt

SEQ ID NO: 2979018 - DNA, 15 bp, Homo sapiens
aagtccttttgtaaa

SEQ ID NO: 2979019 - DNA, 17 bp, Homo sapiens
aagtccttttgtaaagt

SEQ ID NO: 2979020 - DNA, 16 bp, Homo sapiens
aagtctacaaaaaggt

SEQ ID NO: 2979021 - DNA, 15 bp, Homo sapiens
aagtctcaaagatct

SEQ ID NO: 2979022 - DNA, 21 bp, Homo sapiens
aagtctcactggctgtcagta

SEQ ID NO: 2979023 - DNA, 18 bp, Homo sapiens
aagtctctaattctatta

SEQ ID NO: 2979024 - DNA, 20 bp, Homo sapiens
aatgactaaaaaacaaagaa

SEQ ID NO: 2979025 - DNA, 14 bp, Homo sapiens
aatgactaagccaa

SEQ ID NO: 2979026 - DNA, 24 bp, Homo sapiens
aatgacttattgtggataacaaag

SEQ ID NO: 2979027 - DNA, 17 bp, Homo sapiens
aatgacttttaaaattt

SEQ ID NO: 2979028 - DNA, 16 bp, Homo sapiens
aatgagaaaggacaga

SEQ ID NO: 2979029 - DNA, 18 bp, Homo sapiens
aatgagaaaggacagagc

SEQ ID NO: 2979030 - DNA, 24 bp, Homo sapiens
aatgagattcagtgaactaatttg

SEQ ID NO: 2979031 - DNA, 22 bp, Homo sapiens
aatgaggaacaatcacaaaagc

SEQ ID NO: 2979032 - DNA, 21 bp, Homo sapiens
aatgagtaatgtgatcgcttg

SEQ ID NO: 2979033 - DNA, 15 bp, Homo sapiens
aatgagtatttggtc

SEQ ID NO: 2979034 - DNA, 13 bp, Homo sapiens
aatgataagtact

SEQ ID NO: 2979035 - DNA, 16 bp, Homo sapiens
aatgatagaactgtac

SEQ ID NO: 2979036 - DNA, 14 bp, Homo sapiens
aatgatagatttga

SEQ ID NO: 2979037 - DNA, 19 bp, Homo sapiens
aatgatcagcaaaaagact

SEQ ID NO: 2979038 - DNA, 20 bp, Homo sapiens
aatgatcagcaaaaagactg

SEQ ID NO: 2979039 - DNA, 15 bp, Homo sapiens
aatgatcctcagtgc

SEQ ID NO: 2979040 - DNA, 11 bp, Homo sapiens
aatgatcctgc

SEQ ID NO: 2979041 - DNA, 18 bp, Homo sapiens
aatgatgacttgagccct

SEQ ID NO: 2979042 - DNA, 23 bp, Homo sapiens
aatgatgatcaattatagtttct

SEQ ID NO: 2979043 - DNA, 16 bp, Homo sapiens
aatgatgttgataatt

SEQ ID NO: 2979044 - DNA, 19 bp, Homo sapiens
aatgattccagacgacctt

SEQ ID NO: 2979045 - DNA, 11 bp, Homo sapiens
aatgatttcag

SEQ ID NO: 2979046 - DNA, 16 bp, Homo sapiens
aatgatttttgtgtat

SEQ ID NO: 2979047 - DNA, 21 bp, Homo sapiens
aatgcaaaaaagaaacaataa

SEQ ID NO: 2979048 - DNA, 13 bp, Homo sapiens
aatgcaaactggg

SEQ ID NO: 2979049 - DNA, 21 bp, Homo sapiens
aatgcaagattttccacaaga

SEQ ID NO: 2979050 - DNA, 20 bp, Homo sapiens
aatgcaatcaatttaaatta

SEQ ID NO: 2979051 - DNA, 18 bp, Homo sapiens
aatgcacacagcggctgc

SEQ ID NO: 2979052 - DNA, 17 bp, Homo sapiens
aatgcagaggaggagaa

SEQ ID NO: 2979053 - DNA, 20 bp, Homo sapiens
aatgcagcactgctgcctca

SEQ ID NO: 2979054 - DNA, 20 bp, Homo sapiens
aatgcagcagggatgccctg

SEQ ID NO: 2979055 - DNA, 22 bp, Homo sapiens
aatgcagcagggatgccctgga

SEQ ID NO: 2979056 - DNA, 22 bp, Homo sapiens
aatgcagcccaccaggagcacc

SEQ ID NO: 2979057 - DNA, 21 bp, Homo sapiens
aatgcagcccatttctccaga

SEQ ID NO: 2979058 - DNA, 14 bp, Homo sapiens
aatgcagtatggta

SEQ ID NO: 2979059 - DNA, 16 bp, Homo sapiens
aatgcagtatggtaca

SEQ ID NO: 2979060 - DNA, 23 bp, Homo sapiens
aatgcatccattcctcagggaca

SEQ ID NO: 2979061 - DNA, 20 bp, Homo sapiens
aatgcatctcatcaacttaa

SEQ ID NO: 2979062 - DNA, 22 bp, Homo sapiens
aatgcattattgacgaactggc

SEQ ID NO: 2979063 - DNA, 15 bp, Homo sapiens
aatgcattcatgttt

SEQ ID NO: 2979064 - DNA, 22 bp, Homo sapiens
aatgcattgatattgtgaacat

SEQ ID NO: 2979065 - DNA, 12 bp, Homo sapiens
aatgcatttact

SEQ ID NO: 2979066 - DNA, 18 bp, Homo sapiens
aatgccaactgttggaat

SEQ ID NO: 2979067 - DNA, 16 bp, Homo sapiens
aatgccagaatataat

SEQ ID NO: 2979068 - DNA, 20 bp, Homo sapiens
aatgccattttaaggaaaac

SEQ ID NO: 2979069 - DNA, 18 bp, Homo sapiens
aatgcccagccagccacc

SEQ ID NO: 2979070 - DNA, 19 bp, Homo sapiens
aatgcccagccagccaccc

SEQ ID NO: 2979071 - DNA, 18 bp, Homo sapiens
aatgcctataaaatgccc

SEQ ID NO: 2979072 - DNA, 13 bp, Homo sapiens
aatgcctttcatc

SEQ ID NO: 2979073 - DNA, 20 bp, Homo sapiens
aatgcgtggcacatctaaat

SEQ ID NO: 2979074 - DNA, 23 bp, Homo sapiens
aatgctaccgccccaaagtaaaa

SEQ ID NO: 2979075 - DNA, 19 bp, Homo sapiens
aatgctacgtgtgattttt

SEQ ID NO: 2979076 - DNA, 17 bp, Homo sapiens
aatgctattatactgtt

SEQ ID NO: 2979077 - DNA, 16 bp, Homo sapiens
aatgctcaatttcagc

SEQ ID NO: 2979078 - DNA, 23 bp, Homo sapiens
aatgctcccacctgaatttgtat

SEQ ID NO: 2979079 - DNA, 13 bp, Homo sapiens
aatgctctccttt

SEQ ID NO: 2979080 - DNA, 18 bp, Homo sapiens
aatgctgatgaatcactg

SEQ ID NO: 2979081 - DNA, 12 bp, Homo sapiens
aatgctgggctg

SEQ ID NO: 2979082 - DNA, 17 bp, Homo sapiens
aatgctgtacatctatt

SEQ ID NO: 2979083 - DNA, 15 bp, Homo sapiens
aatgctgtctttgtg

SEQ ID NO: 2979084 - DNA, 12 bp, Homo sapiens
aatgctgtgaat

SEQ ID NO: 2979085 - DNA, 20 bp, Homo sapiens
aatgctgtgcaaacagtgta

SEQ ID NO: 2979086 - DNA, 10 bp, Homo sapiens
aatgctgttc

SEQ ID NO: 2979087 - DNA, 21 bp, Homo sapiens
aatgctgttcgttcaaaagtg

SEQ ID NO: 2979088 - DNA, 16 bp, Homo sapiens
aatgctgttgcctcat

SEQ ID NO: 2979089 - DNA, 19 bp, Homo sapiens
aatgcttatggaaagccag

SEQ ID NO: 2979090 - DNA, 20 bp, Homo sapiens
aatgcttatgtgttgcataa

SEQ ID NO: 2979091 - DNA, 21 bp, Homo sapiens
aatgcttctctcatagtgtca

SEQ ID NO: 2979092 - DNA, 15 bp, Homo sapiens
aatgcttctgattta

SEQ ID NO: 2979093 - DNA, 19 bp, Homo sapiens
aatgcttgccaagaaatcg

SEQ ID NO: 2979094 - DNA, 14 bp, Homo sapiens
aatgcttttaaatc

SEQ ID NO: 2979095 - DNA, 11 bp, Homo sapiens
aatggaaaaaa

SEQ ID NO: 2979096 - DNA, 14 bp, Homo sapiens
aatggaaaaaaaca

SEQ ID NO: 2979097 - DNA, 19 bp, Homo sapiens
aatggaaaaaaacataaaa

SEQ ID NO: 2979098 - DNA, 16 bp, Homo sapiens
aatggaaaatgtatat

SEQ ID NO: 2979099 - DNA, 20 bp, Homo sapiens
aatggaaaatgtatattttg

SEQ ID NO: 2979100 - DNA, 16 bp, Homo sapiens
aatggaaattttgcta

SEQ ID NO: 2979101 - DNA, 17 bp, Homo sapiens
aatggaaattttgctat

SEQ ID NO: 2979102 - DNA, 14 bp, Homo sapiens
aatggaaccaggct

SEQ ID NO: 2979103 - DNA, 16 bp, Homo sapiens
aatggaaccaggcttg

SEQ ID NO: 2979104 - DNA, 19 bp, Homo sapiens
aatggacataggactcaaa

SEQ ID NO: 2979105 - DNA, 19 bp, Homo sapiens
aatggacttttgtacatag

SEQ ID NO: 2979106 - DNA, 20 bp, Homo sapiens
aatggagattcagttttcat

SEQ ID NO: 2979107 - DNA, 16 bp, Homo sapiens
aatggagctttctgta

SEQ ID NO: 2979108 - DNA, 15 bp, Homo sapiens
aatggatcagccaag

SEQ ID NO: 2979109 - DNA, 17 bp, Homo sapiens
aatggatgccttgaata

SEQ ID NO: 2979110 - DNA, 22 bp, Homo sapiens
aatggatgccttgaataataag

SEQ ID NO: 2979111 - DNA, 14 bp, Homo sapiens
aatggattctattt

SEQ ID NO: 2979112 - DNA, 22 bp, Homo sapiens
aatggattttagtcaaatattt

SEQ ID NO: 2979113 - DNA, 23 bp, Homo sapiens
aatggcatgagaaatacaaaaat

SEQ ID NO: 2979114 - DNA, 13 bp, Homo sapiens
aatggcctttatt

SEQ ID NO: 2979115 - DNA, 21 bp, Homo sapiens
aatggctctgtgaaatcagaa

SEQ ID NO: 2979116 - DNA, 17 bp, Homo sapiens
aatggctgtaatcattt

SEQ ID NO: 2979117 - DNA, 14 bp, Homo sapiens
aatggctttgtctt

SEQ ID NO: 2979118 - DNA, 14 bp, Homo sapiens
aatgggaacattta

SEQ ID NO: 2979119 - DNA, 21 bp, Homo sapiens
aatgggagaatcagcagaacc

SEQ ID NO: 2979120 - DNA, 17 bp, Homo sapiens
aatgggatattttgaaa

SEQ ID NO: 2979121 - DNA, 19 bp, Homo sapiens
aatgggatattttgaaatg

SEQ ID NO: 2979122 - DNA, 21 bp, Homo sapiens
aatgggattttctagtttcct

SEQ ID NO: 2979123 - DNA, 23 bp, Homo sapiens
aatgggattttctagtttcctgc

SEQ ID NO: 2979124 - DNA, 11 bp, Homo sapiens
aatgggcaggt

SEQ ID NO: 2979125 - DNA, 18 bp, Homo sapiens
aatgggcagttacatgca

SEQ ID NO: 2979126 - DNA, 21 bp, Homo sapiens
aatgggcagttacatgcatac

SEQ ID NO: 2979127 - DNA, 22 bp, Homo sapiens
aatgggggctttcggggagggc

SEQ ID NO: 2979128 - DNA, 12 bp, Homo sapiens
aatgggtaatat

SEQ ID NO: 2979129 - DNA, 17 bp, Homo sapiens
aatgggtcttagctctt

SEQ ID NO: 2979130 - DNA, 23 bp, Homo sapiens
aatggtagtaatcacagttggcc

SEQ ID NO: 2979131 - DNA, 14 bp, Homo sapiens
aatggtctctgtca

SEQ ID NO: 2979132 - DNA, 12 bp, Homo sapiens
aatggtgactga

SEQ ID NO: 2979133 - DNA, 18 bp, Homo sapiens
aatggtgacttaatccgt

SEQ ID NO: 2979134 - DNA, 22 bp, Homo sapiens
aatggtgcaaaggagccgccac

SEQ ID NO: 2979135 - DNA, 19 bp, Homo sapiens
aatggtggcttcagctcca

SEQ ID NO: 2979136 - DNA, 17 bp, Homo sapiens
aatggtgtggtgaatgt

SEQ ID NO: 2979137 - DNA, 17 bp, Homo sapiens
aatggtgttatttgaaa

SEQ ID NO: 2979138 - DNA, 20 bp, Homo sapiens
aatggtgtttttcttgtaaa

SEQ ID NO: 2979139 - DNA, 16 bp, Homo sapiens
aatggtttttaaattt

SEQ ID NO: 2979140 - DNA, 14 bp, Homo sapiens
aatgtaaaaaacaa

SEQ ID NO: 2979141 - DNA, 17 bp, Homo sapiens
aatgtaaaaaacaaaaa

SEQ ID NO: 2979142 - DNA, 12 bp, Homo sapiens
aatgtaaaaaag

SEQ ID NO: 2979143 - DNA, 15 bp, Homo sapiens
aatgtaaaattgaaa

SEQ ID NO: 2979144 - DNA, 16 bp, Homo sapiens
aatgtaaatgatttta

SEQ ID NO: 2979145 - DNA, 17 bp, Homo sapiens
aatgtaacagtctgatc

SEQ ID NO: 2979146 - DNA, 23 bp, Homo sapiens
aatgtaattgtaattttgaaatg

SEQ ID NO: 2979147 - DNA, 15 bp, Homo sapiens
aatgtaatttcagtt

SEQ ID NO: 2979148 - DNA, 16 bp, Homo sapiens
aatgtacagacatatt

SEQ ID NO: 2979149 - DNA, 16 bp, Homo sapiens
aatgtacagagtaacc

SEQ ID NO: 2979150 - DNA, 18 bp, Homo sapiens
aatgtactggtaattgta

SEQ ID NO: 2979151 - DNA, 19 bp, Homo sapiens
aatgtatatagtctttgca

SEQ ID NO: 2979152 - DNA, 14 bp, Homo sapiens
aatgtatccagagg

SEQ ID NO: 2979153 - DNA, 18 bp, Homo sapiens
aatgtatgctatcctctt

SEQ ID NO: 2979154 - DNA, 15 bp, Homo sapiens
aatgtattgtacctt

SEQ ID NO: 2979155 - DNA, 14 bp, Homo sapiens
aatgtatttcctga

SEQ ID NO: 2979156 - DNA, 17 bp, Homo sapiens
aatttatattttagaaa

SEQ ID NO: 2979157 - DNA, 23 bp, Homo sapiens
aatttatattttagaaataataa

SEQ ID NO: 2979158 - DNA, 19 bp, Homo sapiens
aatttattaattgctttga

SEQ ID NO: 2979159 - DNA, 20 bp, Homo sapiens
aatttattgcacattgttca

SEQ ID NO: 2979160 - DNA, 17 bp, Homo sapiens
aatttcacagatgctgt

SEQ ID NO: 2979161 - DNA, 17 bp, Homo sapiens
aatttcactgtctttta

SEQ ID NO: 2979162 - DNA, 18 bp, Homo sapiens
aatttcactgtcttttaa

SEQ ID NO: 2979163 - DNA, 23 bp, Homo sapiens
aatttcatcactaaaagaaaatc

SEQ ID NO: 2979164 - DNA, 18 bp, Homo sapiens
aatttccccaacagtgtg

SEQ ID NO: 2979165 - DNA, 17 bp, Homo sapiens
aatttcctaatgagata

SEQ ID NO: 2979166 - DNA, 19 bp, Homo sapiens
aatttctctttttgaaaaa

SEQ ID NO: 2979167 - DNA, 23 bp, Homo sapiens
aatttctgcacaggtctctgttt

SEQ ID NO: 2979168 - DNA, 23 bp, Homo sapiens
aatttcttctcctggagttgcat

SEQ ID NO: 2979169 - DNA, 16 bp, Homo sapiens
aatttctttaaaaaag

SEQ ID NO: 2979170 - DNA, 15 bp, Homo sapiens
aatttgaactttgga

SEQ ID NO: 2979171 - DNA, 17 bp, Homo sapiens
aatttgagatacaaaca

SEQ ID NO: 2979172 - DNA, 20 bp, Homo sapiens
aatttgagtttgctgtttta

SEQ ID NO: 2979173 - DNA, 20 bp, Homo sapiens
aatttgatagatgtttgact

SEQ ID NO: 2979174 - DNA, 12 bp, Homo sapiens
aatttgattgat

SEQ ID NO: 2979175 - DNA, 14 bp, Homo sapiens
aatttgcaaagtac

SEQ ID NO: 2979176 - DNA, 17 bp, Homo sapiens
aatttgcaaagtactgt

SEQ ID NO: 2979177 - DNA, 21 bp, Homo sapiens
aatttgcatgaaagcacaagg

SEQ ID NO: 2979178 - DNA, 17 bp, Homo sapiens
aatttgcattaaattca

SEQ ID NO: 2979179 - DNA, 15 bp, Homo sapiens
aatttggtttttact

SEQ ID NO: 2979180 - DNA, 22 bp, Homo sapiens
aatttggtttttactcaaccaa

SEQ ID NO: 2979181 - DNA, 22 bp, Homo sapiens
aatttgtaaaaacagcattgct

SEQ ID NO: 2979182 - DNA, 23 bp, Homo sapiens
aatttgtaaaaacagcattgctt

SEQ ID NO: 2979183 - DNA, 23 bp, Homo sapiens
aatttgtaagcaacttgcttcta

SEQ ID NO: 2979184 - DNA, 20 bp, Homo sapiens
aatttgtcagcgttctacca

SEQ ID NO: 2979185 - DNA, 18 bp, Homo sapiens
aatttgttattttgcaac

SEQ ID NO: 2979186 - DNA, 12 bp, Homo sapiens
aatttgttgcat

SEQ ID NO: 2979187 - DNA, 16 bp, Homo sapiens
aatttgtttaaaattc

SEQ ID NO: 2979188 - DNA, 18 bp, Homo sapiens
aatttgtttaaaattctc

SEQ ID NO: 2979189 - DNA, 19 bp, Homo sapiens
aatttgtttaaaattctct

SEQ ID NO: 2979190 - DNA, 12 bp, Homo sapiens
aatttgtttgac

SEQ ID NO: 2979191 - DNA, 15 bp, Homo sapiens
aatttgtttgacaat

SEQ ID NO: 2979192 - DNA, 22 bp, Homo sapiens
aattttaatgtgaagacatttt

SEQ ID NO: 2979193 - DNA, 14 bp, Homo sapiens
aattttaatttagt

SEQ ID NO: 2979194 - DNA, 23 bp, Homo sapiens
aattttacaataaactttttgaa

SEQ ID NO: 2979195 - DNA, 21 bp, Homo sapiens
aattttaccctttagactgta

SEQ ID NO: 2979196 - DNA, 19 bp, Homo sapiens
aattttagtagagacaggg

SEQ ID NO: 2979197 - DNA, 18 bp, Homo sapiens
aattttatggcactattt

SEQ ID NO: 2979198 - DNA, 15 bp, Homo sapiens
aattttcactgctgc

SEQ ID NO: 2979199 - DNA, 12 bp, Homo sapiens
aattttcagcat

SEQ ID NO: 2979200 - DNA, 18 bp, Homo sapiens
aattttcattaaacttga

SEQ ID NO: 2979201 - DNA, 20 bp, Homo sapiens
aattttcattaaacttgaag

SEQ ID NO: 2979202 - DNA, 19 bp, Homo sapiens
aattttcctaataaagttc

SEQ ID NO: 2979203 - DNA, 22 bp, Homo sapiens
aattttctttttgtttcactgg

SEQ ID NO: 2979204 - DNA, 15 bp, Homo sapiens
aattttgaggtcttt

SEQ ID NO: 2979205 - DNA, 21 bp, Homo sapiens
aattttgaggtcttttacata

SEQ ID NO: 2979206 - DNA, 18 bp, Homo sapiens
aattttggttgtattctt

SEQ ID NO: 2979207 - DNA, 22 bp, Homo sapiens
aattttggttgtattctttgat

SEQ ID NO: 2979208 - DNA, 13 bp, Homo sapiens
aattttgtaatga

SEQ ID NO: 2979209 - DNA, 13 bp, Homo sapiens
aattttgtacaaa

SEQ ID NO: 2979210 - DNA, 19 bp, Homo sapiens
aattttgtatccatttaaa

SEQ ID NO: 2979211 - DNA, 23 bp, Homo sapiens
aattttgtatccatttaaactaa

SEQ ID NO: 2979212 - DNA, 13 bp, Homo sapiens
aattttgtatttt

SEQ ID NO: 2979213 - DNA, 13 bp, Homo sapiens
aattttgtgcaaa

SEQ ID NO: 2979214 - DNA, 18 bp, Homo sapiens
aattttgtgcaaaaagga

SEQ ID NO: 2979215 - DNA, 21 bp, Homo sapiens
aattttgtgcttttagtaaaa

SEQ ID NO: 2979216 - DNA, 17 bp, Homo sapiens
aatttttaaaagacttt

SEQ ID NO: 2979217 - DNA, 12 bp, Homo sapiens
aatttttaactg

SEQ ID NO: 2979218 - DNA, 18 bp, Homo sapiens
aatttttaactgtactga

SEQ ID NO: 2979219 - DNA, 19 bp, Homo sapiens
aatttttcagatgcttctg

SEQ ID NO: 2979220 - DNA, 12 bp, Homo sapiens
aatttttgcaat

SEQ ID NO: 2979221 - DNA, 17 bp, Homo sapiens
aatttttgcaataatgc

SEQ ID NO: 2979222 - DNA, 16 bp, Homo sapiens
aatttttgccttcatt

SEQ ID NO: 2979223 - DNA, 12 bp, Homo sapiens
aatttttgttct

SEQ ID NO: 2979224 - DNA, 11 bp, Homo sapiens
aattttttcct

SEQ ID NO: 2979225 - DNA, 16 bp, Homo sapiens
aattttttggtacaaa

SEQ ID NO: 2979226 - DNA, 20 bp, Homo sapiens
aattttttggtacaaaaata

SEQ ID NO: 2979227 - DNA, 21 bp, Homo sapiens
aattttttggtacaaaaataa

SEQ ID NO: 2979228 - DNA, 17 bp, Homo sapiens
aatttttttaattttgt

SEQ ID NO: 2979229 - DNA, 15 bp, Homo sapiens
aattttttttagtat

SEQ ID NO: 2979230 - DNA, 20 bp, Homo sapiens
aattttttttagtatttatt

SEQ ID NO: 2979231 - DNA, 23 bp, Homo sapiens
aattttttttagtatttatttat

SEQ ID NO: 2979232 - DNA, 14 bp, Homo sapiens
acaaaaaaaacaac

SEQ ID NO: 2979233 - DNA, 22 bp, Homo sapiens
acaaaaaaaacaacaaaaaaag

SEQ ID NO: 2979234 - DNA, 11 bp, Homo sapiens
acaaaaaataa

SEQ ID NO: 2979235 - DNA, 21 bp, Homo sapiens
acaaaaacagcctcacagaag

SEQ ID NO: 2979236 - DNA, 20 bp, Homo sapiens
acaaaaaggagcgggcaggg

SEQ ID NO: 2979237 - DNA, 10 bp, Homo sapiens
acaaaaagtc

SEQ ID NO: 2979238 - DNA, 21 bp, Homo sapiens
acaaaaagttttttttttgtt

SEQ ID NO: 2979239 - DNA, 12 bp, Homo sapiens
acaaaaataaat

SEQ ID NO: 2979240 - DNA, 20 bp, Homo sapiens
acaaaaataaatttatatga

SEQ ID NO: 2979241 - DNA, 16 bp, Homo sapiens
acaaaaatactcagat

SEQ ID NO: 2979242 - DNA, 17 bp, Homo sapiens
acaaaaatcagccagac

SEQ ID NO: 2979243 - DNA, 12 bp, Homo sapiens
acaaaaatggga

SEQ ID NO: 2979244 - DNA, 14 bp, Homo sapiens
acaaaaatggtaac

SEQ ID NO: 2979245 - DNA, 14 bp, Homo sapiens
acaaaaattatgca

SEQ ID NO: 2979246 - DNA, 14 bp, Homo sapiens
acaaaacaaaacaa

SEQ ID NO: 2979247 - DNA, 17 bp, Homo sapiens
acaaaacaaaacaacat

SEQ ID NO: 2979248 - DNA, 18 bp, Homo sapiens
acaaaaccaattcatgaa

SEQ ID NO: 2979249 - DNA, 16 bp, Homo sapiens
acaaaacgcgcagatg

SEQ ID NO: 2979250 - DNA, 15 bp, Homo sapiens
acaaaactacatgag

SEQ ID NO: 2979251 - DNA, 13 bp, Homo sapiens
acaaaactcttaa

SEQ ID NO: 2979252 - DNA, 14 bp, Homo sapiens
acaaaactgcattt

SEQ ID NO: 2979253 - DNA, 13 bp, Homo sapiens
acaaaagaaaaaa

SEQ ID NO: 2979254 - DNA, 14 bp, Homo sapiens
acaaaagcagccct

SEQ ID NO: 2979255 - DNA, 15 bp, Homo sapiens
acaaaagctgtgtct

SEQ ID NO: 2979256 - DNA, 16 bp, Homo sapiens
acaaaagctgtgtctc

SEQ ID NO: 2979257 - DNA, 17 bp, Homo sapiens
acaaaaggaagactgga

SEQ ID NO: 2979258 - DNA, 17 bp, Homo sapiens
acaaaagttaatgaata

SEQ ID NO: 2979259 - DNA, 15 bp, Homo sapiens
acaaaataaaactgt

SEQ ID NO: 2979260 - DNA, 22 bp, Homo sapiens
acaaaataaccaatcctggaca

SEQ ID NO: 2979261 - DNA, 14 bp, Homo sapiens
acaaaatctcctct

SEQ ID NO: 2979262 - DNA, 14 bp, Homo sapiens
acaaaatgaaagaa

SEQ ID NO: 2979263 - DNA, 21 bp, Homo sapiens
acaaaatgcctttttgtttac

SEQ ID NO: 2979264 - DNA, 16 bp, Homo sapiens
acaaaatggtcctatt

SEQ ID NO: 2979265 - DNA, 20 bp, Homo sapiens
acaaaatttgactaatttta

SEQ ID NO: 2979266 - DNA, 16 bp, Homo sapiens
acaaacaaacaaacaa

SEQ ID NO: 2979267 - DNA, 13 bp, Homo sapiens
acaaaccaacatc

SEQ ID NO: 2979268 - DNA, 15 bp, Homo sapiens
acaaactctctgaac

SEQ ID NO: 2979269 - DNA, 19 bp, Homo sapiens
acaaagaaacattttacgc

SEQ ID NO: 2979270 - DNA, 21 bp, Homo sapiens
acaaagaaaggtgccatgtct

SEQ ID NO: 2979271 - DNA, 12 bp, Homo sapiens
acaaagaacctt

SEQ ID NO: 2979272 - DNA, 13 bp, Homo sapiens
acaaagaagacat

SEQ ID NO: 2979273 - DNA, 15 bp, Homo sapiens
acaaagagtgaaata

SEQ ID NO: 2979274 - DNA, 20 bp, Homo sapiens
acaaagagtgaaatattgta

SEQ ID NO: 2979275 - DNA, 21 bp, Homo sapiens
acaaagatgggtgaaggctgg

SEQ ID NO: 2979276 - DNA, 16 bp, Homo sapiens
acaaagcacagtttga

SEQ ID NO: 2979277 - DNA, 13 bp, Homo sapiens
acaaagcagccac

SEQ ID NO: 2979278 - DNA, 14 bp, Homo sapiens
acaaagcagccacg

SEQ ID NO: 2979279 - DNA, 16 bp, Homo sapiens
acaaagccagaagctg

SEQ ID NO: 2979280 - DNA, 13 bp, Homo sapiens
acaaagcccaagg

SEQ ID NO: 2979281 - DNA, 19 bp, Homo sapiens
acaaagcttagcaggagag

SEQ ID NO: 2979282 - DNA, 21 bp, Homo sapiens
acaaaggaggacaagaccctc

SEQ ID NO: 2979283 - DNA, 20 bp, Homo sapiens
acaaaggattaattgctgca

SEQ ID NO: 2979284 - DNA, 18 bp, Homo sapiens
acaaaggcaaagggtcca

SEQ ID NO: 2979285 - DNA, 20 bp, Homo sapiens
acaaagggcacagcatctgt

SEQ ID NO: 2979286 - DNA, 22 bp, Homo sapiens
acaaagggcacagcatctgtag

SEQ ID NO: 2979287 - DNA, 17 bp, Homo sapiens
acaaaggggaaagaaca

SEQ ID NO: 2979288 - DNA, 18 bp, Homo sapiens
acaaaggggaaagaacat

SEQ ID NO: 2979289 - DNA, 17 bp, Homo sapiens
acagctcttcttgaaaa

SEQ ID NO: 2979290 - DNA, 16 bp, Homo sapiens
acagctgaagagcaag

SEQ ID NO: 2979291 - DNA, 12 bp, Homo sapiens
acagctgcctta

SEQ ID NO: 2979292 - DNA, 16 bp, Homo sapiens
acagctgccttagctt

SEQ ID NO: 2979293 - DNA, 22 bp, Homo sapiens
acagctgctcctagagggaggg

SEQ ID NO: 2979294 - DNA, 13 bp, Homo sapiens
acagctggtgcca

SEQ ID NO: 2979295 - DNA, 15 bp, Homo sapiens
acagctgtccctgtc

SEQ ID NO: 2979296 - DNA, 13 bp, Homo sapiens
acagctgttcctg

SEQ ID NO: 2979297 - DNA, 15 bp, Homo sapiens
acagctgttcctgtg

SEQ ID NO: 2979298 - DNA, 16 bp, Homo sapiens
acagctgttcctgtgt

SEQ ID NO: 2979299 - DNA, 15 bp, Homo sapiens
acagctttctgacct

SEQ ID NO: 2979300 - DNA, 18 bp, Homo sapiens
acagctttctgaccttca

SEQ ID NO: 2979301 - DNA, 22 bp, Homo sapiens
acagctttctgaccttcagctc

SEQ ID NO: 2979302 - DNA, 11 bp, Homo sapiens
acagctttgct

SEQ ID NO: 2979303 - DNA, 17 bp, Homo sapiens
acaggaaaatcctctgg

SEQ ID NO: 2979304 - DNA, 23 bp, Homo sapiens
acaggaaaatgtatccagaggaa

SEQ ID NO: 2979305 - DNA, 16 bp, Homo sapiens
acaggaaacagcaaac

SEQ ID NO: 2979306 - DNA, 20 bp, Homo sapiens
acaggaaggaaacaacattt

SEQ ID NO: 2979307 - DNA, 14 bp, Homo sapiens
acaggaccagattt

SEQ ID NO: 2979308 - DNA, 17 bp, Homo sapiens
acaggagcaatcacagg

SEQ ID NO: 2979309 - DNA, 16 bp, Homo sapiens
acaggaggacaattca

SEQ ID NO: 2979310 - DNA, 20 bp, Homo sapiens
acaggaggacaattcatgaa

SEQ ID NO: 2979311 - DNA, 21 bp, Homo sapiens
acaggaggtgtgatagagcct

SEQ ID NO: 2979312 - DNA, 19 bp, Homo sapiens
acaggagttgtgagccctc

SEQ ID NO: 2979313 - DNA, 19 bp, Homo sapiens
acaggatcatgtaaatgct

SEQ ID NO: 2979314 - DNA, 19 bp, Homo sapiens
acaggatgtgtttgctttc

SEQ ID NO: 2979315 - DNA, 20 bp, Homo sapiens
acaggcaggggtgagagcac

SEQ ID NO: 2979316 - DNA, 13 bp, Homo sapiens
acaggccctagct

SEQ ID NO: 2979317 - DNA, 21 bp, Homo sapiens
acaggccctccctgttcccca

SEQ ID NO: 2979318 - DNA, 23 bp, Homo sapiens
acaggccctccctgttccccaga

SEQ ID NO: 2979319 - DNA, 23 bp, Homo sapiens
acaggcggggcccagcgctctcc

SEQ ID NO: 2979320 - DNA, 15 bp, Homo sapiens
acagggcacctgcca

SEQ ID NO: 2979321 - DNA, 16 bp, Homo sapiens
acagggcccaggcctg

SEQ ID NO: 2979322 - DNA, 19 bp, Homo sapiens
acagggcccaggcctggag

SEQ ID NO: 2979323 - DNA, 23 bp, Homo sapiens
acagggggtggagagaccagcct

SEQ ID NO: 2979324 - DNA, 14 bp, Homo sapiens
acagggtcttgcta

SEQ ID NO: 2979325 - DNA, 17 bp, Homo sapiens
acagggtggtggcacat

SEQ ID NO: 2979326 - DNA, 12 bp, Homo sapiens
acaggtattttc

SEQ ID NO: 2979327 - DNA, 22 bp, Homo sapiens
acaggtcaatacagtacaggca

SEQ ID NO: 2979328 - DNA, 14 bp, Homo sapiens
acaggtctctgaga

SEQ ID NO: 2979329 - DNA, 15 bp, Homo sapiens
acaggtctctgagac

SEQ ID NO: 2979330 - DNA, 14 bp, Homo sapiens
acaggtctctgttt

SEQ ID NO: 2979331 - DNA, 20 bp, Homo sapiens
acaggtgctggcccagcatg

SEQ ID NO: 2979332 - DNA, 21 bp, Homo sapiens
acaggtgctggcccagcatgg

SEQ ID NO: 2979333 - DNA, 22 bp, Homo sapiens
acaggtgctggcccagcatgga

SEQ ID NO: 2979334 - DNA, 15 bp, Homo sapiens
acaggttaagtagca

SEQ ID NO: 2979335 - DNA, 14 bp, Homo sapiens
acaggttacaacag

SEQ ID NO: 2979336 - DNA, 17 bp, Homo sapiens
acaggttacaacagatt

SEQ ID NO: 2979337 - DNA, 15 bp, Homo sapiens
acaggttagctgctc

SEQ ID NO: 2979338 - DNA, 22 bp, Homo sapiens
acaggttattttagtttctgtt

SEQ ID NO: 2979339 - DNA, 18 bp, Homo sapiens
acaggtttgggacccctg

SEQ ID NO: 2979340 - DNA, 15 bp, Homo sapiens
acaggtttgtttctt

SEQ ID NO: 2979341 - DNA, 23 bp, Homo sapiens
acagtaaatatcccaaactgtga

SEQ ID NO: 2979342 - DNA, 15 bp, Homo sapiens
acagtaactttatgt

SEQ ID NO: 2979343 - DNA, 16 bp, Homo sapiens
acagtaactttatgtg

SEQ ID NO: 2979344 - DNA, 21 bp, Homo sapiens
acagtaactttatgtgtaaat

SEQ ID NO: 2979345 - DNA, 22 bp, Homo sapiens
acagtaattattatttaactct

SEQ ID NO: 2979346 - DNA, 13 bp, Homo sapiens
acagtacaggcag

SEQ ID NO: 2979347 - DNA, 18 bp, Homo sapiens
acagtacaggcagcacag

SEQ ID NO: 2979348 - DNA, 22 bp, Homo sapiens
acagtaccagtgtaaattcagt

SEQ ID NO: 2979349 - DNA, 16 bp, Homo sapiens
acagtataaaaataga

SEQ ID NO: 2979350 - DNA, 16 bp, Homo sapiens
acagtatactcagcta

SEQ ID NO: 2979351 - DNA, 21 bp, Homo sapiens
acagtatttttcagatataaa

SEQ ID NO: 2979352 - DNA, 23 bp, Homo sapiens
acagtatttttcagatataaata

SEQ ID NO: 2979353 - DNA, 21 bp, Homo sapiens
acagtcagaaggacggcagga

SEQ ID NO: 2979354 - DNA, 17 bp, Homo sapiens
acagtcatgaggcagct

SEQ ID NO: 2979355 - DNA, 14 bp, Homo sapiens
acagtcattattta

SEQ ID NO: 2979356 - DNA, 22 bp, Homo sapiens
acagtcattatttaaagcacat

SEQ ID NO: 2979357 - DNA, 13 bp, Homo sapiens
acagtccacagct

SEQ ID NO: 2979358 - DNA, 14 bp, Homo sapiens
acagtcggaaaagc

SEQ ID NO: 2979359 - DNA, 16 bp, Homo sapiens
acagtctaaagaagag

SEQ ID NO: 2979360 - DNA, 15 bp, Homo sapiens
acagtctcaattttg

SEQ ID NO: 2979361 - DNA, 16 bp, Homo sapiens
acagtctcaattttgt

SEQ ID NO: 2979362 - DNA, 19 bp, Homo sapiens
acagtctgatcgtgacgct

SEQ ID NO: 2979363 - DNA, 11 bp, Homo sapiens
acagtctgtct

SEQ ID NO: 2979364 - DNA, 19 bp, Homo sapiens
acagtcttccatttgcaag

SEQ ID NO: 2979365 - DNA, 18 bp, Homo sapiens
acagtgaagacagaagtt

SEQ ID NO: 2979366 - DNA, 18 bp, Homo sapiens
acagtgacaccatttgtc

SEQ ID NO: 2979367 - DNA, 19 bp, Homo sapiens
acagtgacaccatttgtcc

SEQ ID NO: 2979368 - DNA, 21 bp, Homo sapiens
acagtgacactggaccaggtc

SEQ ID NO: 2979369 - DNA, 17 bp, Homo sapiens
acagtgatgatgcatgg

SEQ ID NO: 2979370 - DNA, 14 bp, Homo sapiens
acagtgatgcctgc

SEQ ID NO: 2979371 - DNA, 24 bp, Homo sapiens
acagtgatgctgtgctatgaattt

SEQ ID NO: 2979372 - DNA, 15 bp, Homo sapiens
acagtgcacatgaac

SEQ ID NO: 2979373 - DNA, 14 bp, Homo sapiens
acagtgcagtgcgc

SEQ ID NO: 2979374 - DNA, 16 bp, Homo sapiens
acagtgctaaaaatgg

SEQ ID NO: 2979375 - DNA, 14 bp, Homo sapiens
acagtgctctgcct

SEQ ID NO: 2979376 - DNA, 16 bp, Homo sapiens
acagtgctctgcctct

SEQ ID NO: 2979377 - DNA, 17 bp, Homo sapiens
acagtgctctgcctcta

SEQ ID NO: 2979378 - DNA, 13 bp, Homo sapiens
acagtgcttacat

SEQ ID NO: 2979379 - DNA, 18 bp, Homo sapiens
acagtggaactacattag

SEQ ID NO: 2979380 - DNA, 16 bp, Homo sapiens
acagtggctcacgcct

SEQ ID NO: 2979381 - DNA, 21 bp, Homo sapiens
acagtggctcacgcctgtaat

SEQ ID NO: 2979382 - DNA, 12 bp, Homo sapiens
acagtgggaaat

SEQ ID NO: 2979383 - DNA, 15 bp, Homo sapiens
acagtggtggcaggg

SEQ ID NO: 2979384 - DNA, 13 bp, Homo sapiens
acagtgtaagctt

SEQ ID NO: 2979385 - DNA, 15 bp, Homo sapiens
acagtgtacatgtac

SEQ ID NO: 2979386 - DNA, 24 bp, Homo sapiens
acagtgtcccccaggttccgaaga

SEQ ID NO: 2979387 - DNA, 16 bp, Homo sapiens
acagtgtgaagttaga

SEQ ID NO: 2979388 - DNA, 19 bp, Homo sapiens
acagtgtgaagttagaatt

SEQ ID NO: 2979389 - DNA, 20 bp, Homo sapiens
acagtgtgggcgctctccct

SEQ ID NO: 2979390 - DNA, 16 bp, Homo sapiens
acagtgtttttgtaaa

SEQ ID NO: 2979391 - DNA, 20 bp, Homo sapiens
acagtgtttttgtaaagtgt

SEQ ID NO: 2979392 - DNA, 22 bp, Homo sapiens
acagtgtttttgtaaagtgtgg

SEQ ID NO: 2979393 - DNA, 13 bp, Homo sapiens
acagttacataat

SEQ ID NO: 2979394 - DNA, 22 bp, Homo sapiens
acagttacttaagattcagttt

SEQ ID NO: 2979395 - DNA, 23 bp, Homo sapiens
acagttacttaagattcagtttt

SEQ ID NO: 2979396 - DNA, 15 bp, Homo sapiens
acagttatctaagtt

SEQ ID NO: 2979397 - DNA, 22 bp, Homo sapiens
acagttcataaatttgttgtca

SEQ ID NO: 2979398 - DNA, 15 bp, Homo sapiens
acagttcctcgccct

SEQ ID NO: 2979399 - DNA, 22 bp, Homo sapiens
acagttcggtgagctacaaatg

SEQ ID NO: 2979400 - DNA, 13 bp, Homo sapiens
acagttctgtcat

SEQ ID NO: 2979401 - DNA, 15 bp, Homo sapiens
acagttcttaataca

SEQ ID NO: 2979402 - DNA, 17 bp, Homo sapiens
acagttctttgggccag

SEQ ID NO: 2979403 - DNA, 18 bp, Homo sapiens
acagttctttgggccaga

SEQ ID NO: 2979404 - DNA, 14 bp, Homo sapiens
acagttcttttcta

SEQ ID NO: 2979405 - DNA, 16 bp, Homo sapiens
acagttgcaggagcgt

SEQ ID NO: 2979406 - DNA, 16 bp, Homo sapiens
acagttgctggcatgt

SEQ ID NO: 2979407 - DNA, 16 bp, Homo sapiens
acagtttactttgcca

SEQ ID NO: 2979408 - DNA, 20 bp, Homo sapiens
acagtttataaagccaagaa

SEQ ID NO: 2979409 - DNA, 17 bp, Homo sapiens
acagtttcattattctc

SEQ ID NO: 2979410 - DNA, 13 bp, Homo sapiens
acagtttcttctg

SEQ ID NO: 2979411 - DNA, 19 bp, Homo sapiens
acagtttgtttcctgtctg

SEQ ID NO: 2979412 - DNA, 20 bp, Homo sapiens
acagtttgtttcctgtctga

SEQ ID NO: 2979413 - DNA, 11 bp, Homo sapiens
acagttttgtg

SEQ ID NO: 2979414 - DNA, 21 bp, Homo sapiens
acataaaaagcagaattttaa

SEQ ID NO: 2979415 - DNA, 20 bp, Homo sapiens
acataaaatttacatttaat

SEQ ID NO: 2979416 - DNA, 11 bp, Homo sapiens
acataaatgca

SEQ ID NO: 2979417 - DNA, 16 bp, Homo sapiens
acataaatgcagccca

SEQ ID NO: 2979418 - DNA, 12 bp, Homo sapiens
acataaattatg

SEQ ID NO: 2979419 - DNA, 15 bp, Homo sapiens
acataactgatctat

SEQ ID NO: 2979420 - DNA, 13 bp, Homo sapiens
acataagagaaag

SEQ ID NO: 2979421 - DNA, 14 bp, Homo sapiens
acataagatcactg

SEQ ID NO: 2979422 - DNA, 16 bp, Homo sapiens
accagctgcaaagtgt

SEQ ID NO: 2979423 - DNA, 17 bp, Homo sapiens
accagctgcaaagtgtt

SEQ ID NO: 2979424 - DNA, 18 bp, Homo sapiens
accagctgcaaagtgttt

SEQ ID NO: 2979425 - DNA, 20 bp, Homo sapiens
accaggaatgttaaagtcag

SEQ ID NO: 2979426 - DNA, 13 bp, Homo sapiens
accaggacccagg

SEQ ID NO: 2979427 - DNA, 15 bp, Homo sapiens
accaggacccaggga

SEQ ID NO: 2979428 - DNA, 21 bp, Homo sapiens
accaggagaagggctggggcc

SEQ ID NO: 2979429 - DNA, 20 bp, Homo sapiens
accaggagcacctggacccc

SEQ ID NO: 2979430 - DNA, 19 bp, Homo sapiens
accaggatccagcctcact

SEQ ID NO: 2979431 - DNA, 16 bp, Homo sapiens
accaggcacatggctg

SEQ ID NO: 2979432 - DNA, 18 bp, Homo sapiens
accaggcctcactggctc

SEQ ID NO: 2979433 - DNA, 22 bp, Homo sapiens
accaggcctcactggctcatgc

SEQ ID NO: 2979434 - DNA, 12 bp, Homo sapiens
accagggaccct

SEQ ID NO: 2979435 - DNA, 14 bp, Homo sapiens
accagggcagggcc

SEQ ID NO: 2979436 - DNA, 16 bp, Homo sapiens
accagggccttttctg

SEQ ID NO: 2979437 - DNA, 18 bp, Homo sapiens
accaggtccattttgcct

SEQ ID NO: 2979438 - DNA, 15 bp, Homo sapiens
accaggtcctgctcc

SEQ ID NO: 2979439 - DNA, 13 bp, Homo sapiens
accaggtgccttt

SEQ ID NO: 2979440 - DNA, 22 bp, Homo sapiens
accaggtgcctttcaaatttag

SEQ ID NO: 2979441 - DNA, 18 bp, Homo sapiens
accaggttcacttaaaag

SEQ ID NO: 2979442 - DNA, 20 bp, Homo sapiens
accagtagtcacctctgggc

SEQ ID NO: 2979443 - DNA, 14 bp, Homo sapiens
accagtctgaccct

SEQ ID NO: 2979444 - DNA, 19 bp, Homo sapiens
accagtgaatttttgcaat

SEQ ID NO: 2979445 - DNA, 21 bp, Homo sapiens
accagtgaatttttgcaataa

SEQ ID NO: 2979446 - DNA, 14 bp, Homo sapiens
accagtgcaggctg

SEQ ID NO: 2979447 - DNA, 15 bp, Homo sapiens
accagtgcaggctgg

SEQ ID NO: 2979448 - DNA, 16 bp, Homo sapiens
accagtgcaggctggc

SEQ ID NO: 2979449 - DNA, 23 bp, Homo sapiens
accagtgtaaattcagtcttttc

SEQ ID NO: 2979450 - DNA, 22 bp, Homo sapiens
accagtgttagggaagggcctg

SEQ ID NO: 2979451 - DNA, 13 bp, Homo sapiens
accagtttaaatt

SEQ ID NO: 2979452 - DNA, 13 bp, Homo sapiens
accagtttcttaa

SEQ ID NO: 2979453 - DNA, 14 bp, Homo sapiens
accagtttcttaaa

SEQ ID NO: 2979454 - DNA, 16 bp, Homo sapiens
accataaaaagaggat

SEQ ID NO: 2979455 - DNA, 12 bp, Homo sapiens
accatactcaga

SEQ ID NO: 2979456 - DNA, 22 bp, Homo sapiens
accatagttatttacttgaaag

SEQ ID NO: 2979457 - DNA, 14 bp, Homo sapiens
accatatgaatgaa

SEQ ID NO: 2979458 - DNA, 22 bp, Homo sapiens
accatattttattgtattttga

SEQ ID NO: 2979459 - DNA, 18 bp, Homo sapiens
accatcagaattcagaat

SEQ ID NO: 2979460 - DNA, 15 bp, Homo sapiens
accatcgctggcccc

SEQ ID NO: 2979461 - DNA, 20 bp, Homo sapiens
accatcgctggcccctttgg

SEQ ID NO: 2979462 - DNA, 22 bp, Homo sapiens
accatctgtgactataaagctg

SEQ ID NO: 2979463 - DNA, 23 bp, Homo sapiens
accatctgtgactataaagctgt

SEQ ID NO: 2979464 - DNA, 18 bp, Homo sapiens
accatgaacagaaaacat

SEQ ID NO: 2979465 - DNA, 11 bp, Homo sapiens
accatgcaagg

SEQ ID NO: 2979466 - DNA, 15 bp, Homo sapiens
accatgcacccctga

SEQ ID NO: 2979467 - DNA, 18 bp, Homo sapiens
accatgcaggaaggaaaa

SEQ ID NO: 2979468 - DNA, 19 bp, Homo sapiens
accatgcctcactaatttt

SEQ ID NO: 2979469 - DNA, 22 bp, Homo sapiens
accatgcgacactgggaggcca

SEQ ID NO: 2979470 - DNA, 20 bp, Homo sapiens
accatggggaagaaatctgg

SEQ ID NO: 2979471 - DNA, 17 bp, Homo sapiens
accatgtagaaaatttg

SEQ ID NO: 2979472 - DNA, 22 bp, Homo sapiens
accatgtctatgattcgtgtaa

SEQ ID NO: 2979473 - DNA, 21 bp, Homo sapiens
accatgtttgagctcagaccc

SEQ ID NO: 2979474 - DNA, 16 bp, Homo sapiens
accattatagcctcag

SEQ ID NO: 2979475 - DNA, 13 bp, Homo sapiens
accattctttctt

SEQ ID NO: 2979476 - DNA, 19 bp, Homo sapiens
accattctttcttggtgca

SEQ ID NO: 2979477 - DNA, 18 bp, Homo sapiens
accattgaattcttggtt

SEQ ID NO: 2979478 - DNA, 21 bp, Homo sapiens
accattggacagatttcagta

SEQ ID NO: 2979479 - DNA, 12 bp, Homo sapiens
accattggctgc

SEQ ID NO: 2979480 - DNA, 16 bp, Homo sapiens
accatttgtagtgagc

SEQ ID NO: 2979481 - DNA, 11 bp, Homo sapiens
accattttatc

SEQ ID NO: 2979482 - DNA, 19 bp, Homo sapiens
accattttcccatcatcct

SEQ ID NO: 2979483 - DNA, 19 bp, Homo sapiens
accattttggatgtcattg

SEQ ID NO: 2979484 - DNA, 20 bp, Homo sapiens
accattttttaaggaaacaa

SEQ ID NO: 2979485 - DNA, 15 bp, Homo sapiens
acccaaaccccttcc

SEQ ID NO: 2979486 - DNA, 17 bp, Homo sapiens
acccaaagctgagcctg

SEQ ID NO: 2979487 - DNA, 14 bp, Homo sapiens
acccaacaatgagt

SEQ ID NO: 2979488 - DNA, 19 bp, Homo sapiens
acccaactagctctatgtt

SEQ ID NO: 2979489 - DNA, 22 bp, Homo sapiens
acccaagagaggaaggacccct

SEQ ID NO: 2979490 - DNA, 20 bp, Homo sapiens
acccaagtatacaataaagt

SEQ ID NO: 2979491 - DNA, 22 bp, Homo sapiens
acccacaagctgcctctgacag

SEQ ID NO: 2979492 - DNA, 17 bp, Homo sapiens
acccacagcctccaagt

SEQ ID NO: 2979493 - DNA, 13 bp, Homo sapiens
acccacagggcta

SEQ ID NO: 2979494 - DNA, 15 bp, Homo sapiens
acccacatattgaaa

SEQ ID NO: 2979495 - DNA, 13 bp, Homo sapiens
acccacctcagcc

SEQ ID NO: 2979496 - DNA, 15 bp, Homo sapiens
acccacctcagcctc

SEQ ID NO: 2979497 - DNA, 13 bp, Homo sapiens
acccacctccctg

SEQ ID NO: 2979498 - DNA, 15 bp, Homo sapiens
acccacctccctgcc

SEQ ID NO: 2979499 - DNA, 22 bp, Homo sapiens
acccacctggccccctcagctc

SEQ ID NO: 2979500 - DNA, 13 bp, Homo sapiens
acccacgtggaga

SEQ ID NO: 2979501 - DNA, 13 bp, Homo sapiens
acccactcagctc

SEQ ID NO: 2979502 - DNA, 18 bp, Homo sapiens
acccactctgcggcccgg

SEQ ID NO: 2979503 - DNA, 23 bp, Homo sapiens
acccactctgcggcccgggccga

SEQ ID NO: 2979504 - DNA, 22 bp, Homo sapiens
acccagacctgttagcagacag

SEQ ID NO: 2979505 - DNA, 17 bp, Homo sapiens
acccagacggctccact

SEQ ID NO: 2979506 - DNA, 15 bp, Homo sapiens
acccagactcagaca

SEQ ID NO: 2979507 - DNA, 22 bp, Homo sapiens
acccagaggaaggggccagagg

SEQ ID NO: 2979508 - DNA, 19 bp, Homo sapiens
acccagcccattctctctc

SEQ ID NO: 2979509 - DNA, 23 bp, Homo sapiens
acccagcccattctctctcctgt

SEQ ID NO: 2979510 - DNA, 15 bp, Homo sapiens
acccagccctcatcc

SEQ ID NO: 2979511 - DNA, 15 bp, Homo sapiens
acccagcgtggcctc

SEQ ID NO: 2979512 - DNA, 22 bp, Homo sapiens
acccaggaagggagggagctga

SEQ ID NO: 2979513 - DNA, 15 bp, Homo sapiens
acccaggactcctcc

SEQ ID NO: 2979514 - DNA, 23 bp, Homo sapiens
acccaggacttatttaaactctg

SEQ ID NO: 2979515 - DNA, 20 bp, Homo sapiens
acccaggaggtggaggttgc

SEQ ID NO: 2979516 - DNA, 20 bp, Homo sapiens
acccaggagtttgtgtgtct

SEQ ID NO: 2979517 - DNA, 19 bp, Homo sapiens
acccaggctggagtgcagt

SEQ ID NO: 2979518 - DNA, 20 bp, Homo sapiens
acccaggctggagtgcagtg

SEQ ID NO: 2979519 - DNA, 14 bp, Homo sapiens
acccagggcctgca

SEQ ID NO: 2979520 - DNA, 15 bp, Homo sapiens
acccagggcctgcag

SEQ ID NO: 2979521 - DNA, 23 bp, Homo sapiens
acccagggtctagccgctgccct

SEQ ID NO: 2979522 - DNA, 22 bp, Homo sapiens
acccaggtcccccgactgcctg

SEQ ID NO: 2979523 - DNA, 18 bp, Homo sapiens
acccagtattactgctgc

SEQ ID NO: 2979524 - DNA, 17 bp, Homo sapiens
acccagtcctctgcctc

SEQ ID NO: 2979525 - DNA, 9 bp, Homo sapiens
acccagtgc

SEQ ID NO: 2979526 - DNA, 17 bp, Homo sapiens
acccagtgcagaatgta

SEQ ID NO: 2979527 - DNA, 15 bp, Homo sapiens
acccagtgcccccac

SEQ ID NO: 2979528 - DNA, 17 bp, Homo sapiens
acccagttgccatctgc

SEQ ID NO: 2979529 - DNA, 15 bp, Homo sapiens
acccataggcccaca

SEQ ID NO: 2979530 - DNA, 18 bp, Homo sapiens
acccataggcccacacac

SEQ ID NO: 2979531 - DNA, 20 bp, Homo sapiens
acccataggcccacacacag

SEQ ID NO: 2979532 - DNA, 15 bp, Homo sapiens
acccatcaacaaaaa

SEQ ID NO: 2979533 - DNA, 21 bp, Homo sapiens
acccatctgcacccccctggg

SEQ ID NO: 2979534 - DNA, 22 bp, Homo sapiens
acccatctgcacccccctgggc

SEQ ID NO: 2979535 - DNA, 17 bp, Homo sapiens
acccatcttgcttccaa

SEQ ID NO: 2979536 - DNA, 21 bp, Homo sapiens
acccatcttgcttccaagacc

SEQ ID NO: 2979537 - DNA, 18 bp, Homo sapiens
acccatgatgagctcctc

SEQ ID NO: 2979538 - DNA, 19 bp, Homo sapiens
acccatggtcatctctgtt

SEQ ID NO: 2979539 - DNA, 15 bp, Homo sapiens
accccaaagagaaag

SEQ ID NO: 2979540 - DNA, 21 bp, Homo sapiens
accccaagccagcccggccgc

SEQ ID NO: 2979541 - DNA, 20 bp, Homo sapiens
accccacaatttctttaaaa

SEQ ID NO: 2979542 - DNA, 23 bp, Homo sapiens
accccacaatttctttaaaaaag

SEQ ID NO: 2979543 - DNA, 13 bp, Homo sapiens
accccacccagct

SEQ ID NO: 2979544 - DNA, 16 bp, Homo sapiens
accccacccagctcca

SEQ ID NO: 2979545 - DNA, 14 bp, Homo sapiens
accccactacacag

SEQ ID NO: 2979546 - DNA, 13 bp, Homo sapiens
accccagagccac

SEQ ID NO: 2979547 - DNA, 18 bp, Homo sapiens
accccagagccacacatg

SEQ ID NO: 2979548 - DNA, 13 bp, Homo sapiens
accccagaggcag

SEQ ID NO: 2979549 - DNA, 23 bp, Homo sapiens
accccagaggcagaggttgcagt

SEQ ID NO: 2979550 - DNA, 24 bp, Homo sapiens
accccagattcttcagcttgatcc

SEQ ID NO: 2979551 - DNA, 17 bp, Homo sapiens
accccagcacagctcct

SEQ ID NO: 2979552 - DNA, 18 bp, Homo sapiens
accccagcacagctcctc

SEQ ID NO: 2979553 - DNA, 13 bp, Homo sapiens
accccagcggctg

SEQ ID NO: 2979554 - DNA, 18 bp, Homo sapiens
acccttggtagagtttat

SEQ ID NO: 2979555 - DNA, 19 bp, Homo sapiens
acccttggtagagtttatt

SEQ ID NO: 2979556 - DNA, 20 bp, Homo sapiens
accctttaagatatccatct

SEQ ID NO: 2979557 - DNA, 14 bp, Homo sapiens
accctttccttcct

SEQ ID NO: 2979558 - DNA, 17 bp, Homo sapiens
accctttccttccttcc

SEQ ID NO: 2979559 - DNA, 18 bp, Homo sapiens
accctttccttccttccc

SEQ ID NO: 2979560 - DNA, 19 bp, Homo sapiens
accctttcgctggctttcc

SEQ ID NO: 2979561 - DNA, 17 bp, Homo sapiens
accgacagcggccttga

SEQ ID NO: 2979562 - DNA, 15 bp, Homo sapiens
accgaccccgggccg

SEQ ID NO: 2979563 - DNA, 17 bp, Homo sapiens
accgacccgaggcccag

SEQ ID NO: 2979564 - DNA, 18 bp, Homo sapiens
accgagaaggtttatccc

SEQ ID NO: 2979565 - DNA, 13 bp, Homo sapiens
accgagcccagca

SEQ ID NO: 2979566 - DNA, 13 bp, Homo sapiens
accgaggcaggga

SEQ ID NO: 2979567 - DNA, 15 bp, Homo sapiens
accgatgctttacca

SEQ ID NO: 2979568 - DNA, 15 bp, Homo sapiens
accgatggtcccagg

SEQ ID NO: 2979569 - DNA, 18 bp, Homo sapiens
accgatggtcccaggaag

SEQ ID NO: 2979570 - DNA, 22 bp, Homo sapiens
accgatggtgggtggggctgca

SEQ ID NO: 2979571 - DNA, 23 bp, Homo sapiens
accgcagctactcccctttcttc

SEQ ID NO: 2979572 - DNA, 13 bp, Homo sapiens
accgcagctgctg

SEQ ID NO: 2979573 - DNA, 20 bp, Homo sapiens
accgcagctgctgccactct

SEQ ID NO: 2979574 - DNA, 21 bp, Homo sapiens
accgcagctgctgccactctg

SEQ ID NO: 2979575 - DNA, 16 bp, Homo sapiens
accgcaggaagctgct

SEQ ID NO: 2979576 - DNA, 17 bp, Homo sapiens
accgcatggcagctggg

SEQ ID NO: 2979577 - DNA, 18 bp, Homo sapiens
accgcatggcagctgggc

SEQ ID NO: 2979578 - DNA, 21 bp, Homo sapiens
accgcatggcagctgggccca

SEQ ID NO: 2979579 - DNA, 14 bp, Homo sapiens
accgcccagctctc

SEQ ID NO: 2979580 - DNA, 16 bp, Homo sapiens
accgcccagctctccc

SEQ ID NO: 2979581 - DNA, 17 bp, Homo sapiens
accgcccagctctccca

SEQ ID NO: 2979582 - DNA, 19 bp, Homo sapiens
accgcccagctctcccaca

SEQ ID NO: 2979583 - DNA, 16 bp, Homo sapiens
accgccctgcgggcca

SEQ ID NO: 2979584 - DNA, 19 bp, Homo sapiens
accgccggggtcctgggag

SEQ ID NO: 2979585 - DNA, 15 bp, Homo sapiens
accgcctcctgctct

SEQ ID NO: 2979586 - DNA, 17 bp, Homo sapiens
accgcctcgtgccagca

SEQ ID NO: 2979587 - DNA, 12 bp, Homo sapiens
accgcctgccct

SEQ ID NO: 2979588 - DNA, 23 bp, Homo sapiens
accgcctgccctcccgcaccttc

SEQ ID NO: 2979589 - DNA, 20 bp, Homo sapiens
accgcggacgtgctggcctt

SEQ ID NO: 2979590 - DNA, 12 bp, Homo sapiens
accgctccaggt

SEQ ID NO: 2979591 - DNA, 14 bp, Homo sapiens
accgctgcccaggt

SEQ ID NO: 2979592 - DNA, 16 bp, Homo sapiens
accgctgcccaggtgg

SEQ ID NO: 2979593 - DNA, 17 bp, Homo sapiens
accgcttctgccttttc

SEQ ID NO: 2979594 - DNA, 19 bp, Homo sapiens
accggacacacctctgctc

SEQ ID NO: 2979595 - DNA, 19 bp, Homo sapiens
accggacagtcggaaaagc

SEQ ID NO: 2979596 - DNA, 12 bp, Homo sapiens
accggcaggtgc

SEQ ID NO: 2979597 - DNA, 22 bp, Homo sapiens
accgggcatgtctgcctggagt

SEQ ID NO: 2979598 - DNA, 14 bp, Homo sapiens
accgggctgcaggt

SEQ ID NO: 2979599 - DNA, 23 bp, Homo sapiens
accgggctggctgcttgcagcca

SEQ ID NO: 2979600 - DNA, 14 bp, Homo sapiens
accggtggggctgg

SEQ ID NO: 2979601 - DNA, 15 bp, Homo sapiens
accggttcccacaag

SEQ ID NO: 2979602 - DNA, 18 bp, Homo sapiens
accggttcccacaagcct

SEQ ID NO: 2979603 - DNA, 17 bp, Homo sapiens
accgtagcgtatacatt

SEQ ID NO: 2979604 - DNA, 11 bp, Homo sapiens
accgtccctga

SEQ ID NO: 2979605 - DNA, 17 bp, Homo sapiens
accgtgccaaccccacc

SEQ ID NO: 2979606 - DNA, 13 bp, Homo sapiens
accgtgccattgt

SEQ ID NO: 2979607 - DNA, 13 bp, Homo sapiens
accgtggcctggg

SEQ ID NO: 2979608 - DNA, 16 bp, Homo sapiens
accgtgggctccctga

SEQ ID NO: 2979609 - DNA, 16 bp, Homo sapiens
accgtggggaaggggt

SEQ ID NO: 2979610 - DNA, 19 bp, Homo sapiens
accgtgtacatagccctgg

SEQ ID NO: 2979611 - DNA, 16 bp, Homo sapiens
accgtgtgtcatgtca

SEQ ID NO: 2979612 - DNA, 18 bp, Homo sapiens
accgttcaaattctcttc

SEQ ID NO: 2979613 - DNA, 19 bp, Homo sapiens
acctaaaaccagttttgct

SEQ ID NO: 2979614 - DNA, 14 bp, Homo sapiens
acctaaagcaataa

SEQ ID NO: 2979615 - DNA, 17 bp, Homo sapiens
acctaacccctttcctg

SEQ ID NO: 2979616 - DNA, 16 bp, Homo sapiens
acctaaccctctgtca

SEQ ID NO: 2979617 - DNA, 13 bp, Homo sapiens
acctaacctgtgt

SEQ ID NO: 2979618 - DNA, 17 bp, Homo sapiens
acctaacctgtgtctgc

SEQ ID NO: 2979619 - DNA, 21 bp, Homo sapiens
acctaagaatttcactgtctt

SEQ ID NO: 2979620 - DNA, 20 bp, Homo sapiens
acctaatccaggcagatcca

SEQ ID NO: 2979621 - DNA, 14 bp, Homo sapiens
acctacaataaact

SEQ ID NO: 2979622 - DNA, 16 bp, Homo sapiens
acctacaataaactgg

SEQ ID NO: 2979623 - DNA, 22 bp, Homo sapiens
acctacaccattatcttggaaa

SEQ ID NO: 2979624 - DNA, 15 bp, Homo sapiens
acctacccatacacc

SEQ ID NO: 2979625 - DNA, 17 bp, Homo sapiens
acctacctgttgagcat

SEQ ID NO: 2979626 - DNA, 20 bp, Homo sapiens
acctacgtttgcaccgcctg

SEQ ID NO: 2979627 - DNA, 17 bp, Homo sapiens
acctactggtgtaatct

SEQ ID NO: 2979628 - DNA, 22 bp, Homo sapiens
acctactggtgtaatctcaatg

SEQ ID NO: 2979629 - DNA, 16 bp, Homo sapiens
acctactgttctaaag

SEQ ID NO: 2979630 - DNA, 16 bp, Homo sapiens
acctacttagatattt

SEQ ID NO: 2979631 - DNA, 19 bp, Homo sapiens
acctacttagatatttcat

SEQ ID NO: 2979632 - DNA, 22 bp, Homo sapiens
acctagaaacctttatccctgc

SEQ ID NO: 2979633 - DNA, 23 bp, Homo sapiens
acctagcagcaccgttctgtgca

SEQ ID NO: 2979634 - DNA, 15 bp, Homo sapiens
acctaggggcgccgc

SEQ ID NO: 2979635 - DNA, 18 bp, Homo sapiens
acctagtttgttacttta

SEQ ID NO: 2979636 - DNA, 18 bp, Homo sapiens
acctataaaacaggtcaa

SEQ ID NO: 2979637 - DNA, 15 bp, Homo sapiens
acctatattccttgt

SEQ ID NO: 2979638 - DNA, 23 bp, Homo sapiens
acctatcaaagcttcaaaaactt

SEQ ID NO: 2979639 - DNA, 17 bp, Homo sapiens
acctatcccacctccat

SEQ ID NO: 2979640 - DNA, 14 bp, Homo sapiens
acctatgaagcaat

SEQ ID NO: 2979641 - DNA, 12 bp, Homo sapiens
acctatgtactt

SEQ ID NO: 2979642 - DNA, 23 bp, Homo sapiens
acctattatccttctacttgtcc

SEQ ID NO: 2979643 - DNA, 18 bp, Homo sapiens
acctatttcttaaacact

SEQ ID NO: 2979644 - DNA, 16 bp, Homo sapiens
acctcaaccaatgcca

SEQ ID NO: 2979645 - DNA, 15 bp, Homo sapiens
acctcaactaaccct

SEQ ID NO: 2979646 - DNA, 19 bp, Homo sapiens
acctcaagtgatctgccca

SEQ ID NO: 2979647 - DNA, 23 bp, Homo sapiens
acctcaagtgatctgcccacctc

SEQ ID NO: 2979648 - DNA, 16 bp, Homo sapiens
acctcacaactccttc

SEQ ID NO: 2979649 - DNA, 20 bp, Homo sapiens
acctcaccccgaggccctgc

SEQ ID NO: 2979650 - DNA, 13 bp, Homo sapiens
acctcaccctctc

SEQ ID NO: 2979651 - DNA, 14 bp, Homo sapiens
acctcacctagaaa

SEQ ID NO: 2979652 - DNA, 15 bp, Homo sapiens
acctcacctctttgt

SEQ ID NO: 2979653 - DNA, 15 bp, Homo sapiens
acctcacctggtcct

SEQ ID NO: 2979654 - DNA, 16 bp, Homo sapiens
acctcacctggtcctc

SEQ ID NO: 2979655 - DNA, 16 bp, Homo sapiens
acctcacgcacctccc

SEQ ID NO: 2979656 - DNA, 17 bp, Homo sapiens
acctcacgcacctccca

SEQ ID NO: 2979657 - DNA, 22 bp, Homo sapiens
acctcagccatgaggagttgct

SEQ ID NO: 2979658 - DNA, 11 bp, Homo sapiens
acctcagcctc

SEQ ID NO: 2979659 - DNA, 23 bp, Homo sapiens
acctcagcctgcacagtgtcccc

SEQ ID NO: 2979660 - DNA, 17 bp, Homo sapiens
acctcagcctggccaga

SEQ ID NO: 2979661 - DNA, 18 bp, Homo sapiens
acctcagttattacatgt

SEQ ID NO: 2979662 - DNA, 12 bp, Homo sapiens
acctccacagct

SEQ ID NO: 2979663 - DNA, 15 bp, Homo sapiens
acctccacagcttcc

SEQ ID NO: 2979664 - DNA, 19 bp, Homo sapiens
acctccactctctgcccct

SEQ ID NO: 2979665 - DNA, 14 bp, Homo sapiens
acctccagtcctgc

SEQ ID NO: 2979666 - DNA, 20 bp, Homo sapiens
acctccagtcctgctggcct

SEQ ID NO: 2979667 - DNA, 21 bp, Homo sapiens
acctccagtcctgctggcctg

SEQ ID NO: 2979668 - DNA, 13 bp, Homo sapiens
acctccccagcct

SEQ ID NO: 2979669 - DNA, 18 bp, Homo sapiens
acctccccccactgcagg

SEQ ID NO: 2979670 - DNA, 19 bp, Homo sapiens
acctcccctatccacccag

SEQ ID NO: 2979671 - DNA, 17 bp, Homo sapiens
acctccctatactgctt

SEQ ID NO: 2979672 - DNA, 13 bp, Homo sapiens
acctccctgcctc

SEQ ID NO: 2979673 - DNA, 21 bp, Homo sapiens
acctcctccctaatgctcacc

SEQ ID NO: 2979674 - DNA, 12 bp, Homo sapiens
acctcctctgtg

SEQ ID NO: 2979675 - DNA, 13 bp, Homo sapiens
acctcctctgtga

SEQ ID NO: 2979676 - DNA, 17 bp, Homo sapiens
acctcctgacaacgtct

SEQ ID NO: 2979677 - DNA, 21 bp, Homo sapiens
acctcctgacaacgtctcttc

SEQ ID NO: 2979678 - DNA, 13 bp, Homo sapiens
acctcctgcccag

SEQ ID NO: 2979679 - DNA, 14 bp, Homo sapiens
acctcctgcccagg

SEQ ID NO: 2979680 - DNA, 19 bp, Homo sapiens
acctccttatctgctaact

SEQ ID NO: 2979681 - DNA, 19 bp, Homo sapiens
acctcctttcatcacactg

SEQ ID NO: 2979682 - DNA, 15 bp, Homo sapiens
acctcgagtactgtg

SEQ ID NO: 2979683 - DNA, 19 bp, Homo sapiens
acctcgagtactgtgggca

SEQ ID NO: 2979684 - DNA, 18 bp, Homo sapiens
acctcgctggactctcag

SEQ ID NO: 2979685 - DNA, 14 bp, Homo sapiens
acctcgtcctcccc

SEQ ID NO: 2979686 - DNA, 18 bp, Homo sapiens
acctcgtcctccccctgc

SEQ ID NO: 2979687 - DNA, 18 bp, Homo sapiens
actaatccaatacctctt

SEQ ID NO: 2979688 - DNA, 21 bp, Homo sapiens
actaatgcttgccaagaaatc

SEQ ID NO: 2979689 - DNA, 22 bp, Homo sapiens
actaatggcatgagaaatacaa

SEQ ID NO: 2979690 - DNA, 12 bp, Homo sapiens
actaatgtgatg

SEQ ID NO: 2979691 - DNA, 22 bp, Homo sapiens
actaatgttagaattgatttcc

SEQ ID NO: 2979692 - DNA, 21 bp, Homo sapiens
actaattatactactttgtta

SEQ ID NO: 2979693 - DNA, 23 bp, Homo sapiens
actaattccacaccttttattga

SEQ ID NO: 2979694 - DNA, 15 bp, Homo sapiens
actaattgtataaca

SEQ ID NO: 2979695 - DNA, 19 bp, Homo sapiens
actaattgtataacaggtt

SEQ ID NO: 2979696 - DNA, 20 bp, Homo sapiens
actaattgtataacaggtta

SEQ ID NO: 2979697 - DNA, 14 bp, Homo sapiens
actaatttcaaaat

SEQ ID NO: 2979698 - DNA, 16 bp, Homo sapiens
actaatttcaaaatgc

SEQ ID NO: 2979699 - DNA, 12 bp, Homo sapiens
actaatttcttc

SEQ ID NO: 2979700 - DNA, 14 bp, Homo sapiens
actaatttggtttt

SEQ ID NO: 2979701 - DNA, 18 bp, Homo sapiens
actaatttttgtattatt

SEQ ID NO: 2979702 - DNA, 19 bp, Homo sapiens
actaatttttgtattattt

SEQ ID NO: 2979703 - DNA, 13 bp, Homo sapiens
actacaaatcaag

SEQ ID NO: 2979704 - DNA, 19 bp, Homo sapiens
actacaaatcaagtatttg

SEQ ID NO: 2979705 - DNA, 14 bp, Homo sapiens
actacaccacacac

SEQ ID NO: 2979706 - DNA, 15 bp, Homo sapiens
actacaccacacaca

SEQ ID NO: 2979707 - DNA, 17 bp, Homo sapiens
actacagctatgaagaa

SEQ ID NO: 2979708 - DNA, 18 bp, Homo sapiens
actacagctatgaagaaa

SEQ ID NO: 2979709 - DNA, 13 bp, Homo sapiens
actacattcattt

SEQ ID NO: 2979710 - DNA, 15 bp, Homo sapiens
actacattttgctct

SEQ ID NO: 2979711 - DNA, 18 bp, Homo sapiens
actaccagtgggcatgta

SEQ ID NO: 2979712 - DNA, 17 bp, Homo sapiens
actacctactggtgtaa

SEQ ID NO: 2979713 - DNA, 15 bp, Homo sapiens
actacctagaagtaa

SEQ ID NO: 2979714 - DNA, 16 bp, Homo sapiens
actacctatattcctt

SEQ ID NO: 2979715 - DNA, 18 bp, Homo sapiens
actacctatattccttgt

SEQ ID NO: 2979716 - DNA, 21 bp, Homo sapiens
actacctgccatgcatacatg

SEQ ID NO: 2979717 - DNA, 23 bp, Homo sapiens
actacctgtatttaaaaatagaa

SEQ ID NO: 2979718 - DNA, 17 bp, Homo sapiens
actacctgtgagcatgg

SEQ ID NO: 2979719 - DNA, 13 bp, Homo sapiens
actactactgtta

SEQ ID NO: 2979720 - DNA, 20 bp, Homo sapiens
actactatttttctttccaa

SEQ ID NO: 2979721 - DNA, 15 bp, Homo sapiens
actacttatctctaa

SEQ ID NO: 2979722 - DNA, 16 bp, Homo sapiens
actacttctctctgta

SEQ ID NO: 2979723 - DNA, 22 bp, Homo sapiens
actactttgttaggattttcac

SEQ ID NO: 2979724 - DNA, 16 bp, Homo sapiens
actagaaattgggcag

SEQ ID NO: 2979725 - DNA, 21 bp, Homo sapiens
actagacaagccagaacttga

SEQ ID NO: 2979726 - DNA, 20 bp, Homo sapiens
actagacaccaaagttctaa

SEQ ID NO: 2979727 - DNA, 21 bp, Homo sapiens
actagacaccttctgtgctca

SEQ ID NO: 2979728 - DNA, 22 bp, Homo sapiens
actagagggacctctcccaggg

SEQ ID NO: 2979729 - DNA, 23 bp, Homo sapiens
actagagtaaaggccatcaaact

SEQ ID NO: 2979730 - DNA, 13 bp, Homo sapiens
actagatgacctc

SEQ ID NO: 2979731 - DNA, 14 bp, Homo sapiens
actagatgacctca

SEQ ID NO: 2979732 - DNA, 13 bp, Homo sapiens
actagatgatgga

SEQ ID NO: 2979733 - DNA, 19 bp, Homo sapiens
actagcacctgccagggag

SEQ ID NO: 2979734 - DNA, 21 bp, Homo sapiens
actagcctaggtcataaagag

SEQ ID NO: 2979735 - DNA, 19 bp, Homo sapiens
actagggagccatgtttca

SEQ ID NO: 2979736 - DNA, 16 bp, Homo sapiens
actagggccaagccca

SEQ ID NO: 2979737 - DNA, 17 bp, Homo sapiens
actagggttttggcctg

SEQ ID NO: 2979738 - DNA, 13 bp, Homo sapiens
actaggttctgta

SEQ ID NO: 2979739 - DNA, 17 bp, Homo sapiens
actagtgagtcagcacc

SEQ ID NO: 2979740 - DNA, 20 bp, Homo sapiens
actagtgagtcagcaccttg

SEQ ID NO: 2979741 - DNA, 22 bp, Homo sapiens
actagtgagtcagcaccttggc

SEQ ID NO: 2979742 - DNA, 23 bp, Homo sapiens
actagtgtacatttctataaata

SEQ ID NO: 2979743 - DNA, 11 bp, Homo sapiens
actagtgtccg

SEQ ID NO: 2979744 - DNA, 21 bp, Homo sapiens
actagtgtccgcataagaaaa

SEQ ID NO: 2979745 - DNA, 22 bp, Homo sapiens
actataaactccaggcttgatt

SEQ ID NO: 2979746 - DNA, 13 bp, Homo sapiens
actataaagctgt

SEQ ID NO: 2979747 - DNA, 14 bp, Homo sapiens
actataaagctgtt

SEQ ID NO: 2979748 - DNA, 22 bp, Homo sapiens
actataaatacaaatctgtata

SEQ ID NO: 2979749 - DNA, 17 bp, Homo sapiens
actataacaaaaaaaga

SEQ ID NO: 2979750 - DNA, 23 bp, Homo sapiens
actatagaccaaaaggagagatt

SEQ ID NO: 2979751 - DNA, 15 bp, Homo sapiens
actatataagacatt

SEQ ID NO: 2979752 - DNA, 16 bp, Homo sapiens
actatataagacatta

SEQ ID NO: 2979753 - DNA, 22 bp, Homo sapiens
actatatttgggcctgctccag

SEQ ID NO: 2979754 - DNA, 22 bp, Homo sapiens
actatcacacactttctcttca

SEQ ID NO: 2979755 - DNA, 20 bp, Homo sapiens
actatcccaacagtcatgtt

SEQ ID NO: 2979756 - DNA, 12 bp, Homo sapiens
actatctgcttt

SEQ ID NO: 2979757 - DNA, 13 bp, Homo sapiens
actatctgctttt

SEQ ID NO: 2979758 - DNA, 12 bp, Homo sapiens
actatctgggtg

SEQ ID NO: 2979759 - DNA, 18 bp, Homo sapiens
actatcttctttggactt

SEQ ID NO: 2979760 - DNA, 22 bp, Homo sapiens
actatcttctttggacttctga

SEQ ID NO: 2979761 - DNA, 18 bp, Homo sapiens
actatctttcagctccag

SEQ ID NO: 2979762 - DNA, 23 bp, Homo sapiens
actatgcccctagtaactgctgt

SEQ ID NO: 2979763 - DNA, 19 bp, Homo sapiens
actatgccgtcttctgccc

SEQ ID NO: 2979764 - DNA, 18 bp, Homo sapiens
actatgcctgtgtcttct

SEQ ID NO: 2979765 - DNA, 19 bp, Homo sapiens
actatgcctgtgtcttctc

SEQ ID NO: 2979766 - DNA, 17 bp, Homo sapiens
actatggaatgtcagtg

SEQ ID NO: 2979767 - DNA, 17 bp, Homo sapiens
actatgtgtgttgtttc

SEQ ID NO: 2979768 - DNA, 19 bp, Homo sapiens
actatgtgtgttgtttcca

SEQ ID NO: 2979769 - DNA, 13 bp, Homo sapiens
actatgtttctca

SEQ ID NO: 2979770 - DNA, 20 bp, Homo sapiens
actattaaggatgtagcttt

SEQ ID NO: 2979771 - DNA, 22 bp, Homo sapiens
actattaggtgcaatttcaagg

SEQ ID NO: 2979772 - DNA, 20 bp, Homo sapiens
actattatgttgttagagaa

SEQ ID NO: 2979773 - DNA, 21 bp, Homo sapiens
actattccccagcagggtctt

SEQ ID NO: 2979774 - DNA, 17 bp, Homo sapiens
actattccttttctgta

SEQ ID NO: 2979775 - DNA, 19 bp, Homo sapiens
actattccttttctgtata

SEQ ID NO: 2979776 - DNA, 19 bp, Homo sapiens
actatttaaatccttggct

SEQ ID NO: 2979777 - DNA, 17 bp, Homo sapiens
actatttacaatgtgta

SEQ ID NO: 2979778 - DNA, 12 bp, Homo sapiens
actattttcaga

SEQ ID NO: 2979779 - DNA, 17 bp, Homo sapiens
actcaaaatctgtcata

SEQ ID NO: 2979780 - DNA, 19 bp, Homo sapiens
actcaaagtttcagagacc

SEQ ID NO: 2979781 - DNA, 21 bp, Homo sapiens
actcaaatggggccagatcca

SEQ ID NO: 2979782 - DNA, 23 bp, Homo sapiens
actcaaatggggccagatccagc

SEQ ID NO: 2979783 - DNA, 16 bp, Homo sapiens
actcaacaataaagac

SEQ ID NO: 2979784 - DNA, 23 bp, Homo sapiens
actcaacagagaggaccaacatc

SEQ ID NO: 2979785 - DNA, 15 bp, Homo sapiens
actcaacatgagtca

SEQ ID NO: 2979786 - DNA, 19 bp, Homo sapiens
actcaagcaggtttcttgc

SEQ ID NO: 2979787 - DNA, 14 bp, Homo sapiens
actcaagccaagca

SEQ ID NO: 2979788 - DNA, 17 bp, Homo sapiens
actcaagccaagcagcc

SEQ ID NO: 2979789 - DNA, 22 bp, Homo sapiens
actcaagccaagcagccaagct

SEQ ID NO: 2979790 - DNA, 18 bp, Homo sapiens
actcaaggcggtgcttga

SEQ ID NO: 2979791 - DNA, 20 bp, Homo sapiens
actcaagttgtttaactgtg

SEQ ID NO: 2979792 - DNA, 17 bp, Homo sapiens
actcaagtttttacaaa

SEQ ID NO: 2979793 - DNA, 17 bp, Homo sapiens
actcaatgaaatatgtg

SEQ ID NO: 2979794 - DNA, 13 bp, Homo sapiens
actcacatagcca

SEQ ID NO: 2979795 - DNA, 17 bp, Homo sapiens
actcaccatatttgaat

SEQ ID NO: 2979796 - DNA, 18 bp, Homo sapiens
actcaccatatttgaatt

SEQ ID NO: 2979797 - DNA, 17 bp, Homo sapiens
actcaccccaaacccag

SEQ ID NO: 2979798 - DNA, 21 bp, Homo sapiens
actcacccttcctggcccagg

SEQ ID NO: 2979799 - DNA, 23 bp, Homo sapiens
actcacccttcctggcccaggcc

SEQ ID NO: 2979800 - DNA, 17 bp, Homo sapiens
actcacctctgcctcaa

SEQ ID NO: 2979801 - DNA, 23 bp, Homo sapiens
actcacgataaataatcggccca

SEQ ID NO: 2979802 - DNA, 21 bp, Homo sapiens
actcactggcagccccagcac

SEQ ID NO: 2979803 - DNA, 14 bp, Homo sapiens
actcacttcatgtt

SEQ ID NO: 2979804 - DNA, 17 bp, Homo sapiens
actcacttgatgtttcc

SEQ ID NO: 2979805 - DNA, 21 bp, Homo sapiens
actcacttgatgtttcctgga

SEQ ID NO: 2979806 - DNA, 22 bp, Homo sapiens
actcacttgatgtttcctggaa

SEQ ID NO: 2979807 - DNA, 13 bp, Homo sapiens
actcacttttcac

SEQ ID NO: 2979808 - DNA, 14 bp, Homo sapiens
actcacttttcact

SEQ ID NO: 2979809 - DNA, 15 bp, Homo sapiens
actcacttttcactt

SEQ ID NO: 2979810 - DNA, 19 bp, Homo sapiens
actcacttttcacttgtct

SEQ ID NO: 2979811 - DNA, 14 bp, Homo sapiens
actcagaaacatca

SEQ ID NO: 2979812 - DNA, 22 bp, Homo sapiens
actcagaactgtcggaggaaag

SEQ ID NO: 2979813 - DNA, 23 bp, Homo sapiens
actcagaactgtcggaggaaaga

SEQ ID NO: 2979814 - DNA, 15 bp, Homo sapiens
actcagaagcctctg

SEQ ID NO: 2979815 - DNA, 17 bp, Homo sapiens
actcagaagggagctag

SEQ ID NO: 2979816 - DNA, 18 bp, Homo sapiens
actcagacattggcacct

SEQ ID NO: 2979817 - DNA, 20 bp, Homo sapiens
actcagacgtgtgacctcca

SEQ ID NO: 2979818 - DNA, 19 bp, Homo sapiens
actgattcacatctcattt

SEQ ID NO: 2979819 - DNA, 16 bp, Homo sapiens
actgatttggagatat

SEQ ID NO: 2979820 - DNA, 21 bp, Homo sapiens
actgattttacaaattaatat

SEQ ID NO: 2979821 - DNA, 13 bp, Homo sapiens
actgattttgaaa

SEQ ID NO: 2979822 - DNA, 23 bp, Homo sapiens
actgatttttattaactgctttt

SEQ ID NO: 2979823 - DNA, 14 bp, Homo sapiens
actgcaacttctgc

SEQ ID NO: 2979824 - DNA, 16 bp, Homo sapiens
actgcaacttctgcct

SEQ ID NO: 2979825 - DNA, 15 bp, Homo sapiens
actgcaagagccttg

SEQ ID NO: 2979826 - DNA, 15 bp, Homo sapiens
actgcactccagcct

SEQ ID NO: 2979827 - DNA, 16 bp, Homo sapiens
actgcactccagcctg

SEQ ID NO: 2979828 - DNA, 21 bp, Homo sapiens
actgcagcaatctttgaaaga

SEQ ID NO: 2979829 - DNA, 12 bp, Homo sapiens
actgcaggcccc

SEQ ID NO: 2979830 - DNA, 10 bp, Homo sapiens
actgcaggga

SEQ ID NO: 2979831 - DNA, 21 bp, Homo sapiens
actgcagtcatcaacaatgat

SEQ ID NO: 2979832 - DNA, 17 bp, Homo sapiens
actgcagtcctggagca

SEQ ID NO: 2979833 - DNA, 18 bp, Homo sapiens
actgccaaaatgctctag

SEQ ID NO: 2979834 - DNA, 21 bp, Homo sapiens
actgccacgtgccttaggaat

SEQ ID NO: 2979835 - DNA, 19 bp, Homo sapiens
actgccagatgctgatgtt

SEQ ID NO: 2979836 - DNA, 23 bp, Homo sapiens
actgccagatgctgatgttcagt

SEQ ID NO: 2979837 - DNA, 12 bp, Homo sapiens
actgccagcatt

SEQ ID NO: 2979838 - DNA, 17 bp, Homo sapiens
actgccaggattttgta

SEQ ID NO: 2979839 - DNA, 18 bp, Homo sapiens
actgccaggattttgtat

SEQ ID NO: 2979840 - DNA, 20 bp, Homo sapiens
actgccatgcaccaggactg

SEQ ID NO: 2979841 - DNA, 19 bp, Homo sapiens
actgcccatggacaggctg

SEQ ID NO: 2979842 - DNA, 21 bp, Homo sapiens
actgcccatggacaggctggc

SEQ ID NO: 2979843 - DNA, 15 bp, Homo sapiens
actgccccaactcct

SEQ ID NO: 2979844 - DNA, 13 bp, Homo sapiens
actgccccagcca

SEQ ID NO: 2979845 - DNA, 20 bp, Homo sapiens
actgccgtcagtgctgtgct

SEQ ID NO: 2979846 - DNA, 18 bp, Homo sapiens
actgcctccctctcttcc

SEQ ID NO: 2979847 - DNA, 22 bp, Homo sapiens
actgcctcctccctggctgcag

SEQ ID NO: 2979848 - DNA, 19 bp, Homo sapiens
actgcctccttgccagccc

SEQ ID NO: 2979849 - DNA, 17 bp, Homo sapiens
actgcctgaataaagag

SEQ ID NO: 2979850 - DNA, 12 bp, Homo sapiens
actgcctgggct

SEQ ID NO: 2979851 - DNA, 16 bp, Homo sapiens
actgctaaataaaatt

SEQ ID NO: 2979852 - DNA, 19 bp, Homo sapiens
actgctaaataaaatttgt

SEQ ID NO: 2979853 - DNA, 20 bp, Homo sapiens
actgctaaataaaatttgtt

SEQ ID NO: 2979854 - DNA, 16 bp, Homo sapiens
actgctaagaatattt

SEQ ID NO: 2979855 - DNA, 21 bp, Homo sapiens
actgctacatgtgctggaagg

SEQ ID NO: 2979856 - DNA, 20 bp, Homo sapiens
actgctacctttcaaagctt

SEQ ID NO: 2979857 - DNA, 20 bp, Homo sapiens
actgctatctactaagtttc

SEQ ID NO: 2979858 - DNA, 16 bp, Homo sapiens
actgctcagctctggt

SEQ ID NO: 2979859 - DNA, 17 bp, Homo sapiens
actgctgaagccagttg

SEQ ID NO: 2979860 - DNA, 15 bp, Homo sapiens
actgctgacccacca

SEQ ID NO: 2979861 - DNA, 19 bp, Homo sapiens
actgctgagatacatacag

SEQ ID NO: 2979862 - DNA, 20 bp, Homo sapiens
actgctgagatacatacaga

SEQ ID NO: 2979863 - DNA, 18 bp, Homo sapiens
actgctgatcaatgaaat

SEQ ID NO: 2979864 - DNA, 20 bp, Homo sapiens
actgctgatcaatgaaatgc

SEQ ID NO: 2979865 - DNA, 10 bp, Homo sapiens
actgctgctc

SEQ ID NO: 2979866 - DNA, 16 bp, Homo sapiens
actgctgctccccacc

SEQ ID NO: 2979867 - DNA, 14 bp, Homo sapiens
actgctgctcctct

SEQ ID NO: 2979868 - DNA, 18 bp, Homo sapiens
actgctgctcctctttcc

SEQ ID NO: 2979869 - DNA, 19 bp, Homo sapiens
actgctgctcctctttccc

SEQ ID NO: 2979870 - DNA, 15 bp, Homo sapiens
actgctgctgtgctt

SEQ ID NO: 2979871 - DNA, 23 bp, Homo sapiens
actgctgcttcaccagacttttc

SEQ ID NO: 2979872 - DNA, 11 bp, Homo sapiens
actgctggctc

SEQ ID NO: 2979873 - DNA, 12 bp, Homo sapiens
actgctgtctct

SEQ ID NO: 2979874 - DNA, 13 bp, Homo sapiens
actgcttaattca

SEQ ID NO: 2979875 - DNA, 16 bp, Homo sapiens
actgcttaattcaaat

SEQ ID NO: 2979876 - DNA, 17 bp, Homo sapiens
actgcttctcggccagc

SEQ ID NO: 2979877 - DNA, 19 bp, Homo sapiens
actgcttctcggccagccc

SEQ ID NO: 2979878 - DNA, 13 bp, Homo sapiens
actgcttgagcat

SEQ ID NO: 2979879 - DNA, 14 bp, Homo sapiens
actgcttgaggaaa

SEQ ID NO: 2979880 - DNA, 14 bp, Homo sapiens
actgcttgcccagg

SEQ ID NO: 2979881 - DNA, 12 bp, Homo sapiens
actgcttgctta

SEQ ID NO: 2979882 - DNA, 18 bp, Homo sapiens
actgcttggagctgagca

SEQ ID NO: 2979883 - DNA, 17 bp, Homo sapiens
actgcttttggcctgga

SEQ ID NO: 2979884 - DNA, 17 bp, Homo sapiens
actggaaaaatgaactg

SEQ ID NO: 2979885 - DNA, 13 bp, Homo sapiens
actggaaaggaaa

SEQ ID NO: 2979886 - DNA, 16 bp, Homo sapiens
actggaacactagaca

SEQ ID NO: 2979887 - DNA, 18 bp, Homo sapiens
actggaacttgaactgat

SEQ ID NO: 2979888 - DNA, 20 bp, Homo sapiens
actggaagcatgtaggagaa

SEQ ID NO: 2979889 - DNA, 20 bp, Homo sapiens
actggaagctaatttgcatt

SEQ ID NO: 2979890 - DNA, 12 bp, Homo sapiens
actggaaggagc

SEQ ID NO: 2979891 - DNA, 14 bp, Homo sapiens
actggaaggagcac

SEQ ID NO: 2979892 - DNA, 12 bp, Homo sapiens
actggacagctt

SEQ ID NO: 2979893 - DNA, 14 bp, Homo sapiens
actggacagcttgt

SEQ ID NO: 2979894 - DNA, 15 bp, Homo sapiens
actggacagcttgtg

SEQ ID NO: 2979895 - DNA, 15 bp, Homo sapiens
actggaccagacaat

SEQ ID NO: 2979896 - DNA, 14 bp, Homo sapiens
actggactccggcc

SEQ ID NO: 2979897 - DNA, 19 bp, Homo sapiens
actggagcaccaggcacga

SEQ ID NO: 2979898 - DNA, 20 bp, Homo sapiens
actggagccacaggcagggg

SEQ ID NO: 2979899 - DNA, 17 bp, Homo sapiens
actggaggagagaagaa

SEQ ID NO: 2979900 - DNA, 17 bp, Homo sapiens
actggaggtcgaagcaa

SEQ ID NO: 2979901 - DNA, 22 bp, Homo sapiens
actggaggtcgaagcaatcagc

SEQ ID NO: 2979902 - DNA, 18 bp, Homo sapiens
actggatttgcagaagtt

SEQ ID NO: 2979903 - DNA, 12 bp, Homo sapiens
actggcaaaagg

SEQ ID NO: 2979904 - DNA, 22 bp, Homo sapiens
actggcaaaaggatctttgtgg

SEQ ID NO: 2979905 - DNA, 18 bp, Homo sapiens
actggcaacattccaaga

SEQ ID NO: 2979906 - DNA, 14 bp, Homo sapiens
actggcagccccag

SEQ ID NO: 2979907 - DNA, 13 bp, Homo sapiens
actggcagcctgc

SEQ ID NO: 2979908 - DNA, 14 bp, Homo sapiens
actggcagcctgca

SEQ ID NO: 2979909 - DNA, 21 bp, Homo sapiens
actggcaggcaggctcccagg

SEQ ID NO: 2979910 - DNA, 16 bp, Homo sapiens
actggcagttttccat

SEQ ID NO: 2979911 - DNA, 17 bp, Homo sapiens
actggcatagtttcata

SEQ ID NO: 2979912 - DNA, 14 bp, Homo sapiens
actggcattttata

SEQ ID NO: 2979913 - DNA, 11 bp, Homo sapiens
actggccaggg

SEQ ID NO: 2979914 - DNA, 17 bp, Homo sapiens
actggccccacaggagt

SEQ ID NO: 2979915 - DNA, 18 bp, Homo sapiens
actggccgtggctccaga

SEQ ID NO: 2979916 - DNA, 14 bp, Homo sapiens
actggcgccttctc

SEQ ID NO: 2979917 - DNA, 15 bp, Homo sapiens
actggcgtggattaa

SEQ ID NO: 2979918 - DNA, 19 bp, Homo sapiens
actggctcctctgtggtgt

SEQ ID NO: 2979919 - DNA, 21 bp, Homo sapiens
actggctgtcagtatgacatt

SEQ ID NO: 2979920 - DNA, 16 bp, Homo sapiens
actggctgtgtgacct

SEQ ID NO: 2979921 - DNA, 15 bp, Homo sapiens
actggctttggcttc

SEQ ID NO: 2979922 - DNA, 18 bp, Homo sapiens
actggctttggcttcttg

SEQ ID NO: 2979923 - DNA, 20 bp, Homo sapiens
actggcttttattaatgcac

SEQ ID NO: 2979924 - DNA, 13 bp, Homo sapiens
actgggaagctgg

SEQ ID NO: 2979925 - DNA, 15 bp, Homo sapiens
actgggaagctggag

SEQ ID NO: 2979926 - DNA, 16 bp, Homo sapiens
actgggaagctggagt

SEQ ID NO: 2979927 - DNA, 22 bp, Homo sapiens
actgggaagctggagtgctgct

SEQ ID NO: 2979928 - DNA, 23 bp, Homo sapiens
actgggagcctacccacccccag

SEQ ID NO: 2979929 - DNA, 14 bp, Homo sapiens
actgggccatgggt

SEQ ID NO: 2979930 - DNA, 23 bp, Homo sapiens
actgggccatgggtcctcggccc

SEQ ID NO: 2979931 - DNA, 15 bp, Homo sapiens
actgggcccaggcag

SEQ ID NO: 2979932 - DNA, 16 bp, Homo sapiens
actgggcccaggcagg

SEQ ID NO: 2979933 - DNA, 17 bp, Homo sapiens
actgggcccaggcaggt

SEQ ID NO: 2979934 - DNA, 12 bp, Homo sapiens
actgggcccctc

SEQ ID NO: 2979935 - DNA, 13 bp, Homo sapiens
actgggcccctca

SEQ ID NO: 2979936 - DNA, 15 bp, Homo sapiens
actgggcccctcagg

SEQ ID NO: 2979937 - DNA, 22 bp, Homo sapiens
actgggcccctcaggggaagct

SEQ ID NO: 2979938 - DNA, 14 bp, Homo sapiens
actgggccctgagt

SEQ ID NO: 2979939 - DNA, 14 bp, Homo sapiens
actgggctgaggga

SEQ ID NO: 2979940 - DNA, 17 bp, Homo sapiens
actgggctgagggagcc

SEQ ID NO: 2979941 - DNA, 16 bp, Homo sapiens
actgggctgggtttgc

SEQ ID NO: 2979942 - DNA, 18 bp, Homo sapiens
actggggaggctgaggca

SEQ ID NO: 2979943 - DNA, 12 bp, Homo sapiens
actggggcctcc

SEQ ID NO: 2979944 - DNA, 21 bp, Homo sapiens
actggggtaagcggaataaac

SEQ ID NO: 2979945 - DNA, 13 bp, Homo sapiens
actggtaacatgt

SEQ ID NO: 2979946 - DNA, 16 bp, Homo sapiens
actggtaggaggaggc

SEQ ID NO: 2979947 - DNA, 18 bp, Homo sapiens
actggtaggaggaggcat

SEQ ID NO: 2979948 - DNA, 20 bp, Homo sapiens
actggtaggaggaggcatgg

SEQ ID NO: 2979949 - DNA, 21 bp, Homo sapiens
actggtaggaggaggcatgga

SEQ ID NO: 2979950 - DNA, 14 bp, Homo sapiens
actggtctcacagt

SEQ ID NO: 2979951 - DNA, 23 bp, Homo sapiens
actggtctcgaactcctggcctc

SEQ ID NO: 2979952 - DNA, 13 bp, Homo sapiens
agaaaccctgtct

SEQ ID NO: 2979953 - DNA, 15 bp, Homo sapiens
agaaacctactgccc

SEQ ID NO: 2979954 - DNA, 16 bp, Homo sapiens
agaaacctgggagaga

SEQ ID NO: 2979955 - DNA, 15 bp, Homo sapiens
agaaacctgtatctt

SEQ ID NO: 2979956 - DNA, 16 bp, Homo sapiens
agaaacctgtatcttt

SEQ ID NO: 2979957 - DNA, 19 bp, Homo sapiens
agaaaccttgtttgtttta

SEQ ID NO: 2979958 - DNA, 15 bp, Homo sapiens
agaaacgtcttctaa

SEQ ID NO: 2979959 - DNA, 16 bp, Homo sapiens
agaaacgtcttctaaa

SEQ ID NO: 2979960 - DNA, 21 bp, Homo sapiens
agaaacgtcttctaaacttcc

SEQ ID NO: 2979961 - DNA, 17 bp, Homo sapiens
agaaactaattgacttt

SEQ ID NO: 2979962 - DNA, 13 bp, Homo sapiens
agaaactgatgcc

SEQ ID NO: 2979963 - DNA, 19 bp, Homo sapiens
agaaacttccaaatcccct

SEQ ID NO: 2979964 - DNA, 18 bp, Homo sapiens
agaaactttggaagcact

SEQ ID NO: 2979965 - DNA, 19 bp, Homo sapiens
agaaactttggaagcactt

SEQ ID NO: 2979966 - DNA, 22 bp, Homo sapiens
agaaacttttatctattctgag

SEQ ID NO: 2979967 - DNA, 23 bp, Homo sapiens
agaaacttttatctattctgaga

SEQ ID NO: 2979968 - DNA, 23 bp, Homo sapiens
agaaagaaaaatgcattattgac

SEQ ID NO: 2979969 - DNA, 20 bp, Homo sapiens
agaaagaaacccgacagagg

SEQ ID NO: 2979970 - DNA, 18 bp, Homo sapiens
agaaagaagatagtgaga

SEQ ID NO: 2979971 - DNA, 11 bp, Homo sapiens
agaaagagaga

SEQ ID NO: 2979972 - DNA, 13 bp, Homo sapiens
agaaagagagaaa

SEQ ID NO: 2979973 - DNA, 18 bp, Homo sapiens
agaaagagagaaaataaa

SEQ ID NO: 2979974 - DNA, 22 bp, Homo sapiens
agaaagcaatacgtttgtgcag

SEQ ID NO: 2979975 - DNA, 16 bp, Homo sapiens
agaaagcacaaagaat

SEQ ID NO: 2979976 - DNA, 15 bp, Homo sapiens
agaaagcccacctgg

SEQ ID NO: 2979977 - DNA, 20 bp, Homo sapiens
agaaagcccacctgggctgg

SEQ ID NO: 2979978 - DNA, 18 bp, Homo sapiens
agaaaggacagagccagc

SEQ ID NO: 2979979 - DNA, 15 bp, Homo sapiens
agaaaggactctggg

SEQ ID NO: 2979980 - DNA, 19 bp, Homo sapiens
agaaaggagaaattttggt

SEQ ID NO: 2979981 - DNA, 17 bp, Homo sapiens
agaaagggaggcccagc

SEQ ID NO: 2979982 - DNA, 23 bp, Homo sapiens
agaaagggaggcccagccgcagg

SEQ ID NO: 2979983 - DNA, 12 bp, Homo sapiens
agaaagggcaga

SEQ ID NO: 2979984 - DNA, 15 bp, Homo sapiens
agaaagggcagagga

SEQ ID NO: 2979985 - DNA, 18 bp, Homo sapiens
agaaagggcagaggaaga

SEQ ID NO: 2979986 - DNA, 22 bp, Homo sapiens
agaaagggcagaggaagagaca

SEQ ID NO: 2979987 - DNA, 14 bp, Homo sapiens
agaaaggggagccc

SEQ ID NO: 2979988 - DNA, 20 bp, Homo sapiens
agaaaggtggactggaaggg

SEQ ID NO: 2979989 - DNA, 16 bp, Homo sapiens
agaaaggttagtatca

SEQ ID NO: 2979990 - DNA, 23 bp, Homo sapiens
agaaagtggaaaacaaggaagtc

SEQ ID NO: 2979991 - DNA, 17 bp, Homo sapiens
agaaagtggtgctcagt

SEQ ID NO: 2979992 - DNA, 23 bp, Homo sapiens
agaaagtgtgagcaaactaactt

SEQ ID NO: 2979993 - DNA, 12 bp, Homo sapiens
agaaagtgttca

SEQ ID NO: 2979994 - DNA, 18 bp, Homo sapiens
agaaataaaaggaagcca

SEQ ID NO: 2979995 - DNA, 19 bp, Homo sapiens
agaaataaaaggaagccaa

SEQ ID NO: 2979996 - DNA, 23 bp, Homo sapiens
agaaatactagagtaaaggccat

SEQ ID NO: 2979997 - DNA, 20 bp, Homo sapiens
agaaatagcctgcgctgttt

SEQ ID NO: 2979998 - DNA, 11 bp, Homo sapiens
agaaatattaa

SEQ ID NO: 2979999 - DNA, 20 bp, Homo sapiens
agaaatcgccttatgagaac

SEQ ID NO: 2980000 - DNA, 19 bp, Homo sapiens
agaaatctagaatttttac

SEQ ID NO: 2980001 - DNA, 22 bp, Homo sapiens
agaaatctatagaactgaatga

SEQ ID NO: 2980002 - DNA, 16 bp, Homo sapiens
agaaatctgtcctgtg

SEQ ID NO: 2980003 - DNA, 22 bp, Homo sapiens
agaaatgcatccattcctcagg

SEQ ID NO: 2980004 - DNA, 14 bp, Homo sapiens
agaaatgccaagca

SEQ ID NO: 2980005 - DNA, 21 bp, Homo sapiens
agaaatgccaagcacttcttt

SEQ ID NO: 2980006 - DNA, 15 bp, Homo sapiens
agaaatggaatgaat

SEQ ID NO: 2980007 - DNA, 16 bp, Homo sapiens
agaaatggacaaagaa

SEQ ID NO: 2980008 - DNA, 20 bp, Homo sapiens
agaaatggacaaagaaaacg

SEQ ID NO: 2980009 - DNA, 18 bp, Homo sapiens
agaaatgtagcagcagcc

SEQ ID NO: 2980010 - DNA, 23 bp, Homo sapiens
agaaatgtagcagcagcctactg

SEQ ID NO: 2980011 - DNA, 16 bp, Homo sapiens
agaaatgtataaactt

SEQ ID NO: 2980012 - DNA, 12 bp, Homo sapiens
agaaatgtattt

SEQ ID NO: 2980013 - DNA, 19 bp, Homo sapiens
agaaattatctttagttga

SEQ ID NO: 2980014 - DNA, 20 bp, Homo sapiens
agaaattcgcatgtttaatg

SEQ ID NO: 2980015 - DNA, 21 bp, Homo sapiens
agaaattcgcatgtttaatgt

SEQ ID NO: 2980016 - DNA, 14 bp, Homo sapiens
agaaattctcttta

SEQ ID NO: 2980017 - DNA, 19 bp, Homo sapiens
agaaatttcaggttgttgg

SEQ ID NO: 2980018 - DNA, 19 bp, Homo sapiens
agaaatttgtctttttgta

SEQ ID NO: 2980019 - DNA, 11 bp, Homo sapiens
agaaattttca

SEQ ID NO: 2980020 - DNA, 13 bp, Homo sapiens
agaaattttcaag

SEQ ID NO: 2980021 - DNA, 15 bp, Homo sapiens
agaacaaagagtgaa

SEQ ID NO: 2980022 - DNA, 19 bp, Homo sapiens
agaacaaagagtgaaatat

SEQ ID NO: 2980023 - DNA, 23 bp, Homo sapiens
agaacaaagagtgaaatattgta

SEQ ID NO: 2980024 - DNA, 22 bp, Homo sapiens
agaacaagcccaaatttaattt

SEQ ID NO: 2980025 - DNA, 20 bp, Homo sapiens
agaacaatattgactttgtc

SEQ ID NO: 2980026 - DNA, 15 bp, Homo sapiens
agaacaattttcttg

SEQ ID NO: 2980027 - DNA, 20 bp, Homo sapiens
agaacacagcaattcctcag

SEQ ID NO: 2980028 - DNA, 21 bp, Homo sapiens
agaacacagccgattcacctg

SEQ ID NO: 2980029 - DNA, 18 bp, Homo sapiens
agaacagctgttcctgtg

SEQ ID NO: 2980030 - DNA, 19 bp, Homo sapiens
agaacaggcagaaatataa

SEQ ID NO: 2980031 - DNA, 20 bp, Homo sapiens
agaacaggcagaaatataaa

SEQ ID NO: 2980032 - DNA, 22 bp, Homo sapiens
agaacagggcgggggggggggc

SEQ ID NO: 2980033 - DNA, 15 bp, Homo sapiens
agaacatcattagaa

SEQ ID NO: 2980034 - DNA, 20 bp, Homo sapiens
agaacatgcagtttgaaatt

SEQ ID NO: 2980035 - DNA, 21 bp, Homo sapiens
agaacatgcagtttgaaattc

SEQ ID NO: 2980036 - DNA, 21 bp, Homo sapiens
agaacatggtgtgtgtctctg

SEQ ID NO: 2980037 - DNA, 14 bp, Homo sapiens
agaaccaacaaaac

SEQ ID NO: 2980038 - DNA, 19 bp, Homo sapiens
agaaccagcagaagccaga

SEQ ID NO: 2980039 - DNA, 14 bp, Homo sapiens
agaaccagccatat

SEQ ID NO: 2980040 - DNA, 20 bp, Homo sapiens
agaaccagccatatacactt

SEQ ID NO: 2980041 - DNA, 15 bp, Homo sapiens
agaaccgcattttga

SEQ ID NO: 2980042 - DNA, 15 bp, Homo sapiens
agaacctaactgtat

SEQ ID NO: 2980043 - DNA, 18 bp, Homo sapiens
agaacctaactgtatctt

SEQ ID NO: 2980044 - DNA, 20 bp, Homo sapiens
agaacgaacacaagaaaaag

SEQ ID NO: 2980045 - DNA, 19 bp, Homo sapiens
agaacgagcctggaagcac

SEQ ID NO: 2980046 - DNA, 20 bp, Homo sapiens
agaacgagcctggaagcact

SEQ ID NO: 2980047 - DNA, 23 bp, Homo sapiens
agaacgggcgtcaggggtgcaca

SEQ ID NO: 2980048 - DNA, 20 bp, Homo sapiens
agaacggtgaccgcctcctg

SEQ ID NO: 2980049 - DNA, 17 bp, Homo sapiens
agaacgtaaagaacttt

SEQ ID NO: 2980050 - DNA, 18 bp, Homo sapiens
agaacgtggctctgctgg

SEQ ID NO: 2980051 - DNA, 18 bp, Homo sapiens
agaactagccttatttct

SEQ ID NO: 2980052 - DNA, 19 bp, Homo sapiens
agaactcatcactgtggct

SEQ ID NO: 2980053 - DNA, 14 bp, Homo sapiens
agaactctttcaaa

SEQ ID NO: 2980054 - DNA, 14 bp, Homo sapiens
agaactgaaataaa

SEQ ID NO: 2980055 - DNA, 22 bp, Homo sapiens
agaactgaaggggagttttcac

SEQ ID NO: 2980056 - DNA, 14 bp, Homo sapiens
agaactgagcatct

SEQ ID NO: 2980057 - DNA, 15 bp, Homo sapiens
agaactgagcatctc

SEQ ID NO: 2980058 - DNA, 20 bp, Homo sapiens
agaactgagcatctccagca

SEQ ID NO: 2980059 - DNA, 23 bp, Homo sapiens
agaactgattttacaaattaata

SEQ ID NO: 2980060 - DNA, 17 bp, Homo sapiens
agaactgcacatgaaga

SEQ ID NO: 2980061 - DNA, 15 bp, Homo sapiens
agaactgcatatgtt

SEQ ID NO: 2980062 - DNA, 21 bp, Homo sapiens
agaactgcatatgtttcgctg

SEQ ID NO: 2980063 - DNA, 18 bp, Homo sapiens
agaactgctggggctggt

SEQ ID NO: 2980064 - DNA, 22 bp, Homo sapiens
agaactgtcatgtaaacatacc

SEQ ID NO: 2980065 - DNA, 21 bp, Homo sapiens
agaactgtcggaggaaagaca

SEQ ID NO: 2980066 - DNA, 20 bp, Homo sapiens
agaacttctccgtcctcgat

SEQ ID NO: 2980067 - DNA, 20 bp, Homo sapiens
agaactttttcttttccctc

SEQ ID NO: 2980068 - DNA, 23 bp, Homo sapiens
agaagaaaacatctattctctcc

SEQ ID NO: 2980069 - DNA, 19 bp, Homo sapiens
agaagaaaatggaaccagg

SEQ ID NO: 2980070 - DNA, 13 bp, Homo sapiens
agaagaagaattt

SEQ ID NO: 2980071 - DNA, 23 bp, Homo sapiens
agaagaagtgcttgggggttttt

SEQ ID NO: 2980072 - DNA, 17 bp, Homo sapiens
agaagaatctttcttct

SEQ ID NO: 2980073 - DNA, 19 bp, Homo sapiens
agaagaatgtgtttcaaac

SEQ ID NO: 2980074 - DNA, 20 bp, Homo sapiens
agaagaatgtgtttcaaact

SEQ ID NO: 2980075 - DNA, 23 bp, Homo sapiens
agaagaattttcagaccccagcg

SEQ ID NO: 2980076 - DNA, 19 bp, Homo sapiens
agaagacatgttttagaca

SEQ ID NO: 2980077 - DNA, 16 bp, Homo sapiens
agaagactatttacca

SEQ ID NO: 2980078 - DNA, 15 bp, Homo sapiens
agaagactcctaggc

SEQ ID NO: 2980079 - DNA, 11 bp, Homo sapiens
agaagagccat

SEQ ID NO: 2980080 - DNA, 21 bp, Homo sapiens
agaagagccatcttggcaggg

SEQ ID NO: 2980081 - DNA, 22 bp, Homo sapiens
agaagagccatcttggcagggt

SEQ ID NO: 2980082 - DNA, 16 bp, Homo sapiens
agaagaggagcctcag

SEQ ID NO: 2980083 - DNA, 23 bp, Homo sapiens
agacctgctctccggcgcagaca

SEQ ID NO: 2980084 - DNA, 16 bp, Homo sapiens
agacctggacacaggc

SEQ ID NO: 2980085 - DNA, 19 bp, Homo sapiens
agacctggacacaggcctg

SEQ ID NO: 2980086 - DNA, 14 bp, Homo sapiens
agacctggcagctc

SEQ ID NO: 2980087 - DNA, 21 bp, Homo sapiens
agacctgtcgtctctcccacc

SEQ ID NO: 2980088 - DNA, 13 bp, Homo sapiens
agaccttccataa

SEQ ID NO: 2980089 - DNA, 14 bp, Homo sapiens
agaccttgtggtct

SEQ ID NO: 2980090 - DNA, 14 bp, Homo sapiens
agacctttgcccac

SEQ ID NO: 2980091 - DNA, 17 bp, Homo sapiens
agacctttgcccacaca

SEQ ID NO: 2980092 - DNA, 20 bp, Homo sapiens
agacgatagttatctgttct

SEQ ID NO: 2980093 - DNA, 13 bp, Homo sapiens
agacgatgtttat

SEQ ID NO: 2980094 - DNA, 16 bp, Homo sapiens
agacgcaccttgctgc

SEQ ID NO: 2980095 - DNA, 14 bp, Homo sapiens
agacgggccctggt

SEQ ID NO: 2980096 - DNA, 20 bp, Homo sapiens
agacgtctggccctggcggg

SEQ ID NO: 2980097 - DNA, 18 bp, Homo sapiens
agactaatgctttctgtg

SEQ ID NO: 2980098 - DNA, 19 bp, Homo sapiens
agactagacaccttctgtg

SEQ ID NO: 2980099 - DNA, 15 bp, Homo sapiens
agactagtatcaagt

SEQ ID NO: 2980100 - DNA, 20 bp, Homo sapiens
agactagtcccttggataag

SEQ ID NO: 2980101 - DNA, 18 bp, Homo sapiens
agactatggaatgtcagt

SEQ ID NO: 2980102 - DNA, 20 bp, Homo sapiens
agactcaaatgttctaagtt

SEQ ID NO: 2980103 - DNA, 23 bp, Homo sapiens
agactcaaatgttctaagtttct

SEQ ID NO: 2980104 - DNA, 16 bp, Homo sapiens
agactcacctctgcct

SEQ ID NO: 2980105 - DNA, 13 bp, Homo sapiens
agactcagcctgc

SEQ ID NO: 2980106 - DNA, 18 bp, Homo sapiens
agactcagctctgacatt

SEQ ID NO: 2980107 - DNA, 20 bp, Homo sapiens
agactcagctctgacattct

SEQ ID NO: 2980108 - DNA, 19 bp, Homo sapiens
agactcaggccaagaaacg

SEQ ID NO: 2980109 - DNA, 16 bp, Homo sapiens
agactcagtgcagatg

SEQ ID NO: 2980110 - DNA, 19 bp, Homo sapiens
agactcatcctgaacagca

SEQ ID NO: 2980111 - DNA, 13 bp, Homo sapiens
agactccatctct

SEQ ID NO: 2980112 - DNA, 22 bp, Homo sapiens
agactccatctctatataaaaa

SEQ ID NO: 2980113 - DNA, 23 bp, Homo sapiens
agactccatctctttaaaaacaa

SEQ ID NO: 2980114 - DNA, 23 bp, Homo sapiens
agactcccattcctgaagaacca

SEQ ID NO: 2980115 - DNA, 24 bp, Homo sapiens
agactcccgccccgggctggccct

SEQ ID NO: 2980116 - DNA, 20 bp, Homo sapiens
agactcctgaggacagctgt

SEQ ID NO: 2980117 - DNA, 22 bp, Homo sapiens
agactcctgaggacagctgtcc

SEQ ID NO: 2980118 - DNA, 16 bp, Homo sapiens
agactctagagtccaa

SEQ ID NO: 2980119 - DNA, 19 bp, Homo sapiens
agactctagagtccaaggt

SEQ ID NO: 2980120 - DNA, 20 bp, Homo sapiens
agactctagagtccaaggtt

SEQ ID NO: 2980121 - DNA, 23 bp, Homo sapiens
agactctcgcatcttcccaaccc

SEQ ID NO: 2980122 - DNA, 20 bp, Homo sapiens
agactcttccaccagagcag

SEQ ID NO: 2980123 - DNA, 15 bp, Homo sapiens
agactgaagatttat

SEQ ID NO: 2980124 - DNA, 20 bp, Homo sapiens
agactgagctctccaggcca

SEQ ID NO: 2980125 - DNA, 15 bp, Homo sapiens
agactgaggggtcga

SEQ ID NO: 2980126 - DNA, 19 bp, Homo sapiens
agactgatcaggacctcca

SEQ ID NO: 2980127 - DNA, 14 bp, Homo sapiens
agactgcctccctc

SEQ ID NO: 2980128 - DNA, 19 bp, Homo sapiens
agactgcctccctctcttc

SEQ ID NO: 2980129 - DNA, 15 bp, Homo sapiens
agactgcttggccag

SEQ ID NO: 2980130 - DNA, 16 bp, Homo sapiens
agactgcttggccaga

SEQ ID NO: 2980131 - DNA, 17 bp, Homo sapiens
agactggaacttgaact

SEQ ID NO: 2980132 - DNA, 14 bp, Homo sapiens
agactggaagctaa

SEQ ID NO: 2980133 - DNA, 21 bp, Homo sapiens
agactggaagctaatttgcat

SEQ ID NO: 2980134 - DNA, 13 bp, Homo sapiens
agactggacagct

SEQ ID NO: 2980135 - DNA, 14 bp, Homo sapiens
agactggacagctt

SEQ ID NO: 2980136 - DNA, 16 bp, Homo sapiens
agactggacagcttgt

SEQ ID NO: 2980137 - DNA, 17 bp, Homo sapiens
agactggacagcttgtg

SEQ ID NO: 2980138 - DNA, 22 bp, Homo sapiens
agactggaggtcgaagcaatca

SEQ ID NO: 2980139 - DNA, 20 bp, Homo sapiens
agactggatttgcagaagtt

SEQ ID NO: 2980140 - DNA, 16 bp, Homo sapiens
agactggccgggcagg

SEQ ID NO: 2980141 - DNA, 18 bp, Homo sapiens
agactggccgggcaggcg

SEQ ID NO: 2980142 - DNA, 13 bp, Homo sapiens
agactgggcccag

SEQ ID NO: 2980143 - DNA, 14 bp, Homo sapiens
agactgggcccagg

SEQ ID NO: 2980144 - DNA, 15 bp, Homo sapiens
agactgggcccaggc

SEQ ID NO: 2980145 - DNA, 16 bp, Homo sapiens
agactgggcccaggca

SEQ ID NO: 2980146 - DNA, 21 bp, Homo sapiens
agactgggcccaggcaggtct

SEQ ID NO: 2980147 - DNA, 23 bp, Homo sapiens
agactgggcccaggcaggtctgc

SEQ ID NO: 2980148 - DNA, 19 bp, Homo sapiens
agactggtaggaggaggca

SEQ ID NO: 2980149 - DNA, 21 bp, Homo sapiens
agactggtaggaggaggcatg

SEQ ID NO: 2980150 - DNA, 23 bp, Homo sapiens
agactgtatgttttaattgcatt

SEQ ID NO: 2980151 - DNA, 18 bp, Homo sapiens
agactgtcttacctggca

SEQ ID NO: 2980152 - DNA, 19 bp, Homo sapiens
agactgtcttacctggcag

SEQ ID NO: 2980153 - DNA, 21 bp, Homo sapiens
agactgtggagctctgggggg

SEQ ID NO: 2980154 - DNA, 14 bp, Homo sapiens
agacttactctaag

SEQ ID NO: 2980155 - DNA, 20 bp, Homo sapiens
agacttattcttttataata

SEQ ID NO: 2980156 - DNA, 19 bp, Homo sapiens
agacttcccacggctcctc

SEQ ID NO: 2980157 - DNA, 14 bp, Homo sapiens
agacttccttgaga

SEQ ID NO: 2980158 - DNA, 13 bp, Homo sapiens
agacttgacagtg

SEQ ID NO: 2980159 - DNA, 12 bp, Homo sapiens
agacttgcactg

SEQ ID NO: 2980160 - DNA, 20 bp, Homo sapiens
agacttggagaatactgcca

SEQ ID NO: 2980161 - DNA, 15 bp, Homo sapiens
agactttagtagttt

SEQ ID NO: 2980162 - DNA, 12 bp, Homo sapiens
agactttctgtt

SEQ ID NO: 2980163 - DNA, 23 bp, Homo sapiens
agactttggaaaatgcattgtat

SEQ ID NO: 2980164 - DNA, 21 bp, Homo sapiens
agacttttctttgcgatgtcc

SEQ ID NO: 2980165 - DNA, 23 bp, Homo sapiens
agagaaaaaaaaacacacaaaaa

SEQ ID NO: 2980166 - DNA, 17 bp, Homo sapiens
agagaaaaagaaagaac

SEQ ID NO: 2980167 - DNA, 15 bp, Homo sapiens
agagaaaacactttc

SEQ ID NO: 2980168 - DNA, 13 bp, Homo sapiens
agagaaaactctt

SEQ ID NO: 2980169 - DNA, 13 bp, Homo sapiens
agagaaaataaaa

SEQ ID NO: 2980170 - DNA, 15 bp, Homo sapiens
agagaaaataaaaag

SEQ ID NO: 2980171 - DNA, 17 bp, Homo sapiens
agagaaaataaaaagtt

SEQ ID NO: 2980172 - DNA, 20 bp, Homo sapiens
agagaaaataaaaagttaaa

SEQ ID NO: 2980173 - DNA, 12 bp, Homo sapiens
agagaaaatata

SEQ ID NO: 2980174 - DNA, 15 bp, Homo sapiens
agagaaaatatatgt

SEQ ID NO: 2980175 - DNA, 20 bp, Homo sapiens
agagaaaatgagaaaggaca

SEQ ID NO: 2980176 - DNA, 13 bp, Homo sapiens
agagaaagagaca

SEQ ID NO: 2980177 - DNA, 23 bp, Homo sapiens
agagaaaggggagcccactgtcc

SEQ ID NO: 2980178 - DNA, 19 bp, Homo sapiens
agagaacctaactgtatct

SEQ ID NO: 2980179 - DNA, 23 bp, Homo sapiens
agagaacctcacgcacctcccat

SEQ ID NO: 2980180 - DNA, 12 bp, Homo sapiens
agagaagaatga

SEQ ID NO: 2980181 - DNA, 13 bp, Homo sapiens
agagaaggaaaag

SEQ ID NO: 2980182 - DNA, 18 bp, Homo sapiens
agagaaggcctccctagc

SEQ ID NO: 2980183 - DNA, 20 bp, Homo sapiens
agagaaggtggacctggcag

SEQ ID NO: 2980184 - DNA, 14 bp, Homo sapiens
agagaatagagctg

SEQ ID NO: 2980185 - DNA, 21 bp, Homo sapiens
agagaatagagctgccactgg

SEQ ID NO: 2980186 - DNA, 22 bp, Homo sapiens
agagaatatgtctgctcctttc

SEQ ID NO: 2980187 - DNA, 22 bp, Homo sapiens
agagaatattagctttactgtt

SEQ ID NO: 2980188 - DNA, 15 bp, Homo sapiens
agagaatcaacattt

SEQ ID NO: 2980189 - DNA, 20 bp, Homo sapiens
agagaatcaacatttctcaa

SEQ ID NO: 2980190 - DNA, 22 bp, Homo sapiens
agagaattctgttctaaaactc

SEQ ID NO: 2980191 - DNA, 23 bp, Homo sapiens
agagaatttgctttatctgttgt

SEQ ID NO: 2980192 - DNA, 20 bp, Homo sapiens
agagacacctgcacctcccc

SEQ ID NO: 2980193 - DNA, 22 bp, Homo sapiens
agagacacctgcacctcccccc

SEQ ID NO: 2980194 - DNA, 19 bp, Homo sapiens
agagacagtgatgcctgcc

SEQ ID NO: 2980195 - DNA, 17 bp, Homo sapiens
agagacatgagaaaggg

SEQ ID NO: 2980196 - DNA, 15 bp, Homo sapiens
agagaccagcctttc

SEQ ID NO: 2980197 - DNA, 17 bp, Homo sapiens
agagaccagcctttctt

SEQ ID NO: 2980198 - DNA, 21 bp, Homo sapiens
agagacccccggaacaagcct

SEQ ID NO: 2980199 - DNA, 17 bp, Homo sapiens
agagacccgggaaggaa

SEQ ID NO: 2980200 - DNA, 13 bp, Homo sapiens
agagacctttgcc

SEQ ID NO: 2980201 - DNA, 15 bp, Homo sapiens
agagactcagcctgc

SEQ ID NO: 2980202 - DNA, 12 bp, Homo sapiens
agagagaaaata

SEQ ID NO: 2980203 - DNA, 13 bp, Homo sapiens
agagagaaaataa

SEQ ID NO: 2980204 - DNA, 20 bp, Homo sapiens
agagagaaaataaaaagtta

SEQ ID NO: 2980205 - DNA, 22 bp, Homo sapiens
agagagaaaataaaaagttaaa

SEQ ID NO: 2980206 - DNA, 22 bp, Homo sapiens
agagagaacctaactgtatctt

SEQ ID NO: 2980207 - DNA, 18 bp, Homo sapiens
agagagaagacccttctc

SEQ ID NO: 2980208 - DNA, 17 bp, Homo sapiens
agagagaatagagctgc

SEQ ID NO: 2980209 - DNA, 19 bp, Homo sapiens
agagagaatagagctgcca

SEQ ID NO: 2980210 - DNA, 16 bp, Homo sapiens
agagagacatggaaaa

SEQ ID NO: 2980211 - DNA, 15 bp, Homo sapiens
agagagagaaccttt

SEQ ID NO: 2980212 - DNA, 14 bp, Homo sapiens
agagagagagaaag

SEQ ID NO: 2980213 - DNA, 14 bp, Homo sapiens
agagagagtgtttg

SEQ ID NO: 2980214 - DNA, 16 bp, Homo sapiens
agagagattggatttt

SEQ ID NO: 2980215 - DNA, 12 bp, Homo sapiens
agattattttat

SEQ ID NO: 2980216 - DNA, 14 bp, Homo sapiens
agattattttggaa

SEQ ID NO: 2980217 - DNA, 17 bp, Homo sapiens
agattattttggaaagt

SEQ ID NO: 2980218 - DNA, 15 bp, Homo sapiens
agattcaaaggttct

SEQ ID NO: 2980219 - DNA, 18 bp, Homo sapiens
agattcaaaggttctagg

SEQ ID NO: 2980220 - DNA, 21 bp, Homo sapiens
agattcaaaggttctaggttt

SEQ ID NO: 2980221 - DNA, 18 bp, Homo sapiens
agattcacctaagagatt

SEQ ID NO: 2980222 - DNA, 20 bp, Homo sapiens
agattcacctaagagattct

SEQ ID NO: 2980223 - DNA, 19 bp, Homo sapiens
agattcaggtatgttgcct

SEQ ID NO: 2980224 - DNA, 21 bp, Homo sapiens
agattcagttttcccactttt

SEQ ID NO: 2980225 - DNA, 17 bp, Homo sapiens
agattcatttttaatca

SEQ ID NO: 2980226 - DNA, 19 bp, Homo sapiens
agattccattggtccaaga

SEQ ID NO: 2980227 - DNA, 13 bp, Homo sapiens
agattcccagaga

SEQ ID NO: 2980228 - DNA, 20 bp, Homo sapiens
agattcccaggccagggctg

SEQ ID NO: 2980229 - DNA, 14 bp, Homo sapiens
agattcctgtcctt

SEQ ID NO: 2980230 - DNA, 16 bp, Homo sapiens
agattcctttcctgtg

SEQ ID NO: 2980231 - DNA, 21 bp, Homo sapiens
agattcgctgtcccctcagcg

SEQ ID NO: 2980232 - DNA, 18 bp, Homo sapiens
agattctaaagattctat

SEQ ID NO: 2980233 - DNA, 12 bp, Homo sapiens
agattctaaagg

SEQ ID NO: 2980234 - DNA, 13 bp, Homo sapiens
agattctaaaggt

SEQ ID NO: 2980235 - DNA, 23 bp, Homo sapiens
agattctaaaggtccacaggtct

SEQ ID NO: 2980236 - DNA, 10 bp, Homo sapiens
agattctaac

SEQ ID NO: 2980237 - DNA, 14 bp, Homo sapiens
agattctaatgatg

SEQ ID NO: 2980238 - DNA, 11 bp, Homo sapiens
agattctagat

SEQ ID NO: 2980239 - DNA, 16 bp, Homo sapiens
agattctatagttcta

SEQ ID NO: 2980240 - DNA, 15 bp, Homo sapiens
agattctctgcccag

SEQ ID NO: 2980241 - DNA, 17 bp, Homo sapiens
agattctctgcccagcc

SEQ ID NO: 2980242 - DNA, 23 bp, Homo sapiens
agattctctggctgtaaggctct

SEQ ID NO: 2980243 - DNA, 17 bp, Homo sapiens
agattctctgtgtctaa

SEQ ID NO: 2980244 - DNA, 19 bp, Homo sapiens
agattctctgtgtctaaga

SEQ ID NO: 2980245 - DNA, 20 bp, Homo sapiens
agattctctgtgtctaagat

SEQ ID NO: 2980246 - DNA, 22 bp, Homo sapiens
agattctctgtgtctaagattc

SEQ ID NO: 2980247 - DNA, 21 bp, Homo sapiens
agattctgatttgccactgat

SEQ ID NO: 2980248 - DNA, 21 bp, Homo sapiens
agattctggacagtcagctct

SEQ ID NO: 2980249 - DNA, 15 bp, Homo sapiens
agattctgtcttata

SEQ ID NO: 2980250 - DNA, 17 bp, Homo sapiens
agattcttacaaggccc

SEQ ID NO: 2980251 - DNA, 12 bp, Homo sapiens
agattcttcagc

SEQ ID NO: 2980252 - DNA, 12 bp, Homo sapiens
agattctttccc

SEQ ID NO: 2980253 - DNA, 19 bp, Homo sapiens
agattgaaaacttttctca

SEQ ID NO: 2980254 - DNA, 15 bp, Homo sapiens
agattgaacactgcg

SEQ ID NO: 2980255 - DNA, 13 bp, Homo sapiens
agattgaactttc

SEQ ID NO: 2980256 - DNA, 19 bp, Homo sapiens
agattgaagtaaactgcag

SEQ ID NO: 2980257 - DNA, 20 bp, Homo sapiens
agattgcacagtcaaaacga

SEQ ID NO: 2980258 - DNA, 18 bp, Homo sapiens
agattgcatgtgactctg

SEQ ID NO: 2980259 - DNA, 23 bp, Homo sapiens
agattgcatgtgactctgaagct

SEQ ID NO: 2980260 - DNA, 16 bp, Homo sapiens
agattggaaagacagg

SEQ ID NO: 2980261 - DNA, 21 bp, Homo sapiens
agattggaaggagacacagat

SEQ ID NO: 2980262 - DNA, 23 bp, Homo sapiens
agattggaaggagacacagatgt

SEQ ID NO: 2980263 - DNA, 20 bp, Homo sapiens
agattggagtggggaagtgt

SEQ ID NO: 2980264 - DNA, 21 bp, Homo sapiens
agattggccaattaaaaacga

SEQ ID NO: 2980265 - DNA, 18 bp, Homo sapiens
agattgtttctatacaaa

SEQ ID NO: 2980266 - DNA, 18 bp, Homo sapiens
agatttaagttcctgctg

SEQ ID NO: 2980267 - DNA, 16 bp, Homo sapiens
agatttatcaaatcag

SEQ ID NO: 2980268 - DNA, 19 bp, Homo sapiens
agatttatttttaatatgt

SEQ ID NO: 2980269 - DNA, 18 bp, Homo sapiens
agatttcagtaatgtctt

SEQ ID NO: 2980270 - DNA, 22 bp, Homo sapiens
agatttctagttttttttctag

SEQ ID NO: 2980271 - DNA, 13 bp, Homo sapiens
agatttcttaaat

SEQ ID NO: 2980272 - DNA, 15 bp, Homo sapiens
agatttgacctcctc

SEQ ID NO: 2980273 - DNA, 16 bp, Homo sapiens
agatttgtgaactcag

SEQ ID NO: 2980274 - DNA, 19 bp, Homo sapiens
agatttgtgaactcagcca

SEQ ID NO: 2980275 - DNA, 21 bp, Homo sapiens
agatttgtgaactcagccaag

SEQ ID NO: 2980276 - DNA, 13 bp, Homo sapiens
agatttgtgttat

SEQ ID NO: 2980277 - DNA, 13 bp, Homo sapiens
agatttgtttcct

SEQ ID NO: 2980278 - DNA, 19 bp, Homo sapiens
agattttatacccttgact

SEQ ID NO: 2980279 - DNA, 23 bp, Homo sapiens
agattttccacaagattcccaga

SEQ ID NO: 2980280 - DNA, 18 bp, Homo sapiens
agattttctggttctaac

SEQ ID NO: 2980281 - DNA, 13 bp, Homo sapiens
agattttctttaa

SEQ ID NO: 2980282 - DNA, 14 bp, Homo sapiens
agattttctttaaa

SEQ ID NO: 2980283 - DNA, 17 bp, Homo sapiens
agattttctttaaaaga

SEQ ID NO: 2980284 - DNA, 20 bp, Homo sapiens
agattttctttaaaagaatg

SEQ ID NO: 2980285 - DNA, 21 bp, Homo sapiens
agatttttaaaatgaatctta

SEQ ID NO: 2980286 - DNA, 22 bp, Homo sapiens
agatttttggtagtttctgggt

SEQ ID NO: 2980287 - DNA, 20 bp, Homo sapiens
agattttttaaaaaaaatgt

SEQ ID NO: 2980288 - DNA, 21 bp, Homo sapiens
agattttttcagacttgtcaa

SEQ ID NO: 2980289 - DNA, 19 bp, Homo sapiens
agcaaaaagactggatttg

SEQ ID NO: 2980290 - DNA, 20 bp, Homo sapiens
agcaaaaatgtaaaaaacaa

SEQ ID NO: 2980291 - DNA, 23 bp, Homo sapiens
agcaaaaatgtaaaaaacaaaaa

SEQ ID NO: 2980292 - DNA, 12 bp, Homo sapiens
agcaaaactccg

SEQ ID NO: 2980293 - DNA, 14 bp, Homo sapiens
agcaaaacttttaa

SEQ ID NO: 2980294 - DNA, 20 bp, Homo sapiens
agcaaaatcatggaatggtt

SEQ ID NO: 2980295 - DNA, 23 bp, Homo sapiens
agcaaaatcatggaatggttata

SEQ ID NO: 2980296 - DNA, 17 bp, Homo sapiens
agcaaaatccaaactgc

SEQ ID NO: 2980297 - DNA, 23 bp, Homo sapiens
agcaaaatccaaactgctgtctc

SEQ ID NO: 2980298 - DNA, 13 bp, Homo sapiens
agcaaacacaata

SEQ ID NO: 2980299 - DNA, 14 bp, Homo sapiens
agcaaacacaataa

SEQ ID NO: 2980300 - DNA, 21 bp, Homo sapiens
agcaaaccaagagattgctaa

SEQ ID NO: 2980301 - DNA, 22 bp, Homo sapiens
agcaaaccaagagattgctaat

SEQ ID NO: 2980302 - DNA, 14 bp, Homo sapiens
agcaaagagaatgt

SEQ ID NO: 2980303 - DNA, 16 bp, Homo sapiens
agcaaagatatatatt

SEQ ID NO: 2980304 - DNA, 16 bp, Homo sapiens
agcaaagcgcccaccc

SEQ ID NO: 2980305 - DNA, 12 bp, Homo sapiens
agcaaaggcagt

SEQ ID NO: 2980306 - DNA, 19 bp, Homo sapiens
agcaaaggcagtcccggga

SEQ ID NO: 2980307 - DNA, 21 bp, Homo sapiens
agcaaatcaccacaaactgta

SEQ ID NO: 2980308 - DNA, 22 bp, Homo sapiens
agcaaatcaccacaaactgtaa

SEQ ID NO: 2980309 - DNA, 16 bp, Homo sapiens
agcaaatcagaaactt

SEQ ID NO: 2980310 - DNA, 11 bp, Homo sapiens
agcaaatcttt

SEQ ID NO: 2980311 - DNA, 22 bp, Homo sapiens
agcaaatctttctgtaaacaga

SEQ ID NO: 2980312 - DNA, 17 bp, Homo sapiens
agcaaatgaaaaagtca

SEQ ID NO: 2980313 - DNA, 22 bp, Homo sapiens
agcaaatgcattctatcgttat

SEQ ID NO: 2980314 - DNA, 13 bp, Homo sapiens
agcaaattccaga

SEQ ID NO: 2980315 - DNA, 17 bp, Homo sapiens
agcaaattccagatttg

SEQ ID NO: 2980316 - DNA, 23 bp, Homo sapiens
agcaaattccagatttgtttcct

SEQ ID NO: 2980317 - DNA, 14 bp, Homo sapiens
agcaaccccaggct

SEQ ID NO: 2980318 - DNA, 16 bp, Homo sapiens
agcaaccccaggctga

SEQ ID NO: 2980319 - DNA, 15 bp, Homo sapiens
agcaacctacccagc

SEQ ID NO: 2980320 - DNA, 24 bp, Homo sapiens
agcaacctactgtctaagcagttt

SEQ ID NO: 2980321 - DNA, 14 bp, Homo sapiens
agcaacgccagtgg

SEQ ID NO: 2980322 - DNA, 19 bp, Homo sapiens
agcaacgttagtagaactt

SEQ ID NO: 2980323 - DNA, 16 bp, Homo sapiens
agcaactcttgattat

SEQ ID NO: 2980324 - DNA, 12 bp, Homo sapiens
agcaacttgaac

SEQ ID NO: 2980325 - DNA, 22 bp, Homo sapiens
agcaacttgaacttcacctgca

SEQ ID NO: 2980326 - DNA, 13 bp, Homo sapiens
agcaacttgcttc

SEQ ID NO: 2980327 - DNA, 15 bp, Homo sapiens
agcaacttgcttcta

SEQ ID NO: 2980328 - DNA, 15 bp, Homo sapiens
agcaagaaagaaacc

SEQ ID NO: 2980329 - DNA, 23 bp, Homo sapiens
agcaagacagctcttcttgaaaa

SEQ ID NO: 2980330 - DNA, 18 bp, Homo sapiens
agcaagcagtagcatttg

SEQ ID NO: 2980331 - DNA, 16 bp, Homo sapiens
agcaagctgtgttact

SEQ ID NO: 2980332 - DNA, 23 bp, Homo sapiens
agcaagctgtgttacttgaagta

SEQ ID NO: 2980333 - DNA, 15 bp, Homo sapiens
agcaaggatatcaga

SEQ ID NO: 2980334 - DNA, 24 bp, Homo sapiens
agcaagggggaaggctgcaaagta

SEQ ID NO: 2980335 - DNA, 18 bp, Homo sapiens
agcaagggggtgatgtag

SEQ ID NO: 2980336 - DNA, 17 bp, Homo sapiens
agcaaggtgtccctgcc

SEQ ID NO: 2980337 - DNA, 15 bp, Homo sapiens
agcaataaaattttt

SEQ ID NO: 2980338 - DNA, 19 bp, Homo sapiens
agcaataacattcccactg

SEQ ID NO: 2980339 - DNA, 20 bp, Homo sapiens
agcaatacgtttgtgcagaa

SEQ ID NO: 2980340 - DNA, 20 bp, Homo sapiens
agcaatcagcaaacacaata

SEQ ID NO: 2980341 - DNA, 18 bp, Homo sapiens
agcaatcgcatcccggct

SEQ ID NO: 2980342 - DNA, 12 bp, Homo sapiens
agcaatctttga

SEQ ID NO: 2980343 - DNA, 13 bp, Homo sapiens
agcaatgaagaac

SEQ ID NO: 2980344 - DNA, 14 bp, Homo sapiens
agcaatgctgtgaa

SEQ ID NO: 2980345 - DNA, 15 bp, Homo sapiens
agcaatgctgtgaat

SEQ ID NO: 2980346 - DNA, 18 bp, Homo sapiens
agcaatgggtcttagctc

SEQ ID NO: 2980347 - DNA, 16 bp, Homo sapiens
agcccatccatagtaa

SEQ ID NO: 2980348 - DNA, 23 bp, Homo sapiens
agcccatggtaacgaacccctag

SEQ ID NO: 2980349 - DNA, 19 bp, Homo sapiens
agcccattctctctcctgt

SEQ ID NO: 2980350 - DNA, 15 bp, Homo sapiens
agccccacagttctt

SEQ ID NO: 2980351 - DNA, 15 bp, Homo sapiens
agccccactgccctt

SEQ ID NO: 2980352 - DNA, 16 bp, Homo sapiens
agccccagactgggcc

SEQ ID NO: 2980353 - DNA, 13 bp, Homo sapiens
agccccagcacca

SEQ ID NO: 2980354 - DNA, 14 bp, Homo sapiens
agccccatctgtgc

SEQ ID NO: 2980355 - DNA, 15 bp, Homo sapiens
agccccatctgtgca

SEQ ID NO: 2980356 - DNA, 17 bp, Homo sapiens
agccccatctgtgcatt

SEQ ID NO: 2980357 - DNA, 23 bp, Homo sapiens
agcccccaccccagcacagctcc

SEQ ID NO: 2980358 - DNA, 22 bp, Homo sapiens
agcccccagctaagaacctgga

SEQ ID NO: 2980359 - DNA, 13 bp, Homo sapiens
agcccccccttcc

SEQ ID NO: 2980360 - DNA, 15 bp, Homo sapiens
agcccccccttccac

SEQ ID NO: 2980361 - DNA, 22 bp, Homo sapiens
agccccctgccccgcaggcctg

SEQ ID NO: 2980362 - DNA, 19 bp, Homo sapiens
agccccctggcagctgccc

SEQ ID NO: 2980363 - DNA, 16 bp, Homo sapiens
agccccctggcctctg

SEQ ID NO: 2980364 - DNA, 22 bp, Homo sapiens
agccccgctcccacctagtgcc

SEQ ID NO: 2980365 - DNA, 20 bp, Homo sapiens
agcccctacccctgccctgc

SEQ ID NO: 2980366 - DNA, 22 bp, Homo sapiens
agcccctacccctgccctgctc

SEQ ID NO: 2980367 - DNA, 20 bp, Homo sapiens
agcccctcccaagctggctg

SEQ ID NO: 2980368 - DNA, 14 bp, Homo sapiens
agcccctcctctgc

SEQ ID NO: 2980369 - DNA, 16 bp, Homo sapiens
agcccctcctctgcca

SEQ ID NO: 2980370 - DNA, 17 bp, Homo sapiens
agcccctcctctgccac

SEQ ID NO: 2980371 - DNA, 17 bp, Homo sapiens
agcccctcggctctgga

SEQ ID NO: 2980372 - DNA, 18 bp, Homo sapiens
agcccctcggctctggag

SEQ ID NO: 2980373 - DNA, 18 bp, Homo sapiens
agcccctgcagacgtctg

SEQ ID NO: 2980374 - DNA, 21 bp, Homo sapiens
agcccctgcagacgtctggcc

SEQ ID NO: 2980375 - DNA, 22 bp, Homo sapiens
agcccctggggtggccaccagt

SEQ ID NO: 2980376 - DNA, 23 bp, Homo sapiens
agcccctgtctagagagggaggc

SEQ ID NO: 2980377 - DNA, 19 bp, Homo sapiens
agccccttctgctcagctc

SEQ ID NO: 2980378 - DNA, 15 bp, Homo sapiens
agcccgcacacctgc

SEQ ID NO: 2980379 - DNA, 19 bp, Homo sapiens
agcccgcactgtcccagta

SEQ ID NO: 2980380 - DNA, 15 bp, Homo sapiens
agcccgcgtctgtgc

SEQ ID NO: 2980381 - DNA, 18 bp, Homo sapiens
agcccggctcggcccagc

SEQ ID NO: 2980382 - DNA, 21 bp, Homo sapiens
agcccggctcggcccagcacc

SEQ ID NO: 2980383 - DNA, 22 bp, Homo sapiens
agcccggctcggcccagcaccc

SEQ ID NO: 2980384 - DNA, 16 bp, Homo sapiens
agcccgtcctcctcta

SEQ ID NO: 2980385 - DNA, 19 bp, Homo sapiens
agcccgtgccacccccagc

SEQ ID NO: 2980386 - DNA, 23 bp, Homo sapiens
agcccgtgccacccccagccctg

SEQ ID NO: 2980387 - DNA, 20 bp, Homo sapiens
agccctagggtggagagcca

SEQ ID NO: 2980388 - DNA, 14 bp, Homo sapiens
agccctcagaaccc

SEQ ID NO: 2980389 - DNA, 19 bp, Homo sapiens
agccctcagaacccttggc

SEQ ID NO: 2980390 - DNA, 24 bp, Homo sapiens
agccctcagaacccttggcttgcc

SEQ ID NO: 2980391 - DNA, 22 bp, Homo sapiens
agccctcccactttgctgttcc

SEQ ID NO: 2980392 - DNA, 22 bp, Homo sapiens
agccctccccatctcggggctg

SEQ ID NO: 2980393 - DNA, 21 bp, Homo sapiens
agccctccccatggagccagc

SEQ ID NO: 2980394 - DNA, 16 bp, Homo sapiens
agccctccctgtcctc

SEQ ID NO: 2980395 - DNA, 21 bp, Homo sapiens
agccctccctgtcctcctcgg

SEQ ID NO: 2980396 - DNA, 14 bp, Homo sapiens
agccctcctcaccc

SEQ ID NO: 2980397 - DNA, 12 bp, Homo sapiens
agccctctgcct

SEQ ID NO: 2980398 - DNA, 13 bp, Homo sapiens
agccctgaccctg

SEQ ID NO: 2980399 - DNA, 15 bp, Homo sapiens
agccctgaccctgtg

SEQ ID NO: 2980400 - DNA, 18 bp, Homo sapiens
agccctgagaaagccctg

SEQ ID NO: 2980401 - DNA, 14 bp, Homo sapiens
agccctgagttcct

SEQ ID NO: 2980402 - DNA, 20 bp, Homo sapiens
agccctgagttcctagccac

SEQ ID NO: 2980403 - DNA, 14 bp, Homo sapiens
agccctgcccaccc

SEQ ID NO: 2980404 - DNA, 13 bp, Homo sapiens
agccctgcctctg

SEQ ID NO: 2980405 - DNA, 17 bp, Homo sapiens
agccctgcctctgtgta

SEQ ID NO: 2980406 - DNA, 21 bp, Homo sapiens
agccctgctgcttcctaactt

SEQ ID NO: 2980407 - DNA, 22 bp, Homo sapiens
agccctgctgcttcctaactta

SEQ ID NO: 2980408 - DNA, 23 bp, Homo sapiens
agccctggatttcagaaagagca

SEQ ID NO: 2980409 - DNA, 16 bp, Homo sapiens
agccctggccccctga

SEQ ID NO: 2980410 - DNA, 14 bp, Homo sapiens
agccctggcccctc

SEQ ID NO: 2980411 - DNA, 23 bp, Homo sapiens
agccctgggtgacttcaggtgga

SEQ ID NO: 2980412 - DNA, 18 bp, Homo sapiens
agccctggtgctcctgcc

SEQ ID NO: 2980413 - DNA, 18 bp, Homo sapiens
agccctgtcgggctttgt

SEQ ID NO: 2980414 - DNA, 20 bp, Homo sapiens
agccctgttctcgttgccct

SEQ ID NO: 2980415 - DNA, 18 bp, Homo sapiens
agccctgttgacacaggt

SEQ ID NO: 2980416 - DNA, 14 bp, Homo sapiens
agccctgttgtgcc

SEQ ID NO: 2980417 - DNA, 12 bp, Homo sapiens
agcccttagcct

SEQ ID NO: 2980418 - DNA, 16 bp, Homo sapiens
agcccttagccttgct

SEQ ID NO: 2980419 - DNA, 23 bp, Homo sapiens
agcccttagccttgctgtagaga

SEQ ID NO: 2980420 - DNA, 18 bp, Homo sapiens
agcccttatctgtgctca

SEQ ID NO: 2980421 - DNA, 13 bp, Homo sapiens
agcccttgaggga

SEQ ID NO: 2980422 - DNA, 20 bp, Homo sapiens
agcccttgagggagaactta

SEQ ID NO: 2980423 - DNA, 17 bp, Homo sapiens
agccgaactccaggctg

SEQ ID NO: 2980424 - DNA, 19 bp, Homo sapiens
agccgaactccaggctggg

SEQ ID NO: 2980425 - DNA, 23 bp, Homo sapiens
agccgaactccaggctgggctga

SEQ ID NO: 2980426 - DNA, 22 bp, Homo sapiens
agccgacaactatttcggcctt

SEQ ID NO: 2980427 - DNA, 21 bp, Homo sapiens
agccgacaccttttttcaaca

SEQ ID NO: 2980428 - DNA, 13 bp, Homo sapiens
agccgagagcctg

SEQ ID NO: 2980429 - DNA, 17 bp, Homo sapiens
agccgagagcctgctcc

SEQ ID NO: 2980430 - DNA, 16 bp, Homo sapiens
agccgagggcgtcaga

SEQ ID NO: 2980431 - DNA, 20 bp, Homo sapiens
agccgagggcgtcagagaga

SEQ ID NO: 2980432 - DNA, 16 bp, Homo sapiens
agccgcatcttctcca

SEQ ID NO: 2980433 - DNA, 17 bp, Homo sapiens
agccgcatcttctccat

SEQ ID NO: 2980434 - DNA, 12 bp, Homo sapiens
agccgccctgag

SEQ ID NO: 2980435 - DNA, 14 bp, Homo sapiens
agccgccctgagag

SEQ ID NO: 2980436 - DNA, 22 bp, Homo sapiens
agccgccggaagtggctccgtg

SEQ ID NO: 2980437 - DNA, 19 bp, Homo sapiens
agccgctgagcgaggagat

SEQ ID NO: 2980438 - DNA, 14 bp, Homo sapiens
agccgctgccctgg

SEQ ID NO: 2980439 - DNA, 15 bp, Homo sapiens
agccggaaggccgag

SEQ ID NO: 2980440 - DNA, 15 bp, Homo sapiens
agccgggaccctcag

SEQ ID NO: 2980441 - DNA, 14 bp, Homo sapiens
agccgggagcctga

SEQ ID NO: 2980442 - DNA, 12 bp, Homo sapiens
agccgggcacag

SEQ ID NO: 2980443 - DNA, 16 bp, Homo sapiens
agccgggtctgcctct

SEQ ID NO: 2980444 - DNA, 22 bp, Homo sapiens
agccgggtctgcctcttctggg

SEQ ID NO: 2980445 - DNA, 13 bp, Homo sapiens
agccgtgagcatg

SEQ ID NO: 2980446 - DNA, 16 bp, Homo sapiens
agccgtgccctgcccc

SEQ ID NO: 2980447 - DNA, 18 bp, Homo sapiens
agccgtgctcgccccagc

SEQ ID NO: 2980448 - DNA, 23 bp, Homo sapiens
agcctaatccctgggcattgctt

SEQ ID NO: 2980449 - DNA, 16 bp, Homo sapiens
agcctaattgtcacat

SEQ ID NO: 2980450 - DNA, 22 bp, Homo sapiens
agcctaattgtcacatcaagca

SEQ ID NO: 2980451 - DNA, 18 bp, Homo sapiens
agcctagaagctggtggc

SEQ ID NO: 2980452 - DNA, 14 bp, Homo sapiens
agcctagtgaaggc

SEQ ID NO: 2980453 - DNA, 23 bp, Homo sapiens
agcctagtgaaggcttctctctg

SEQ ID NO: 2980454 - DNA, 15 bp, Homo sapiens
agcctagtggcttgt

SEQ ID NO: 2980455 - DNA, 18 bp, Homo sapiens
agcctagtggcttgtcct

SEQ ID NO: 2980456 - DNA, 19 bp, Homo sapiens
agcctagtggcttgtcctc

SEQ ID NO: 2980457 - DNA, 16 bp, Homo sapiens
agcctatggcagaaaa

SEQ ID NO: 2980458 - DNA, 15 bp, Homo sapiens
agcctcaacctcctg

SEQ ID NO: 2980459 - DNA, 15 bp, Homo sapiens
agcctcaatttctga

SEQ ID NO: 2980460 - DNA, 18 bp, Homo sapiens
agcctcacagatgctggc

SEQ ID NO: 2980461 - DNA, 21 bp, Homo sapiens
agcctcacagatgctggcctc

SEQ ID NO: 2980462 - DNA, 22 bp, Homo sapiens
agcctcacgtatttcacagagc

SEQ ID NO: 2980463 - DNA, 21 bp, Homo sapiens
agcctcacttggtctgccagg

SEQ ID NO: 2980464 - DNA, 22 bp, Homo sapiens
agcctcagcggaccactcttct

SEQ ID NO: 2980465 - DNA, 11 bp, Homo sapiens
agcctcagctc

SEQ ID NO: 2980466 - DNA, 12 bp, Homo sapiens
agcctcatctct

SEQ ID NO: 2980467 - DNA, 11 bp, Homo sapiens
agcctccacca

SEQ ID NO: 2980468 - DNA, 16 bp, Homo sapiens
agcctccaccatcccc

SEQ ID NO: 2980469 - DNA, 13 bp, Homo sapiens
agcctcccaaagt

SEQ ID NO: 2980470 - DNA, 14 bp, Homo sapiens
agcctcccaaagtg

SEQ ID NO: 2980471 - DNA, 17 bp, Homo sapiens
agcctcccatccagggc

SEQ ID NO: 2980472 - DNA, 17 bp, Homo sapiens
agcctcccctgccaggg

SEQ ID NO: 2980473 - DNA, 22 bp, Homo sapiens
agcctcccctgccagggcaggg

SEQ ID NO: 2980474 - DNA, 19 bp, Homo sapiens
agcctcccgagtagggagg

SEQ ID NO: 2980475 - DNA, 16 bp, Homo sapiens
agcctccctgaagcct

SEQ ID NO: 2980476 - DNA, 17 bp, Homo sapiens
agcctcgacacagagtg

SEQ ID NO: 2980477 - DNA, 16 bp, Homo sapiens
agcctcgaggtgcctt

SEQ ID NO: 2980478 - DNA, 16 bp, Homo sapiens
agcctcgcacaggccc

SEQ ID NO: 2980479 - DNA, 12 bp, Homo sapiens
agctgtgttcat

SEQ ID NO: 2980480 - DNA, 16 bp, Homo sapiens
agctgtgttcatccag

SEQ ID NO: 2980481 - DNA, 15 bp, Homo sapiens
agctgtgttgttgct

SEQ ID NO: 2980482 - DNA, 18 bp, Homo sapiens
agctgttcctgttcagta

SEQ ID NO: 2980483 - DNA, 15 bp, Homo sapiens
agctgttctcattcc

SEQ ID NO: 2980484 - DNA, 23 bp, Homo sapiens
agctgttctcattcctgttcttt

SEQ ID NO: 2980485 - DNA, 19 bp, Homo sapiens
agctgttgcaggcagtgtc

SEQ ID NO: 2980486 - DNA, 21 bp, Homo sapiens
agctgttgtggtttttagtgc

SEQ ID NO: 2980487 - DNA, 19 bp, Homo sapiens
agcttacaagccagctgga

SEQ ID NO: 2980488 - DNA, 20 bp, Homo sapiens
agcttacacaaatctattta

SEQ ID NO: 2980489 - DNA, 17 bp, Homo sapiens
agcttagattctgtatg

SEQ ID NO: 2980490 - DNA, 16 bp, Homo sapiens
agcttagattttctgt

SEQ ID NO: 2980491 - DNA, 18 bp, Homo sapiens
agcttagattttctgtaa

SEQ ID NO: 2980492 - DNA, 16 bp, Homo sapiens
agcttagcaggagagg

SEQ ID NO: 2980493 - DNA, 11 bp, Homo sapiens
agcttatctct

SEQ ID NO: 2980494 - DNA, 14 bp, Homo sapiens
agcttatctctttt

SEQ ID NO: 2980495 - DNA, 15 bp, Homo sapiens
agcttatgtttctta

SEQ ID NO: 2980496 - DNA, 22 bp, Homo sapiens
agcttattgtgtgcgctgcctg

SEQ ID NO: 2980497 - DNA, 18 bp, Homo sapiens
agcttatttagcacattt

SEQ ID NO: 2980498 - DNA, 19 bp, Homo sapiens
agcttatttagcacatttt

SEQ ID NO: 2980499 - DNA, 17 bp, Homo sapiens
agcttatttttttctac

SEQ ID NO: 2980500 - DNA, 16 bp, Homo sapiens
agcttcaaaaactttg

SEQ ID NO: 2980501 - DNA, 21 bp, Homo sapiens
agcttcaccccaatcccagct

SEQ ID NO: 2980502 - DNA, 12 bp, Homo sapiens
agcttccagagc

SEQ ID NO: 2980503 - DNA, 19 bp, Homo sapiens
agcttccagagctctgacc

SEQ ID NO: 2980504 - DNA, 20 bp, Homo sapiens
agcttccagagctctgaccc

SEQ ID NO: 2980505 - DNA, 22 bp, Homo sapiens
agcttccatgattctatttata

SEQ ID NO: 2980506 - DNA, 18 bp, Homo sapiens
agcttcccacacctgcct

SEQ ID NO: 2980507 - DNA, 19 bp, Homo sapiens
agcttcccacacctgcctg

SEQ ID NO: 2980508 - DNA, 21 bp, Homo sapiens
agcttcccacacctgcctgcg

SEQ ID NO: 2980509 - DNA, 22 bp, Homo sapiens
agcttcccacacctgcctgcgt

SEQ ID NO: 2980510 - DNA, 18 bp, Homo sapiens
agcttcctccagaggagg

SEQ ID NO: 2980511 - DNA, 14 bp, Homo sapiens
agcttccttggctt

SEQ ID NO: 2980512 - DNA, 20 bp, Homo sapiens
agcttcggtgtgcagatcat

SEQ ID NO: 2980513 - DNA, 14 bp, Homo sapiens
agcttcgtgcctgg

SEQ ID NO: 2980514 - DNA, 12 bp, Homo sapiens
agcttctcctgt

SEQ ID NO: 2980515 - DNA, 16 bp, Homo sapiens
agcttctcctgtgtga

SEQ ID NO: 2980516 - DNA, 18 bp, Homo sapiens
agcttctggggtccccag

SEQ ID NO: 2980517 - DNA, 21 bp, Homo sapiens
agcttctggggtccccagggc

SEQ ID NO: 2980518 - DNA, 22 bp, Homo sapiens
agcttctggggtccccagggct

SEQ ID NO: 2980519 - DNA, 19 bp, Homo sapiens
agcttctgtattttcaaag

SEQ ID NO: 2980520 - DNA, 20 bp, Homo sapiens
agcttctgtattttcaaaga

SEQ ID NO: 2980521 - DNA, 20 bp, Homo sapiens
agcttgaaaagattctgaaa

SEQ ID NO: 2980522 - DNA, 22 bp, Homo sapiens
agcttgagagttttctttcttt

SEQ ID NO: 2980523 - DNA, 16 bp, Homo sapiens
agcttgccagatgctg

SEQ ID NO: 2980524 - DNA, 22 bp, Homo sapiens
agcttgggaagtcgaggctgca

SEQ ID NO: 2980525 - DNA, 23 bp, Homo sapiens
agcttggggacaggggcaggagg

SEQ ID NO: 2980526 - DNA, 15 bp, Homo sapiens
agcttggggccaggg

SEQ ID NO: 2980527 - DNA, 18 bp, Homo sapiens
agcttggtatgagacaga

SEQ ID NO: 2980528 - DNA, 14 bp, Homo sapiens
agcttgtaaatatg

SEQ ID NO: 2980529 - DNA, 21 bp, Homo sapiens
agcttgtaaatatggggatag

SEQ ID NO: 2980530 - DNA, 14 bp, Homo sapiens
agctttaaaaagaa

SEQ ID NO: 2980531 - DNA, 15 bp, Homo sapiens
agctttactgtggct

SEQ ID NO: 2980532 - DNA, 21 bp, Homo sapiens
agctttcctggaagtcaaata

SEQ ID NO: 2980533 - DNA, 22 bp, Homo sapiens
agctttcctggaagtcaaataa

SEQ ID NO: 2980534 - DNA, 21 bp, Homo sapiens
agctttctcataaatttctct

SEQ ID NO: 2980535 - DNA, 13 bp, Homo sapiens
agctttctgcctt

SEQ ID NO: 2980536 - DNA, 14 bp, Homo sapiens
agctttcttcagct

SEQ ID NO: 2980537 - DNA, 13 bp, Homo sapiens
agctttcttgttt

SEQ ID NO: 2980538 - DNA, 23 bp, Homo sapiens
agctttgaatatctgcaatcttt

SEQ ID NO: 2980539 - DNA, 13 bp, Homo sapiens
agctttgcagtga

SEQ ID NO: 2980540 - DNA, 17 bp, Homo sapiens
agctttgggtcattttt

SEQ ID NO: 2980541 - DNA, 21 bp, Homo sapiens
agctttgtcccctgcttcaga

SEQ ID NO: 2980542 - DNA, 13 bp, Homo sapiens
agcttttgttgtt

SEQ ID NO: 2980543 - DNA, 12 bp, Homo sapiens
agctttttaatg

SEQ ID NO: 2980544 - DNA, 17 bp, Homo sapiens
agctttttgtcttttct

SEQ ID NO: 2980545 - DNA, 16 bp, Homo sapiens
agcttttttcctcctt

SEQ ID NO: 2980546 - DNA, 13 bp, Homo sapiens
agcttttttgcat

SEQ ID NO: 2980547 - DNA, 22 bp, Homo sapiens
aggaaaaaaaaaaaaagaaatt

SEQ ID NO: 2980548 - DNA, 24 bp, Homo sapiens
aggaaaaaaactattaaggatgta

SEQ ID NO: 2980549 - DNA, 13 bp, Homo sapiens
aggaaaaaaagac

SEQ ID NO: 2980550 - DNA, 14 bp, Homo sapiens
aggaaaaaaagact

SEQ ID NO: 2980551 - DNA, 15 bp, Homo sapiens
aggaaaaaaagcatg

SEQ ID NO: 2980552 - DNA, 16 bp, Homo sapiens
aggaaaaaaattacaa

SEQ ID NO: 2980553 - DNA, 21 bp, Homo sapiens
aggaaaaaaattacaaagaaa

SEQ ID NO: 2980554 - DNA, 18 bp, Homo sapiens
aggaaaaacaacaaataa

SEQ ID NO: 2980555 - DNA, 14 bp, Homo sapiens
aggaaaaacaggtc

SEQ ID NO: 2980556 - DNA, 15 bp, Homo sapiens
aggaaaagattcctg

SEQ ID NO: 2980557 - DNA, 14 bp, Homo sapiens
aggaaaagcacaag

SEQ ID NO: 2980558 - DNA, 20 bp, Homo sapiens
aggaaaagcggacatcagct

SEQ ID NO: 2980559 - DNA, 20 bp, Homo sapiens
aggaaaataatacttatctt

SEQ ID NO: 2980560 - DNA, 14 bp, Homo sapiens
aggaaaataatgta

SEQ ID NO: 2980561 - DNA, 16 bp, Homo sapiens
aggaaaatgagtattt

SEQ ID NO: 2980562 - DNA, 21 bp, Homo sapiens
aggaaaatgtatccagaggaa

SEQ ID NO: 2980563 - DNA, 18 bp, Homo sapiens
aggaaacatatttaagaa

SEQ ID NO: 2980564 - DNA, 15 bp, Homo sapiens
aggaaagacaacaca

SEQ ID NO: 2980565 - DNA, 21 bp, Homo sapiens
aggaaagatgatgctcagttt

SEQ ID NO: 2980566 - DNA, 16 bp, Homo sapiens
aggaaagcaataaatg

SEQ ID NO: 2980567 - DNA, 19 bp, Homo sapiens
aggaaagcaataaatgaat

SEQ ID NO: 2980568 - DNA, 19 bp, Homo sapiens
aggaaagcagttgaaatga

SEQ ID NO: 2980569 - DNA, 22 bp, Homo sapiens
aggaaagctttggcagtgtttt

SEQ ID NO: 2980570 - DNA, 14 bp, Homo sapiens
aggaaaggcagatg

SEQ ID NO: 2980571 - DNA, 14 bp, Homo sapiens
aggaaaggccagct

SEQ ID NO: 2980572 - DNA, 22 bp, Homo sapiens
aggaaaggccagctggcagcag

SEQ ID NO: 2980573 - DNA, 16 bp, Homo sapiens
aggaaagggcctggcc

SEQ ID NO: 2980574 - DNA, 22 bp, Homo sapiens
aggaaagggcctggccagtcct

SEQ ID NO: 2980575 - DNA, 16 bp, Homo sapiens
aggaaataaaattaat

SEQ ID NO: 2980576 - DNA, 21 bp, Homo sapiens
aggaaataaagggataaagaa

SEQ ID NO: 2980577 - DNA, 21 bp, Homo sapiens
aggaaatcaacttgcttatca

SEQ ID NO: 2980578 - DNA, 19 bp, Homo sapiens
aggaaatgaaaatgtcttg

SEQ ID NO: 2980579 - DNA, 20 bp, Homo sapiens
aggaaatggctgtggagtgt

SEQ ID NO: 2980580 - DNA, 23 bp, Homo sapiens
aggaaatgtggtagcctcacttt

SEQ ID NO: 2980581 - DNA, 23 bp, Homo sapiens
aggaaattgtacataagtacctc

SEQ ID NO: 2980582 - DNA, 16 bp, Homo sapiens
aggaacatatgaaaat

SEQ ID NO: 2980583 - DNA, 17 bp, Homo sapiens
aggaaccacaccacatc

SEQ ID NO: 2980584 - DNA, 16 bp, Homo sapiens
aggaacctcgagtact

SEQ ID NO: 2980585 - DNA, 12 bp, Homo sapiens
aggaacggccct

SEQ ID NO: 2980586 - DNA, 13 bp, Homo sapiens
aggaacggccctg

SEQ ID NO: 2980587 - DNA, 20 bp, Homo sapiens
aggaacggtaaatttctgtg

SEQ ID NO: 2980588 - DNA, 22 bp, Homo sapiens
aggaactcgcacctgtgctgga

SEQ ID NO: 2980589 - DNA, 15 bp, Homo sapiens
aggaactcgcctcag

SEQ ID NO: 2980590 - DNA, 14 bp, Homo sapiens
aggaagaaaacgga

SEQ ID NO: 2980591 - DNA, 16 bp, Homo sapiens
aggaagaacgtttttt

SEQ ID NO: 2980592 - DNA, 17 bp, Homo sapiens
aggaagaattttaaaaa

SEQ ID NO: 2980593 - DNA, 20 bp, Homo sapiens
aggaagaattttaaaaatga

SEQ ID NO: 2980594 - DNA, 17 bp, Homo sapiens
aggaagaccaaggcctc

SEQ ID NO: 2980595 - DNA, 14 bp, Homo sapiens
aggaagactggaga

SEQ ID NO: 2980596 - DNA, 18 bp, Homo sapiens
aggaagactggagaaatg

SEQ ID NO: 2980597 - DNA, 16 bp, Homo sapiens
aggaagagctaataaa

SEQ ID NO: 2980598 - DNA, 11 bp, Homo sapiens
aggaagcaggg

SEQ ID NO: 2980599 - DNA, 12 bp, Homo sapiens
aggaagcaggga

SEQ ID NO: 2980600 - DNA, 13 bp, Homo sapiens
aggaagcagggag

SEQ ID NO: 2980601 - DNA, 14 bp, Homo sapiens
aggaagcagggaga

SEQ ID NO: 2980602 - DNA, 19 bp, Homo sapiens
aggaagcagggagagttgg

SEQ ID NO: 2980603 - DNA, 17 bp, Homo sapiens
aggaagcccactgcctc

SEQ ID NO: 2980604 - DNA, 19 bp, Homo sapiens
aggaagccggggaagagat

SEQ ID NO: 2980605 - DNA, 17 bp, Homo sapiens
aggaagctgctccgtgc

SEQ ID NO: 2980606 - DNA, 17 bp, Homo sapiens
aggaagctgtgttgaaa

SEQ ID NO: 2980607 - DNA, 20 bp, Homo sapiens
aggaagctgtgttgaaacag

SEQ ID NO: 2980608 - DNA, 14 bp, Homo sapiens
aggaaggaaaacta

SEQ ID NO: 2980609 - DNA, 19 bp, Homo sapiens
aggaaggacttacccagta

SEQ ID NO: 2980610 - DNA, 19 bp, Homo sapiens
aggaaggagactcacctct

SEQ ID NO: 2980611 - DNA, 21 bp, Homo sapiens
aggagcgctagtgccttgccc

SEQ ID NO: 2980612 - DNA, 21 bp, Homo sapiens
aggagcggcgccctggacttg

SEQ ID NO: 2980613 - DNA, 15 bp, Homo sapiens
aggagcgggcagggc

SEQ ID NO: 2980614 - DNA, 20 bp, Homo sapiens
aggagctaaggctctatgag

SEQ ID NO: 2980615 - DNA, 12 bp, Homo sapiens
aggagctctgcg

SEQ ID NO: 2980616 - DNA, 24 bp, Homo sapiens
aggagctctgcgccaggcagagct

SEQ ID NO: 2980617 - DNA, 11 bp, Homo sapiens
aggagctgcta

SEQ ID NO: 2980618 - DNA, 13 bp, Homo sapiens
aggagctgctata

SEQ ID NO: 2980619 - DNA, 19 bp, Homo sapiens
aggagctgctatagcctgg

SEQ ID NO: 2980620 - DNA, 17 bp, Homo sapiens
aggagctgggaggaaaa

SEQ ID NO: 2980621 - DNA, 14 bp, Homo sapiens
aggagcttctgggg

SEQ ID NO: 2980622 - DNA, 17 bp, Homo sapiens
aggagctttcttgtttc

SEQ ID NO: 2980623 - DNA, 13 bp, Homo sapiens
aggaggacaattc

SEQ ID NO: 2980624 - DNA, 14 bp, Homo sapiens
aggaggacaattca

SEQ ID NO: 2980625 - DNA, 22 bp, Homo sapiens
aggaggacaattcatgaacttc

SEQ ID NO: 2980626 - DNA, 18 bp, Homo sapiens
aggaggaggattgtgctg

SEQ ID NO: 2980627 - DNA, 15 bp, Homo sapiens
aggaggaggcatgga

SEQ ID NO: 2980628 - DNA, 11 bp, Homo sapiens
aggaggaggct

SEQ ID NO: 2980629 - DNA, 14 bp, Homo sapiens
aggaggcaggacct

SEQ ID NO: 2980630 - DNA, 20 bp, Homo sapiens
aggaggcaggcatggccctg

SEQ ID NO: 2980631 - DNA, 22 bp, Homo sapiens
aggaggcaggcatggccctggg

SEQ ID NO: 2980632 - DNA, 13 bp, Homo sapiens
aggaggcgcggcc

SEQ ID NO: 2980633 - DNA, 19 bp, Homo sapiens
aggaggctccagagggcac

SEQ ID NO: 2980634 - DNA, 20 bp, Homo sapiens
aggaggctgccctgaggggc

SEQ ID NO: 2980635 - DNA, 22 bp, Homo sapiens
aggagggcactggagctgggag

SEQ ID NO: 2980636 - DNA, 13 bp, Homo sapiens
aggagggcaggca

SEQ ID NO: 2980637 - DNA, 15 bp, Homo sapiens
aggagggcaggcatc

SEQ ID NO: 2980638 - DNA, 17 bp, Homo sapiens
aggagggcgttcttagg

SEQ ID NO: 2980639 - DNA, 20 bp, Homo sapiens
aggaggggaacactgccctc

SEQ ID NO: 2980640 - DNA, 20 bp, Homo sapiens
aggaggggacgggacagacg

SEQ ID NO: 2980641 - DNA, 19 bp, Homo sapiens
aggaggggcccccctgccc

SEQ ID NO: 2980642 - DNA, 20 bp, Homo sapiens
aggaggggcccggtggcggc

SEQ ID NO: 2980643 - DNA, 13 bp, Homo sapiens
aggaggggccgct

SEQ ID NO: 2980644 - DNA, 20 bp, Homo sapiens
aggaggtggaggttgcagtg

SEQ ID NO: 2980645 - DNA, 14 bp, Homo sapiens
aggaggtgggggct

SEQ ID NO: 2980646 - DNA, 21 bp, Homo sapiens
aggaggtgtgatagagccttt

SEQ ID NO: 2980647 - DNA, 15 bp, Homo sapiens
aggagtcaactggct

SEQ ID NO: 2980648 - DNA, 16 bp, Homo sapiens
aggagtcaactggctg

SEQ ID NO: 2980649 - DNA, 18 bp, Homo sapiens
aggagtcaccatgcaagg

SEQ ID NO: 2980650 - DNA, 19 bp, Homo sapiens
aggagtgtatgagtgtgag

SEQ ID NO: 2980651 - DNA, 14 bp, Homo sapiens
aggagtgtcctctt

SEQ ID NO: 2980652 - DNA, 20 bp, Homo sapiens
aggagttcaagaccagcctg

SEQ ID NO: 2980653 - DNA, 19 bp, Homo sapiens
aggagttccacagattgtt

SEQ ID NO: 2980654 - DNA, 15 bp, Homo sapiens
aggagttccagtgct

SEQ ID NO: 2980655 - DNA, 21 bp, Homo sapiens
aggagttgctgtttgtttgac

SEQ ID NO: 2980656 - DNA, 17 bp, Homo sapiens
aggagttgtgagccctc

SEQ ID NO: 2980657 - DNA, 21 bp, Homo sapiens
aggagttgtgagccctctagg

SEQ ID NO: 2980658 - DNA, 19 bp, Homo sapiens
aggagtttgagaccaggct

SEQ ID NO: 2980659 - DNA, 17 bp, Homo sapiens
aggataatgaaataatc

SEQ ID NO: 2980660 - DNA, 17 bp, Homo sapiens
aggatactcaaagtgga

SEQ ID NO: 2980661 - DNA, 14 bp, Homo sapiens
aggatagagactgg

SEQ ID NO: 2980662 - DNA, 15 bp, Homo sapiens
aggatagatgctggc

SEQ ID NO: 2980663 - DNA, 19 bp, Homo sapiens
aggatagatgctggcccag

SEQ ID NO: 2980664 - DNA, 22 bp, Homo sapiens
aggatagatgctggcccagggc

SEQ ID NO: 2980665 - DNA, 20 bp, Homo sapiens
aggatagctaactgtaaatc

SEQ ID NO: 2980666 - DNA, 23 bp, Homo sapiens
aggatatgaaactctacatttaa

SEQ ID NO: 2980667 - DNA, 15 bp, Homo sapiens
aggatattcttctct

SEQ ID NO: 2980668 - DNA, 19 bp, Homo sapiens
aggatattttcaacaatta

SEQ ID NO: 2980669 - DNA, 15 bp, Homo sapiens
aggatcacctgaggt

SEQ ID NO: 2980670 - DNA, 18 bp, Homo sapiens
aggatcacctgaggtcag

SEQ ID NO: 2980671 - DNA, 16 bp, Homo sapiens
aggatcatatgaattg

SEQ ID NO: 2980672 - DNA, 20 bp, Homo sapiens
aggatcccctgtcccctggg

SEQ ID NO: 2980673 - DNA, 15 bp, Homo sapiens
aggatccgtgctgtc

SEQ ID NO: 2980674 - DNA, 19 bp, Homo sapiens
aggatcctgagctgctgtt

SEQ ID NO: 2980675 - DNA, 16 bp, Homo sapiens
aggatctaaggctgtt

SEQ ID NO: 2980676 - DNA, 22 bp, Homo sapiens
aggatctcgcctggaaacagag

SEQ ID NO: 2980677 - DNA, 14 bp, Homo sapiens
aggatctgaaaact

SEQ ID NO: 2980678 - DNA, 16 bp, Homo sapiens
aggatctttgtggcca

SEQ ID NO: 2980679 - DNA, 18 bp, Homo sapiens
aggatctttgtggccaag

SEQ ID NO: 2980680 - DNA, 23 bp, Homo sapiens
aggatgacctcagggctatgtgg

SEQ ID NO: 2980681 - DNA, 11 bp, Homo sapiens
aggatgagggt

SEQ ID NO: 2980682 - DNA, 15 bp, Homo sapiens
aggatgatttcagaa

SEQ ID NO: 2980683 - DNA, 22 bp, Homo sapiens
aggatgatttcagaaggagaag

SEQ ID NO: 2980684 - DNA, 21 bp, Homo sapiens
aggatgccttagcatgtgact

SEQ ID NO: 2980685 - DNA, 13 bp, Homo sapiens
aggatgctgctgt

SEQ ID NO: 2980686 - DNA, 22 bp, Homo sapiens
aggatggctggctctgcacctg

SEQ ID NO: 2980687 - DNA, 15 bp, Homo sapiens
aggatggtgttactg

SEQ ID NO: 2980688 - DNA, 20 bp, Homo sapiens
aggatgtaaacagtgcctgc

SEQ ID NO: 2980689 - DNA, 21 bp, Homo sapiens
aggatgtaaacagtgcctgct

SEQ ID NO: 2980690 - DNA, 16 bp, Homo sapiens
aggatgtagcttttca

SEQ ID NO: 2980691 - DNA, 19 bp, Homo sapiens
aggatgtcactcagatgga

SEQ ID NO: 2980692 - DNA, 20 bp, Homo sapiens
aggatgtgattgtggaatgg

SEQ ID NO: 2980693 - DNA, 14 bp, Homo sapiens
aggattacagaaac

SEQ ID NO: 2980694 - DNA, 13 bp, Homo sapiens
aggattaggcaaa

SEQ ID NO: 2980695 - DNA, 22 bp, Homo sapiens
aggattaggcaaaaataattta

SEQ ID NO: 2980696 - DNA, 18 bp, Homo sapiens
aggattaggggatgggga

SEQ ID NO: 2980697 - DNA, 14 bp, Homo sapiens
aggattctaaaatg

SEQ ID NO: 2980698 - DNA, 22 bp, Homo sapiens
aggattctcatgggaaggggag

SEQ ID NO: 2980699 - DNA, 12 bp, Homo sapiens
aggattgtgctg

SEQ ID NO: 2980700 - DNA, 18 bp, Homo sapiens
aggatttcttaaattttt

SEQ ID NO: 2980701 - DNA, 16 bp, Homo sapiens
aggatttggttgttta

SEQ ID NO: 2980702 - DNA, 22 bp, Homo sapiens
aggattttagctaggatttgaa

SEQ ID NO: 2980703 - DNA, 17 bp, Homo sapiens
aggattttgtattgcca

SEQ ID NO: 2980704 - DNA, 18 bp, Homo sapiens
aggattttgtattgccat

SEQ ID NO: 2980705 - DNA, 22 bp, Homo sapiens
aggcaaaaataatttattttgc

SEQ ID NO: 2980706 - DNA, 22 bp, Homo sapiens
aggcaaacccatcaacaaaaat

SEQ ID NO: 2980707 - DNA, 14 bp, Homo sapiens
aggcaaagctggct

SEQ ID NO: 2980708 - DNA, 14 bp, Homo sapiens
aggcaaatgtgtac

SEQ ID NO: 2980709 - DNA, 17 bp, Homo sapiens
aggcaagccatggagtg

SEQ ID NO: 2980710 - DNA, 12 bp, Homo sapiens
aggcaagccctg

SEQ ID NO: 2980711 - DNA, 14 bp, Homo sapiens
aggcaataaaaatc

SEQ ID NO: 2980712 - DNA, 17 bp, Homo sapiens
aggcaataaaaatcata

SEQ ID NO: 2980713 - DNA, 22 bp, Homo sapiens
aggcaatgattgttaatttaca

SEQ ID NO: 2980714 - DNA, 19 bp, Homo sapiens
aggcaattctcctgccttt

SEQ ID NO: 2980715 - DNA, 11 bp, Homo sapiens
aggcacacagc

SEQ ID NO: 2980716 - DNA, 13 bp, Homo sapiens
aggcacatggctg

SEQ ID NO: 2980717 - DNA, 15 bp, Homo sapiens
aggcacatggctggg

SEQ ID NO: 2980718 - DNA, 17 bp, Homo sapiens
aggcacatggctggggg

SEQ ID NO: 2980719 - DNA, 14 bp, Homo sapiens
aggcacattaactg

SEQ ID NO: 2980720 - DNA, 22 bp, Homo sapiens
aggcacccaccaccatgcccag

SEQ ID NO: 2980721 - DNA, 20 bp, Homo sapiens
aggcacccctttccccagcc

SEQ ID NO: 2980722 - DNA, 16 bp, Homo sapiens
aggcaccgcagcctgt

SEQ ID NO: 2980723 - DNA, 15 bp, Homo sapiens
aggcaccgggctggc

SEQ ID NO: 2980724 - DNA, 17 bp, Homo sapiens
aggcaccgggctggctg

SEQ ID NO: 2980725 - DNA, 18 bp, Homo sapiens
aggcaccgggctggctgc

SEQ ID NO: 2980726 - DNA, 19 bp, Homo sapiens
aggcaccgggctggctgct

SEQ ID NO: 2980727 - DNA, 18 bp, Homo sapiens
aggcacctcaagaagaag

SEQ ID NO: 2980728 - DNA, 17 bp, Homo sapiens
aggcacgaacccacctg

SEQ ID NO: 2980729 - DNA, 14 bp, Homo sapiens
aggcactctagatt

SEQ ID NO: 2980730 - DNA, 13 bp, Homo sapiens
aggcactgaagcc

SEQ ID NO: 2980731 - DNA, 16 bp, Homo sapiens
aggcactgagaatgat

SEQ ID NO: 2980732 - DNA, 16 bp, Homo sapiens
aggcactgtagttcta

SEQ ID NO: 2980733 - DNA, 17 bp, Homo sapiens
aggcactgtagttctaa

SEQ ID NO: 2980734 - DNA, 20 bp, Homo sapiens
aggcacttcctcccctcgcc

SEQ ID NO: 2980735 - DNA, 14 bp, Homo sapiens
aggcactttggggg

SEQ ID NO: 2980736 - DNA, 14 bp, Homo sapiens
aggcagaaatataa

SEQ ID NO: 2980737 - DNA, 21 bp, Homo sapiens
aggcagaagaattgaacccag

SEQ ID NO: 2980738 - DNA, 22 bp, Homo sapiens
aggcagaagaattgaacccagg

SEQ ID NO: 2980739 - DNA, 14 bp, Homo sapiens
aggcagagcgggag

SEQ ID NO: 2980740 - DNA, 15 bp, Homo sapiens
aggcagagcgggagg

SEQ ID NO: 2980741 - DNA, 13 bp, Homo sapiens
aggcagagctgag

SEQ ID NO: 2980742 - DNA, 15 bp, Homo sapiens
aggcagaggttgcag

SEQ ID NO: 2980743 - DNA, 18 bp, Homo sapiens
aggcagataactgctgta

SEQ ID NO: 2980744 - DNA, 11 bp, Homo sapiens
agggcctggcc

SEQ ID NO: 2980745 - DNA, 14 bp, Homo sapiens
agggcctggccagt

SEQ ID NO: 2980746 - DNA, 15 bp, Homo sapiens
agggcctggccagtc

SEQ ID NO: 2980747 - DNA, 16 bp, Homo sapiens
agggcctggccagtcc

SEQ ID NO: 2980748 - DNA, 17 bp, Homo sapiens
agggcctggccagtcct

SEQ ID NO: 2980749 - DNA, 18 bp, Homo sapiens
agggcctggccagtcctg

SEQ ID NO: 2980750 - DNA, 23 bp, Homo sapiens
agggcctggccagtcctggtcct

SEQ ID NO: 2980751 - DNA, 17 bp, Homo sapiens
agggcctggtccctggg

SEQ ID NO: 2980752 - DNA, 17 bp, Homo sapiens
agggcctggttgaagaa

SEQ ID NO: 2980753 - DNA, 12 bp, Homo sapiens
agggccttgccc

SEQ ID NO: 2980754 - DNA, 15 bp, Homo sapiens
agggccttttctggc

SEQ ID NO: 2980755 - DNA, 20 bp, Homo sapiens
agggccttttctggcaccgc

SEQ ID NO: 2980756 - DNA, 15 bp, Homo sapiens
agggcgcaaagggca

SEQ ID NO: 2980757 - DNA, 17 bp, Homo sapiens
agggcgcaaagggcatg

SEQ ID NO: 2980758 - DNA, 19 bp, Homo sapiens
agggcgcccagcagcctgc

SEQ ID NO: 2980759 - DNA, 23 bp, Homo sapiens
agggcgcccagcagcctgccagc

SEQ ID NO: 2980760 - DNA, 13 bp, Homo sapiens
agggcggccaggg

SEQ ID NO: 2980761 - DNA, 14 bp, Homo sapiens
agggcggccaggga

SEQ ID NO: 2980762 - DNA, 17 bp, Homo sapiens
agggcgggcagagggct

SEQ ID NO: 2980763 - DNA, 15 bp, Homo sapiens
agggctaccctgagc

SEQ ID NO: 2980764 - DNA, 21 bp, Homo sapiens
agggctagtgaagtggcctct

SEQ ID NO: 2980765 - DNA, 15 bp, Homo sapiens
agggctcagggcagt

SEQ ID NO: 2980766 - DNA, 15 bp, Homo sapiens
agggctccctgccat

SEQ ID NO: 2980767 - DNA, 12 bp, Homo sapiens
agggctgctggg

SEQ ID NO: 2980768 - DNA, 17 bp, Homo sapiens
agggctggaggcccagg

SEQ ID NO: 2980769 - DNA, 17 bp, Homo sapiens
agggctggctggcctca

SEQ ID NO: 2980770 - DNA, 15 bp, Homo sapiens
agggctggtttgttc

SEQ ID NO: 2980771 - DNA, 18 bp, Homo sapiens
agggctgtcatctgtgca

SEQ ID NO: 2980772 - DNA, 13 bp, Homo sapiens
agggcttcctctt

SEQ ID NO: 2980773 - DNA, 18 bp, Homo sapiens
agggcttgacacctttga

SEQ ID NO: 2980774 - DNA, 21 bp, Homo sapiens
agggctttcagcgcccccagg

SEQ ID NO: 2980775 - DNA, 18 bp, Homo sapiens
agggctttgttttgcaca

SEQ ID NO: 2980776 - DNA, 22 bp, Homo sapiens
agggcttttattttttcttttg

SEQ ID NO: 2980777 - DNA, 17 bp, Homo sapiens
aggggaaacgtctccca

SEQ ID NO: 2980778 - DNA, 18 bp, Homo sapiens
aggggaacactgccctcg

SEQ ID NO: 2980779 - DNA, 22 bp, Homo sapiens
aggggaagaaacactttctctt

SEQ ID NO: 2980780 - DNA, 13 bp, Homo sapiens
aggggaagggcag

SEQ ID NO: 2980781 - DNA, 17 bp, Homo sapiens
aggggaagggcaggcac

SEQ ID NO: 2980782 - DNA, 23 bp, Homo sapiens
aggggacaagggaggcagtggct

SEQ ID NO: 2980783 - DNA, 18 bp, Homo sapiens
aggggaccagagggatgg

SEQ ID NO: 2980784 - DNA, 24 bp, Homo sapiens
aggggacgcaggcccctctcctcc

SEQ ID NO: 2980785 - DNA, 17 bp, Homo sapiens
aggggacgtgggccctg

SEQ ID NO: 2980786 - DNA, 13 bp, Homo sapiens
aggggactgggcc

SEQ ID NO: 2980787 - DNA, 19 bp, Homo sapiens
aggggagaatgcagcccac

SEQ ID NO: 2980788 - DNA, 22 bp, Homo sapiens
aggggagcagcggctctggtcc

SEQ ID NO: 2980789 - DNA, 12 bp, Homo sapiens
aggggagcccac

SEQ ID NO: 2980790 - DNA, 13 bp, Homo sapiens
aggggagcccact

SEQ ID NO: 2980791 - DNA, 24 bp, Homo sapiens
aggggagcccactgtcctgggcct

SEQ ID NO: 2980792 - DNA, 15 bp, Homo sapiens
aggggaggccttcca

SEQ ID NO: 2980793 - DNA, 19 bp, Homo sapiens
aggggatctggaagggcca

SEQ ID NO: 2980794 - DNA, 12 bp, Homo sapiens
aggggcaggagg

SEQ ID NO: 2980795 - DNA, 12 bp, Homo sapiens
aggggccagagg

SEQ ID NO: 2980796 - DNA, 13 bp, Homo sapiens
aggggccagaggc

SEQ ID NO: 2980797 - DNA, 14 bp, Homo sapiens
aggggccagaggct

SEQ ID NO: 2980798 - DNA, 13 bp, Homo sapiens
aggggccagggct

SEQ ID NO: 2980799 - DNA, 16 bp, Homo sapiens
aggggcccccctgccc

SEQ ID NO: 2980800 - DNA, 18 bp, Homo sapiens
aggggcccccctgccctg

SEQ ID NO: 2980801 - DNA, 14 bp, Homo sapiens
aggggcccctggcc

SEQ ID NO: 2980802 - DNA, 23 bp, Homo sapiens
aggggcccggccagccatgtctg

SEQ ID NO: 2980803 - DNA, 17 bp, Homo sapiens
aggggcccggtggcggc

SEQ ID NO: 2980804 - DNA, 18 bp, Homo sapiens
aggggcccggtggcggca

SEQ ID NO: 2980805 - DNA, 15 bp, Homo sapiens
aggggccctccgagg

SEQ ID NO: 2980806 - DNA, 16 bp, Homo sapiens
aggggccgctgccacc

SEQ ID NO: 2980807 - DNA, 22 bp, Homo sapiens
aggggccgctgccacccacctc

SEQ ID NO: 2980808 - DNA, 15 bp, Homo sapiens
aggggccggccctgt

SEQ ID NO: 2980809 - DNA, 17 bp, Homo sapiens
aggggccggggaggggg

SEQ ID NO: 2980810 - DNA, 23 bp, Homo sapiens
aggggccggggagggggcacggc

SEQ ID NO: 2980811 - DNA, 16 bp, Homo sapiens
aggggcctaggcctca

SEQ ID NO: 2980812 - DNA, 20 bp, Homo sapiens
aggggcgggtggatcacctg

SEQ ID NO: 2980813 - DNA, 19 bp, Homo sapiens
aggggcgtctgttccccct

SEQ ID NO: 2980814 - DNA, 21 bp, Homo sapiens
aggggcgtctgttcccccttc

SEQ ID NO: 2980815 - DNA, 22 bp, Homo sapiens
aggggcgtctgttcccccttca

SEQ ID NO: 2980816 - DNA, 22 bp, Homo sapiens
aggggctgctgacctccacagc

SEQ ID NO: 2980817 - DNA, 12 bp, Homo sapiens
aggggctgctgg

SEQ ID NO: 2980818 - DNA, 15 bp, Homo sapiens
aggggctgctggggg

SEQ ID NO: 2980819 - DNA, 23 bp, Homo sapiens
aggggctgctgggggctcccctt

SEQ ID NO: 2980820 - DNA, 22 bp, Homo sapiens
aggggctggggagggggtacct

SEQ ID NO: 2980821 - DNA, 16 bp, Homo sapiens
aggggcttcaggtcca

SEQ ID NO: 2980822 - DNA, 18 bp, Homo sapiens
agggggaccatggggagg

SEQ ID NO: 2980823 - DNA, 15 bp, Homo sapiens
agggggagagggctg

SEQ ID NO: 2980824 - DNA, 22 bp, Homo sapiens
agggggcctggagcatggacag

SEQ ID NO: 2980825 - DNA, 21 bp, Homo sapiens
agggggcggggactgctggct

SEQ ID NO: 2980826 - DNA, 13 bp, Homo sapiens
agggggtaaggcc

SEQ ID NO: 2980827 - DNA, 19 bp, Homo sapiens
agggggtgaaggcaggagt

SEQ ID NO: 2980828 - DNA, 14 bp, Homo sapiens
aggggtcaggtgtc

SEQ ID NO: 2980829 - DNA, 21 bp, Homo sapiens
aggggtcgacttcgggctggc

SEQ ID NO: 2980830 - DNA, 14 bp, Homo sapiens
aggggtgacacaga

SEQ ID NO: 2980831 - DNA, 22 bp, Homo sapiens
aggggtggccatctcctgccct

SEQ ID NO: 2980832 - DNA, 17 bp, Homo sapiens
aggggtggccgggcaca

SEQ ID NO: 2980833 - DNA, 17 bp, Homo sapiens
aggggtggctgggtctt

SEQ ID NO: 2980834 - DNA, 11 bp, Homo sapiens
aggggtggggg

SEQ ID NO: 2980835 - DNA, 24 bp, Homo sapiens
aggggtggtggggggcagggccac

SEQ ID NO: 2980836 - DNA, 24 bp, Homo sapiens
aggggttaatttatcagtacatga

SEQ ID NO: 2980837 - DNA, 20 bp, Homo sapiens
aggggttcttgagccagcca

SEQ ID NO: 2980838 - DNA, 19 bp, Homo sapiens
agggtaccaggataaagcc

SEQ ID NO: 2980839 - DNA, 15 bp, Homo sapiens
agggtagcaggtacc

SEQ ID NO: 2980840 - DNA, 18 bp, Homo sapiens
agggtattgcttgccact

SEQ ID NO: 2980841 - DNA, 21 bp, Homo sapiens
agggtcagacgcctgaggaac

SEQ ID NO: 2980842 - DNA, 18 bp, Homo sapiens
agggtccagaaggagaca

SEQ ID NO: 2980843 - DNA, 21 bp, Homo sapiens
agggtccagaaggagacaggc

SEQ ID NO: 2980844 - DNA, 15 bp, Homo sapiens
agggtcccctgccac

SEQ ID NO: 2980845 - DNA, 20 bp, Homo sapiens
agggtcctttagtacctgaa

SEQ ID NO: 2980846 - DNA, 15 bp, Homo sapiens
agggtcgaaagctct

SEQ ID NO: 2980847 - DNA, 20 bp, Homo sapiens
agggtctaccaatacaaaat

SEQ ID NO: 2980848 - DNA, 16 bp, Homo sapiens
agggtctagccgctgc

SEQ ID NO: 2980849 - DNA, 16 bp, Homo sapiens
agggtctagggagaga

SEQ ID NO: 2980850 - DNA, 14 bp, Homo sapiens
agggtctctgctcc

SEQ ID NO: 2980851 - DNA, 21 bp, Homo sapiens
agggtctgggaaatgagcagg

SEQ ID NO: 2980852 - DNA, 14 bp, Homo sapiens
agggtcttgggaaa

SEQ ID NO: 2980853 - DNA, 18 bp, Homo sapiens
agggtgagaggaagggtg

SEQ ID NO: 2980854 - DNA, 14 bp, Homo sapiens
agggtgagctggtg

SEQ ID NO: 2980855 - DNA, 19 bp, Homo sapiens
agggtgagctggtgcctgc

SEQ ID NO: 2980856 - DNA, 20 bp, Homo sapiens
agggtgagctggtgcctgct

SEQ ID NO: 2980857 - DNA, 19 bp, Homo sapiens
agggtgatgccaggttcta

SEQ ID NO: 2980858 - DNA, 15 bp, Homo sapiens
agggtgcagccacac

SEQ ID NO: 2980859 - DNA, 21 bp, Homo sapiens
agggtgccatccacattttaa

SEQ ID NO: 2980860 - DNA, 23 bp, Homo sapiens
agggtgccatccacattttaaca

SEQ ID NO: 2980861 - DNA, 18 bp, Homo sapiens
agggtgcccttttccagc

SEQ ID NO: 2980862 - DNA, 17 bp, Homo sapiens
agggtgcgtctgggagg

SEQ ID NO: 2980863 - DNA, 20 bp, Homo sapiens
agggtgctaggcccctgtgt

SEQ ID NO: 2980864 - DNA, 22 bp, Homo sapiens
agggtgctgccccatgaagcca

SEQ ID NO: 2980865 - DNA, 23 bp, Homo sapiens
agggtggcacatctgtcctgaca

SEQ ID NO: 2980866 - DNA, 14 bp, Homo sapiens
agggtggcaggtca

SEQ ID NO: 2980867 - DNA, 18 bp, Homo sapiens
agggtggcccaggtggct

SEQ ID NO: 2980868 - DNA, 16 bp, Homo sapiens
agggtgggaaggggct

SEQ ID NO: 2980869 - DNA, 17 bp, Homo sapiens
agggtgggaaggggcta

SEQ ID NO: 2980870 - DNA, 19 bp, Homo sapiens
agggtgggtttgagatgtt

SEQ ID NO: 2980871 - DNA, 12 bp, Homo sapiens
agggtggtggta

SEQ ID NO: 2980872 - DNA, 18 bp, Homo sapiens
agggtggtggtattctgt

SEQ ID NO: 2980873 - DNA, 15 bp, Homo sapiens
agggtgtcctgaggt

SEQ ID NO: 2980874 - DNA, 12 bp, Homo sapiens
agggtgtgtgct

SEQ ID NO: 2980875 - DNA, 18 bp, Homo sapiens
agggttattgcatttgga

SEQ ID NO: 2980876 - DNA, 21 bp, Homo sapiens
agtccaaaaagctcctggggc

SEQ ID NO: 2980877 - DNA, 14 bp, Homo sapiens
agtccaagaatcca

SEQ ID NO: 2980878 - DNA, 19 bp, Homo sapiens
agtccaagagggtccttta

SEQ ID NO: 2980879 - DNA, 13 bp, Homo sapiens
agtccaaggttta

SEQ ID NO: 2980880 - DNA, 14 bp, Homo sapiens
agtccaattttaat

SEQ ID NO: 2980881 - DNA, 15 bp, Homo sapiens
agtccaattttaatt

SEQ ID NO: 2980882 - DNA, 19 bp, Homo sapiens
agtccaattttaatttagt

SEQ ID NO: 2980883 - DNA, 17 bp, Homo sapiens
agtccaggactgggtct

SEQ ID NO: 2980884 - DNA, 18 bp, Homo sapiens
agtccaggactgggtctg

SEQ ID NO: 2980885 - DNA, 22 bp, Homo sapiens
agtccaggactgggtctgacct

SEQ ID NO: 2980886 - DNA, 20 bp, Homo sapiens
agtcccaccttggagcattt

SEQ ID NO: 2980887 - DNA, 12 bp, Homo sapiens
agtcccagagct

SEQ ID NO: 2980888 - DNA, 13 bp, Homo sapiens
agtccccaggccc

SEQ ID NO: 2980889 - DNA, 19 bp, Homo sapiens
agtccccaggccccaggaa

SEQ ID NO: 2980890 - DNA, 16 bp, Homo sapiens
agtcccccttcaatct

SEQ ID NO: 2980891 - DNA, 22 bp, Homo sapiens
agtccctcacgtttcttcccca

SEQ ID NO: 2980892 - DNA, 20 bp, Homo sapiens
agtccctgcttatgatgggc

SEQ ID NO: 2980893 - DNA, 20 bp, Homo sapiens
agtccctgggggaagccctg

SEQ ID NO: 2980894 - DNA, 16 bp, Homo sapiens
agtccctgtgttctgc

SEQ ID NO: 2980895 - DNA, 17 bp, Homo sapiens
agtccgcctgcgcctcc

SEQ ID NO: 2980896 - DNA, 14 bp, Homo sapiens
agtccgtcaaaaca

SEQ ID NO: 2980897 - DNA, 20 bp, Homo sapiens
agtccgtgctgacagctgct

SEQ ID NO: 2980898 - DNA, 22 bp, Homo sapiens
agtccgtgctgacagctgctcc

SEQ ID NO: 2980899 - DNA, 16 bp, Homo sapiens
agtcctagtgaacctc

SEQ ID NO: 2980900 - DNA, 16 bp, Homo sapiens
agtcctagttttccta

SEQ ID NO: 2980901 - DNA, 15 bp, Homo sapiens
agtcctatggaaacc

SEQ ID NO: 2980902 - DNA, 12 bp, Homo sapiens
agtcctctgcct

SEQ ID NO: 2980903 - DNA, 20 bp, Homo sapiens
agtcctgatcagagccgtgg

SEQ ID NO: 2980904 - DNA, 14 bp, Homo sapiens
agtcctgcctttgg

SEQ ID NO: 2980905 - DNA, 12 bp, Homo sapiens
agtcctgctggc

SEQ ID NO: 2980906 - DNA, 15 bp, Homo sapiens
agtcctgctggcctg

SEQ ID NO: 2980907 - DNA, 18 bp, Homo sapiens
agtcctgctggcctgctc

SEQ ID NO: 2980908 - DNA, 15 bp, Homo sapiens
agtcctggcttcagg

SEQ ID NO: 2980909 - DNA, 14 bp, Homo sapiens
agtcctggtcctgg

SEQ ID NO: 2980910 - DNA, 17 bp, Homo sapiens
agtcctggtcctggctg

SEQ ID NO: 2980911 - DNA, 19 bp, Homo sapiens
agtcctggtctgctcagga

SEQ ID NO: 2980912 - DNA, 20 bp, Homo sapiens
agtcctggtctgctcaggaa

SEQ ID NO: 2980913 - DNA, 16 bp, Homo sapiens
agtcctgtatgtctgt

SEQ ID NO: 2980914 - DNA, 17 bp, Homo sapiens
agtcctgtatgtctgtc

SEQ ID NO: 2980915 - DNA, 24 bp, Homo sapiens
agtccttaaaatgtaagattatag

SEQ ID NO: 2980916 - DNA, 17 bp, Homo sapiens
agtccttcacctcactg

SEQ ID NO: 2980917 - DNA, 20 bp, Homo sapiens
agtcctttataagttgcttt

SEQ ID NO: 2980918 - DNA, 20 bp, Homo sapiens
agtccttttactacagctat

SEQ ID NO: 2980919 - DNA, 14 bp, Homo sapiens
agtccttttgtaaa

SEQ ID NO: 2980920 - DNA, 15 bp, Homo sapiens
agtccttttgtaaag

SEQ ID NO: 2980921 - DNA, 23 bp, Homo sapiens
agtccttttgtaaagtgaagaat

SEQ ID NO: 2980922 - DNA, 14 bp, Homo sapiens
agtcgaggctgcag

SEQ ID NO: 2980923 - DNA, 23 bp, Homo sapiens
agtcgaggctgcagtcagccctg

SEQ ID NO: 2980924 - DNA, 19 bp, Homo sapiens
agtcgatagagctgtatta

SEQ ID NO: 2980925 - DNA, 15 bp, Homo sapiens
agtcgatgaactatt

SEQ ID NO: 2980926 - DNA, 12 bp, Homo sapiens
agtcgctgcagg

SEQ ID NO: 2980927 - DNA, 12 bp, Homo sapiens
agtcggaaaagc

SEQ ID NO: 2980928 - DNA, 21 bp, Homo sapiens
agtcgtggctttggcagtgtt

SEQ ID NO: 2980929 - DNA, 20 bp, Homo sapiens
agtctaaagatggagtttct

SEQ ID NO: 2980930 - DNA, 21 bp, Homo sapiens
agtctaaagatggagtttcta

SEQ ID NO: 2980931 - DNA, 23 bp, Homo sapiens
agtctaaatattcagaatctttg

SEQ ID NO: 2980932 - DNA, 15 bp, Homo sapiens
agtctacgctctcct

SEQ ID NO: 2980933 - DNA, 18 bp, Homo sapiens
agtctactcttaagccat

SEQ ID NO: 2980934 - DNA, 22 bp, Homo sapiens
agtctacttcactaatgacgat

SEQ ID NO: 2980935 - DNA, 14 bp, Homo sapiens
agtctacttctgtg

SEQ ID NO: 2980936 - DNA, 14 bp, Homo sapiens
agtctagaagaatt

SEQ ID NO: 2980937 - DNA, 14 bp, Homo sapiens
agtctagaagttgt

SEQ ID NO: 2980938 - DNA, 20 bp, Homo sapiens
agtctagattcaaaggttct

SEQ ID NO: 2980939 - DNA, 22 bp, Homo sapiens
agtctagattcaaaggttctag

SEQ ID NO: 2980940 - DNA, 13 bp, Homo sapiens
agtctagattctc

SEQ ID NO: 2980941 - DNA, 14 bp, Homo sapiens
agtctagattctct

SEQ ID NO: 2980942 - DNA, 16 bp, Homo sapiens
agtctaggagctggga

SEQ ID NO: 2980943 - DNA, 18 bp, Homo sapiens
agtctaggagctgggagg

SEQ ID NO: 2980944 - DNA, 15 bp, Homo sapiens
agtctagtgtagtat

SEQ ID NO: 2980945 - DNA, 23 bp, Homo sapiens
agtctatcaaccccagacactgg

SEQ ID NO: 2980946 - DNA, 14 bp, Homo sapiens
agtctattagccac

SEQ ID NO: 2980947 - DNA, 20 bp, Homo sapiens
agtctatttttgtacaaaag

SEQ ID NO: 2980948 - DNA, 19 bp, Homo sapiens
agtctcaagggtggcaggt

SEQ ID NO: 2980949 - DNA, 16 bp, Homo sapiens
agtctcaattttgtat

SEQ ID NO: 2980950 - DNA, 17 bp, Homo sapiens
agtctcaattttgtatt

SEQ ID NO: 2980951 - DNA, 18 bp, Homo sapiens
agtctcaattttgtattt

SEQ ID NO: 2980952 - DNA, 16 bp, Homo sapiens
agtctccagaagaaaa

SEQ ID NO: 2980953 - DNA, 17 bp, Homo sapiens
agtctccagaagaaaat

SEQ ID NO: 2980954 - DNA, 20 bp, Homo sapiens
agtctcctaggggcttggtc

SEQ ID NO: 2980955 - DNA, 20 bp, Homo sapiens
agtctcctcccctactctgc

SEQ ID NO: 2980956 - DNA, 14 bp, Homo sapiens
agtctccttctctt

SEQ ID NO: 2980957 - DNA, 18 bp, Homo sapiens
agtctccttctcttctct

SEQ ID NO: 2980958 - DNA, 15 bp, Homo sapiens
agtctcgctctgtcg

SEQ ID NO: 2980959 - DNA, 14 bp, Homo sapiens
agtctctaattcta

SEQ ID NO: 2980960 - DNA, 20 bp, Homo sapiens
agtctctacccctttctgtt

SEQ ID NO: 2980961 - DNA, 16 bp, Homo sapiens
agtctctatcattaaa

SEQ ID NO: 2980962 - DNA, 20 bp, Homo sapiens
agtctctatcattaaagttc

SEQ ID NO: 2980963 - DNA, 13 bp, Homo sapiens
agtctctccagcc

SEQ ID NO: 2980964 - DNA, 15 bp, Homo sapiens
agtctctccagcctc

SEQ ID NO: 2980965 - DNA, 21 bp, Homo sapiens
agtctctccagcctcacagat

SEQ ID NO: 2980966 - DNA, 11 bp, Homo sapiens
agtctctgagc

SEQ ID NO: 2980967 - DNA, 13 bp, Homo sapiens
agtctctgccttg

SEQ ID NO: 2980968 - DNA, 12 bp, Homo sapiens
agtctctgctcc

SEQ ID NO: 2980969 - DNA, 13 bp, Homo sapiens
agtctctggctca

SEQ ID NO: 2980970 - DNA, 14 bp, Homo sapiens
agtctctggctcag

SEQ ID NO: 2980971 - DNA, 17 bp, Homo sapiens
agtctctggctcagctg

SEQ ID NO: 2980972 - DNA, 17 bp, Homo sapiens
agtctctttattcctag

SEQ ID NO: 2980973 - DNA, 23 bp, Homo sapiens
agtctgacttccccgcattccag

SEQ ID NO: 2980974 - DNA, 23 bp, Homo sapiens
agtctgagagaggccattctttc

SEQ ID NO: 2980975 - DNA, 19 bp, Homo sapiens
agtctgaggcacctgcata

SEQ ID NO: 2980976 - DNA, 16 bp, Homo sapiens
agtctgagggaaacca

SEQ ID NO: 2980977 - DNA, 18 bp, Homo sapiens
agtctgatcgtgacgctg

SEQ ID NO: 2980978 - DNA, 23 bp, Homo sapiens
agtctgatcgtgacgctgaataa

SEQ ID NO: 2980979 - DNA, 15 bp, Homo sapiens
agtctggagagctgt

SEQ ID NO: 2980980 - DNA, 21 bp, Homo sapiens
agtctggcaaacatgtgcaac

SEQ ID NO: 2980981 - DNA, 11 bp, Homo sapiens
agtctgggtca

SEQ ID NO: 2980982 - DNA, 17 bp, Homo sapiens
agtctgtattttccacc

SEQ ID NO: 2980983 - DNA, 18 bp, Homo sapiens
agtctgtcttctgtatat

SEQ ID NO: 2980984 - DNA, 16 bp, Homo sapiens
agtctgttgtgtgtca

SEQ ID NO: 2980985 - DNA, 22 bp, Homo sapiens
agtcttaacaaaccaacatctt

SEQ ID NO: 2980986 - DNA, 18 bp, Homo sapiens
agtcttaatttatttctt

SEQ ID NO: 2980987 - DNA, 19 bp, Homo sapiens
agtcttactacagaaatga

SEQ ID NO: 2980988 - DNA, 22 bp, Homo sapiens
agtcttatctgagctgagccag

SEQ ID NO: 2980989 - DNA, 16 bp, Homo sapiens
agtcttccatttgcaa

SEQ ID NO: 2980990 - DNA, 17 bp, Homo sapiens
agtcttccatttgcaag

SEQ ID NO: 2980991 - DNA, 19 bp, Homo sapiens
agtcttccatttgcaaggg

SEQ ID NO: 2980992 - DNA, 23 bp, Homo sapiens
agtcttcctcttagcctctggat

SEQ ID NO: 2980993 - DNA, 16 bp, Homo sapiens
agtcttgaatttctga

SEQ ID NO: 2980994 - DNA, 17 bp, Homo sapiens
agtcttgtcttagctct

SEQ ID NO: 2980995 - DNA, 20 bp, Homo sapiens
agtcttgtcttagctctgga

SEQ ID NO: 2980996 - DNA, 19 bp, Homo sapiens
agtctttaggtctttgtaa

SEQ ID NO: 2980997 - DNA, 16 bp, Homo sapiens
agtctttcacatttaa

SEQ ID NO: 2980998 - DNA, 18 bp, Homo sapiens
agtctttcacatttaaat

SEQ ID NO: 2980999 - DNA, 17 bp, Homo sapiens
agtctttgccagtcatt

SEQ ID NO: 2981000 - DNA, 16 bp, Homo sapiens
agtctttggttctaag

SEQ ID NO: 2981001 - DNA, 14 bp, Homo sapiens
agtcttttctctga

SEQ ID NO: 2981002 - DNA, 15 bp, Homo sapiens
agtcttttctctgaa

SEQ ID NO: 2981003 - DNA, 18 bp, Homo sapiens
agtcttttctctgaaaag

SEQ ID NO: 2981004 - DNA, 15 bp, Homo sapiens
agtgaaacacttgct

SEQ ID NO: 2981005 - DNA, 16 bp, Homo sapiens
agtgaaacacttgctt

SEQ ID NO: 2981006 - DNA, 16 bp, Homo sapiens
agtgaaagctagagat

SEQ ID NO: 2981007 - DNA, 17 bp, Homo sapiens
agtgaaatattgtaaat

SEQ ID NO: 2981008 - DNA, 19 bp, Homo sapiens
agtgaagacgtcaggggca

SEQ ID NO: 2981009 - DNA, 20 bp, Homo sapiens
agttgtctttctttgctgct

SEQ ID NO: 2981010 - DNA, 19 bp, Homo sapiens
agttgtgagccctctaggg

SEQ ID NO: 2981011 - DNA, 16 bp, Homo sapiens
agttgtgccaaactat

SEQ ID NO: 2981012 - DNA, 18 bp, Homo sapiens
agttgtggatttcagttt

SEQ ID NO: 2981013 - DNA, 15 bp, Homo sapiens
agttgtggtgtgagt

SEQ ID NO: 2981014 - DNA, 20 bp, Homo sapiens
agttgtggtgtgagtatcag

SEQ ID NO: 2981015 - DNA, 22 bp, Homo sapiens
agttgtgtttgttgctggcttg

SEQ ID NO: 2981016 - DNA, 19 bp, Homo sapiens
agttgttccttaagtcaga

SEQ ID NO: 2981017 - DNA, 15 bp, Homo sapiens
agttgtttaactgtg

SEQ ID NO: 2981018 - DNA, 15 bp, Homo sapiens
agttgtttgtgcctt

SEQ ID NO: 2981019 - DNA, 16 bp, Homo sapiens
agtttaaaaatcaact

SEQ ID NO: 2981020 - DNA, 18 bp, Homo sapiens
agtttaaaacagaagcct

SEQ ID NO: 2981021 - DNA, 14 bp, Homo sapiens
agtttaaattgtaa

SEQ ID NO: 2981022 - DNA, 13 bp, Homo sapiens
agtttaacttttt

SEQ ID NO: 2981023 - DNA, 17 bp, Homo sapiens
agtttaagacttagtta

SEQ ID NO: 2981024 - DNA, 13 bp, Homo sapiens
agtttacagaaaa

SEQ ID NO: 2981025 - DNA, 22 bp, Homo sapiens
agtttacatcatttttgtatct

SEQ ID NO: 2981026 - DNA, 15 bp, Homo sapiens
agtttactttgccaa

SEQ ID NO: 2981027 - DNA, 17 bp, Homo sapiens
agtttagaacagaggga

SEQ ID NO: 2981028 - DNA, 14 bp, Homo sapiens
agtttagtgcatct

SEQ ID NO: 2981029 - DNA, 14 bp, Homo sapiens
agtttataaagcca

SEQ ID NO: 2981030 - DNA, 15 bp, Homo sapiens
agtttataaagccaa

SEQ ID NO: 2981031 - DNA, 17 bp, Homo sapiens
agtttataaagccaaga

SEQ ID NO: 2981032 - DNA, 15 bp, Homo sapiens
agtttatacagtgta

SEQ ID NO: 2981033 - DNA, 18 bp, Homo sapiens
agtttatacagtgtacat

SEQ ID NO: 2981034 - DNA, 22 bp, Homo sapiens
agtttatacagtgtacatgtac

SEQ ID NO: 2981035 - DNA, 22 bp, Homo sapiens
agtttatatatatgctactttt

SEQ ID NO: 2981036 - DNA, 16 bp, Homo sapiens
agtttatcattcaagt

SEQ ID NO: 2981037 - DNA, 13 bp, Homo sapiens
agtttatttgttg

SEQ ID NO: 2981038 - DNA, 15 bp, Homo sapiens
agtttattttaagac

SEQ ID NO: 2981039 - DNA, 17 bp, Homo sapiens
agtttcaattcagtgct

SEQ ID NO: 2981040 - DNA, 20 bp, Homo sapiens
agtttcacagactcttacca

SEQ ID NO: 2981041 - DNA, 17 bp, Homo sapiens
agtttcactgccatata

SEQ ID NO: 2981042 - DNA, 16 bp, Homo sapiens
agtttcataattgtgt

SEQ ID NO: 2981043 - DNA, 15 bp, Homo sapiens
agtttcatgtacaag

SEQ ID NO: 2981044 - DNA, 16 bp, Homo sapiens
agtttcatgtgagttt

SEQ ID NO: 2981045 - DNA, 12 bp, Homo sapiens
agtttcctgaaa

SEQ ID NO: 2981046 - DNA, 19 bp, Homo sapiens
agtttccttccagcccaga

SEQ ID NO: 2981047 - DNA, 20 bp, Homo sapiens
agtttcgaggggtcctcacc

SEQ ID NO: 2981048 - DNA, 14 bp, Homo sapiens
agtttctaagattc

SEQ ID NO: 2981049 - DNA, 18 bp, Homo sapiens
agtttctaagattctaaa

SEQ ID NO: 2981050 - DNA, 20 bp, Homo sapiens
agtttctaagattctaaagg

SEQ ID NO: 2981051 - DNA, 15 bp, Homo sapiens
agtttctcagatcct

SEQ ID NO: 2981052 - DNA, 18 bp, Homo sapiens
agtttctcagatccttgt

SEQ ID NO: 2981053 - DNA, 16 bp, Homo sapiens
agtttctgttctgtgg

SEQ ID NO: 2981054 - DNA, 17 bp, Homo sapiens
agtttctgttctgtgga

SEQ ID NO: 2981055 - DNA, 21 bp, Homo sapiens
agtttcttctgcgcctcaggc

SEQ ID NO: 2981056 - DNA, 13 bp, Homo sapiens
agtttgaaattct

SEQ ID NO: 2981057 - DNA, 17 bp, Homo sapiens
agtttgaaattctgaat

SEQ ID NO: 2981058 - DNA, 19 bp, Homo sapiens
agtttgaaattctgaattt

SEQ ID NO: 2981059 - DNA, 20 bp, Homo sapiens
agtttgaaattctgaatttg

SEQ ID NO: 2981060 - DNA, 18 bp, Homo sapiens
agtttgacagtttttgac

SEQ ID NO: 2981061 - DNA, 13 bp, Homo sapiens
agtttgacattta

SEQ ID NO: 2981062 - DNA, 19 bp, Homo sapiens
agtttgaggctgcaatgag

SEQ ID NO: 2981063 - DNA, 14 bp, Homo sapiens
agtttgattattca

SEQ ID NO: 2981064 - DNA, 23 bp, Homo sapiens
agtttgattattcagtgtcactg

SEQ ID NO: 2981065 - DNA, 14 bp, Homo sapiens
agtttgcagaaaag

SEQ ID NO: 2981066 - DNA, 21 bp, Homo sapiens
agtttgcagaaaagcacctgc

SEQ ID NO: 2981067 - DNA, 15 bp, Homo sapiens
agtttgcattcctga

SEQ ID NO: 2981068 - DNA, 14 bp, Homo sapiens
agtttgctattaga

SEQ ID NO: 2981069 - DNA, 14 bp, Homo sapiens
agtttgctgtttta

SEQ ID NO: 2981070 - DNA, 18 bp, Homo sapiens
agtttgctgttttaaatt

SEQ ID NO: 2981071 - DNA, 13 bp, Homo sapiens
agtttgcttagaa

SEQ ID NO: 2981072 - DNA, 15 bp, Homo sapiens
agtttgcttgtttct

SEQ ID NO: 2981073 - DNA, 16 bp, Homo sapiens
agtttggaaggtgtcc

SEQ ID NO: 2981074 - DNA, 21 bp, Homo sapiens
agtttgggatccctgtctttc

SEQ ID NO: 2981075 - DNA, 15 bp, Homo sapiens
agtttgggcatattt

SEQ ID NO: 2981076 - DNA, 22 bp, Homo sapiens
agtttggggcaagtcatgtaaa

SEQ ID NO: 2981077 - DNA, 21 bp, Homo sapiens
agtttggttaatcagtgttga

SEQ ID NO: 2981078 - DNA, 15 bp, Homo sapiens
agtttggttttgaca

SEQ ID NO: 2981079 - DNA, 13 bp, Homo sapiens
agtttgtaaaaat

SEQ ID NO: 2981080 - DNA, 22 bp, Homo sapiens
agtttgtaatatagtccaacat

SEQ ID NO: 2981081 - DNA, 19 bp, Homo sapiens
agtttgtattaaacttgaa

SEQ ID NO: 2981082 - DNA, 20 bp, Homo sapiens
agtttgtggcatcttgccaa

SEQ ID NO: 2981083 - DNA, 13 bp, Homo sapiens
agtttgtgtgtct

SEQ ID NO: 2981084 - DNA, 14 bp, Homo sapiens
agtttgttactttg

SEQ ID NO: 2981085 - DNA, 17 bp, Homo sapiens
agtttgttactttgaat

SEQ ID NO: 2981086 - DNA, 18 bp, Homo sapiens
agtttgttactttgaata

SEQ ID NO: 2981087 - DNA, 22 bp, Homo sapiens
agtttgtttttgtttggtataa

SEQ ID NO: 2981088 - DNA, 14 bp, Homo sapiens
agttttaaagaagt

SEQ ID NO: 2981089 - DNA, 22 bp, Homo sapiens
agttttccatggcaggaaggct

SEQ ID NO: 2981090 - DNA, 20 bp, Homo sapiens
agttttcccttgaggaaaca

SEQ ID NO: 2981091 - DNA, 18 bp, Homo sapiens
agttttcctatgctttga

SEQ ID NO: 2981092 - DNA, 14 bp, Homo sapiens
agttttccttctca

SEQ ID NO: 2981093 - DNA, 22 bp, Homo sapiens
agttttccttctcatctgtgat

SEQ ID NO: 2981094 - DNA, 23 bp, Homo sapiens
agttttccttctcatctgtgatt

SEQ ID NO: 2981095 - DNA, 12 bp, Homo sapiens
agttttcttata

SEQ ID NO: 2981096 - DNA, 15 bp, Homo sapiens
agttttcttccatga

SEQ ID NO: 2981097 - DNA, 12 bp, Homo sapiens
agttttcttgtt

SEQ ID NO: 2981098 - DNA, 21 bp, Homo sapiens
agttttcttgttgctttgttg

SEQ ID NO: 2981099 - DNA, 13 bp, Homo sapiens
agttttgtaaatg

SEQ ID NO: 2981100 - DNA, 15 bp, Homo sapiens
agttttgtaagccct

SEQ ID NO: 2981101 - DNA, 14 bp, Homo sapiens
agttttgtggactg

SEQ ID NO: 2981102 - DNA, 16 bp, Homo sapiens
agttttgtgtgtatat

SEQ ID NO: 2981103 - DNA, 18 bp, Homo sapiens
agttttgttttaaaatta

SEQ ID NO: 2981104 - DNA, 13 bp, Homo sapiens
agtttttaagagt

SEQ ID NO: 2981105 - DNA, 14 bp, Homo sapiens
agtttttaattcat

SEQ ID NO: 2981106 - DNA, 22 bp, Homo sapiens
agtttttaattcatatttttcc

SEQ ID NO: 2981107 - DNA, 23 bp, Homo sapiens
agtttttaattcatatttttcct

SEQ ID NO: 2981108 - DNA, 17 bp, Homo sapiens
agtttttacaagatgta

SEQ ID NO: 2981109 - DNA, 19 bp, Homo sapiens
agtttttattcaaagcagc

SEQ ID NO: 2981110 - DNA, 21 bp, Homo sapiens
agtttttattcaaagcagctg

SEQ ID NO: 2981111 - DNA, 22 bp, Homo sapiens
agtttttcccagctacaccttt

SEQ ID NO: 2981112 - DNA, 23 bp, Homo sapiens
agtttttctttaatatgattcta

SEQ ID NO: 2981113 - DNA, 23 bp, Homo sapiens
agtttttggagtgttatgtattt

SEQ ID NO: 2981114 - DNA, 15 bp, Homo sapiens
ataaaaaacaagaaa

SEQ ID NO: 2981115 - DNA, 11 bp, Homo sapiens
ataaaaaagaa

SEQ ID NO: 2981116 - DNA, 18 bp, Homo sapiens
ataaaaaagaagcacttt

SEQ ID NO: 2981117 - DNA, 23 bp, Homo sapiens
ataaaaacattgcctttgaatgt

SEQ ID NO: 2981118 - DNA, 17 bp, Homo sapiens
ataaaaaccaagaagat

SEQ ID NO: 2981119 - DNA, 10 bp, Homo sapiens
ataaaaagtt

SEQ ID NO: 2981120 - DNA, 18 bp, Homo sapiens
ataaaaagttaaaaagtt

SEQ ID NO: 2981121 - DNA, 21 bp, Homo sapiens
ataaaaatatatgttgaatgt

SEQ ID NO: 2981122 - DNA, 14 bp, Homo sapiens
ataaaaatgtcttg

SEQ ID NO: 2981123 - DNA, 14 bp, Homo sapiens
ataaaactaaatgt

SEQ ID NO: 2981124 - DNA, 14 bp, Homo sapiens
ataaaagtgattgt

SEQ ID NO: 2981125 - DNA, 22 bp, Homo sapiens
ataaaataattttatctctttc

SEQ ID NO: 2981126 - DNA, 15 bp, Homo sapiens
ataaaatataaacaa

SEQ ID NO: 2981127 - DNA, 16 bp, Homo sapiens
ataaaatgatgttata

SEQ ID NO: 2981128 - DNA, 18 bp, Homo sapiens
ataaaatgcccatttcga

SEQ ID NO: 2981129 - DNA, 13 bp, Homo sapiens
ataaaattataga

SEQ ID NO: 2981130 - DNA, 16 bp, Homo sapiens
ataaaattcatttcta

SEQ ID NO: 2981131 - DNA, 22 bp, Homo sapiens
ataaaatttacatttaatacag

SEQ ID NO: 2981132 - DNA, 13 bp, Homo sapiens
ataaaatttgttg

SEQ ID NO: 2981133 - DNA, 23 bp, Homo sapiens
ataaaattttttttcatgtttta

SEQ ID NO: 2981134 - DNA, 14 bp, Homo sapiens
ataaacaatccaaa

SEQ ID NO: 2981135 - DNA, 20 bp, Homo sapiens
ataaacactggttgtagtca

SEQ ID NO: 2981136 - DNA, 17 bp, Homo sapiens
ataaacagaaatgctct

SEQ ID NO: 2981137 - DNA, 16 bp, Homo sapiens
ataaacagtttgacaa

SEQ ID NO: 2981138 - DNA, 19 bp, Homo sapiens
ataaaccaaatatgttaaa

SEQ ID NO: 2981139 - DNA, 16 bp, Homo sapiens
ataaacctggagatat

SEQ ID NO: 2981140 - DNA, 21 bp, Homo sapiens
ataaaccttgtttctttctga

SEQ ID NO: 2981141 - DNA, 19 bp, Homo sapiens
ataaacgatttaattctct

SEQ ID NO: 2981142 - DNA, 18 bp, Homo sapiens
atagtcattaaaaacata

SEQ ID NO: 2981143 - DNA, 20 bp, Homo sapiens
atagtctagatggctcctct

SEQ ID NO: 2981144 - DNA, 15 bp, Homo sapiens
atagtctgggtcaga

SEQ ID NO: 2981145 - DNA, 19 bp, Homo sapiens
atagtgaacacagcagacc

SEQ ID NO: 2981146 - DNA, 15 bp, Homo sapiens
atagtgactaaacta

SEQ ID NO: 2981147 - DNA, 22 bp, Homo sapiens
atagtgcattgtttctgtgggc

SEQ ID NO: 2981148 - DNA, 15 bp, Homo sapiens
atagtgcttcttgta

SEQ ID NO: 2981149 - DNA, 18 bp, Homo sapiens
atagtgcttcttgtaata

SEQ ID NO: 2981150 - DNA, 22 bp, Homo sapiens
atagtgtcatagacttgggaaa

SEQ ID NO: 2981151 - DNA, 12 bp, Homo sapiens
atagtgtctttg

SEQ ID NO: 2981152 - DNA, 16 bp, Homo sapiens
atagttactgttgtga

SEQ ID NO: 2981153 - DNA, 15 bp, Homo sapiens
atagttcaaagccaa

SEQ ID NO: 2981154 - DNA, 14 bp, Homo sapiens
atagttctagacat

SEQ ID NO: 2981155 - DNA, 12 bp, Homo sapiens
atagttctaggc

SEQ ID NO: 2981156 - DNA, 14 bp, Homo sapiens
atagttgtattttg

SEQ ID NO: 2981157 - DNA, 23 bp, Homo sapiens
atagttgtctttctttgctgctg

SEQ ID NO: 2981158 - DNA, 18 bp, Homo sapiens
atagttgtgggtgggaga

SEQ ID NO: 2981159 - DNA, 17 bp, Homo sapiens
atagtttacctgaataa

SEQ ID NO: 2981160 - DNA, 19 bp, Homo sapiens
atagtttctgaggctttat

SEQ ID NO: 2981161 - DNA, 18 bp, Homo sapiens
atagtttggcatttgcac

SEQ ID NO: 2981162 - DNA, 22 bp, Homo sapiens
atagtttgggcttcagcctagt

SEQ ID NO: 2981163 - DNA, 15 bp, Homo sapiens
atagttttagattat

SEQ ID NO: 2981164 - DNA, 13 bp, Homo sapiens
atagttttctaga

SEQ ID NO: 2981165 - DNA, 13 bp, Homo sapiens
atagttttgatga

SEQ ID NO: 2981166 - DNA, 12 bp, Homo sapiens
atataaaaagaa

SEQ ID NO: 2981167 - DNA, 21 bp, Homo sapiens
atataaaaatatatgttgaat

SEQ ID NO: 2981168 - DNA, 18 bp, Homo sapiens
atataaaataaaaagtca

SEQ ID NO: 2981169 - DNA, 18 bp, Homo sapiens
atataaaatgctgatatt

SEQ ID NO: 2981170 - DNA, 14 bp, Homo sapiens
atataaagatgtta

SEQ ID NO: 2981171 - DNA, 19 bp, Homo sapiens
atataaagcctcaaatctt

SEQ ID NO: 2981172 - DNA, 22 bp, Homo sapiens
atataaagtttttttatttctt

SEQ ID NO: 2981173 - DNA, 21 bp, Homo sapiens
atataaatactgacaatgtat

SEQ ID NO: 2981174 - DNA, 17 bp, Homo sapiens
atataaatatattttct

SEQ ID NO: 2981175 - DNA, 12 bp, Homo sapiens
atataaatggga

SEQ ID NO: 2981176 - DNA, 19 bp, Homo sapiens
atataaatgggaacattta

SEQ ID NO: 2981177 - DNA, 19 bp, Homo sapiens
atataaatgttaagaaaaa

SEQ ID NO: 2981178 - DNA, 15 bp, Homo sapiens
atataacatgaaatg

SEQ ID NO: 2981179 - DNA, 12 bp, Homo sapiens
atataagaaaga

SEQ ID NO: 2981180 - DNA, 14 bp, Homo sapiens
atataagaaagaca

SEQ ID NO: 2981181 - DNA, 16 bp, Homo sapiens
atataagaaagacatc

SEQ ID NO: 2981182 - DNA, 14 bp, Homo sapiens
atataagtttgaag

SEQ ID NO: 2981183 - DNA, 17 bp, Homo sapiens
atataagtttgaaggaa

SEQ ID NO: 2981184 - DNA, 20 bp, Homo sapiens
atataatatatttgtgtatt

SEQ ID NO: 2981185 - DNA, 20 bp, Homo sapiens
atataatatctaaagttata

SEQ ID NO: 2981186 - DNA, 23 bp, Homo sapiens
atataatatgcacacagtgcttt

SEQ ID NO: 2981187 - DNA, 13 bp, Homo sapiens
atataatgaattc

SEQ ID NO: 2981188 - DNA, 19 bp, Homo sapiens
atataatgatcagcaaaaa

SEQ ID NO: 2981189 - DNA, 21 bp, Homo sapiens
atataatgatcagcaaaaaga

SEQ ID NO: 2981190 - DNA, 15 bp, Homo sapiens
atatacaataatgga

SEQ ID NO: 2981191 - DNA, 16 bp, Homo sapiens
atatacaataatggaa

SEQ ID NO: 2981192 - DNA, 20 bp, Homo sapiens
atatacaataatggaaaaaa

SEQ ID NO: 2981193 - DNA, 15 bp, Homo sapiens
atatacacacacaca

SEQ ID NO: 2981194 - DNA, 22 bp, Homo sapiens
atatacagtaactttatgtgta

SEQ ID NO: 2981195 - DNA, 23 bp, Homo sapiens
atatacagtaactttatgtgtaa

SEQ ID NO: 2981196 - DNA, 22 bp, Homo sapiens
atatactattaaaaaggtttac

SEQ ID NO: 2981197 - DNA, 21 bp, Homo sapiens
atatactgattttgaaaagta

SEQ ID NO: 2981198 - DNA, 19 bp, Homo sapiens
atatactgtaaagaaagag

SEQ ID NO: 2981199 - DNA, 24 bp, Homo sapiens
atatactgtaaagaaagagagaaa

SEQ ID NO: 2981200 - DNA, 12 bp, Homo sapiens
atatacttttaa

SEQ ID NO: 2981201 - DNA, 20 bp, Homo sapiens
atatacttttaaattatgga

SEQ ID NO: 2981202 - DNA, 13 bp, Homo sapiens
atatagaaaacaa

SEQ ID NO: 2981203 - DNA, 15 bp, Homo sapiens
atatagacttggaga

SEQ ID NO: 2981204 - DNA, 20 bp, Homo sapiens
atatagcaaaacttttaaac

SEQ ID NO: 2981205 - DNA, 22 bp, Homo sapiens
atatagcaaaacttttaaacta

SEQ ID NO: 2981206 - DNA, 15 bp, Homo sapiens
atatagcaaagatat

SEQ ID NO: 2981207 - DNA, 17 bp, Homo sapiens
atatagcaaagatatat

SEQ ID NO: 2981208 - DNA, 19 bp, Homo sapiens
atatagcaaagatatatat

SEQ ID NO: 2981209 - DNA, 20 bp, Homo sapiens
atatagcaaagatatatatt

SEQ ID NO: 2981210 - DNA, 18 bp, Homo sapiens
atatagctgatcagtttt

SEQ ID NO: 2981211 - DNA, 20 bp, Homo sapiens
atataggaaaacaataattt

SEQ ID NO: 2981212 - DNA, 17 bp, Homo sapiens
atatataaaaagaaacg

SEQ ID NO: 2981213 - DNA, 18 bp, Homo sapiens
atatataacatatatgga

SEQ ID NO: 2981214 - DNA, 22 bp, Homo sapiens
atatataagaaagacatctttc

SEQ ID NO: 2981215 - DNA, 13 bp, Homo sapiens
atatatacacaca

SEQ ID NO: 2981216 - DNA, 14 bp, Homo sapiens
atatatacacacac

SEQ ID NO: 2981217 - DNA, 15 bp, Homo sapiens
atatatacacacaca

SEQ ID NO: 2981218 - DNA, 21 bp, Homo sapiens
atatatacagtaactttatgt

SEQ ID NO: 2981219 - DNA, 14 bp, Homo sapiens
atatatacatatat

SEQ ID NO: 2981220 - DNA, 14 bp, Homo sapiens
atatatactggaag

SEQ ID NO: 2981221 - DNA, 13 bp, Homo sapiens
atatatagaaaag

SEQ ID NO: 2981222 - DNA, 14 bp, Homo sapiens
atatatagaaaaga

SEQ ID NO: 2981223 - DNA, 19 bp, Homo sapiens
atatatagacagctttgac

SEQ ID NO: 2981224 - DNA, 15 bp, Homo sapiens
atatatagtatttaa

SEQ ID NO: 2981225 - DNA, 14 bp, Homo sapiens
atatatatatatat

SEQ ID NO: 2981226 - DNA, 16 bp, Homo sapiens
atatatatatatatgt

SEQ ID NO: 2981227 - DNA, 15 bp, Homo sapiens
atatatatatatatt

SEQ ID NO: 2981228 - DNA, 14 bp, Homo sapiens
atatatatatatgt

SEQ ID NO: 2981229 - DNA, 21 bp, Homo sapiens
atatatatctatatatataat

SEQ ID NO: 2981230 - DNA, 15 bp, Homo sapiens
atatatatgtacagt

SEQ ID NO: 2981231 - DNA, 19 bp, Homo sapiens
atatatcctgaaagcatta

SEQ ID NO: 2981232 - DNA, 18 bp, Homo sapiens
atatatctaaattgaata

SEQ ID NO: 2981233 - DNA, 17 bp, Homo sapiens
atatatctctatttgag

SEQ ID NO: 2981234 - DNA, 15 bp, Homo sapiens
atatatctttatact

SEQ ID NO: 2981235 - DNA, 12 bp, Homo sapiens
atatatgtattt

SEQ ID NO: 2981236 - DNA, 18 bp, Homo sapiens
atatatgtgaggatgtat

SEQ ID NO: 2981237 - DNA, 15 bp, Homo sapiens
atatatgtgtatgta

SEQ ID NO: 2981238 - DNA, 13 bp, Homo sapiens
atatattatatat

SEQ ID NO: 2981239 - DNA, 17 bp, Homo sapiens
atatattcttataaaaa

SEQ ID NO: 2981240 - DNA, 15 bp, Homo sapiens
atatatttaacatgt

SEQ ID NO: 2981241 - DNA, 13 bp, Homo sapiens
atatatttaagca

SEQ ID NO: 2981242 - DNA, 9 bp, Homo sapiens
atatatttc

SEQ ID NO: 2981243 - DNA, 12 bp, Homo sapiens
atatatttctat

SEQ ID NO: 2981244 - DNA, 13 bp, Homo sapiens
atatatttctatt

SEQ ID NO: 2981245 - DNA, 17 bp, Homo sapiens
atatatttgtgtattta

SEQ ID NO: 2981246 - DNA, 22 bp, Homo sapiens
atatatttgtgtatttaacagg

SEQ ID NO: 2981247 - DNA, 20 bp, Homo sapiens
atatattttctttctagttt

SEQ ID NO: 2981248 - DNA, 18 bp, Homo sapiens
atatcaaaataggatttc

SEQ ID NO: 2981249 - DNA, 22 bp, Homo sapiens
atatcaaaataggatttcttaa

SEQ ID NO: 2981250 - DNA, 12 bp, Homo sapiens
atatcaaatgca

SEQ ID NO: 2981251 - DNA, 20 bp, Homo sapiens
atatcaagtactacattttc

SEQ ID NO: 2981252 - DNA, 22 bp, Homo sapiens
atatcacaagagtccccagact

SEQ ID NO: 2981253 - DNA, 17 bp, Homo sapiens
atatcagagctgggaaa

SEQ ID NO: 2981254 - DNA, 18 bp, Homo sapiens
atatcagttactcagccc

SEQ ID NO: 2981255 - DNA, 20 bp, Homo sapiens
atatcagttactcagccctg

SEQ ID NO: 2981256 - DNA, 13 bp, Homo sapiens
atatcatatgtat

SEQ ID NO: 2981257 - DNA, 14 bp, Homo sapiens
atatcatatgtata

SEQ ID NO: 2981258 - DNA, 16 bp, Homo sapiens
atatcatgaagccttg

SEQ ID NO: 2981259 - DNA, 14 bp, Homo sapiens
atatcatgctaaaa

SEQ ID NO: 2981260 - DNA, 23 bp, Homo sapiens
atatcatgctaaaattctataga

SEQ ID NO: 2981261 - DNA, 21 bp, Homo sapiens
atatccaggtcaacagaatga

SEQ ID NO: 2981262 - DNA, 16 bp, Homo sapiens
atatccatctttttct

SEQ ID NO: 2981263 - DNA, 14 bp, Homo sapiens
atatcccaaactgt

SEQ ID NO: 2981264 - DNA, 16 bp, Homo sapiens
atatcccaaactgtga

SEQ ID NO: 2981265 - DNA, 21 bp, Homo sapiens
atatccctcttgacattcaaa

SEQ ID NO: 2981266 - DNA, 21 bp, Homo sapiens
atatcctgaaagcattatttt

SEQ ID NO: 2981267 - DNA, 23 bp, Homo sapiens
atatccttctggctgtagataaa

SEQ ID NO: 2981268 - DNA, 14 bp, Homo sapiens
atatccttttcttc

SEQ ID NO: 2981269 - DNA, 17 bp, Homo sapiens
atatcggtgctatgtgt

SEQ ID NO: 2981270 - DNA, 13 bp, Homo sapiens
atatctaaagtca

SEQ ID NO: 2981271 - DNA, 20 bp, Homo sapiens
atatctaaagttatatttca

SEQ ID NO: 2981272 - DNA, 14 bp, Homo sapiens
atatctacagatag

SEQ ID NO: 2981273 - DNA, 23 bp, Homo sapiens
atatctacagatagagagttgtt

SEQ ID NO: 2981274 - DNA, 18 bp, Homo sapiens
atatctatatatataatt

SEQ ID NO: 2981275 - DNA, 19 bp, Homo sapiens
atcgccttgaacaaaaagt

SEQ ID NO: 2981276 - DNA, 22 bp, Homo sapiens
atcgcggcggagctggccccgc

SEQ ID NO: 2981277 - DNA, 12 bp, Homo sapiens
atcgctggcccc

SEQ ID NO: 2981278 - DNA, 14 bp, Homo sapiens
atcgctggcccctt

SEQ ID NO: 2981279 - DNA, 18 bp, Homo sapiens
atcgctgtattttgagtt

SEQ ID NO: 2981280 - DNA, 17 bp, Homo sapiens
atcggcagatgatgctt

SEQ ID NO: 2981281 - DNA, 18 bp, Homo sapiens
atcggcagtattttctgt

SEQ ID NO: 2981282 - DNA, 19 bp, Homo sapiens
atcggcccacagctcccac

SEQ ID NO: 2981283 - DNA, 20 bp, Homo sapiens
atcggcccacagctcccacc

SEQ ID NO: 2981284 - DNA, 13 bp, Homo sapiens
atcggccctgtcc

SEQ ID NO: 2981285 - DNA, 17 bp, Homo sapiens
atcggccctgtcccctg

SEQ ID NO: 2981286 - DNA, 17 bp, Homo sapiens
atcgggaaggatgggaa

SEQ ID NO: 2981287 - DNA, 15 bp, Homo sapiens
atcgggcccagggac

SEQ ID NO: 2981288 - DNA, 17 bp, Homo sapiens
atcggtgctatgtgttt

SEQ ID NO: 2981289 - DNA, 22 bp, Homo sapiens
atcgtatagctgtattgaatca

SEQ ID NO: 2981290 - DNA, 23 bp, Homo sapiens
atcgtatagctgtattgaatcat

SEQ ID NO: 2981291 - DNA, 16 bp, Homo sapiens
atcgtattaaaaaaca

SEQ ID NO: 2981292 - DNA, 19 bp, Homo sapiens
atcgtattaaaaaacaatt

SEQ ID NO: 2981293 - DNA, 18 bp, Homo sapiens
atcgtgccgttactctcc

SEQ ID NO: 2981294 - DNA, 12 bp, Homo sapiens
atcgttattata

SEQ ID NO: 2981295 - DNA, 14 bp, Homo sapiens
atcgttccccaccc

SEQ ID NO: 2981296 - DNA, 16 bp, Homo sapiens
atcgttccccacccct

SEQ ID NO: 2981297 - DNA, 17 bp, Homo sapiens
atcgttggactcattaa

SEQ ID NO: 2981298 - DNA, 14 bp, Homo sapiens
atcgtttaatgttt

SEQ ID NO: 2981299 - DNA, 21 bp, Homo sapiens
atctaaaggatggaaaaataa

SEQ ID NO: 2981300 - DNA, 21 bp, Homo sapiens
atctaaattgaataatggtac

SEQ ID NO: 2981301 - DNA, 20 bp, Homo sapiens
atctaagaatacagctttct

SEQ ID NO: 2981302 - DNA, 21 bp, Homo sapiens
atctaagcccatgggacaaat

SEQ ID NO: 2981303 - DNA, 17 bp, Homo sapiens
atctaagttaatttaaa

SEQ ID NO: 2981304 - DNA, 17 bp, Homo sapiens
atctaatacctctgtgt

SEQ ID NO: 2981305 - DNA, 22 bp, Homo sapiens
atctaatacctctgtgtgctcc

SEQ ID NO: 2981306 - DNA, 17 bp, Homo sapiens
atctaatgcttgtttat

SEQ ID NO: 2981307 - DNA, 21 bp, Homo sapiens
atctacatcttttttcacaaa

SEQ ID NO: 2981308 - DNA, 13 bp, Homo sapiens
atctacatttgtt

SEQ ID NO: 2981309 - DNA, 18 bp, Homo sapiens
atctacatttgtttgtat

SEQ ID NO: 2981310 - DNA, 14 bp, Homo sapiens
atctacccgtgcct

SEQ ID NO: 2981311 - DNA, 15 bp, Homo sapiens
atctacccgtgcctg

SEQ ID NO: 2981312 - DNA, 17 bp, Homo sapiens
atctacctgcaacacaa

SEQ ID NO: 2981313 - DNA, 14 bp, Homo sapiens
atctacctgttctg

SEQ ID NO: 2981314 - DNA, 17 bp, Homo sapiens
atctacctgttctgtag

SEQ ID NO: 2981315 - DNA, 18 bp, Homo sapiens
atctacctgttctgtagc

SEQ ID NO: 2981316 - DNA, 21 bp, Homo sapiens
atctactctggaccaaggagc

SEQ ID NO: 2981317 - DNA, 13 bp, Homo sapiens
atctactcttttg

SEQ ID NO: 2981318 - DNA, 14 bp, Homo sapiens
atctagcaaatgtt

SEQ ID NO: 2981319 - DNA, 18 bp, Homo sapiens
atctaggcaacatagtat

SEQ ID NO: 2981320 - DNA, 17 bp, Homo sapiens
atctatatatgtgtatg

SEQ ID NO: 2981321 - DNA, 19 bp, Homo sapiens
atctatatatgtgtatgta

SEQ ID NO: 2981322 - DNA, 22 bp, Homo sapiens
atctatatgtacttgtcaaaga

SEQ ID NO: 2981323 - DNA, 23 bp, Homo sapiens
atctatatgtacttgtcaaagaa

SEQ ID NO: 2981324 - DNA, 19 bp, Homo sapiens
atctatccacactgtcaaa

SEQ ID NO: 2981325 - DNA, 12 bp, Homo sapiens
atctatgaaaac

SEQ ID NO: 2981326 - DNA, 20 bp, Homo sapiens
atctatgtcgtgttttcaag

SEQ ID NO: 2981327 - DNA, 21 bp, Homo sapiens
atctatgtcgtgttttcaagg

SEQ ID NO: 2981328 - DNA, 23 bp, Homo sapiens
atctatgtcgtgttttcaaggaa

SEQ ID NO: 2981329 - DNA, 23 bp, Homo sapiens
atctattaagggattagtatttt

SEQ ID NO: 2981330 - DNA, 22 bp, Homo sapiens
atctattatactttatcaaaga

SEQ ID NO: 2981331 - DNA, 13 bp, Homo sapiens
atctatttaagta

SEQ ID NO: 2981332 - DNA, 23 bp, Homo sapiens
atctatttattagtcagagtttc

SEQ ID NO: 2981333 - DNA, 17 bp, Homo sapiens
atctcaaatgttttctg

SEQ ID NO: 2981334 - DNA, 13 bp, Homo sapiens
atctcaatcctgc

SEQ ID NO: 2981335 - DNA, 12 bp, Homo sapiens
atctcaatgcaa

SEQ ID NO: 2981336 - DNA, 22 bp, Homo sapiens
atctcaatgcaagccccaactt

SEQ ID NO: 2981337 - DNA, 14 bp, Homo sapiens
atctcactctgccc

SEQ ID NO: 2981338 - DNA, 16 bp, Homo sapiens
atctcactctgccccc

SEQ ID NO: 2981339 - DNA, 21 bp, Homo sapiens
atctcagaaggggatggtgtt

SEQ ID NO: 2981340 - DNA, 20 bp, Homo sapiens
atctcagatcagtgtaccat

SEQ ID NO: 2981341 - DNA, 17 bp, Homo sapiens
atctcagtggtgtgtga

SEQ ID NO: 2981342 - DNA, 18 bp, Homo sapiens
atctcagtggtgtgtgaa

SEQ ID NO: 2981343 - DNA, 14 bp, Homo sapiens
atctcattggaccc

SEQ ID NO: 2981344 - DNA, 14 bp, Homo sapiens
atctccatactttg

SEQ ID NO: 2981345 - DNA, 16 bp, Homo sapiens
atctccatactttgga

SEQ ID NO: 2981346 - DNA, 23 bp, Homo sapiens
atctccatgtagaataaatgaag

SEQ ID NO: 2981347 - DNA, 15 bp, Homo sapiens
atctcccagacttgt

SEQ ID NO: 2981348 - DNA, 20 bp, Homo sapiens
atctcccagacttgtttcct

SEQ ID NO: 2981349 - DNA, 20 bp, Homo sapiens
atctcccatggtccctagca

SEQ ID NO: 2981350 - DNA, 18 bp, Homo sapiens
atctcccttccacctcac

SEQ ID NO: 2981351 - DNA, 19 bp, Homo sapiens
atctccgcctccacactga

SEQ ID NO: 2981352 - DNA, 14 bp, Homo sapiens
atctcctatctttt

SEQ ID NO: 2981353 - DNA, 16 bp, Homo sapiens
atctcctgccttcctc

SEQ ID NO: 2981354 - DNA, 17 bp, Homo sapiens
atctcctgccttcctcc

SEQ ID NO: 2981355 - DNA, 15 bp, Homo sapiens
atctcgccttcctgc

SEQ ID NO: 2981356 - DNA, 19 bp, Homo sapiens
atctcgctccctcccagga

SEQ ID NO: 2981357 - DNA, 19 bp, Homo sapiens
atctcggctcactgcaacc

SEQ ID NO: 2981358 - DNA, 15 bp, Homo sapiens
atctcggctcagtgc

SEQ ID NO: 2981359 - DNA, 15 bp, Homo sapiens
atctctaataaaaac

SEQ ID NO: 2981360 - DNA, 21 bp, Homo sapiens
atctctatataaaaacaaaaa

SEQ ID NO: 2981361 - DNA, 17 bp, Homo sapiens
atctctcccttacccat

SEQ ID NO: 2981362 - DNA, 22 bp, Homo sapiens
atctctgagtgtctctgcctgg

SEQ ID NO: 2981363 - DNA, 20 bp, Homo sapiens
atctctgcctagaatcttta

SEQ ID NO: 2981364 - DNA, 22 bp, Homo sapiens
atctctgcctagaatctttatt

SEQ ID NO: 2981365 - DNA, 14 bp, Homo sapiens
atctctgcctttga

SEQ ID NO: 2981366 - DNA, 15 bp, Homo sapiens
atctctgtcagtgtg

SEQ ID NO: 2981367 - DNA, 15 bp, Homo sapiens
atctctgttcttttc

SEQ ID NO: 2981368 - DNA, 22 bp, Homo sapiens
atctctgttcttttcccgcctc

SEQ ID NO: 2981369 - DNA, 12 bp, Homo sapiens
atctcttaaact

SEQ ID NO: 2981370 - DNA, 16 bp, Homo sapiens
atctcttaaactctct

SEQ ID NO: 2981371 - DNA, 14 bp, Homo sapiens
atctcttgataaag

SEQ ID NO: 2981372 - DNA, 16 bp, Homo sapiens
atctcttgcccttcct

SEQ ID NO: 2981373 - DNA, 13 bp, Homo sapiens
atctcttgggtta

SEQ ID NO: 2981374 - DNA, 20 bp, Homo sapiens
atctctttctctttaatgga

SEQ ID NO: 2981375 - DNA, 14 bp, Homo sapiens
atctctttgtcctg

SEQ ID NO: 2981376 - DNA, 16 bp, Homo sapiens
atctctttgtcctgaa

SEQ ID NO: 2981377 - DNA, 11 bp, Homo sapiens
atctcttttat

SEQ ID NO: 2981378 - DNA, 14 bp, Homo sapiens
atctgaacccagct

SEQ ID NO: 2981379 - DNA, 18 bp, Homo sapiens
atctgaagacctaccagg

SEQ ID NO: 2981380 - DNA, 21 bp, Homo sapiens
atctgaaggggcaaattcttt

SEQ ID NO: 2981381 - DNA, 16 bp, Homo sapiens
atctgaatgaaaataa

SEQ ID NO: 2981382 - DNA, 18 bp, Homo sapiens
atctgaatgatcctgtct

SEQ ID NO: 2981383 - DNA, 18 bp, Homo sapiens
atctgaattaaataaata

SEQ ID NO: 2981384 - DNA, 18 bp, Homo sapiens
atctgaattttaaaacat

SEQ ID NO: 2981385 - DNA, 21 bp, Homo sapiens
atctgaattttaaaacatgct

SEQ ID NO: 2981386 - DNA, 20 bp, Homo sapiens
atctgacaaattcaaaagag

SEQ ID NO: 2981387 - DNA, 16 bp, Homo sapiens
atctgaccatctgtga

SEQ ID NO: 2981388 - DNA, 18 bp, Homo sapiens
atctgaccatctgtgact

SEQ ID NO: 2981389 - DNA, 19 bp, Homo sapiens
atctgaccatctgtgacta

SEQ ID NO: 2981390 - DNA, 13 bp, Homo sapiens
atctgacccagtg

SEQ ID NO: 2981391 - DNA, 12 bp, Homo sapiens
atctgagcaagg

SEQ ID NO: 2981392 - DNA, 18 bp, Homo sapiens
atctgagctgagccaggc

SEQ ID NO: 2981393 - DNA, 18 bp, Homo sapiens
atctgaggatgagacagg

SEQ ID NO: 2981394 - DNA, 23 bp, Homo sapiens
atctgaggcatccagcagtctct

SEQ ID NO: 2981395 - DNA, 17 bp, Homo sapiens
atctgataaagttgaga

SEQ ID NO: 2981396 - DNA, 19 bp, Homo sapiens
atctgataaagttgagaga

SEQ ID NO: 2981397 - DNA, 21 bp, Homo sapiens
atctgatcacccccctgctta

SEQ ID NO: 2981398 - DNA, 13 bp, Homo sapiens
atctgatttatac

SEQ ID NO: 2981399 - DNA, 21 bp, Homo sapiens
atctgcaatgtttttgtgtag

SEQ ID NO: 2981400 - DNA, 22 bp, Homo sapiens
atctgcaatgtttttgtgtaga

SEQ ID NO: 2981401 - DNA, 21 bp, Homo sapiens
atctgcaattcaaaagttcca

SEQ ID NO: 2981402 - DNA, 18 bp, Homo sapiens
atctgcaatttctactac

SEQ ID NO: 2981403 - DNA, 12 bp, Homo sapiens
atctgcacagtc

SEQ ID NO: 2981404 - DNA, 15 bp, Homo sapiens
atctgcacagtcaga

SEQ ID NO: 2981405 - DNA, 15 bp, Homo sapiens
atctgcccacctcag

SEQ ID NO: 2981406 - DNA, 21 bp, Homo sapiens
atctgcctcccctgtggaaat

SEQ ID NO: 2981407 - DNA, 18 bp, Homo sapiens
atgcagttgtggtgtgcc

SEQ ID NO: 2981408 - DNA, 11 bp, Homo sapiens
atgcagtttga

SEQ ID NO: 2981409 - DNA, 18 bp, Homo sapiens
atgcagtttgaaattctg

SEQ ID NO: 2981410 - DNA, 23 bp, Homo sapiens
atgcataaaagggtcaaacctgt

SEQ ID NO: 2981411 - DNA, 13 bp, Homo sapiens
atgcatacacaca

SEQ ID NO: 2981412 - DNA, 11 bp, Homo sapiens
atgcatacatg

SEQ ID NO: 2981413 - DNA, 16 bp, Homo sapiens
atgcatacttcaaaag

SEQ ID NO: 2981414 - DNA, 16 bp, Homo sapiens
atgcataggcttaact

SEQ ID NO: 2981415 - DNA, 16 bp, Homo sapiens
atgcatattcaacaca

SEQ ID NO: 2981416 - DNA, 16 bp, Homo sapiens
atgcatcacatgatga

SEQ ID NO: 2981417 - DNA, 14 bp, Homo sapiens
atgcatccattcct

SEQ ID NO: 2981418 - DNA, 14 bp, Homo sapiens
atgcatctggctac

SEQ ID NO: 2981419 - DNA, 15 bp, Homo sapiens
atgcatctggctact

SEQ ID NO: 2981420 - DNA, 13 bp, Homo sapiens
atgcatcttctgt

SEQ ID NO: 2981421 - DNA, 18 bp, Homo sapiens
atgcatgacacttccaaa

SEQ ID NO: 2981422 - DNA, 22 bp, Homo sapiens
atgcatgatccagctgtgtgtt

SEQ ID NO: 2981423 - DNA, 15 bp, Homo sapiens
atgcatgctaaatta

SEQ ID NO: 2981424 - DNA, 16 bp, Homo sapiens
atgcatggtgccccag

SEQ ID NO: 2981425 - DNA, 17 bp, Homo sapiens
atgcatggtgccccagg

SEQ ID NO: 2981426 - DNA, 15 bp, Homo sapiens
atgcatgtcttttaa

SEQ ID NO: 2981427 - DNA, 16 bp, Homo sapiens
atgcatgtgaagaaag

SEQ ID NO: 2981428 - DNA, 17 bp, Homo sapiens
atgcatgtgaagaaagg

SEQ ID NO: 2981429 - DNA, 15 bp, Homo sapiens
atgcattctatcgtt

SEQ ID NO: 2981430 - DNA, 21 bp, Homo sapiens
atgcattctatcgttattata

SEQ ID NO: 2981431 - DNA, 22 bp, Homo sapiens
atgcattctatcgttattataa

SEQ ID NO: 2981432 - DNA, 21 bp, Homo sapiens
atgcattctgataggaggggg

SEQ ID NO: 2981433 - DNA, 18 bp, Homo sapiens
atgcattgatattgtgaa

SEQ ID NO: 2981434 - DNA, 14 bp, Homo sapiens
atgcattgtagttt

SEQ ID NO: 2981435 - DNA, 18 bp, Homo sapiens
atgcatttggaaccaaag

SEQ ID NO: 2981436 - DNA, 20 bp, Homo sapiens
atgcatttttttagtttgtt

SEQ ID NO: 2981437 - DNA, 18 bp, Homo sapiens
atgccaaaaaaagacagg

SEQ ID NO: 2981438 - DNA, 13 bp, Homo sapiens
atgccaacaagaa

SEQ ID NO: 2981439 - DNA, 20 bp, Homo sapiens
atgccaacaagaatgcattg

SEQ ID NO: 2981440 - DNA, 21 bp, Homo sapiens
atgccaacaagaatgcattga

SEQ ID NO: 2981441 - DNA, 19 bp, Homo sapiens
atgccaaggggctgagtga

SEQ ID NO: 2981442 - DNA, 22 bp, Homo sapiens
atgccaatgtcagcatcaagcc

SEQ ID NO: 2981443 - DNA, 16 bp, Homo sapiens
atgccaccaggtaaca

SEQ ID NO: 2981444 - DNA, 18 bp, Homo sapiens
atgccactcctccctccg

SEQ ID NO: 2981445 - DNA, 17 bp, Homo sapiens
atgccaggttaggaagg

SEQ ID NO: 2981446 - DNA, 21 bp, Homo sapiens
atgccaggttaggaaggcagc

SEQ ID NO: 2981447 - DNA, 14 bp, Homo sapiens
atgccagtgtgctg

SEQ ID NO: 2981448 - DNA, 18 bp, Homo sapiens
atgccataaatacaagat

SEQ ID NO: 2981449 - DNA, 17 bp, Homo sapiens
atgccataatacaaaag

SEQ ID NO: 2981450 - DNA, 15 bp, Homo sapiens
atgccatcatctcct

SEQ ID NO: 2981451 - DNA, 17 bp, Homo sapiens
atgccattggaacctgt

SEQ ID NO: 2981452 - DNA, 22 bp, Homo sapiens
atgccatttttagtttaaaatc

SEQ ID NO: 2981453 - DNA, 23 bp, Homo sapiens
atgcccacatttagtctctttat

SEQ ID NO: 2981454 - DNA, 22 bp, Homo sapiens
atgcccagacatcagcctcctt

SEQ ID NO: 2981455 - DNA, 17 bp, Homo sapiens
atgcccagccagccacc

SEQ ID NO: 2981456 - DNA, 23 bp, Homo sapiens
atgcccagccagccacccctgcc

SEQ ID NO: 2981457 - DNA, 22 bp, Homo sapiens
atgcccccccatcctgctcagc

SEQ ID NO: 2981458 - DNA, 17 bp, Homo sapiens
atgcccggctaattttt

SEQ ID NO: 2981459 - DNA, 13 bp, Homo sapiens
atgccctcctctc

SEQ ID NO: 2981460 - DNA, 14 bp, Homo sapiens
atgccctcctctcc

SEQ ID NO: 2981461 - DNA, 14 bp, Homo sapiens
atgccctggaggtg

SEQ ID NO: 2981462 - DNA, 19 bp, Homo sapiens
atgccgatatactctagat

SEQ ID NO: 2981463 - DNA, 14 bp, Homo sapiens
atgccgtcttctgc

SEQ ID NO: 2981464 - DNA, 23 bp, Homo sapiens
atgccgtgtgtctcgtctcctga

SEQ ID NO: 2981465 - DNA, 23 bp, Homo sapiens
atgcctaccgggttctcctgatt

SEQ ID NO: 2981466 - DNA, 23 bp, Homo sapiens
atgcctcactaatttttgtatta

SEQ ID NO: 2981467 - DNA, 24 bp, Homo sapiens
atgcctcagccctgaccctgtgga

SEQ ID NO: 2981468 - DNA, 21 bp, Homo sapiens
atgcctccaccgctgcctaag

SEQ ID NO: 2981469 - DNA, 21 bp, Homo sapiens
atgcctctcctttgtatatta

SEQ ID NO: 2981470 - DNA, 17 bp, Homo sapiens
atgcctctgtctagcat

SEQ ID NO: 2981471 - DNA, 22 bp, Homo sapiens
atgcctctgtctagcatgccaa

SEQ ID NO: 2981472 - DNA, 19 bp, Homo sapiens
atgcctgactaatttttgt

SEQ ID NO: 2981473 - DNA, 22 bp, Homo sapiens
atgcctgcccgcaccctggcct

SEQ ID NO: 2981474 - DNA, 16 bp, Homo sapiens
atgcctgtaatcccag

SEQ ID NO: 2981475 - DNA, 19 bp, Homo sapiens
atgcctgtaatcccagaac

SEQ ID NO: 2981476 - DNA, 16 bp, Homo sapiens
atgcctgtaattcagt

SEQ ID NO: 2981477 - DNA, 19 bp, Homo sapiens
atgcctgtagtctcagcta

SEQ ID NO: 2981478 - DNA, 15 bp, Homo sapiens
atgccttgaataata

SEQ ID NO: 2981479 - DNA, 23 bp, Homo sapiens
atgccttgaataataagcaggat

SEQ ID NO: 2981480 - DNA, 21 bp, Homo sapiens
atgccttgattagacctaatt

SEQ ID NO: 2981481 - DNA, 14 bp, Homo sapiens
atgcctttgctgtt

SEQ ID NO: 2981482 - DNA, 17 bp, Homo sapiens
atgcctttgctgtttag

SEQ ID NO: 2981483 - DNA, 20 bp, Homo sapiens
atgcgacactgggaggccag

SEQ ID NO: 2981484 - DNA, 19 bp, Homo sapiens
atgcgattttattactggc

SEQ ID NO: 2981485 - DNA, 23 bp, Homo sapiens
atgcgcagccccatctgtgcatt

SEQ ID NO: 2981486 - DNA, 13 bp, Homo sapiens
atgcggagccagc

SEQ ID NO: 2981487 - DNA, 19 bp, Homo sapiens
atgcggccgcattccctga

SEQ ID NO: 2981488 - DNA, 15 bp, Homo sapiens
atgcgggcattttga

SEQ ID NO: 2981489 - DNA, 15 bp, Homo sapiens
atgcgggctcgccca

SEQ ID NO: 2981490 - DNA, 20 bp, Homo sapiens
atgcggtagccagcacacag

SEQ ID NO: 2981491 - DNA, 21 bp, Homo sapiens
atgcggtagccagcacacagg

SEQ ID NO: 2981492 - DNA, 13 bp, Homo sapiens
atgcgtattctgt

SEQ ID NO: 2981493 - DNA, 15 bp, Homo sapiens
atgcgtattctgtgg

SEQ ID NO: 2981494 - DNA, 15 bp, Homo sapiens
atgcgttcgcctctg

SEQ ID NO: 2981495 - DNA, 15 bp, Homo sapiens
atgctaaaattctat

SEQ ID NO: 2981496 - DNA, 13 bp, Homo sapiens
atgctaaataact

SEQ ID NO: 2981497 - DNA, 16 bp, Homo sapiens
atgctaaataactata

SEQ ID NO: 2981498 - DNA, 16 bp, Homo sapiens
atgctaaatgtgtaat

SEQ ID NO: 2981499 - DNA, 17 bp, Homo sapiens
atgctaatattaaaagt

SEQ ID NO: 2981500 - DNA, 18 bp, Homo sapiens
atgctaatgaggtgcaca

SEQ ID NO: 2981501 - DNA, 17 bp, Homo sapiens
atgctacgtgtgatttt

SEQ ID NO: 2981502 - DNA, 20 bp, Homo sapiens
atgctacgtgtgatttttct

SEQ ID NO: 2981503 - DNA, 16 bp, Homo sapiens
atgctatcctcttatt

SEQ ID NO: 2981504 - DNA, 19 bp, Homo sapiens
atgctattatactgttatc

SEQ ID NO: 2981505 - DNA, 22 bp, Homo sapiens
atgctattatactgttatccat

SEQ ID NO: 2981506 - DNA, 23 bp, Homo sapiens
atgctattatactgttatccata

SEQ ID NO: 2981507 - DNA, 16 bp, Homo sapiens
atgctatttcagccaa

SEQ ID NO: 2981508 - DNA, 22 bp, Homo sapiens
atgctatttcagccaatctgga

SEQ ID NO: 2981509 - DNA, 12 bp, Homo sapiens
atgctcagacca

SEQ ID NO: 2981510 - DNA, 14 bp, Homo sapiens
atgctcagttgcta

SEQ ID NO: 2981511 - DNA, 17 bp, Homo sapiens
atgctcatctgagccag

SEQ ID NO: 2981512 - DNA, 16 bp, Homo sapiens
atgctccaagattcta

SEQ ID NO: 2981513 - DNA, 20 bp, Homo sapiens
atgctccaagattctagatg

SEQ ID NO: 2981514 - DNA, 17 bp, Homo sapiens
atgctccagggtcaggc

SEQ ID NO: 2981515 - DNA, 17 bp, Homo sapiens
atgctcccaactccctt

SEQ ID NO: 2981516 - DNA, 19 bp, Homo sapiens
atgctcccaactcccttct

SEQ ID NO: 2981517 - DNA, 20 bp, Homo sapiens
atgctcccaactcccttctg

SEQ ID NO: 2981518 - DNA, 23 bp, Homo sapiens
atgctcccttttacattctgtgt

SEQ ID NO: 2981519 - DNA, 20 bp, Homo sapiens
atgctccgaggactggactg

SEQ ID NO: 2981520 - DNA, 14 bp, Homo sapiens
atgctctcctttcc

SEQ ID NO: 2981521 - DNA, 19 bp, Homo sapiens
atgctctctgcagccagcc

SEQ ID NO: 2981522 - DNA, 12 bp, Homo sapiens
atgctctgatta

SEQ ID NO: 2981523 - DNA, 15 bp, Homo sapiens
atgctcttctgtgga

SEQ ID NO: 2981524 - DNA, 14 bp, Homo sapiens
atgctctttcccag

SEQ ID NO: 2981525 - DNA, 15 bp, Homo sapiens
atgctctttcccagg

SEQ ID NO: 2981526 - DNA, 18 bp, Homo sapiens
atgctgaaataaactagg

SEQ ID NO: 2981527 - DNA, 16 bp, Homo sapiens
atgctgacctcacctg

SEQ ID NO: 2981528 - DNA, 19 bp, Homo sapiens
atgctgacctcacctggtc

SEQ ID NO: 2981529 - DNA, 13 bp, Homo sapiens
atgctgagggtgt

SEQ ID NO: 2981530 - DNA, 18 bp, Homo sapiens
atgctgatgaatcactgt

SEQ ID NO: 2981531 - DNA, 19 bp, Homo sapiens
atgctgatgaatcactgtt

SEQ ID NO: 2981532 - DNA, 16 bp, Homo sapiens
atgctgatgttcagtg

SEQ ID NO: 2981533 - DNA, 19 bp, Homo sapiens
atgctgatgttcagtgtaa

SEQ ID NO: 2981534 - DNA, 18 bp, Homo sapiens
atgctgcaggacttgaga

SEQ ID NO: 2981535 - DNA, 19 bp, Homo sapiens
atgctgcaggacttgagaa

SEQ ID NO: 2981536 - DNA, 19 bp, Homo sapiens
atgctgcctgagtattact

SEQ ID NO: 2981537 - DNA, 14 bp, Homo sapiens
atgctgctttctgc

SEQ ID NO: 2981538 - DNA, 19 bp, Homo sapiens
atgctgcttttatatctgt

SEQ ID NO: 2981539 - DNA, 15 bp, Homo sapiens
atgtgtgccaaggct

SEQ ID NO: 2981540 - DNA, 14 bp, Homo sapiens
atgtgtggcctgca

SEQ ID NO: 2981541 - DNA, 18 bp, Homo sapiens
atgtgtgtattttttcat

SEQ ID NO: 2981542 - DNA, 21 bp, Homo sapiens
atgtgtgtccacgactgtctc

SEQ ID NO: 2981543 - DNA, 15 bp, Homo sapiens
atgtgtgttgtttcc

SEQ ID NO: 2981544 - DNA, 16 bp, Homo sapiens
atgtgtgttgtttcca

SEQ ID NO: 2981545 - DNA, 20 bp, Homo sapiens
atgtgttgaccggctgccgt

SEQ ID NO: 2981546 - DNA, 23 bp, Homo sapiens
atgtgttgataattttttaatta

SEQ ID NO: 2981547 - DNA, 12 bp, Homo sapiens
atgtgtttgtgt

SEQ ID NO: 2981548 - DNA, 14 bp, Homo sapiens
atgtgttttagagt

SEQ ID NO: 2981549 - DNA, 16 bp, Homo sapiens
atgtgttttataaaat

SEQ ID NO: 2981550 - DNA, 15 bp, Homo sapiens
atgtgttttcagtct

SEQ ID NO: 2981551 - DNA, 17 bp, Homo sapiens
atgtgttttcatcattt

SEQ ID NO: 2981552 - DNA, 14 bp, Homo sapiens
atgtgttttgcttt

SEQ ID NO: 2981553 - DNA, 20 bp, Homo sapiens
atgtgttttgtttattaaat

SEQ ID NO: 2981554 - DNA, 14 bp, Homo sapiens
atgttaaactcttt

SEQ ID NO: 2981555 - DNA, 14 bp, Homo sapiens
atgttaaagtttaa

SEQ ID NO: 2981556 - DNA, 18 bp, Homo sapiens
atgttaacacattttgta

SEQ ID NO: 2981557 - DNA, 21 bp, Homo sapiens
atgttaacacattttgtataa

SEQ ID NO: 2981558 - DNA, 23 bp, Homo sapiens
atgttaattttttggtacaaaaa

SEQ ID NO: 2981559 - DNA, 17 bp, Homo sapiens
atgttacaagtttatat

SEQ ID NO: 2981560 - DNA, 18 bp, Homo sapiens
atgttagaattgatttcc

SEQ ID NO: 2981561 - DNA, 24 bp, Homo sapiens
atgttagactcatggtgtgttaca

SEQ ID NO: 2981562 - DNA, 12 bp, Homo sapiens
atgttagagcac

SEQ ID NO: 2981563 - DNA, 20 bp, Homo sapiens
atgttagccgggatggtctt

SEQ ID NO: 2981564 - DNA, 15 bp, Homo sapiens
atgttagtttcttgg

SEQ ID NO: 2981565 - DNA, 21 bp, Homo sapiens
atgttatacatcaatatgtat

SEQ ID NO: 2981566 - DNA, 23 bp, Homo sapiens
atgttatacatcaatatgtatat

SEQ ID NO: 2981567 - DNA, 14 bp, Homo sapiens
atgttatcttaaca

SEQ ID NO: 2981568 - DNA, 15 bp, Homo sapiens
atgttatcttctcaa

SEQ ID NO: 2981569 - DNA, 17 bp, Homo sapiens
atgttatgcataaagtc

SEQ ID NO: 2981570 - DNA, 21 bp, Homo sapiens
atgttatggcttattgtgtga

SEQ ID NO: 2981571 - DNA, 15 bp, Homo sapiens
atgttattagatgtt

SEQ ID NO: 2981572 - DNA, 14 bp, Homo sapiens
atgttattctagta

SEQ ID NO: 2981573 - DNA, 21 bp, Homo sapiens
atgttattgcctaatcactcc

SEQ ID NO: 2981574 - DNA, 22 bp, Homo sapiens
atgttatttttgtatttttaaa

SEQ ID NO: 2981575 - DNA, 21 bp, Homo sapiens
atgttcacttcgaaattctga

SEQ ID NO: 2981576 - DNA, 18 bp, Homo sapiens
atgttcacttttgacaaa

SEQ ID NO: 2981577 - DNA, 14 bp, Homo sapiens
atgttcagtgtaat

SEQ ID NO: 2981578 - DNA, 16 bp, Homo sapiens
atgttcagtgtaattt

SEQ ID NO: 2981579 - DNA, 17 bp, Homo sapiens
atgttcccaaaacaatg

SEQ ID NO: 2981580 - DNA, 22 bp, Homo sapiens
atgttcccttgaccattggctg

SEQ ID NO: 2981581 - DNA, 23 bp, Homo sapiens
atgttcccttgaccattggctgc

SEQ ID NO: 2981582 - DNA, 20 bp, Homo sapiens
atgttccgaattgagcacaa

SEQ ID NO: 2981583 - DNA, 21 bp, Homo sapiens
atgttcggtttttttcctgtt

SEQ ID NO: 2981584 - DNA, 14 bp, Homo sapiens
atgttctaaggctc

SEQ ID NO: 2981585 - DNA, 19 bp, Homo sapiens
atgttctaagtctttccat

SEQ ID NO: 2981586 - DNA, 15 bp, Homo sapiens
atgttctaagtttct

SEQ ID NO: 2981587 - DNA, 21 bp, Homo sapiens
atgttctaagtttctaagatt

SEQ ID NO: 2981588 - DNA, 11 bp, Homo sapiens
atgttctatta

SEQ ID NO: 2981589 - DNA, 22 bp, Homo sapiens
atgttcttatagaataaaagct

SEQ ID NO: 2981590 - DNA, 14 bp, Homo sapiens
atgttgaatacttt

SEQ ID NO: 2981591 - DNA, 19 bp, Homo sapiens
atgttgaatactttttaca

SEQ ID NO: 2981592 - DNA, 12 bp, Homo sapiens
atgttgacttta

SEQ ID NO: 2981593 - DNA, 18 bp, Homo sapiens
atgttgactttatttctg

SEQ ID NO: 2981594 - DNA, 16 bp, Homo sapiens
atgttgagaatcccaa

SEQ ID NO: 2981595 - DNA, 21 bp, Homo sapiens
atgttgatttttactgtgttt

SEQ ID NO: 2981596 - DNA, 23 bp, Homo sapiens
atgttgatttttactgtgtttta

SEQ ID NO: 2981597 - DNA, 22 bp, Homo sapiens
atgttgctttaacctgaacctt

SEQ ID NO: 2981598 - DNA, 23 bp, Homo sapiens
atgttgctttaacctgaaccttg

SEQ ID NO: 2981599 - DNA, 16 bp, Homo sapiens
atgttggccaggctgg

SEQ ID NO: 2981600 - DNA, 21 bp, Homo sapiens
atgttggccaggctggtctaa

SEQ ID NO: 2981601 - DNA, 14 bp, Homo sapiens
atgttggtgttcca

SEQ ID NO: 2981602 - DNA, 12 bp, Homo sapiens
atgttgtagtgt

SEQ ID NO: 2981603 - DNA, 22 bp, Homo sapiens
atgttgtcaggtcgttcttatc

SEQ ID NO: 2981604 - DNA, 21 bp, Homo sapiens
atgttgtgtttctgttcacct

SEQ ID NO: 2981605 - DNA, 17 bp, Homo sapiens
atgttgttttttcatag

SEQ ID NO: 2981606 - DNA, 20 bp, Homo sapiens
atgtttaaaaaaacattatt

SEQ ID NO: 2981607 - DNA, 13 bp, Homo sapiens
atgtttaattgtg

SEQ ID NO: 2981608 - DNA, 14 bp, Homo sapiens
atgtttaattgtga

SEQ ID NO: 2981609 - DNA, 16 bp, Homo sapiens
atgtttacaaatggac

SEQ ID NO: 2981610 - DNA, 15 bp, Homo sapiens
atgtttacctggtgc

SEQ ID NO: 2981611 - DNA, 17 bp, Homo sapiens
atgtttacctggtgctc

SEQ ID NO: 2981612 - DNA, 14 bp, Homo sapiens
atgtttactgtaaa

SEQ ID NO: 2981613 - DNA, 19 bp, Homo sapiens
atgtttactgtaaattttt

SEQ ID NO: 2981614 - DNA, 19 bp, Homo sapiens
atgtttataactattcagt

SEQ ID NO: 2981615 - DNA, 17 bp, Homo sapiens
atgtttatacagagtaa

SEQ ID NO: 2981616 - DNA, 22 bp, Homo sapiens
atgtttatgtaacatagtccag

SEQ ID NO: 2981617 - DNA, 16 bp, Homo sapiens
atgtttattcttctag

SEQ ID NO: 2981618 - DNA, 21 bp, Homo sapiens
atgtttattcttctagagttc

SEQ ID NO: 2981619 - DNA, 13 bp, Homo sapiens
atgtttcacttaa

SEQ ID NO: 2981620 - DNA, 15 bp, Homo sapiens
atgtttccagacttc

SEQ ID NO: 2981621 - DNA, 15 bp, Homo sapiens
atgtttcctggaagc

SEQ ID NO: 2981622 - DNA, 12 bp, Homo sapiens
atgtttctctgg

SEQ ID NO: 2981623 - DNA, 17 bp, Homo sapiens
atgtttgactttaaaga

SEQ ID NO: 2981624 - DNA, 16 bp, Homo sapiens
atgtttgcacttgtga

SEQ ID NO: 2981625 - DNA, 15 bp, Homo sapiens
atgtttgctcagagg

SEQ ID NO: 2981626 - DNA, 17 bp, Homo sapiens
atgtttgggtgggttaa

SEQ ID NO: 2981627 - DNA, 19 bp, Homo sapiens
atgtttgggtgggttaagt

SEQ ID NO: 2981628 - DNA, 23 bp, Homo sapiens
atgtttgggtgggttaagtgggc

SEQ ID NO: 2981629 - DNA, 14 bp, Homo sapiens
atgtttgtctcact

SEQ ID NO: 2981630 - DNA, 14 bp, Homo sapiens
atgtttgtgtctgt

SEQ ID NO: 2981631 - DNA, 16 bp, Homo sapiens
atgtttgtgtctgtgg

SEQ ID NO: 2981632 - DNA, 15 bp, Homo sapiens
atgttttaaaataat

SEQ ID NO: 2981633 - DNA, 18 bp, Homo sapiens
atgttttaaaattatata

SEQ ID NO: 2981634 - DNA, 13 bp, Homo sapiens
atgttttaaagaa

SEQ ID NO: 2981635 - DNA, 15 bp, Homo sapiens
atgttttaattccat

SEQ ID NO: 2981636 - DNA, 18 bp, Homo sapiens
atgttttaattccatgaa

SEQ ID NO: 2981637 - DNA, 16 bp, Homo sapiens
atgttttacactgtac

SEQ ID NO: 2981638 - DNA, 18 bp, Homo sapiens
atgttttacgcaaggaag

SEQ ID NO: 2981639 - DNA, 23 bp, Homo sapiens
atgttttacgcaaggaaggactt

SEQ ID NO: 2981640 - DNA, 19 bp, Homo sapiens
atgttttagacaaatactc

SEQ ID NO: 2981641 - DNA, 23 bp, Homo sapiens
atgttttagacaaatactcatgt

SEQ ID NO: 2981642 - DNA, 20 bp, Homo sapiens
atgttttctgaaaatataac

SEQ ID NO: 2981643 - DNA, 14 bp, Homo sapiens
atgttttctgcaga

SEQ ID NO: 2981644 - DNA, 15 bp, Homo sapiens
atgttttctgcttta

SEQ ID NO: 2981645 - DNA, 21 bp, Homo sapiens
atgttttgataaagtagtaaa

SEQ ID NO: 2981646 - DNA, 12 bp, Homo sapiens
atgtttttatac

SEQ ID NO: 2981647 - DNA, 18 bp, Homo sapiens
atgtttttatacaaaata

SEQ ID NO: 2981648 - DNA, 14 bp, Homo sapiens
atgttttttctgca

SEQ ID NO: 2981649 - DNA, 15 bp, Homo sapiens
atgttttttctgcaa

SEQ ID NO: 2981650 - DNA, 14 bp, Homo sapiens
attaaaaaaaaaga

SEQ ID NO: 2981651 - DNA, 12 bp, Homo sapiens
attaaaaaacaa

SEQ ID NO: 2981652 - DNA, 19 bp, Homo sapiens
attaaaaaagcatacttct

SEQ ID NO: 2981653 - DNA, 16 bp, Homo sapiens
attaaaaaagctgctg

SEQ ID NO: 2981654 - DNA, 17 bp, Homo sapiens
attaaaaactagtagtt

SEQ ID NO: 2981655 - DNA, 19 bp, Homo sapiens
attaaaaagccttacagtt

SEQ ID NO: 2981656 - DNA, 11 bp, Homo sapiens
attaaaaccac

SEQ ID NO: 2981657 - DNA, 19 bp, Homo sapiens
attaaaagacaaatatgta

SEQ ID NO: 2981658 - DNA, 12 bp, Homo sapiens
attaaaagtcac

SEQ ID NO: 2981659 - DNA, 22 bp, Homo sapiens
attaaaagtcacaatgttcttt

SEQ ID NO: 2981660 - DNA, 23 bp, Homo sapiens
attaaaagtcacaatgttcttta

SEQ ID NO: 2981661 - DNA, 15 bp, Homo sapiens
attaaaataaaccaa

SEQ ID NO: 2981662 - DNA, 17 bp, Homo sapiens
attaaaataaaccaaat

SEQ ID NO: 2981663 - DNA, 13 bp, Homo sapiens
attaaaatatgaa

SEQ ID NO: 2981664 - DNA, 14 bp, Homo sapiens
attaaaatatgaag

SEQ ID NO: 2981665 - DNA, 15 bp, Homo sapiens
attaaaatctttctt

SEQ ID NO: 2981666 - DNA, 16 bp, Homo sapiens
attaaaattagtgctg

SEQ ID NO: 2981667 - DNA, 17 bp, Homo sapiens
attaaaattttatgaca

SEQ ID NO: 2981668 - DNA, 16 bp, Homo sapiens
attaaacccacaagct

SEQ ID NO: 2981669 - DNA, 22 bp, Homo sapiens
attaaacccacaagctgcctct

SEQ ID NO: 2981670 - DNA, 14 bp, Homo sapiens
attaaaccctggat

SEQ ID NO: 2981671 - DNA, 15 bp, Homo sapiens
attaaacctttccat

SEQ ID NO: 2981672 - DNA, 16 bp, Homo sapiens
attgaatacttacatt

SEQ ID NO: 2981673 - DNA, 20 bp, Homo sapiens
attgaatcatgtagtatcaa

SEQ ID NO: 2981674 - DNA, 18 bp, Homo sapiens
attgaatctatttaagta

SEQ ID NO: 2981675 - DNA, 13 bp, Homo sapiens
attgaatgctgcc

SEQ ID NO: 2981676 - DNA, 20 bp, Homo sapiens
attgaattcttggttgagga

SEQ ID NO: 2981677 - DNA, 22 bp, Homo sapiens
attgaattcttggttgaggaaa

SEQ ID NO: 2981678 - DNA, 14 bp, Homo sapiens
attgacacagaaaa

SEQ ID NO: 2981679 - DNA, 17 bp, Homo sapiens
attgacacagaaaatgt

SEQ ID NO: 2981680 - DNA, 21 bp, Homo sapiens
attgacagatcaagctgtgag

SEQ ID NO: 2981681 - DNA, 14 bp, Homo sapiens
attgacagctttgc

SEQ ID NO: 2981682 - DNA, 19 bp, Homo sapiens
attgacagctttgctgctg

SEQ ID NO: 2981683 - DNA, 23 bp, Homo sapiens
attgacatgaccctctgtcccca

SEQ ID NO: 2981684 - DNA, 14 bp, Homo sapiens
attgacattctcta

SEQ ID NO: 2981685 - DNA, 15 bp, Homo sapiens
attgacattctctat

SEQ ID NO: 2981686 - DNA, 16 bp, Homo sapiens
attgaccatgtgatta

SEQ ID NO: 2981687 - DNA, 23 bp, Homo sapiens
attgaccgcgactaatttcaaaa

SEQ ID NO: 2981688 - DNA, 15 bp, Homo sapiens
attgacttagatatt

SEQ ID NO: 2981689 - DNA, 18 bp, Homo sapiens
attgacttcaatgatagt

SEQ ID NO: 2981690 - DNA, 18 bp, Homo sapiens
attgagaactgcatatgt

SEQ ID NO: 2981691 - DNA, 22 bp, Homo sapiens
attgagaactgcatatgtttcg

SEQ ID NO: 2981692 - DNA, 14 bp, Homo sapiens
attgagaagttcat

SEQ ID NO: 2981693 - DNA, 16 bp, Homo sapiens
attgagaagttcattg

SEQ ID NO: 2981694 - DNA, 16 bp, Homo sapiens
attgagagttttgtct

SEQ ID NO: 2981695 - DNA, 15 bp, Homo sapiens
attgagcgtgattct

SEQ ID NO: 2981696 - DNA, 15 bp, Homo sapiens
attgagctctctcat

SEQ ID NO: 2981697 - DNA, 20 bp, Homo sapiens
attgaggataaaaaggaagg

SEQ ID NO: 2981698 - DNA, 14 bp, Homo sapiens
attgataagatggt

SEQ ID NO: 2981699 - DNA, 16 bp, Homo sapiens
attgataattgcattc

SEQ ID NO: 2981700 - DNA, 21 bp, Homo sapiens
attgatatacacggatgactt

SEQ ID NO: 2981701 - DNA, 19 bp, Homo sapiens
attgatgagcactcctgat

SEQ ID NO: 2981702 - DNA, 22 bp, Homo sapiens
attgattaaaatctcttgatta

SEQ ID NO: 2981703 - DNA, 13 bp, Homo sapiens
attgattcctttt

SEQ ID NO: 2981704 - DNA, 13 bp, Homo sapiens
attgatttaaaag

SEQ ID NO: 2981705 - DNA, 21 bp, Homo sapiens
attgatttaaaagtgtatttt

SEQ ID NO: 2981706 - DNA, 15 bp, Homo sapiens
attgatttcctgtgt

SEQ ID NO: 2981707 - DNA, 16 bp, Homo sapiens
attgatttcctgtgtc

SEQ ID NO: 2981708 - DNA, 17 bp, Homo sapiens
attgatttcctgtgtca

SEQ ID NO: 2981709 - DNA, 15 bp, Homo sapiens
attgatttcttttct

SEQ ID NO: 2981710 - DNA, 13 bp, Homo sapiens
attgatttgcatt

SEQ ID NO: 2981711 - DNA, 16 bp, Homo sapiens
attgatttgcattgaa

SEQ ID NO: 2981712 - DNA, 20 bp, Homo sapiens
attgatttgcattgaacaca

SEQ ID NO: 2981713 - DNA, 21 bp, Homo sapiens
attgcaaaatgcgtatttgca

SEQ ID NO: 2981714 - DNA, 20 bp, Homo sapiens
attgcaattttgcatagctt

SEQ ID NO: 2981715 - DNA, 13 bp, Homo sapiens
attgcacaatatt

SEQ ID NO: 2981716 - DNA, 13 bp, Homo sapiens
attgcacattgtt

SEQ ID NO: 2981717 - DNA, 19 bp, Homo sapiens
attgcacctatctcagcca

SEQ ID NO: 2981718 - DNA, 21 bp, Homo sapiens
attgcacctatctcagccata

SEQ ID NO: 2981719 - DNA, 17 bp, Homo sapiens
attgcactccagcctgg

SEQ ID NO: 2981720 - DNA, 22 bp, Homo sapiens
attgcactgaagtttttgaaat

SEQ ID NO: 2981721 - DNA, 20 bp, Homo sapiens
attgcagataactttgactt

SEQ ID NO: 2981722 - DNA, 18 bp, Homo sapiens
attgcaggagacattttc

SEQ ID NO: 2981723 - DNA, 19 bp, Homo sapiens
attgcagtttatcattcaa

SEQ ID NO: 2981724 - DNA, 14 bp, Homo sapiens
attgcatgtgactc

SEQ ID NO: 2981725 - DNA, 13 bp, Homo sapiens
attgcattcattg

SEQ ID NO: 2981726 - DNA, 14 bp, Homo sapiens
attgccaagggctt

SEQ ID NO: 2981727 - DNA, 17 bp, Homo sapiens
attgccaggaatgtttc

SEQ ID NO: 2981728 - DNA, 18 bp, Homo sapiens
attgccaggaatgtttca

SEQ ID NO: 2981729 - DNA, 19 bp, Homo sapiens
attgccatcgggtgccaaa

SEQ ID NO: 2981730 - DNA, 16 bp, Homo sapiens
attgcccaggctggtc

SEQ ID NO: 2981731 - DNA, 11 bp, Homo sapiens
attgccctggt

SEQ ID NO: 2981732 - DNA, 22 bp, Homo sapiens
attgcctctactttgattctga

SEQ ID NO: 2981733 - DNA, 20 bp, Homo sapiens
attgcctgactaaaatgttt

SEQ ID NO: 2981734 - DNA, 15 bp, Homo sapiens
attgcctgggcagtg

SEQ ID NO: 2981735 - DNA, 20 bp, Homo sapiens
attgccttctcaccagctgc

SEQ ID NO: 2981736 - DNA, 21 bp, Homo sapiens
attgccttctcaccagctgca

SEQ ID NO: 2981737 - DNA, 22 bp, Homo sapiens
attgccttctcaccagctgcaa

SEQ ID NO: 2981738 - DNA, 12 bp, Homo sapiens
attgcctttaaa

SEQ ID NO: 2981739 - DNA, 17 bp, Homo sapiens
attgcctttgaatgtta

SEQ ID NO: 2981740 - DNA, 16 bp, Homo sapiens
attgctaaatgtaaca

SEQ ID NO: 2981741 - DNA, 17 bp, Homo sapiens
attgctaaatgtaacag

SEQ ID NO: 2981742 - DNA, 18 bp, Homo sapiens
attgctaaatgtaacagt

SEQ ID NO: 2981743 - DNA, 17 bp, Homo sapiens
attgctaacgttttttc

SEQ ID NO: 2981744 - DNA, 15 bp, Homo sapiens
attgctaagatgctc

SEQ ID NO: 2981745 - DNA, 22 bp, Homo sapiens
attgctactagaaataaataac

SEQ ID NO: 2981746 - DNA, 19 bp, Homo sapiens
attgctccattttcttgtc

SEQ ID NO: 2981747 - DNA, 23 bp, Homo sapiens
attgctcccatcagggaagaacc

SEQ ID NO: 2981748 - DNA, 16 bp, Homo sapiens
attgctgagcctctgc

SEQ ID NO: 2981749 - DNA, 22 bp, Homo sapiens
attgctgagcctctgctcccca

SEQ ID NO: 2981750 - DNA, 23 bp, Homo sapiens
attgctgataccatatgaatgaa

SEQ ID NO: 2981751 - DNA, 14 bp, Homo sapiens
attgctgccacttt

SEQ ID NO: 2981752 - DNA, 22 bp, Homo sapiens
attgctgctccttagctgccaa

SEQ ID NO: 2981753 - DNA, 22 bp, Homo sapiens
attgctgtaggatctaaggctg

SEQ ID NO: 2981754 - DNA, 15 bp, Homo sapiens
attgctgtctgcagc

SEQ ID NO: 2981755 - DNA, 17 bp, Homo sapiens
attgctgtctgcagcct

SEQ ID NO: 2981756 - DNA, 17 bp, Homo sapiens
attgctgtgagccttgc

SEQ ID NO: 2981757 - DNA, 19 bp, Homo sapiens
attgcttcctcctccccaa

SEQ ID NO: 2981758 - DNA, 16 bp, Homo sapiens
attgctttctgaaatt

SEQ ID NO: 2981759 - DNA, 10 bp, Homo sapiens
attgctttga

SEQ ID NO: 2981760 - DNA, 16 bp, Homo sapiens
attgctttgaaaaagt

SEQ ID NO: 2981761 - DNA, 21 bp, Homo sapiens
attgcttttattacattagtt

SEQ ID NO: 2981762 - DNA, 16 bp, Homo sapiens
attggaaggagacaca

SEQ ID NO: 2981763 - DNA, 17 bp, Homo sapiens
attggaaggagacacag

SEQ ID NO: 2981764 - DNA, 15 bp, Homo sapiens
attggaataatcact

SEQ ID NO: 2981765 - DNA, 17 bp, Homo sapiens
attggacaaagaacctt

SEQ ID NO: 2981766 - DNA, 14 bp, Homo sapiens
attggacccttcca

SEQ ID NO: 2981767 - DNA, 16 bp, Homo sapiens
attggagatgcaaata

SEQ ID NO: 2981768 - DNA, 21 bp, Homo sapiens
attggagtgcagctaacatga

SEQ ID NO: 2981769 - DNA, 20 bp, Homo sapiens
attggataaagtttggtgtt

SEQ ID NO: 2981770 - DNA, 15 bp, Homo sapiens
attggatacagcagt

SEQ ID NO: 2981771 - DNA, 14 bp, Homo sapiens
attggatttgtcca

SEQ ID NO: 2981772 - DNA, 13 bp, Homo sapiens
attggccctgccc

SEQ ID NO: 2981773 - DNA, 16 bp, Homo sapiens
attggccctgcccctc

SEQ ID NO: 2981774 - DNA, 21 bp, Homo sapiens
attggcctgaacagatgtaaa

SEQ ID NO: 2981775 - DNA, 23 bp, Homo sapiens
attggcctgaacagatgtaaatc

SEQ ID NO: 2981776 - DNA, 21 bp, Homo sapiens
attggccttcgattttaaata

SEQ ID NO: 2981777 - DNA, 18 bp, Homo sapiens
attggctatttaaaactt

SEQ ID NO: 2981778 - DNA, 17 bp, Homo sapiens
attgggaataaatatgc

SEQ ID NO: 2981779 - DNA, 17 bp, Homo sapiens
attgggactagtttata

SEQ ID NO: 2981780 - DNA, 18 bp, Homo sapiens
attgggcagaatcctggg

SEQ ID NO: 2981781 - DNA, 15 bp, Homo sapiens
attgggctcagagag

SEQ ID NO: 2981782 - DNA, 18 bp, Homo sapiens
attggggtttgatttgct

SEQ ID NO: 2981783 - DNA, 22 bp, Homo sapiens
attgggtatcaagacatagcat

SEQ ID NO: 2981784 - DNA, 16 bp, Homo sapiens
attgggtctattccag

SEQ ID NO: 2981785 - DNA, 17 bp, Homo sapiens
attgggtctattccagc

SEQ ID NO: 2981786 - DNA, 23 bp, Homo sapiens
attgggtggggggcttcatacac

SEQ ID NO: 2981787 - DNA, 23 bp, Homo sapiens
attggtcatttagagtttcacag

SEQ ID NO: 2981788 - DNA, 20 bp, Homo sapiens
attggtccaccctttcatag

SEQ ID NO: 2981789 - DNA, 14 bp, Homo sapiens
attggtccagcttg

SEQ ID NO: 2981790 - DNA, 17 bp, Homo sapiens
attggtccagcttgctc

SEQ ID NO: 2981791 - DNA, 21 bp, Homo sapiens
attggtctgggtggatgtgag

SEQ ID NO: 2981792 - DNA, 18 bp, Homo sapiens
attggtgtatatcatgaa

SEQ ID NO: 2981793 - DNA, 19 bp, Homo sapiens
attggttggacactgtggt

SEQ ID NO: 2981794 - DNA, 14 bp, Homo sapiens
attggttgtatata

SEQ ID NO: 2981795 - DNA, 15 bp, Homo sapiens
attggttgtatataa

SEQ ID NO: 2981796 - DNA, 23 bp, Homo sapiens
attggtttgttattcttttccag

SEQ ID NO: 2981797 - DNA, 19 bp, Homo sapiens
attgtaaataaattttgtg

SEQ ID NO: 2981798 - DNA, 19 bp, Homo sapiens
attgtaaatgctattatac

SEQ ID NO: 2981799 - DNA, 23 bp, Homo sapiens
attgtaataggcgtaactaattt

SEQ ID NO: 2981800 - DNA, 13 bp, Homo sapiens
attgtaatctatg

SEQ ID NO: 2981801 - DNA, 16 bp, Homo sapiens
attgtaccttttaaca

SEQ ID NO: 2981802 - DNA, 18 bp, Homo sapiens
attgtactcaatggattt

SEQ ID NO: 2981803 - DNA, 14 bp, Homo sapiens
attgtactccagcc

SEQ ID NO: 2981804 - DNA, 15 bp, Homo sapiens
atttagtttgattat

SEQ ID NO: 2981805 - DNA, 15 bp, Homo sapiens
atttataaacagaca

SEQ ID NO: 2981806 - DNA, 23 bp, Homo sapiens
atttataaacagacaatatgtga

SEQ ID NO: 2981807 - DNA, 15 bp, Homo sapiens
atttatagaagaaat

SEQ ID NO: 2981808 - DNA, 21 bp, Homo sapiens
atttatagtaatgagtttaaa

SEQ ID NO: 2981809 - DNA, 19 bp, Homo sapiens
atttatatattgtctgtaa

SEQ ID NO: 2981810 - DNA, 20 bp, Homo sapiens
atttatatgaagcaagctgt

SEQ ID NO: 2981811 - DNA, 17 bp, Homo sapiens
atttatatgtacatgag

SEQ ID NO: 2981812 - DNA, 13 bp, Homo sapiens
atttatatgtact

SEQ ID NO: 2981813 - DNA, 18 bp, Homo sapiens
atttatattgtaaatatt

SEQ ID NO: 2981814 - DNA, 20 bp, Homo sapiens
atttatattgtaaatattgt

SEQ ID NO: 2981815 - DNA, 17 bp, Homo sapiens
atttatccaaaatgtgt

SEQ ID NO: 2981816 - DNA, 18 bp, Homo sapiens
atttatccaaaatgtgta

SEQ ID NO: 2981817 - DNA, 17 bp, Homo sapiens
atttatctaaaagaatt

SEQ ID NO: 2981818 - DNA, 20 bp, Homo sapiens
atttatctgggattatggtt

SEQ ID NO: 2981819 - DNA, 24 bp, Homo sapiens
atttatgacaagctgtatcactgc

SEQ ID NO: 2981820 - DNA, 13 bp, Homo sapiens
atttatgatttca

SEQ ID NO: 2981821 - DNA, 15 bp, Homo sapiens
atttatgtagacatt

SEQ ID NO: 2981822 - DNA, 16 bp, Homo sapiens
atttatgtagacattg

SEQ ID NO: 2981823 - DNA, 17 bp, Homo sapiens
atttatgtagacattgt

SEQ ID NO: 2981824 - DNA, 20 bp, Homo sapiens
atttatgtagacattgtaaa

SEQ ID NO: 2981825 - DNA, 23 bp, Homo sapiens
atttatgtagacattgtaaataa

SEQ ID NO: 2981826 - DNA, 12 bp, Homo sapiens
atttatgtatct

SEQ ID NO: 2981827 - DNA, 13 bp, Homo sapiens
atttatgtttgca

SEQ ID NO: 2981828 - DNA, 13 bp, Homo sapiens
atttattatttat

SEQ ID NO: 2981829 - DNA, 16 bp, Homo sapiens
atttattgaaattttt

SEQ ID NO: 2981830 - DNA, 20 bp, Homo sapiens
atttattgaatatttatact

SEQ ID NO: 2981831 - DNA, 23 bp, Homo sapiens
atttattgattccttttttcaaa

SEQ ID NO: 2981832 - DNA, 17 bp, Homo sapiens
atttattggatgataca

SEQ ID NO: 2981833 - DNA, 16 bp, Homo sapiens
atttattgtttatgta

SEQ ID NO: 2981834 - DNA, 19 bp, Homo sapiens
atttattgtttatgtaaat

SEQ ID NO: 2981835 - DNA, 21 bp, Homo sapiens
atttattgtttatgtaaatgt

SEQ ID NO: 2981836 - DNA, 20 bp, Homo sapiens
atttatttaaaagattcatt

SEQ ID NO: 2981837 - DNA, 15 bp, Homo sapiens
atttatttaattttc

SEQ ID NO: 2981838 - DNA, 13 bp, Homo sapiens
atttatttattat

SEQ ID NO: 2981839 - DNA, 13 bp, Homo sapiens
atttatttcttaa

SEQ ID NO: 2981840 - DNA, 13 bp, Homo sapiens
atttattttatga

SEQ ID NO: 2981841 - DNA, 16 bp, Homo sapiens
atttattttatgagaa

SEQ ID NO: 2981842 - DNA, 22 bp, Homo sapiens
atttatttttagccattgtcgt

SEQ ID NO: 2981843 - DNA, 13 bp, Homo sapiens
atttcaaaatata

SEQ ID NO: 2981844 - DNA, 13 bp, Homo sapiens
atttcaaaatgct

SEQ ID NO: 2981845 - DNA, 16 bp, Homo sapiens
atttcaaaattaatag

SEQ ID NO: 2981846 - DNA, 19 bp, Homo sapiens
atttcaaaattaatagctt

SEQ ID NO: 2981847 - DNA, 20 bp, Homo sapiens
atttcaaaattaatagcttt

SEQ ID NO: 2981848 - DNA, 17 bp, Homo sapiens
atttcaaacatttgtca

SEQ ID NO: 2981849 - DNA, 16 bp, Homo sapiens
atttcaaagccctgcc

SEQ ID NO: 2981850 - DNA, 12 bp, Homo sapiens
atttcaaatctc

SEQ ID NO: 2981851 - DNA, 15 bp, Homo sapiens
atttcaaatctgtaa

SEQ ID NO: 2981852 - DNA, 21 bp, Homo sapiens
atttcaaatctgtaattacca

SEQ ID NO: 2981853 - DNA, 17 bp, Homo sapiens
atttcaaattggagctt

SEQ ID NO: 2981854 - DNA, 14 bp, Homo sapiens
atttcaagatccaa

SEQ ID NO: 2981855 - DNA, 12 bp, Homo sapiens
atttcaaggttc

SEQ ID NO: 2981856 - DNA, 15 bp, Homo sapiens
atttcaaggttctaa

SEQ ID NO: 2981857 - DNA, 17 bp, Homo sapiens
atttcaaggttctaacc

SEQ ID NO: 2981858 - DNA, 22 bp, Homo sapiens
atttcaataaatgatatataat

SEQ ID NO: 2981859 - DNA, 22 bp, Homo sapiens
atttcaatcccacgtacttata

SEQ ID NO: 2981860 - DNA, 15 bp, Homo sapiens
atttcacaagctatt

SEQ ID NO: 2981861 - DNA, 15 bp, Homo sapiens
atttcacatgccttg

SEQ ID NO: 2981862 - DNA, 14 bp, Homo sapiens
atttcacattgaat

SEQ ID NO: 2981863 - DNA, 12 bp, Homo sapiens
atttcactgtct

SEQ ID NO: 2981864 - DNA, 13 bp, Homo sapiens
atttcactgtctt

SEQ ID NO: 2981865 - DNA, 12 bp, Homo sapiens
atttcacttaat

SEQ ID NO: 2981866 - DNA, 17 bp, Homo sapiens
atttcacttaataatgt

SEQ ID NO: 2981867 - DNA, 19 bp, Homo sapiens
atttcagaaggagaaggaa

SEQ ID NO: 2981868 - DNA, 12 bp, Homo sapiens
atttcagactcc

SEQ ID NO: 2981869 - DNA, 23 bp, Homo sapiens
atttcagactcccattcctgaag

SEQ ID NO: 2981870 - DNA, 14 bp, Homo sapiens
atttcagatgtaat

SEQ ID NO: 2981871 - DNA, 17 bp, Homo sapiens
atttcagatgtaatgtt

SEQ ID NO: 2981872 - DNA, 19 bp, Homo sapiens
atttcagatgtaatgtttt

SEQ ID NO: 2981873 - DNA, 11 bp, Homo sapiens
atttcagccat

SEQ ID NO: 2981874 - DNA, 16 bp, Homo sapiens
atttcaggaatttaaa

SEQ ID NO: 2981875 - DNA, 16 bp, Homo sapiens
atttcaggccctcagc

SEQ ID NO: 2981876 - DNA, 17 bp, Homo sapiens
atttcaggctccccaga

SEQ ID NO: 2981877 - DNA, 14 bp, Homo sapiens
atttcagggaaatt

SEQ ID NO: 2981878 - DNA, 20 bp, Homo sapiens
atttcagggaaattaatcaa

SEQ ID NO: 2981879 - DNA, 18 bp, Homo sapiens
atttcaggtgtaaccatt

SEQ ID NO: 2981880 - DNA, 15 bp, Homo sapiens
atttcagtaatgtct

SEQ ID NO: 2981881 - DNA, 13 bp, Homo sapiens
atttcagtgccat

SEQ ID NO: 2981882 - DNA, 22 bp, Homo sapiens
atttcagttccgtcagaaagtg

SEQ ID NO: 2981883 - DNA, 18 bp, Homo sapiens
atttcatattctttcaat

SEQ ID NO: 2981884 - DNA, 22 bp, Homo sapiens
atttcatgtgtcaacttcaaca

SEQ ID NO: 2981885 - DNA, 16 bp, Homo sapiens
atttccaaagagaaaa

SEQ ID NO: 2981886 - DNA, 19 bp, Homo sapiens
atttccagaaggatttctt

SEQ ID NO: 2981887 - DNA, 14 bp, Homo sapiens
atttcccaggaccc

SEQ ID NO: 2981888 - DNA, 16 bp, Homo sapiens
atttcccaggaccctg

SEQ ID NO: 2981889 - DNA, 22 bp, Homo sapiens
atttcccagtaattattttctt

SEQ ID NO: 2981890 - DNA, 18 bp, Homo sapiens
atttccccaacagtgtga

SEQ ID NO: 2981891 - DNA, 23 bp, Homo sapiens
atttcccctctgcacccagaaca

SEQ ID NO: 2981892 - DNA, 23 bp, Homo sapiens
atttccctgaaggaaccaaagcg

SEQ ID NO: 2981893 - DNA, 20 bp, Homo sapiens
atttcccttccttcctctcc

SEQ ID NO: 2981894 - DNA, 22 bp, Homo sapiens
atttccgtccccccccaggccc

SEQ ID NO: 2981895 - DNA, 23 bp, Homo sapiens
atttcctaatgagatatatcttt

SEQ ID NO: 2981896 - DNA, 16 bp, Homo sapiens
atttcctccacaaatt

SEQ ID NO: 2981897 - DNA, 20 bp, Homo sapiens
atttcctccattcctgctct

SEQ ID NO: 2981898 - DNA, 12 bp, Homo sapiens
atttcctcctcc

SEQ ID NO: 2981899 - DNA, 24 bp, Homo sapiens
atttcctcctcccagtgccttctg

SEQ ID NO: 2981900 - DNA, 18 bp, Homo sapiens
atttcctgaaataaatgt

SEQ ID NO: 2981901 - DNA, 14 bp, Homo sapiens
atttcctggatgtt

SEQ ID NO: 2981902 - DNA, 17 bp, Homo sapiens
atttcctggtgtgaagg

SEQ ID NO: 2981903 - DNA, 16 bp, Homo sapiens
atttcctgttggattt

SEQ ID NO: 2981904 - DNA, 21 bp, Homo sapiens
atttcctgttggatttgttta

SEQ ID NO: 2981905 - DNA, 17 bp, Homo sapiens
atttcctttatactgtg

SEQ ID NO: 2981906 - DNA, 19 bp, Homo sapiens
atttcctttatactgtgaa

SEQ ID NO: 2981907 - DNA, 15 bp, Homo sapiens
atttcgatgtacagt

SEQ ID NO: 2981908 - DNA, 20 bp, Homo sapiens
atttcggttgagaatggaaa

SEQ ID NO: 2981909 - DNA, 14 bp, Homo sapiens
atttcgtgagcccc

SEQ ID NO: 2981910 - DNA, 17 bp, Homo sapiens
atttcgtgtaatattct

SEQ ID NO: 2981911 - DNA, 18 bp, Homo sapiens
atttctaatgttggacac

SEQ ID NO: 2981912 - DNA, 15 bp, Homo sapiens
atttctactgaagtt

SEQ ID NO: 2981913 - DNA, 23 bp, Homo sapiens
atttctagaacatccctgccagc

SEQ ID NO: 2981914 - DNA, 20 bp, Homo sapiens
atttctatttctcctccatg

SEQ ID NO: 2981915 - DNA, 15 bp, Homo sapiens
atttctattttgcaa

SEQ ID NO: 2981916 - DNA, 20 bp, Homo sapiens
atttctcaaagatctgaatt

SEQ ID NO: 2981917 - DNA, 21 bp, Homo sapiens
atttctcagactttggaaaat

SEQ ID NO: 2981918 - DNA, 16 bp, Homo sapiens
atttctctgtgaatcc

SEQ ID NO: 2981919 - DNA, 20 bp, Homo sapiens
atttctctgtgtatttatat

SEQ ID NO: 2981920 - DNA, 22 bp, Homo sapiens
atttctctgtgtatttatataa

SEQ ID NO: 2981921 - DNA, 16 bp, Homo sapiens
atttctgataagacat

SEQ ID NO: 2981922 - DNA, 20 bp, Homo sapiens
atttctgcacaggtctctgt

SEQ ID NO: 2981923 - DNA, 23 bp, Homo sapiens
atttctgcacaggtctctgttta

SEQ ID NO: 2981924 - DNA, 20 bp, Homo sapiens
atttctgcctataaatttac

SEQ ID NO: 2981925 - DNA, 23 bp, Homo sapiens
atttctgcctataaatttactct

SEQ ID NO: 2981926 - DNA, 15 bp, Homo sapiens
atttctggaatggaa

SEQ ID NO: 2981927 - DNA, 15 bp, Homo sapiens
atttcttaaatcttt

SEQ ID NO: 2981928 - DNA, 17 bp, Homo sapiens
atttcttaacctttgct

SEQ ID NO: 2981929 - DNA, 20 bp, Homo sapiens
atttcttaagtataaacctt

SEQ ID NO: 2981930 - DNA, 11 bp, Homo sapiens
atttcttaggg

SEQ ID NO: 2981931 - DNA, 22 bp, Homo sapiens
atttcttatacgcttttctttg

SEQ ID NO: 2981932 - DNA, 22 bp, Homo sapiens
atttcttcaggaggagtcatgt

SEQ ID NO: 2981933 - DNA, 15 bp, Homo sapiens
atttcttcagggctg

SEQ ID NO: 2981934 - DNA, 18 bp, Homo sapiens
atttcttgctaagctcca

SEQ ID NO: 2981935 - DNA, 12 bp, Homo sapiens
atttctttaaaa

SEQ ID NO: 2981936 - DNA, 18 bp, Homo sapiens
caaacaaaagcagccctc

SEQ ID NO: 2981937 - DNA, 15 bp, Homo sapiens
caaacaaccttcagc

SEQ ID NO: 2981938 - DNA, 18 bp, Homo sapiens
caaacaaccttcagcttt

SEQ ID NO: 2981939 - DNA, 14 bp, Homo sapiens
caaacaatttaaaa

SEQ ID NO: 2981940 - DNA, 15 bp, Homo sapiens
caaacacaagaaatc

SEQ ID NO: 2981941 - DNA, 23 bp, Homo sapiens
caaacacaaggtcatggccacac

SEQ ID NO: 2981942 - DNA, 16 bp, Homo sapiens
caaacacaataagagt

SEQ ID NO: 2981943 - DNA, 16 bp, Homo sapiens
caaacacacacaaaag

SEQ ID NO: 2981944 - DNA, 11 bp, Homo sapiens
caaacagcaaa

SEQ ID NO: 2981945 - DNA, 16 bp, Homo sapiens
caaacagggtggccca

SEQ ID NO: 2981946 - DNA, 15 bp, Homo sapiens
caaacaggtgctggc

SEQ ID NO: 2981947 - DNA, 22 bp, Homo sapiens
caaacagtgaatttaagcatga

SEQ ID NO: 2981948 - DNA, 16 bp, Homo sapiens
caaacatatgcacatt

SEQ ID NO: 2981949 - DNA, 13 bp, Homo sapiens
caaacatgaaaac

SEQ ID NO: 2981950 - DNA, 16 bp, Homo sapiens
caaacatgaaaacatt

SEQ ID NO: 2981951 - DNA, 19 bp, Homo sapiens
caaacatgaaaacattgat

SEQ ID NO: 2981952 - DNA, 23 bp, Homo sapiens
caaacatgagatgtgtggactgt

SEQ ID NO: 2981953 - DNA, 15 bp, Homo sapiens
caaaccacactggac

SEQ ID NO: 2981954 - DNA, 15 bp, Homo sapiens
caaaccagcctcagc

SEQ ID NO: 2981955 - DNA, 14 bp, Homo sapiens
caaacccagaacat

SEQ ID NO: 2981956 - DNA, 19 bp, Homo sapiens
caaacccaggagtttgtgt

SEQ ID NO: 2981957 - DNA, 20 bp, Homo sapiens
caaacccttagcagcccagc

SEQ ID NO: 2981958 - DNA, 13 bp, Homo sapiens
caaaccggcaggt

SEQ ID NO: 2981959 - DNA, 22 bp, Homo sapiens
caaacctgtagatgcagaaaaa

SEQ ID NO: 2981960 - DNA, 17 bp, Homo sapiens
caaaccttgaggagaag

SEQ ID NO: 2981961 - DNA, 20 bp, Homo sapiens
caaacctttattttagaatt

SEQ ID NO: 2981962 - DNA, 20 bp, Homo sapiens
caaacctttttatattttat

SEQ ID NO: 2981963 - DNA, 23 bp, Homo sapiens
caaacgccctttcctcctcaggc

SEQ ID NO: 2981964 - DNA, 14 bp, Homo sapiens
caaacgcctcccct

SEQ ID NO: 2981965 - DNA, 17 bp, Homo sapiens
caaacgcctcccctgcc

SEQ ID NO: 2981966 - DNA, 13 bp, Homo sapiens
caaacgctgcctg

SEQ ID NO: 2981967 - DNA, 14 bp, Homo sapiens
caaacgctgcctgc

SEQ ID NO: 2981968 - DNA, 15 bp, Homo sapiens
caaacgctgcctgcc

SEQ ID NO: 2981969 - DNA, 18 bp, Homo sapiens
caaacgctgcctgcccac

SEQ ID NO: 2981970 - DNA, 18 bp, Homo sapiens
caaacggagcccctgaaa

SEQ ID NO: 2981971 - DNA, 20 bp, Homo sapiens
caaactaaggtgctaaatct

SEQ ID NO: 2981972 - DNA, 18 bp, Homo sapiens
caaactacctatattcct

SEQ ID NO: 2981973 - DNA, 14 bp, Homo sapiens
caaactacttgatt

SEQ ID NO: 2981974 - DNA, 14 bp, Homo sapiens
caaactctctgaac

SEQ ID NO: 2981975 - DNA, 18 bp, Homo sapiens
caaactctgctgtctaac

SEQ ID NO: 2981976 - DNA, 14 bp, Homo sapiens
caaactcttcagtt

SEQ ID NO: 2981977 - DNA, 16 bp, Homo sapiens
caaactgagactctta

SEQ ID NO: 2981978 - DNA, 15 bp, Homo sapiens
caaactgctggaaat

SEQ ID NO: 2981979 - DNA, 12 bp, Homo sapiens
caaactgtaaat

SEQ ID NO: 2981980 - DNA, 23 bp, Homo sapiens
caaactgtagttgttttggcgat

SEQ ID NO: 2981981 - DNA, 21 bp, Homo sapiens
caaacttgggtagagtttaca

SEQ ID NO: 2981982 - DNA, 22 bp, Homo sapiens
caaactttattgacaagtgatt

SEQ ID NO: 2981983 - DNA, 23 bp, Homo sapiens
caaacttttattagccagtgaaa

SEQ ID NO: 2981984 - DNA, 23 bp, Homo sapiens
caaagaaatccccccttcagaac

SEQ ID NO: 2981985 - DNA, 18 bp, Homo sapiens
caaagaaccatgcaggaa

SEQ ID NO: 2981986 - DNA, 17 bp, Homo sapiens
caaagaaccttgaagaa

SEQ ID NO: 2981987 - DNA, 14 bp, Homo sapiens
caaagaagacaaca

SEQ ID NO: 2981988 - DNA, 20 bp, Homo sapiens
caaagaagacatgttttaga

SEQ ID NO: 2981989 - DNA, 23 bp, Homo sapiens
caaagaatccctagactttaggc

SEQ ID NO: 2981990 - DNA, 20 bp, Homo sapiens
caaagagagttaaaagcagc

SEQ ID NO: 2981991 - DNA, 17 bp, Homo sapiens
caaagagcctttccaaa

SEQ ID NO: 2981992 - DNA, 22 bp, Homo sapiens
caaagaggctgaggctggcaca

SEQ ID NO: 2981993 - DNA, 17 bp, Homo sapiens
caaagagtctctggctc

SEQ ID NO: 2981994 - DNA, 18 bp, Homo sapiens
caaagagtctctggctca

SEQ ID NO: 2981995 - DNA, 20 bp, Homo sapiens
caaagagtctctggctcagc

SEQ ID NO: 2981996 - DNA, 13 bp, Homo sapiens
caaagagtgaaat

SEQ ID NO: 2981997 - DNA, 14 bp, Homo sapiens
caaagagtgaaata

SEQ ID NO: 2981998 - DNA, 19 bp, Homo sapiens
caaagagtgaaatattgta

SEQ ID NO: 2981999 - DNA, 22 bp, Homo sapiens
caaagagtgaaatattgtaaat

SEQ ID NO: 2982000 - DNA, 23 bp, Homo sapiens
caaagagtgaaatattgtaaatg

SEQ ID NO: 2982001 - DNA, 16 bp, Homo sapiens
caaagatatatattca

SEQ ID NO: 2982002 - DNA, 22 bp, Homo sapiens
caaagatctgaattaaataaat

SEQ ID NO: 2982003 - DNA, 20 bp, Homo sapiens
caaagatctgtcctcagcct

SEQ ID NO: 2982004 - DNA, 19 bp, Homo sapiens
caaagatgaccataaccac

SEQ ID NO: 2982005 - DNA, 13 bp, Homo sapiens
caaagatgataat

SEQ ID NO: 2982006 - DNA, 20 bp, Homo sapiens
caaagatgggtgaaggctgg

SEQ ID NO: 2982007 - DNA, 22 bp, Homo sapiens
caaagatgggtgaaggctggca

SEQ ID NO: 2982008 - DNA, 12 bp, Homo sapiens
caaagcagacag

SEQ ID NO: 2982009 - DNA, 15 bp, Homo sapiens
caaagcagacagctc

SEQ ID NO: 2982010 - DNA, 16 bp, Homo sapiens
caaagcagacagctcc

SEQ ID NO: 2982011 - DNA, 17 bp, Homo sapiens
caaagcagacagctcca

SEQ ID NO: 2982012 - DNA, 16 bp, Homo sapiens
caaagcaggagtggaa

SEQ ID NO: 2982013 - DNA, 18 bp, Homo sapiens
caaagcaggagtggaagg

SEQ ID NO: 2982014 - DNA, 23 bp, Homo sapiens
caaagcagtggcttagctgccat

SEQ ID NO: 2982015 - DNA, 19 bp, Homo sapiens
caaagcatcggtcatgtgt

SEQ ID NO: 2982016 - DNA, 21 bp, Homo sapiens
caaagcatcggtcatgtgtgt

SEQ ID NO: 2982017 - DNA, 20 bp, Homo sapiens
caaagccactggaaggagca

SEQ ID NO: 2982018 - DNA, 20 bp, Homo sapiens
caaagccagcgtcctcctct

SEQ ID NO: 2982019 - DNA, 13 bp, Homo sapiens
caaagccatatgg

SEQ ID NO: 2982020 - DNA, 19 bp, Homo sapiens
caaagccatatggacactg

SEQ ID NO: 2982021 - DNA, 16 bp, Homo sapiens
caaagccctgcctctg

SEQ ID NO: 2982022 - DNA, 19 bp, Homo sapiens
caaagccggcctgagaaac

SEQ ID NO: 2982023 - DNA, 18 bp, Homo sapiens
caaagcgcccacccaggt

SEQ ID NO: 2982024 - DNA, 20 bp, Homo sapiens
caaagctcaaataaaaataa

SEQ ID NO: 2982025 - DNA, 15 bp, Homo sapiens
caaagcttagcagga

SEQ ID NO: 2982026 - DNA, 17 bp, Homo sapiens
caaagcttagcaggaga

SEQ ID NO: 2982027 - DNA, 16 bp, Homo sapiens
caaagcttcaaaaact

SEQ ID NO: 2982028 - DNA, 23 bp, Homo sapiens
caaagctttatttcaaatctctt

SEQ ID NO: 2982029 - DNA, 19 bp, Homo sapiens
caaaggagctcgaaggata

SEQ ID NO: 2982030 - DNA, 20 bp, Homo sapiens
caaaggaggacaagaccctc

SEQ ID NO: 2982031 - DNA, 21 bp, Homo sapiens
caaaggatgtgttttcagtct

SEQ ID NO: 2982032 - DNA, 22 bp, Homo sapiens
caaaggatgtgttttcagtctt

SEQ ID NO: 2982033 - DNA, 15 bp, Homo sapiens
caaaggcaagcactt

SEQ ID NO: 2982034 - DNA, 17 bp, Homo sapiens
caaaggcagtcccggga

SEQ ID NO: 2982035 - DNA, 18 bp, Homo sapiens
caaaggcatccaggccag

SEQ ID NO: 2982036 - DNA, 21 bp, Homo sapiens
caaagggacttttgtaaaatc

SEQ ID NO: 2982037 - DNA, 20 bp, Homo sapiens
caaagggcacagcatctgta

SEQ ID NO: 2982038 - DNA, 23 bp, Homo sapiens
caaagggcatgggtcgggagagg

SEQ ID NO: 2982039 - DNA, 12 bp, Homo sapiens
caaagggcccag

SEQ ID NO: 2982040 - DNA, 14 bp, Homo sapiens
caaagggcctcctc

SEQ ID NO: 2982041 - DNA, 17 bp, Homo sapiens
caaaggtgtgcaaactt

SEQ ID NO: 2982042 - DNA, 22 bp, Homo sapiens
caaaggttctaggtttcaaaga

SEQ ID NO: 2982043 - DNA, 13 bp, Homo sapiens
caaagtaaaagaa

SEQ ID NO: 2982044 - DNA, 23 bp, Homo sapiens
caaagtaaaagaaaccacttctg

SEQ ID NO: 2982045 - DNA, 16 bp, Homo sapiens
caaagtaaactgtgta

SEQ ID NO: 2982046 - DNA, 13 bp, Homo sapiens
caaagtactgtaa

SEQ ID NO: 2982047 - DNA, 19 bp, Homo sapiens
caaagtatcaggacgagaa

SEQ ID NO: 2982048 - DNA, 17 bp, Homo sapiens
caaagtattgtaaatta

SEQ ID NO: 2982049 - DNA, 15 bp, Homo sapiens
caaagtcacagtcgt

SEQ ID NO: 2982050 - DNA, 15 bp, Homo sapiens
caaagtcacttctcc

SEQ ID NO: 2982051 - DNA, 16 bp, Homo sapiens
caaagtcacttctcca

SEQ ID NO: 2982052 - DNA, 17 bp, Homo sapiens
caaagtcacttctccat

SEQ ID NO: 2982053 - DNA, 23 bp, Homo sapiens
caaagtcctttttttccatcttt

SEQ ID NO: 2982054 - DNA, 14 bp, Homo sapiens
caaagtctaaactg

SEQ ID NO: 2982055 - DNA, 19 bp, Homo sapiens
caaagtctccagaagaaaa

SEQ ID NO: 2982056 - DNA, 14 bp, Homo sapiens
caaagtctctaatt

SEQ ID NO: 2982057 - DNA, 14 bp, Homo sapiens
caaagtgccaaaga

SEQ ID NO: 2982058 - DNA, 19 bp, Homo sapiens
caaagtgctgggattacag

SEQ ID NO: 2982059 - DNA, 20 bp, Homo sapiens
caaagtgctgggattacagg

SEQ ID NO: 2982060 - DNA, 19 bp, Homo sapiens
caaagtgtcttttgacatt

SEQ ID NO: 2982061 - DNA, 23 bp, Homo sapiens
caaagtgttttgtaccagtgaat

SEQ ID NO: 2982062 - DNA, 15 bp, Homo sapiens
caaagttaaatgtat

SEQ ID NO: 2982063 - DNA, 16 bp, Homo sapiens
caaagttaacagattt

SEQ ID NO: 2982064 - DNA, 21 bp, Homo sapiens
caaagttaattgtatttatgt

SEQ ID NO: 2982065 - DNA, 21 bp, Homo sapiens
caaagttctaataatttctaa

SEQ ID NO: 2982066 - DNA, 18 bp, Homo sapiens
caaataaaaaacagaaac

SEQ ID NO: 2982067 - DNA, 20 bp, Homo sapiens
caaggtgcatatagaaaaca

SEQ ID NO: 2982068 - DNA, 19 bp, Homo sapiens
caaggtggctccagcacca

SEQ ID NO: 2982069 - DNA, 12 bp, Homo sapiens
caaggtgggcgg

SEQ ID NO: 2982070 - DNA, 18 bp, Homo sapiens
caaggtgtccctgccttc

SEQ ID NO: 2982071 - DNA, 21 bp, Homo sapiens
caaggttactcagcagcagag

SEQ ID NO: 2982072 - DNA, 17 bp, Homo sapiens
caaggttatatgaatat

SEQ ID NO: 2982073 - DNA, 15 bp, Homo sapiens
caaggttccacagag

SEQ ID NO: 2982074 - DNA, 18 bp, Homo sapiens
caaggtttaaagagtcta

SEQ ID NO: 2982075 - DNA, 22 bp, Homo sapiens
caaggtttaaagagtctagatt

SEQ ID NO: 2982076 - DNA, 24 bp, Homo sapiens
caaggtttaggctggtggcccagg

SEQ ID NO: 2982077 - DNA, 17 bp, Homo sapiens
caaggtttcgtggcagc

SEQ ID NO: 2982078 - DNA, 13 bp, Homo sapiens
caaggttttaggt

SEQ ID NO: 2982079 - DNA, 18 bp, Homo sapiens
caaggttttaggttctaa

SEQ ID NO: 2982080 - DNA, 20 bp, Homo sapiens
caaggttttaggttctaaag

SEQ ID NO: 2982081 - DNA, 15 bp, Homo sapiens
caagtactacatttt

SEQ ID NO: 2982082 - DNA, 17 bp, Homo sapiens
caagtagaacaaaaact

SEQ ID NO: 2982083 - DNA, 13 bp, Homo sapiens
caagtagaatctc

SEQ ID NO: 2982084 - DNA, 23 bp, Homo sapiens
caagtagaatctcagttgatttt

SEQ ID NO: 2982085 - DNA, 13 bp, Homo sapiens
caagtagctgcta

SEQ ID NO: 2982086 - DNA, 21 bp, Homo sapiens
caagtagctgggattttaaac

SEQ ID NO: 2982087 - DNA, 18 bp, Homo sapiens
caagtatactagggagcc

SEQ ID NO: 2982088 - DNA, 12 bp, Homo sapiens
caagtatatact

SEQ ID NO: 2982089 - DNA, 18 bp, Homo sapiens
caagtatatacttttaaa

SEQ ID NO: 2982090 - DNA, 20 bp, Homo sapiens
caagtcactcttttttagtt

SEQ ID NO: 2982091 - DNA, 13 bp, Homo sapiens
caagtcaggccag

SEQ ID NO: 2982092 - DNA, 17 bp, Homo sapiens
caagtcatgtaaatact

SEQ ID NO: 2982093 - DNA, 23 bp, Homo sapiens
caagtcatttccgtcccccccca

SEQ ID NO: 2982094 - DNA, 19 bp, Homo sapiens
caagtcctgactgggctgg

SEQ ID NO: 2982095 - DNA, 20 bp, Homo sapiens
caagtcctgactgggctggg

SEQ ID NO: 2982096 - DNA, 18 bp, Homo sapiens
caagtcctttaactcgtt

SEQ ID NO: 2982097 - DNA, 16 bp, Homo sapiens
caagtccttttgtaaa

SEQ ID NO: 2982098 - DNA, 17 bp, Homo sapiens
caagtccttttgtaaag

SEQ ID NO: 2982099 - DNA, 18 bp, Homo sapiens
caagtccttttgtaaagt

SEQ ID NO: 2982100 - DNA, 17 bp, Homo sapiens
caagtcgatgaactatt

SEQ ID NO: 2982101 - DNA, 23 bp, Homo sapiens
caagtcttaacaaaccaacatct

SEQ ID NO: 2982102 - DNA, 20 bp, Homo sapiens
caagtctttaggtctttgta

SEQ ID NO: 2982103 - DNA, 22 bp, Homo sapiens
caagtctttaggtctttgtaag

SEQ ID NO: 2982104 - DNA, 19 bp, Homo sapiens
caagtgatctgtccacctc

SEQ ID NO: 2982105 - DNA, 16 bp, Homo sapiens
caagtgattctcctgc

SEQ ID NO: 2982106 - DNA, 17 bp, Homo sapiens
caagtgcaatatgggcg

SEQ ID NO: 2982107 - DNA, 22 bp, Homo sapiens
caagtgcaatatgggcgggcag

SEQ ID NO: 2982108 - DNA, 17 bp, Homo sapiens
caagtgccgcaaattgt

SEQ ID NO: 2982109 - DNA, 15 bp, Homo sapiens
caagtgctcaagcag

SEQ ID NO: 2982110 - DNA, 19 bp, Homo sapiens
caagtgctcaagcagcaaa

SEQ ID NO: 2982111 - DNA, 21 bp, Homo sapiens
caagtgctggcccacccagtc

SEQ ID NO: 2982112 - DNA, 18 bp, Homo sapiens
caagtgctgtttgggcag

SEQ ID NO: 2982113 - DNA, 12 bp, Homo sapiens
caagtggacctt

SEQ ID NO: 2982114 - DNA, 23 bp, Homo sapiens
caagtggaccttaggccttcctc

SEQ ID NO: 2982115 - DNA, 16 bp, Homo sapiens
caagtggactcagggc

SEQ ID NO: 2982116 - DNA, 22 bp, Homo sapiens
caagtggatgggaatttgtcag

SEQ ID NO: 2982117 - DNA, 22 bp, Homo sapiens
caagtggcagtttttaaaattg

SEQ ID NO: 2982118 - DNA, 18 bp, Homo sapiens
caagtgggagatgaaaac

SEQ ID NO: 2982119 - DNA, 10 bp, Homo sapiens
caagtgggct

SEQ ID NO: 2982120 - DNA, 12 bp, Homo sapiens
caagtgggctgg

SEQ ID NO: 2982121 - DNA, 13 bp, Homo sapiens
caagtgggctggt

SEQ ID NO: 2982122 - DNA, 19 bp, Homo sapiens
caagtgggctggtattctc

SEQ ID NO: 2982123 - DNA, 13 bp, Homo sapiens
caagtgtatttta

SEQ ID NO: 2982124 - DNA, 17 bp, Homo sapiens
caagtgtattttaaaat

SEQ ID NO: 2982125 - DNA, 21 bp, Homo sapiens
caagtgtattttaaaatagag

SEQ ID NO: 2982126 - DNA, 15 bp, Homo sapiens
caagtgtgcatattg

SEQ ID NO: 2982127 - DNA, 18 bp, Homo sapiens
caagtgtgcatattgtac

SEQ ID NO: 2982128 - DNA, 21 bp, Homo sapiens
caagtgtgcatattgtacact

SEQ ID NO: 2982129 - DNA, 16 bp, Homo sapiens
caagtgttcacaacct

SEQ ID NO: 2982130 - DNA, 17 bp, Homo sapiens
caagttctaagattcta

SEQ ID NO: 2982131 - DNA, 18 bp, Homo sapiens
caagttctaagattctaa

SEQ ID NO: 2982132 - DNA, 20 bp, Homo sapiens
caagttctaagattctaatg

SEQ ID NO: 2982133 - DNA, 19 bp, Homo sapiens
caagttgctttgttacaat

SEQ ID NO: 2982134 - DNA, 21 bp, Homo sapiens
caagttgttccttaagtcaga

SEQ ID NO: 2982135 - DNA, 21 bp, Homo sapiens
caagttgtttaactgtgcatg

SEQ ID NO: 2982136 - DNA, 17 bp, Homo sapiens
caagtttgaccagtgca

SEQ ID NO: 2982137 - DNA, 19 bp, Homo sapiens
caagtttttacaaaatact

SEQ ID NO: 2982138 - DNA, 20 bp, Homo sapiens
caataaaaacattgcctttg

SEQ ID NO: 2982139 - DNA, 15 bp, Homo sapiens
caataaaacattaat

SEQ ID NO: 2982140 - DNA, 18 bp, Homo sapiens
caataaaactaaatgtgt

SEQ ID NO: 2982141 - DNA, 13 bp, Homo sapiens
caataaaatagca

SEQ ID NO: 2982142 - DNA, 19 bp, Homo sapiens
caataaacgatttaattct

SEQ ID NO: 2982143 - DNA, 21 bp, Homo sapiens
caataaacgatttaattctct

SEQ ID NO: 2982144 - DNA, 17 bp, Homo sapiens
caataaacttgtaggac

SEQ ID NO: 2982145 - DNA, 11 bp, Homo sapiens
caataaagaaa

SEQ ID NO: 2982146 - DNA, 20 bp, Homo sapiens
caataaagaaagaaatatta

SEQ ID NO: 2982147 - DNA, 13 bp, Homo sapiens
caataaagcacta

SEQ ID NO: 2982148 - DNA, 14 bp, Homo sapiens
caataaagcactat

SEQ ID NO: 2982149 - DNA, 17 bp, Homo sapiens
caataaatctgacccag

SEQ ID NO: 2982150 - DNA, 18 bp, Homo sapiens
caataaatctgacccagt

SEQ ID NO: 2982151 - DNA, 20 bp, Homo sapiens
caataaatctgacccagtgc

SEQ ID NO: 2982152 - DNA, 16 bp, Homo sapiens
caataacttctatatt

SEQ ID NO: 2982153 - DNA, 17 bp, Homo sapiens
caataacttctatattt

SEQ ID NO: 2982154 - DNA, 18 bp, Homo sapiens
caataacttctatatttt

SEQ ID NO: 2982155 - DNA, 20 bp, Homo sapiens
caataacttctatattttaa

SEQ ID NO: 2982156 - DNA, 21 bp, Homo sapiens
caataacttctatattttaat

SEQ ID NO: 2982157 - DNA, 20 bp, Homo sapiens
caataagagtctccttctct

SEQ ID NO: 2982158 - DNA, 10 bp, Homo sapiens
caataataaa

SEQ ID NO: 2982159 - DNA, 15 bp, Homo sapiens
caataataaagatgt

SEQ ID NO: 2982160 - DNA, 20 bp, Homo sapiens
caataataaagatgtgaaaa

SEQ ID NO: 2982161 - DNA, 18 bp, Homo sapiens
caataatatattttctgt

SEQ ID NO: 2982162 - DNA, 20 bp, Homo sapiens
caataatatattttctgttt

SEQ ID NO: 2982163 - DNA, 11 bp, Homo sapiens
caataatgcag

SEQ ID NO: 2982164 - DNA, 23 bp, Homo sapiens
caataatggaaaaaaaaaaaaga

SEQ ID NO: 2982165 - DNA, 16 bp, Homo sapiens
caataattgcagaact

SEQ ID NO: 2982166 - DNA, 13 bp, Homo sapiens
caatacaaaatgt

SEQ ID NO: 2982167 - DNA, 18 bp, Homo sapiens
caatacagtacaggcagc

SEQ ID NO: 2982168 - DNA, 23 bp, Homo sapiens
caatacagtttataaagccaaga

SEQ ID NO: 2982169 - DNA, 23 bp, Homo sapiens
caatacatctgaggtcctgtgat

SEQ ID NO: 2982170 - DNA, 12 bp, Homo sapiens
caatacattgtt

SEQ ID NO: 2982171 - DNA, 13 bp, Homo sapiens
caatacatttgta

SEQ ID NO: 2982172 - DNA, 16 bp, Homo sapiens
caatacatttgtattt

SEQ ID NO: 2982173 - DNA, 14 bp, Homo sapiens
caataccccgactc

SEQ ID NO: 2982174 - DNA, 23 bp, Homo sapiens
caataccccgactcaccttgtgt

SEQ ID NO: 2982175 - DNA, 21 bp, Homo sapiens
caatacgtttgataatagttt

SEQ ID NO: 2982176 - DNA, 20 bp, Homo sapiens
caatacgtttgtgcagaatc

SEQ ID NO: 2982177 - DNA, 16 bp, Homo sapiens
caatagctccaagctg

SEQ ID NO: 2982178 - DNA, 18 bp, Homo sapiens
caatagctccaagctgtt

SEQ ID NO: 2982179 - DNA, 19 bp, Homo sapiens
caatagctccaagctgtta

SEQ ID NO: 2982180 - DNA, 18 bp, Homo sapiens
caatagctgcccatttcg

SEQ ID NO: 2982181 - DNA, 17 bp, Homo sapiens
caatagtattacccatg

SEQ ID NO: 2982182 - DNA, 15 bp, Homo sapiens
caatataatgttttt

SEQ ID NO: 2982183 - DNA, 20 bp, Homo sapiens
caatatatctaaattgaata

SEQ ID NO: 2982184 - DNA, 13 bp, Homo sapiens
caatatctgaagc

SEQ ID NO: 2982185 - DNA, 21 bp, Homo sapiens
caatatgaattcaagaaagga

SEQ ID NO: 2982186 - DNA, 18 bp, Homo sapiens
caatatgggcgggcagtc

SEQ ID NO: 2982187 - DNA, 12 bp, Homo sapiens
caatatgtatat

SEQ ID NO: 2982188 - DNA, 17 bp, Homo sapiens
caatatgtatatatgta

SEQ ID NO: 2982189 - DNA, 17 bp, Homo sapiens
caatattttattctagg

SEQ ID NO: 2982190 - DNA, 14 bp, Homo sapiens
caatatttttagat

SEQ ID NO: 2982191 - DNA, 15 bp, Homo sapiens
caatcaagtctgttt

SEQ ID NO: 2982192 - DNA, 11 bp, Homo sapiens
caatcaagttt

SEQ ID NO: 2982193 - DNA, 15 bp, Homo sapiens
caatcaatttaaatg

SEQ ID NO: 2982194 - DNA, 21 bp, Homo sapiens
caatcaatttaaatgtttact

SEQ ID NO: 2982195 - DNA, 16 bp, Homo sapiens
caatcacaaaagctgt

SEQ ID NO: 2982196 - DNA, 19 bp, Homo sapiens
caatcagaacttcaggtgt

SEQ ID NO: 2982197 - DNA, 19 bp, Homo sapiens
caatcagagaccaggccct

SEQ ID NO: 2982198 - DNA, 20 bp, Homo sapiens
caatcagagaccaggccctg

SEQ ID NO: 2982199 - DNA, 20 bp, Homo sapiens
cacatgtcagtaccttcaaa

SEQ ID NO: 2982200 - DNA, 17 bp, Homo sapiens
cacatgtccttgtgtgt

SEQ ID NO: 2982201 - DNA, 15 bp, Homo sapiens
cacatgtcttgtaca

SEQ ID NO: 2982202 - DNA, 20 bp, Homo sapiens
cacatgtcttgtacatgtgt

SEQ ID NO: 2982203 - DNA, 15 bp, Homo sapiens
cacatgtgacacata

SEQ ID NO: 2982204 - DNA, 15 bp, Homo sapiens
cacatgttttctctg

SEQ ID NO: 2982205 - DNA, 13 bp, Homo sapiens
cacatgtttttat

SEQ ID NO: 2982206 - DNA, 21 bp, Homo sapiens
cacattagaagacaattgaca

SEQ ID NO: 2982207 - DNA, 16 bp, Homo sapiens
cacattcttataaata

SEQ ID NO: 2982208 - DNA, 18 bp, Homo sapiens
cacattcttataaatatg

SEQ ID NO: 2982209 - DNA, 19 bp, Homo sapiens
cacattcttataaatatga

SEQ ID NO: 2982210 - DNA, 23 bp, Homo sapiens
cacattcttataaatatgaagct

SEQ ID NO: 2982211 - DNA, 14 bp, Homo sapiens
cacattgaatcatg

SEQ ID NO: 2982212 - DNA, 17 bp, Homo sapiens
cacattgagctgtgcaa

SEQ ID NO: 2982213 - DNA, 12 bp, Homo sapiens
cacattgtttta

SEQ ID NO: 2982214 - DNA, 16 bp, Homo sapiens
cacattgttttaaaaa

SEQ ID NO: 2982215 - DNA, 13 bp, Homo sapiens
cacatttctaaaa

SEQ ID NO: 2982216 - DNA, 21 bp, Homo sapiens
cacattttaacagtacctgtg

SEQ ID NO: 2982217 - DNA, 16 bp, Homo sapiens
cacattttcagccaaa

SEQ ID NO: 2982218 - DNA, 14 bp, Homo sapiens
cacattttgacaca

SEQ ID NO: 2982219 - DNA, 22 bp, Homo sapiens
cacattttgacacaatgttgca

SEQ ID NO: 2982220 - DNA, 14 bp, Homo sapiens
caccaaagttctaa

SEQ ID NO: 2982221 - DNA, 16 bp, Homo sapiens
caccaaagttctaata

SEQ ID NO: 2982222 - DNA, 11 bp, Homo sapiens
caccaaatagg

SEQ ID NO: 2982223 - DNA, 15 bp, Homo sapiens
caccaaatctgtcta

SEQ ID NO: 2982224 - DNA, 19 bp, Homo sapiens
caccaaatctgtctagaat

SEQ ID NO: 2982225 - DNA, 20 bp, Homo sapiens
caccaaccccgcggcccaga

SEQ ID NO: 2982226 - DNA, 17 bp, Homo sapiens
caccaagcacagcagcc

SEQ ID NO: 2982227 - DNA, 14 bp, Homo sapiens
caccaagctcacag

SEQ ID NO: 2982228 - DNA, 15 bp, Homo sapiens
caccaagctcacagt

SEQ ID NO: 2982229 - DNA, 11 bp, Homo sapiens
caccaaggaaa

SEQ ID NO: 2982230 - DNA, 22 bp, Homo sapiens
caccaaggtctcacactcctcc

SEQ ID NO: 2982231 - DNA, 23 bp, Homo sapiens
caccaagttggaacatccttgga

SEQ ID NO: 2982232 - DNA, 20 bp, Homo sapiens
caccacaagccaccttttgt

SEQ ID NO: 2982233 - DNA, 18 bp, Homo sapiens
caccacacacaacagcca

SEQ ID NO: 2982234 - DNA, 16 bp, Homo sapiens
caccacacatcccagc

SEQ ID NO: 2982235 - DNA, 19 bp, Homo sapiens
caccacacatcccagccca

SEQ ID NO: 2982236 - DNA, 14 bp, Homo sapiens
caccacactcagcc

SEQ ID NO: 2982237 - DNA, 22 bp, Homo sapiens
caccacagcttatggcatctca

SEQ ID NO: 2982238 - DNA, 19 bp, Homo sapiens
caccacatcttgtcttttc

SEQ ID NO: 2982239 - DNA, 13 bp, Homo sapiens
caccaccacaccc

SEQ ID NO: 2982240 - DNA, 15 bp, Homo sapiens
caccaccaggtctcc

SEQ ID NO: 2982241 - DNA, 11 bp, Homo sapiens
caccacccaaa

SEQ ID NO: 2982242 - DNA, 17 bp, Homo sapiens
caccacccaacctgtcc

SEQ ID NO: 2982243 - DNA, 14 bp, Homo sapiens
caccacccccactg

SEQ ID NO: 2982244 - DNA, 16 bp, Homo sapiens
caccaccgagctctgt

SEQ ID NO: 2982245 - DNA, 19 bp, Homo sapiens
caccaccgagctctgtggg

SEQ ID NO: 2982246 - DNA, 22 bp, Homo sapiens
caccaccttatacatcacttcc

SEQ ID NO: 2982247 - DNA, 16 bp, Homo sapiens
caccaccttcccagct

SEQ ID NO: 2982248 - DNA, 22 bp, Homo sapiens
caccaccttcccagctctccct

SEQ ID NO: 2982249 - DNA, 15 bp, Homo sapiens
caccacgatgtggcc

SEQ ID NO: 2982250 - DNA, 13 bp, Homo sapiens
caccacggccaga

SEQ ID NO: 2982251 - DNA, 22 bp, Homo sapiens
caccacgggacatcacagggtg

SEQ ID NO: 2982252 - DNA, 13 bp, Homo sapiens
caccactataaaa

SEQ ID NO: 2982253 - DNA, 21 bp, Homo sapiens
caccactataaaatgtcttca

SEQ ID NO: 2982254 - DNA, 13 bp, Homo sapiens
caccactcctgcc

SEQ ID NO: 2982255 - DNA, 18 bp, Homo sapiens
caccactcctgccagccc

SEQ ID NO: 2982256 - DNA, 19 bp, Homo sapiens
caccactcctgccagcccg

SEQ ID NO: 2982257 - DNA, 16 bp, Homo sapiens
caccactgagctctgc

SEQ ID NO: 2982258 - DNA, 19 bp, Homo sapiens
caccactgagctctgcctc

SEQ ID NO: 2982259 - DNA, 20 bp, Homo sapiens
caccactgagctctgcctca

SEQ ID NO: 2982260 - DNA, 16 bp, Homo sapiens
caccactgcactccag

SEQ ID NO: 2982261 - DNA, 21 bp, Homo sapiens
caccacttggagatctttgct

SEQ ID NO: 2982262 - DNA, 22 bp, Homo sapiens
caccacttggagatctttgctt

SEQ ID NO: 2982263 - DNA, 17 bp, Homo sapiens
caccagaagctgttggg

SEQ ID NO: 2982264 - DNA, 15 bp, Homo sapiens
caccagacacccagg

SEQ ID NO: 2982265 - DNA, 16 bp, Homo sapiens
caccagacacccagga

SEQ ID NO: 2982266 - DNA, 18 bp, Homo sapiens
caccagacacccaggact

SEQ ID NO: 2982267 - DNA, 19 bp, Homo sapiens
caccagacacccaggactt

SEQ ID NO: 2982268 - DNA, 19 bp, Homo sapiens
caccagagcaggggctgct

SEQ ID NO: 2982269 - DNA, 21 bp, Homo sapiens
caccagagcaggggctgctgg

SEQ ID NO: 2982270 - DNA, 15 bp, Homo sapiens
caccagagctgcctc

SEQ ID NO: 2982271 - DNA, 17 bp, Homo sapiens
caccagagctgcctccc

SEQ ID NO: 2982272 - DNA, 15 bp, Homo sapiens
caccagcagcactgg

SEQ ID NO: 2982273 - DNA, 14 bp, Homo sapiens
caccagcattcctt

SEQ ID NO: 2982274 - DNA, 15 bp, Homo sapiens
caccagcattccttt

SEQ ID NO: 2982275 - DNA, 22 bp, Homo sapiens
caccagctctgccgtctctgga

SEQ ID NO: 2982276 - DNA, 11 bp, Homo sapiens
caccagctgca

SEQ ID NO: 2982277 - DNA, 18 bp, Homo sapiens
caccagctgcaaagtgtt

SEQ ID NO: 2982278 - DNA, 21 bp, Homo sapiens
caccaggaatgttaaagtcag

SEQ ID NO: 2982279 - DNA, 15 bp, Homo sapiens
caccaggagcacctg

SEQ ID NO: 2982280 - DNA, 21 bp, Homo sapiens
caccaggcacgaacccacctg

SEQ ID NO: 2982281 - DNA, 22 bp, Homo sapiens
caccaggcacgaacccacctgc

SEQ ID NO: 2982282 - DNA, 17 bp, Homo sapiens
caccaggcctcactggc

SEQ ID NO: 2982283 - DNA, 21 bp, Homo sapiens
caccagggactcggcccaggg

SEQ ID NO: 2982284 - DNA, 19 bp, Homo sapiens
caccagggttgaccccaga

SEQ ID NO: 2982285 - DNA, 14 bp, Homo sapiens
caccaggtgcatct

SEQ ID NO: 2982286 - DNA, 16 bp, Homo sapiens
caccaggtgcatctgc

SEQ ID NO: 2982287 - DNA, 22 bp, Homo sapiens
caccaggtgcctttcaaattta

SEQ ID NO: 2982288 - DNA, 15 bp, Homo sapiens
caccagtttacagga

SEQ ID NO: 2982289 - DNA, 16 bp, Homo sapiens
caccatacctttgcta

SEQ ID NO: 2982290 - DNA, 13 bp, Homo sapiens
caccatgcaaggg

SEQ ID NO: 2982291 - DNA, 20 bp, Homo sapiens
caccatgttgcccaggctgg

SEQ ID NO: 2982292 - DNA, 19 bp, Homo sapiens
caccatgtttgagctcaga

SEQ ID NO: 2982293 - DNA, 14 bp, Homo sapiens
caccattaaaaggg

SEQ ID NO: 2982294 - DNA, 17 bp, Homo sapiens
cacccaaaccccttccc

SEQ ID NO: 2982295 - DNA, 19 bp, Homo sapiens
cacccaaaccccttcccac

SEQ ID NO: 2982296 - DNA, 22 bp, Homo sapiens
cacccaaagcctgtcccaggac

SEQ ID NO: 2982297 - DNA, 19 bp, Homo sapiens
cacccaacctgtccttact

SEQ ID NO: 2982298 - DNA, 20 bp, Homo sapiens
cacccaagacctcagggcac

SEQ ID NO: 2982299 - DNA, 14 bp, Homo sapiens
cacccaagagagga

SEQ ID NO: 2982300 - DNA, 21 bp, Homo sapiens
cacccaagtatacaataaagt

SEQ ID NO: 2982301 - DNA, 21 bp, Homo sapiens
cacccaagtgccaagacacag

SEQ ID NO: 2982302 - DNA, 19 bp, Homo sapiens
cacccacaaccctctggaa

SEQ ID NO: 2982303 - DNA, 21 bp, Homo sapiens
cacccacaaccctctggaagt

SEQ ID NO: 2982304 - DNA, 13 bp, Homo sapiens
cacccacatgtga

SEQ ID NO: 2982305 - DNA, 16 bp, Homo sapiens
cacccacctcagcctc

SEQ ID NO: 2982306 - DNA, 16 bp, Homo sapiens
cacccacctccctgcc

SEQ ID NO: 2982307 - DNA, 15 bp, Homo sapiens
cacccactcagctcc

SEQ ID NO: 2982308 - DNA, 11 bp, Homo sapiens
cacccagacta

SEQ ID NO: 2982309 - DNA, 16 bp, Homo sapiens
cacccagcccagattg

SEQ ID NO: 2982310 - DNA, 15 bp, Homo sapiens
cacccagcccattct

SEQ ID NO: 2982311 - DNA, 23 bp, Homo sapiens
cacccagcccattctctctcctg

SEQ ID NO: 2982312 - DNA, 14 bp, Homo sapiens
cacccagctcagca

SEQ ID NO: 2982313 - DNA, 19 bp, Homo sapiens
cacccaggtcccccgactg

SEQ ID NO: 2982314 - DNA, 23 bp, Homo sapiens
cacccaggtcccccgactgcctg

SEQ ID NO: 2982315 - DNA, 21 bp, Homo sapiens
cacccagtccatgctccaggg

SEQ ID NO: 2982316 - DNA, 17 bp, Homo sapiens
cacccagtcctctgcct

SEQ ID NO: 2982317 - DNA, 18 bp, Homo sapiens
cacccagtctctgctcca

SEQ ID NO: 2982318 - DNA, 19 bp, Homo sapiens
cacccatgcaagcagagga

SEQ ID NO: 2982319 - DNA, 14 bp, Homo sapiens
cacccattcttccc

SEQ ID NO: 2982320 - DNA, 15 bp, Homo sapiens
cacccattcttcccg

SEQ ID NO: 2982321 - DNA, 16 bp, Homo sapiens
caccccacacctgcag

SEQ ID NO: 2982322 - DNA, 13 bp, Homo sapiens
caccccaccccct

SEQ ID NO: 2982323 - DNA, 17 bp, Homo sapiens
caccccagagccacaca

SEQ ID NO: 2982324 - DNA, 18 bp, Homo sapiens
caccccagagccacacat

SEQ ID NO: 2982325 - DNA, 10 bp, Homo sapiens
caccccagca

SEQ ID NO: 2982326 - DNA, 20 bp, Homo sapiens
caccccagcacagctcctcc

SEQ ID NO: 2982327 - DNA, 11 bp, Homo sapiens
caccccagctc

SEQ ID NO: 2982328 - DNA, 18 bp, Homo sapiens
caccccagctccgacctc

SEQ ID NO: 2982329 - DNA, 19 bp, Homo sapiens
caccccaggaaaagcacaa

SEQ ID NO: 2982330 - DNA, 20 bp, Homo sapiens
caccccaggaaaagcacaag

SEQ ID NO: 2982331 - DNA, 17 bp, Homo sapiens
caccccagggcctgagc

SEQ ID NO: 2982332 - DNA, 21 bp, Homo sapiens
cactactgctaccacaactat

SEQ ID NO: 2982333 - DNA, 17 bp, Homo sapiens
cactagacaagccagaa

SEQ ID NO: 2982334 - DNA, 19 bp, Homo sapiens
cactagacaagccagaact

SEQ ID NO: 2982335 - DNA, 16 bp, Homo sapiens
cactagagtgctctga

SEQ ID NO: 2982336 - DNA, 18 bp, Homo sapiens
cactagttgtcagcttct

SEQ ID NO: 2982337 - DNA, 15 bp, Homo sapiens
cactatacaaacaaa

SEQ ID NO: 2982338 - DNA, 18 bp, Homo sapiens
cactatctgggtgcatga

SEQ ID NO: 2982339 - DNA, 14 bp, Homo sapiens
cactatctttcagc

SEQ ID NO: 2982340 - DNA, 15 bp, Homo sapiens
cactatgcactgctg

SEQ ID NO: 2982341 - DNA, 21 bp, Homo sapiens
cactatgtgtgttgtttccat

SEQ ID NO: 2982342 - DNA, 13 bp, Homo sapiens
cactatgtttctc

SEQ ID NO: 2982343 - DNA, 14 bp, Homo sapiens
cactatgtttctca

SEQ ID NO: 2982344 - DNA, 15 bp, Homo sapiens
cactatgtttctcag

SEQ ID NO: 2982345 - DNA, 14 bp, Homo sapiens
cactattgtttaga

SEQ ID NO: 2982346 - DNA, 15 bp, Homo sapiens
cactatttgtgactt

SEQ ID NO: 2982347 - DNA, 15 bp, Homo sapiens
cactcaacaataaag

SEQ ID NO: 2982348 - DNA, 15 bp, Homo sapiens
cactcaagccaagca

SEQ ID NO: 2982349 - DNA, 18 bp, Homo sapiens
cactcacccttcctggcc

SEQ ID NO: 2982350 - DNA, 20 bp, Homo sapiens
cactcacccttcctggccca

SEQ ID NO: 2982351 - DNA, 21 bp, Homo sapiens
cactcacccttcctggcccag

SEQ ID NO: 2982352 - DNA, 22 bp, Homo sapiens
cactcacccttcctggcccagg

SEQ ID NO: 2982353 - DNA, 14 bp, Homo sapiens
cactcactgaagcc

SEQ ID NO: 2982354 - DNA, 21 bp, Homo sapiens
cactcactgaagcccagacct

SEQ ID NO: 2982355 - DNA, 21 bp, Homo sapiens
cactcagcccctacccctgcc

SEQ ID NO: 2982356 - DNA, 20 bp, Homo sapiens
cactcaggctggagtacagt

SEQ ID NO: 2982357 - DNA, 12 bp, Homo sapiens
cactcagggcag

SEQ ID NO: 2982358 - DNA, 19 bp, Homo sapiens
cactcagggcagctgcctg

SEQ ID NO: 2982359 - DNA, 15 bp, Homo sapiens
cactcaggtgcacac

SEQ ID NO: 2982360 - DNA, 17 bp, Homo sapiens
cactcattgaaatgtaa

SEQ ID NO: 2982361 - DNA, 16 bp, Homo sapiens
cactccaacctaacct

SEQ ID NO: 2982362 - DNA, 21 bp, Homo sapiens
cactccaacctaacctgtgtc

SEQ ID NO: 2982363 - DNA, 23 bp, Homo sapiens
cactccagaattacccttcctca

SEQ ID NO: 2982364 - DNA, 15 bp, Homo sapiens
cactccagcctgggt

SEQ ID NO: 2982365 - DNA, 18 bp, Homo sapiens
cactcccgggatgggtgg

SEQ ID NO: 2982366 - DNA, 19 bp, Homo sapiens
cactcccgggatgggtgga

SEQ ID NO: 2982367 - DNA, 9 bp, Homo sapiens
cactcccta

SEQ ID NO: 2982368 - DNA, 12 bp, Homo sapiens
cactccctggcc

SEQ ID NO: 2982369 - DNA, 13 bp, Homo sapiens
cactccctggcct

SEQ ID NO: 2982370 - DNA, 17 bp, Homo sapiens
cactccctggccttgcc

SEQ ID NO: 2982371 - DNA, 23 bp, Homo sapiens
cactccggcctgggtgacagagt

SEQ ID NO: 2982372 - DNA, 23 bp, Homo sapiens
cactcctaatcaagagtctctcc

SEQ ID NO: 2982373 - DNA, 13 bp, Homo sapiens
cactcctcagggc

SEQ ID NO: 2982374 - DNA, 15 bp, Homo sapiens
cactcctccaaagga

SEQ ID NO: 2982375 - DNA, 13 bp, Homo sapiens
cactcctccctcc

SEQ ID NO: 2982376 - DNA, 14 bp, Homo sapiens
cactcctccctccg

SEQ ID NO: 2982377 - DNA, 13 bp, Homo sapiens
cactcctcctgcc

SEQ ID NO: 2982378 - DNA, 18 bp, Homo sapiens
cactcctcctgccagctc

SEQ ID NO: 2982379 - DNA, 20 bp, Homo sapiens
cactcctcctgccagctctg

SEQ ID NO: 2982380 - DNA, 21 bp, Homo sapiens
cactcctcctgccagctctgt

SEQ ID NO: 2982381 - DNA, 17 bp, Homo sapiens
cactcctcggcaggcat

SEQ ID NO: 2982382 - DNA, 12 bp, Homo sapiens
cactcctctgac

SEQ ID NO: 2982383 - DNA, 21 bp, Homo sapiens
cactcctctgactcagggctc

SEQ ID NO: 2982384 - DNA, 16 bp, Homo sapiens
cactcctgccagcccg

SEQ ID NO: 2982385 - DNA, 12 bp, Homo sapiens
cactccttcccc

SEQ ID NO: 2982386 - DNA, 13 bp, Homo sapiens
cactccttcccct

SEQ ID NO: 2982387 - DNA, 22 bp, Homo sapiens
cactccttccccttgtccctgg

SEQ ID NO: 2982388 - DNA, 15 bp, Homo sapiens
cactccttgcatcaa

SEQ ID NO: 2982389 - DNA, 20 bp, Homo sapiens
cactcgccatctcctgggcc

SEQ ID NO: 2982390 - DNA, 16 bp, Homo sapiens
cactcgccatttcctc

SEQ ID NO: 2982391 - DNA, 18 bp, Homo sapiens
cactctaccagtgcaggc

SEQ ID NO: 2982392 - DNA, 17 bp, Homo sapiens
cactctcattccccagg

SEQ ID NO: 2982393 - DNA, 16 bp, Homo sapiens
cactctcccttgtaca

SEQ ID NO: 2982394 - DNA, 15 bp, Homo sapiens
cactctctaccagat

SEQ ID NO: 2982395 - DNA, 14 bp, Homo sapiens
cactctgccctctg

SEQ ID NO: 2982396 - DNA, 21 bp, Homo sapiens
cactctgccctctgctgctgc

SEQ ID NO: 2982397 - DNA, 22 bp, Homo sapiens
cactctgccctctgctgctgcc

SEQ ID NO: 2982398 - DNA, 21 bp, Homo sapiens
cactctgcggcccgggccgac

SEQ ID NO: 2982399 - DNA, 13 bp, Homo sapiens
cactctgctgcct

SEQ ID NO: 2982400 - DNA, 15 bp, Homo sapiens
cactctgctgcctgt

SEQ ID NO: 2982401 - DNA, 17 bp, Homo sapiens
cactctgctgcctgtac

SEQ ID NO: 2982402 - DNA, 20 bp, Homo sapiens
cactctgctgcctgtacaga

SEQ ID NO: 2982403 - DNA, 17 bp, Homo sapiens
cactctgggctccagag

SEQ ID NO: 2982404 - DNA, 17 bp, Homo sapiens
cactctgttatttagac

SEQ ID NO: 2982405 - DNA, 20 bp, Homo sapiens
cactcttctctccaaggaaa

SEQ ID NO: 2982406 - DNA, 17 bp, Homo sapiens
cactcttgaactgggcg

SEQ ID NO: 2982407 - DNA, 19 bp, Homo sapiens
cactcttgaagtccaggac

SEQ ID NO: 2982408 - DNA, 22 bp, Homo sapiens
cactcttggagcctgcagagct

SEQ ID NO: 2982409 - DNA, 15 bp, Homo sapiens
cactctttctcccta

SEQ ID NO: 2982410 - DNA, 15 bp, Homo sapiens
cactgaaaacatctg

SEQ ID NO: 2982411 - DNA, 16 bp, Homo sapiens
cactgaaaagctttcc

SEQ ID NO: 2982412 - DNA, 11 bp, Homo sapiens
cactgaaacaa

SEQ ID NO: 2982413 - DNA, 20 bp, Homo sapiens
cactgaaattgcctgaaacc

SEQ ID NO: 2982414 - DNA, 22 bp, Homo sapiens
cactgaagtgcttgcagatcat

SEQ ID NO: 2982415 - DNA, 21 bp, Homo sapiens
cactgaagtttttgaaatacc

SEQ ID NO: 2982416 - DNA, 20 bp, Homo sapiens
cactgaattgacatgaccct

SEQ ID NO: 2982417 - DNA, 13 bp, Homo sapiens
cactgaccagaac

SEQ ID NO: 2982418 - DNA, 23 bp, Homo sapiens
cactgagataccagcgaggaggc

SEQ ID NO: 2982419 - DNA, 18 bp, Homo sapiens
cactgagcatcactagtg

SEQ ID NO: 2982420 - DNA, 18 bp, Homo sapiens
cactgaggcagggaagtc

SEQ ID NO: 2982421 - DNA, 16 bp, Homo sapiens
cactgaggcctgagac

SEQ ID NO: 2982422 - DNA, 22 bp, Homo sapiens
cactgaggcctgagacccagga

SEQ ID NO: 2982423 - DNA, 23 bp, Homo sapiens
cactgaggcctgagacccaggac

SEQ ID NO: 2982424 - DNA, 15 bp, Homo sapiens
cactgagggtcactc

SEQ ID NO: 2982425 - DNA, 14 bp, Homo sapiens
cactgagtgaagga

SEQ ID NO: 2982426 - DNA, 12 bp, Homo sapiens
cactgagtttct

SEQ ID NO: 2982427 - DNA, 14 bp, Homo sapiens
cactgagtttctat

SEQ ID NO: 2982428 - DNA, 15 bp, Homo sapiens
cactgagtttctatt

SEQ ID NO: 2982429 - DNA, 14 bp, Homo sapiens
cactgatccagccc

SEQ ID NO: 2982430 - DNA, 16 bp, Homo sapiens
cactgatccagccctg

SEQ ID NO: 2982431 - DNA, 18 bp, Homo sapiens
cactgatctgaacatctg

SEQ ID NO: 2982432 - DNA, 14 bp, Homo sapiens
cactgatgcaagga

SEQ ID NO: 2982433 - DNA, 22 bp, Homo sapiens
cactgatgcaaggattacagaa

SEQ ID NO: 2982434 - DNA, 19 bp, Homo sapiens
cactgatgctgcccctcat

SEQ ID NO: 2982435 - DNA, 15 bp, Homo sapiens
cactgatgcttagat

SEQ ID NO: 2982436 - DNA, 16 bp, Homo sapiens
cactgatgcttagatg

SEQ ID NO: 2982437 - DNA, 21 bp, Homo sapiens
cactgcaaaccgccacctccc

SEQ ID NO: 2982438 - DNA, 16 bp, Homo sapiens
cactgcaagagccttg

SEQ ID NO: 2982439 - DNA, 19 bp, Homo sapiens
cactgcaagagccttggtg

SEQ ID NO: 2982440 - DNA, 20 bp, Homo sapiens
cactgcaagagccttggtgt

SEQ ID NO: 2982441 - DNA, 14 bp, Homo sapiens
cactgcactccagc

SEQ ID NO: 2982442 - DNA, 16 bp, Homo sapiens
cactgcactccagcct

SEQ ID NO: 2982443 - DNA, 23 bp, Homo sapiens
cactgcagcctcaacctcctggg

SEQ ID NO: 2982444 - DNA, 22 bp, Homo sapiens
cactgcatgagcttttatacta

SEQ ID NO: 2982445 - DNA, 20 bp, Homo sapiens
cactgccaggggttcttgag

SEQ ID NO: 2982446 - DNA, 14 bp, Homo sapiens
cactgccatatact

SEQ ID NO: 2982447 - DNA, 20 bp, Homo sapiens
cactgccatcaaactgtaaa

SEQ ID NO: 2982448 - DNA, 22 bp, Homo sapiens
cactgccatcttagtttggatt

SEQ ID NO: 2982449 - DNA, 14 bp, Homo sapiens
cactgcccatggca

SEQ ID NO: 2982450 - DNA, 17 bp, Homo sapiens
cactgcccatggcatgt

SEQ ID NO: 2982451 - DNA, 18 bp, Homo sapiens
cactgccctcgcacggcc

SEQ ID NO: 2982452 - DNA, 13 bp, Homo sapiens
cactgcccttctc

SEQ ID NO: 2982453 - DNA, 22 bp, Homo sapiens
cactgccgacatccctccccca

SEQ ID NO: 2982454 - DNA, 14 bp, Homo sapiens
cactgcctcctccc

SEQ ID NO: 2982455 - DNA, 20 bp, Homo sapiens
cactgcctcctccctggctg

SEQ ID NO: 2982456 - DNA, 13 bp, Homo sapiens
cactgcctgggct

SEQ ID NO: 2982457 - DNA, 19 bp, Homo sapiens
cactgcctgggctgacccc

SEQ ID NO: 2982458 - DNA, 20 bp, Homo sapiens
cactgccttcgtttatattt

SEQ ID NO: 2982459 - DNA, 12 bp, Homo sapiens
cactgccttttt

SEQ ID NO: 2982460 - DNA, 19 bp, Homo sapiens
cactgcctttttatttata

SEQ ID NO: 2982461 - DNA, 12 bp, Homo sapiens
cactgcgccccg

SEQ ID NO: 2982462 - DNA, 18 bp, Homo sapiens
cactgcgctttattttct

SEQ ID NO: 2982463 - DNA, 16 bp, Homo sapiens
cactgctacacttctg

SEQ ID NO: 2982464 - DNA, 17 bp, Homo sapiens
cactgctcacggacccc

SEQ ID NO: 2982465 - DNA, 22 bp, Homo sapiens
cagagcaaagcgcccacccagg

SEQ ID NO: 2982466 - DNA, 16 bp, Homo sapiens
cagagcacgcctgcca

SEQ ID NO: 2982467 - DNA, 22 bp, Homo sapiens
cagagcactgtgttcacacttt

SEQ ID NO: 2982468 - DNA, 14 bp, Homo sapiens
cagagcagctaact

SEQ ID NO: 2982469 - DNA, 22 bp, Homo sapiens
cagagcagctaactccgagagc

SEQ ID NO: 2982470 - DNA, 23 bp, Homo sapiens
cagagcagctaactccgagagca

SEQ ID NO: 2982471 - DNA, 16 bp, Homo sapiens
cagagcaggggctgct

SEQ ID NO: 2982472 - DNA, 19 bp, Homo sapiens
cagagcaggggctgctggg

SEQ ID NO: 2982473 - DNA, 21 bp, Homo sapiens
cagagcaggggctgctggggg

SEQ ID NO: 2982474 - DNA, 22 bp, Homo sapiens
cagagcaggggctgctgggggc

SEQ ID NO: 2982475 - DNA, 17 bp, Homo sapiens
cagagcatcccacagga

SEQ ID NO: 2982476 - DNA, 14 bp, Homo sapiens
cagagccacacatg

SEQ ID NO: 2982477 - DNA, 16 bp, Homo sapiens
cagagccagcggctcc

SEQ ID NO: 2982478 - DNA, 14 bp, Homo sapiens
cagagcccagccca

SEQ ID NO: 2982479 - DNA, 15 bp, Homo sapiens
cagagcccagcccag

SEQ ID NO: 2982480 - DNA, 13 bp, Homo sapiens
cagagcccagctc

SEQ ID NO: 2982481 - DNA, 14 bp, Homo sapiens
cagagcccagctct

SEQ ID NO: 2982482 - DNA, 16 bp, Homo sapiens
cagagcccagctcttg

SEQ ID NO: 2982483 - DNA, 15 bp, Homo sapiens
cagagccggcatcct

SEQ ID NO: 2982484 - DNA, 22 bp, Homo sapiens
cagagccggcatccttgcctgt

SEQ ID NO: 2982485 - DNA, 13 bp, Homo sapiens
cagagcctgtccc

SEQ ID NO: 2982486 - DNA, 14 bp, Homo sapiens
cagagcctgtcccc

SEQ ID NO: 2982487 - DNA, 23 bp, Homo sapiens
cagagccttctgaggacattcca

SEQ ID NO: 2982488 - DNA, 20 bp, Homo sapiens
cagagccttttacccctgca

SEQ ID NO: 2982489 - DNA, 14 bp, Homo sapiens
cagagcgggaggga

SEQ ID NO: 2982490 - DNA, 20 bp, Homo sapiens
cagagctcaaaacaaggcga

SEQ ID NO: 2982491 - DNA, 17 bp, Homo sapiens
cagagctctgacccaca

SEQ ID NO: 2982492 - DNA, 16 bp, Homo sapiens
cagagctgaagagttg

SEQ ID NO: 2982493 - DNA, 13 bp, Homo sapiens
cagagctgagggc

SEQ ID NO: 2982494 - DNA, 16 bp, Homo sapiens
cagagctgagggccct

SEQ ID NO: 2982495 - DNA, 18 bp, Homo sapiens
cagagctgagggccctgt

SEQ ID NO: 2982496 - DNA, 19 bp, Homo sapiens
cagagctgagggccctgtg

SEQ ID NO: 2982497 - DNA, 20 bp, Homo sapiens
cagagctgagggccctgtgg

SEQ ID NO: 2982498 - DNA, 21 bp, Homo sapiens
cagagctgagggccctgtgga

SEQ ID NO: 2982499 - DNA, 14 bp, Homo sapiens
cagagctgcacagg

SEQ ID NO: 2982500 - DNA, 14 bp, Homo sapiens
cagagctgcgggct

SEQ ID NO: 2982501 - DNA, 17 bp, Homo sapiens
cagagctgcgggctgag

SEQ ID NO: 2982502 - DNA, 20 bp, Homo sapiens
cagagctgcgggctgagggc

SEQ ID NO: 2982503 - DNA, 24 bp, Homo sapiens
cagagctgcgggctgagggcatct

SEQ ID NO: 2982504 - DNA, 14 bp, Homo sapiens
cagagctgcttctg

SEQ ID NO: 2982505 - DNA, 17 bp, Homo sapiens
cagagctggtggaccca

SEQ ID NO: 2982506 - DNA, 14 bp, Homo sapiens
cagagcttccctga

SEQ ID NO: 2982507 - DNA, 18 bp, Homo sapiens
cagagcttccctgactca

SEQ ID NO: 2982508 - DNA, 23 bp, Homo sapiens
cagagcttcttccaggtgcccag

SEQ ID NO: 2982509 - DNA, 20 bp, Homo sapiens
cagagctttggtctgtgtgt

SEQ ID NO: 2982510 - DNA, 13 bp, Homo sapiens
cagagcttttcag

SEQ ID NO: 2982511 - DNA, 22 bp, Homo sapiens
cagagcttttcgaactgtgctc

SEQ ID NO: 2982512 - DNA, 19 bp, Homo sapiens
cagaggaaggggccagagg

SEQ ID NO: 2982513 - DNA, 20 bp, Homo sapiens
cagaggaaggggccagaggc

SEQ ID NO: 2982514 - DNA, 21 bp, Homo sapiens
cagaggaaggggccagaggct

SEQ ID NO: 2982515 - DNA, 23 bp, Homo sapiens
cagaggaatcactcttgtggatg

SEQ ID NO: 2982516 - DNA, 21 bp, Homo sapiens
cagaggaatgatgggcttttg

SEQ ID NO: 2982517 - DNA, 23 bp, Homo sapiens
cagaggaatttggctgcttctac

SEQ ID NO: 2982518 - DNA, 15 bp, Homo sapiens
cagaggaccagggcc

SEQ ID NO: 2982519 - DNA, 14 bp, Homo sapiens
cagaggactgtgat

SEQ ID NO: 2982520 - DNA, 23 bp, Homo sapiens
cagaggagagatagcctgtggcc

SEQ ID NO: 2982521 - DNA, 17 bp, Homo sapiens
cagaggagcatcagctg

SEQ ID NO: 2982522 - DNA, 18 bp, Homo sapiens
cagaggagcatcagctgt

SEQ ID NO: 2982523 - DNA, 14 bp, Homo sapiens
cagaggagcccagt

SEQ ID NO: 2982524 - DNA, 19 bp, Homo sapiens
cagaggaggggccgctgcc

SEQ ID NO: 2982525 - DNA, 20 bp, Homo sapiens
cagaggaggggccgctgcca

SEQ ID NO: 2982526 - DNA, 20 bp, Homo sapiens
cagaggatgctctttcccag

SEQ ID NO: 2982527 - DNA, 16 bp, Homo sapiens
cagaggcagtggccac

SEQ ID NO: 2982528 - DNA, 13 bp, Homo sapiens
cagaggccccagc

SEQ ID NO: 2982529 - DNA, 17 bp, Homo sapiens
cagaggccccagcctcc

SEQ ID NO: 2982530 - DNA, 19 bp, Homo sapiens
cagaggccctcgctgccag

SEQ ID NO: 2982531 - DNA, 19 bp, Homo sapiens
cagaggcctgaagctgagc

SEQ ID NO: 2982532 - DNA, 19 bp, Homo sapiens
cagaggcgtcccgcacctg

SEQ ID NO: 2982533 - DNA, 14 bp, Homo sapiens
cagaggctgcccca

SEQ ID NO: 2982534 - DNA, 22 bp, Homo sapiens
cagagggaccaaattgcttcta

SEQ ID NO: 2982535 - DNA, 14 bp, Homo sapiens
cagagggcacatga

SEQ ID NO: 2982536 - DNA, 24 bp, Homo sapiens
cagagggcacatgaacagcttgcc

SEQ ID NO: 2982537 - DNA, 14 bp, Homo sapiens
cagagggcgctcct

SEQ ID NO: 2982538 - DNA, 17 bp, Homo sapiens
cagagggcgctcctgtt

SEQ ID NO: 2982539 - DNA, 10 bp, Homo sapiens
cagagggctg

SEQ ID NO: 2982540 - DNA, 13 bp, Homo sapiens
cagagggctgatg

SEQ ID NO: 2982541 - DNA, 12 bp, Homo sapiens
cagagggctgga

SEQ ID NO: 2982542 - DNA, 13 bp, Homo sapiens
cagagggctggag

SEQ ID NO: 2982543 - DNA, 14 bp, Homo sapiens
cagagggctggagg

SEQ ID NO: 2982544 - DNA, 14 bp, Homo sapiens
cagagggctttcag

SEQ ID NO: 2982545 - DNA, 19 bp, Homo sapiens
cagagggctttcagcgccc

SEQ ID NO: 2982546 - DNA, 20 bp, Homo sapiens
cagagggtcacagtgtttac

SEQ ID NO: 2982547 - DNA, 19 bp, Homo sapiens
cagagggtgggaggggcca

SEQ ID NO: 2982548 - DNA, 19 bp, Homo sapiens
cagagggtttgtgcccagt

SEQ ID NO: 2982549 - DNA, 20 bp, Homo sapiens
cagaggtaaaaaaaagaagt

SEQ ID NO: 2982550 - DNA, 15 bp, Homo sapiens
cagaggtaccctggg

SEQ ID NO: 2982551 - DNA, 20 bp, Homo sapiens
cagaggtgtcatccacaggc

SEQ ID NO: 2982552 - DNA, 18 bp, Homo sapiens
cagaggttgcagtgagct

SEQ ID NO: 2982553 - DNA, 22 bp, Homo sapiens
cagaggttgcagtgagctgaga

SEQ ID NO: 2982554 - DNA, 18 bp, Homo sapiens
cagaggttgtagtgagcc

SEQ ID NO: 2982555 - DNA, 22 bp, Homo sapiens
cagaggttgtagtgagccaaga

SEQ ID NO: 2982556 - DNA, 22 bp, Homo sapiens
cagagtccatttcccacatctt

SEQ ID NO: 2982557 - DNA, 14 bp, Homo sapiens
cagagtccctgcct

SEQ ID NO: 2982558 - DNA, 16 bp, Homo sapiens
cagagtccttaaaatg

SEQ ID NO: 2982559 - DNA, 15 bp, Homo sapiens
cagagtcctttccaa

SEQ ID NO: 2982560 - DNA, 18 bp, Homo sapiens
cagagtcggaacggagaa

SEQ ID NO: 2982561 - DNA, 14 bp, Homo sapiens
cagagtctcgctct

SEQ ID NO: 2982562 - DNA, 22 bp, Homo sapiens
cagagtgacacccaagagggct

SEQ ID NO: 2982563 - DNA, 17 bp, Homo sapiens
cagagtgagacccagcc

SEQ ID NO: 2982564 - DNA, 14 bp, Homo sapiens
cagagtggccacgg

SEQ ID NO: 2982565 - DNA, 20 bp, Homo sapiens
cagagtggccacggcccagg

SEQ ID NO: 2982566 - DNA, 23 bp, Homo sapiens
cagagtggccacggcccagggag

SEQ ID NO: 2982567 - DNA, 17 bp, Homo sapiens
cagagtggcctagagca

SEQ ID NO: 2982568 - DNA, 17 bp, Homo sapiens
cagagtgtgtttttgca

SEQ ID NO: 2982569 - DNA, 21 bp, Homo sapiens
cagagtgtgtttttgcactgt

SEQ ID NO: 2982570 - DNA, 14 bp, Homo sapiens
cagagttaaaatgt

SEQ ID NO: 2982571 - DNA, 15 bp, Homo sapiens
cagagttaaaatgtt

SEQ ID NO: 2982572 - DNA, 21 bp, Homo sapiens
cagagttaaaatgtttactgt

SEQ ID NO: 2982573 - DNA, 20 bp, Homo sapiens
cagagttctatactgtaaag

SEQ ID NO: 2982574 - DNA, 15 bp, Homo sapiens
cagagttctgtgaag

SEQ ID NO: 2982575 - DNA, 20 bp, Homo sapiens
cagagttctgtgaagaggaa

SEQ ID NO: 2982576 - DNA, 12 bp, Homo sapiens
cagagttctttg

SEQ ID NO: 2982577 - DNA, 16 bp, Homo sapiens
cagagttctttgcaag

SEQ ID NO: 2982578 - DNA, 15 bp, Homo sapiens
cagagtttctgcagt

SEQ ID NO: 2982579 - DNA, 21 bp, Homo sapiens
cagagttttttaaacaaatga

SEQ ID NO: 2982580 - DNA, 23 bp, Homo sapiens
cagagttttttaaacaaatgagt

SEQ ID NO: 2982581 - DNA, 21 bp, Homo sapiens
cagataaaattatagatggga

SEQ ID NO: 2982582 - DNA, 13 bp, Homo sapiens
cagataactgagg

SEQ ID NO: 2982583 - DNA, 22 bp, Homo sapiens
cagataagtaagagtactatta

SEQ ID NO: 2982584 - DNA, 13 bp, Homo sapiens
cagatacaatgta

SEQ ID NO: 2982585 - DNA, 14 bp, Homo sapiens
cagatacaatgtat

SEQ ID NO: 2982586 - DNA, 13 bp, Homo sapiens
cagatactgtgag

SEQ ID NO: 2982587 - DNA, 21 bp, Homo sapiens
cagatactgtgagcttacatt

SEQ ID NO: 2982588 - DNA, 13 bp, Homo sapiens
cagatataaatac

SEQ ID NO: 2982589 - DNA, 14 bp, Homo sapiens
cagatataaatact

SEQ ID NO: 2982590 - DNA, 17 bp, Homo sapiens
cagatatcaaaattcta

SEQ ID NO: 2982591 - DNA, 22 bp, Homo sapiens
cagatatctttttcattattgt

SEQ ID NO: 2982592 - DNA, 13 bp, Homo sapiens
cagatatttatgt

SEQ ID NO: 2982593 - DNA, 18 bp, Homo sapiens
cagatatttatgtatctt

SEQ ID NO: 2982594 - DNA, 22 bp, Homo sapiens
cagatcaaagtatgtatgtttt

SEQ ID NO: 2982595 - DNA, 17 bp, Homo sapiens
cagatcaagctgtgaga

SEQ ID NO: 2982596 - DNA, 13 bp, Homo sapiens
cagatcacctgag

SEQ ID NO: 2982597 - DNA, 17 bp, Homo sapiens
caggaaggagccagact

SEQ ID NO: 2982598 - DNA, 20 bp, Homo sapiens
caggaaggcctaggctagga

SEQ ID NO: 2982599 - DNA, 15 bp, Homo sapiens
caggaagggagggag

SEQ ID NO: 2982600 - DNA, 19 bp, Homo sapiens
caggaagggagggagctga

SEQ ID NO: 2982601 - DNA, 20 bp, Homo sapiens
caggaaggtctgatttgcag

SEQ ID NO: 2982602 - DNA, 14 bp, Homo sapiens
caggaatatccagt

SEQ ID NO: 2982603 - DNA, 17 bp, Homo sapiens
caggaatgtgtggcaga

SEQ ID NO: 2982604 - DNA, 19 bp, Homo sapiens
caggaatgtgtggcctgca

SEQ ID NO: 2982605 - DNA, 21 bp, Homo sapiens
caggaatgtgtggcctgcaca

SEQ ID NO: 2982606 - DNA, 23 bp, Homo sapiens
caggaatgtgtggcctgcacagt

SEQ ID NO: 2982607 - DNA, 18 bp, Homo sapiens
caggaatgttaaagtcag

SEQ ID NO: 2982608 - DNA, 15 bp, Homo sapiens
caggaattgaagatg

SEQ ID NO: 2982609 - DNA, 16 bp, Homo sapiens
caggaatttcccagga

SEQ ID NO: 2982610 - DNA, 15 bp, Homo sapiens
caggaatttgggacc

SEQ ID NO: 2982611 - DNA, 18 bp, Homo sapiens
caggaatttgggaccctg

SEQ ID NO: 2982612 - DNA, 16 bp, Homo sapiens
caggacaacgaggaag

SEQ ID NO: 2982613 - DNA, 13 bp, Homo sapiens
caggacagatgcc

SEQ ID NO: 2982614 - DNA, 17 bp, Homo sapiens
caggacagatgccacac

SEQ ID NO: 2982615 - DNA, 13 bp, Homo sapiens
caggacaggacca

SEQ ID NO: 2982616 - DNA, 18 bp, Homo sapiens
caggacatgcggtagcca

SEQ ID NO: 2982617 - DNA, 21 bp, Homo sapiens
caggacatgcggtagccagca

SEQ ID NO: 2982618 - DNA, 22 bp, Homo sapiens
caggacatgcggtagccagcac

SEQ ID NO: 2982619 - DNA, 23 bp, Homo sapiens
caggacatgcggtagccagcaca

SEQ ID NO: 2982620 - DNA, 12 bp, Homo sapiens
caggacatttct

SEQ ID NO: 2982621 - DNA, 14 bp, Homo sapiens
caggacatttctct

SEQ ID NO: 2982622 - DNA, 16 bp, Homo sapiens
caggaccaagggggcg

SEQ ID NO: 2982623 - DNA, 15 bp, Homo sapiens
caggaccaggaccca

SEQ ID NO: 2982624 - DNA, 21 bp, Homo sapiens
caggaccagtcaacctgggca

SEQ ID NO: 2982625 - DNA, 13 bp, Homo sapiens
caggacccagagg

SEQ ID NO: 2982626 - DNA, 13 bp, Homo sapiens
caggacccaggga

SEQ ID NO: 2982627 - DNA, 14 bp, Homo sapiens
caggacccagggag

SEQ ID NO: 2982628 - DNA, 22 bp, Homo sapiens
caggacccagggagaggctgtg

SEQ ID NO: 2982629 - DNA, 14 bp, Homo sapiens
caggacccctgagt

SEQ ID NO: 2982630 - DNA, 13 bp, Homo sapiens
caggaccctgaag

SEQ ID NO: 2982631 - DNA, 15 bp, Homo sapiens
caggaccctgaaggg

SEQ ID NO: 2982632 - DNA, 16 bp, Homo sapiens
caggaccctgaagggg

SEQ ID NO: 2982633 - DNA, 18 bp, Homo sapiens
caggaccctgaaggggcc

SEQ ID NO: 2982634 - DNA, 19 bp, Homo sapiens
caggacctgcctgtagccc

SEQ ID NO: 2982635 - DNA, 15 bp, Homo sapiens
caggacctggcttgg

SEQ ID NO: 2982636 - DNA, 21 bp, Homo sapiens
caggaccttcgggctgtgccc

SEQ ID NO: 2982637 - DNA, 15 bp, Homo sapiens
caggacgaatgcata

SEQ ID NO: 2982638 - DNA, 20 bp, Homo sapiens
caggactatatttgggcctg

SEQ ID NO: 2982639 - DNA, 22 bp, Homo sapiens
caggactcaccctccacaaagc

SEQ ID NO: 2982640 - DNA, 19 bp, Homo sapiens
caggactcagaagcctctg

SEQ ID NO: 2982641 - DNA, 15 bp, Homo sapiens
caggactctctgctt

SEQ ID NO: 2982642 - DNA, 16 bp, Homo sapiens
caggactgggtctgac

SEQ ID NO: 2982643 - DNA, 18 bp, Homo sapiens
caggactgggtctgacct

SEQ ID NO: 2982644 - DNA, 22 bp, Homo sapiens
caggagaaggccaattcctata

SEQ ID NO: 2982645 - DNA, 15 bp, Homo sapiens
caggagaagggctgg

SEQ ID NO: 2982646 - DNA, 19 bp, Homo sapiens
caggagaagggctggggcc

SEQ ID NO: 2982647 - DNA, 23 bp, Homo sapiens
caggagaaggtcagcgagaagga

SEQ ID NO: 2982648 - DNA, 19 bp, Homo sapiens
caggagacccaacaatgag

SEQ ID NO: 2982649 - DNA, 16 bp, Homo sapiens
caggagactgggctct

SEQ ID NO: 2982650 - DNA, 17 bp, Homo sapiens
caggagagccagccctc

SEQ ID NO: 2982651 - DNA, 18 bp, Homo sapiens
caggagaggagagccaga

SEQ ID NO: 2982652 - DNA, 19 bp, Homo sapiens
caggagaggagagccagag

SEQ ID NO: 2982653 - DNA, 20 bp, Homo sapiens
caggagaggagagccagaga

SEQ ID NO: 2982654 - DNA, 21 bp, Homo sapiens
caggagaggagagccagagaa

SEQ ID NO: 2982655 - DNA, 21 bp, Homo sapiens
caggagcacacccagccccca

SEQ ID NO: 2982656 - DNA, 22 bp, Homo sapiens
caggagcccccagctgccaaag

SEQ ID NO: 2982657 - DNA, 20 bp, Homo sapiens
caggagctagttctcagctt

SEQ ID NO: 2982658 - DNA, 13 bp, Homo sapiens
caggagctctgcg

SEQ ID NO: 2982659 - DNA, 15 bp, Homo sapiens
caggagctctgcgcc

SEQ ID NO: 2982660 - DNA, 20 bp, Homo sapiens
caggagctctgcgccaggca

SEQ ID NO: 2982661 - DNA, 12 bp, Homo sapiens
caggagcttcct

SEQ ID NO: 2982662 - DNA, 23 bp, Homo sapiens
caggagcttcctgtcctcccagc

SEQ ID NO: 2982663 - DNA, 19 bp, Homo sapiens
caggaggacaattcatgaa

SEQ ID NO: 2982664 - DNA, 21 bp, Homo sapiens
caggaggaggctgccctgagg

SEQ ID NO: 2982665 - DNA, 20 bp, Homo sapiens
caggaggcagaggttgcagt

SEQ ID NO: 2982666 - DNA, 18 bp, Homo sapiens
caggaggcaggaccttcg

SEQ ID NO: 2982667 - DNA, 12 bp, Homo sapiens
caggaggcaggc

SEQ ID NO: 2982668 - DNA, 21 bp, Homo sapiens
caggaggcaggcatggccctg

SEQ ID NO: 2982669 - DNA, 20 bp, Homo sapiens
caggaggccctggtcctggc

SEQ ID NO: 2982670 - DNA, 22 bp, Homo sapiens
caggaggcggcagctcttctgg

SEQ ID NO: 2982671 - DNA, 18 bp, Homo sapiens
caggaggctgagacagga

SEQ ID NO: 2982672 - DNA, 15 bp, Homo sapiens
caggaggctgaggca

SEQ ID NO: 2982673 - DNA, 21 bp, Homo sapiens
caggaggctttaagctccagc

SEQ ID NO: 2982674 - DNA, 22 bp, Homo sapiens
caggaggctttaagctccagct

SEQ ID NO: 2982675 - DNA, 18 bp, Homo sapiens
caggagggagggtttctc

SEQ ID NO: 2982676 - DNA, 22 bp, Homo sapiens
caggagggcgttcttaggctgc

SEQ ID NO: 2982677 - DNA, 19 bp, Homo sapiens
caggaggtggaggttgcag

SEQ ID NO: 2982678 - DNA, 18 bp, Homo sapiens
caggaggttcaaaagtaa

SEQ ID NO: 2982679 - DNA, 18 bp, Homo sapiens
caggagtcaccatgcaag

SEQ ID NO: 2982680 - DNA, 17 bp, Homo sapiens
caggagtgtcctcttcc

SEQ ID NO: 2982681 - DNA, 16 bp, Homo sapiens
caggagtgtcctggct

SEQ ID NO: 2982682 - DNA, 21 bp, Homo sapiens
caggagttcaataaatgtctg

SEQ ID NO: 2982683 - DNA, 15 bp, Homo sapiens
caggagttgggggca

SEQ ID NO: 2982684 - DNA, 22 bp, Homo sapiens
caggagttgtgagccctctagg

SEQ ID NO: 2982685 - DNA, 11 bp, Homo sapiens
caggagtttca

SEQ ID NO: 2982686 - DNA, 17 bp, Homo sapiens
caggagtttgagaccag

SEQ ID NO: 2982687 - DNA, 21 bp, Homo sapiens
caggagtttgagaccagcctg

SEQ ID NO: 2982688 - DNA, 19 bp, Homo sapiens
caggagtttgaggctgcaa

SEQ ID NO: 2982689 - DNA, 22 bp, Homo sapiens
caggagtttgtgtgtcttttat

SEQ ID NO: 2982690 - DNA, 24 bp, Homo sapiens
caggatcagattgcatgtgactct

SEQ ID NO: 2982691 - DNA, 13 bp, Homo sapiens
caggatccagcct

SEQ ID NO: 2982692 - DNA, 17 bp, Homo sapiens
caggatctgctccaaca

SEQ ID NO: 2982693 - DNA, 18 bp, Homo sapiens
caggatctgctccaacag

SEQ ID NO: 2982694 - DNA, 16 bp, Homo sapiens
caggatgaccacgcac

SEQ ID NO: 2982695 - DNA, 14 bp, Homo sapiens
caggatgactttac

SEQ ID NO: 2982696 - DNA, 19 bp, Homo sapiens
caggatgaggacagagggc

SEQ ID NO: 2982697 - DNA, 22 bp, Homo sapiens
caggatggtgttactgcagttg

SEQ ID NO: 2982698 - DNA, 20 bp, Homo sapiens
caggatttatacatacagag

SEQ ID NO: 2982699 - DNA, 22 bp, Homo sapiens
caggatttatacatacagagat

SEQ ID NO: 2982700 - DNA, 15 bp, Homo sapiens
caggatttgcacaga

SEQ ID NO: 2982701 - DNA, 12 bp, Homo sapiens
caggatttggtt

SEQ ID NO: 2982702 - DNA, 17 bp, Homo sapiens
caggatttttagagcat

SEQ ID NO: 2982703 - DNA, 18 bp, Homo sapiens
caggatttttagagcatt

SEQ ID NO: 2982704 - DNA, 22 bp, Homo sapiens
caggcaacgcacaaaacagaaa

SEQ ID NO: 2982705 - DNA, 19 bp, Homo sapiens
caggcaacgcagaccaaca

SEQ ID NO: 2982706 - DNA, 14 bp, Homo sapiens
caggcacacagcta

SEQ ID NO: 2982707 - DNA, 23 bp, Homo sapiens
caggcacacagctactctcccca

SEQ ID NO: 2982708 - DNA, 12 bp, Homo sapiens
caggcacaggtc

SEQ ID NO: 2982709 - DNA, 16 bp, Homo sapiens
caggcacatggctggg

SEQ ID NO: 2982710 - DNA, 17 bp, Homo sapiens
caggcacatggctgggg

SEQ ID NO: 2982711 - DNA, 23 bp, Homo sapiens
caggcacatggctgggggaggga

SEQ ID NO: 2982712 - DNA, 17 bp, Homo sapiens
caggcacattaactgtt

SEQ ID NO: 2982713 - DNA, 14 bp, Homo sapiens
caggcaccgggctg

SEQ ID NO: 2982714 - DNA, 22 bp, Homo sapiens
caggcaccgggctggctgcttg

SEQ ID NO: 2982715 - DNA, 22 bp, Homo sapiens
caggcacgaacccacctgctga

SEQ ID NO: 2982716 - DNA, 18 bp, Homo sapiens
caggcacggcccgcagcc

SEQ ID NO: 2982717 - DNA, 14 bp, Homo sapiens
caggcactgcaaac

SEQ ID NO: 2982718 - DNA, 14 bp, Homo sapiens
caggcagaagaatc

SEQ ID NO: 2982719 - DNA, 20 bp, Homo sapiens
caggcagaagaatctttctt

SEQ ID NO: 2982720 - DNA, 12 bp, Homo sapiens
caggcagagctg

SEQ ID NO: 2982721 - DNA, 22 bp, Homo sapiens
caggcagagctgagggccctgt

SEQ ID NO: 2982722 - DNA, 15 bp, Homo sapiens
caggcagatccagga

SEQ ID NO: 2982723 - DNA, 17 bp, Homo sapiens
caggcagcgcctgtccc

SEQ ID NO: 2982724 - DNA, 12 bp, Homo sapiens
caggcagggaga

SEQ ID NO: 2982725 - DNA, 21 bp, Homo sapiens
caggcaggggtgagagcaccc

SEQ ID NO: 2982726 - DNA, 22 bp, Homo sapiens
caggcaggggtgagagcaccca

SEQ ID NO: 2982727 - DNA, 16 bp, Homo sapiens
caggcaggtctgcaag

SEQ ID NO: 2982728 - DNA, 19 bp, Homo sapiens
cagtgtctggctgcagagc

SEQ ID NO: 2982729 - DNA, 17 bp, Homo sapiens
cagtgtgaagttagaat

SEQ ID NO: 2982730 - DNA, 21 bp, Homo sapiens
cagtgtgaagttagaattcct

SEQ ID NO: 2982731 - DNA, 12 bp, Homo sapiens
cagtgtgaatgg

SEQ ID NO: 2982732 - DNA, 17 bp, Homo sapiens
cagtgtgaggccagggc

SEQ ID NO: 2982733 - DNA, 19 bp, Homo sapiens
cagtgtgaggccagggcag

SEQ ID NO: 2982734 - DNA, 14 bp, Homo sapiens
cagtgtgctgatgg

SEQ ID NO: 2982735 - DNA, 14 bp, Homo sapiens
cagtgttaaatgtg

SEQ ID NO: 2982736 - DNA, 19 bp, Homo sapiens
cagtgttaaatgtgatgaa

SEQ ID NO: 2982737 - DNA, 18 bp, Homo sapiens
cagtgttccgtggttaaa

SEQ ID NO: 2982738 - DNA, 23 bp, Homo sapiens
cagtgttgttgctctaggaagac

SEQ ID NO: 2982739 - DNA, 15 bp, Homo sapiens
cagtgtttctgaatg

SEQ ID NO: 2982740 - DNA, 17 bp, Homo sapiens
cagtgtttcttcacttc

SEQ ID NO: 2982741 - DNA, 17 bp, Homo sapiens
cagtgttttgcacatca

SEQ ID NO: 2982742 - DNA, 14 bp, Homo sapiens
cagtgtttttgtaa

SEQ ID NO: 2982743 - DNA, 19 bp, Homo sapiens
cagtgtttttgtaaagtgt

SEQ ID NO: 2982744 - DNA, 16 bp, Homo sapiens
cagtgttttttaggaa

SEQ ID NO: 2982745 - DNA, 21 bp, Homo sapiens
cagttaattagcattctggca

SEQ ID NO: 2982746 - DNA, 14 bp, Homo sapiens
cagttacagaaagt

SEQ ID NO: 2982747 - DNA, 15 bp, Homo sapiens
cagttacagaaagtg

SEQ ID NO: 2982748 - DNA, 22 bp, Homo sapiens
cagttacataattcactctgag

SEQ ID NO: 2982749 - DNA, 20 bp, Homo sapiens
cagttacgtgagaagaggtc

SEQ ID NO: 2982750 - DNA, 16 bp, Homo sapiens
cagttactcagccctg

SEQ ID NO: 2982751 - DNA, 18 bp, Homo sapiens
cagttactcagccctggg

SEQ ID NO: 2982752 - DNA, 19 bp, Homo sapiens
cagttactccctacactga

SEQ ID NO: 2982753 - DNA, 23 bp, Homo sapiens
cagttactccctacactgatgca

SEQ ID NO: 2982754 - DNA, 16 bp, Homo sapiens
cagttactctgaaggg

SEQ ID NO: 2982755 - DNA, 19 bp, Homo sapiens
cagttagggttttgcaata

SEQ ID NO: 2982756 - DNA, 20 bp, Homo sapiens
cagttagggttttgcaataa

SEQ ID NO: 2982757 - DNA, 13 bp, Homo sapiens
cagttcaccctga

SEQ ID NO: 2982758 - DNA, 16 bp, Homo sapiens
cagttcacctgcactt

SEQ ID NO: 2982759 - DNA, 22 bp, Homo sapiens
cagttcacttctttgcagagcc

SEQ ID NO: 2982760 - DNA, 15 bp, Homo sapiens
cagttcagcttgggg

SEQ ID NO: 2982761 - DNA, 15 bp, Homo sapiens
cagttcataaatttg

SEQ ID NO: 2982762 - DNA, 14 bp, Homo sapiens
cagttcctcgccct

SEQ ID NO: 2982763 - DNA, 18 bp, Homo sapiens
cagttcgcctggagccct

SEQ ID NO: 2982764 - DNA, 14 bp, Homo sapiens
cagttcttaataca

SEQ ID NO: 2982765 - DNA, 20 bp, Homo sapiens
cagttcttagattcagggga

SEQ ID NO: 2982766 - DNA, 17 bp, Homo sapiens
cagttctttgggccaga

SEQ ID NO: 2982767 - DNA, 19 bp, Homo sapiens
cagttctttgggccagaca

SEQ ID NO: 2982768 - DNA, 20 bp, Homo sapiens
cagttctttgggccagacat

SEQ ID NO: 2982769 - DNA, 16 bp, Homo sapiens
cagttgcaattcataa

SEQ ID NO: 2982770 - DNA, 16 bp, Homo sapiens
cagttgctaaacactg

SEQ ID NO: 2982771 - DNA, 18 bp, Homo sapiens
cagttggccctttaatat

SEQ ID NO: 2982772 - DNA, 19 bp, Homo sapiens
cagttgtagaatgtattgt

SEQ ID NO: 2982773 - DNA, 21 bp, Homo sapiens
cagttgtagaatgtattgtac

SEQ ID NO: 2982774 - DNA, 12 bp, Homo sapiens
cagttgtgcagc

SEQ ID NO: 2982775 - DNA, 23 bp, Homo sapiens
cagttgtgtttgttgctggcttg

SEQ ID NO: 2982776 - DNA, 19 bp, Homo sapiens
cagtttaagacaccaaata

SEQ ID NO: 2982777 - DNA, 20 bp, Homo sapiens
cagtttaagagcagaacaga

SEQ ID NO: 2982778 - DNA, 18 bp, Homo sapiens
cagtttaattctgttaac

SEQ ID NO: 2982779 - DNA, 18 bp, Homo sapiens
cagtttagaacagaggga

SEQ ID NO: 2982780 - DNA, 21 bp, Homo sapiens
cagtttagaacagagggacca

SEQ ID NO: 2982781 - DNA, 21 bp, Homo sapiens
cagtttatatatatgctactt

SEQ ID NO: 2982782 - DNA, 14 bp, Homo sapiens
cagtttatgaaaca

SEQ ID NO: 2982783 - DNA, 19 bp, Homo sapiens
cagtttatgaaacagaaaa

SEQ ID NO: 2982784 - DNA, 19 bp, Homo sapiens
cagtttatttgaaccaata

SEQ ID NO: 2982785 - DNA, 14 bp, Homo sapiens
cagtttatttgttg

SEQ ID NO: 2982786 - DNA, 21 bp, Homo sapiens
cagtttcatcatttgcacaaa

SEQ ID NO: 2982787 - DNA, 17 bp, Homo sapiens
cagtttcctcatctgtc

SEQ ID NO: 2982788 - DNA, 13 bp, Homo sapiens
cagtttgaaattc

SEQ ID NO: 2982789 - DNA, 19 bp, Homo sapiens
cagtttgaaattctgaatt

SEQ ID NO: 2982790 - DNA, 22 bp, Homo sapiens
cagtttgaaattctgaatttgc

SEQ ID NO: 2982791 - DNA, 19 bp, Homo sapiens
cagtttgactatgccgtct

SEQ ID NO: 2982792 - DNA, 21 bp, Homo sapiens
cagtttgcagaaaagcacctg

SEQ ID NO: 2982793 - DNA, 15 bp, Homo sapiens
cagtttggtgtcaac

SEQ ID NO: 2982794 - DNA, 19 bp, Homo sapiens
cagtttgtctctttgcaac

SEQ ID NO: 2982795 - DNA, 19 bp, Homo sapiens
cagtttgtttcctgtctga

SEQ ID NO: 2982796 - DNA, 19 bp, Homo sapiens
cagttttaaacgttaaaag

SEQ ID NO: 2982797 - DNA, 15 bp, Homo sapiens
cagttttgctgctat

SEQ ID NO: 2982798 - DNA, 18 bp, Homo sapiens
cagttttgtaaatgtact

SEQ ID NO: 2982799 - DNA, 19 bp, Homo sapiens
cagttttgtaaatgtactg

SEQ ID NO: 2982800 - DNA, 13 bp, Homo sapiens
cagttttgttttg

SEQ ID NO: 2982801 - DNA, 13 bp, Homo sapiens
cagtttttaaaat

SEQ ID NO: 2982802 - DNA, 21 bp, Homo sapiens
cagtttttaaaattggccttt

SEQ ID NO: 2982803 - DNA, 14 bp, Homo sapiens
cagtttttgacatt

SEQ ID NO: 2982804 - DNA, 16 bp, Homo sapiens
cagtttttgacattta

SEQ ID NO: 2982805 - DNA, 20 bp, Homo sapiens
cataaaaaagaagcactttg

SEQ ID NO: 2982806 - DNA, 21 bp, Homo sapiens
cataaaaaagaagcactttga

SEQ ID NO: 2982807 - DNA, 22 bp, Homo sapiens
cataaaaaagaagcactttgat

SEQ ID NO: 2982808 - DNA, 14 bp, Homo sapiens
cataaaaagcagaa

SEQ ID NO: 2982809 - DNA, 18 bp, Homo sapiens
cataaaaagcagaatttt

SEQ ID NO: 2982810 - DNA, 22 bp, Homo sapiens
cataaaactcatgactgagtct

SEQ ID NO: 2982811 - DNA, 20 bp, Homo sapiens
cataaaagggtcaaacctgt

SEQ ID NO: 2982812 - DNA, 16 bp, Homo sapiens
cataaacttcaggcaa

SEQ ID NO: 2982813 - DNA, 15 bp, Homo sapiens
cataaagtcagtgcc

SEQ ID NO: 2982814 - DNA, 15 bp, Homo sapiens
cataaatagtagaaa

SEQ ID NO: 2982815 - DNA, 14 bp, Homo sapiens
cataaattaatgat

SEQ ID NO: 2982816 - DNA, 17 bp, Homo sapiens
cataaattaatgattct

SEQ ID NO: 2982817 - DNA, 21 bp, Homo sapiens
cataaatttgttgtcatgtgt

SEQ ID NO: 2982818 - DNA, 15 bp, Homo sapiens
cataactgatctatt

SEQ ID NO: 2982819 - DNA, 16 bp, Homo sapiens
cataactgatctattt

SEQ ID NO: 2982820 - DNA, 13 bp, Homo sapiens
cataacttcctgt

SEQ ID NO: 2982821 - DNA, 14 bp, Homo sapiens
cataacttcctgta

SEQ ID NO: 2982822 - DNA, 12 bp, Homo sapiens
cataagaaaaag

SEQ ID NO: 2982823 - DNA, 24 bp, Homo sapiens
cataagataaaatgatgttataca

SEQ ID NO: 2982824 - DNA, 22 bp, Homo sapiens
cataagctatagacccgaggaa

SEQ ID NO: 2982825 - DNA, 21 bp, Homo sapiens
cataaggtttcgtttctgtat

SEQ ID NO: 2982826 - DNA, 20 bp, Homo sapiens
cataagtggagaaatgaaaa

SEQ ID NO: 2982827 - DNA, 12 bp, Homo sapiens
cataatagaatt

SEQ ID NO: 2982828 - DNA, 14 bp, Homo sapiens
cataatagaatttc

SEQ ID NO: 2982829 - DNA, 19 bp, Homo sapiens
cataatagaatttcctaat

SEQ ID NO: 2982830 - DNA, 19 bp, Homo sapiens
cataatgggccactgaaat

SEQ ID NO: 2982831 - DNA, 14 bp, Homo sapiens
cataatggggtcct

SEQ ID NO: 2982832 - DNA, 15 bp, Homo sapiens
cataatgtgaagtgt

SEQ ID NO: 2982833 - DNA, 19 bp, Homo sapiens
cataatgtgaagtgttaat

SEQ ID NO: 2982834 - DNA, 17 bp, Homo sapiens
cataattcactctgagt

SEQ ID NO: 2982835 - DNA, 21 bp, Homo sapiens
cataattcactctgagtgttt

SEQ ID NO: 2982836 - DNA, 22 bp, Homo sapiens
cataattgattaaaatctcttg

SEQ ID NO: 2982837 - DNA, 21 bp, Homo sapiens
cataattgtgaccaatacatt

SEQ ID NO: 2982838 - DNA, 22 bp, Homo sapiens
cataattgtgaccaatacattt

SEQ ID NO: 2982839 - DNA, 14 bp, Homo sapiens
catacacacacaca

SEQ ID NO: 2982840 - DNA, 19 bp, Homo sapiens
catacacacacacacacag

SEQ ID NO: 2982841 - DNA, 23 bp, Homo sapiens
catacacacacacacacagccac

SEQ ID NO: 2982842 - DNA, 23 bp, Homo sapiens
catacagcacaatgttattacct

SEQ ID NO: 2982843 - DNA, 19 bp, Homo sapiens
catacatagacatttcaaa

SEQ ID NO: 2982844 - DNA, 15 bp, Homo sapiens
catacatgttattgt

SEQ ID NO: 2982845 - DNA, 15 bp, Homo sapiens
catacccgtgacagt

SEQ ID NO: 2982846 - DNA, 17 bp, Homo sapiens
cataccgcctcgtgcca

SEQ ID NO: 2982847 - DNA, 20 bp, Homo sapiens
cataccgcctcgtgccagca

SEQ ID NO: 2982848 - DNA, 13 bp, Homo sapiens
catactaacctat

SEQ ID NO: 2982849 - DNA, 15 bp, Homo sapiens
catactacctagaag

SEQ ID NO: 2982850 - DNA, 17 bp, Homo sapiens
catactacctagaagta

SEQ ID NO: 2982851 - DNA, 20 bp, Homo sapiens
catactagcaagacagctct

SEQ ID NO: 2982852 - DNA, 13 bp, Homo sapiens
catactaggtgcc

SEQ ID NO: 2982853 - DNA, 12 bp, Homo sapiens
catactctgttg

SEQ ID NO: 2982854 - DNA, 20 bp, Homo sapiens
catactctgttgcctcctct

SEQ ID NO: 2982855 - DNA, 16 bp, Homo sapiens
catacttcaaaaatgt

SEQ ID NO: 2982856 - DNA, 16 bp, Homo sapiens
catacttcaaaagtat

SEQ ID NO: 2982857 - DNA, 19 bp, Homo sapiens
catacttcaaaagtatttt

SEQ ID NO: 2982858 - DNA, 22 bp, Homo sapiens
catacttcaaaagtattttcct

SEQ ID NO: 2982859 - DNA, 22 bp, Homo sapiens
catacttgaagggccagagcca

SEQ ID NO: 2982860 - DNA, 18 bp, Homo sapiens
catgagactgatccctgg

SEQ ID NO: 2982861 - DNA, 19 bp, Homo sapiens
catgagactgatccctggc

SEQ ID NO: 2982862 - DNA, 15 bp, Homo sapiens
catgagatgtgtgga

SEQ ID NO: 2982863 - DNA, 23 bp, Homo sapiens
catgagctccttaaggctctttt

SEQ ID NO: 2982864 - DNA, 21 bp, Homo sapiens
catgaggaaagcagttgaaat

SEQ ID NO: 2982865 - DNA, 15 bp, Homo sapiens
catgaggagttgctg

SEQ ID NO: 2982866 - DNA, 21 bp, Homo sapiens
catgagtggccttaataaata

SEQ ID NO: 2982867 - DNA, 21 bp, Homo sapiens
catgagttggggtctggcagc

SEQ ID NO: 2982868 - DNA, 13 bp, Homo sapiens
catgatattttgt

SEQ ID NO: 2982869 - DNA, 20 bp, Homo sapiens
catgatattttgtttttccc

SEQ ID NO: 2982870 - DNA, 21 bp, Homo sapiens
catgatccacccacctcagcc

SEQ ID NO: 2982871 - DNA, 13 bp, Homo sapiens
catgatctccctg

SEQ ID NO: 2982872 - DNA, 15 bp, Homo sapiens
catgatctccctgcc

SEQ ID NO: 2982873 - DNA, 17 bp, Homo sapiens
catgatctccctgccgc

SEQ ID NO: 2982874 - DNA, 19 bp, Homo sapiens
catgatctccctgccgcct

SEQ ID NO: 2982875 - DNA, 16 bp, Homo sapiens
catgatgcttttactg

SEQ ID NO: 2982876 - DNA, 18 bp, Homo sapiens
catgatgcttttactgaa

SEQ ID NO: 2982877 - DNA, 14 bp, Homo sapiens
catgatggaatttc

SEQ ID NO: 2982878 - DNA, 19 bp, Homo sapiens
catgatggcaacagatctg

SEQ ID NO: 2982879 - DNA, 20 bp, Homo sapiens
catgatggcaacagatctgg

SEQ ID NO: 2982880 - DNA, 13 bp, Homo sapiens
catgatggccagg

SEQ ID NO: 2982881 - DNA, 16 bp, Homo sapiens
catgatgggaaaatat

SEQ ID NO: 2982882 - DNA, 18 bp, Homo sapiens
catgatgggaaaatattt

SEQ ID NO: 2982883 - DNA, 17 bp, Homo sapiens
catgatggtgcatgcct

SEQ ID NO: 2982884 - DNA, 23 bp, Homo sapiens
catgatttccctccagagaaagc

SEQ ID NO: 2982885 - DNA, 19 bp, Homo sapiens
catgattttaagaggcttt

SEQ ID NO: 2982886 - DNA, 13 bp, Homo sapiens
catgcaaaagaaa

SEQ ID NO: 2982887 - DNA, 16 bp, Homo sapiens
catgcaaatgctgtat

SEQ ID NO: 2982888 - DNA, 22 bp, Homo sapiens
catgcaaatgctgtattcttct

SEQ ID NO: 2982889 - DNA, 20 bp, Homo sapiens
catgcaagaactcatcactg

SEQ ID NO: 2982890 - DNA, 22 bp, Homo sapiens
catgcaagaactcatcactgtg

SEQ ID NO: 2982891 - DNA, 13 bp, Homo sapiens
catgcaagtgctg

SEQ ID NO: 2982892 - DNA, 15 bp, Homo sapiens
catgcaagtgctgtt

SEQ ID NO: 2982893 - DNA, 23 bp, Homo sapiens
catgcacacggctggtcactctg

SEQ ID NO: 2982894 - DNA, 20 bp, Homo sapiens
catgcaccaacccactgccc

SEQ ID NO: 2982895 - DNA, 16 bp, Homo sapiens
catgcaccctcataca

SEQ ID NO: 2982896 - DNA, 14 bp, Homo sapiens
catgcactgtgaag

SEQ ID NO: 2982897 - DNA, 18 bp, Homo sapiens
catgcactgtgaaggacc

SEQ ID NO: 2982898 - DNA, 20 bp, Homo sapiens
catgcactgtgaaggaccct

SEQ ID NO: 2982899 - DNA, 23 bp, Homo sapiens
catgcactgttccccctgtgcag

SEQ ID NO: 2982900 - DNA, 13 bp, Homo sapiens
catgcaggtctcc

SEQ ID NO: 2982901 - DNA, 17 bp, Homo sapiens
catgcaggtctccatga

SEQ ID NO: 2982902 - DNA, 13 bp, Homo sapiens
catgcagtttgaa

SEQ ID NO: 2982903 - DNA, 17 bp, Homo sapiens
catgcagtttgaaattc

SEQ ID NO: 2982904 - DNA, 15 bp, Homo sapiens
catgcataaaagggt

SEQ ID NO: 2982905 - DNA, 12 bp, Homo sapiens
catgcatacaca

SEQ ID NO: 2982906 - DNA, 15 bp, Homo sapiens
catgcatctgtttat

SEQ ID NO: 2982907 - DNA, 17 bp, Homo sapiens
catgcatcttactgaag

SEQ ID NO: 2982908 - DNA, 17 bp, Homo sapiens
catgccaacaagaatgc

SEQ ID NO: 2982909 - DNA, 21 bp, Homo sapiens
catgccaacaagaatgcattg

SEQ ID NO: 2982910 - DNA, 13 bp, Homo sapiens
catgccaggaccc

SEQ ID NO: 2982911 - DNA, 21 bp, Homo sapiens
catgccaggttaggaaggcag

SEQ ID NO: 2982912 - DNA, 12 bp, Homo sapiens
catgcccagcta

SEQ ID NO: 2982913 - DNA, 14 bp, Homo sapiens
catgcccctggctg

SEQ ID NO: 2982914 - DNA, 21 bp, Homo sapiens
catgcccggctaatttttgta

SEQ ID NO: 2982915 - DNA, 13 bp, Homo sapiens
catgccctcctct

SEQ ID NO: 2982916 - DNA, 20 bp, Homo sapiens
catgccctcctctcccattg

SEQ ID NO: 2982917 - DNA, 14 bp, Homo sapiens
catgccctgtgcaa

SEQ ID NO: 2982918 - DNA, 18 bp, Homo sapiens
catgccctgtgcaacctc

SEQ ID NO: 2982919 - DNA, 23 bp, Homo sapiens
catgccctgtgcaacctcttggc

SEQ ID NO: 2982920 - DNA, 16 bp, Homo sapiens
catgcctcagccctga

SEQ ID NO: 2982921 - DNA, 15 bp, Homo sapiens
catgcctctgagctt

SEQ ID NO: 2982922 - DNA, 13 bp, Homo sapiens
catgcctgatgaa

SEQ ID NO: 2982923 - DNA, 14 bp, Homo sapiens
catgcctgatgaaa

SEQ ID NO: 2982924 - DNA, 18 bp, Homo sapiens
catgcctgtaatcccaga

SEQ ID NO: 2982925 - DNA, 22 bp, Homo sapiens
catgcgacactgggaggccagt

SEQ ID NO: 2982926 - DNA, 16 bp, Homo sapiens
catgcggagccagcag

SEQ ID NO: 2982927 - DNA, 19 bp, Homo sapiens
catgcgggctcgcccatac

SEQ ID NO: 2982928 - DNA, 19 bp, Homo sapiens
catgcggtagccagcacac

SEQ ID NO: 2982929 - DNA, 21 bp, Homo sapiens
catgcggtagccagcacacag

SEQ ID NO: 2982930 - DNA, 16 bp, Homo sapiens
catgctaaaattctat

SEQ ID NO: 2982931 - DNA, 14 bp, Homo sapiens
catgctaaataact

SEQ ID NO: 2982932 - DNA, 15 bp, Homo sapiens
catgctaaataacta

SEQ ID NO: 2982933 - DNA, 16 bp, Homo sapiens
catgctaaattattat

SEQ ID NO: 2982934 - DNA, 21 bp, Homo sapiens
catgctatatatcttttgtaa

SEQ ID NO: 2982935 - DNA, 13 bp, Homo sapiens
catgctcccaact

SEQ ID NO: 2982936 - DNA, 15 bp, Homo sapiens
catgctcccaactcc

SEQ ID NO: 2982937 - DNA, 16 bp, Homo sapiens
catgctcccaactccc

SEQ ID NO: 2982938 - DNA, 17 bp, Homo sapiens
catgctcccaactccct

SEQ ID NO: 2982939 - DNA, 16 bp, Homo sapiens
catgctctctgcagcc

SEQ ID NO: 2982940 - DNA, 22 bp, Homo sapiens
catgctggaaaataatactgct

SEQ ID NO: 2982941 - DNA, 23 bp, Homo sapiens
catgctggaaaataatactgctg

SEQ ID NO: 2982942 - DNA, 18 bp, Homo sapiens
catgctggaacctgcaaa

SEQ ID NO: 2982943 - DNA, 17 bp, Homo sapiens
catgctgtccctgcact

SEQ ID NO: 2982944 - DNA, 21 bp, Homo sapiens
catgctgtccctgcactgtgc

SEQ ID NO: 2982945 - DNA, 19 bp, Homo sapiens
catgctgtgattgtgccta

SEQ ID NO: 2982946 - DNA, 18 bp, Homo sapiens
catgctgttgattgctaa

SEQ ID NO: 2982947 - DNA, 22 bp, Homo sapiens
catgctgttgattgctaaatgt

SEQ ID NO: 2982948 - DNA, 23 bp, Homo sapiens
catgctgttgattgctaaatgta

SEQ ID NO: 2982949 - DNA, 23 bp, Homo sapiens
catgcttcatcattccctctcat

SEQ ID NO: 2982950 - DNA, 18 bp, Homo sapiens
catgcttgaatggagctg

SEQ ID NO: 2982951 - DNA, 15 bp, Homo sapiens
catgcttgcaccgag

SEQ ID NO: 2982952 - DNA, 19 bp, Homo sapiens
catgcttgtgaaaatgtgt

SEQ ID NO: 2982953 - DNA, 16 bp, Homo sapiens
catggaaaaacttcct

SEQ ID NO: 2982954 - DNA, 17 bp, Homo sapiens
catggaaaagccttctt

SEQ ID NO: 2982955 - DNA, 18 bp, Homo sapiens
catggaaggggcttctgg

SEQ ID NO: 2982956 - DNA, 21 bp, Homo sapiens
catggaaggggcttctggacc

SEQ ID NO: 2982957 - DNA, 20 bp, Homo sapiens
catggaaggtgccagaagga

SEQ ID NO: 2982958 - DNA, 17 bp, Homo sapiens
catggaatctgatgaaa

SEQ ID NO: 2982959 - DNA, 15 bp, Homo sapiens
catggaatggttata

SEQ ID NO: 2982960 - DNA, 14 bp, Homo sapiens
catggacaggctgg

SEQ ID NO: 2982961 - DNA, 15 bp, Homo sapiens
catggacaggctggc

SEQ ID NO: 2982962 - DNA, 11 bp, Homo sapiens
catggagaaac

SEQ ID NO: 2982963 - DNA, 14 bp, Homo sapiens
catggaggagacag

SEQ ID NO: 2982964 - DNA, 18 bp, Homo sapiens
catggaggttctaaggcc

SEQ ID NO: 2982965 - DNA, 22 bp, Homo sapiens
catggagtgagacccaggagcc

SEQ ID NO: 2982966 - DNA, 14 bp, Homo sapiens
catggatacatatt

SEQ ID NO: 2982967 - DNA, 16 bp, Homo sapiens
catggatttccactgc

SEQ ID NO: 2982968 - DNA, 16 bp, Homo sapiens
catggcactccctcca

SEQ ID NO: 2982969 - DNA, 21 bp, Homo sapiens
catggcagctgggcccacagc

SEQ ID NO: 2982970 - DNA, 22 bp, Homo sapiens
catggcagctgggcccacagcc

SEQ ID NO: 2982971 - DNA, 14 bp, Homo sapiens
catggcatgtcttt

SEQ ID NO: 2982972 - DNA, 15 bp, Homo sapiens
catggccacactgtg

SEQ ID NO: 2982973 - DNA, 19 bp, Homo sapiens
catggccacactgtgacac

SEQ ID NO: 2982974 - DNA, 18 bp, Homo sapiens
catggccaccttttcagc

SEQ ID NO: 2982975 - DNA, 15 bp, Homo sapiens
catggccctgctgcc

SEQ ID NO: 2982976 - DNA, 16 bp, Homo sapiens
catggccctgctgccc

SEQ ID NO: 2982977 - DNA, 20 bp, Homo sapiens
catggcgagatactgcatgt

SEQ ID NO: 2982978 - DNA, 10 bp, Homo sapiens
catggcttcc

SEQ ID NO: 2982979 - DNA, 18 bp, Homo sapiens
catggcttctcctttggc

SEQ ID NO: 2982980 - DNA, 18 bp, Homo sapiens
catggctttcatcctgtg

SEQ ID NO: 2982981 - DNA, 21 bp, Homo sapiens
catgggaacgcagcctccagt

SEQ ID NO: 2982982 - DNA, 13 bp, Homo sapiens
catgggaagggga

SEQ ID NO: 2982983 - DNA, 14 bp, Homo sapiens
catgggaaggggag

SEQ ID NO: 2982984 - DNA, 16 bp, Homo sapiens
catgggaatacaaaag

SEQ ID NO: 2982985 - DNA, 21 bp, Homo sapiens
catgggcacaaagggcccaga

SEQ ID NO: 2982986 - DNA, 15 bp, Homo sapiens
catgggccagcccct

SEQ ID NO: 2982987 - DNA, 21 bp, Homo sapiens
catggggatcaattttcatta

SEQ ID NO: 2982988 - DNA, 20 bp, Homo sapiens
catggggcatgtcctttcca

SEQ ID NO: 2982989 - DNA, 18 bp, Homo sapiens
catgggtcctcggcccat

SEQ ID NO: 2982990 - DNA, 15 bp, Homo sapiens
catgggtcgggagag

SEQ ID NO: 2982991 - DNA, 20 bp, Homo sapiens
catgggtcgggagaggggac

SEQ ID NO: 2982992 - DNA, 22 bp, Homo sapiens
cattaaaaaaaaaaaaaaaagt

SEQ ID NO: 2982993 - DNA, 22 bp, Homo sapiens
cattaaaacaatattgtttcta

SEQ ID NO: 2982994 - DNA, 19 bp, Homo sapiens
cattaaaagacaaatatgt

SEQ ID NO: 2982995 - DNA, 11 bp, Homo sapiens
cattaaaataa

SEQ ID NO: 2982996 - DNA, 13 bp, Homo sapiens
cattaaaataaac

SEQ ID NO: 2982997 - DNA, 15 bp, Homo sapiens
cattaaaatgaattt

SEQ ID NO: 2982998 - DNA, 15 bp, Homo sapiens
cattaaaattgttac

SEQ ID NO: 2982999 - DNA, 19 bp, Homo sapiens
cattaaagttaatagaact

SEQ ID NO: 2983000 - DNA, 17 bp, Homo sapiens
cattaaattcacaaact

SEQ ID NO: 2983001 - DNA, 21 bp, Homo sapiens
cattaaattcacaaactttta

SEQ ID NO: 2983002 - DNA, 13 bp, Homo sapiens
cattaacacattg

SEQ ID NO: 2983003 - DNA, 15 bp, Homo sapiens
cattaacacattgtt

SEQ ID NO: 2983004 - DNA, 23 bp, Homo sapiens
cattaacacattgttatttctgt

SEQ ID NO: 2983005 - DNA, 17 bp, Homo sapiens
cattaaccatctttaat

SEQ ID NO: 2983006 - DNA, 14 bp, Homo sapiens
cattaactgttgca

SEQ ID NO: 2983007 - DNA, 22 bp, Homo sapiens
cattaactgttgcacttttgaa

SEQ ID NO: 2983008 - DNA, 12 bp, Homo sapiens
cattaataatag

SEQ ID NO: 2983009 - DNA, 13 bp, Homo sapiens
cattaatgcccag

SEQ ID NO: 2983010 - DNA, 12 bp, Homo sapiens
cattactttata

SEQ ID NO: 2983011 - DNA, 19 bp, Homo sapiens
cattagaaaaatagcaact

SEQ ID NO: 2983012 - DNA, 14 bp, Homo sapiens
cattagaatgtgat

SEQ ID NO: 2983013 - DNA, 17 bp, Homo sapiens
cattagaatgtgatttt

SEQ ID NO: 2983014 - DNA, 16 bp, Homo sapiens
cattagactggaactt

SEQ ID NO: 2983015 - DNA, 21 bp, Homo sapiens
cattagattatcaaaaagtat

SEQ ID NO: 2983016 - DNA, 19 bp, Homo sapiens
cattagccagatttgtctt

SEQ ID NO: 2983017 - DNA, 14 bp, Homo sapiens
cattataaaagatc

SEQ ID NO: 2983018 - DNA, 20 bp, Homo sapiens
cattataactgaaggagaag

SEQ ID NO: 2983019 - DNA, 15 bp, Homo sapiens
cattatcatgtgtaa

SEQ ID NO: 2983020 - DNA, 22 bp, Homo sapiens
cattatgagaggcaatgattgt

SEQ ID NO: 2983021 - DNA, 17 bp, Homo sapiens
cattatgtggttttaga

SEQ ID NO: 2983022 - DNA, 22 bp, Homo sapiens
cattattatataaatcatgatg

SEQ ID NO: 2983023 - DNA, 22 bp, Homo sapiens
cattattcgtagatattggaca

SEQ ID NO: 2983024 - DNA, 19 bp, Homo sapiens
cattattctcataatcctt

SEQ ID NO: 2983025 - DNA, 20 bp, Homo sapiens
cattattgacgaactggcta

SEQ ID NO: 2983026 - DNA, 21 bp, Homo sapiens
cattatttgagtttgacattt

SEQ ID NO: 2983027 - DNA, 13 bp, Homo sapiens
cattatttgataa

SEQ ID NO: 2983028 - DNA, 19 bp, Homo sapiens
cattcaaaaaactctctcc

SEQ ID NO: 2983029 - DNA, 16 bp, Homo sapiens
cattcaaaagttgaaa

SEQ ID NO: 2983030 - DNA, 17 bp, Homo sapiens
cattcaaaagttgaaat

SEQ ID NO: 2983031 - DNA, 18 bp, Homo sapiens
cattcaaaagttgaaatt

SEQ ID NO: 2983032 - DNA, 18 bp, Homo sapiens
cattcaagtgtaaaatat

SEQ ID NO: 2983033 - DNA, 19 bp, Homo sapiens
cattcaagtgtaaaatatt

SEQ ID NO: 2983034 - DNA, 20 bp, Homo sapiens
cattcaagtgtaaaatattt

SEQ ID NO: 2983035 - DNA, 23 bp, Homo sapiens
cattcaagtgtaaaatattttga

SEQ ID NO: 2983036 - DNA, 23 bp, Homo sapiens
cattcacagttctttgggccaga

SEQ ID NO: 2983037 - DNA, 13 bp, Homo sapiens
cattcacatttca

SEQ ID NO: 2983038 - DNA, 15 bp, Homo sapiens
cattcacatttcaag

SEQ ID NO: 2983039 - DNA, 13 bp, Homo sapiens
cattcacctgccc

SEQ ID NO: 2983040 - DNA, 15 bp, Homo sapiens
cattcacctgcccca

SEQ ID NO: 2983041 - DNA, 20 bp, Homo sapiens
cattcacttctgcattcctg

SEQ ID NO: 2983042 - DNA, 16 bp, Homo sapiens
cattcagatttaccat

SEQ ID NO: 2983043 - DNA, 19 bp, Homo sapiens
cattcagcagcaaattttc

SEQ ID NO: 2983044 - DNA, 16 bp, Homo sapiens
cattcatgttttaaaa

SEQ ID NO: 2983045 - DNA, 20 bp, Homo sapiens
cattcatttagctaaacgga

SEQ ID NO: 2983046 - DNA, 14 bp, Homo sapiens
cattcattttatat

SEQ ID NO: 2983047 - DNA, 18 bp, Homo sapiens
cattcattttatattgaa

SEQ ID NO: 2983048 - DNA, 20 bp, Homo sapiens
cattcattttatattgaaaa

SEQ ID NO: 2983049 - DNA, 22 bp, Homo sapiens
cattcattttatattgaaaaaa

SEQ ID NO: 2983050 - DNA, 23 bp, Homo sapiens
cattccaaaggggacccctatga

SEQ ID NO: 2983051 - DNA, 12 bp, Homo sapiens
cattccaacaaa

SEQ ID NO: 2983052 - DNA, 14 bp, Homo sapiens
cattccaagactct

SEQ ID NO: 2983053 - DNA, 17 bp, Homo sapiens
cattccaagactctaga

SEQ ID NO: 2983054 - DNA, 21 bp, Homo sapiens
cattccacaggatcatcattt

SEQ ID NO: 2983055 - DNA, 19 bp, Homo sapiens
cattccagagttaaaatgt

SEQ ID NO: 2983056 - DNA, 17 bp, Homo sapiens
cattccaggctcctccc

SEQ ID NO: 2983057 - DNA, 14 bp, Homo sapiens
cattcccactgcca

SEQ ID NO: 2983058 - DNA, 23 bp, Homo sapiens
cattccccaggtggctgacccag

SEQ ID NO: 2983059 - DNA, 18 bp, Homo sapiens
cattcccccttcaacaaa

SEQ ID NO: 2983060 - DNA, 21 bp, Homo sapiens
cattccctctcatctcaggta

SEQ ID NO: 2983061 - DNA, 22 bp, Homo sapiens
cattcctaaagaaaaatatctt

SEQ ID NO: 2983062 - DNA, 13 bp, Homo sapiens
cattcctgaagaa

SEQ ID NO: 2983063 - DNA, 20 bp, Homo sapiens
cattcctgaagaaccagtcc

SEQ ID NO: 2983064 - DNA, 21 bp, Homo sapiens
cattcctgggaaatattccct

SEQ ID NO: 2983065 - DNA, 13 bp, Homo sapiens
cattcctgttctt

SEQ ID NO: 2983066 - DNA, 17 bp, Homo sapiens
cattcgcgctctgctca

SEQ ID NO: 2983067 - DNA, 21 bp, Homo sapiens
cattctacttgcttattacat

SEQ ID NO: 2983068 - DNA, 15 bp, Homo sapiens
cattctatcgttatt

SEQ ID NO: 2983069 - DNA, 23 bp, Homo sapiens
cattctatcgttattataaatgt

SEQ ID NO: 2983070 - DNA, 14 bp, Homo sapiens
cattctcaggcacc

SEQ ID NO: 2983071 - DNA, 16 bp, Homo sapiens
cattctcaggcaccag

SEQ ID NO: 2983072 - DNA, 17 bp, Homo sapiens
cattctcaggcaccagt

SEQ ID NO: 2983073 - DNA, 17 bp, Homo sapiens
cattctccacagcaacc

SEQ ID NO: 2983074 - DNA, 21 bp, Homo sapiens
cattctcctcctcctccctcc

SEQ ID NO: 2983075 - DNA, 15 bp, Homo sapiens
cattctcctgcctca

SEQ ID NO: 2983076 - DNA, 17 bp, Homo sapiens
cattctcctgcctcagc

SEQ ID NO: 2983077 - DNA, 20 bp, Homo sapiens
cattctcctgcctcagcctt

SEQ ID NO: 2983078 - DNA, 22 bp, Homo sapiens
cattctcctttgcagttcctct

SEQ ID NO: 2983079 - DNA, 21 bp, Homo sapiens
cattctctattgtaattttgt

SEQ ID NO: 2983080 - DNA, 12 bp, Homo sapiens
cattctctctcc

SEQ ID NO: 2983081 - DNA, 16 bp, Homo sapiens
cattctctctcctgta

SEQ ID NO: 2983082 - DNA, 15 bp, Homo sapiens
cattctgagaccaaa

SEQ ID NO: 2983083 - DNA, 16 bp, Homo sapiens
cattctgataggaggg

SEQ ID NO: 2983084 - DNA, 17 bp, Homo sapiens
cattctgataggagggg

SEQ ID NO: 2983085 - DNA, 18 bp, Homo sapiens
cattctgataggaggggg

SEQ ID NO: 2983086 - DNA, 13 bp, Homo sapiens
cattctggaataa

SEQ ID NO: 2983087 - DNA, 16 bp, Homo sapiens
cattctggagacagaa

SEQ ID NO: 2983088 - DNA, 17 bp, Homo sapiens
cattcttataaatatga

SEQ ID NO: 2983089 - DNA, 22 bp, Homo sapiens
cattcttataaatatgaagctc

SEQ ID NO: 2983090 - DNA, 20 bp, Homo sapiens
cattcttggcatctactctg

SEQ ID NO: 2983091 - DNA, 20 bp, Homo sapiens
cattcttggcttaatcattt

SEQ ID NO: 2983092 - DNA, 21 bp, Homo sapiens
cattcttgtaaggctttgatt

SEQ ID NO: 2983093 - DNA, 22 bp, Homo sapiens
cattcttgtaaggctttgatta

SEQ ID NO: 2983094 - DNA, 20 bp, Homo sapiens
cattctttcttggtgcattc

SEQ ID NO: 2983095 - DNA, 18 bp, Homo sapiens
cattctttgcaatactgc

SEQ ID NO: 2983096 - DNA, 15 bp, Homo sapiens
cattcttttgtaatt

SEQ ID NO: 2983097 - DNA, 16 bp, Homo sapiens
cattcttttgtaattt

SEQ ID NO: 2983098 - DNA, 19 bp, Homo sapiens
cattcttttgtaatttaaa

SEQ ID NO: 2983099 - DNA, 16 bp, Homo sapiens
cattgaaaacagatat

SEQ ID NO: 2983100 - DNA, 18 bp, Homo sapiens
cattgaaagaagagatga

SEQ ID NO: 2983101 - DNA, 16 bp, Homo sapiens
cattgaacacaaactg

SEQ ID NO: 2983102 - DNA, 21 bp, Homo sapiens
cattgaagtgtttgctgcaga

SEQ ID NO: 2983103 - DNA, 21 bp, Homo sapiens
cattgaattcttggttgagga

SEQ ID NO: 2983104 - DNA, 20 bp, Homo sapiens
cattgaatttagtcattatt

SEQ ID NO: 2983105 - DNA, 15 bp, Homo sapiens
cattgacattataga

SEQ ID NO: 2983106 - DNA, 21 bp, Homo sapiens
cattgacattatagacattga

SEQ ID NO: 2983107 - DNA, 19 bp, Homo sapiens
cattgagaactgcatatgt

SEQ ID NO: 2983108 - DNA, 23 bp, Homo sapiens
cattgagaactgcatatgtttcg

SEQ ID NO: 2983109 - DNA, 15 bp, Homo sapiens
cattgagctgtgcaa

SEQ ID NO: 2983110 - DNA, 14 bp, Homo sapiens
cattgatattgtga

SEQ ID NO: 2983111 - DNA, 22 bp, Homo sapiens
cattgatgaatgaggaacaatc

SEQ ID NO: 2983112 - DNA, 18 bp, Homo sapiens
cattgatttcctgtgtca

SEQ ID NO: 2983113 - DNA, 14 bp, Homo sapiens
cattgcacctatct

SEQ ID NO: 2983114 - DNA, 14 bp, Homo sapiens
cattgcccagtctt

SEQ ID NO: 2983115 - DNA, 17 bp, Homo sapiens
cattgcccagtctttca

SEQ ID NO: 2983116 - DNA, 20 bp, Homo sapiens
cattgcccagtctttcatgt

SEQ ID NO: 2983117 - DNA, 21 bp, Homo sapiens
cattgcctgactaaaatgttt

SEQ ID NO: 2983118 - DNA, 15 bp, Homo sapiens
cattgctaagatgct

SEQ ID NO: 2983119 - DNA, 16 bp, Homo sapiens
cattgctaagatgctc

SEQ ID NO: 2983120 - DNA, 17 bp, Homo sapiens
cattgctccaagatgtt

SEQ ID NO: 2983121 - DNA, 16 bp, Homo sapiens
cattgctgagcctctg

SEQ ID NO: 2983122 - DNA, 21 bp, Homo sapiens
cattgctgagcctctgctccc

SEQ ID NO: 2983123 - DNA, 23 bp, Homo sapiens
ccaatttgtctcctactctgtgt

SEQ ID NO: 2983124 - DNA, 15 bp, Homo sapiens
ccaattttttttaag

SEQ ID NO: 2983125 - DNA, 17 bp, Homo sapiens
ccacaaagcaaaggcag

SEQ ID NO: 2983126 - DNA, 19 bp, Homo sapiens
ccacaaagcagtggcttag

SEQ ID NO: 2983127 - DNA, 22 bp, Homo sapiens
ccacaaatgtgtcccagtgaac

SEQ ID NO: 2983128 - DNA, 16 bp, Homo sapiens
ccacaaccctctggaa

SEQ ID NO: 2983129 - DNA, 21 bp, Homo sapiens
ccacaacttgtcacccaaagc

SEQ ID NO: 2983130 - DNA, 16 bp, Homo sapiens
ccacaagattcccaga

SEQ ID NO: 2983131 - DNA, 16 bp, Homo sapiens
ccacaagcctgcctcg

SEQ ID NO: 2983132 - DNA, 20 bp, Homo sapiens
ccacaagcctgcctcgcctt

SEQ ID NO: 2983133 - DNA, 24 bp, Homo sapiens
ccacaaggaataaatgagagggaa

SEQ ID NO: 2983134 - DNA, 21 bp, Homo sapiens
ccacaaggacttcctgtccag

SEQ ID NO: 2983135 - DNA, 13 bp, Homo sapiens
ccacaaggcctgg

SEQ ID NO: 2983136 - DNA, 15 bp, Homo sapiens
ccacaaggcctggtc

SEQ ID NO: 2983137 - DNA, 20 bp, Homo sapiens
ccacaaggcctggtctggga

SEQ ID NO: 2983138 - DNA, 15 bp, Homo sapiens
ccacaatttctttaa

SEQ ID NO: 2983139 - DNA, 17 bp, Homo sapiens
ccacaatttctttaaaa

SEQ ID NO: 2983140 - DNA, 21 bp, Homo sapiens
ccacaatttctttaaaaaaga

SEQ ID NO: 2983141 - DNA, 14 bp, Homo sapiens
ccacacacaacagc

SEQ ID NO: 2983142 - DNA, 15 bp, Homo sapiens
ccacacacacacaca

SEQ ID NO: 2983143 - DNA, 21 bp, Homo sapiens
ccacacacacacacatgcata

SEQ ID NO: 2983144 - DNA, 24 bp, Homo sapiens
ccacacacacacacatgcatacac

SEQ ID NO: 2983145 - DNA, 17 bp, Homo sapiens
ccacacacacagaaaat

SEQ ID NO: 2983146 - DNA, 23 bp, Homo sapiens
ccacacacacagaaaatatactg

SEQ ID NO: 2983147 - DNA, 15 bp, Homo sapiens
ccacacacactcctt

SEQ ID NO: 2983148 - DNA, 16 bp, Homo sapiens
ccacacacactccttc

SEQ ID NO: 2983149 - DNA, 18 bp, Homo sapiens
ccacacacactccttccc

SEQ ID NO: 2983150 - DNA, 19 bp, Homo sapiens
ccacacacactccttcccc

SEQ ID NO: 2983151 - DNA, 14 bp, Homo sapiens
ccacaccaagcagc

SEQ ID NO: 2983152 - DNA, 13 bp, Homo sapiens
ccacaccagcctc

SEQ ID NO: 2983153 - DNA, 14 bp, Homo sapiens
ccacaccagcctcc

SEQ ID NO: 2983154 - DNA, 17 bp, Homo sapiens
ccacaccagcctcctgg

SEQ ID NO: 2983155 - DNA, 15 bp, Homo sapiens
ccacacccaaagctg

SEQ ID NO: 2983156 - DNA, 16 bp, Homo sapiens
ccacacccagctcagc

SEQ ID NO: 2983157 - DNA, 14 bp, Homo sapiens
ccacaccctgcctg

SEQ ID NO: 2983158 - DNA, 17 bp, Homo sapiens
ccacaccctgcctgctg

SEQ ID NO: 2983159 - DNA, 18 bp, Homo sapiens
ccacaccctgcctgctgt

SEQ ID NO: 2983160 - DNA, 19 bp, Homo sapiens
ccacaccctgcctgctgtg

SEQ ID NO: 2983161 - DNA, 20 bp, Homo sapiens
ccacacctgcagtgccagct

SEQ ID NO: 2983162 - DNA, 12 bp, Homo sapiens
ccacacctgcct

SEQ ID NO: 2983163 - DNA, 15 bp, Homo sapiens
ccacacgcaggcggc

SEQ ID NO: 2983164 - DNA, 22 bp, Homo sapiens
ccacacgtaatgaaacttggat

SEQ ID NO: 2983165 - DNA, 14 bp, Homo sapiens
ccacactatgtgtg

SEQ ID NO: 2983166 - DNA, 24 bp, Homo sapiens
ccacactatgtgtgttgtttccat

SEQ ID NO: 2983167 - DNA, 20 bp, Homo sapiens
ccacactcttctatgaccca

SEQ ID NO: 2983168 - DNA, 14 bp, Homo sapiens
ccacactgctacac

SEQ ID NO: 2983169 - DNA, 21 bp, Homo sapiens
ccacactggactccggccctc

SEQ ID NO: 2983170 - DNA, 21 bp, Homo sapiens
ccacactgtgacacactacac

SEQ ID NO: 2983171 - DNA, 19 bp, Homo sapiens
ccacacttgtgccagcccg

SEQ ID NO: 2983172 - DNA, 19 bp, Homo sapiens
ccacagaaggtgaactttg

SEQ ID NO: 2983173 - DNA, 17 bp, Homo sapiens
ccacagactgccccagc

SEQ ID NO: 2983174 - DNA, 17 bp, Homo sapiens
ccacagagtaagacatt

SEQ ID NO: 2983175 - DNA, 18 bp, Homo sapiens
ccacagagtaagacattg

SEQ ID NO: 2983176 - DNA, 19 bp, Homo sapiens
ccacagcaaccccaggctg

SEQ ID NO: 2983177 - DNA, 16 bp, Homo sapiens
ccacagcccaggcctc

SEQ ID NO: 2983178 - DNA, 21 bp, Homo sapiens
ccacagcccaggcctccagct

SEQ ID NO: 2983179 - DNA, 16 bp, Homo sapiens
ccacagcccccacccc

SEQ ID NO: 2983180 - DNA, 20 bp, Homo sapiens
ccacagcccccaccccagca

SEQ ID NO: 2983181 - DNA, 11 bp, Homo sapiens
ccacagcttcc

SEQ ID NO: 2983182 - DNA, 12 bp, Homo sapiens
ccacagcttcct

SEQ ID NO: 2983183 - DNA, 14 bp, Homo sapiens
ccacagcttcctgt

SEQ ID NO: 2983184 - DNA, 18 bp, Homo sapiens
ccacaggaacggccctgc

SEQ ID NO: 2983185 - DNA, 21 bp, Homo sapiens
ccacaggaacggccctgcagg

SEQ ID NO: 2983186 - DNA, 21 bp, Homo sapiens
ccacaggacatttctctaaga

SEQ ID NO: 2983187 - DNA, 15 bp, Homo sapiens
ccacaggacgaatgc

SEQ ID NO: 2983188 - DNA, 21 bp, Homo sapiens
ccacaggagccctgctatgaa

SEQ ID NO: 2983189 - DNA, 22 bp, Homo sapiens
ccacaggagccctgctatgaaa

SEQ ID NO: 2983190 - DNA, 23 bp, Homo sapiens
ccacaggaggtgtgatagagcct

SEQ ID NO: 2983191 - DNA, 20 bp, Homo sapiens
ccacaggagtgggaaaacac

SEQ ID NO: 2983192 - DNA, 17 bp, Homo sapiens
ccacagggctaagagct

SEQ ID NO: 2983193 - DNA, 18 bp, Homo sapiens
ccacaggtgcgggaccat

SEQ ID NO: 2983194 - DNA, 21 bp, Homo sapiens
ccacaggtgcgggaccatctg

SEQ ID NO: 2983195 - DNA, 23 bp, Homo sapiens
ccacaggtgtttatacagctcag

SEQ ID NO: 2983196 - DNA, 22 bp, Homo sapiens
ccacagttcttaatacaggaga

SEQ ID NO: 2983197 - DNA, 20 bp, Homo sapiens
ccacagtttcctcatctgtc

SEQ ID NO: 2983198 - DNA, 22 bp, Homo sapiens
ccacagtttcctcatctgtcca

SEQ ID NO: 2983199 - DNA, 14 bp, Homo sapiens
ccacatcccactgg

SEQ ID NO: 2983200 - DNA, 22 bp, Homo sapiens
ccacatctaagcctgaaggggc

SEQ ID NO: 2983201 - DNA, 14 bp, Homo sapiens
ccacatctgtgtct

SEQ ID NO: 2983202 - DNA, 16 bp, Homo sapiens
ccacatgccccaggct

SEQ ID NO: 2983203 - DNA, 17 bp, Homo sapiens
ccacatgccccaggctc

SEQ ID NO: 2983204 - DNA, 18 bp, Homo sapiens
ccacatggcggagagttt

SEQ ID NO: 2983205 - DNA, 18 bp, Homo sapiens
ccacatggtgtggccatc

SEQ ID NO: 2983206 - DNA, 23 bp, Homo sapiens
ccacattcccccttcaacaaaca

SEQ ID NO: 2983207 - DNA, 13 bp, Homo sapiens
ccacatttacata

SEQ ID NO: 2983208 - DNA, 23 bp, Homo sapiens
ccacatttagtctctttattcct

SEQ ID NO: 2983209 - DNA, 15 bp, Homo sapiens
ccacatttctaaaat

SEQ ID NO: 2983210 - DNA, 22 bp, Homo sapiens
ccacatttggaatactttttgt

SEQ ID NO: 2983211 - DNA, 14 bp, Homo sapiens
ccacattttaggat

SEQ ID NO: 2983212 - DNA, 20 bp, Homo sapiens
ccacatttttgcacagatta

SEQ ID NO: 2983213 - DNA, 16 bp, Homo sapiens
ccaccaaatctgtcta

SEQ ID NO: 2983214 - DNA, 15 bp, Homo sapiens
ccaccaacatcccat

SEQ ID NO: 2983215 - DNA, 21 bp, Homo sapiens
ccaccaacccatcagaaggag

SEQ ID NO: 2983216 - DNA, 19 bp, Homo sapiens
ccaccaactttttccaagt

SEQ ID NO: 2983217 - DNA, 21 bp, Homo sapiens
ccaccaagagggacgcctggg

SEQ ID NO: 2983218 - DNA, 22 bp, Homo sapiens
ccaccaaggtctcacactcctc

SEQ ID NO: 2983219 - DNA, 14 bp, Homo sapiens
ccaccacagcttat

SEQ ID NO: 2983220 - DNA, 14 bp, Homo sapiens
ccaccacccaacct

SEQ ID NO: 2983221 - DNA, 19 bp, Homo sapiens
ccaccacccaacctgtcct

SEQ ID NO: 2983222 - DNA, 20 bp, Homo sapiens
ccaccacccaacctgtcctt

SEQ ID NO: 2983223 - DNA, 18 bp, Homo sapiens
ccaccaccgcccgtctgt

SEQ ID NO: 2983224 - DNA, 22 bp, Homo sapiens
ccaccacctaggccactcctcc

SEQ ID NO: 2983225 - DNA, 14 bp, Homo sapiens
ccaccactataaaa

SEQ ID NO: 2983226 - DNA, 18 bp, Homo sapiens
ccaccagagcaggggctg

SEQ ID NO: 2983227 - DNA, 22 bp, Homo sapiens
ccaccagagcaggggctgctgg

SEQ ID NO: 2983228 - DNA, 14 bp, Homo sapiens
ccaccagagctgcc

SEQ ID NO: 2983229 - DNA, 16 bp, Homo sapiens
ccaccagagctgcctc

SEQ ID NO: 2983230 - DNA, 16 bp, Homo sapiens
ccaccagctctgccgt

SEQ ID NO: 2983231 - DNA, 16 bp, Homo sapiens
ccaccaggagcacctg

SEQ ID NO: 2983232 - DNA, 18 bp, Homo sapiens
ccaccaggagcacctgga

SEQ ID NO: 2983233 - DNA, 20 bp, Homo sapiens
ccaccaggagcacctggacc

SEQ ID NO: 2983234 - DNA, 14 bp, Homo sapiens
ccaccaggatcagc

SEQ ID NO: 2983235 - DNA, 14 bp, Homo sapiens
ccaccaggcctcac

SEQ ID NO: 2983236 - DNA, 17 bp, Homo sapiens
ccaccaggtctcccggg

SEQ ID NO: 2983237 - DNA, 20 bp, Homo sapiens
ccaccaggtgcctttcaaat

SEQ ID NO: 2983238 - DNA, 16 bp, Homo sapiens
ccaccatgcctcacta

SEQ ID NO: 2983239 - DNA, 19 bp, Homo sapiens
ccacccaagagaggaagga

SEQ ID NO: 2983240 - DNA, 22 bp, Homo sapiens
ccacccagcccattctctctcc

SEQ ID NO: 2983241 - DNA, 23 bp, Homo sapiens
ccacccaggaagggagggagctg

SEQ ID NO: 2983242 - DNA, 12 bp, Homo sapiens
ccacccaggtcc

SEQ ID NO: 2983243 - DNA, 13 bp, Homo sapiens
ccacccaggtccc

SEQ ID NO: 2983244 - DNA, 12 bp, Homo sapiens
ccacccagtcca

SEQ ID NO: 2983245 - DNA, 15 bp, Homo sapiens
ccaccccagcacagc

SEQ ID NO: 2983246 - DNA, 13 bp, Homo sapiens
ccaccccccaggc

SEQ ID NO: 2983247 - DNA, 15 bp, Homo sapiens
ccaccccccaggcct

SEQ ID NO: 2983248 - DNA, 21 bp, Homo sapiens
ccacccccgggatcctgcccc

SEQ ID NO: 2983249 - DNA, 22 bp, Homo sapiens
ccaccccgcaccccgcgtgtcc

SEQ ID NO: 2983250 - DNA, 15 bp, Homo sapiens
ccaccccggccccct

SEQ ID NO: 2983251 - DNA, 14 bp, Homo sapiens
ccacccctccccat

SEQ ID NO: 2983252 - DNA, 17 bp, Homo sapiens
ccacccctgggggctct

SEQ ID NO: 2983253 - DNA, 13 bp, Homo sapiens
ccaccccttagat

SEQ ID NO: 2983254 - DNA, 11 bp, Homo sapiens
ccaggaagccg

SEQ ID NO: 2983255 - DNA, 15 bp, Homo sapiens
ccaggaaggcctagg

SEQ ID NO: 2983256 - DNA, 16 bp, Homo sapiens
ccaggaaggcctaggc

SEQ ID NO: 2983257 - DNA, 21 bp, Homo sapiens
ccaggaaggcctaggctagga

SEQ ID NO: 2983258 - DNA, 18 bp, Homo sapiens
ccaggaatttcccaggac

SEQ ID NO: 2983259 - DNA, 20 bp, Homo sapiens
ccaggaatttcccaggaccc

SEQ ID NO: 2983260 - DNA, 23 bp, Homo sapiens
ccaggaatttcccaggaccctga

SEQ ID NO: 2983261 - DNA, 19 bp, Homo sapiens
ccaggaatttgggaccctg

SEQ ID NO: 2983262 - DNA, 20 bp, Homo sapiens
ccaggaatttgggaccctgc

SEQ ID NO: 2983263 - DNA, 23 bp, Homo sapiens
ccaggacacagattatcaactgg

SEQ ID NO: 2983264 - DNA, 15 bp, Homo sapiens
ccaggacaggcccgg

SEQ ID NO: 2983265 - DNA, 15 bp, Homo sapiens
ccaggaccagctcag

SEQ ID NO: 2983266 - DNA, 14 bp, Homo sapiens
ccaggacccaggga

SEQ ID NO: 2983267 - DNA, 15 bp, Homo sapiens
ccaggacccgccagc

SEQ ID NO: 2983268 - DNA, 20 bp, Homo sapiens
ccaggacccgccagccccgc

SEQ ID NO: 2983269 - DNA, 21 bp, Homo sapiens
ccaggacccgccagccccgct

SEQ ID NO: 2983270 - DNA, 14 bp, Homo sapiens
ccaggaccctgaag

SEQ ID NO: 2983271 - DNA, 16 bp, Homo sapiens
ccaggaccctgaaggg

SEQ ID NO: 2983272 - DNA, 18 bp, Homo sapiens
ccaggaccctgaaggggc

SEQ ID NO: 2983273 - DNA, 17 bp, Homo sapiens
ccaggacctggctgcca

SEQ ID NO: 2983274 - DNA, 18 bp, Homo sapiens
ccaggacctggctgccat

SEQ ID NO: 2983275 - DNA, 14 bp, Homo sapiens
ccaggactcctccc

SEQ ID NO: 2983276 - DNA, 17 bp, Homo sapiens
ccaggactcctccccac

SEQ ID NO: 2983277 - DNA, 14 bp, Homo sapiens
ccaggactctgacc

SEQ ID NO: 2983278 - DNA, 14 bp, Homo sapiens
ccaggactgggtct

SEQ ID NO: 2983279 - DNA, 20 bp, Homo sapiens
ccaggagaaggccaattcct

SEQ ID NO: 2983280 - DNA, 16 bp, Homo sapiens
ccaggagaagggctgg

SEQ ID NO: 2983281 - DNA, 19 bp, Homo sapiens
ccaggagaagggctggggc

SEQ ID NO: 2983282 - DNA, 12 bp, Homo sapiens
ccaggagaaggt

SEQ ID NO: 2983283 - DNA, 13 bp, Homo sapiens
ccaggagacaggt

SEQ ID NO: 2983284 - DNA, 20 bp, Homo sapiens
ccaggagagccagccctccc

SEQ ID NO: 2983285 - DNA, 23 bp, Homo sapiens
ccaggagagccagccctccctgt

SEQ ID NO: 2983286 - DNA, 21 bp, Homo sapiens
ccaggagcaacgccagtggca

SEQ ID NO: 2983287 - DNA, 13 bp, Homo sapiens
ccaggagcacctg

SEQ ID NO: 2983288 - DNA, 12 bp, Homo sapiens
ccaggagctctg

SEQ ID NO: 2983289 - DNA, 16 bp, Homo sapiens
ccaggagctctgcgcc

SEQ ID NO: 2983290 - DNA, 18 bp, Homo sapiens
ccaggagctctgcgccag

SEQ ID NO: 2983291 - DNA, 15 bp, Homo sapiens
ccaggagctgtcacc

SEQ ID NO: 2983292 - DNA, 23 bp, Homo sapiens
ccaggaggccctggtcctggcct

SEQ ID NO: 2983293 - DNA, 12 bp, Homo sapiens
ccaggaggcttt

SEQ ID NO: 2983294 - DNA, 22 bp, Homo sapiens
ccaggaggggaacactgccctc

SEQ ID NO: 2983295 - DNA, 17 bp, Homo sapiens
ccaggagtttgaggctg

SEQ ID NO: 2983296 - DNA, 18 bp, Homo sapiens
ccaggagtttgtgtgtct

SEQ ID NO: 2983297 - DNA, 18 bp, Homo sapiens
ccaggatagagactggaa

SEQ ID NO: 2983298 - DNA, 16 bp, Homo sapiens
ccaggatctgctccaa

SEQ ID NO: 2983299 - DNA, 17 bp, Homo sapiens
ccaggatctgctccaac

SEQ ID NO: 2983300 - DNA, 14 bp, Homo sapiens
ccaggattttgtat

SEQ ID NO: 2983301 - DNA, 18 bp, Homo sapiens
ccaggcacgaacccacct

SEQ ID NO: 2983302 - DNA, 20 bp, Homo sapiens
ccaggcacgaacccacctgc

SEQ ID NO: 2983303 - DNA, 13 bp, Homo sapiens
ccaggcagagctg

SEQ ID NO: 2983304 - DNA, 20 bp, Homo sapiens
ccaggcagagctgagggccc

SEQ ID NO: 2983305 - DNA, 15 bp, Homo sapiens
ccaggcagatccagg

SEQ ID NO: 2983306 - DNA, 16 bp, Homo sapiens
ccaggcagatccagga

SEQ ID NO: 2983307 - DNA, 23 bp, Homo sapiens
ccaggcagggccaacccttctcc

SEQ ID NO: 2983308 - DNA, 14 bp, Homo sapiens
ccaggcaggtctgc

SEQ ID NO: 2983309 - DNA, 17 bp, Homo sapiens
ccaggccaacagtagcc

SEQ ID NO: 2983310 - DNA, 13 bp, Homo sapiens
ccaggccagggct

SEQ ID NO: 2983311 - DNA, 14 bp, Homo sapiens
ccaggccagggctc

SEQ ID NO: 2983312 - DNA, 15 bp, Homo sapiens
ccaggccagggctcc

SEQ ID NO: 2983313 - DNA, 17 bp, Homo sapiens
ccaggccagggctcctg

SEQ ID NO: 2983314 - DNA, 15 bp, Homo sapiens
ccaggccagggctgg

SEQ ID NO: 2983315 - DNA, 17 bp, Homo sapiens
ccaggccagggctgggt

SEQ ID NO: 2983316 - DNA, 18 bp, Homo sapiens
ccaggccagggctgggtc

SEQ ID NO: 2983317 - DNA, 19 bp, Homo sapiens
ccaggccatgtggcctgcc

SEQ ID NO: 2983318 - DNA, 21 bp, Homo sapiens
ccaggccatgtggcctgccca

SEQ ID NO: 2983319 - DNA, 23 bp, Homo sapiens
ccaggccatgtggcctgcccagc

SEQ ID NO: 2983320 - DNA, 19 bp, Homo sapiens
ccaggcccaaggctcccgg

SEQ ID NO: 2983321 - DNA, 15 bp, Homo sapiens
ccaggcccactcagg

SEQ ID NO: 2983322 - DNA, 15 bp, Homo sapiens
ccaggccccaggaag

SEQ ID NO: 2983323 - DNA, 16 bp, Homo sapiens
ccaggccccaggaagc

SEQ ID NO: 2983324 - DNA, 17 bp, Homo sapiens
ccaggccccaggaagcc

SEQ ID NO: 2983325 - DNA, 19 bp, Homo sapiens
ccaggcccccaagcctgca

SEQ ID NO: 2983326 - DNA, 20 bp, Homo sapiens
ccaggcccccaagcctgcag

SEQ ID NO: 2983327 - DNA, 23 bp, Homo sapiens
ccaggcccccaccacacatccca

SEQ ID NO: 2983328 - DNA, 16 bp, Homo sapiens
ccaggcccggggctgg

SEQ ID NO: 2983329 - DNA, 20 bp, Homo sapiens
ccaggcccggggctggcggc

SEQ ID NO: 2983330 - DNA, 17 bp, Homo sapiens
ccaggcccgtctgtcca

SEQ ID NO: 2983331 - DNA, 18 bp, Homo sapiens
ccaggcccgtctgtccat

SEQ ID NO: 2983332 - DNA, 20 bp, Homo sapiens
ccaggcccgtctgtccatct

SEQ ID NO: 2983333 - DNA, 23 bp, Homo sapiens
ccaggcccgtctgtccatctgcc

SEQ ID NO: 2983334 - DNA, 15 bp, Homo sapiens
ccaggccctcccacc

SEQ ID NO: 2983335 - DNA, 16 bp, Homo sapiens
ccaggccctcccacca

SEQ ID NO: 2983336 - DNA, 18 bp, Homo sapiens
ccaggccctggagggcag

SEQ ID NO: 2983337 - DNA, 22 bp, Homo sapiens
ccaggccctggagggcagagac

SEQ ID NO: 2983338 - DNA, 13 bp, Homo sapiens
ccaggccggagcc

SEQ ID NO: 2983339 - DNA, 18 bp, Homo sapiens
ccaggccgggcctgtaca

SEQ ID NO: 2983340 - DNA, 20 bp, Homo sapiens
ccaggccggggctggaggga

SEQ ID NO: 2983341 - DNA, 24 bp, Homo sapiens
ccaggcctatgttgatccatccag

SEQ ID NO: 2983342 - DNA, 15 bp, Homo sapiens
ccaggcctcactggc

SEQ ID NO: 2983343 - DNA, 21 bp, Homo sapiens
ccaggcctcactggctcatgc

SEQ ID NO: 2983344 - DNA, 22 bp, Homo sapiens
ccaggcctcactggctcatgcc

SEQ ID NO: 2983345 - DNA, 14 bp, Homo sapiens
ccaggcctccagct

SEQ ID NO: 2983346 - DNA, 13 bp, Homo sapiens
ccaggcctcgcct

SEQ ID NO: 2983347 - DNA, 14 bp, Homo sapiens
ccaggcctcgcctg

SEQ ID NO: 2983348 - DNA, 14 bp, Homo sapiens
ccaggcctgccctg

SEQ ID NO: 2983349 - DNA, 16 bp, Homo sapiens
ccaggcctgccctgct

SEQ ID NO: 2983350 - DNA, 19 bp, Homo sapiens
ccaggcctgccctgctatt

SEQ ID NO: 2983351 - DNA, 12 bp, Homo sapiens
ccaggcctggag

SEQ ID NO: 2983352 - DNA, 16 bp, Homo sapiens
ccaggcctggagcgtt

SEQ ID NO: 2983353 - DNA, 23 bp, Homo sapiens
ccaggcctggcccggctgggccc

SEQ ID NO: 2983354 - DNA, 18 bp, Homo sapiens
ccaggccttgctgactct

SEQ ID NO: 2983355 - DNA, 13 bp, Homo sapiens
ccaggcgagcctg

SEQ ID NO: 2983356 - DNA, 17 bp, Homo sapiens
ccaggcgagcctgactc

SEQ ID NO: 2983357 - DNA, 19 bp, Homo sapiens
ccaggctagagtgcaatgg

SEQ ID NO: 2983358 - DNA, 22 bp, Homo sapiens
ccaggctctcgctgccctgtgg

SEQ ID NO: 2983359 - DNA, 15 bp, Homo sapiens
ccaggctgaccacag

SEQ ID NO: 2983360 - DNA, 21 bp, Homo sapiens
ccaggctgaccacagcacagc

SEQ ID NO: 2983361 - DNA, 16 bp, Homo sapiens
ccaggctggagtacag

SEQ ID NO: 2983362 - DNA, 17 bp, Homo sapiens
ccaggctggagtgcaat

SEQ ID NO: 2983363 - DNA, 18 bp, Homo sapiens
ccaggctggagtgcagtg

SEQ ID NO: 2983364 - DNA, 17 bp, Homo sapiens
ccaggctggccagtgct

SEQ ID NO: 2983365 - DNA, 21 bp, Homo sapiens
ccaggctgggccgcaagggcc

SEQ ID NO: 2983366 - DNA, 15 bp, Homo sapiens
ccaggctgggctcag

SEQ ID NO: 2983367 - DNA, 18 bp, Homo sapiens
ccaggctgggctgagcca

SEQ ID NO: 2983368 - DNA, 17 bp, Homo sapiens
ccaggctggtctaaaac

SEQ ID NO: 2983369 - DNA, 20 bp, Homo sapiens
ccaggctggtctaaaactcc

SEQ ID NO: 2983370 - DNA, 14 bp, Homo sapiens
ccaggctggtctca

SEQ ID NO: 2983371 - DNA, 13 bp, Homo sapiens
ccaggctggtctt

SEQ ID NO: 2983372 - DNA, 23 bp, Homo sapiens
ccaggctgtgtttggctttcagg

SEQ ID NO: 2983373 - DNA, 18 bp, Homo sapiens
ccaggcttctcccggacc

SEQ ID NO: 2983374 - DNA, 15 bp, Homo sapiens
ccaggcttgcctggg

SEQ ID NO: 2983375 - DNA, 16 bp, Homo sapiens
ccaggcttgcctgggc

SEQ ID NO: 2983376 - DNA, 22 bp, Homo sapiens
ccaggcttggatggaacatgcc

SEQ ID NO: 2983377 - DNA, 13 bp, Homo sapiens
ccagggacagagg

SEQ ID NO: 2983378 - DNA, 21 bp, Homo sapiens
ccagggacagaggccccagcc

SEQ ID NO: 2983379 - DNA, 22 bp, Homo sapiens
ccagggacccaaagcaggatga

SEQ ID NO: 2983380 - DNA, 21 bp, Homo sapiens
ccagggaccctggagtatttg

SEQ ID NO: 2983381 - DNA, 23 bp, Homo sapiens
ccagggaccctggagtatttgga

SEQ ID NO: 2983382 - DNA, 18 bp, Homo sapiens
ccagggacgaagaagagc

SEQ ID NO: 2983383 - DNA, 19 bp, Homo sapiens
ccagggacgaagaagagcc

SEQ ID NO: 2983384 - DNA, 20 bp, Homo sapiens
ccagggacgaagaagagcca

SEQ ID NO: 2983385 - DNA, 16 bp, Homo sapiens
ccagggagacctggac

SEQ ID NO: 2983386 - DNA, 12 bp, Homo sapiens
cccacagctccc

SEQ ID NO: 2983387 - DNA, 12 bp, Homo sapiens
cccacaggtgcg

SEQ ID NO: 2983388 - DNA, 19 bp, Homo sapiens
cccacatcccactggatct

SEQ ID NO: 2983389 - DNA, 11 bp, Homo sapiens
cccacatcttt

SEQ ID NO: 2983390 - DNA, 15 bp, Homo sapiens
cccacatgtccagca

SEQ ID NO: 2983391 - DNA, 19 bp, Homo sapiens
cccacatttagtctcttta

SEQ ID NO: 2983392 - DNA, 21 bp, Homo sapiens
cccacatttagtctctttatt

SEQ ID NO: 2983393 - DNA, 22 bp, Homo sapiens
cccacatttgtgccgacactgt

SEQ ID NO: 2983394 - DNA, 21 bp, Homo sapiens
cccaccaacatcccattgccc

SEQ ID NO: 2983395 - DNA, 11 bp, Homo sapiens
cccaccacaca

SEQ ID NO: 2983396 - DNA, 15 bp, Homo sapiens
cccaccacacatccc

SEQ ID NO: 2983397 - DNA, 17 bp, Homo sapiens
cccaccacacatcccag

SEQ ID NO: 2983398 - DNA, 13 bp, Homo sapiens
cccaccaccccat

SEQ ID NO: 2983399 - DNA, 16 bp, Homo sapiens
cccaccacctaggcca

SEQ ID NO: 2983400 - DNA, 22 bp, Homo sapiens
cccaccacctaggccactcctc

SEQ ID NO: 2983401 - DNA, 14 bp, Homo sapiens
cccaccagagctgc

SEQ ID NO: 2983402 - DNA, 23 bp, Homo sapiens
cccaccagagctgcctccccaat

SEQ ID NO: 2983403 - DNA, 12 bp, Homo sapiens
cccaccaggagc

SEQ ID NO: 2983404 - DNA, 21 bp, Homo sapiens
cccaccaggagcacctggacc

SEQ ID NO: 2983405 - DNA, 14 bp, Homo sapiens
cccacccagctcca

SEQ ID NO: 2983406 - DNA, 15 bp, Homo sapiens
cccacccagctccag

SEQ ID NO: 2983407 - DNA, 16 bp, Homo sapiens
cccacccagctccagg

SEQ ID NO: 2983408 - DNA, 12 bp, Homo sapiens
cccacccaggaa

SEQ ID NO: 2983409 - DNA, 13 bp, Homo sapiens
cccacccagtcca

SEQ ID NO: 2983410 - DNA, 12 bp, Homo sapiens
cccaccccagca

SEQ ID NO: 2983411 - DNA, 16 bp, Homo sapiens
cccaccccagcacagc

SEQ ID NO: 2983412 - DNA, 19 bp, Homo sapiens
cccaccccagcacagctcc

SEQ ID NO: 2983413 - DNA, 19 bp, Homo sapiens
cccacccccttcagtgccc

SEQ ID NO: 2983414 - DNA, 23 bp, Homo sapiens
cccacccctaccgatggtcccag

SEQ ID NO: 2983415 - DNA, 11 bp, Homo sapiens
cccacccctgc

SEQ ID NO: 2983416 - DNA, 17 bp, Homo sapiens
cccaccctagcctccac

SEQ ID NO: 2983417 - DNA, 13 bp, Homo sapiens
cccaccctcctgg

SEQ ID NO: 2983418 - DNA, 21 bp, Homo sapiens
cccaccctgtttggattttta

SEQ ID NO: 2983419 - DNA, 22 bp, Homo sapiens
cccaccgccggggtcctgggag

SEQ ID NO: 2983420 - DNA, 23 bp, Homo sapiens
cccaccgccggggtcctgggagg

SEQ ID NO: 2983421 - DNA, 17 bp, Homo sapiens
cccaccgctgagaggct

SEQ ID NO: 2983422 - DNA, 19 bp, Homo sapiens
cccaccgctgagaggctgc

SEQ ID NO: 2983423 - DNA, 14 bp, Homo sapiens
cccacctagtgccc

SEQ ID NO: 2983424 - DNA, 14 bp, Homo sapiens
cccacctcagcctc

SEQ ID NO: 2983425 - DNA, 18 bp, Homo sapiens
cccacctcagcctcccaa

SEQ ID NO: 2983426 - DNA, 14 bp, Homo sapiens
cccacctccctgcc

SEQ ID NO: 2983427 - DNA, 16 bp, Homo sapiens
cccacctgaaagcctg

SEQ ID NO: 2983428 - DNA, 12 bp, Homo sapiens
cccacctgcctg

SEQ ID NO: 2983429 - DNA, 13 bp, Homo sapiens
cccacctgcctgg

SEQ ID NO: 2983430 - DNA, 17 bp, Homo sapiens
cccacctgcctggccgg

SEQ ID NO: 2983431 - DNA, 18 bp, Homo sapiens
cccacctgcctggccggc

SEQ ID NO: 2983432 - DNA, 19 bp, Homo sapiens
cccacctgctgagagaccc

SEQ ID NO: 2983433 - DNA, 22 bp, Homo sapiens
cccacctggccccctcagctct

SEQ ID NO: 2983434 - DNA, 12 bp, Homo sapiens
cccacctgggct

SEQ ID NO: 2983435 - DNA, 23 bp, Homo sapiens
cccacctgtcaaacaaagccaga

SEQ ID NO: 2983436 - DNA, 13 bp, Homo sapiens
cccacgacaaaaa

SEQ ID NO: 2983437 - DNA, 16 bp, Homo sapiens
cccacgacccctgcct

SEQ ID NO: 2983438 - DNA, 23 bp, Homo sapiens
cccacgacccctgcctcgagggc

SEQ ID NO: 2983439 - DNA, 19 bp, Homo sapiens
cccacgatggaatgtaaaa

SEQ ID NO: 2983440 - DNA, 14 bp, Homo sapiens
cccacgccttatcc

SEQ ID NO: 2983441 - DNA, 15 bp, Homo sapiens
cccacggctcctcga

SEQ ID NO: 2983442 - DNA, 16 bp, Homo sapiens
cccacgtctctctgcc

SEQ ID NO: 2983443 - DNA, 17 bp, Homo sapiens
cccacgtctctctgcct

SEQ ID NO: 2983444 - DNA, 23 bp, Homo sapiens
cccacgtctctctgcctgctggg

SEQ ID NO: 2983445 - DNA, 16 bp, Homo sapiens
cccacgtggagacagc

SEQ ID NO: 2983446 - DNA, 18 bp, Homo sapiens
cccactagcctaggtcat

SEQ ID NO: 2983447 - DNA, 19 bp, Homo sapiens
cccactcaagccaagcagc

SEQ ID NO: 2983448 - DNA, 20 bp, Homo sapiens
cccactcaagccaagcagcc

SEQ ID NO: 2983449 - DNA, 23 bp, Homo sapiens
cccactcaagccaagcagccaag

SEQ ID NO: 2983450 - DNA, 19 bp, Homo sapiens
cccactcacctttctccac

SEQ ID NO: 2983451 - DNA, 19 bp, Homo sapiens
cccactctcattccccagg

SEQ ID NO: 2983452 - DNA, 23 bp, Homo sapiens
cccactgaattgacatgaccctc

SEQ ID NO: 2983453 - DNA, 14 bp, Homo sapiens
cccactgcactcca

SEQ ID NO: 2983454 - DNA, 15 bp, Homo sapiens
cccactgcactccag

SEQ ID NO: 2983455 - DNA, 17 bp, Homo sapiens
cccactgcactccagcc

SEQ ID NO: 2983456 - DNA, 15 bp, Homo sapiens
cccactgcaggcccc

SEQ ID NO: 2983457 - DNA, 22 bp, Homo sapiens
cccactgccaggggttcttgag

SEQ ID NO: 2983458 - DNA, 18 bp, Homo sapiens
cccactgcctcctccctg

SEQ ID NO: 2983459 - DNA, 24 bp, Homo sapiens
cccactgcctcctccctggctgca

SEQ ID NO: 2983460 - DNA, 15 bp, Homo sapiens
cccactgctggctgc

SEQ ID NO: 2983461 - DNA, 19 bp, Homo sapiens
cccactgtatctaggcaac

SEQ ID NO: 2983462 - DNA, 12 bp, Homo sapiens
cccactgtatga

SEQ ID NO: 2983463 - DNA, 15 bp, Homo sapiens
cccactgtcctgggc

SEQ ID NO: 2983464 - DNA, 21 bp, Homo sapiens
cccacttctcatcacacacat

SEQ ID NO: 2983465 - DNA, 22 bp, Homo sapiens
cccacttctcatcacacacatg

SEQ ID NO: 2983466 - DNA, 17 bp, Homo sapiens
cccagaactttgggagg

SEQ ID NO: 2983467 - DNA, 19 bp, Homo sapiens
cccagacaaggagagcgga

SEQ ID NO: 2983468 - DNA, 16 bp, Homo sapiens
cccagacactggtttg

SEQ ID NO: 2983469 - DNA, 16 bp, Homo sapiens
cccagacagctgctca

SEQ ID NO: 2983470 - DNA, 14 bp, Homo sapiens
cccagaccgctggc

SEQ ID NO: 2983471 - DNA, 13 bp, Homo sapiens
cccagaccggctt

SEQ ID NO: 2983472 - DNA, 22 bp, Homo sapiens
cccagacctgttagcagacagg

SEQ ID NO: 2983473 - DNA, 21 bp, Homo sapiens
cccagacggctccactaggac

SEQ ID NO: 2983474 - DNA, 12 bp, Homo sapiens
cccagactcaga

SEQ ID NO: 2983475 - DNA, 16 bp, Homo sapiens
cccagactcagacatt

SEQ ID NO: 2983476 - DNA, 20 bp, Homo sapiens
cccagactcagacattggca

SEQ ID NO: 2983477 - DNA, 14 bp, Homo sapiens
cccagactgagctc

SEQ ID NO: 2983478 - DNA, 17 bp, Homo sapiens
cccagactgagctctcc

SEQ ID NO: 2983479 - DNA, 19 bp, Homo sapiens
cccagactgagctctccag

SEQ ID NO: 2983480 - DNA, 20 bp, Homo sapiens
cccagactgagctctccagg

SEQ ID NO: 2983481 - DNA, 23 bp, Homo sapiens
cccagactgagctctccaggcca

SEQ ID NO: 2983482 - DNA, 19 bp, Homo sapiens
cccagactgggcccaggca

SEQ ID NO: 2983483 - DNA, 20 bp, Homo sapiens
cccagactgggcccaggcag

SEQ ID NO: 2983484 - DNA, 17 bp, Homo sapiens
cccagacttgcactggg

SEQ ID NO: 2983485 - DNA, 16 bp, Homo sapiens
cccagacttgtttcct

SEQ ID NO: 2983486 - DNA, 18 bp, Homo sapiens
cccagagacatacttgaa

SEQ ID NO: 2983487 - DNA, 19 bp, Homo sapiens
cccagagaggaatcagact

SEQ ID NO: 2983488 - DNA, 21 bp, Homo sapiens
cccagagaggaatcagacttc

SEQ ID NO: 2983489 - DNA, 16 bp, Homo sapiens
cccagagatgcctcca

SEQ ID NO: 2983490 - DNA, 17 bp, Homo sapiens
cccagagatgcctccac

SEQ ID NO: 2983491 - DNA, 20 bp, Homo sapiens
cccagagatgcctccaccgc

SEQ ID NO: 2983492 - DNA, 13 bp, Homo sapiens
cccagagccacac

SEQ ID NO: 2983493 - DNA, 15 bp, Homo sapiens
cccagagccacacat

SEQ ID NO: 2983494 - DNA, 17 bp, Homo sapiens
cccagagccacacatgg

SEQ ID NO: 2983495 - DNA, 13 bp, Homo sapiens
cccagagcccagc

SEQ ID NO: 2983496 - DNA, 21 bp, Homo sapiens
cccagaggaaggggccagagg

SEQ ID NO: 2983497 - DNA, 22 bp, Homo sapiens
cccagaggaaggggccagaggc

SEQ ID NO: 2983498 - DNA, 17 bp, Homo sapiens
cccagaggagcccagcg

SEQ ID NO: 2983499 - DNA, 16 bp, Homo sapiens
cccagaggattgctgc

SEQ ID NO: 2983500 - DNA, 22 bp, Homo sapiens
cccagaggcgtcccgcacctgt

SEQ ID NO: 2983501 - DNA, 20 bp, Homo sapiens
cccagatacgggggctgtga

SEQ ID NO: 2983502 - DNA, 20 bp, Homo sapiens
cccagatcatgttttggtga

SEQ ID NO: 2983503 - DNA, 21 bp, Homo sapiens
cccagatgttttacgtctggg

SEQ ID NO: 2983504 - DNA, 23 bp, Homo sapiens
cccagcaatcgcatcccggctga

SEQ ID NO: 2983505 - DNA, 15 bp, Homo sapiens
cccagcacagctcct

SEQ ID NO: 2983506 - DNA, 18 bp, Homo sapiens
cccagcaccaccaggtct

SEQ ID NO: 2983507 - DNA, 15 bp, Homo sapiens
cccagcactttggga

SEQ ID NO: 2983508 - DNA, 22 bp, Homo sapiens
cccagcactttgggaggcaggg

SEQ ID NO: 2983509 - DNA, 21 bp, Homo sapiens
cccagcagaatggaggcaggg

SEQ ID NO: 2983510 - DNA, 19 bp, Homo sapiens
cccagcagatctcatgtcc

SEQ ID NO: 2983511 - DNA, 15 bp, Homo sapiens
cccagcagcctgcca

SEQ ID NO: 2983512 - DNA, 16 bp, Homo sapiens
cccagcagcctgccag

SEQ ID NO: 2983513 - DNA, 18 bp, Homo sapiens
cccagcagcctgccagca

SEQ ID NO: 2983514 - DNA, 16 bp, Homo sapiens
cccagcattctcaggc

SEQ ID NO: 2983515 - DNA, 20 bp, Homo sapiens
cccagcatttcccgaaggcc

SEQ ID NO: 2983516 - DNA, 10 bp, Homo sapiens
cccagccaca

SEQ ID NO: 2983517 - DNA, 16 bp, Homo sapiens
cccagccacaggccaa

SEQ ID NO: 2983518 - DNA, 15 bp, Homo sapiens
cctcctcccagtgcc

SEQ ID NO: 2983519 - DNA, 18 bp, Homo sapiens
cctcctccctcctcactc

SEQ ID NO: 2983520 - DNA, 13 bp, Homo sapiens
cctcctccctgca

SEQ ID NO: 2983521 - DNA, 14 bp, Homo sapiens
cctcctccctgcat

SEQ ID NO: 2983522 - DNA, 16 bp, Homo sapiens
cctcctccctgcatct

SEQ ID NO: 2983523 - DNA, 14 bp, Homo sapiens
cctcctccctggct

SEQ ID NO: 2983524 - DNA, 16 bp, Homo sapiens
cctcctccctggctgc

SEQ ID NO: 2983525 - DNA, 17 bp, Homo sapiens
cctcctccctggctgca

SEQ ID NO: 2983526 - DNA, 12 bp, Homo sapiens
cctcctcctcat

SEQ ID NO: 2983527 - DNA, 13 bp, Homo sapiens
cctcctcctcatt

SEQ ID NO: 2983528 - DNA, 13 bp, Homo sapiens
cctcctcctgggc

SEQ ID NO: 2983529 - DNA, 12 bp, Homo sapiens
cctcctctccat

SEQ ID NO: 2983530 - DNA, 13 bp, Homo sapiens
cctcctctccatg

SEQ ID NO: 2983531 - DNA, 22 bp, Homo sapiens
cctcctctccatgcaagtgctg

SEQ ID NO: 2983532 - DNA, 15 bp, Homo sapiens
cctcctctctccctg

SEQ ID NO: 2983533 - DNA, 14 bp, Homo sapiens
cctcctctgccacc

SEQ ID NO: 2983534 - DNA, 15 bp, Homo sapiens
cctcctctgccacct

SEQ ID NO: 2983535 - DNA, 23 bp, Homo sapiens
cctcctgacaacgtctcttcaag

SEQ ID NO: 2983536 - DNA, 12 bp, Homo sapiens
cctcctgagaaa

SEQ ID NO: 2983537 - DNA, 15 bp, Homo sapiens
cctcctgcccaggag

SEQ ID NO: 2983538 - DNA, 19 bp, Homo sapiens
cctcctgcccaggagagcc

SEQ ID NO: 2983539 - DNA, 21 bp, Homo sapiens
cctcctgcccaggagagccag

SEQ ID NO: 2983540 - DNA, 23 bp, Homo sapiens
cctcctgcccaggagagccagcc

SEQ ID NO: 2983541 - DNA, 13 bp, Homo sapiens
cctcctggagcag

SEQ ID NO: 2983542 - DNA, 14 bp, Homo sapiens
cctcctggagcaga

SEQ ID NO: 2983543 - DNA, 20 bp, Homo sapiens
cctcctggagctctgtgggt

SEQ ID NO: 2983544 - DNA, 15 bp, Homo sapiens
cctcctggcccaggt

SEQ ID NO: 2983545 - DNA, 15 bp, Homo sapiens
cctcctggcctcaga

SEQ ID NO: 2983546 - DNA, 10 bp, Homo sapiens
cctcctgggg

SEQ ID NO: 2983547 - DNA, 12 bp, Homo sapiens
cctcctggggcc

SEQ ID NO: 2983548 - DNA, 13 bp, Homo sapiens
cctcctggggcca

SEQ ID NO: 2983549 - DNA, 16 bp, Homo sapiens
cctcctggggccaggc

SEQ ID NO: 2983550 - DNA, 17 bp, Homo sapiens
cctcctgggttcaagca

SEQ ID NO: 2983551 - DNA, 20 bp, Homo sapiens
cctcctgggttcacatgatt

SEQ ID NO: 2983552 - DNA, 19 bp, Homo sapiens
cctcctggtaacagctatg

SEQ ID NO: 2983553 - DNA, 20 bp, Homo sapiens
cctcctgttacttgcttctg

SEQ ID NO: 2983554 - DNA, 18 bp, Homo sapiens
cctccttgggcagggtct

SEQ ID NO: 2983555 - DNA, 19 bp, Homo sapiens
cctcctttcatcacactgg

SEQ ID NO: 2983556 - DNA, 13 bp, Homo sapiens
cctcctttgtctt

SEQ ID NO: 2983557 - DNA, 22 bp, Homo sapiens
cctcgaattttatctgtggagt

SEQ ID NO: 2983558 - DNA, 15 bp, Homo sapiens
cctcgaccctgtgca

SEQ ID NO: 2983559 - DNA, 17 bp, Homo sapiens
cctcgagggccgcctgc

SEQ ID NO: 2983560 - DNA, 19 bp, Homo sapiens
cctcgagggccgcctgcct

SEQ ID NO: 2983561 - DNA, 16 bp, Homo sapiens
cctcgaggtgccttct

SEQ ID NO: 2983562 - DNA, 18 bp, Homo sapiens
cctcgaggtgccttcttc

SEQ ID NO: 2983563 - DNA, 18 bp, Homo sapiens
cctcgagtactgtgggca

SEQ ID NO: 2983564 - DNA, 18 bp, Homo sapiens
cctcgcacggccccgaag

SEQ ID NO: 2983565 - DNA, 20 bp, Homo sapiens
cctcgcccaggccggggctg

SEQ ID NO: 2983566 - DNA, 20 bp, Homo sapiens
cctcgcccatcagtgccagc

SEQ ID NO: 2983567 - DNA, 14 bp, Homo sapiens
cctcgcctcctact

SEQ ID NO: 2983568 - DNA, 19 bp, Homo sapiens
cctcgcctgccctcctctc

SEQ ID NO: 2983569 - DNA, 15 bp, Homo sapiens
cctcgctctgttacc

SEQ ID NO: 2983570 - DNA, 14 bp, Homo sapiens
cctcgctgccagct

SEQ ID NO: 2983571 - DNA, 20 bp, Homo sapiens
cctcgctgccagctctgtat

SEQ ID NO: 2983572 - DNA, 17 bp, Homo sapiens
cctcgctggactctcag

SEQ ID NO: 2983573 - DNA, 12 bp, Homo sapiens
cctcgcttggac

SEQ ID NO: 2983574 - DNA, 16 bp, Homo sapiens
cctcggacacccaggg

SEQ ID NO: 2983575 - DNA, 19 bp, Homo sapiens
cctcggacacccagggtct

SEQ ID NO: 2983576 - DNA, 15 bp, Homo sapiens
cctcggaggctcctc

SEQ ID NO: 2983577 - DNA, 19 bp, Homo sapiens
cctcggaggctcctccctc

SEQ ID NO: 2983578 - DNA, 20 bp, Homo sapiens
cctcggaggctcctccctct

SEQ ID NO: 2983579 - DNA, 15 bp, Homo sapiens
cctcggatcaccgag

SEQ ID NO: 2983580 - DNA, 21 bp, Homo sapiens
cctcggatgaccatactcaga

SEQ ID NO: 2983581 - DNA, 14 bp, Homo sapiens
cctcggcagaactc

SEQ ID NO: 2983582 - DNA, 19 bp, Homo sapiens
cctcggcagaactctctgt

SEQ ID NO: 2983583 - DNA, 20 bp, Homo sapiens
cctcggcagaactctctgtc

SEQ ID NO: 2983584 - DNA, 18 bp, Homo sapiens
cctcggcccatctgtcca

SEQ ID NO: 2983585 - DNA, 18 bp, Homo sapiens
cctcggcccctcccacac

SEQ ID NO: 2983586 - DNA, 16 bp, Homo sapiens
cctcggccctccctgc

SEQ ID NO: 2983587 - DNA, 21 bp, Homo sapiens
cctcgggattggcgggtccac

SEQ ID NO: 2983588 - DNA, 16 bp, Homo sapiens
cctcgggggcctgtgg

SEQ ID NO: 2983589 - DNA, 17 bp, Homo sapiens
cctcgggggcctgtggt

SEQ ID NO: 2983590 - DNA, 15 bp, Homo sapiens
cctcggtggccctga

SEQ ID NO: 2983591 - DNA, 24 bp, Homo sapiens
cctcggtttcccatttgttgctgc

SEQ ID NO: 2983592 - DNA, 16 bp, Homo sapiens
cctcgtcctccccctg

SEQ ID NO: 2983593 - DNA, 17 bp, Homo sapiens
cctcgtcctccccctgc

SEQ ID NO: 2983594 - DNA, 21 bp, Homo sapiens
cctcgtcctccccctgccagt

SEQ ID NO: 2983595 - DNA, 14 bp, Homo sapiens
cctcgtgccagcag

SEQ ID NO: 2983596 - DNA, 15 bp, Homo sapiens
cctcgtttgatagtg

SEQ ID NO: 2983597 - DNA, 20 bp, Homo sapiens
cctctaactccctcctcaca

SEQ ID NO: 2983598 - DNA, 21 bp, Homo sapiens
cctctacagagcttccctgac

SEQ ID NO: 2983599 - DNA, 24 bp, Homo sapiens
cctctacagagcttccctgactca

SEQ ID NO: 2983600 - DNA, 18 bp, Homo sapiens
cctctacatggactcaga

SEQ ID NO: 2983601 - DNA, 13 bp, Homo sapiens
cctctacctctct

SEQ ID NO: 2983602 - DNA, 14 bp, Homo sapiens
cctctacctctctc

SEQ ID NO: 2983603 - DNA, 18 bp, Homo sapiens
cctctactttgattctga

SEQ ID NO: 2983604 - DNA, 17 bp, Homo sapiens
cctctagagaaaagatg

SEQ ID NO: 2983605 - DNA, 21 bp, Homo sapiens
cctctatttatgtttgcactt

SEQ ID NO: 2983606 - DNA, 14 bp, Homo sapiens
cctctatttcttta

SEQ ID NO: 2983607 - DNA, 17 bp, Homo sapiens
cctctcaactgcctcag

SEQ ID NO: 2983608 - DNA, 14 bp, Homo sapiens
cctctcacctcagc

SEQ ID NO: 2983609 - DNA, 16 bp, Homo sapiens
cctctcacctcagcct

SEQ ID NO: 2983610 - DNA, 15 bp, Homo sapiens
cctctcacgccaccc

SEQ ID NO: 2983611 - DNA, 12 bp, Homo sapiens
cctctcactgtc

SEQ ID NO: 2983612 - DNA, 13 bp, Homo sapiens
cctctcactgtct

SEQ ID NO: 2983613 - DNA, 14 bp, Homo sapiens
cctctcactgtctg

SEQ ID NO: 2983614 - DNA, 15 bp, Homo sapiens
cctctcaggagccat

SEQ ID NO: 2983615 - DNA, 15 bp, Homo sapiens
cctctcaggatccaa

SEQ ID NO: 2983616 - DNA, 13 bp, Homo sapiens
cctctcagtgcct

SEQ ID NO: 2983617 - DNA, 19 bp, Homo sapiens
cctctcagtgccttctctc

SEQ ID NO: 2983618 - DNA, 20 bp, Homo sapiens
cctctcagtgccttctctca

SEQ ID NO: 2983619 - DNA, 16 bp, Homo sapiens
cctctccatcttcagc

SEQ ID NO: 2983620 - DNA, 13 bp, Homo sapiens
cctctccatgcaa

SEQ ID NO: 2983621 - DNA, 19 bp, Homo sapiens
cctctcccattgtccctct

SEQ ID NO: 2983622 - DNA, 19 bp, Homo sapiens
cctctccccagcccagaga

SEQ ID NO: 2983623 - DNA, 20 bp, Homo sapiens
cctctccccagcccagagac

SEQ ID NO: 2983624 - DNA, 21 bp, Homo sapiens
cctctccccagcccagagaca

SEQ ID NO: 2983625 - DNA, 15 bp, Homo sapiens
cctctccctgaccct

SEQ ID NO: 2983626 - DNA, 17 bp, Homo sapiens
cctctcccttcccttcc

SEQ ID NO: 2983627 - DNA, 23 bp, Homo sapiens
cctctccgcacacctctggctgt

SEQ ID NO: 2983628 - DNA, 13 bp, Homo sapiens
cctctcctccgtg

SEQ ID NO: 2983629 - DNA, 21 bp, Homo sapiens
cctctcctcggacacccaggg

SEQ ID NO: 2983630 - DNA, 16 bp, Homo sapiens
cctctcctgcctactc

SEQ ID NO: 2983631 - DNA, 13 bp, Homo sapiens
cctctccttcctg

SEQ ID NO: 2983632 - DNA, 14 bp, Homo sapiens
cctctccttccttg

SEQ ID NO: 2983633 - DNA, 15 bp, Homo sapiens
cctctccttccttgt

SEQ ID NO: 2983634 - DNA, 22 bp, Homo sapiens
cctctcctttgtatattatttc

SEQ ID NO: 2983635 - DNA, 19 bp, Homo sapiens
cctctcggccccatcgccc

SEQ ID NO: 2983636 - DNA, 17 bp, Homo sapiens
cctctcggttgaaacct

SEQ ID NO: 2983637 - DNA, 15 bp, Homo sapiens
cctctctcagcccca

SEQ ID NO: 2983638 - DNA, 18 bp, Homo sapiens
cctctctcaggagcaggg

SEQ ID NO: 2983639 - DNA, 18 bp, Homo sapiens
cctctctcatatcactga

SEQ ID NO: 2983640 - DNA, 20 bp, Homo sapiens
cctctctcccaccctaaggg

SEQ ID NO: 2983641 - DNA, 14 bp, Homo sapiens
cctctctccctgcc

SEQ ID NO: 2983642 - DNA, 19 bp, Homo sapiens
cctctctccctgcctcaca

SEQ ID NO: 2983643 - DNA, 17 bp, Homo sapiens
cctctctcctggactgg

SEQ ID NO: 2983644 - DNA, 18 bp, Homo sapiens
cctctctcctggactggt

SEQ ID NO: 2983645 - DNA, 16 bp, Homo sapiens
cctctctcggccccct

SEQ ID NO: 2983646 - DNA, 10 bp, Homo sapiens
cctctctctc

SEQ ID NO: 2983647 - DNA, 11 bp, Homo sapiens
cctctctctcc

SEQ ID NO: 2983648 - DNA, 12 bp, Homo sapiens
cctctctgctct

SEQ ID NO: 2983649 - DNA, 16 bp, Homo sapiens
cctctctgggcctcag

SEQ ID NO: 2983650 - DNA, 17 bp, Homo sapiens
cctctctgtctgtctct

SEQ ID NO: 2983651 - DNA, 18 bp, Homo sapiens
cctctctgtctgtctctc

SEQ ID NO: 2983652 - DNA, 19 bp, Homo sapiens
cctggccgttcagcctgtc

SEQ ID NO: 2983653 - DNA, 18 bp, Homo sapiens
cctggcctcaagccatct

SEQ ID NO: 2983654 - DNA, 23 bp, Homo sapiens
cctggcctcaagccatcttcccg

SEQ ID NO: 2983655 - DNA, 20 bp, Homo sapiens
cctggcctcagactgcaccc

SEQ ID NO: 2983656 - DNA, 16 bp, Homo sapiens
cctggcctccaggccc

SEQ ID NO: 2983657 - DNA, 18 bp, Homo sapiens
cctggcctccaggcccgt

SEQ ID NO: 2983658 - DNA, 13 bp, Homo sapiens
cctggcctctgtg

SEQ ID NO: 2983659 - DNA, 13 bp, Homo sapiens
cctggcctggcac

SEQ ID NO: 2983660 - DNA, 19 bp, Homo sapiens
cctggcctggcacacatca

SEQ ID NO: 2983661 - DNA, 15 bp, Homo sapiens
cctggcctggtccct

SEQ ID NO: 2983662 - DNA, 21 bp, Homo sapiens
cctggcctggtccctggtcct

SEQ ID NO: 2983663 - DNA, 23 bp, Homo sapiens
cctggccttgcccgtcgtgtgct

SEQ ID NO: 2983664 - DNA, 21 bp, Homo sapiens
cctggccttgtcctcagccag

SEQ ID NO: 2983665 - DNA, 22 bp, Homo sapiens
cctggctccccgagggctcaga

SEQ ID NO: 2983666 - DNA, 20 bp, Homo sapiens
cctggctctgaccgaaacag

SEQ ID NO: 2983667 - DNA, 23 bp, Homo sapiens
cctggctctgattcttcattctg

SEQ ID NO: 2983668 - DNA, 19 bp, Homo sapiens
cctggctgaacagtgctct

SEQ ID NO: 2983669 - DNA, 15 bp, Homo sapiens
cctggctgcagcctc

SEQ ID NO: 2983670 - DNA, 16 bp, Homo sapiens
cctggctgcagcctcc

SEQ ID NO: 2983671 - DNA, 21 bp, Homo sapiens
cctggctggagaatgtggaga

SEQ ID NO: 2983672 - DNA, 23 bp, Homo sapiens
cctggctggctgggatgctggtg

SEQ ID NO: 2983673 - DNA, 21 bp, Homo sapiens
cctggctgggacgtggctcag

SEQ ID NO: 2983674 - DNA, 22 bp, Homo sapiens
cctggctgggacgtggctcagc

SEQ ID NO: 2983675 - DNA, 18 bp, Homo sapiens
cctggcttcactctccct

SEQ ID NO: 2983676 - DNA, 17 bp, Homo sapiens
cctgggaaatattccct

SEQ ID NO: 2983677 - DNA, 18 bp, Homo sapiens
cctgggaaatattcccta

SEQ ID NO: 2983678 - DNA, 14 bp, Homo sapiens
cctgggaagtggag

SEQ ID NO: 2983679 - DNA, 22 bp, Homo sapiens
cctgggacactgcgggacagag

SEQ ID NO: 2983680 - DNA, 21 bp, Homo sapiens
cctgggacatcaggagactgg

SEQ ID NO: 2983681 - DNA, 11 bp, Homo sapiens
cctgggagaga

SEQ ID NO: 2983682 - DNA, 22 bp, Homo sapiens
cctgggagagacttggatgagg

SEQ ID NO: 2983683 - DNA, 12 bp, Homo sapiens
cctgggaggctg

SEQ ID NO: 2983684 - DNA, 15 bp, Homo sapiens
cctgggaggctgcag

SEQ ID NO: 2983685 - DNA, 18 bp, Homo sapiens
cctgggaggctgcagcca

SEQ ID NO: 2983686 - DNA, 19 bp, Homo sapiens
cctgggaggctgcagccag

SEQ ID NO: 2983687 - DNA, 21 bp, Homo sapiens
cctgggaggctgcagccaggc

SEQ ID NO: 2983688 - DNA, 12 bp, Homo sapiens
cctgggcaggag

SEQ ID NO: 2983689 - DNA, 14 bp, Homo sapiens
cctgggcaggaggg

SEQ ID NO: 2983690 - DNA, 12 bp, Homo sapiens
cctgggcagtgc

SEQ ID NO: 2983691 - DNA, 14 bp, Homo sapiens
cctgggcagtgccc

SEQ ID NO: 2983692 - DNA, 16 bp, Homo sapiens
cctgggcagtgcccac

SEQ ID NO: 2983693 - DNA, 14 bp, Homo sapiens
cctgggcattgctt

SEQ ID NO: 2983694 - DNA, 16 bp, Homo sapiens
cctgggcattgctttc

SEQ ID NO: 2983695 - DNA, 14 bp, Homo sapiens
cctgggccccacca

SEQ ID NO: 2983696 - DNA, 13 bp, Homo sapiens
cctgggcccctcc

SEQ ID NO: 2983697 - DNA, 18 bp, Homo sapiens
cctgggcccctcccctca

SEQ ID NO: 2983698 - DNA, 21 bp, Homo sapiens
cctgggcccctcccctcagag

SEQ ID NO: 2983699 - DNA, 11 bp, Homo sapiens
cctgggccctc

SEQ ID NO: 2983700 - DNA, 21 bp, Homo sapiens
cctgggccgcgtgccgggccc

SEQ ID NO: 2983701 - DNA, 12 bp, Homo sapiens
cctgggcctgca

SEQ ID NO: 2983702 - DNA, 13 bp, Homo sapiens
cctgggcctggag

SEQ ID NO: 2983703 - DNA, 22 bp, Homo sapiens
cctgggctgagagaacctcacg

SEQ ID NO: 2983704 - DNA, 17 bp, Homo sapiens
cctgggctgggcagcct

SEQ ID NO: 2983705 - DNA, 14 bp, Homo sapiens
cctgggctgggcgc

SEQ ID NO: 2983706 - DNA, 13 bp, Homo sapiens
cctggggacccac

SEQ ID NO: 2983707 - DNA, 21 bp, Homo sapiens
cctggggagaaagaggggcct

SEQ ID NO: 2983708 - DNA, 19 bp, Homo sapiens
cctggggcaaacctagccg

SEQ ID NO: 2983709 - DNA, 14 bp, Homo sapiens
cctggggcactccc

SEQ ID NO: 2983710 - DNA, 17 bp, Homo sapiens
cctggggcactccccca

SEQ ID NO: 2983711 - DNA, 15 bp, Homo sapiens
cctggggccaggccg

SEQ ID NO: 2983712 - DNA, 18 bp, Homo sapiens
cctggggcctgggccccg

SEQ ID NO: 2983713 - DNA, 22 bp, Homo sapiens
cctggggctaggctggagccca

SEQ ID NO: 2983714 - DNA, 17 bp, Homo sapiens
cctggggctggcctccc

SEQ ID NO: 2983715 - DNA, 14 bp, Homo sapiens
cctggggctggctt

SEQ ID NO: 2983716 - DNA, 14 bp, Homo sapiens
cctggggctggtgg

SEQ ID NO: 2983717 - DNA, 17 bp, Homo sapiens
cctgggggaagccctgg

SEQ ID NO: 2983718 - DNA, 19 bp, Homo sapiens
cctgggggaagccctggat

SEQ ID NO: 2983719 - DNA, 19 bp, Homo sapiens
cctgggggacccctggctc

SEQ ID NO: 2983720 - DNA, 17 bp, Homo sapiens
cctgggggagccgacca

SEQ ID NO: 2983721 - DNA, 23 bp, Homo sapiens
cctgggggcacaggaggcaggca

SEQ ID NO: 2983722 - DNA, 14 bp, Homo sapiens
cctgggggctctca

SEQ ID NO: 2983723 - DNA, 16 bp, Homo sapiens
cctgggggtgccagga

SEQ ID NO: 2983724 - DNA, 14 bp, Homo sapiens
cctggggtctggag

SEQ ID NO: 2983725 - DNA, 21 bp, Homo sapiens
cctggggtggggatagggagc

SEQ ID NO: 2983726 - DNA, 15 bp, Homo sapiens
cctggggtggggtca

SEQ ID NO: 2983727 - DNA, 21 bp, Homo sapiens
cctggggtgttagtggcaccg

SEQ ID NO: 2983728 - DNA, 15 bp, Homo sapiens
cctgggtaggcccca

SEQ ID NO: 2983729 - DNA, 18 bp, Homo sapiens
cctgggtaggccccacaa

SEQ ID NO: 2983730 - DNA, 14 bp, Homo sapiens
cctgggtcctgcct

SEQ ID NO: 2983731 - DNA, 15 bp, Homo sapiens
cctgggtcctgcctg

SEQ ID NO: 2983732 - DNA, 16 bp, Homo sapiens
cctgggtgacagagtg

SEQ ID NO: 2983733 - DNA, 18 bp, Homo sapiens
cctgggtgacagagtgag

SEQ ID NO: 2983734 - DNA, 16 bp, Homo sapiens
cctgggtgacttcagg

SEQ ID NO: 2983735 - DNA, 23 bp, Homo sapiens
cctgggtggggctgctcctccag

SEQ ID NO: 2983736 - DNA, 19 bp, Homo sapiens
cctgggtggtctgcaggca

SEQ ID NO: 2983737 - DNA, 20 bp, Homo sapiens
cctgggtggtctgcaggcag

SEQ ID NO: 2983738 - DNA, 20 bp, Homo sapiens
cctgggtgtccccgctgctg

SEQ ID NO: 2983739 - DNA, 14 bp, Homo sapiens
cctgggtttggccc

SEQ ID NO: 2983740 - DNA, 23 bp, Homo sapiens
cctgggttttgtattctctgagc

SEQ ID NO: 2983741 - DNA, 17 bp, Homo sapiens
cctggtaagcagaggct

SEQ ID NO: 2983742 - DNA, 21 bp, Homo sapiens
cctggtacaaacgtatggaat

SEQ ID NO: 2983743 - DNA, 15 bp, Homo sapiens
cctggtactcaagcc

SEQ ID NO: 2983744 - DNA, 16 bp, Homo sapiens
cctggtactcaagccc

SEQ ID NO: 2983745 - DNA, 19 bp, Homo sapiens
cctggtactcaagcccgcg

SEQ ID NO: 2983746 - DNA, 17 bp, Homo sapiens
cctggtccacagggcac

SEQ ID NO: 2983747 - DNA, 16 bp, Homo sapiens
cctggtccctgggagg

SEQ ID NO: 2983748 - DNA, 13 bp, Homo sapiens
cctggtccctggt

SEQ ID NO: 2983749 - DNA, 21 bp, Homo sapiens
cctggtcctccgcctactgtc

SEQ ID NO: 2983750 - DNA, 23 bp, Homo sapiens
cctggtcctggcctccttccccg

SEQ ID NO: 2983751 - DNA, 14 bp, Homo sapiens
cctggtcctggctg

SEQ ID NO: 2983752 - DNA, 16 bp, Homo sapiens
cctggtcctggctgca

SEQ ID NO: 2983753 - DNA, 19 bp, Homo sapiens
cctggtcctggctgcactc

SEQ ID NO: 2983754 - DNA, 23 bp, Homo sapiens
cctggtctgctcaggaattgaag

SEQ ID NO: 2983755 - DNA, 12 bp, Homo sapiens
cctggtctggga

SEQ ID NO: 2983756 - DNA, 15 bp, Homo sapiens
cctggtgctcctgcc

SEQ ID NO: 2983757 - DNA, 21 bp, Homo sapiens
cctggtgctcctgcccagcca

SEQ ID NO: 2983758 - DNA, 20 bp, Homo sapiens
cctggtgctgcctctacctg

SEQ ID NO: 2983759 - DNA, 18 bp, Homo sapiens
cctggtggctgggcccag

SEQ ID NO: 2983760 - DNA, 20 bp, Homo sapiens
cctggtgggagcacctgcca

SEQ ID NO: 2983761 - DNA, 23 bp, Homo sapiens
cctggtgggccaacaaagaacac

SEQ ID NO: 2983762 - DNA, 18 bp, Homo sapiens
cctggtgtcaccccagag

SEQ ID NO: 2983763 - DNA, 14 bp, Homo sapiens
cctggttcctgctg

SEQ ID NO: 2983764 - DNA, 22 bp, Homo sapiens
cctggttcctgctgtcctggtg

SEQ ID NO: 2983765 - DNA, 23 bp, Homo sapiens
cctggttctgtctagactggcct

SEQ ID NO: 2983766 - DNA, 20 bp, Homo sapiens
cctggttgacccaaaaatgt

SEQ ID NO: 2983767 - DNA, 22 bp, Homo sapiens
cctgtaaatacatcctttttct

SEQ ID NO: 2983768 - DNA, 21 bp, Homo sapiens
cctgtaaatgtcctgaatcca

SEQ ID NO: 2983769 - DNA, 16 bp, Homo sapiens
cctgtaacaagccaga

SEQ ID NO: 2983770 - DNA, 18 bp, Homo sapiens
cctgtaacttgagagtag

SEQ ID NO: 2983771 - DNA, 15 bp, Homo sapiens
cctgtaatattatat

SEQ ID NO: 2983772 - DNA, 17 bp, Homo sapiens
cctgtaatcccagaact

SEQ ID NO: 2983773 - DNA, 17 bp, Homo sapiens
cctgtaatcccagcact

SEQ ID NO: 2983774 - DNA, 15 bp, Homo sapiens
cctgtaatctttttc

SEQ ID NO: 2983775 - DNA, 16 bp, Homo sapiens
cctgtaatctttttct

SEQ ID NO: 2983776 - DNA, 21 bp, Homo sapiens
cctgtaatctttttctccacc

SEQ ID NO: 2983777 - DNA, 17 bp, Homo sapiens
cctgtaattcagtgtat

SEQ ID NO: 2983778 - DNA, 14 bp, Homo sapiens
cctgtacagtctgt

SEQ ID NO: 2983779 - DNA, 17 bp, Homo sapiens
cctgtacagtctgtctt

SEQ ID NO: 2983780 - DNA, 15 bp, Homo sapiens
cctgtactaaggagc

SEQ ID NO: 2983781 - DNA, 20 bp, Homo sapiens
cctgtagaatagcctgtggc

SEQ ID NO: 2983782 - DNA, 17 bp, Homo sapiens
cctgtagagccagcctt

SEQ ID NO: 2983783 - DNA, 20 bp, Homo sapiens
cctgtagagccagccttggt

SEQ ID NO: 2983784 - DNA, 22 bp, Homo sapiens
cctttttccttatttcaagggt

SEQ ID NO: 2983785 - DNA, 13 bp, Homo sapiens
ccttttttaaaaa

SEQ ID NO: 2983786 - DNA, 16 bp, Homo sapiens
ccttttttaaaaatgc

SEQ ID NO: 2983787 - DNA, 17 bp, Homo sapiens
ccttttttaaaaatgca

SEQ ID NO: 2983788 - DNA, 18 bp, Homo sapiens
ccttttttatcatttcta

SEQ ID NO: 2983789 - DNA, 20 bp, Homo sapiens
ccttttttatcatttctact

SEQ ID NO: 2983790 - DNA, 13 bp, Homo sapiens
ccttttttgatca

SEQ ID NO: 2983791 - DNA, 22 bp, Homo sapiens
ccttttttgttttttcaaaata

SEQ ID NO: 2983792 - DNA, 15 bp, Homo sapiens
cctttttttaaattt

SEQ ID NO: 2983793 - DNA, 20 bp, Homo sapiens
cctttttttaaattttctcc

SEQ ID NO: 2983794 - DNA, 13 bp, Homo sapiens
cctttttttctct

SEQ ID NO: 2983795 - DNA, 14 bp, Homo sapiens
cgaaaacctgacta

SEQ ID NO: 2983796 - DNA, 21 bp, Homo sapiens
cgaaaccaattcctcatcctc

SEQ ID NO: 2983797 - DNA, 13 bp, Homo sapiens
cgaaagctctaga

SEQ ID NO: 2983798 - DNA, 14 bp, Homo sapiens
cgaaagctctagaa

SEQ ID NO: 2983799 - DNA, 19 bp, Homo sapiens
cgaacatcttcatataaac

SEQ ID NO: 2983800 - DNA, 14 bp, Homo sapiens
cgaacccacctgct

SEQ ID NO: 2983801 - DNA, 13 bp, Homo sapiens
cgaaccccaagga

SEQ ID NO: 2983802 - DNA, 15 bp, Homo sapiens
cgaacctcctctgtg

SEQ ID NO: 2983803 - DNA, 17 bp, Homo sapiens
cgaacctcggggtgggg

SEQ ID NO: 2983804 - DNA, 14 bp, Homo sapiens
cgaactccaggctg

SEQ ID NO: 2983805 - DNA, 18 bp, Homo sapiens
cgaactccaggctgggct

SEQ ID NO: 2983806 - DNA, 16 bp, Homo sapiens
cgaagaagagccacag

SEQ ID NO: 2983807 - DNA, 19 bp, Homo sapiens
cgaagaaggaccagtgaag

SEQ ID NO: 2983808 - DNA, 17 bp, Homo sapiens
cgaagcgttgtcctcag

SEQ ID NO: 2983809 - DNA, 16 bp, Homo sapiens
cgaagctgctgtgact

SEQ ID NO: 2983810 - DNA, 23 bp, Homo sapiens
cgaagctgctgtgactgtgtccc

SEQ ID NO: 2983811 - DNA, 18 bp, Homo sapiens
cgaagtcaagctcaacag

SEQ ID NO: 2983812 - DNA, 13 bp, Homo sapiens
cgaagttcatttt

SEQ ID NO: 2983813 - DNA, 17 bp, Homo sapiens
cgaatctactaattcca

SEQ ID NO: 2983814 - DNA, 16 bp, Homo sapiens
cgaatgacactgttca

SEQ ID NO: 2983815 - DNA, 20 bp, Homo sapiens
cgaatgcccctgttcatgtt

SEQ ID NO: 2983816 - DNA, 14 bp, Homo sapiens
cgaattgagcacaa

SEQ ID NO: 2983817 - DNA, 23 bp, Homo sapiens
cgaatttgtcttcagattattaa

SEQ ID NO: 2983818 - DNA, 23 bp, Homo sapiens
cgacaaaaacaagactgcctccc

SEQ ID NO: 2983819 - DNA, 18 bp, Homo sapiens
cgacaccactcctgccag

SEQ ID NO: 2983820 - DNA, 20 bp, Homo sapiens
cgacaccactcctgccagcc

SEQ ID NO: 2983821 - DNA, 12 bp, Homo sapiens
cgacaccagaag

SEQ ID NO: 2983822 - DNA, 17 bp, Homo sapiens
cgacaccagccctgctg

SEQ ID NO: 2983823 - DNA, 21 bp, Homo sapiens
cgacactcagggcagctgcct

SEQ ID NO: 2983824 - DNA, 22 bp, Homo sapiens
cgacactcagggcagctgcctg

SEQ ID NO: 2983825 - DNA, 17 bp, Homo sapiens
cgacactgggaggccag

SEQ ID NO: 2983826 - DNA, 18 bp, Homo sapiens
cgacagtcggtgacccca

SEQ ID NO: 2983827 - DNA, 13 bp, Homo sapiens
cgacatgctgcca

SEQ ID NO: 2983828 - DNA, 15 bp, Homo sapiens
cgacccccgcagagg

SEQ ID NO: 2983829 - DNA, 18 bp, Homo sapiens
cgacccccgcagaggcag

SEQ ID NO: 2983830 - DNA, 15 bp, Homo sapiens
cgaccccgggccgga

SEQ ID NO: 2983831 - DNA, 14 bp, Homo sapiens
cgacccctgcctcg

SEQ ID NO: 2983832 - DNA, 19 bp, Homo sapiens
cgaccctgggggcacagga

SEQ ID NO: 2983833 - DNA, 23 bp, Homo sapiens
cgaccctgggggcacaggaggca

SEQ ID NO: 2983834 - DNA, 14 bp, Homo sapiens
cgacctcgtcctcc

SEQ ID NO: 2983835 - DNA, 19 bp, Homo sapiens
cgacctcgtcctccccctg

SEQ ID NO: 2983836 - DNA, 20 bp, Homo sapiens
cgacctctccatcttcagct

SEQ ID NO: 2983837 - DNA, 21 bp, Homo sapiens
cgactcccccaaccaaggaag

SEQ ID NO: 2983838 - DNA, 12 bp, Homo sapiens
cgactgaagaag

SEQ ID NO: 2983839 - DNA, 14 bp, Homo sapiens
cgactgcccagcca

SEQ ID NO: 2983840 - DNA, 13 bp, Homo sapiens
cgactgcctgtct

SEQ ID NO: 2983841 - DNA, 14 bp, Homo sapiens
cgactggccagggc

SEQ ID NO: 2983842 - DNA, 20 bp, Homo sapiens
cgactggccagggccacgct

SEQ ID NO: 2983843 - DNA, 17 bp, Homo sapiens
cgacttttgttctcttc

SEQ ID NO: 2983844 - DNA, 13 bp, Homo sapiens
cgagaagcaagaa

SEQ ID NO: 2983845 - DNA, 15 bp, Homo sapiens
cgagaccagcctggc

SEQ ID NO: 2983846 - DNA, 16 bp, Homo sapiens
cgagaccagcctggcc

SEQ ID NO: 2983847 - DNA, 11 bp, Homo sapiens
cgagactccat

SEQ ID NO: 2983848 - DNA, 15 bp, Homo sapiens
cgagactccatctct

SEQ ID NO: 2983849 - DNA, 16 bp, Homo sapiens
cgagagcagtgggcag

SEQ ID NO: 2983850 - DNA, 13 bp, Homo sapiens
cgagagcctgctc

SEQ ID NO: 2983851 - DNA, 20 bp, Homo sapiens
cgagagcctgctcccccacc

SEQ ID NO: 2983852 - DNA, 23 bp, Homo sapiens
cgagaggctggtgtatgcactgc

SEQ ID NO: 2983853 - DNA, 21 bp, Homo sapiens
cgagatcccaacactgccagc

SEQ ID NO: 2983854 - DNA, 15 bp, Homo sapiens
cgagccacaggaacg

SEQ ID NO: 2983855 - DNA, 16 bp, Homo sapiens
cgagccacaggaacgg

SEQ ID NO: 2983856 - DNA, 21 bp, Homo sapiens
cgagcccctcggctctggagg

SEQ ID NO: 2983857 - DNA, 22 bp, Homo sapiens
cgagcccctcggctctggaggc

SEQ ID NO: 2983858 - DNA, 13 bp, Homo sapiens
cgagcccttagcc

SEQ ID NO: 2983859 - DNA, 14 bp, Homo sapiens
cgagcccttagcct

SEQ ID NO: 2983860 - DNA, 15 bp, Homo sapiens
cgagcccttagcctt

SEQ ID NO: 2983861 - DNA, 19 bp, Homo sapiens
cgagcccttagccttgctg

SEQ ID NO: 2983862 - DNA, 15 bp, Homo sapiens
cgagcggtggccccg

SEQ ID NO: 2983863 - DNA, 11 bp, Homo sapiens
cgagctctgtg

SEQ ID NO: 2983864 - DNA, 14 bp, Homo sapiens
cgagctctgtggga

SEQ ID NO: 2983865 - DNA, 21 bp, Homo sapiens
cgagctctgtgggaaaaaaga

SEQ ID NO: 2983866 - DNA, 12 bp, Homo sapiens
cgagctggtttc

SEQ ID NO: 2983867 - DNA, 14 bp, Homo sapiens
cgagcttagattct

SEQ ID NO: 2983868 - DNA, 14 bp, Homo sapiens
cgaggaaaaacaac

SEQ ID NO: 2983869 - DNA, 14 bp, Homo sapiens
cgaggaaactcaga

SEQ ID NO: 2983870 - DNA, 16 bp, Homo sapiens
cgaggaactcgcctca

SEQ ID NO: 2983871 - DNA, 23 bp, Homo sapiens
cgaggaagatgctcatctgagcc

SEQ ID NO: 2983872 - DNA, 11 bp, Homo sapiens
cgaggaagccc

SEQ ID NO: 2983873 - DNA, 18 bp, Homo sapiens
cgaggactgtatttgtga

SEQ ID NO: 2983874 - DNA, 16 bp, Homo sapiens
cgaggaggcgcggcct

SEQ ID NO: 2983875 - DNA, 17 bp, Homo sapiens
cgaggaggcgcggcctc

SEQ ID NO: 2983876 - DNA, 11 bp, Homo sapiens
cgaggccagta

SEQ ID NO: 2983877 - DNA, 19 bp, Homo sapiens
cgaggcccagatccaaggc

SEQ ID NO: 2983878 - DNA, 21 bp, Homo sapiens
cgaggcccagatccaaggccg

SEQ ID NO: 2983879 - DNA, 14 bp, Homo sapiens
cgaggccctgcatg

SEQ ID NO: 2983880 - DNA, 14 bp, Homo sapiens
cgaggctgcagtca

SEQ ID NO: 2983881 - DNA, 20 bp, Homo sapiens
cgaggctgcagtcagccctg

SEQ ID NO: 2983882 - DNA, 16 bp, Homo sapiens
cgaggctgccccaggc

SEQ ID NO: 2983883 - DNA, 19 bp, Homo sapiens
cgaggctgccccaggccgg

SEQ ID NO: 2983884 - DNA, 18 bp, Homo sapiens
cgagggccgcctgcctta

SEQ ID NO: 2983885 - DNA, 19 bp, Homo sapiens
cgagggctcagaagagcag

SEQ ID NO: 2983886 - DNA, 17 bp, Homo sapiens
cgagggctggctggcct

SEQ ID NO: 2983887 - DNA, 23 bp, Homo sapiens
cgagggctggctggcctcaccca

SEQ ID NO: 2983888 - DNA, 18 bp, Homo sapiens
cgaggggacccatggggg

SEQ ID NO: 2983889 - DNA, 20 bp, Homo sapiens
cgaggggacccatgggggct

SEQ ID NO: 2983890 - DNA, 17 bp, Homo sapiens
cgaggtcaacagagaag

SEQ ID NO: 2983891 - DNA, 15 bp, Homo sapiens
cgaggtggctgcctg

SEQ ID NO: 2983892 - DNA, 16 bp, Homo sapiens
cgagtactgtgggcaa

SEQ ID NO: 2983893 - DNA, 16 bp, Homo sapiens
cgagtcaatcccctca

SEQ ID NO: 2983894 - DNA, 13 bp, Homo sapiens
cgagtccaagctg

SEQ ID NO: 2983895 - DNA, 15 bp, Homo sapiens
cgagtccaagctggg

SEQ ID NO: 2983896 - DNA, 17 bp, Homo sapiens
cgagtgcggcgtggaga

SEQ ID NO: 2983897 - DNA, 20 bp, Homo sapiens
cgagtgcggcgtggagactg

SEQ ID NO: 2983898 - DNA, 16 bp, Homo sapiens
cgagtgctaagtgtag

SEQ ID NO: 2983899 - DNA, 20 bp, Homo sapiens
cgagtggtctcctctcagct

SEQ ID NO: 2983900 - DNA, 21 bp, Homo sapiens
cgagtggtctcctctcagctt

SEQ ID NO: 2983901 - DNA, 22 bp, Homo sapiens
cgagtgtgaagcttccttggct

SEQ ID NO: 2983902 - DNA, 18 bp, Homo sapiens
cgagtgttcctgtgctta

SEQ ID NO: 2983903 - DNA, 18 bp, Homo sapiens
cgatatgaaaaataaata

SEQ ID NO: 2983904 - DNA, 22 bp, Homo sapiens
cgatatttcgtttggtcttagg

SEQ ID NO: 2983905 - DNA, 17 bp, Homo sapiens
cgatcaggcacaggtca

SEQ ID NO: 2983906 - DNA, 19 bp, Homo sapiens
cgatcgcggcggagctggc

SEQ ID NO: 2983907 - DNA, 22 bp, Homo sapiens
cgatcttccagaagctgtactt

SEQ ID NO: 2983908 - DNA, 15 bp, Homo sapiens
cgatgcaatgaacac

SEQ ID NO: 2983909 - DNA, 18 bp, Homo sapiens
cgatgcctggcctgccag

SEQ ID NO: 2983910 - DNA, 22 bp, Homo sapiens
cgatgcctggcctgccagacac

SEQ ID NO: 2983911 - DNA, 19 bp, Homo sapiens
cgatgcgtattctgtggcc

SEQ ID NO: 2983912 - DNA, 23 bp, Homo sapiens
cgatgctgacctcacctggtcct

SEQ ID NO: 2983913 - DNA, 22 bp, Homo sapiens
cgatgctgctggcctccctccg

SEQ ID NO: 2983914 - DNA, 22 bp, Homo sapiens
cgatgggagggatggcccttcc

SEQ ID NO: 2983915 - DNA, 11 bp, Homo sapiens
cgatgtggccc

SEQ ID NO: 2983916 - DNA, 17 bp, Homo sapiens
cgatgttattagatgtt

SEQ ID NO: 2983917 - DNA, 17 bp, Homo sapiens
cggggcctgtctcagtg

SEQ ID NO: 2983918 - DNA, 15 bp, Homo sapiens
cggggcgcctagagc

SEQ ID NO: 2983919 - DNA, 19 bp, Homo sapiens
cggggcgcctagagcgcgg

SEQ ID NO: 2983920 - DNA, 17 bp, Homo sapiens
cgggggcagtctgagag

SEQ ID NO: 2983921 - DNA, 13 bp, Homo sapiens
cgggggcctgtgg

SEQ ID NO: 2983922 - DNA, 15 bp, Homo sapiens
cgggggccttgaaga

SEQ ID NO: 2983923 - DNA, 18 bp, Homo sapiens
cggggggggcgcctggag

SEQ ID NO: 2983924 - DNA, 14 bp, Homo sapiens
cggggtcctgggag

SEQ ID NO: 2983925 - DNA, 17 bp, Homo sapiens
cggggtctcctggacct

SEQ ID NO: 2983926 - DNA, 19 bp, Homo sapiens
cgggtccacttgccagggc

SEQ ID NO: 2983927 - DNA, 20 bp, Homo sapiens
cgggtccacttgccagggct

SEQ ID NO: 2983928 - DNA, 14 bp, Homo sapiens
cgggtcctcagctg

SEQ ID NO: 2983929 - DNA, 20 bp, Homo sapiens
cgggtcctcagctgctccca

SEQ ID NO: 2983930 - DNA, 23 bp, Homo sapiens
cgggtctctcactgttgcagtgg

SEQ ID NO: 2983931 - DNA, 21 bp, Homo sapiens
cgggtgaacaaagcagccacg

SEQ ID NO: 2983932 - DNA, 20 bp, Homo sapiens
cgggtgcccgtaatcccagc

SEQ ID NO: 2983933 - DNA, 15 bp, Homo sapiens
cgggtggatcacctg

SEQ ID NO: 2983934 - DNA, 15 bp, Homo sapiens
cgggtgggggagcca

SEQ ID NO: 2983935 - DNA, 15 bp, Homo sapiens
cggtcagactggagg

SEQ ID NO: 2983936 - DNA, 16 bp, Homo sapiens
cggtcagactggaggt

SEQ ID NO: 2983937 - DNA, 13 bp, Homo sapiens
cggtcatgtgtgt

SEQ ID NO: 2983938 - DNA, 23 bp, Homo sapiens
cggtccccacagactgccccagc

SEQ ID NO: 2983939 - DNA, 22 bp, Homo sapiens
cggtcctgcacagattcccagg

SEQ ID NO: 2983940 - DNA, 21 bp, Homo sapiens
cggtctgttctgtttcaaggc

SEQ ID NO: 2983941 - DNA, 22 bp, Homo sapiens
cggtgaccccatcactcgcagg

SEQ ID NO: 2983942 - DNA, 21 bp, Homo sapiens
cggtgaccgcctcctgctctg

SEQ ID NO: 2983943 - DNA, 23 bp, Homo sapiens
cggtgaccgcctcctgctctgca

SEQ ID NO: 2983944 - DNA, 17 bp, Homo sapiens
cggtgagctacaaatgc

SEQ ID NO: 2983945 - DNA, 13 bp, Homo sapiens
cggtgcagtctgg

SEQ ID NO: 2983946 - DNA, 20 bp, Homo sapiens
cggtgcgcacaccgccagca

SEQ ID NO: 2983947 - DNA, 23 bp, Homo sapiens
cggtgctccatctccgcctccac

SEQ ID NO: 2983948 - DNA, 15 bp, Homo sapiens
cggtggaagagctca

SEQ ID NO: 2983949 - DNA, 14 bp, Homo sapiens
cggtggccacagcg

SEQ ID NO: 2983950 - DNA, 20 bp, Homo sapiens
cggtggctagtcaagctcct

SEQ ID NO: 2983951 - DNA, 21 bp, Homo sapiens
cggtggctagtcaagctcctc

SEQ ID NO: 2983952 - DNA, 20 bp, Homo sapiens
cggtggctcacgcctgtaat

SEQ ID NO: 2983953 - DNA, 20 bp, Homo sapiens
cggtggctcatgcctgtaat

SEQ ID NO: 2983954 - DNA, 14 bp, Homo sapiens
cggtgggaaggaaa

SEQ ID NO: 2983955 - DNA, 16 bp, Homo sapiens
cggtgggaaggaaagg

SEQ ID NO: 2983956 - DNA, 22 bp, Homo sapiens
cggtgggggggagaaggcctcc

SEQ ID NO: 2983957 - DNA, 23 bp, Homo sapiens
cggtgggggggagaaggcctccc

SEQ ID NO: 2983958 - DNA, 19 bp, Homo sapiens
cggtgggtccgcatccctg

SEQ ID NO: 2983959 - DNA, 13 bp, Homo sapiens
cggtgtcaggtcc

SEQ ID NO: 2983960 - DNA, 17 bp, Homo sapiens
cggtgtctcgctgcatc

SEQ ID NO: 2983961 - DNA, 15 bp, Homo sapiens
cggtgtcttgttctg

SEQ ID NO: 2983962 - DNA, 16 bp, Homo sapiens
cggtgtggaccgagga

SEQ ID NO: 2983963 - DNA, 13 bp, Homo sapiens
cggtttccaggga

SEQ ID NO: 2983964 - DNA, 20 bp, Homo sapiens
cggtttccagggaggggccg

SEQ ID NO: 2983965 - DNA, 15 bp, Homo sapiens
cggtttttttcctgt

SEQ ID NO: 2983966 - DNA, 13 bp, Homo sapiens
cgtaagcactgtt

SEQ ID NO: 2983967 - DNA, 14 bp, Homo sapiens
cgtaagcactgttt

SEQ ID NO: 2983968 - DNA, 13 bp, Homo sapiens
cgtaatcccagct

SEQ ID NO: 2983969 - DNA, 14 bp, Homo sapiens
cgtaatcccagcta

SEQ ID NO: 2983970 - DNA, 15 bp, Homo sapiens
cgtaccaagccaccg

SEQ ID NO: 2983971 - DNA, 13 bp, Homo sapiens
cgtaccttcccac

SEQ ID NO: 2983972 - DNA, 23 bp, Homo sapiens
cgtagatattggacaaagaacct

SEQ ID NO: 2983973 - DNA, 12 bp, Homo sapiens
cgtagccacagg

SEQ ID NO: 2983974 - DNA, 16 bp, Homo sapiens
cgtagccagctgctcc

SEQ ID NO: 2983975 - DNA, 14 bp, Homo sapiens
cgtagttccctgaa

SEQ ID NO: 2983976 - DNA, 16 bp, Homo sapiens
cgtatagctgtattga

SEQ ID NO: 2983977 - DNA, 15 bp, Homo sapiens
cgtataggcatgtaa

SEQ ID NO: 2983978 - DNA, 16 bp, Homo sapiens
cgtataggcatgtaaa

SEQ ID NO: 2983979 - DNA, 14 bp, Homo sapiens
cgtatatttctcat

SEQ ID NO: 2983980 - DNA, 17 bp, Homo sapiens
cgtatgtatttcattgc

SEQ ID NO: 2983981 - DNA, 20 bp, Homo sapiens
cgtatgtgctcttataaagt

SEQ ID NO: 2983982 - DNA, 23 bp, Homo sapiens
cgtattaaaaaacaattaactgc

SEQ ID NO: 2983983 - DNA, 22 bp, Homo sapiens
cgtcaaaacagattgtttgcaa

SEQ ID NO: 2983984 - DNA, 16 bp, Homo sapiens
cgtcaacgttgtactg

SEQ ID NO: 2983985 - DNA, 17 bp, Homo sapiens
cgtcaacgttgtactgt

SEQ ID NO: 2983986 - DNA, 14 bp, Homo sapiens
cgtcaaggaaaggg

SEQ ID NO: 2983987 - DNA, 21 bp, Homo sapiens
cgtcacccttggtagagttta

SEQ ID NO: 2983988 - DNA, 19 bp, Homo sapiens
cgtcacgtgcgctgggcac

SEQ ID NO: 2983989 - DNA, 15 bp, Homo sapiens
cgtcagacttttctt

SEQ ID NO: 2983990 - DNA, 13 bp, Homo sapiens
cgtcatcttccct

SEQ ID NO: 2983991 - DNA, 16 bp, Homo sapiens
cgtcatcttccctgcc

SEQ ID NO: 2983992 - DNA, 18 bp, Homo sapiens
cgtcatgggccccccatg

SEQ ID NO: 2983993 - DNA, 14 bp, Homo sapiens
cgtccaccaggcct

SEQ ID NO: 2983994 - DNA, 17 bp, Homo sapiens
cgtccagctgcccttcc

SEQ ID NO: 2983995 - DNA, 22 bp, Homo sapiens
cgtccaggccgcgccctttccc

SEQ ID NO: 2983996 - DNA, 11 bp, Homo sapiens
cgtccagggag

SEQ ID NO: 2983997 - DNA, 12 bp, Homo sapiens
cgtccatctctc

SEQ ID NO: 2983998 - DNA, 16 bp, Homo sapiens
cgtccatctctctccc

SEQ ID NO: 2983999 - DNA, 19 bp, Homo sapiens
cgtccatctctctccctta

SEQ ID NO: 2984000 - DNA, 16 bp, Homo sapiens
cgtcccagcggcctca

SEQ ID NO: 2984001 - DNA, 17 bp, Homo sapiens
cgtcccagcggcctcag

SEQ ID NO: 2984002 - DNA, 15 bp, Homo sapiens
cgtccccccccaggc

SEQ ID NO: 2984003 - DNA, 16 bp, Homo sapiens
cgtccccccccaggcc

SEQ ID NO: 2984004 - DNA, 22 bp, Homo sapiens
cgtcccccttccgccttctccc

SEQ ID NO: 2984005 - DNA, 13 bp, Homo sapiens
cgtcccctccccc

SEQ ID NO: 2984006 - DNA, 20 bp, Homo sapiens
cgtccggcagttctgggtgc

SEQ ID NO: 2984007 - DNA, 21 bp, Homo sapiens
cgtccgtgggttgctaactga

SEQ ID NO: 2984008 - DNA, 23 bp, Homo sapiens
cgtccgtgggttgctaactgaac

SEQ ID NO: 2984009 - DNA, 15 bp, Homo sapiens
cgtcctccccctgcc

SEQ ID NO: 2984010 - DNA, 14 bp, Homo sapiens
cgtcctcctctgtg

SEQ ID NO: 2984011 - DNA, 15 bp, Homo sapiens
cgtcctcctctgtga

SEQ ID NO: 2984012 - DNA, 15 bp, Homo sapiens
cgtcgccctcccagg

SEQ ID NO: 2984013 - DNA, 19 bp, Homo sapiens
cgtcggagctgcctgcagc

SEQ ID NO: 2984014 - DNA, 22 bp, Homo sapiens
cgtctcattttgtccatgtccc

SEQ ID NO: 2984015 - DNA, 13 bp, Homo sapiens
cgtctctcccacc

SEQ ID NO: 2984016 - DNA, 20 bp, Homo sapiens
cgtctctcccaccccctccc

SEQ ID NO: 2984017 - DNA, 11 bp, Homo sapiens
cgtctctctgc

SEQ ID NO: 2984018 - DNA, 12 bp, Homo sapiens
cgtctctctgcc

SEQ ID NO: 2984019 - DNA, 13 bp, Homo sapiens
cgtctctctgcct

SEQ ID NO: 2984020 - DNA, 23 bp, Homo sapiens
cgtctctggagcggaatttacct

SEQ ID NO: 2984021 - DNA, 18 bp, Homo sapiens
cgtctcttcaagcatcct

SEQ ID NO: 2984022 - DNA, 20 bp, Homo sapiens
cgtctgactccctccccacc

SEQ ID NO: 2984023 - DNA, 14 bp, Homo sapiens
cgtctgccttggca

SEQ ID NO: 2984024 - DNA, 18 bp, Homo sapiens
cgtctgccttggcatcct

SEQ ID NO: 2984025 - DNA, 19 bp, Homo sapiens
cgtctgcgattttatctgt

SEQ ID NO: 2984026 - DNA, 22 bp, Homo sapiens
cgtctggccctggcgggtggct

SEQ ID NO: 2984027 - DNA, 21 bp, Homo sapiens
cgtctgggagaaattgacaga

SEQ ID NO: 2984028 - DNA, 22 bp, Homo sapiens
cgtctgggagaaattgacagat

SEQ ID NO: 2984029 - DNA, 23 bp, Homo sapiens
cgtctggggttcagcccctcctc

SEQ ID NO: 2984030 - DNA, 11 bp, Homo sapiens
cgtctgtgtgc

SEQ ID NO: 2984031 - DNA, 23 bp, Homo sapiens
cgtcttagaagtggaccaggaca

SEQ ID NO: 2984032 - DNA, 14 bp, Homo sapiens
cgtctttaagagac

SEQ ID NO: 2984033 - DNA, 17 bp, Homo sapiens
cgtctttaagagactca

SEQ ID NO: 2984034 - DNA, 15 bp, Homo sapiens
cgtgacagactcctg

SEQ ID NO: 2984035 - DNA, 16 bp, Homo sapiens
cgtgacgctgaataaa

SEQ ID NO: 2984036 - DNA, 20 bp, Homo sapiens
cgtgacgctgaataaatgtc

SEQ ID NO: 2984037 - DNA, 14 bp, Homo sapiens
cgtgactcagagct

SEQ ID NO: 2984038 - DNA, 13 bp, Homo sapiens
cgtgactgcccca

SEQ ID NO: 2984039 - DNA, 14 bp, Homo sapiens
cgtgagccccatct

SEQ ID NO: 2984040 - DNA, 16 bp, Homo sapiens
cgtgagccccatcttc

SEQ ID NO: 2984041 - DNA, 20 bp, Homo sapiens
cgtgagctgcccggcgcctg

SEQ ID NO: 2984042 - DNA, 15 bp, Homo sapiens
cgtgaggctgctgcc

SEQ ID NO: 2984043 - DNA, 18 bp, Homo sapiens
cgtgaggctgctgccatc

SEQ ID NO: 2984044 - DNA, 14 bp, Homo sapiens
cgtgatcaaagcca

SEQ ID NO: 2984045 - DNA, 18 bp, Homo sapiens
cgtgatcaaagccacact

SEQ ID NO: 2984046 - DNA, 14 bp, Homo sapiens
cgtgatgtgccact

SEQ ID NO: 2984047 - DNA, 18 bp, Homo sapiens
cgtgcaggacagctcttg

SEQ ID NO: 2984048 - DNA, 14 bp, Homo sapiens
cgtgccaaccccac

SEQ ID NO: 2984049 - DNA, 21 bp, Homo sapiens
cgtgccaaccccacccagctc

SEQ ID NO: 2984050 - DNA, 21 bp, Homo sapiens
ctactgtagaactgattttac

SEQ ID NO: 2984051 - DNA, 22 bp, Homo sapiens
ctactgtagaagaagtgaacac

SEQ ID NO: 2984052 - DNA, 23 bp, Homo sapiens
ctactgtagaagaagtgaacact

SEQ ID NO: 2984053 - DNA, 21 bp, Homo sapiens
ctactgtccctctcagtgcct

SEQ ID NO: 2984054 - DNA, 23 bp, Homo sapiens
ctactgtccctctcagtgccttc

SEQ ID NO: 2984055 - DNA, 19 bp, Homo sapiens
ctactgtctaagcagtttt

SEQ ID NO: 2984056 - DNA, 23 bp, Homo sapiens
ctactgtctaagcagttttgtaa

SEQ ID NO: 2984057 - DNA, 20 bp, Homo sapiens
ctactgtctcactgaaacat

SEQ ID NO: 2984058 - DNA, 19 bp, Homo sapiens
ctactgtggcaaatgccaa

SEQ ID NO: 2984059 - DNA, 20 bp, Homo sapiens
ctactgttatcagtaatgct

SEQ ID NO: 2984060 - DNA, 18 bp, Homo sapiens
ctactgttctaaagctct

SEQ ID NO: 2984061 - DNA, 17 bp, Homo sapiens
ctacttagatatttcat

SEQ ID NO: 2984062 - DNA, 20 bp, Homo sapiens
ctacttagctggccaaggag

SEQ ID NO: 2984063 - DNA, 19 bp, Homo sapiens
ctacttcaggaacaccccc

SEQ ID NO: 2984064 - DNA, 19 bp, Homo sapiens
ctacttcattttcagagtg

SEQ ID NO: 2984065 - DNA, 19 bp, Homo sapiens
ctacttctctgagtcagct

SEQ ID NO: 2984066 - DNA, 20 bp, Homo sapiens
ctacttctctgagtcagctg

SEQ ID NO: 2984067 - DNA, 21 bp, Homo sapiens
ctacttctctgagtcagctga

SEQ ID NO: 2984068 - DNA, 20 bp, Homo sapiens
ctacttctggaagtcatctc

SEQ ID NO: 2984069 - DNA, 23 bp, Homo sapiens
ctacttgatatttccttcaccac

SEQ ID NO: 2984070 - DNA, 17 bp, Homo sapiens
ctacttgattttattgt

SEQ ID NO: 2984071 - DNA, 14 bp, Homo sapiens
ctacttgctcaggt

SEQ ID NO: 2984072 - DNA, 13 bp, Homo sapiens
ctacttgtgtttt

SEQ ID NO: 2984073 - DNA, 19 bp, Homo sapiens
ctacttgtttcaaatgtgt

SEQ ID NO: 2984074 - DNA, 18 bp, Homo sapiens
ctactttctcttgtttaa

SEQ ID NO: 2984075 - DNA, 21 bp, Homo sapiens
ctactttgatatgactgtttt

SEQ ID NO: 2984076 - DNA, 15 bp, Homo sapiens
ctactttgattctga

SEQ ID NO: 2984077 - DNA, 16 bp, Homo sapiens
ctactttgattctgat

SEQ ID NO: 2984078 - DNA, 22 bp, Homo sapiens
ctactttgtcctttttgttatt

SEQ ID NO: 2984079 - DNA, 13 bp, Homo sapiens
ctactttgtttat

SEQ ID NO: 2984080 - DNA, 14 bp, Homo sapiens
ctacttttacttgt

SEQ ID NO: 2984081 - DNA, 18 bp, Homo sapiens
ctacttttacttgttcat

SEQ ID NO: 2984082 - DNA, 19 bp, Homo sapiens
ctacttttacttgttcatt

SEQ ID NO: 2984083 - DNA, 13 bp, Homo sapiens
ctagaaaaaaaga

SEQ ID NO: 2984084 - DNA, 13 bp, Homo sapiens
ctagaaaaaacat

SEQ ID NO: 2984085 - DNA, 13 bp, Homo sapiens
ctagaaaggagag

SEQ ID NO: 2984086 - DNA, 14 bp, Homo sapiens
ctagaaaggagaga

SEQ ID NO: 2984087 - DNA, 18 bp, Homo sapiens
ctagaaatctgtcctgtg

SEQ ID NO: 2984088 - DNA, 19 bp, Homo sapiens
ctagaaatctgtcctgtgg

SEQ ID NO: 2984089 - DNA, 16 bp, Homo sapiens
ctagaaattgacacaa

SEQ ID NO: 2984090 - DNA, 12 bp, Homo sapiens
ctagaaattttc

SEQ ID NO: 2984091 - DNA, 16 bp, Homo sapiens
ctagaaggggtggctg

SEQ ID NO: 2984092 - DNA, 17 bp, Homo sapiens
ctagaagtaagaagagg

SEQ ID NO: 2984093 - DNA, 18 bp, Homo sapiens
ctagaagtaagaagagga

SEQ ID NO: 2984094 - DNA, 22 bp, Homo sapiens
ctagaagtaagaagaggagcct

SEQ ID NO: 2984095 - DNA, 21 bp, Homo sapiens
ctagaagtgggccaggacagg

SEQ ID NO: 2984096 - DNA, 17 bp, Homo sapiens
ctagaataatcttgctc

SEQ ID NO: 2984097 - DNA, 20 bp, Homo sapiens
ctagaatggtttttgttgag

SEQ ID NO: 2984098 - DNA, 17 bp, Homo sapiens
ctagacatggaggttct

SEQ ID NO: 2984099 - DNA, 18 bp, Homo sapiens
ctagacatggaggttcta

SEQ ID NO: 2984100 - DNA, 22 bp, Homo sapiens
ctagacatggaggttctaaggc

SEQ ID NO: 2984101 - DNA, 21 bp, Homo sapiens
ctagactttaggctttcagct

SEQ ID NO: 2984102 - DNA, 22 bp, Homo sapiens
ctagagaagggagacattgttt

SEQ ID NO: 2984103 - DNA, 22 bp, Homo sapiens
ctagagacagtgatgcctgccc

SEQ ID NO: 2984104 - DNA, 18 bp, Homo sapiens
ctagagacgcaccttgct

SEQ ID NO: 2984105 - DNA, 20 bp, Homo sapiens
ctagagacgcaccttgctgc

SEQ ID NO: 2984106 - DNA, 18 bp, Homo sapiens
ctagagagaaaaagaaag

SEQ ID NO: 2984107 - DNA, 21 bp, Homo sapiens
ctagagagggaggcaagccct

SEQ ID NO: 2984108 - DNA, 19 bp, Homo sapiens
ctagagcactctcacccca

SEQ ID NO: 2984109 - DNA, 20 bp, Homo sapiens
ctagagcgcggctggctctg

SEQ ID NO: 2984110 - DNA, 21 bp, Homo sapiens
ctagagcgcggctggctctgt

SEQ ID NO: 2984111 - DNA, 22 bp, Homo sapiens
ctagagcttgcagtgaagtgtt

SEQ ID NO: 2984112 - DNA, 19 bp, Homo sapiens
ctagaggaaccaaccccca

SEQ ID NO: 2984113 - DNA, 15 bp, Homo sapiens
ctagagggacctctc

SEQ ID NO: 2984114 - DNA, 16 bp, Homo sapiens
ctagagggacctctcc

SEQ ID NO: 2984115 - DNA, 19 bp, Homo sapiens
ctagagggacctctcccag

SEQ ID NO: 2984116 - DNA, 21 bp, Homo sapiens
ctagagggacctctcccaggg

SEQ ID NO: 2984117 - DNA, 16 bp, Homo sapiens
ctagagggagaagact

SEQ ID NO: 2984118 - DNA, 19 bp, Homo sapiens
ctagagggagaagactgtg

SEQ ID NO: 2984119 - DNA, 16 bp, Homo sapiens
ctagagggaggggcct

SEQ ID NO: 2984120 - DNA, 23 bp, Homo sapiens
ctagagtatacctgtggtttggt

SEQ ID NO: 2984121 - DNA, 20 bp, Homo sapiens
ctagagtccaaggtttaaag

SEQ ID NO: 2984122 - DNA, 23 bp, Homo sapiens
ctagagtccaaggtttaaagagt

SEQ ID NO: 2984123 - DNA, 15 bp, Homo sapiens
ctagagtttatacag

SEQ ID NO: 2984124 - DNA, 19 bp, Homo sapiens
ctagagtttatacagtgta

SEQ ID NO: 2984125 - DNA, 22 bp, Homo sapiens
ctagagtttatacagtgtacat

SEQ ID NO: 2984126 - DNA, 23 bp, Homo sapiens
ctagagtttatacagtgtacatg

SEQ ID NO: 2984127 - DNA, 24 bp, Homo sapiens
ctagatacctaaaacataagatca

SEQ ID NO: 2984128 - DNA, 21 bp, Homo sapiens
ctagatcatttgttctgggag

SEQ ID NO: 2984129 - DNA, 13 bp, Homo sapiens
ctagatccaggct

SEQ ID NO: 2984130 - DNA, 15 bp, Homo sapiens
ctagatcctaagggt

SEQ ID NO: 2984131 - DNA, 16 bp, Homo sapiens
ctagatgacctcatta

SEQ ID NO: 2984132 - DNA, 21 bp, Homo sapiens
ctagatgattaaataagattc

SEQ ID NO: 2984133 - DNA, 22 bp, Homo sapiens
ctagatgattaaataagattct

SEQ ID NO: 2984134 - DNA, 15 bp, Homo sapiens
ctagatgattgaata

SEQ ID NO: 2984135 - DNA, 17 bp, Homo sapiens
ctagattatatcaaagt

SEQ ID NO: 2984136 - DNA, 12 bp, Homo sapiens
ctagattcaaag

SEQ ID NO: 2984137 - DNA, 18 bp, Homo sapiens
ctagattcaaaggttcta

SEQ ID NO: 2984138 - DNA, 23 bp, Homo sapiens
ctagattccattggtccaagatt

SEQ ID NO: 2984139 - DNA, 21 bp, Homo sapiens
ctagatttctagaaaagcttc

SEQ ID NO: 2984140 - DNA, 22 bp, Homo sapiens
ctagatttctagaaaagcttcc

SEQ ID NO: 2984141 - DNA, 14 bp, Homo sapiens
ctagcacatgcttc

SEQ ID NO: 2984142 - DNA, 15 bp, Homo sapiens
ctagcacatgcttca

SEQ ID NO: 2984143 - DNA, 16 bp, Homo sapiens
ctagcacatgcttcaa

SEQ ID NO: 2984144 - DNA, 23 bp, Homo sapiens
ctagcacggacatggtctgtcct

SEQ ID NO: 2984145 - DNA, 16 bp, Homo sapiens
ctagcatctcatgagt

SEQ ID NO: 2984146 - DNA, 21 bp, Homo sapiens
ctagcatgccaacaagaatgc

SEQ ID NO: 2984147 - DNA, 19 bp, Homo sapiens
ctagccaccgcctcctaca

SEQ ID NO: 2984148 - DNA, 12 bp, Homo sapiens
ctagccagccaa

SEQ ID NO: 2984149 - DNA, 14 bp, Homo sapiens
ctagcccacccccc

SEQ ID NO: 2984150 - DNA, 13 bp, Homo sapiens
ctagcccagtgct

SEQ ID NO: 2984151 - DNA, 15 bp, Homo sapiens
ctagcccagtgcttc

SEQ ID NO: 2984152 - DNA, 14 bp, Homo sapiens
ctagccctctccct

SEQ ID NO: 2984153 - DNA, 12 bp, Homo sapiens
ctagccgctgcc

SEQ ID NO: 2984154 - DNA, 21 bp, Homo sapiens
ctagccgctgccctgggtcct

SEQ ID NO: 2984155 - DNA, 23 bp, Homo sapiens
ctagcctggggcttgaatttgca

SEQ ID NO: 2984156 - DNA, 12 bp, Homo sapiens
ctagccttagtc

SEQ ID NO: 2984157 - DNA, 12 bp, Homo sapiens
ctagcgctgccg

SEQ ID NO: 2984158 - DNA, 16 bp, Homo sapiens
ctagcgctgccgcacc

SEQ ID NO: 2984159 - DNA, 22 bp, Homo sapiens
ctagcggagttccagcaaacaa

SEQ ID NO: 2984160 - DNA, 14 bp, Homo sapiens
ctagctagccagcc

SEQ ID NO: 2984161 - DNA, 13 bp, Homo sapiens
ctagctatttcta

SEQ ID NO: 2984162 - DNA, 17 bp, Homo sapiens
ctagctgtatgatttgt

SEQ ID NO: 2984163 - DNA, 21 bp, Homo sapiens
ctagcttatctccctgcttca

SEQ ID NO: 2984164 - DNA, 23 bp, Homo sapiens
ctagctttacgctcatcacctaa

SEQ ID NO: 2984165 - DNA, 22 bp, Homo sapiens
ctagctttcctttacagctgtt

SEQ ID NO: 2984166 - DNA, 14 bp, Homo sapiens
ctagcttttttcct

SEQ ID NO: 2984167 - DNA, 19 bp, Homo sapiens
ctagcttttttcctccttt

SEQ ID NO: 2984168 - DNA, 20 bp, Homo sapiens
ctagcttttttcctcctttc

SEQ ID NO: 2984169 - DNA, 22 bp, Homo sapiens
ctaggaagaattttaaaaatga

SEQ ID NO: 2984170 - DNA, 23 bp, Homo sapiens
ctaggaagaattttaaaaatgaa

SEQ ID NO: 2984171 - DNA, 23 bp, Homo sapiens
ctaggaccatggttaagagtcca

SEQ ID NO: 2984172 - DNA, 19 bp, Homo sapiens
ctaggattccccctgccct

SEQ ID NO: 2984173 - DNA, 20 bp, Homo sapiens
ctaggcactgtagttctaag

SEQ ID NO: 2984174 - DNA, 16 bp, Homo sapiens
ctaggcagtaggccgg

SEQ ID NO: 2984175 - DNA, 17 bp, Homo sapiens
ctaggccactcctccaa

SEQ ID NO: 2984176 - DNA, 15 bp, Homo sapiens
ctaggcccctgtgta

SEQ ID NO: 2984177 - DNA, 17 bp, Homo sapiens
ctaggcctcagccagag

SEQ ID NO: 2984178 - DNA, 17 bp, Homo sapiens
ctaggcctcctggccca

SEQ ID NO: 2984179 - DNA, 13 bp, Homo sapiens
ctaggcctgtagt

SEQ ID NO: 2984180 - DNA, 21 bp, Homo sapiens
ctcagcgggggccttgaagac

SEQ ID NO: 2984181 - DNA, 18 bp, Homo sapiens
ctcagctcggggagcctt

SEQ ID NO: 2984182 - DNA, 19 bp, Homo sapiens
ctcagctcggggagcctta

SEQ ID NO: 2984183 - DNA, 13 bp, Homo sapiens
ctcagctctggtc

SEQ ID NO: 2984184 - DNA, 14 bp, Homo sapiens
ctcagctctgtctg

SEQ ID NO: 2984185 - DNA, 20 bp, Homo sapiens
ctcagctcttggctccactg

SEQ ID NO: 2984186 - DNA, 18 bp, Homo sapiens
ctcagctgcatctgataa

SEQ ID NO: 2984187 - DNA, 19 bp, Homo sapiens
ctcagctgcatctgataaa

SEQ ID NO: 2984188 - DNA, 12 bp, Homo sapiens
ctcagctgctcc

SEQ ID NO: 2984189 - DNA, 13 bp, Homo sapiens
ctcagctgctccc

SEQ ID NO: 2984190 - DNA, 23 bp, Homo sapiens
ctcagctggatgatggtcttcag

SEQ ID NO: 2984191 - DNA, 20 bp, Homo sapiens
ctcagctgtcgggggccact

SEQ ID NO: 2984192 - DNA, 11 bp, Homo sapiens
ctcagctgtgg

SEQ ID NO: 2984193 - DNA, 18 bp, Homo sapiens
ctcagctgtggtcccacc

SEQ ID NO: 2984194 - DNA, 21 bp, Homo sapiens
ctcagctgtggtcccacccag

SEQ ID NO: 2984195 - DNA, 17 bp, Homo sapiens
ctcagcttgcagctgga

SEQ ID NO: 2984196 - DNA, 19 bp, Homo sapiens
ctcaggaaccgaggcaggg

SEQ ID NO: 2984197 - DNA, 13 bp, Homo sapiens
ctcaggaagaaca

SEQ ID NO: 2984198 - DNA, 15 bp, Homo sapiens
ctcaggaagccccca

SEQ ID NO: 2984199 - DNA, 16 bp, Homo sapiens
ctcaggaattccaatt

SEQ ID NO: 2984200 - DNA, 12 bp, Homo sapiens
ctcaggacagat

SEQ ID NO: 2984201 - DNA, 16 bp, Homo sapiens
ctcaggacagatgcca

SEQ ID NO: 2984202 - DNA, 18 bp, Homo sapiens
ctcaggacagatgccaca

SEQ ID NO: 2984203 - DNA, 21 bp, Homo sapiens
ctcaggaccaaagctttcatg

SEQ ID NO: 2984204 - DNA, 12 bp, Homo sapiens
ctcaggagcagg

SEQ ID NO: 2984205 - DNA, 13 bp, Homo sapiens
ctcaggaggaggc

SEQ ID NO: 2984206 - DNA, 14 bp, Homo sapiens
ctcaggaggaggct

SEQ ID NO: 2984207 - DNA, 18 bp, Homo sapiens
ctcaggaggcaggacctt

SEQ ID NO: 2984208 - DNA, 19 bp, Homo sapiens
ctcaggaggctgagacagg

SEQ ID NO: 2984209 - DNA, 20 bp, Homo sapiens
ctcaggaggctgagacagga

SEQ ID NO: 2984210 - DNA, 19 bp, Homo sapiens
ctcaggaggctgaggcaga

SEQ ID NO: 2984211 - DNA, 20 bp, Homo sapiens
ctcaggaggctgaggcagaa

SEQ ID NO: 2984212 - DNA, 23 bp, Homo sapiens
ctcaggagtggggttgggggaca

SEQ ID NO: 2984213 - DNA, 14 bp, Homo sapiens
ctcaggcacacagc

SEQ ID NO: 2984214 - DNA, 18 bp, Homo sapiens
ctcaggccagagccaagg

SEQ ID NO: 2984215 - DNA, 13 bp, Homo sapiens
ctcaggcccagct

SEQ ID NO: 2984216 - DNA, 11 bp, Homo sapiens
ctcaggctccg

SEQ ID NO: 2984217 - DNA, 13 bp, Homo sapiens
ctcaggctctcca

SEQ ID NO: 2984218 - DNA, 13 bp, Homo sapiens
ctcaggctgtccc

SEQ ID NO: 2984219 - DNA, 19 bp, Homo sapiens
ctcaggctgtcccaagctc

SEQ ID NO: 2984220 - DNA, 22 bp, Homo sapiens
ctcagggatgtgggaatctccc

SEQ ID NO: 2984221 - DNA, 10 bp, Homo sapiens
ctcagggcag

SEQ ID NO: 2984222 - DNA, 20 bp, Homo sapiens
ctcagggcagcgccaggctg

SEQ ID NO: 2984223 - DNA, 16 bp, Homo sapiens
ctcagggcagctgcct

SEQ ID NO: 2984224 - DNA, 15 bp, Homo sapiens
ctcagggctcctggg

SEQ ID NO: 2984225 - DNA, 17 bp, Homo sapiens
ctcagggctcctgggtt

SEQ ID NO: 2984226 - DNA, 15 bp, Homo sapiens
ctcaggggaagctgc

SEQ ID NO: 2984227 - DNA, 16 bp, Homo sapiens
ctcaggggaagctgct

SEQ ID NO: 2984228 - DNA, 21 bp, Homo sapiens
ctcaggggacactggccccac

SEQ ID NO: 2984229 - DNA, 18 bp, Homo sapiens
ctcaggggatgtttacct

SEQ ID NO: 2984230 - DNA, 20 bp, Homo sapiens
ctcaggtggccatgcctcag

SEQ ID NO: 2984231 - DNA, 21 bp, Homo sapiens
ctcaggtggccatgcctcagc

SEQ ID NO: 2984232 - DNA, 21 bp, Homo sapiens
ctcaggtggtgtccttcttcc

SEQ ID NO: 2984233 - DNA, 23 bp, Homo sapiens
ctcaggtggtgtccttcttcctc

SEQ ID NO: 2984234 - DNA, 20 bp, Homo sapiens
ctcaggttagggctctgccc

SEQ ID NO: 2984235 - DNA, 17 bp, Homo sapiens
ctcagtactttggaggc

SEQ ID NO: 2984236 - DNA, 19 bp, Homo sapiens
ctcagtactttggaggccc

SEQ ID NO: 2984237 - DNA, 12 bp, Homo sapiens
ctcagtcccaaa

SEQ ID NO: 2984238 - DNA, 12 bp, Homo sapiens
ctcagtcgccct

SEQ ID NO: 2984239 - DNA, 18 bp, Homo sapiens
ctcagtcgccctgttctt

SEQ ID NO: 2984240 - DNA, 13 bp, Homo sapiens
ctcagtctctgag

SEQ ID NO: 2984241 - DNA, 14 bp, Homo sapiens
ctcagtctctgagc

SEQ ID NO: 2984242 - DNA, 20 bp, Homo sapiens
ctcagtctctgagcagtgaa

SEQ ID NO: 2984243 - DNA, 18 bp, Homo sapiens
ctcagtctgttcactgca

SEQ ID NO: 2984244 - DNA, 21 bp, Homo sapiens
ctcagtctgttcactgcattc

SEQ ID NO: 2984245 - DNA, 19 bp, Homo sapiens
ctcagtgaaggcccatgaa

SEQ ID NO: 2984246 - DNA, 20 bp, Homo sapiens
ctcagtgcaaaatgtcttgt

SEQ ID NO: 2984247 - DNA, 21 bp, Homo sapiens
ctcagtgcaaaatgtcttgtg

SEQ ID NO: 2984248 - DNA, 22 bp, Homo sapiens
ctcagtgcaaaatgtcttgtgt

SEQ ID NO: 2984249 - DNA, 23 bp, Homo sapiens
ctcagtgcaacctctgcttccca

SEQ ID NO: 2984250 - DNA, 15 bp, Homo sapiens
ctcagtgcagatgga

SEQ ID NO: 2984251 - DNA, 16 bp, Homo sapiens
ctcagtgcatttgtgc

SEQ ID NO: 2984252 - DNA, 21 bp, Homo sapiens
ctcagtgccaactgtggctgg

SEQ ID NO: 2984253 - DNA, 22 bp, Homo sapiens
ctcagtgccaactgtggctggt

SEQ ID NO: 2984254 - DNA, 14 bp, Homo sapiens
ctcagtgccttctc

SEQ ID NO: 2984255 - DNA, 15 bp, Homo sapiens
ctcagtgccttctct

SEQ ID NO: 2984256 - DNA, 21 bp, Homo sapiens
ctcagtgccttctctcagctc

SEQ ID NO: 2984257 - DNA, 12 bp, Homo sapiens
ctcagtgttttg

SEQ ID NO: 2984258 - DNA, 18 bp, Homo sapiens
ctcagttctcaaatgtgt

SEQ ID NO: 2984259 - DNA, 14 bp, Homo sapiens
ctcagttctgcctt

SEQ ID NO: 2984260 - DNA, 12 bp, Homo sapiens
ctcagttgtgca

SEQ ID NO: 2984261 - DNA, 14 bp, Homo sapiens
ctcataaacatttg

SEQ ID NO: 2984262 - DNA, 18 bp, Homo sapiens
ctcataaattaatgattc

SEQ ID NO: 2984263 - DNA, 15 bp, Homo sapiens
ctcataatgtgaagt

SEQ ID NO: 2984264 - DNA, 23 bp, Homo sapiens
ctcatagcatgatattgttctcc

SEQ ID NO: 2984265 - DNA, 14 bp, Homo sapiens
ctcatatgttccca

SEQ ID NO: 2984266 - DNA, 12 bp, Homo sapiens
ctcatcactgtg

SEQ ID NO: 2984267 - DNA, 15 bp, Homo sapiens
ctcatcagaactgaa

SEQ ID NO: 2984268 - DNA, 20 bp, Homo sapiens
ctcatcattctctgtctcat

SEQ ID NO: 2984269 - DNA, 14 bp, Homo sapiens
ctcatcatttgtgg

SEQ ID NO: 2984270 - DNA, 16 bp, Homo sapiens
ctcatccatcatcatg

SEQ ID NO: 2984271 - DNA, 16 bp, Homo sapiens
ctcatcctcagatgct

SEQ ID NO: 2984272 - DNA, 22 bp, Homo sapiens
ctcatcctcagatgctcaaagt

SEQ ID NO: 2984273 - DNA, 17 bp, Homo sapiens
ctcatcctcctcctcat

SEQ ID NO: 2984274 - DNA, 16 bp, Homo sapiens
ctcatcctgaacagca

SEQ ID NO: 2984275 - DNA, 18 bp, Homo sapiens
ctcatcctgaacagcatg

SEQ ID NO: 2984276 - DNA, 12 bp, Homo sapiens
ctcatcctgctt

SEQ ID NO: 2984277 - DNA, 17 bp, Homo sapiens
ctcatcgggcccaggga

SEQ ID NO: 2984278 - DNA, 18 bp, Homo sapiens
ctcatcgggcccagggac

SEQ ID NO: 2984279 - DNA, 20 bp, Homo sapiens
ctcatcgtcttttagttcca

SEQ ID NO: 2984280 - DNA, 12 bp, Homo sapiens
ctcatctcaggt

SEQ ID NO: 2984281 - DNA, 17 bp, Homo sapiens
ctcatctctctgcccaa

SEQ ID NO: 2984282 - DNA, 18 bp, Homo sapiens
ctcatctgtccctccggg

SEQ ID NO: 2984283 - DNA, 12 bp, Homo sapiens
ctcatctgtgat

SEQ ID NO: 2984284 - DNA, 13 bp, Homo sapiens
ctcatctgtgcct

SEQ ID NO: 2984285 - DNA, 18 bp, Homo sapiens
ctcatctgtgcctgtctg

SEQ ID NO: 2984286 - DNA, 12 bp, Homo sapiens
ctcatctttatc

SEQ ID NO: 2984287 - DNA, 14 bp, Homo sapiens
ctcatctttatcct

SEQ ID NO: 2984288 - DNA, 20 bp, Homo sapiens
ctcatgatccacccacctca

SEQ ID NO: 2984289 - DNA, 16 bp, Homo sapiens
ctcatgcccctggctg

SEQ ID NO: 2984290 - DNA, 22 bp, Homo sapiens
ctcatggcaggattctagcctg

SEQ ID NO: 2984291 - DNA, 13 bp, Homo sapiens
ctcatgggacctg

SEQ ID NO: 2984292 - DNA, 18 bp, Homo sapiens
ctcatgggacctgccctc

SEQ ID NO: 2984293 - DNA, 23 bp, Homo sapiens
ctcatgtatattacccaatggaa

SEQ ID NO: 2984294 - DNA, 12 bp, Homo sapiens
ctcatgtgtatg

SEQ ID NO: 2984295 - DNA, 15 bp, Homo sapiens
ctcatgttctgcttt

SEQ ID NO: 2984296 - DNA, 16 bp, Homo sapiens
ctcatgttctgctttc

SEQ ID NO: 2984297 - DNA, 16 bp, Homo sapiens
ctcatgttttcaactg

SEQ ID NO: 2984298 - DNA, 17 bp, Homo sapiens
ctcatgttttcaactgc

SEQ ID NO: 2984299 - DNA, 18 bp, Homo sapiens
ctcatgttttcaactgcc

SEQ ID NO: 2984300 - DNA, 20 bp, Homo sapiens
ctcatgttttcaactgccaa

SEQ ID NO: 2984301 - DNA, 17 bp, Homo sapiens
ctcatgttttccattgt

SEQ ID NO: 2984302 - DNA, 15 bp, Homo sapiens
ctcattaatgacact

SEQ ID NO: 2984303 - DNA, 17 bp, Homo sapiens
ctcattccacactgttg

SEQ ID NO: 2984304 - DNA, 19 bp, Homo sapiens
ctcattctgaaggagcccc

SEQ ID NO: 2984305 - DNA, 15 bp, Homo sapiens
ctcattgaaatgtaa

SEQ ID NO: 2984306 - DNA, 22 bp, Homo sapiens
ctcattgaaatgtaatttcagt

SEQ ID NO: 2984307 - DNA, 12 bp, Homo sapiens
ctcattgcattt

SEQ ID NO: 2984308 - DNA, 16 bp, Homo sapiens
ctcattgctgagcctc

SEQ ID NO: 2984309 - DNA, 13 bp, Homo sapiens
ctcattgctgccc

SEQ ID NO: 2984310 - DNA, 15 bp, Homo sapiens
ctcatttgtttttct

SEQ ID NO: 2984311 - DNA, 21 bp, Homo sapiens
ctccaaaccctcgaggcggat

SEQ ID NO: 2984312 - DNA, 16 bp, Homo sapiens
ctccaacaccaagcac

SEQ ID NO: 2984313 - DNA, 14 bp, Homo sapiens
ctcccacggggacc

SEQ ID NO: 2984314 - DNA, 19 bp, Homo sapiens
ctcccacggggaccactgg

SEQ ID NO: 2984315 - DNA, 13 bp, Homo sapiens
ctcccactcctaa

SEQ ID NO: 2984316 - DNA, 16 bp, Homo sapiens
ctcccactcctaatca

SEQ ID NO: 2984317 - DNA, 24 bp, Homo sapiens
ctcccagaacacactccatcagct

SEQ ID NO: 2984318 - DNA, 18 bp, Homo sapiens
ctcccagacttgtttcct

SEQ ID NO: 2984319 - DNA, 19 bp, Homo sapiens
ctcccagacttgtttcctg

SEQ ID NO: 2984320 - DNA, 12 bp, Homo sapiens
ctcccagaggcg

SEQ ID NO: 2984321 - DNA, 17 bp, Homo sapiens
ctcccagagtgctggga

SEQ ID NO: 2984322 - DNA, 16 bp, Homo sapiens
ctcccagctctgagga

SEQ ID NO: 2984323 - DNA, 21 bp, Homo sapiens
ctcccaggactctgaccccag

SEQ ID NO: 2984324 - DNA, 20 bp, Homo sapiens
ctcccaggccaacagtagcc

SEQ ID NO: 2984325 - DNA, 22 bp, Homo sapiens
ctcccaggtgttaacattccaa

SEQ ID NO: 2984326 - DNA, 15 bp, Homo sapiens
ctcccagtgccttct

SEQ ID NO: 2984327 - DNA, 17 bp, Homo sapiens
ctcccatcctccagccc

SEQ ID NO: 2984328 - DNA, 19 bp, Homo sapiens
ctcccatcctccagccctg

SEQ ID NO: 2984329 - DNA, 16 bp, Homo sapiens
ctcccatggtccctag

SEQ ID NO: 2984330 - DNA, 15 bp, Homo sapiens
ctcccattcctgaag

SEQ ID NO: 2984331 - DNA, 19 bp, Homo sapiens
ctcccattcctgaagaacc

SEQ ID NO: 2984332 - DNA, 19 bp, Homo sapiens
ctccccaaagccactggaa

SEQ ID NO: 2984333 - DNA, 20 bp, Homo sapiens
ctccccaaagccactggaag

SEQ ID NO: 2984334 - DNA, 20 bp, Homo sapiens
ctccccaatgagacttgcct

SEQ ID NO: 2984335 - DNA, 21 bp, Homo sapiens
ctccccaatgagacttgcctt

SEQ ID NO: 2984336 - DNA, 16 bp, Homo sapiens
ctccccaccagagctg

SEQ ID NO: 2984337 - DNA, 19 bp, Homo sapiens
ctccccaccagagctgcct

SEQ ID NO: 2984338 - DNA, 13 bp, Homo sapiens
ctccccacccaag

SEQ ID NO: 2984339 - DNA, 17 bp, Homo sapiens
ctccccaccctcctggc

SEQ ID NO: 2984340 - DNA, 23 bp, Homo sapiens
ctccccaccctcctggcctcaga

SEQ ID NO: 2984341 - DNA, 22 bp, Homo sapiens
ctccccagtagctgggattaca

SEQ ID NO: 2984342 - DNA, 21 bp, Homo sapiens
ctccccatcatccacgccaag

SEQ ID NO: 2984343 - DNA, 17 bp, Homo sapiens
ctcccccacgtctctct

SEQ ID NO: 2984344 - DNA, 19 bp, Homo sapiens
ctcccccacgtctctctgc

SEQ ID NO: 2984345 - DNA, 22 bp, Homo sapiens
ctcccccacgtctctctgcctg

SEQ ID NO: 2984346 - DNA, 21 bp, Homo sapiens
ctcccccccatgcactgtgaa

SEQ ID NO: 2984347 - DNA, 16 bp, Homo sapiens
ctcccccggctgggcc

SEQ ID NO: 2984348 - DNA, 11 bp, Homo sapiens
ctccccctcct

SEQ ID NO: 2984349 - DNA, 13 bp, Homo sapiens
ctccccctctgct

SEQ ID NO: 2984350 - DNA, 13 bp, Homo sapiens
ctccccctgccag

SEQ ID NO: 2984351 - DNA, 18 bp, Homo sapiens
ctccccctgccagtgcct

SEQ ID NO: 2984352 - DNA, 16 bp, Homo sapiens
ctcccccttaccccac

SEQ ID NO: 2984353 - DNA, 21 bp, Homo sapiens
ctccccgaggctgccccaggc

SEQ ID NO: 2984354 - DNA, 19 bp, Homo sapiens
ctcccctatccacccagcc

SEQ ID NO: 2984355 - DNA, 14 bp, Homo sapiens
ctcccctccatccc

SEQ ID NO: 2984356 - DNA, 17 bp, Homo sapiens
ctcccctccatccccat

SEQ ID NO: 2984357 - DNA, 16 bp, Homo sapiens
ctcccctctccttcct

SEQ ID NO: 2984358 - DNA, 12 bp, Homo sapiens
ctcccctgagga

SEQ ID NO: 2984359 - DNA, 23 bp, Homo sapiens
ctcccctgaggatcccctgtccc

SEQ ID NO: 2984360 - DNA, 16 bp, Homo sapiens
ctcccctgccagggca

SEQ ID NO: 2984361 - DNA, 20 bp, Homo sapiens
ctcccctgccgcctcccggg

SEQ ID NO: 2984362 - DNA, 19 bp, Homo sapiens
ctccccttcctcactgccc

SEQ ID NO: 2984363 - DNA, 12 bp, Homo sapiens
ctccccttctct

SEQ ID NO: 2984364 - DNA, 23 bp, Homo sapiens
ctccccttcttgtgtcctggctg

SEQ ID NO: 2984365 - DNA, 15 bp, Homo sapiens
ctccccttgcagcct

SEQ ID NO: 2984366 - DNA, 12 bp, Homo sapiens
ctccccttgccc

SEQ ID NO: 2984367 - DNA, 15 bp, Homo sapiens
ctccccttttgtcct

SEQ ID NO: 2984368 - DNA, 20 bp, Homo sapiens
ctcccgcaccttcctcctcc

SEQ ID NO: 2984369 - DNA, 19 bp, Homo sapiens
ctcccgccccgggctggcc

SEQ ID NO: 2984370 - DNA, 21 bp, Homo sapiens
ctcccgccccgggctggccct

SEQ ID NO: 2984371 - DNA, 13 bp, Homo sapiens
ctcccggacctgg

SEQ ID NO: 2984372 - DNA, 23 bp, Homo sapiens
ctcccgggactcactggcagccc

SEQ ID NO: 2984373 - DNA, 15 bp, Homo sapiens
ctcccgtctcgcctg

SEQ ID NO: 2984374 - DNA, 23 bp, Homo sapiens
ctccctaaccactaatgttagaa

SEQ ID NO: 2984375 - DNA, 21 bp, Homo sapiens
ctccctaaggcatgtgtgaaa

SEQ ID NO: 2984376 - DNA, 22 bp, Homo sapiens
ctccctaccacctccccagcct

SEQ ID NO: 2984377 - DNA, 14 bp, Homo sapiens
ctccctaccttgcc

SEQ ID NO: 2984378 - DNA, 14 bp, Homo sapiens
ctccctagatccag

SEQ ID NO: 2984379 - DNA, 23 bp, Homo sapiens
ctccctaggcccaagtctcctag

SEQ ID NO: 2984380 - DNA, 22 bp, Homo sapiens
ctccctagttagcatccaggct

SEQ ID NO: 2984381 - DNA, 24 bp, Homo sapiens
ctccctagttagcatccaggctgg

SEQ ID NO: 2984382 - DNA, 18 bp, Homo sapiens
ctccctatactgcttgga

SEQ ID NO: 2984383 - DNA, 19 bp, Homo sapiens
ctccctatatgcacccctg

SEQ ID NO: 2984384 - DNA, 22 bp, Homo sapiens
ctccctatatgcacccctggaa

SEQ ID NO: 2984385 - DNA, 16 bp, Homo sapiens
ctccctatcttgtgaa

SEQ ID NO: 2984386 - DNA, 15 bp, Homo sapiens
ctccctccactcctc

SEQ ID NO: 2984387 - DNA, 14 bp, Homo sapiens
ctccctcccaggac

SEQ ID NO: 2984388 - DNA, 17 bp, Homo sapiens
ctccctcccaggactct

SEQ ID NO: 2984389 - DNA, 17 bp, Homo sapiens
ctccctccccacccaag

SEQ ID NO: 2984390 - DNA, 13 bp, Homo sapiens
ctccctcccttcc

SEQ ID NO: 2984391 - DNA, 20 bp, Homo sapiens
ctccctcccttccttgggca

SEQ ID NO: 2984392 - DNA, 19 bp, Homo sapiens
ctccctccgcctcccatcc

SEQ ID NO: 2984393 - DNA, 12 bp, Homo sapiens
ctccctcctcac

SEQ ID NO: 2984394 - DNA, 15 bp, Homo sapiens
ctccctcctggagct

SEQ ID NO: 2984395 - DNA, 19 bp, Homo sapiens
ctccctctaggctctgcct

SEQ ID NO: 2984396 - DNA, 22 bp, Homo sapiens
ctccctctcactgtctgagagt

SEQ ID NO: 2984397 - DNA, 22 bp, Homo sapiens
ctccctctcccccttaccccac

SEQ ID NO: 2984398 - DNA, 15 bp, Homo sapiens
ctccctctctcctgg

SEQ ID NO: 2984399 - DNA, 16 bp, Homo sapiens
ctccctctctcctgga

SEQ ID NO: 2984400 - DNA, 14 bp, Homo sapiens
ctccctctgccggc

SEQ ID NO: 2984401 - DNA, 12 bp, Homo sapiens
ctccctctgcct

SEQ ID NO: 2984402 - DNA, 19 bp, Homo sapiens
ctccctctgcctcatcctc

SEQ ID NO: 2984403 - DNA, 21 bp, Homo sapiens
ctccctctgcctcatcctcct

SEQ ID NO: 2984404 - DNA, 23 bp, Homo sapiens
ctccctctgcctcatcctcctcc

SEQ ID NO: 2984405 - DNA, 13 bp, Homo sapiens
ctccctcttcttt

SEQ ID NO: 2984406 - DNA, 19 bp, Homo sapiens
ctccctctttctagcctgg

SEQ ID NO: 2984407 - DNA, 22 bp, Homo sapiens
ctccctctttctagcctggggc

SEQ ID NO: 2984408 - DNA, 23 bp, Homo sapiens
ctccctctttctagcctggggct

SEQ ID NO: 2984409 - DNA, 19 bp, Homo sapiens
ctccctgaaacactgcttc

SEQ ID NO: 2984410 - DNA, 23 bp, Homo sapiens
ctccctgaccctgtatatagccc

SEQ ID NO: 2984411 - DNA, 13 bp, Homo sapiens
ctccctgccatcc

SEQ ID NO: 2984412 - DNA, 23 bp, Homo sapiens
ctccctgccatccccctctcacg

SEQ ID NO: 2984413 - DNA, 13 bp, Homo sapiens
ctccctgcctcac

SEQ ID NO: 2984414 - DNA, 16 bp, Homo sapiens
ctccctgcctcacatc

SEQ ID NO: 2984415 - DNA, 18 bp, Homo sapiens
ctccctgcctcacatctc

SEQ ID NO: 2984416 - DNA, 14 bp, Homo sapiens
ctccctgcctcagc

SEQ ID NO: 2984417 - DNA, 15 bp, Homo sapiens
ctccctgcctccacc

SEQ ID NO: 2984418 - DNA, 16 bp, Homo sapiens
ctccctgcctccaccc

SEQ ID NO: 2984419 - DNA, 18 bp, Homo sapiens
ctccctgcgcttcctgag

SEQ ID NO: 2984420 - DNA, 21 bp, Homo sapiens
ctccctgcgcttcctgagcag

SEQ ID NO: 2984421 - DNA, 17 bp, Homo sapiens
ctccctggcagacacaa

SEQ ID NO: 2984422 - DNA, 14 bp, Homo sapiens
ctccctggccttgc

SEQ ID NO: 2984423 - DNA, 16 bp, Homo sapiens
ctccctggccttgccc

SEQ ID NO: 2984424 - DNA, 13 bp, Homo sapiens
ctccctggctgca

SEQ ID NO: 2984425 - DNA, 15 bp, Homo sapiens
ctccctggctgcagc

SEQ ID NO: 2984426 - DNA, 19 bp, Homo sapiens
ctccctggctgcagcctcc

SEQ ID NO: 2984427 - DNA, 20 bp, Homo sapiens
ctccctggctgcagcctccg

SEQ ID NO: 2984428 - DNA, 11 bp, Homo sapiens
ctccctgggcc

SEQ ID NO: 2984429 - DNA, 11 bp, Homo sapiens
ctccctgtcct

SEQ ID NO: 2984430 - DNA, 15 bp, Homo sapiens
ctccctgtcctcctc

SEQ ID NO: 2984431 - DNA, 17 bp, Homo sapiens
ctccctgttccccagag

SEQ ID NO: 2984432 - DNA, 19 bp, Homo sapiens
ctccctgttccccagagaa

SEQ ID NO: 2984433 - DNA, 14 bp, Homo sapiens
ctcccttccacctc

SEQ ID NO: 2984434 - DNA, 18 bp, Homo sapiens
ctcccttccttgggcaga

SEQ ID NO: 2984435 - DNA, 18 bp, Homo sapiens
ctcccttcgctctgctgg

SEQ ID NO: 2984436 - DNA, 22 bp, Homo sapiens
ctcccttcggtggaagagctca

SEQ ID NO: 2984437 - DNA, 14 bp, Homo sapiens
ctcccttctgctac

SEQ ID NO: 2984438 - DNA, 16 bp, Homo sapiens
ctcccttctgctactg

SEQ ID NO: 2984439 - DNA, 17 bp, Homo sapiens
ctcccttggcccagaga

SEQ ID NO: 2984440 - DNA, 13 bp, Homo sapiens
ctcccttggcttt

SEQ ID NO: 2984441 - DNA, 14 bp, Homo sapiens
ctcccttgggctcc

SEQ ID NO: 2984442 - DNA, 13 bp, Homo sapiens
ctcccttgtgttc

SEQ ID NO: 2984443 - DNA, 15 bp, Homo sapiens
ctcccttgtgttcct

SEQ ID NO: 2984444 - DNA, 17 bp, Homo sapiens
ctcccttgtgttccttc

SEQ ID NO: 2984445 - DNA, 23 bp, Homo sapiens
ctctgagacaaaagaaaaaatat

SEQ ID NO: 2984446 - DNA, 15 bp, Homo sapiens
ctctgagagtctaga

SEQ ID NO: 2984447 - DNA, 18 bp, Homo sapiens
ctctgagagtctagattc

SEQ ID NO: 2984448 - DNA, 14 bp, Homo sapiens
ctctgagctgggga

SEQ ID NO: 2984449 - DNA, 12 bp, Homo sapiens
ctctgagcttct

SEQ ID NO: 2984450 - DNA, 20 bp, Homo sapiens
ctctgagctttgttactgaa

SEQ ID NO: 2984451 - DNA, 17 bp, Homo sapiens
ctctgagtatctcctcg

SEQ ID NO: 2984452 - DNA, 17 bp, Homo sapiens
ctctgagtcctggccca

SEQ ID NO: 2984453 - DNA, 18 bp, Homo sapiens
ctctgagtcctggcccaa

SEQ ID NO: 2984454 - DNA, 14 bp, Homo sapiens
ctctgagtgtctct

SEQ ID NO: 2984455 - DNA, 24 bp, Homo sapiens
ctctgagtgtctctgcctggagca

SEQ ID NO: 2984456 - DNA, 14 bp, Homo sapiens
ctctgattttctcc

SEQ ID NO: 2984457 - DNA, 17 bp, Homo sapiens
ctctgcaagtgtctgga

SEQ ID NO: 2984458 - DNA, 14 bp, Homo sapiens
ctctgcacccagaa

SEQ ID NO: 2984459 - DNA, 13 bp, Homo sapiens
ctctgcaccggac

SEQ ID NO: 2984460 - DNA, 17 bp, Homo sapiens
ctctgcagccagcccag

SEQ ID NO: 2984461 - DNA, 18 bp, Homo sapiens
ctctgcagccagcccagc

SEQ ID NO: 2984462 - DNA, 19 bp, Homo sapiens
ctctgcagccagcccagcc

SEQ ID NO: 2984463 - DNA, 13 bp, Homo sapiens
ctctgcagggccg

SEQ ID NO: 2984464 - DNA, 21 bp, Homo sapiens
ctctgcagtcgcttgccaaag

SEQ ID NO: 2984465 - DNA, 22 bp, Homo sapiens
ctctgcagtcgcttgccaaagc

SEQ ID NO: 2984466 - DNA, 12 bp, Homo sapiens
ctctgccacctc

SEQ ID NO: 2984467 - DNA, 13 bp, Homo sapiens
ctctgccacctcc

SEQ ID NO: 2984468 - DNA, 18 bp, Homo sapiens
ctctgccacctcccctat

SEQ ID NO: 2984469 - DNA, 19 bp, Homo sapiens
ctctgccagtcgggagagc

SEQ ID NO: 2984470 - DNA, 14 bp, Homo sapiens
ctctgcccaaccct

SEQ ID NO: 2984471 - DNA, 20 bp, Homo sapiens
ctctgcccaacccttccctc

SEQ ID NO: 2984472 - DNA, 15 bp, Homo sapiens
ctctgcccacctctc

SEQ ID NO: 2984473 - DNA, 17 bp, Homo sapiens
ctctgcccagccgggca

SEQ ID NO: 2984474 - DNA, 22 bp, Homo sapiens
ctctgccccatcctccagcagg

SEQ ID NO: 2984475 - DNA, 14 bp, Homo sapiens
ctctgccctctgct

SEQ ID NO: 2984476 - DNA, 17 bp, Homo sapiens
ctctgccgccgcccgct

SEQ ID NO: 2984477 - DNA, 22 bp, Homo sapiens
ctctgccgccgcccgctgggga

SEQ ID NO: 2984478 - DNA, 14 bp, Homo sapiens
ctctgccgctacct

SEQ ID NO: 2984479 - DNA, 13 bp, Homo sapiens
ctctgccggctct

SEQ ID NO: 2984480 - DNA, 17 bp, Homo sapiens
ctctgccgtctctggag

SEQ ID NO: 2984481 - DNA, 10 bp, Homo sapiens
ctctgcctca

SEQ ID NO: 2984482 - DNA, 15 bp, Homo sapiens
ctctgcctcatcctc

SEQ ID NO: 2984483 - DNA, 16 bp, Homo sapiens
ctctgcctcatcctcc

SEQ ID NO: 2984484 - DNA, 19 bp, Homo sapiens
ctctgcctcatcctcctcc

SEQ ID NO: 2984485 - DNA, 21 bp, Homo sapiens
ctctgcctcatcctcctcctc

SEQ ID NO: 2984486 - DNA, 12 bp, Homo sapiens
ctctgcctcctc

SEQ ID NO: 2984487 - DNA, 16 bp, Homo sapiens
ctctgcctcctgggtt

SEQ ID NO: 2984488 - DNA, 16 bp, Homo sapiens
ctctgcctctaactcc

SEQ ID NO: 2984489 - DNA, 19 bp, Homo sapiens
ctctgcctctaactccctc

SEQ ID NO: 2984490 - DNA, 10 bp, Homo sapiens
ctctgcctgc

SEQ ID NO: 2984491 - DNA, 13 bp, Homo sapiens
ctctgcctgcact

SEQ ID NO: 2984492 - DNA, 18 bp, Homo sapiens
ctctgcctgcactccctg

SEQ ID NO: 2984493 - DNA, 12 bp, Homo sapiens
ctctgcctgcct

SEQ ID NO: 2984494 - DNA, 18 bp, Homo sapiens
ctctgcctggagcagggg

SEQ ID NO: 2984495 - DNA, 14 bp, Homo sapiens
ctctgcctttgagt

SEQ ID NO: 2984496 - DNA, 16 bp, Homo sapiens
ctctgcgccaggcaga

SEQ ID NO: 2984497 - DNA, 19 bp, Homo sapiens
ctctgcgccaggcagagct

SEQ ID NO: 2984498 - DNA, 22 bp, Homo sapiens
ctctgcgccaggcagagctgag

SEQ ID NO: 2984499 - DNA, 19 bp, Homo sapiens
ctctgcggcccgggccgac

SEQ ID NO: 2984500 - DNA, 13 bp, Homo sapiens
ctctgctccacct

SEQ ID NO: 2984501 - DNA, 19 bp, Homo sapiens
ctctgctccacctttcagc

SEQ ID NO: 2984502 - DNA, 12 bp, Homo sapiens
ctctgctgaaga

SEQ ID NO: 2984503 - DNA, 15 bp, Homo sapiens
ctctgctgcctgtac

SEQ ID NO: 2984504 - DNA, 15 bp, Homo sapiens
ctctgctggtctctg

SEQ ID NO: 2984505 - DNA, 23 bp, Homo sapiens
ctctgcttccatggcttcctgag

SEQ ID NO: 2984506 - DNA, 14 bp, Homo sapiens
ctctgcttcccagg

SEQ ID NO: 2984507 - DNA, 14 bp, Homo sapiens
ctctgcttctcacg

SEQ ID NO: 2984508 - DNA, 19 bp, Homo sapiens
ctctgcttgacaacatctg

SEQ ID NO: 2984509 - DNA, 20 bp, Homo sapiens
ctctggacagatggacgcag

SEQ ID NO: 2984510 - DNA, 15 bp, Homo sapiens
ctctggacagcccca

SEQ ID NO: 2984511 - DNA, 16 bp, Homo sapiens
ctctggacgtgaaata

SEQ ID NO: 2984512 - DNA, 16 bp, Homo sapiens
ctctggagcccctcct

SEQ ID NO: 2984513 - DNA, 20 bp, Homo sapiens
ctctggatcccgttcagaaa

SEQ ID NO: 2984514 - DNA, 18 bp, Homo sapiens
ctctggccctgccttctt

SEQ ID NO: 2984515 - DNA, 15 bp, Homo sapiens
ctctggctcagctgt

SEQ ID NO: 2984516 - DNA, 22 bp, Homo sapiens
ctctggctcagctgtggtccca

SEQ ID NO: 2984517 - DNA, 14 bp, Homo sapiens
ctctggctccaggc

SEQ ID NO: 2984518 - DNA, 21 bp, Homo sapiens
ctctggctgtaaggctctaga

SEQ ID NO: 2984519 - DNA, 16 bp, Homo sapiens
ctctggcttggcctat

SEQ ID NO: 2984520 - DNA, 13 bp, Homo sapiens
ctctgggaactga

SEQ ID NO: 2984521 - DNA, 19 bp, Homo sapiens
ctctgggatttatgctcat

SEQ ID NO: 2984522 - DNA, 22 bp, Homo sapiens
ctctgggatttatgctcatgaa

SEQ ID NO: 2984523 - DNA, 19 bp, Homo sapiens
ctctgggccaggttggaaa

SEQ ID NO: 2984524 - DNA, 14 bp, Homo sapiens
ctctgggggcagat

SEQ ID NO: 2984525 - DNA, 19 bp, Homo sapiens
ctctgggtacctgcaagca

SEQ ID NO: 2984526 - DNA, 23 bp, Homo sapiens
ctctgggtacctgcaagcagaac

SEQ ID NO: 2984527 - DNA, 14 bp, Homo sapiens
ctctggtcctcgga

SEQ ID NO: 2984528 - DNA, 17 bp, Homo sapiens
ctctggtcctcggagct

SEQ ID NO: 2984529 - DNA, 16 bp, Homo sapiens
ctctggtgataaggac

SEQ ID NO: 2984530 - DNA, 19 bp, Homo sapiens
ctctggtgataaggacatg

SEQ ID NO: 2984531 - DNA, 16 bp, Homo sapiens
ctctgtaaaagtgtct

SEQ ID NO: 2984532 - DNA, 15 bp, Homo sapiens
ctctgtaaccacctc

SEQ ID NO: 2984533 - DNA, 19 bp, Homo sapiens
ctctgtaaccacctctctg

SEQ ID NO: 2984534 - DNA, 21 bp, Homo sapiens
ctctgtaaccacctctctgtc

SEQ ID NO: 2984535 - DNA, 21 bp, Homo sapiens
ctctgtaatctcgtttcaaaa

SEQ ID NO: 2984536 - DNA, 19 bp, Homo sapiens
ctctgtaccccatgacctt

SEQ ID NO: 2984537 - DNA, 9 bp, Homo sapiens
ctctgtata

SEQ ID NO: 2984538 - DNA, 23 bp, Homo sapiens
ctctgtatatagctctacacaac

SEQ ID NO: 2984539 - DNA, 15 bp, Homo sapiens
ctctgtatattgggc

SEQ ID NO: 2984540 - DNA, 18 bp, Homo sapiens
ctctgtatattgggctca

SEQ ID NO: 2984541 - DNA, 13 bp, Homo sapiens
ctctgtatattta

SEQ ID NO: 2984542 - DNA, 17 bp, Homo sapiens
ctctgtcaccctggcca

SEQ ID NO: 2984543 - DNA, 14 bp, Homo sapiens
ctctgtcagtcaca

SEQ ID NO: 2984544 - DNA, 19 bp, Homo sapiens
ctctgtcagtgtgaaaatt

SEQ ID NO: 2984545 - DNA, 19 bp, Homo sapiens
ctctgtccagctcccgctg

SEQ ID NO: 2984546 - DNA, 19 bp, Homo sapiens
ctctgtccaggcactgaga

SEQ ID NO: 2984547 - DNA, 17 bp, Homo sapiens
ctctgtccccacgaggg

SEQ ID NO: 2984548 - DNA, 22 bp, Homo sapiens
ctctgtcctgttaggccaactg

SEQ ID NO: 2984549 - DNA, 15 bp, Homo sapiens
ctctgtctagcatgc

SEQ ID NO: 2984550 - DNA, 19 bp, Homo sapiens
ctctgtctagcatgccaac

SEQ ID NO: 2984551 - DNA, 14 bp, Homo sapiens
ctctgtctcatcca

SEQ ID NO: 2984552 - DNA, 13 bp, Homo sapiens
ctctgtctctgtg

SEQ ID NO: 2984553 - DNA, 14 bp, Homo sapiens
ctctgtctgtctct

SEQ ID NO: 2984554 - DNA, 23 bp, Homo sapiens
ctctgtctgtctctccccctctg

SEQ ID NO: 2984555 - DNA, 17 bp, Homo sapiens
ctctgtcttctctatcc

SEQ ID NO: 2984556 - DNA, 14 bp, Homo sapiens
ctctgtcttctctc

SEQ ID NO: 2984557 - DNA, 18 bp, Homo sapiens
ctctgtgaagcattcgag

SEQ ID NO: 2984558 - DNA, 21 bp, Homo sapiens
ctctgtgaatccatgggtctg

SEQ ID NO: 2984559 - DNA, 17 bp, Homo sapiens
ctctgtgaccaatgtct

SEQ ID NO: 2984560 - DNA, 13 bp, Homo sapiens
ctctgtgccttgg

SEQ ID NO: 2984561 - DNA, 20 bp, Homo sapiens
ctctgtggaaaagccatctc

SEQ ID NO: 2984562 - DNA, 16 bp, Homo sapiens
ctctgtggaggggccc

SEQ ID NO: 2984563 - DNA, 20 bp, Homo sapiens
ctctgtgggtctctggaaga

SEQ ID NO: 2984564 - DNA, 22 bp, Homo sapiens
ctctgtgtagccgccctgagag

SEQ ID NO: 2984565 - DNA, 19 bp, Homo sapiens
ctctgtgtatttatataaa

SEQ ID NO: 2984566 - DNA, 15 bp, Homo sapiens
ctctgtgtctaagat

SEQ ID NO: 2984567 - DNA, 13 bp, Homo sapiens
ctctgtgttttgt

SEQ ID NO: 2984568 - DNA, 22 bp, Homo sapiens
ctctgttacccagggtggagtg

SEQ ID NO: 2984569 - DNA, 14 bp, Homo sapiens
ctctgttcagtgta

SEQ ID NO: 2984570 - DNA, 13 bp, Homo sapiens
ctctgttccatgt

SEQ ID NO: 2984571 - DNA, 21 bp, Homo sapiens
ctctgttcctcaatggccttt

SEQ ID NO: 2984572 - DNA, 22 bp, Homo sapiens
ctctgttccttcacatcctgtg

SEQ ID NO: 2984573 - DNA, 14 bp, Homo sapiens
ctctgttgaatatt

SEQ ID NO: 2984574 - DNA, 15 bp, Homo sapiens
ctctgttgaatattt

SEQ ID NO: 2984575 - DNA, 14 bp, Homo sapiens
ctctgttgcccagg

SEQ ID NO: 2984576 - DNA, 22 bp, Homo sapiens
ctctgttgcccaggctggagtg

SEQ ID NO: 2984577 - DNA, 14 bp, Homo sapiens
ctctgttgcctcct

SEQ ID NO: 2984578 - DNA, 23 bp, Homo sapiens
ctgagggaccgagcccagcagat

SEQ ID NO: 2984579 - DNA, 12 bp, Homo sapiens
ctgagggagcct

SEQ ID NO: 2984580 - DNA, 20 bp, Homo sapiens
ctgagggagctccaactcag

SEQ ID NO: 2984581 - DNA, 11 bp, Homo sapiens
ctgagggaggg

SEQ ID NO: 2984582 - DNA, 14 bp, Homo sapiens
ctgagggagggagc

SEQ ID NO: 2984583 - DNA, 15 bp, Homo sapiens
ctgagggagggagcc

SEQ ID NO: 2984584 - DNA, 16 bp, Homo sapiens
ctgagggcagtcgata

SEQ ID NO: 2984585 - DNA, 16 bp, Homo sapiens
ctgagggcatctctga

SEQ ID NO: 2984586 - DNA, 15 bp, Homo sapiens
ctgaggggacgggca

SEQ ID NO: 2984587 - DNA, 19 bp, Homo sapiens
ctgaggggctggggagggg

SEQ ID NO: 2984588 - DNA, 13 bp, Homo sapiens
ctgaggggtgtcc

SEQ ID NO: 2984589 - DNA, 15 bp, Homo sapiens
ctgagggtgcccttt

SEQ ID NO: 2984590 - DNA, 19 bp, Homo sapiens
ctgaggtcaggagttcaag

SEQ ID NO: 2984591 - DNA, 21 bp, Homo sapiens
ctgaggtggtaggatcacctg

SEQ ID NO: 2984592 - DNA, 17 bp, Homo sapiens
ctgaggtgtctggcctg

SEQ ID NO: 2984593 - DNA, 22 bp, Homo sapiens
ctgaggttcccgacaccagaag

SEQ ID NO: 2984594 - DNA, 18 bp, Homo sapiens
ctgagtagatgcgcagcc

SEQ ID NO: 2984595 - DNA, 14 bp, Homo sapiens
ctgagtcaccagga

SEQ ID NO: 2984596 - DNA, 19 bp, Homo sapiens
ctgagtcagctgaccccct

SEQ ID NO: 2984597 - DNA, 21 bp, Homo sapiens
ctgagtccaagagggtccttt

SEQ ID NO: 2984598 - DNA, 17 bp, Homo sapiens
ctgagtccctccatgca

SEQ ID NO: 2984599 - DNA, 22 bp, Homo sapiens
ctgagtccgcctgcgcctccat

SEQ ID NO: 2984600 - DNA, 15 bp, Homo sapiens
ctgagtcctggccca

SEQ ID NO: 2984601 - DNA, 14 bp, Homo sapiens
ctgagtctccaggg

SEQ ID NO: 2984602 - DNA, 18 bp, Homo sapiens
ctgagtctggcaaacatg

SEQ ID NO: 2984603 - DNA, 14 bp, Homo sapiens
ctgagtgacagctt

SEQ ID NO: 2984604 - DNA, 11 bp, Homo sapiens
ctgagtgactc

SEQ ID NO: 2984605 - DNA, 14 bp, Homo sapiens
ctgagtgtctctgc

SEQ ID NO: 2984606 - DNA, 19 bp, Homo sapiens
ctgagtgtctctgcctgga

SEQ ID NO: 2984607 - DNA, 23 bp, Homo sapiens
ctgagtgtgggagtgcagagaaa

SEQ ID NO: 2984608 - DNA, 15 bp, Homo sapiens
ctgagtttcccttcc

SEQ ID NO: 2984609 - DNA, 16 bp, Homo sapiens
ctgagtttcccttcct

SEQ ID NO: 2984610 - DNA, 18 bp, Homo sapiens
ctgagttttccatggcag

SEQ ID NO: 2984611 - DNA, 22 bp, Homo sapiens
ctgagttttccatggcaggaag

SEQ ID NO: 2984612 - DNA, 17 bp, Homo sapiens
ctgagtttttcagatgt

SEQ ID NO: 2984613 - DNA, 17 bp, Homo sapiens
ctgataccatatgaatg

SEQ ID NO: 2984614 - DNA, 22 bp, Homo sapiens
ctgatagaaatggtttcctctg

SEQ ID NO: 2984615 - DNA, 14 bp, Homo sapiens
ctgataggaggggg

SEQ ID NO: 2984616 - DNA, 19 bp, Homo sapiens
ctgatagttactgttgtga

SEQ ID NO: 2984617 - DNA, 16 bp, Homo sapiens
ctgatatctgaatgtt

SEQ ID NO: 2984618 - DNA, 21 bp, Homo sapiens
ctgatatgatttaaaacatgt

SEQ ID NO: 2984619 - DNA, 23 bp, Homo sapiens
ctgatatgatttaaaacatgtaa

SEQ ID NO: 2984620 - DNA, 17 bp, Homo sapiens
ctgatattcagaattat

SEQ ID NO: 2984621 - DNA, 15 bp, Homo sapiens
ctgatcaatgacaga

SEQ ID NO: 2984622 - DNA, 17 bp, Homo sapiens
ctgatcaatgacagagc

SEQ ID NO: 2984623 - DNA, 17 bp, Homo sapiens
ctgatcagaccacggct

SEQ ID NO: 2984624 - DNA, 17 bp, Homo sapiens
ctgatcaggcttcctgg

SEQ ID NO: 2984625 - DNA, 18 bp, Homo sapiens
ctgatcatcgccagaggt

SEQ ID NO: 2984626 - DNA, 20 bp, Homo sapiens
ctgatcatttggctcttttt

SEQ ID NO: 2984627 - DNA, 20 bp, Homo sapiens
ctgatccagccctgagttcc

SEQ ID NO: 2984628 - DNA, 16 bp, Homo sapiens
ctgatcccagacctgt

SEQ ID NO: 2984629 - DNA, 20 bp, Homo sapiens
ctgatcccagtttctgctgt

SEQ ID NO: 2984630 - DNA, 19 bp, Homo sapiens
ctgatcccctttggtttta

SEQ ID NO: 2984631 - DNA, 12 bp, Homo sapiens
ctgatccctcta

SEQ ID NO: 2984632 - DNA, 17 bp, Homo sapiens
ctgatccctggccactg

SEQ ID NO: 2984633 - DNA, 18 bp, Homo sapiens
ctgatccctggccactga

SEQ ID NO: 2984634 - DNA, 18 bp, Homo sapiens
ctgatcctggaggcccag

SEQ ID NO: 2984635 - DNA, 19 bp, Homo sapiens
ctgatcctggaggcccagt

SEQ ID NO: 2984636 - DNA, 12 bp, Homo sapiens
ctgatctattta

SEQ ID NO: 2984637 - DNA, 18 bp, Homo sapiens
ctgatcttaagaggctga

SEQ ID NO: 2984638 - DNA, 20 bp, Homo sapiens
ctgatcttggaaaaacagcg

SEQ ID NO: 2984639 - DNA, 21 bp, Homo sapiens
ctgatgaaaatattctgattg

SEQ ID NO: 2984640 - DNA, 15 bp, Homo sapiens
ctgatgaatcactgt

SEQ ID NO: 2984641 - DNA, 23 bp, Homo sapiens
ctgatgcaggatttgttctctgt

SEQ ID NO: 2984642 - DNA, 17 bp, Homo sapiens
ctgatgccaaggggctg

SEQ ID NO: 2984643 - DNA, 18 bp, Homo sapiens
ctgatgccataaatacaa

SEQ ID NO: 2984644 - DNA, 20 bp, Homo sapiens
ctgatgccataaatacaaga

SEQ ID NO: 2984645 - DNA, 15 bp, Homo sapiens
ctgatgcgctgggat

SEQ ID NO: 2984646 - DNA, 23 bp, Homo sapiens
ctgatgctgaaataaactagggt

SEQ ID NO: 2984647 - DNA, 14 bp, Homo sapiens
ctgatgctgcccct

SEQ ID NO: 2984648 - DNA, 16 bp, Homo sapiens
ctgatggagagtgaga

SEQ ID NO: 2984649 - DNA, 21 bp, Homo sapiens
ctgatggattccaaaccagga

SEQ ID NO: 2984650 - DNA, 23 bp, Homo sapiens
ctgatggattccaaccttccttt

SEQ ID NO: 2984651 - DNA, 22 bp, Homo sapiens
ctgatgggcgtacgctggtgct

SEQ ID NO: 2984652 - DNA, 21 bp, Homo sapiens
ctgatggtgagcagtaactgt

SEQ ID NO: 2984653 - DNA, 16 bp, Homo sapiens
ctgatgttcagtgtaa

SEQ ID NO: 2984654 - DNA, 21 bp, Homo sapiens
ctgattaagttgtctaaacaa

SEQ ID NO: 2984655 - DNA, 14 bp, Homo sapiens
ctgattagataatc

SEQ ID NO: 2984656 - DNA, 20 bp, Homo sapiens
ctgattcactgcatggctcc

SEQ ID NO: 2984657 - DNA, 17 bp, Homo sapiens
ctgattccatcctgtgt

SEQ ID NO: 2984658 - DNA, 17 bp, Homo sapiens
ctgattgagaagttcat

SEQ ID NO: 2984659 - DNA, 19 bp, Homo sapiens
ctgattgagaagttcattg

SEQ ID NO: 2984660 - DNA, 17 bp, Homo sapiens
ctgattgtgccagtgca

SEQ ID NO: 2984661 - DNA, 19 bp, Homo sapiens
ctgattgtgccagtgcact

SEQ ID NO: 2984662 - DNA, 19 bp, Homo sapiens
ctgatttacctcttacctg

SEQ ID NO: 2984663 - DNA, 22 bp, Homo sapiens
ctgatttagcaatgctgtgaat

SEQ ID NO: 2984664 - DNA, 16 bp, Homo sapiens
ctgatttaggagaagc

SEQ ID NO: 2984665 - DNA, 17 bp, Homo sapiens
ctgatttaggagaagcc

SEQ ID NO: 2984666 - DNA, 17 bp, Homo sapiens
ctgatttattgaaattt

SEQ ID NO: 2984667 - DNA, 15 bp, Homo sapiens
ctgatttcaaatcat

SEQ ID NO: 2984668 - DNA, 12 bp, Homo sapiens
ctgatttctagg

SEQ ID NO: 2984669 - DNA, 11 bp, Homo sapiens
ctgatttgcag

SEQ ID NO: 2984670 - DNA, 17 bp, Homo sapiens
ctgatttgcaggatttt

SEQ ID NO: 2984671 - DNA, 17 bp, Homo sapiens
ctgatttgccactgata

SEQ ID NO: 2984672 - DNA, 22 bp, Homo sapiens
ctgatttgccactgatattcag

SEQ ID NO: 2984673 - DNA, 22 bp, Homo sapiens
ctgattttacaaattaatattt

SEQ ID NO: 2984674 - DNA, 15 bp, Homo sapiens
ctgcaacaacctttc

SEQ ID NO: 2984675 - DNA, 21 bp, Homo sapiens
ctgcaacacaacatttgtgtc

SEQ ID NO: 2984676 - DNA, 18 bp, Homo sapiens
ctgcaacagagagaaaaa

SEQ ID NO: 2984677 - DNA, 20 bp, Homo sapiens
ctgcaacagagagaaaaaga

SEQ ID NO: 2984678 - DNA, 15 bp, Homo sapiens
ctgcaacctctgcct

SEQ ID NO: 2984679 - DNA, 16 bp, Homo sapiens
ctgcaacctctgcctc

SEQ ID NO: 2984680 - DNA, 15 bp, Homo sapiens
ctgcaacctgttgat

SEQ ID NO: 2984681 - DNA, 17 bp, Homo sapiens
ctgcaaccttgcatcca

SEQ ID NO: 2984682 - DNA, 11 bp, Homo sapiens
ctgcaacttaa

SEQ ID NO: 2984683 - DNA, 17 bp, Homo sapiens
ctgcaagagccttggtg

SEQ ID NO: 2984684 - DNA, 23 bp, Homo sapiens
ctgcaagagccttggtgtccacc

SEQ ID NO: 2984685 - DNA, 19 bp, Homo sapiens
ctgcaagattctgaaacat

SEQ ID NO: 2984686 - DNA, 20 bp, Homo sapiens
ctgcaagattctgaaacatt

SEQ ID NO: 2984687 - DNA, 14 bp, Homo sapiens
ctgcaaggacattc

SEQ ID NO: 2984688 - DNA, 14 bp, Homo sapiens
ctgcaagggcccag

SEQ ID NO: 2984689 - DNA, 15 bp, Homo sapiens
ctgcaagggcccaga

SEQ ID NO: 2984690 - DNA, 19 bp, Homo sapiens
ctgcaagtgacatctcttt

SEQ ID NO: 2984691 - DNA, 17 bp, Homo sapiens
ctgcaagtgtctggagc

SEQ ID NO: 2984692 - DNA, 22 bp, Homo sapiens
ctgcaagtgtctggagcggctg

SEQ ID NO: 2984693 - DNA, 13 bp, Homo sapiens
ctgcaatcactgt

SEQ ID NO: 2984694 - DNA, 23 bp, Homo sapiens
ctgcaatcctgtctttctgagca

SEQ ID NO: 2984695 - DNA, 23 bp, Homo sapiens
ctgcaatgactgtggagttccat

SEQ ID NO: 2984696 - DNA, 14 bp, Homo sapiens
ctgcaatgagccat

SEQ ID NO: 2984697 - DNA, 21 bp, Homo sapiens
ctgcaatggtgactgatttca

SEQ ID NO: 2984698 - DNA, 15 bp, Homo sapiens
ctgcacaataaaacc

SEQ ID NO: 2984699 - DNA, 23 bp, Homo sapiens
ctgcacaataaaaccaagcctct

SEQ ID NO: 2984700 - DNA, 15 bp, Homo sapiens
ctgcacagattccca

SEQ ID NO: 2984701 - DNA, 16 bp, Homo sapiens
ctgcacagattcccag

SEQ ID NO: 2984702 - DNA, 22 bp, Homo sapiens
ctgcacagattcccaggccagg

SEQ ID NO: 2984703 - DNA, 18 bp, Homo sapiens
ctgcacaggtctctgttt

SEQ ID NO: 2984704 - DNA, 20 bp, Homo sapiens
ctgcacagtttagaacagag

SEQ ID NO: 2984705 - DNA, 24 bp, Homo sapiens
ctgcacagtttagaacagagggac

SEQ ID NO: 2984706 - DNA, 15 bp, Homo sapiens
ctgcacatagcagac

SEQ ID NO: 2984707 - DNA, 14 bp, Homo sapiens
ctgcacatgaagaa

SEQ ID NO: 2984708 - DNA, 14 bp, Homo sapiens
ctgcacatgtcttg

SEQ ID NO: 2984709 - DNA, 14 bp, Homo sapiens
ctgcaccaccatgc

SEQ ID NO: 2984710 - DNA, 13 bp, Homo sapiens
ctgctgcttccta

SEQ ID NO: 2984711 - DNA, 14 bp, Homo sapiens
ctgctgcttcctaa

SEQ ID NO: 2984712 - DNA, 12 bp, Homo sapiens
ctgctgcttctt

SEQ ID NO: 2984713 - DNA, 20 bp, Homo sapiens
ctgctggagtttcatgtaca

SEQ ID NO: 2984714 - DNA, 15 bp, Homo sapiens
ctgctggccggagca

SEQ ID NO: 2984715 - DNA, 14 bp, Homo sapiens
ctgctggcctccct

SEQ ID NO: 2984716 - DNA, 17 bp, Homo sapiens
ctgctggcctccctccg

SEQ ID NO: 2984717 - DNA, 14 bp, Homo sapiens
ctgctggcctgctc

SEQ ID NO: 2984718 - DNA, 16 bp, Homo sapiens
ctgctggcctgctctt

SEQ ID NO: 2984719 - DNA, 23 bp, Homo sapiens
ctgctggcctgctcttacttccc

SEQ ID NO: 2984720 - DNA, 16 bp, Homo sapiens
ctgctggctggtgcct

SEQ ID NO: 2984721 - DNA, 15 bp, Homo sapiens
ctgctgggctctcca

SEQ ID NO: 2984722 - DNA, 16 bp, Homo sapiens
ctgctgggctctccac

SEQ ID NO: 2984723 - DNA, 17 bp, Homo sapiens
ctgctgggctctccacc

SEQ ID NO: 2984724 - DNA, 19 bp, Homo sapiens
ctgctgggctctccacctc

SEQ ID NO: 2984725 - DNA, 15 bp, Homo sapiens
ctgctggggctggtg

SEQ ID NO: 2984726 - DNA, 10 bp, Homo sapiens
ctgctggggg

SEQ ID NO: 2984727 - DNA, 15 bp, Homo sapiens
ctgctgggggctccc

SEQ ID NO: 2984728 - DNA, 16 bp, Homo sapiens
ctgctgggggctcccc

SEQ ID NO: 2984729 - DNA, 21 bp, Homo sapiens
ctgctggggtctcaggtccag

SEQ ID NO: 2984730 - DNA, 14 bp, Homo sapiens
ctgctggtctctgg

SEQ ID NO: 2984731 - DNA, 18 bp, Homo sapiens
ctgctggtctctggctct

SEQ ID NO: 2984732 - DNA, 19 bp, Homo sapiens
ctgctggtctctggctcta

SEQ ID NO: 2984733 - DNA, 14 bp, Homo sapiens
ctgctgtcctggtg

SEQ ID NO: 2984734 - DNA, 20 bp, Homo sapiens
ctgctgtctaacctgtgacc

SEQ ID NO: 2984735 - DNA, 15 bp, Homo sapiens
ctgctgtctctctgg

SEQ ID NO: 2984736 - DNA, 14 bp, Homo sapiens
ctgctgtgctggga

SEQ ID NO: 2984737 - DNA, 14 bp, Homo sapiens
ctgctgtggagccc

SEQ ID NO: 2984738 - DNA, 21 bp, Homo sapiens
ctgctgtgtggacggcgctgc

SEQ ID NO: 2984739 - DNA, 12 bp, Homo sapiens
ctgctgttgaac

SEQ ID NO: 2984740 - DNA, 15 bp, Homo sapiens
ctgctgttgaacttt

SEQ ID NO: 2984741 - DNA, 22 bp, Homo sapiens
ctgctgttggtcctctctctgt

SEQ ID NO: 2984742 - DNA, 23 bp, Homo sapiens
ctgctgttggtcctctctctgtg

SEQ ID NO: 2984743 - DNA, 19 bp, Homo sapiens
ctgcttaaacttgacccag

SEQ ID NO: 2984744 - DNA, 12 bp, Homo sapiens
ctgcttaattca

SEQ ID NO: 2984745 - DNA, 15 bp, Homo sapiens
ctgcttatctgaaac

SEQ ID NO: 2984746 - DNA, 17 bp, Homo sapiens
ctgcttcaccagacttt

SEQ ID NO: 2984747 - DNA, 20 bp, Homo sapiens
ctgcttcagatgtggagcca

SEQ ID NO: 2984748 - DNA, 21 bp, Homo sapiens
ctgcttcatatctctcccttc

SEQ ID NO: 2984749 - DNA, 17 bp, Homo sapiens
ctgcttccaggctgggc

SEQ ID NO: 2984750 - DNA, 20 bp, Homo sapiens
ctgcttccatggcttcctga

SEQ ID NO: 2984751 - DNA, 13 bp, Homo sapiens
ctgcttcccaggt

SEQ ID NO: 2984752 - DNA, 10 bp, Homo sapiens
ctgcttccta

SEQ ID NO: 2984753 - DNA, 13 bp, Homo sapiens
ctgcttcctaact

SEQ ID NO: 2984754 - DNA, 14 bp, Homo sapiens
ctgcttcctaactt

SEQ ID NO: 2984755 - DNA, 19 bp, Homo sapiens
ctgcttctccatggccacc

SEQ ID NO: 2984756 - DNA, 22 bp, Homo sapiens
ctgcttctcggggtccagtgca

SEQ ID NO: 2984757 - DNA, 13 bp, Homo sapiens
ctgcttcttgctt

SEQ ID NO: 2984758 - DNA, 16 bp, Homo sapiens
ctgcttggagctgagc

SEQ ID NO: 2984759 - DNA, 15 bp, Homo sapiens
ctgcttggattcact

SEQ ID NO: 2984760 - DNA, 18 bp, Homo sapiens
ctgcttgggtggagaagc

SEQ ID NO: 2984761 - DNA, 22 bp, Homo sapiens
ctgcttgggtggagaagccatt

SEQ ID NO: 2984762 - DNA, 17 bp, Homo sapiens
ctgcttgtactaagcca

SEQ ID NO: 2984763 - DNA, 22 bp, Homo sapiens
ctgcttgtactaagccaggagg

SEQ ID NO: 2984764 - DNA, 15 bp, Homo sapiens
ctgcttgtgcctccc

SEQ ID NO: 2984765 - DNA, 19 bp, Homo sapiens
ctgcttgtgcctcccttcc

SEQ ID NO: 2984766 - DNA, 18 bp, Homo sapiens
ctgctttaaattaaaatt

SEQ ID NO: 2984767 - DNA, 20 bp, Homo sapiens
ctgctttacaggatcatgta

SEQ ID NO: 2984768 - DNA, 17 bp, Homo sapiens
ctgctttatcaggggac

SEQ ID NO: 2984769 - DNA, 15 bp, Homo sapiens
ctgctttccaaagcc

SEQ ID NO: 2984770 - DNA, 17 bp, Homo sapiens
ctgctttctctttcagt

SEQ ID NO: 2984771 - DNA, 15 bp, Homo sapiens
ctgctttctggtata

SEQ ID NO: 2984772 - DNA, 14 bp, Homo sapiens
ctgctttctgttca

SEQ ID NO: 2984773 - DNA, 15 bp, Homo sapiens
ctgctttctgttcat

SEQ ID NO: 2984774 - DNA, 16 bp, Homo sapiens
ctgctttgacgggcca

SEQ ID NO: 2984775 - DNA, 17 bp, Homo sapiens
ctgctttgacgggccag

SEQ ID NO: 2984776 - DNA, 12 bp, Homo sapiens
ctgcttttaagt

SEQ ID NO: 2984777 - DNA, 22 bp, Homo sapiens
ctgcttttccttggggcaggca

SEQ ID NO: 2984778 - DNA, 13 bp, Homo sapiens
ctgcttttggcct

SEQ ID NO: 2984779 - DNA, 12 bp, Homo sapiens
ctggaaacagag

SEQ ID NO: 2984780 - DNA, 18 bp, Homo sapiens
ctggaaacagaggtaaaa

SEQ ID NO: 2984781 - DNA, 17 bp, Homo sapiens
ctggaaaccaagtcagg

SEQ ID NO: 2984782 - DNA, 18 bp, Homo sapiens
ctggaaacttctgtaagg

SEQ ID NO: 2984783 - DNA, 13 bp, Homo sapiens
ctggaaaggaaag

SEQ ID NO: 2984784 - DNA, 17 bp, Homo sapiens
ctggaaatctggatttt

SEQ ID NO: 2984785 - DNA, 20 bp, Homo sapiens
ctggaaatgtaaaattgaaa

SEQ ID NO: 2984786 - DNA, 17 bp, Homo sapiens
ctggaacaaattatttt

SEQ ID NO: 2984787 - DNA, 19 bp, Homo sapiens
ctggaacaaattatttttg

SEQ ID NO: 2984788 - DNA, 15 bp, Homo sapiens
ctggaaccacctgga

SEQ ID NO: 2984789 - DNA, 18 bp, Homo sapiens
ctggaacccagactcaga

SEQ ID NO: 2984790 - DNA, 18 bp, Homo sapiens
ctggaacctcagcctggc

SEQ ID NO: 2984791 - DNA, 13 bp, Homo sapiens
ctggaacctttcc

SEQ ID NO: 2984792 - DNA, 20 bp, Homo sapiens
ctggaacttgaactgattca

SEQ ID NO: 2984793 - DNA, 17 bp, Homo sapiens
ctggaagaaccactgtc

SEQ ID NO: 2984794 - DNA, 14 bp, Homo sapiens
ctggaagaagcagc

SEQ ID NO: 2984795 - DNA, 14 bp, Homo sapiens
ctggaagaggtggg

SEQ ID NO: 2984796 - DNA, 22 bp, Homo sapiens
ctggaagcatttgtttctactt

SEQ ID NO: 2984797 - DNA, 22 bp, Homo sapiens
ctggaagctgtgtccttgcacc

SEQ ID NO: 2984798 - DNA, 13 bp, Homo sapiens
ctggaagggccaa

SEQ ID NO: 2984799 - DNA, 17 bp, Homo sapiens
ctggaagtattttcctc

SEQ ID NO: 2984800 - DNA, 18 bp, Homo sapiens
ctggaagtcaaataaatg

SEQ ID NO: 2984801 - DNA, 22 bp, Homo sapiens
ctggaagtcaaataaatgtttc

SEQ ID NO: 2984802 - DNA, 16 bp, Homo sapiens
ctggaagtccaatgtg

SEQ ID NO: 2984803 - DNA, 16 bp, Homo sapiens
ctggaataactcttac

SEQ ID NO: 2984804 - DNA, 23 bp, Homo sapiens
ctggaataatcctaaacatatga

SEQ ID NO: 2984805 - DNA, 15 bp, Homo sapiens
ctggaatggaaaagg

SEQ ID NO: 2984806 - DNA, 13 bp, Homo sapiens
ctggacacaggcc

SEQ ID NO: 2984807 - DNA, 17 bp, Homo sapiens
ctggacaccctcaccac

SEQ ID NO: 2984808 - DNA, 14 bp, Homo sapiens
ctggacagccccac

SEQ ID NO: 2984809 - DNA, 19 bp, Homo sapiens
ctggacagccccaccctgg

SEQ ID NO: 2984810 - DNA, 17 bp, Homo sapiens
ctggaccagacaatgtt

SEQ ID NO: 2984811 - DNA, 14 bp, Homo sapiens
ctggaccccctgcc

SEQ ID NO: 2984812 - DNA, 13 bp, Homo sapiens
ctggacccctgga

SEQ ID NO: 2984813 - DNA, 14 bp, Homo sapiens
ctggacccctggac

SEQ ID NO: 2984814 - DNA, 15 bp, Homo sapiens
ctggacccctggacc

SEQ ID NO: 2984815 - DNA, 16 bp, Homo sapiens
ctggacctctcttgtg

SEQ ID NO: 2984816 - DNA, 16 bp, Homo sapiens
ctggaccttgacagag

SEQ ID NO: 2984817 - DNA, 17 bp, Homo sapiens
ctggaccttgacagagc

SEQ ID NO: 2984818 - DNA, 20 bp, Homo sapiens
ctggaccttgacagagcagc

SEQ ID NO: 2984819 - DNA, 21 bp, Homo sapiens
ctggaccttgacagagcagct

SEQ ID NO: 2984820 - DNA, 21 bp, Homo sapiens
ctggacgaagagcaggccagc

SEQ ID NO: 2984821 - DNA, 23 bp, Homo sapiens
ctggactagagggacctctccca

SEQ ID NO: 2984822 - DNA, 14 bp, Homo sapiens
ctggactagggcct

SEQ ID NO: 2984823 - DNA, 19 bp, Homo sapiens
ctggactagggcctcggag

SEQ ID NO: 2984824 - DNA, 18 bp, Homo sapiens
ctggactccggccctcct

SEQ ID NO: 2984825 - DNA, 18 bp, Homo sapiens
ctggactctcagtctctg

SEQ ID NO: 2984826 - DNA, 21 bp, Homo sapiens
ctggactgacctggtccacag

SEQ ID NO: 2984827 - DNA, 17 bp, Homo sapiens
ctggactggttatcttg

SEQ ID NO: 2984828 - DNA, 20 bp, Homo sapiens
ctggactggttatcttgtta

SEQ ID NO: 2984829 - DNA, 21 bp, Homo sapiens
ctggactgttactgacttgga

SEQ ID NO: 2984830 - DNA, 23 bp, Homo sapiens
ctggactgttactgacttggatc

SEQ ID NO: 2984831 - DNA, 15 bp, Homo sapiens
ctggacttatttaaa

SEQ ID NO: 2984832 - DNA, 19 bp, Homo sapiens
ctggagacagaaccagcag

SEQ ID NO: 2984833 - DNA, 18 bp, Homo sapiens
ctggagaccagggagcct

SEQ ID NO: 2984834 - DNA, 19 bp, Homo sapiens
ctggagaccagggagcctt

SEQ ID NO: 2984835 - DNA, 13 bp, Homo sapiens
ctggagagcgagg

SEQ ID NO: 2984836 - DNA, 14 bp, Homo sapiens
ctggagagcgagga

SEQ ID NO: 2984837 - DNA, 18 bp, Homo sapiens
ctggagagcgaggaggcg

SEQ ID NO: 2984838 - DNA, 19 bp, Homo sapiens
ctggagcaacctactgtct

SEQ ID NO: 2984839 - DNA, 20 bp, Homo sapiens
ctggagcaacctactgtcta

SEQ ID NO: 2984840 - DNA, 23 bp, Homo sapiens
ctggagcaccaggcacgaaccca

SEQ ID NO: 2984841 - DNA, 18 bp, Homo sapiens
ctggagccacaggcaggg

SEQ ID NO: 2984842 - DNA, 16 bp, Homo sapiens
ctggagcccctcctcc

SEQ ID NO: 2984843 - DNA, 15 bp, Homo sapiens
ctgtatataaatggg

SEQ ID NO: 2984844 - DNA, 16 bp, Homo sapiens
ctgtatataaatggga

SEQ ID NO: 2984845 - DNA, 18 bp, Homo sapiens
ctgtatataaatgggaac

SEQ ID NO: 2984846 - DNA, 19 bp, Homo sapiens
ctgtatataaatgggaaca

SEQ ID NO: 2984847 - DNA, 15 bp, Homo sapiens
ctgtatatacttttt

SEQ ID NO: 2984848 - DNA, 16 bp, Homo sapiens
ctgtatatagcccagc

SEQ ID NO: 2984849 - DNA, 13 bp, Homo sapiens
ctgtatattgggc

SEQ ID NO: 2984850 - DNA, 16 bp, Homo sapiens
ctgtatattgggctca

SEQ ID NO: 2984851 - DNA, 12 bp, Homo sapiens
ctgtatatttat

SEQ ID NO: 2984852 - DNA, 14 bp, Homo sapiens
ctgtatcactgcct

SEQ ID NO: 2984853 - DNA, 16 bp, Homo sapiens
ctgtatcaggacccag

SEQ ID NO: 2984854 - DNA, 17 bp, Homo sapiens
ctgtatctgtagtgaga

SEQ ID NO: 2984855 - DNA, 14 bp, Homo sapiens
ctgtatgcaaagtc

SEQ ID NO: 2984856 - DNA, 15 bp, Homo sapiens
ctgtatggaatcaac

SEQ ID NO: 2984857 - DNA, 16 bp, Homo sapiens
ctgtatgtattagtga

SEQ ID NO: 2984858 - DNA, 12 bp, Homo sapiens
ctgtatgtctgt

SEQ ID NO: 2984859 - DNA, 17 bp, Homo sapiens
ctgtatgtctgtcattg

SEQ ID NO: 2984860 - DNA, 15 bp, Homo sapiens
ctgtattcagacaga

SEQ ID NO: 2984861 - DNA, 13 bp, Homo sapiens
ctgtattgaatca

SEQ ID NO: 2984862 - DNA, 14 bp, Homo sapiens
ctgtattgaatcat

SEQ ID NO: 2984863 - DNA, 17 bp, Homo sapiens
ctgtattgaatcatgta

SEQ ID NO: 2984864 - DNA, 16 bp, Homo sapiens
ctgtatttgtgactaa

SEQ ID NO: 2984865 - DNA, 14 bp, Homo sapiens
ctgtattttgagtt

SEQ ID NO: 2984866 - DNA, 18 bp, Homo sapiens
ctgtcaagcatattggaa

SEQ ID NO: 2984867 - DNA, 20 bp, Homo sapiens
ctgtcaagcatattggaaag

SEQ ID NO: 2984868 - DNA, 14 bp, Homo sapiens
ctgtcaccaagctc

SEQ ID NO: 2984869 - DNA, 15 bp, Homo sapiens
ctgtcaccacatctt

SEQ ID NO: 2984870 - DNA, 17 bp, Homo sapiens
ctgtcaccacatcttgt

SEQ ID NO: 2984871 - DNA, 15 bp, Homo sapiens
ctgtcaccctggcca

SEQ ID NO: 2984872 - DNA, 16 bp, Homo sapiens
ctgtcaccctggccac

SEQ ID NO: 2984873 - DNA, 21 bp, Homo sapiens
ctgtcaccctggccaccaccc

SEQ ID NO: 2984874 - DNA, 16 bp, Homo sapiens
ctgtcactcaggctgg

SEQ ID NO: 2984875 - DNA, 18 bp, Homo sapiens
ctgtcactcaggctggag

SEQ ID NO: 2984876 - DNA, 14 bp, Homo sapiens
ctgtcactcattgc

SEQ ID NO: 2984877 - DNA, 21 bp, Homo sapiens
ctgtcagcaagactgaagatg

SEQ ID NO: 2984878 - DNA, 17 bp, Homo sapiens
ctgtcagtcacagccac

SEQ ID NO: 2984879 - DNA, 18 bp, Homo sapiens
ctgtcagtcacagccacc

SEQ ID NO: 2984880 - DNA, 11 bp, Homo sapiens
ctgtcagtgtg

SEQ ID NO: 2984881 - DNA, 22 bp, Homo sapiens
ctgtcataagcattactttata

SEQ ID NO: 2984882 - DNA, 19 bp, Homo sapiens
ctgtcatcaacattcttgt

SEQ ID NO: 2984883 - DNA, 15 bp, Homo sapiens
ctgtccaacccctcc

SEQ ID NO: 2984884 - DNA, 15 bp, Homo sapiens
ctgtccacacccagc

SEQ ID NO: 2984885 - DNA, 20 bp, Homo sapiens
ctgtccacacccagctcagc

SEQ ID NO: 2984886 - DNA, 15 bp, Homo sapiens
ctgtccacatcccca

SEQ ID NO: 2984887 - DNA, 16 bp, Homo sapiens
ctgtccacatccccag

SEQ ID NO: 2984888 - DNA, 19 bp, Homo sapiens
ctgtccacatccccagagc

SEQ ID NO: 2984889 - DNA, 20 bp, Homo sapiens
ctgtccacatccccagagcc

SEQ ID NO: 2984890 - DNA, 21 bp, Homo sapiens
ctgtccacatccccagagccc

SEQ ID NO: 2984891 - DNA, 12 bp, Homo sapiens
ctgtccagctcc

SEQ ID NO: 2984892 - DNA, 14 bp, Homo sapiens
ctgtccagctccaa

SEQ ID NO: 2984893 - DNA, 13 bp, Homo sapiens
ctgtccaggctcg

SEQ ID NO: 2984894 - DNA, 22 bp, Homo sapiens
ctgtccatcctcctctccatgc

SEQ ID NO: 2984895 - DNA, 15 bp, Homo sapiens
ctgtccatctgcccg

SEQ ID NO: 2984896 - DNA, 23 bp, Homo sapiens
ctgtcccaaggtgaaatgaagca

SEQ ID NO: 2984897 - DNA, 15 bp, Homo sapiens
ctgtcccacttctca

SEQ ID NO: 2984898 - DNA, 13 bp, Homo sapiens
ctgtcccaggact

SEQ ID NO: 2984899 - DNA, 21 bp, Homo sapiens
ctgtcccaggactcaccctcc

SEQ ID NO: 2984900 - DNA, 22 bp, Homo sapiens
ctgtcccaggactcaccctcca

SEQ ID NO: 2984901 - DNA, 17 bp, Homo sapiens
ctgtcccagttgtggca

SEQ ID NO: 2984902 - DNA, 15 bp, Homo sapiens
ctgtccccacgaggg

SEQ ID NO: 2984903 - DNA, 21 bp, Homo sapiens
ctgtccccacgaggggaccca

SEQ ID NO: 2984904 - DNA, 18 bp, Homo sapiens
ctgtccccaggcctggct

SEQ ID NO: 2984905 - DNA, 15 bp, Homo sapiens
ctgtccccgcagccc

SEQ ID NO: 2984906 - DNA, 17 bp, Homo sapiens
ctgtccccgcagccctg

SEQ ID NO: 2984907 - DNA, 21 bp, Homo sapiens
ctgtccccgccttccctcact

SEQ ID NO: 2984908 - DNA, 15 bp, Homo sapiens
ctgtcccctcacaga

SEQ ID NO: 2984909 - DNA, 18 bp, Homo sapiens
ctgtcccctggagtgtgt

SEQ ID NO: 2984910 - DNA, 19 bp, Homo sapiens
ctgtccctagtaaaaatac

SEQ ID NO: 2984911 - DNA, 12 bp, Homo sapiens
ctgtccctccgg

SEQ ID NO: 2984912 - DNA, 17 bp, Homo sapiens
ctgtccctccgggacct

SEQ ID NO: 2984913 - DNA, 21 bp, Homo sapiens
ctgtccctccgggacctggtg

SEQ ID NO: 2984914 - DNA, 19 bp, Homo sapiens
ctgtccctcctggtgtcac

SEQ ID NO: 2984915 - DNA, 20 bp, Homo sapiens
ctgtccctctcagtgccttc

SEQ ID NO: 2984916 - DNA, 15 bp, Homo sapiens
ctgtccctgcactgt

SEQ ID NO: 2984917 - DNA, 17 bp, Homo sapiens
ctgtcccttctgtccct

SEQ ID NO: 2984918 - DNA, 18 bp, Homo sapiens
ctgtcccttctgtccctc

SEQ ID NO: 2984919 - DNA, 16 bp, Homo sapiens
ctgtccgtccagagcc

SEQ ID NO: 2984920 - DNA, 18 bp, Homo sapiens
ctgtccgtccagagccgg

SEQ ID NO: 2984921 - DNA, 23 bp, Homo sapiens
ctgtcctatgaatgctttgcatt

SEQ ID NO: 2984922 - DNA, 20 bp, Homo sapiens
ctgtcctcagccttgccaga

SEQ ID NO: 2984923 - DNA, 16 bp, Homo sapiens
ctgtcctcaggtggcc

SEQ ID NO: 2984924 - DNA, 15 bp, Homo sapiens
ctgtcctccaacacc

SEQ ID NO: 2984925 - DNA, 23 bp, Homo sapiens
ctgtcctccaacaccaagcacag

SEQ ID NO: 2984926 - DNA, 23 bp, Homo sapiens
ctgtcctcgaattttatctgtgg

SEQ ID NO: 2984927 - DNA, 12 bp, Homo sapiens
ctgtcctctgta

SEQ ID NO: 2984928 - DNA, 12 bp, Homo sapiens
ctgtcctctttg

SEQ ID NO: 2984929 - DNA, 16 bp, Homo sapiens
ctgtcctggtggctgg

SEQ ID NO: 2984930 - DNA, 14 bp, Homo sapiens
ctgtcctgtgaggt

SEQ ID NO: 2984931 - DNA, 16 bp, Homo sapiens
ctgtcctgtgaggttt

SEQ ID NO: 2984932 - DNA, 19 bp, Homo sapiens
ctgtccttacccatctgca

SEQ ID NO: 2984933 - DNA, 20 bp, Homo sapiens
ctgtccttactcagagctgc

SEQ ID NO: 2984934 - DNA, 17 bp, Homo sapiens
ctgtcggaggaaagaca

SEQ ID NO: 2984935 - DNA, 16 bp, Homo sapiens
ctgtcgggggccactg

SEQ ID NO: 2984936 - DNA, 22 bp, Homo sapiens
ctgtcgtctctcccaccccctc

SEQ ID NO: 2984937 - DNA, 16 bp, Homo sapiens
ctgtctaaagccttaa

SEQ ID NO: 2984938 - DNA, 19 bp, Homo sapiens
ctgtctaaagccttaacta

SEQ ID NO: 2984939 - DNA, 20 bp, Homo sapiens
ctgtctacttgctcaggtac

SEQ ID NO: 2984940 - DNA, 16 bp, Homo sapiens
ctgtctactttctctt

SEQ ID NO: 2984941 - DNA, 18 bp, Homo sapiens
ctgtctactttctcttgt

SEQ ID NO: 2984942 - DNA, 20 bp, Homo sapiens
ctgtctactttctcttgttt

SEQ ID NO: 2984943 - DNA, 21 bp, Homo sapiens
ctgtctactttctcttgttta

SEQ ID NO: 2984944 - DNA, 21 bp, Homo sapiens
ctgtctagaatcctgctttac

SEQ ID NO: 2984945 - DNA, 17 bp, Homo sapiens
ctgtctagactggccta

SEQ ID NO: 2984946 - DNA, 14 bp, Homo sapiens
ctgtctagagaggg

SEQ ID NO: 2984947 - DNA, 17 bp, Homo sapiens
ctgtctagagagggagg

SEQ ID NO: 2984948 - DNA, 14 bp, Homo sapiens
ctgtctagtgtctg

SEQ ID NO: 2984949 - DNA, 14 bp, Homo sapiens
ctgtctcaatagct

SEQ ID NO: 2984950 - DNA, 17 bp, Homo sapiens
ctgtctcaatagctcca

SEQ ID NO: 2984951 - DNA, 21 bp, Homo sapiens
ctgtctcaatagctccaagct

SEQ ID NO: 2984952 - DNA, 15 bp, Homo sapiens
ctgtctcagtgattc

SEQ ID NO: 2984953 - DNA, 19 bp, Homo sapiens
ctgtctcagtgattcgctt

SEQ ID NO: 2984954 - DNA, 12 bp, Homo sapiens
ctgtctcatcca

SEQ ID NO: 2984955 - DNA, 21 bp, Homo sapiens
ctgtctcatccatcatcatgt

SEQ ID NO: 2984956 - DNA, 20 bp, Homo sapiens
ctgtctccatggccctgcaa

SEQ ID NO: 2984957 - DNA, 11 bp, Homo sapiens
ctgtctccttt

SEQ ID NO: 2984958 - DNA, 22 bp, Homo sapiens
ctgtctctaaaaagaagccaca

SEQ ID NO: 2984959 - DNA, 20 bp, Homo sapiens
ctgtctctccccctctgtct

SEQ ID NO: 2984960 - DNA, 12 bp, Homo sapiens
ctgtctctctgg

SEQ ID NO: 2984961 - DNA, 18 bp, Homo sapiens
ctgtctctcttgtcacat

SEQ ID NO: 2984962 - DNA, 17 bp, Homo sapiens
ctgtctctggcatttgt

SEQ ID NO: 2984963 - DNA, 14 bp, Homo sapiens
ctgtctctgtggaa

SEQ ID NO: 2984964 - DNA, 23 bp, Homo sapiens
ctgtctctgtggaaaagccatct

SEQ ID NO: 2984965 - DNA, 18 bp, Homo sapiens
ctgtctcttaaatctctt

SEQ ID NO: 2984966 - DNA, 14 bp, Homo sapiens
ctgtctgatagcac

SEQ ID NO: 2984967 - DNA, 13 bp, Homo sapiens
ctgtctgcagcct

SEQ ID NO: 2984968 - DNA, 16 bp, Homo sapiens
ctgtctggattaatta

SEQ ID NO: 2984969 - DNA, 15 bp, Homo sapiens
ctgtctggccaggcc

SEQ ID NO: 2984970 - DNA, 19 bp, Homo sapiens
ctgtctgtccaacccctcc

SEQ ID NO: 2984971 - DNA, 15 bp, Homo sapiens
ctgtctgtccttctg

SEQ ID NO: 2984972 - DNA, 16 bp, Homo sapiens
ctgtctgtccttctga

SEQ ID NO: 2984973 - DNA, 20 bp, Homo sapiens
ctgtctgtccttctgaagtg

SEQ ID NO: 2984974 - DNA, 23 bp, Homo sapiens
ctgtctgtctctccccctctgtc

SEQ ID NO: 2984975 - DNA, 16 bp, Homo sapiens
ctgtctgttacactgg

SEQ ID NO: 2984976 - DNA, 19 bp, Homo sapiens
cttagactttagtagtttg

SEQ ID NO: 2984977 - DNA, 21 bp, Homo sapiens
cttagagggatttctttgctg

SEQ ID NO: 2984978 - DNA, 18 bp, Homo sapiens
cttagatacactaaaaat

SEQ ID NO: 2984979 - DNA, 20 bp, Homo sapiens
cttagatattaaaatttggt

SEQ ID NO: 2984980 - DNA, 13 bp, Homo sapiens
cttagatatttca

SEQ ID NO: 2984981 - DNA, 14 bp, Homo sapiens
cttagatctctcct

SEQ ID NO: 2984982 - DNA, 18 bp, Homo sapiens
cttagatgttctaagtct

SEQ ID NO: 2984983 - DNA, 20 bp, Homo sapiens
cttagattctctgtgtctaa

SEQ ID NO: 2984984 - DNA, 21 bp, Homo sapiens
cttagcactaccactcctgcc

SEQ ID NO: 2984985 - DNA, 11 bp, Homo sapiens
cttagcatgtg

SEQ ID NO: 2984986 - DNA, 21 bp, Homo sapiens
cttagcatgtgactcctgaag

SEQ ID NO: 2984987 - DNA, 19 bp, Homo sapiens
cttagccgactgcgctgct

SEQ ID NO: 2984988 - DNA, 17 bp, Homo sapiens
cttagcctctggatcta

SEQ ID NO: 2984989 - DNA, 15 bp, Homo sapiens
cttagccttgctgta

SEQ ID NO: 2984990 - DNA, 22 bp, Homo sapiens
cttagccttgctgtagagactt

SEQ ID NO: 2984991 - DNA, 18 bp, Homo sapiens
cttagcgctctggacaga

SEQ ID NO: 2984992 - DNA, 14 bp, Homo sapiens
cttagctctttctc

SEQ ID NO: 2984993 - DNA, 22 bp, Homo sapiens
cttagctgccatcttgcttttc

SEQ ID NO: 2984994 - DNA, 21 bp, Homo sapiens
cttaggcccggagctgcccct

SEQ ID NO: 2984995 - DNA, 23 bp, Homo sapiens
cttaggccttcctctctccagat

SEQ ID NO: 2984996 - DNA, 17 bp, Homo sapiens
cttaggtttcaggaagt

SEQ ID NO: 2984997 - DNA, 17 bp, Homo sapiens
cttagtgtcacctttct

SEQ ID NO: 2984998 - DNA, 19 bp, Homo sapiens
cttagtgtggtatttgctg

SEQ ID NO: 2984999 - DNA, 19 bp, Homo sapiens
cttagttctgtatataaat

SEQ ID NO: 2985000 - DNA, 19 bp, Homo sapiens
cttagtttggattcttatg

SEQ ID NO: 2985001 - DNA, 22 bp, Homo sapiens
cttagtttggattcttatgtag

SEQ ID NO: 2985002 - DNA, 12 bp, Homo sapiens
cttataaatatg

SEQ ID NO: 2985003 - DNA, 18 bp, Homo sapiens
cttatacatcacttcctg

SEQ ID NO: 2985004 - DNA, 19 bp, Homo sapiens
cttatacgcttttctttgt

SEQ ID NO: 2985005 - DNA, 17 bp, Homo sapiens
cttatagggtaaaaaaa

SEQ ID NO: 2985006 - DNA, 16 bp, Homo sapiens
cttatagttctaggca

SEQ ID NO: 2985007 - DNA, 22 bp, Homo sapiens
cttatatatatattgattattt

SEQ ID NO: 2985008 - DNA, 17 bp, Homo sapiens
cttatattcagtctgtg

SEQ ID NO: 2985009 - DNA, 16 bp, Homo sapiens
cttatccctgcccatt

SEQ ID NO: 2985010 - DNA, 13 bp, Homo sapiens
cttatctccaaga

SEQ ID NO: 2985011 - DNA, 22 bp, Homo sapiens
cttatctccctgcttcatatct

SEQ ID NO: 2985012 - DNA, 12 bp, Homo sapiens
cttatctctttt

SEQ ID NO: 2985013 - DNA, 21 bp, Homo sapiens
cttatctcttttatatttgta

SEQ ID NO: 2985014 - DNA, 22 bp, Homo sapiens
cttatctgtgctcaggactcag

SEQ ID NO: 2985015 - DNA, 14 bp, Homo sapiens
cttatcttgtttca

SEQ ID NO: 2985016 - DNA, 15 bp, Homo sapiens
cttatgaactacagt

SEQ ID NO: 2985017 - DNA, 13 bp, Homo sapiens
cttatgagaaact

SEQ ID NO: 2985018 - DNA, 15 bp, Homo sapiens
cttatgagaacatgg

SEQ ID NO: 2985019 - DNA, 22 bp, Homo sapiens
cttatgagtataatgaacactc

SEQ ID NO: 2985020 - DNA, 19 bp, Homo sapiens
cttatgatgggctccccag

SEQ ID NO: 2985021 - DNA, 14 bp, Homo sapiens
cttatgcttaaatt

SEQ ID NO: 2985022 - DNA, 14 bp, Homo sapiens
cttatggcatctca

SEQ ID NO: 2985023 - DNA, 14 bp, Homo sapiens
cttatgtgttgcat

SEQ ID NO: 2985024 - DNA, 13 bp, Homo sapiens
cttattaaagttc

SEQ ID NO: 2985025 - DNA, 14 bp, Homo sapiens
cttattaaagttct

SEQ ID NO: 2985026 - DNA, 18 bp, Homo sapiens
cttattaaagttctgtaa

SEQ ID NO: 2985027 - DNA, 21 bp, Homo sapiens
cttattaacaattaggcagac

SEQ ID NO: 2985028 - DNA, 22 bp, Homo sapiens
cttattaccctgattgaatgtg

SEQ ID NO: 2985029 - DNA, 21 bp, Homo sapiens
cttattagagtgtctttccac

SEQ ID NO: 2985030 - DNA, 16 bp, Homo sapiens
cttattccacagatat

SEQ ID NO: 2985031 - DNA, 14 bp, Homo sapiens
cttattctgtagat

SEQ ID NO: 2985032 - DNA, 12 bp, Homo sapiens
cttattctgtat

SEQ ID NO: 2985033 - DNA, 19 bp, Homo sapiens
cttattcttttataataat

SEQ ID NO: 2985034 - DNA, 22 bp, Homo sapiens
cttattgacaaccgagaaggtt

SEQ ID NO: 2985035 - DNA, 17 bp, Homo sapiens
cttattgatctttgccc

SEQ ID NO: 2985036 - DNA, 21 bp, Homo sapiens
cttattgcctgggcagtgccc

SEQ ID NO: 2985037 - DNA, 21 bp, Homo sapiens
cttattgtgtgcgctgcctgg

SEQ ID NO: 2985038 - DNA, 13 bp, Homo sapiens
cttatttaaaaat

SEQ ID NO: 2985039 - DNA, 22 bp, Homo sapiens
cttatttaaaaatatttcagat

SEQ ID NO: 2985040 - DNA, 15 bp, Homo sapiens
cttatttagaaaaaa

SEQ ID NO: 2985041 - DNA, 14 bp, Homo sapiens
cttatttatatgaa

SEQ ID NO: 2985042 - DNA, 17 bp, Homo sapiens
cttatttatatgaagca

SEQ ID NO: 2985043 - DNA, 18 bp, Homo sapiens
cttatttatatgaagcaa

SEQ ID NO: 2985044 - DNA, 23 bp, Homo sapiens
cttatttatatgaagcaagctgt

SEQ ID NO: 2985045 - DNA, 18 bp, Homo sapiens
cttatttggaattgacat

SEQ ID NO: 2985046 - DNA, 15 bp, Homo sapiens
cttattttgtactag

SEQ ID NO: 2985047 - DNA, 18 bp, Homo sapiens
cttatttttaatttttcc

SEQ ID NO: 2985048 - DNA, 20 bp, Homo sapiens
cttcaaaacattctcctttg

SEQ ID NO: 2985049 - DNA, 17 bp, Homo sapiens
cttcaaaagtaatgcct

SEQ ID NO: 2985050 - DNA, 20 bp, Homo sapiens
cttcaaaagtaatgcctctg

SEQ ID NO: 2985051 - DNA, 17 bp, Homo sapiens
cttcaaatgcgaacact

SEQ ID NO: 2985052 - DNA, 22 bp, Homo sapiens
cttcaaattaaagtgctgttta

SEQ ID NO: 2985053 - DNA, 20 bp, Homo sapiens
cttcaagaaacagcgagagg

SEQ ID NO: 2985054 - DNA, 18 bp, Homo sapiens
cttcaagaatcagaagaa

SEQ ID NO: 2985055 - DNA, 14 bp, Homo sapiens
cttcaagcatcctc

SEQ ID NO: 2985056 - DNA, 15 bp, Homo sapiens
cttcaagggtaatct

SEQ ID NO: 2985057 - DNA, 17 bp, Homo sapiens
cttcaatacttaaaaat

SEQ ID NO: 2985058 - DNA, 21 bp, Homo sapiens
cttcaatctcgtttagtgcca

SEQ ID NO: 2985059 - DNA, 16 bp, Homo sapiens
cttcaattaaaattac

SEQ ID NO: 2985060 - DNA, 17 bp, Homo sapiens
cttcacaaagcccaagg

SEQ ID NO: 2985061 - DNA, 23 bp, Homo sapiens
cttcacaaagcccaagggatctg

SEQ ID NO: 2985062 - DNA, 18 bp, Homo sapiens
cttcacactgcaagagcc

SEQ ID NO: 2985063 - DNA, 21 bp, Homo sapiens
cttcacactgcaagagccttg

SEQ ID NO: 2985064 - DNA, 16 bp, Homo sapiens
cttcacagtgacactg

SEQ ID NO: 2985065 - DNA, 23 bp, Homo sapiens
cttcacagtgatcgatgattcag

SEQ ID NO: 2985066 - DNA, 20 bp, Homo sapiens
cttcacatcctgtgtttcta

SEQ ID NO: 2985067 - DNA, 21 bp, Homo sapiens
cttcacattcccctggggacc

SEQ ID NO: 2985068 - DNA, 22 bp, Homo sapiens
cttcacattcccctggggaccc

SEQ ID NO: 2985069 - DNA, 19 bp, Homo sapiens
cttcaccatggatcctgga

SEQ ID NO: 2985070 - DNA, 14 bp, Homo sapiens
cttcacccaggcct

SEQ ID NO: 2985071 - DNA, 17 bp, Homo sapiens
cttcacccaggcctatg

SEQ ID NO: 2985072 - DNA, 21 bp, Homo sapiens
cttcacccaggcctatgttga

SEQ ID NO: 2985073 - DNA, 22 bp, Homo sapiens
cttcacctgggcgccaactgct

SEQ ID NO: 2985074 - DNA, 15 bp, Homo sapiens
cttcaccttggttta

SEQ ID NO: 2985075 - DNA, 20 bp, Homo sapiens
cttcacctttcccactttct

SEQ ID NO: 2985076 - DNA, 18 bp, Homo sapiens
cttcacgaagtgttgcat

SEQ ID NO: 2985077 - DNA, 17 bp, Homo sapiens
cttcacggcaggacaac

SEQ ID NO: 2985078 - DNA, 20 bp, Homo sapiens
cttcactgctacatgtgctg

SEQ ID NO: 2985079 - DNA, 19 bp, Homo sapiens
cttcactggcgccttctcg

SEQ ID NO: 2985080 - DNA, 21 bp, Homo sapiens
cttcacttacaagaaaggcct

SEQ ID NO: 2985081 - DNA, 16 bp, Homo sapiens
cttcagaatcagatat

SEQ ID NO: 2985082 - DNA, 17 bp, Homo sapiens
cttcagaatcagatata

SEQ ID NO: 2985083 - DNA, 21 bp, Homo sapiens
cttcagaggagcatcagctgt

SEQ ID NO: 2985084 - DNA, 16 bp, Homo sapiens
cttcagatgctcttgg

SEQ ID NO: 2985085 - DNA, 17 bp, Homo sapiens
cttcagattattaaaat

SEQ ID NO: 2985086 - DNA, 15 bp, Homo sapiens
cttcagcaagagaga

SEQ ID NO: 2985087 - DNA, 17 bp, Homo sapiens
cttcagcaagagagaac

SEQ ID NO: 2985088 - DNA, 20 bp, Homo sapiens
cttcagcaagagagaaccta

SEQ ID NO: 2985089 - DNA, 16 bp, Homo sapiens
cttcagcagcagctca

SEQ ID NO: 2985090 - DNA, 16 bp, Homo sapiens
cttcagcattgtaatt

SEQ ID NO: 2985091 - DNA, 23 bp, Homo sapiens
cttcagcattgtaattatgtaaa

SEQ ID NO: 2985092 - DNA, 15 bp, Homo sapiens
cttcagccacctctc

SEQ ID NO: 2985093 - DNA, 12 bp, Homo sapiens
cttcagctggtg

SEQ ID NO: 2985094 - DNA, 13 bp, Homo sapiens
cttcagctggtgg

SEQ ID NO: 2985095 - DNA, 19 bp, Homo sapiens
cttcagctggtggatggtg

SEQ ID NO: 2985096 - DNA, 13 bp, Homo sapiens
cttcagcttcttc

SEQ ID NO: 2985097 - DNA, 22 bp, Homo sapiens
cttcagctttatttttctttaa

SEQ ID NO: 2985098 - DNA, 16 bp, Homo sapiens
cttcaggcaattctcc

SEQ ID NO: 2985099 - DNA, 22 bp, Homo sapiens
cttcaggcaattctcctgcctt

SEQ ID NO: 2985100 - DNA, 23 bp, Homo sapiens
cttcaggcaattctcctgccttt

SEQ ID NO: 2985101 - DNA, 15 bp, Homo sapiens
cttcaggctctgccc

SEQ ID NO: 2985102 - DNA, 15 bp, Homo sapiens
cttcagggcctggtt

SEQ ID NO: 2985103 - DNA, 19 bp, Homo sapiens
cttcaggggcacttcattg

SEQ ID NO: 2985104 - DNA, 18 bp, Homo sapiens
cttcaggtcaggagttcg

SEQ ID NO: 2985105 - DNA, 18 bp, Homo sapiens
cttcaggtggagagcact

SEQ ID NO: 2985106 - DNA, 16 bp, Homo sapiens
cttcagtcctggtctg

SEQ ID NO: 2985107 - DNA, 17 bp, Homo sapiens
cttggaaaaagaaagaa

SEQ ID NO: 2985108 - DNA, 22 bp, Homo sapiens
cttggaaccgtaggacccaagc

SEQ ID NO: 2985109 - DNA, 16 bp, Homo sapiens
cttggaagcattcaca

SEQ ID NO: 2985110 - DNA, 22 bp, Homo sapiens
cttggagcatttatgtagacat

SEQ ID NO: 2985111 - DNA, 19 bp, Homo sapiens
cttggagcctgcagagctg

SEQ ID NO: 2985112 - DNA, 15 bp, Homo sapiens
cttggaggacagtgg

SEQ ID NO: 2985113 - DNA, 18 bp, Homo sapiens
cttggagggctcagggca

SEQ ID NO: 2985114 - DNA, 14 bp, Homo sapiens
cttggagtcccagg

SEQ ID NO: 2985115 - DNA, 15 bp, Homo sapiens
cttggagtcccaggg

SEQ ID NO: 2985116 - DNA, 18 bp, Homo sapiens
cttggataatgctgttgc

SEQ ID NO: 2985117 - DNA, 23 bp, Homo sapiens
cttggataatgctgttgcctcat

SEQ ID NO: 2985118 - DNA, 17 bp, Homo sapiens
cttggataccagctcag

SEQ ID NO: 2985119 - DNA, 13 bp, Homo sapiens
cttggatcctggg

SEQ ID NO: 2985120 - DNA, 11 bp, Homo sapiens
cttggatgagg

SEQ ID NO: 2985121 - DNA, 18 bp, Homo sapiens
cttggatgtacctgcccc

SEQ ID NO: 2985122 - DNA, 14 bp, Homo sapiens
cttggcaactttct

SEQ ID NO: 2985123 - DNA, 21 bp, Homo sapiens
cttggcacccaagacctcagg

SEQ ID NO: 2985124 - DNA, 12 bp, Homo sapiens
cttggcacctgc

SEQ ID NO: 2985125 - DNA, 13 bp, Homo sapiens
cttggcacctgcc

SEQ ID NO: 2985126 - DNA, 15 bp, Homo sapiens
cttggcatctgtgtg

SEQ ID NO: 2985127 - DNA, 17 bp, Homo sapiens
cttggccaagagaaggg

SEQ ID NO: 2985128 - DNA, 12 bp, Homo sapiens
cttggcccagag

SEQ ID NO: 2985129 - DNA, 13 bp, Homo sapiens
cttggcccaggag

SEQ ID NO: 2985130 - DNA, 16 bp, Homo sapiens
cttggcccaggagctc

SEQ ID NO: 2985131 - DNA, 21 bp, Homo sapiens
cttggcccaggagctctgcgc

SEQ ID NO: 2985132 - DNA, 18 bp, Homo sapiens
cttggcccgcggcctgca

SEQ ID NO: 2985133 - DNA, 19 bp, Homo sapiens
cttggcccgcggcctgcac

SEQ ID NO: 2985134 - DNA, 21 bp, Homo sapiens
cttggccggctgtgctcagag

SEQ ID NO: 2985135 - DNA, 22 bp, Homo sapiens
cttggccggctgtgctcagaga

SEQ ID NO: 2985136 - DNA, 21 bp, Homo sapiens
cttggcctatctcctagggct

SEQ ID NO: 2985137 - DNA, 18 bp, Homo sapiens
cttggcctctctgtacac

SEQ ID NO: 2985138 - DNA, 23 bp, Homo sapiens
cttggcctctctgtacactgccc

SEQ ID NO: 2985139 - DNA, 17 bp, Homo sapiens
cttggcctgatcagacc

SEQ ID NO: 2985140 - DNA, 16 bp, Homo sapiens
cttggccttgcagctg

SEQ ID NO: 2985141 - DNA, 19 bp, Homo sapiens
cttggccttgcagctggcc

SEQ ID NO: 2985142 - DNA, 24 bp, Homo sapiens
cttggctcactgcaacttctgcct

SEQ ID NO: 2985143 - DNA, 12 bp, Homo sapiens
cttggctcagac

SEQ ID NO: 2985144 - DNA, 14 bp, Homo sapiens
cttggctttcatgt

SEQ ID NO: 2985145 - DNA, 15 bp, Homo sapiens
cttggctttcatgtt

SEQ ID NO: 2985146 - DNA, 12 bp, Homo sapiens
cttgggaaatat

SEQ ID NO: 2985147 - DNA, 20 bp, Homo sapiens
cttgggaagtcgaggctgca

SEQ ID NO: 2985148 - DNA, 15 bp, Homo sapiens
cttgggagcctgagg

SEQ ID NO: 2985149 - DNA, 22 bp, Homo sapiens
cttgggagcctgaggcaggaga

SEQ ID NO: 2985150 - DNA, 22 bp, Homo sapiens
cttgggaggccccactggggaa

SEQ ID NO: 2985151 - DNA, 11 bp, Homo sapiens
cttgggcagaa

SEQ ID NO: 2985152 - DNA, 11 bp, Homo sapiens
cttgggcaggg

SEQ ID NO: 2985153 - DNA, 18 bp, Homo sapiens
cttgggcagggtctctgc

SEQ ID NO: 2985154 - DNA, 19 bp, Homo sapiens
cttgggcagggtctctgct

SEQ ID NO: 2985155 - DNA, 23 bp, Homo sapiens
cttgggcagggtctctgctccag

SEQ ID NO: 2985156 - DNA, 14 bp, Homo sapiens
cttgggccctttga

SEQ ID NO: 2985157 - DNA, 14 bp, Homo sapiens
cttgggcctggcca

SEQ ID NO: 2985158 - DNA, 13 bp, Homo sapiens
cttgggctccctg

SEQ ID NO: 2985159 - DNA, 20 bp, Homo sapiens
cttgggctggtcagagtggc

SEQ ID NO: 2985160 - DNA, 19 bp, Homo sapiens
cttggggagttaagacctg

SEQ ID NO: 2985161 - DNA, 22 bp, Homo sapiens
cttggggagttaagacctggca

SEQ ID NO: 2985162 - DNA, 21 bp, Homo sapiens
cttggggagtttagggtgggg

SEQ ID NO: 2985163 - DNA, 23 bp, Homo sapiens
cttggggcaacattgttcacctt

SEQ ID NO: 2985164 - DNA, 12 bp, Homo sapiens
cttggggcccag

SEQ ID NO: 2985165 - DNA, 16 bp, Homo sapiens
cttgggggggctgcct

SEQ ID NO: 2985166 - DNA, 19 bp, Homo sapiens
cttgggggggctgcctttg

SEQ ID NO: 2985167 - DNA, 18 bp, Homo sapiens
cttgggggttcaggcccg

SEQ ID NO: 2985168 - DNA, 17 bp, Homo sapiens
cttgggggtttttgaag

SEQ ID NO: 2985169 - DNA, 13 bp, Homo sapiens
cttggggtcccac

SEQ ID NO: 2985170 - DNA, 13 bp, Homo sapiens
cttggggtggcgc

SEQ ID NO: 2985171 - DNA, 20 bp, Homo sapiens
cttggggtggcgcgcctgcc

SEQ ID NO: 2985172 - DNA, 23 bp, Homo sapiens
cttggggtggcgcgcctgccttt

SEQ ID NO: 2985173 - DNA, 12 bp, Homo sapiens
cttggggtgggg

SEQ ID NO: 2985174 - DNA, 20 bp, Homo sapiens
cttggggtgggggccaggcc

SEQ ID NO: 2985175 - DNA, 21 bp, Homo sapiens
cttggggttcataggggcagg

SEQ ID NO: 2985176 - DNA, 18 bp, Homo sapiens
cttgggtggagaagccat

SEQ ID NO: 2985177 - DNA, 16 bp, Homo sapiens
cttgggttattattgt

SEQ ID NO: 2985178 - DNA, 17 bp, Homo sapiens
cttgggtttctgtgcag

SEQ ID NO: 2985179 - DNA, 22 bp, Homo sapiens
cttggtaaagtccttttcttgc

SEQ ID NO: 2985180 - DNA, 13 bp, Homo sapiens
cttggtagagttt

SEQ ID NO: 2985181 - DNA, 19 bp, Homo sapiens
cttggtcctagggtgggaa

SEQ ID NO: 2985182 - DNA, 22 bp, Homo sapiens
cttggtcctagggtgggaaggg

SEQ ID NO: 2985183 - DNA, 14 bp, Homo sapiens
cttggtctctcctt

SEQ ID NO: 2985184 - DNA, 13 bp, Homo sapiens
cttggtctgccag

SEQ ID NO: 2985185 - DNA, 23 bp, Homo sapiens
cttggtgcaaggccatctgctta

SEQ ID NO: 2985186 - DNA, 15 bp, Homo sapiens
cttggtgctgggaac

SEQ ID NO: 2985187 - DNA, 14 bp, Homo sapiens
cttggtgctggttt

SEQ ID NO: 2985188 - DNA, 15 bp, Homo sapiens
cttggtgctggttta

SEQ ID NO: 2985189 - DNA, 13 bp, Homo sapiens
cttggtggggagc

SEQ ID NO: 2985190 - DNA, 17 bp, Homo sapiens
cttggtgtccacctggc

SEQ ID NO: 2985191 - DNA, 21 bp, Homo sapiens
cttggtgttaaaacacttctg

SEQ ID NO: 2985192 - DNA, 13 bp, Homo sapiens
cttggttattctg

SEQ ID NO: 2985193 - DNA, 17 bp, Homo sapiens
cttggttccagcctgcc

SEQ ID NO: 2985194 - DNA, 14 bp, Homo sapiens
cttggttgaggaaa

SEQ ID NO: 2985195 - DNA, 16 bp, Homo sapiens
cttggttgaggaaaca

SEQ ID NO: 2985196 - DNA, 15 bp, Homo sapiens
cttggtttgccttcc

SEQ ID NO: 2985197 - DNA, 18 bp, Homo sapiens
cttgtaaaggaatttaaa

SEQ ID NO: 2985198 - DNA, 23 bp, Homo sapiens
cttgtaaattattaatttatgca

SEQ ID NO: 2985199 - DNA, 21 bp, Homo sapiens
cttgtaactccaccaacccat

SEQ ID NO: 2985200 - DNA, 13 bp, Homo sapiens
cttgtacatgtgt

SEQ ID NO: 2985201 - DNA, 18 bp, Homo sapiens
cttgtacatttttaaatt

SEQ ID NO: 2985202 - DNA, 19 bp, Homo sapiens
cttgtacatttttaaattc

SEQ ID NO: 2985203 - DNA, 17 bp, Homo sapiens
cttgtactttattttct

SEQ ID NO: 2985204 - DNA, 23 bp, Homo sapiens
cttgtactttatttttctgatag

SEQ ID NO: 2985205 - DNA, 23 bp, Homo sapiens
cttgtagcggatgattcttcaag

SEQ ID NO: 2985206 - DNA, 14 bp, Homo sapiens
cttgtataacatca

SEQ ID NO: 2985207 - DNA, 22 bp, Homo sapiens
cttgtataggttttaaagacct

SEQ ID NO: 2985208 - DNA, 15 bp, Homo sapiens
cttgtcaaagaaggt

SEQ ID NO: 2985209 - DNA, 15 bp, Homo sapiens
cttgtcaataaaaat

SEQ ID NO: 2985210 - DNA, 13 bp, Homo sapiens
cttgtcacatgga

SEQ ID NO: 2985211 - DNA, 16 bp, Homo sapiens
cttgtcacgccagact

SEQ ID NO: 2985212 - DNA, 18 bp, Homo sapiens
cttgtcacgccagacttc

SEQ ID NO: 2985213 - DNA, 23 bp, Homo sapiens
cttgtcaggtggaccctgtaaat

SEQ ID NO: 2985214 - DNA, 19 bp, Homo sapiens
cttgtcccagaggctgccc

SEQ ID NO: 2985215 - DNA, 20 bp, Homo sapiens
cttgtccctggggcactccc

SEQ ID NO: 2985216 - DNA, 22 bp, Homo sapiens
cttgtccctggggcactccccc

SEQ ID NO: 2985217 - DNA, 16 bp, Homo sapiens
cttgtcctcagccagt

SEQ ID NO: 2985218 - DNA, 18 bp, Homo sapiens
cttgtcttagctctggac

SEQ ID NO: 2985219 - DNA, 14 bp, Homo sapiens
cttgtcttgctctt

SEQ ID NO: 2985220 - DNA, 14 bp, Homo sapiens
cttgtcttttcccc

SEQ ID NO: 2985221 - DNA, 18 bp, Homo sapiens
cttgtgaaaatgtgttct

SEQ ID NO: 2985222 - DNA, 18 bp, Homo sapiens
cttgtgaagttgtttttt

SEQ ID NO: 2985223 - DNA, 17 bp, Homo sapiens
cttgtgacgtgcactgt

SEQ ID NO: 2985224 - DNA, 22 bp, Homo sapiens
cttgtgagcatcagagggctga

SEQ ID NO: 2985225 - DNA, 15 bp, Homo sapiens
cttgtgagggagaga

SEQ ID NO: 2985226 - DNA, 17 bp, Homo sapiens
cttgtgattatttatta

SEQ ID NO: 2985227 - DNA, 12 bp, Homo sapiens
cttgtgccagcc

SEQ ID NO: 2985228 - DNA, 14 bp, Homo sapiens
cttgtgcctccctt

SEQ ID NO: 2985229 - DNA, 21 bp, Homo sapiens
cttgtgcctcccttcccagtg

SEQ ID NO: 2985230 - DNA, 12 bp, Homo sapiens
cttgtgctcagt

SEQ ID NO: 2985231 - DNA, 15 bp, Homo sapiens
cttgtggatgtttta

SEQ ID NO: 2985232 - DNA, 20 bp, Homo sapiens
cttgtgtaatttatgtgaaa

SEQ ID NO: 2985233 - DNA, 15 bp, Homo sapiens
cttgtgtatccatta

SEQ ID NO: 2985234 - DNA, 22 bp, Homo sapiens
cttgtgtatccattatcatgtg

SEQ ID NO: 2985235 - DNA, 23 bp, Homo sapiens
cttgtgtatccattatcatgtgt

SEQ ID NO: 2985236 - DNA, 19 bp, Homo sapiens
cttgtgtatttctctgtga

SEQ ID NO: 2985237 - DNA, 20 bp, Homo sapiens
cttgtgtatttctctgtgaa

SEQ ID NO: 2985238 - DNA, 12 bp, Homo sapiens
cttgtgtcctgg

SEQ ID NO: 2985239 - DNA, 15 bp, Homo sapiens
cttttggtgtgttgg

SEQ ID NO: 2985240 - DNA, 14 bp, Homo sapiens
cttttgtaaaatca

SEQ ID NO: 2985241 - DNA, 12 bp, Homo sapiens
cttttgtaataa

SEQ ID NO: 2985242 - DNA, 14 bp, Homo sapiens
cttttgtaattgtg

SEQ ID NO: 2985243 - DNA, 21 bp, Homo sapiens
cttttgtaattgtgtaaaaaa

SEQ ID NO: 2985244 - DNA, 22 bp, Homo sapiens
cttttgtaattgtgtaaaaaat

SEQ ID NO: 2985245 - DNA, 14 bp, Homo sapiens
cttttgttgtttat

SEQ ID NO: 2985246 - DNA, 22 bp, Homo sapiens
ctttttaaagaagtgcatgaaa

SEQ ID NO: 2985247 - DNA, 16 bp, Homo sapiens
ctttttaaatgtgaat

SEQ ID NO: 2985248 - DNA, 21 bp, Homo sapiens
ctttttaaatgtgaattttta

SEQ ID NO: 2985249 - DNA, 14 bp, Homo sapiens
ctttttaaccaagt

SEQ ID NO: 2985250 - DNA, 23 bp, Homo sapiens
ctttttaaccaagttgtttattc

SEQ ID NO: 2985251 - DNA, 20 bp, Homo sapiens
ctttttaataaaaaggcacc

SEQ ID NO: 2985252 - DNA, 22 bp, Homo sapiens
ctttttatattttatactgcac

SEQ ID NO: 2985253 - DNA, 19 bp, Homo sapiens
ctttttatttatatgtact

SEQ ID NO: 2985254 - DNA, 16 bp, Homo sapiens
ctttttatttctgcat

SEQ ID NO: 2985255 - DNA, 15 bp, Homo sapiens
ctttttcatcccctt

SEQ ID NO: 2985256 - DNA, 16 bp, Homo sapiens
ctttttcatcccctta

SEQ ID NO: 2985257 - DNA, 12 bp, Homo sapiens
ctttttccacaa

SEQ ID NO: 2985258 - DNA, 19 bp, Homo sapiens
ctttttccatatccctctt

SEQ ID NO: 2985259 - DNA, 16 bp, Homo sapiens
ctttttccttatttca

SEQ ID NO: 2985260 - DNA, 12 bp, Homo sapiens
ctttttctaatg

SEQ ID NO: 2985261 - DNA, 13 bp, Homo sapiens
ctttttctaatga

SEQ ID NO: 2985262 - DNA, 22 bp, Homo sapiens
ctttttctcactatctgaaaat

SEQ ID NO: 2985263 - DNA, 14 bp, Homo sapiens
ctttttctcttctg

SEQ ID NO: 2985264 - DNA, 13 bp, Homo sapiens
ctttttcttcact

SEQ ID NO: 2985265 - DNA, 15 bp, Homo sapiens
ctttttgaaatcagc

SEQ ID NO: 2985266 - DNA, 19 bp, Homo sapiens
ctttttgaccagtttcttt

SEQ ID NO: 2985267 - DNA, 20 bp, Homo sapiens
ctttttgagtaattttctga

SEQ ID NO: 2985268 - DNA, 19 bp, Homo sapiens
ctttttgataagcacatta

SEQ ID NO: 2985269 - DNA, 14 bp, Homo sapiens
ctttttgatgtata

SEQ ID NO: 2985270 - DNA, 21 bp, Homo sapiens
ctttttgcaggggactgggcc

SEQ ID NO: 2985271 - DNA, 24 bp, Homo sapiens
ctttttggaaaagagctgggatcc

SEQ ID NO: 2985272 - DNA, 14 bp, Homo sapiens
ctttttgggtccag

SEQ ID NO: 2985273 - DNA, 18 bp, Homo sapiens
ctttttggtaatatatat

SEQ ID NO: 2985274 - DNA, 17 bp, Homo sapiens
ctttttgttccagagct

SEQ ID NO: 2985275 - DNA, 21 bp, Homo sapiens
cttttttacttagtagattaa

SEQ ID NO: 2985276 - DNA, 15 bp, Homo sapiens
cttttttattaccag

SEQ ID NO: 2985277 - DNA, 15 bp, Homo sapiens
cttttttcacaaatt

SEQ ID NO: 2985278 - DNA, 20 bp, Homo sapiens
cttttttcctcctttctctg

SEQ ID NO: 2985279 - DNA, 17 bp, Homo sapiens
cttttttgataaagttt

SEQ ID NO: 2985280 - DNA, 18 bp, Homo sapiens
cttttttgataaagtttc

SEQ ID NO: 2985281 - DNA, 20 bp, Homo sapiens
cttttttggggatatgctta

SEQ ID NO: 2985282 - DNA, 16 bp, Homo sapiens
cttttttgtacagtat

SEQ ID NO: 2985283 - DNA, 17 bp, Homo sapiens
cttttttgtacagtatt

SEQ ID NO: 2985284 - DNA, 21 bp, Homo sapiens
cttttttgttttttcaaaata

SEQ ID NO: 2985285 - DNA, 19 bp, Homo sapiens
ctttttttccatctttaca

SEQ ID NO: 2985286 - DNA, 11 bp, Homo sapiens
ctttttttccc

SEQ ID NO: 2985287 - DNA, 14 bp, Homo sapiens
cttttttttcttta

SEQ ID NO: 2985288 - DNA, 15 bp, Homo sapiens
cttttttttctttaa

SEQ ID NO: 2985289 - DNA, 15 bp, Homo sapiens
ctttttttttccaaa

SEQ ID NO: 2985290 - DNA, 22 bp, Homo sapiens
ctttttttttttttaaagacag

SEQ ID NO: 2985291 - DNA, 19 bp, Homo sapiens
cttttttttttttttggta

SEQ ID NO: 2985292 - DNA, 22 bp, Homo sapiens
cttttttttttttttttttaaa

SEQ ID NO: 2985293 - DNA, 22 bp, Homo sapiens
gaaaaaaaaaaaaagaaattcg

SEQ ID NO: 2985294 - DNA, 21 bp, Homo sapiens
gaaaaaaaaaaaagaggaaaa

SEQ ID NO: 2985295 - DNA, 20 bp, Homo sapiens
gaaaaaaaaacacacaaaaa

SEQ ID NO: 2985296 - DNA, 16 bp, Homo sapiens
gaaaaaaaaagaatta

SEQ ID NO: 2985297 - DNA, 14 bp, Homo sapiens
gaaaaaaaaatgcc

SEQ ID NO: 2985298 - DNA, 20 bp, Homo sapiens
gaaaaaaaaatgccataata

SEQ ID NO: 2985299 - DNA, 10 bp, Homo sapiens
gaaaaaaaga

SEQ ID NO: 2985300 - DNA, 20 bp, Homo sapiens
gaaaaaaagtttgccagaag

SEQ ID NO: 2985301 - DNA, 22 bp, Homo sapiens
gaaaaaaataattttaaaaatg

SEQ ID NO: 2985302 - DNA, 15 bp, Homo sapiens
gaaaaaaattacaaa

SEQ ID NO: 2985303 - DNA, 22 bp, Homo sapiens
gaaaaaaattacaaagaaaata

SEQ ID NO: 2985304 - DNA, 17 bp, Homo sapiens
gaaaaaactatatttga

SEQ ID NO: 2985305 - DNA, 18 bp, Homo sapiens
gaaaaaagggtttatgct

SEQ ID NO: 2985306 - DNA, 14 bp, Homo sapiens
gaaaaaagttactg

SEQ ID NO: 2985307 - DNA, 16 bp, Homo sapiens
gaaaaaatactaccta

SEQ ID NO: 2985308 - DNA, 19 bp, Homo sapiens
gaaaaaatgatgttcattt

SEQ ID NO: 2985309 - DNA, 20 bp, Homo sapiens
gaaaaacaacaaataattta

SEQ ID NO: 2985310 - DNA, 18 bp, Homo sapiens
gaaaaacatctgaaagcc

SEQ ID NO: 2985311 - DNA, 21 bp, Homo sapiens
gaaaaagaaagaactgtccgt

SEQ ID NO: 2985312 - DNA, 18 bp, Homo sapiens
gaaaaagacaatagtatt

SEQ ID NO: 2985313 - DNA, 19 bp, Homo sapiens
gaaaaagccaaaattgtca

SEQ ID NO: 2985314 - DNA, 15 bp, Homo sapiens
gaaaaaggctgtgct

SEQ ID NO: 2985315 - DNA, 16 bp, Homo sapiens
gaaaaaggctgtgctg

SEQ ID NO: 2985316 - DNA, 17 bp, Homo sapiens
gaaaaatagtgtctttg

SEQ ID NO: 2985317 - DNA, 16 bp, Homo sapiens
gaaaaatatttctgag

SEQ ID NO: 2985318 - DNA, 15 bp, Homo sapiens
gaaaaatgaaagatg

SEQ ID NO: 2985319 - DNA, 24 bp, Homo sapiens
gaaaaatgaactgtattattgcaa

SEQ ID NO: 2985320 - DNA, 17 bp, Homo sapiens
gaaaaatgatgtcttta

SEQ ID NO: 2985321 - DNA, 16 bp, Homo sapiens
gaaaaatgctttgctt

SEQ ID NO: 2985322 - DNA, 16 bp, Homo sapiens
gaaaaatggagcaaag

SEQ ID NO: 2985323 - DNA, 18 bp, Homo sapiens
gaaaaatgtaaaacacat

SEQ ID NO: 2985324 - DNA, 18 bp, Homo sapiens
gaaaaattcttggttatt

SEQ ID NO: 2985325 - DNA, 22 bp, Homo sapiens
gaaaaattgcattcattgactt

SEQ ID NO: 2985326 - DNA, 15 bp, Homo sapiens
gaaaacaaaggagca

SEQ ID NO: 2985327 - DNA, 14 bp, Homo sapiens
gaaaacaaagttct

SEQ ID NO: 2985328 - DNA, 15 bp, Homo sapiens
gaaaacaaagttcta

SEQ ID NO: 2985329 - DNA, 12 bp, Homo sapiens
gaaaacaaggaa

SEQ ID NO: 2985330 - DNA, 14 bp, Homo sapiens
gaaaacaataattt

SEQ ID NO: 2985331 - DNA, 22 bp, Homo sapiens
gaaaacaattgttctgggtgat

SEQ ID NO: 2985332 - DNA, 21 bp, Homo sapiens
gaaaacactgtgcacatctgt

SEQ ID NO: 2985333 - DNA, 21 bp, Homo sapiens
gaaaacactttcctggataaa

SEQ ID NO: 2985334 - DNA, 12 bp, Homo sapiens
gaaaacatctgg

SEQ ID NO: 2985335 - DNA, 17 bp, Homo sapiens
gaaaacattgatgaatg

SEQ ID NO: 2985336 - DNA, 19 bp, Homo sapiens
gaaaaccacaaacggagcc

SEQ ID NO: 2985337 - DNA, 18 bp, Homo sapiens
gaaaaccaccccttagat

SEQ ID NO: 2985338 - DNA, 16 bp, Homo sapiens
gaaaacccaaggccag

SEQ ID NO: 2985339 - DNA, 18 bp, Homo sapiens
gaaaacccaagtttttaa

SEQ ID NO: 2985340 - DNA, 13 bp, Homo sapiens
gaaaacccctggc

SEQ ID NO: 2985341 - DNA, 13 bp, Homo sapiens
gaaaacctctcct

SEQ ID NO: 2985342 - DNA, 16 bp, Homo sapiens
gaaaacgccagtgtgt

SEQ ID NO: 2985343 - DNA, 13 bp, Homo sapiens
gaaaacggagctg

SEQ ID NO: 2985344 - DNA, 14 bp, Homo sapiens
gaaaacggagctga

SEQ ID NO: 2985345 - DNA, 20 bp, Homo sapiens
gaaaactatgtattaattta

SEQ ID NO: 2985346 - DNA, 13 bp, Homo sapiens
gaaaactattcca

SEQ ID NO: 2985347 - DNA, 19 bp, Homo sapiens
gaaaactattccatgtttt

SEQ ID NO: 2985348 - DNA, 18 bp, Homo sapiens
gaaaactcagaatgaaaa

SEQ ID NO: 2985349 - DNA, 18 bp, Homo sapiens
gaaaactccaccttccca

SEQ ID NO: 2985350 - DNA, 21 bp, Homo sapiens
gaaaactccagggtcccctgc

SEQ ID NO: 2985351 - DNA, 16 bp, Homo sapiens
gaaaactgacagagga

SEQ ID NO: 2985352 - DNA, 19 bp, Homo sapiens
gaaaactggaaatctggat

SEQ ID NO: 2985353 - DNA, 16 bp, Homo sapiens
gaaaacttttctcaga

SEQ ID NO: 2985354 - DNA, 18 bp, Homo sapiens
gaaaagaaatcaattttt

SEQ ID NO: 2985355 - DNA, 22 bp, Homo sapiens
gaaaagaaatctatgattccag

SEQ ID NO: 2985356 - DNA, 11 bp, Homo sapiens
gaaaagagaga

SEQ ID NO: 2985357 - DNA, 21 bp, Homo sapiens
gaaaagagagcagagaatata

SEQ ID NO: 2985358 - DNA, 18 bp, Homo sapiens
gaaaagaggagaggaaaa

SEQ ID NO: 2985359 - DNA, 13 bp, Homo sapiens
gaaaagataaacc

SEQ ID NO: 2985360 - DNA, 23 bp, Homo sapiens
gaaaagattcttctgtgtttata

SEQ ID NO: 2985361 - DNA, 17 bp, Homo sapiens
gaaaagcagctctcccc

SEQ ID NO: 2985362 - DNA, 13 bp, Homo sapiens
gaaaagcctcagc

SEQ ID NO: 2985363 - DNA, 15 bp, Homo sapiens
gaaaagcctcagctc

SEQ ID NO: 2985364 - DNA, 16 bp, Homo sapiens
gaaaagccttcttata

SEQ ID NO: 2985365 - DNA, 18 bp, Homo sapiens
gaaaagcggacatcagct

SEQ ID NO: 2985366 - DNA, 12 bp, Homo sapiens
gaaaagcgtctt

SEQ ID NO: 2985367 - DNA, 19 bp, Homo sapiens
gaaaagcgtctttaagaga

SEQ ID NO: 2985368 - DNA, 20 bp, Homo sapiens
gaaaagcgtctttaagagac

SEQ ID NO: 2985369 - DNA, 22 bp, Homo sapiens
gaaaagctagtgtacctcctct

SEQ ID NO: 2985370 - DNA, 24 bp, Homo sapiens
gaaaagctagtgtacctcctctca

SEQ ID NO: 2985371 - DNA, 20 bp, Homo sapiens
gaagaattttcagaccccag

SEQ ID NO: 2985372 - DNA, 21 bp, Homo sapiens
gaagaattttcagaccccagc

SEQ ID NO: 2985373 - DNA, 16 bp, Homo sapiens
gaagacaacagaaaga

SEQ ID NO: 2985374 - DNA, 17 bp, Homo sapiens
gaagacaacagaaagag

SEQ ID NO: 2985375 - DNA, 13 bp, Homo sapiens
gaagacatatatt

SEQ ID NO: 2985376 - DNA, 15 bp, Homo sapiens
gaagacatatattat

SEQ ID NO: 2985377 - DNA, 16 bp, Homo sapiens
gaagacatatcatgtg

SEQ ID NO: 2985378 - DNA, 14 bp, Homo sapiens
gaagaccaaggcct

SEQ ID NO: 2985379 - DNA, 21 bp, Homo sapiens
gaagacgccgtctccatggca

SEQ ID NO: 2985380 - DNA, 19 bp, Homo sapiens
gaagactatttaccaggga

SEQ ID NO: 2985381 - DNA, 13 bp, Homo sapiens
gaagactccctga

SEQ ID NO: 2985382 - DNA, 19 bp, Homo sapiens
gaagactccctgatcccag

SEQ ID NO: 2985383 - DNA, 14 bp, Homo sapiens
gaagagaccactca

SEQ ID NO: 2985384 - DNA, 19 bp, Homo sapiens
gaagagcaggccagcccgg

SEQ ID NO: 2985385 - DNA, 18 bp, Homo sapiens
gaagagccatcttggcag

SEQ ID NO: 2985386 - DNA, 20 bp, Homo sapiens
gaagagccatcttggcaggg

SEQ ID NO: 2985387 - DNA, 17 bp, Homo sapiens
gaagagctattatataa

SEQ ID NO: 2985388 - DNA, 20 bp, Homo sapiens
gaagagctcaagggacaagg

SEQ ID NO: 2985389 - DNA, 13 bp, Homo sapiens
gaagaggagcctc

SEQ ID NO: 2985390 - DNA, 18 bp, Homo sapiens
gaagaggagcctcagaag

SEQ ID NO: 2985391 - DNA, 21 bp, Homo sapiens
gaagaggagcctcagaagaaa

SEQ ID NO: 2985392 - DNA, 15 bp, Homo sapiens
gaagagtaagttttc

SEQ ID NO: 2985393 - DNA, 13 bp, Homo sapiens
gaagagtcatttt

SEQ ID NO: 2985394 - DNA, 23 bp, Homo sapiens
gaagagtcattttcacttttaaa

SEQ ID NO: 2985395 - DNA, 18 bp, Homo sapiens
gaagagtgggtttcacaa

SEQ ID NO: 2985396 - DNA, 22 bp, Homo sapiens
gaagagttgccccgtctctgtt

SEQ ID NO: 2985397 - DNA, 20 bp, Homo sapiens
gaagataggctctcagtaag

SEQ ID NO: 2985398 - DNA, 14 bp, Homo sapiens
gaagatagtaactg

SEQ ID NO: 2985399 - DNA, 13 bp, Homo sapiens
gaagatcctgtga

SEQ ID NO: 2985400 - DNA, 20 bp, Homo sapiens
gaagatcctgtgaggagccc

SEQ ID NO: 2985401 - DNA, 22 bp, Homo sapiens
gaagatctctgcagggccgcca

SEQ ID NO: 2985402 - DNA, 14 bp, Homo sapiens
gaagatctgattta

SEQ ID NO: 2985403 - DNA, 19 bp, Homo sapiens
gaagcaacgtgttaattat

SEQ ID NO: 2985404 - DNA, 14 bp, Homo sapiens
gaagcaagctgtgt

SEQ ID NO: 2985405 - DNA, 22 bp, Homo sapiens
gaagcaagctgtgttacttgaa

SEQ ID NO: 2985406 - DNA, 20 bp, Homo sapiens
gaagcaattatttaaagaaa

SEQ ID NO: 2985407 - DNA, 21 bp, Homo sapiens
gaagcaattatttaaagaaag

SEQ ID NO: 2985408 - DNA, 22 bp, Homo sapiens
gaagcaattatttaaagaaagt

SEQ ID NO: 2985409 - DNA, 16 bp, Homo sapiens
gaagcactttttctgc

SEQ ID NO: 2985410 - DNA, 18 bp, Homo sapiens
gaagcagctctgccttct

SEQ ID NO: 2985411 - DNA, 12 bp, Homo sapiens
gaagcagctctt

SEQ ID NO: 2985412 - DNA, 15 bp, Homo sapiens
gaagcagtgagccgc

SEQ ID NO: 2985413 - DNA, 16 bp, Homo sapiens
gaagcagtgagccgca

SEQ ID NO: 2985414 - DNA, 23 bp, Homo sapiens
gaagcataatttgtttaaaattc

SEQ ID NO: 2985415 - DNA, 16 bp, Homo sapiens
gaagcatcctccccac

SEQ ID NO: 2985416 - DNA, 18 bp, Homo sapiens
gaagcatcctccccacca

SEQ ID NO: 2985417 - DNA, 23 bp, Homo sapiens
gaagcatcctccccaccagagct

SEQ ID NO: 2985418 - DNA, 16 bp, Homo sapiens
gaagcatgtaggagaa

SEQ ID NO: 2985419 - DNA, 17 bp, Homo sapiens
gaagcatgtaggagaat

SEQ ID NO: 2985420 - DNA, 13 bp, Homo sapiens
gaagccacagaaa

SEQ ID NO: 2985421 - DNA, 15 bp, Homo sapiens
gaagccacagcccag

SEQ ID NO: 2985422 - DNA, 17 bp, Homo sapiens
gaagccacagcccaggc

SEQ ID NO: 2985423 - DNA, 18 bp, Homo sapiens
gaagccacagcccaggcc

SEQ ID NO: 2985424 - DNA, 16 bp, Homo sapiens
gaagccacccttccct

SEQ ID NO: 2985425 - DNA, 17 bp, Homo sapiens
gaagccacccttccctg

SEQ ID NO: 2985426 - DNA, 20 bp, Homo sapiens
gaagccacccttccctgcct

SEQ ID NO: 2985427 - DNA, 23 bp, Homo sapiens
gaagccacccttccctgcctcca

SEQ ID NO: 2985428 - DNA, 23 bp, Homo sapiens
gaagccaggaatttcccaggacc

SEQ ID NO: 2985429 - DNA, 14 bp, Homo sapiens
gaagccattgtctt

SEQ ID NO: 2985430 - DNA, 18 bp, Homo sapiens
gaagcccaattgctggag

SEQ ID NO: 2985431 - DNA, 14 bp, Homo sapiens
gaagcccagacctc

SEQ ID NO: 2985432 - DNA, 15 bp, Homo sapiens
gaagcccagctctgg

SEQ ID NO: 2985433 - DNA, 12 bp, Homo sapiens
gaagccctcctt

SEQ ID NO: 2985434 - DNA, 16 bp, Homo sapiens
gaagccctccttccac

SEQ ID NO: 2985435 - DNA, 21 bp, Homo sapiens
gaagccctggatttcagaaag

SEQ ID NO: 2985436 - DNA, 13 bp, Homo sapiens
gaagccctgttct

SEQ ID NO: 2985437 - DNA, 20 bp, Homo sapiens
gaagccgtgctcgccccagc

SEQ ID NO: 2985438 - DNA, 18 bp, Homo sapiens
gaagcctaattgtcacat

SEQ ID NO: 2985439 - DNA, 22 bp, Homo sapiens
gaagcctaggaggactggggta

SEQ ID NO: 2985440 - DNA, 19 bp, Homo sapiens
gaagcctcaagttccagtg

SEQ ID NO: 2985441 - DNA, 12 bp, Homo sapiens
gaagcctgtcct

SEQ ID NO: 2985442 - DNA, 16 bp, Homo sapiens
gaagccttgctgaact

SEQ ID NO: 2985443 - DNA, 14 bp, Homo sapiens
gaagcgaacatctt

SEQ ID NO: 2985444 - DNA, 20 bp, Homo sapiens
gaagcgaacatcttcatata

SEQ ID NO: 2985445 - DNA, 17 bp, Homo sapiens
gaagctaatttgcatta

SEQ ID NO: 2985446 - DNA, 22 bp, Homo sapiens
gaagctacaggttacaacagat

SEQ ID NO: 2985447 - DNA, 23 bp, Homo sapiens
gaagctacaggttacaacagatt

SEQ ID NO: 2985448 - DNA, 17 bp, Homo sapiens
gaagctcctctccccag

SEQ ID NO: 2985449 - DNA, 22 bp, Homo sapiens
gaagctgaaaacctaagtcctt

SEQ ID NO: 2985450 - DNA, 19 bp, Homo sapiens
gaagctgagcaccagggga

SEQ ID NO: 2985451 - DNA, 13 bp, Homo sapiens
gaagctgcatcca

SEQ ID NO: 2985452 - DNA, 13 bp, Homo sapiens
gaagctgctccgt

SEQ ID NO: 2985453 - DNA, 12 bp, Homo sapiens
gaagctgctgca

SEQ ID NO: 2985454 - DNA, 15 bp, Homo sapiens
gaagctgctgcagcc

SEQ ID NO: 2985455 - DNA, 14 bp, Homo sapiens
gaagctgctggagc

SEQ ID NO: 2985456 - DNA, 15 bp, Homo sapiens
gaagctgtgttgaaa

SEQ ID NO: 2985457 - DNA, 19 bp, Homo sapiens
gaagctgtgttgaaacaga

SEQ ID NO: 2985458 - DNA, 20 bp, Homo sapiens
gaagctgtgttgaaacagaa

SEQ ID NO: 2985459 - DNA, 21 bp, Homo sapiens
gaagctgtgttgaaacagaaa

SEQ ID NO: 2985460 - DNA, 22 bp, Homo sapiens
gaagctgtgttgaaacagaaaa

SEQ ID NO: 2985461 - DNA, 20 bp, Homo sapiens
gaagctgttgggagaaagca

SEQ ID NO: 2985462 - DNA, 15 bp, Homo sapiens
gaagcttatgtttct

SEQ ID NO: 2985463 - DNA, 17 bp, Homo sapiens
gaagcttatgtttctta

SEQ ID NO: 2985464 - DNA, 22 bp, Homo sapiens
gaagcttgtgtatccattatca

SEQ ID NO: 2985465 - DNA, 14 bp, Homo sapiens
gaagctttggtgag

SEQ ID NO: 2985466 - DNA, 20 bp, Homo sapiens
gaagctttggtgagaacctg

SEQ ID NO: 2985467 - DNA, 20 bp, Homo sapiens
gaagctttgtcccctgcttc

SEQ ID NO: 2985468 - DNA, 23 bp, Homo sapiens
gaaggaaaaaattatgtttttca

SEQ ID NO: 2985469 - DNA, 23 bp, Homo sapiens
gaaggaaagcatgtctctgcttc

SEQ ID NO: 2985470 - DNA, 21 bp, Homo sapiens
gaaggaaatgagtggccagcg

SEQ ID NO: 2985471 - DNA, 23 bp, Homo sapiens
gaaggaaccaaagcgaattttaa

SEQ ID NO: 2985472 - DNA, 21 bp, Homo sapiens
gaaggaagctgtgttgaaaca

SEQ ID NO: 2985473 - DNA, 15 bp, Homo sapiens
gaaggacagactggc

SEQ ID NO: 2985474 - DNA, 19 bp, Homo sapiens
gaaggacaggtctctgaga

SEQ ID NO: 2985475 - DNA, 15 bp, Homo sapiens
gaaggaccagccctt

SEQ ID NO: 2985476 - DNA, 14 bp, Homo sapiens
gaaggacccctcac

SEQ ID NO: 2985477 - DNA, 20 bp, Homo sapiens
gaaggacccctcaccacccc

SEQ ID NO: 2985478 - DNA, 20 bp, Homo sapiens
gaaggactggccgtggctcc

SEQ ID NO: 2985479 - DNA, 15 bp, Homo sapiens
gaaggagacacagat

SEQ ID NO: 2985480 - DNA, 17 bp, Homo sapiens
gaaggagcccctgagtc

SEQ ID NO: 2985481 - DNA, 21 bp, Homo sapiens
gaaggagtgtatgagtgtgag

SEQ ID NO: 2985482 - DNA, 21 bp, Homo sapiens
gaaggatcccatgagctcctt

SEQ ID NO: 2985483 - DNA, 13 bp, Homo sapiens
gaaggatgggaaa

SEQ ID NO: 2985484 - DNA, 15 bp, Homo sapiens
gaaggatgtacattt

SEQ ID NO: 2985485 - DNA, 16 bp, Homo sapiens
gaaggatgtacatttc

SEQ ID NO: 2985486 - DNA, 20 bp, Homo sapiens
gaaggatgtacatttccaaa

SEQ ID NO: 2985487 - DNA, 12 bp, Homo sapiens
gaaggcaaaggc

SEQ ID NO: 2985488 - DNA, 13 bp, Homo sapiens
gaaggcaaaggca

SEQ ID NO: 2985489 - DNA, 17 bp, Homo sapiens
gaaggcaaaggcagagg

SEQ ID NO: 2985490 - DNA, 24 bp, Homo sapiens
gaaggcactaaaaagagctgtcct

SEQ ID NO: 2985491 - DNA, 15 bp, Homo sapiens
gaaggcagagaaagg

SEQ ID NO: 2985492 - DNA, 23 bp, Homo sapiens
gaaggcatttgcagggtcctctt

SEQ ID NO: 2985493 - DNA, 22 bp, Homo sapiens
gaaggccagctgccccagccag

SEQ ID NO: 2985494 - DNA, 17 bp, Homo sapiens
gaaggcccatgaaggaa

SEQ ID NO: 2985495 - DNA, 22 bp, Homo sapiens
gaaggccgagaagcaagaaaga

SEQ ID NO: 2985496 - DNA, 17 bp, Homo sapiens
gaaggcctaggctagga

SEQ ID NO: 2985497 - DNA, 20 bp, Homo sapiens
gaaggcctccctagccagca

SEQ ID NO: 2985498 - DNA, 18 bp, Homo sapiens
gaaggctggcatgatcca

SEQ ID NO: 2985499 - DNA, 12 bp, Homo sapiens
gaaggctttgtg

SEQ ID NO: 2985500 - DNA, 16 bp, Homo sapiens
gaagggacggctgtgg

SEQ ID NO: 2985501 - DNA, 22 bp, Homo sapiens
gaagggacggctgtgggaccag

SEQ ID NO: 2985502 - DNA, 21 bp, Homo sapiens
gacaggcggggcccagcgctc

SEQ ID NO: 2985503 - DNA, 17 bp, Homo sapiens
gacaggctggaatgagg

SEQ ID NO: 2985504 - DNA, 17 bp, Homo sapiens
gacagggaagctacagg

SEQ ID NO: 2985505 - DNA, 18 bp, Homo sapiens
gacaggggcaggaggaag

SEQ ID NO: 2985506 - DNA, 17 bp, Homo sapiens
gacagggttttttcatt

SEQ ID NO: 2985507 - DNA, 13 bp, Homo sapiens
gacaggtctctga

SEQ ID NO: 2985508 - DNA, 16 bp, Homo sapiens
gacaggtctctgagac

SEQ ID NO: 2985509 - DNA, 16 bp, Homo sapiens
gacaggttagctgctc

SEQ ID NO: 2985510 - DNA, 15 bp, Homo sapiens
gacagtatacagtcc

SEQ ID NO: 2985511 - DNA, 21 bp, Homo sapiens
gacagtccgtcaaaacagatt

SEQ ID NO: 2985512 - DNA, 18 bp, Homo sapiens
gacagtcgctcagtctgt

SEQ ID NO: 2985513 - DNA, 18 bp, Homo sapiens
gacagtcggaaaagcgtc

SEQ ID NO: 2985514 - DNA, 22 bp, Homo sapiens
gacagtgacgtgactcagagct

SEQ ID NO: 2985515 - DNA, 13 bp, Homo sapiens
gacagtgcacatg

SEQ ID NO: 2985516 - DNA, 14 bp, Homo sapiens
gacagtgccctgag

SEQ ID NO: 2985517 - DNA, 17 bp, Homo sapiens
gacagtggctgacaagg

SEQ ID NO: 2985518 - DNA, 15 bp, Homo sapiens
gacagtgtgggcgct

SEQ ID NO: 2985519 - DNA, 14 bp, Homo sapiens
gacagttctgaaga

SEQ ID NO: 2985520 - DNA, 16 bp, Homo sapiens
gacagttgtttggaga

SEQ ID NO: 2985521 - DNA, 18 bp, Homo sapiens
gacagtttactttgccaa

SEQ ID NO: 2985522 - DNA, 19 bp, Homo sapiens
gacagtttactttgccaac

SEQ ID NO: 2985523 - DNA, 14 bp, Homo sapiens
gacagtttgtttcc

SEQ ID NO: 2985524 - DNA, 16 bp, Homo sapiens
gacagtttgtttcctg

SEQ ID NO: 2985525 - DNA, 17 bp, Homo sapiens
gacataaaatttacatt

SEQ ID NO: 2985526 - DNA, 15 bp, Homo sapiens
gacatacttgaaggg

SEQ ID NO: 2985527 - DNA, 19 bp, Homo sapiens
gacatagaagagccaagag

SEQ ID NO: 2985528 - DNA, 20 bp, Homo sapiens
gacatagagagggagaagaa

SEQ ID NO: 2985529 - DNA, 22 bp, Homo sapiens
gacatagagagggagaagaagt

SEQ ID NO: 2985530 - DNA, 20 bp, Homo sapiens
gacatagcatccaagtggca

SEQ ID NO: 2985531 - DNA, 22 bp, Homo sapiens
gacatagcctcatgttctgtgg

SEQ ID NO: 2985532 - DNA, 18 bp, Homo sapiens
gacatatcatgtgtgaga

SEQ ID NO: 2985533 - DNA, 14 bp, Homo sapiens
gacatatttaactg

SEQ ID NO: 2985534 - DNA, 15 bp, Homo sapiens
gacatatttaactgg

SEQ ID NO: 2985535 - DNA, 13 bp, Homo sapiens
gacatatttcagt

SEQ ID NO: 2985536 - DNA, 19 bp, Homo sapiens
gacatcacagggtgggcct

SEQ ID NO: 2985537 - DNA, 13 bp, Homo sapiens
gacatcagctggt

SEQ ID NO: 2985538 - DNA, 18 bp, Homo sapiens
gacatccataaagaagca

SEQ ID NO: 2985539 - DNA, 20 bp, Homo sapiens
gacatccataaagaagcaat

SEQ ID NO: 2985540 - DNA, 23 bp, Homo sapiens
gacatccccccgccaaaagctgc

SEQ ID NO: 2985541 - DNA, 17 bp, Homo sapiens
gacatccttgcagttta

SEQ ID NO: 2985542 - DNA, 13 bp, Homo sapiens
gacatcgatatga

SEQ ID NO: 2985543 - DNA, 16 bp, Homo sapiens
gacatcgatatgaaaa

SEQ ID NO: 2985544 - DNA, 17 bp, Homo sapiens
gacatcgatatgaaaaa

SEQ ID NO: 2985545 - DNA, 16 bp, Homo sapiens
gacatctctttgaatt

SEQ ID NO: 2985546 - DNA, 18 bp, Homo sapiens
gacatctggaatctggag

SEQ ID NO: 2985547 - DNA, 15 bp, Homo sapiens
gacatgaaaagttat

SEQ ID NO: 2985548 - DNA, 15 bp, Homo sapiens
gacatgaccctctgt

SEQ ID NO: 2985549 - DNA, 19 bp, Homo sapiens
gacatgaccctctgtcccc

SEQ ID NO: 2985550 - DNA, 16 bp, Homo sapiens
gacatgatttccttga

SEQ ID NO: 2985551 - DNA, 20 bp, Homo sapiens
gacatgatttccttgaatgt

SEQ ID NO: 2985552 - DNA, 14 bp, Homo sapiens
gacatgccctgtgt

SEQ ID NO: 2985553 - DNA, 17 bp, Homo sapiens
gacatgccctgtgtggc

SEQ ID NO: 2985554 - DNA, 16 bp, Homo sapiens
gacatgcggtagccag

SEQ ID NO: 2985555 - DNA, 18 bp, Homo sapiens
gacatgcggtagccagca

SEQ ID NO: 2985556 - DNA, 23 bp, Homo sapiens
gacatgcggtagccagcacacag

SEQ ID NO: 2985557 - DNA, 19 bp, Homo sapiens
gacatggaggttctaaggc

SEQ ID NO: 2985558 - DNA, 17 bp, Homo sapiens
gacatggagtgttactg

SEQ ID NO: 2985559 - DNA, 16 bp, Homo sapiens
gacatggtctgtcctg

SEQ ID NO: 2985560 - DNA, 22 bp, Homo sapiens
gacatgtaccccctttcccttc

SEQ ID NO: 2985561 - DNA, 16 bp, Homo sapiens
gacatgttttgataaa

SEQ ID NO: 2985562 - DNA, 14 bp, Homo sapiens
gacattaactcatt

SEQ ID NO: 2985563 - DNA, 23 bp, Homo sapiens
gacattatgtggttttagatttt

SEQ ID NO: 2985564 - DNA, 21 bp, Homo sapiens
gacattcaaaaaactctctcc

SEQ ID NO: 2985565 - DNA, 15 bp, Homo sapiens
gacattcacctgccc

SEQ ID NO: 2985566 - DNA, 18 bp, Homo sapiens
gacattcacctgccccaa

SEQ ID NO: 2985567 - DNA, 14 bp, Homo sapiens
gacattctgccagg

SEQ ID NO: 2985568 - DNA, 17 bp, Homo sapiens
gacattctgccaggccc

SEQ ID NO: 2985569 - DNA, 16 bp, Homo sapiens
gacattgatgtgttcg

SEQ ID NO: 2985570 - DNA, 14 bp, Homo sapiens
gacattgcgtttga

SEQ ID NO: 2985571 - DNA, 21 bp, Homo sapiens
gacattgcgtttgacctttta

SEQ ID NO: 2985572 - DNA, 23 bp, Homo sapiens
gacattgggtctattccagctca

SEQ ID NO: 2985573 - DNA, 12 bp, Homo sapiens
gacattgtaaat

SEQ ID NO: 2985574 - DNA, 13 bp, Homo sapiens
gacattgtaaata

SEQ ID NO: 2985575 - DNA, 20 bp, Homo sapiens
gacattgtttggatttcctt

SEQ ID NO: 2985576 - DNA, 22 bp, Homo sapiens
gacattgtttggatttccttta

SEQ ID NO: 2985577 - DNA, 14 bp, Homo sapiens
gacatttatattaa

SEQ ID NO: 2985578 - DNA, 20 bp, Homo sapiens
gacatttatattaaataaca

SEQ ID NO: 2985579 - DNA, 18 bp, Homo sapiens
gacatttcaaaattaata

SEQ ID NO: 2985580 - DNA, 18 bp, Homo sapiens
gacatttcaaatctgtag

SEQ ID NO: 2985581 - DNA, 13 bp, Homo sapiens
gacatttctctaa

SEQ ID NO: 2985582 - DNA, 19 bp, Homo sapiens
gacattttaacaagaagat

SEQ ID NO: 2985583 - DNA, 22 bp, Homo sapiens
gacattttaacaagaagatgaa

SEQ ID NO: 2985584 - DNA, 19 bp, Homo sapiens
gaccaaaaaaggacgtaaa

SEQ ID NO: 2985585 - DNA, 14 bp, Homo sapiens
gaccaaagggggag

SEQ ID NO: 2985586 - DNA, 17 bp, Homo sapiens
gaccaaattgcttctag

SEQ ID NO: 2985587 - DNA, 18 bp, Homo sapiens
gaccaaattgcttctagg

SEQ ID NO: 2985588 - DNA, 21 bp, Homo sapiens
gaccaacaaagtcacagtcgt

SEQ ID NO: 2985589 - DNA, 20 bp, Homo sapiens
gaccaacagaacttcacagt

SEQ ID NO: 2985590 - DNA, 21 bp, Homo sapiens
gaccaacatggagaaaccctg

SEQ ID NO: 2985591 - DNA, 19 bp, Homo sapiens
gaccaagcaggaagctcag

SEQ ID NO: 2985592 - DNA, 13 bp, Homo sapiens
gaccaaggagcat

SEQ ID NO: 2985593 - DNA, 21 bp, Homo sapiens
gaccaaggcctcggcagaact

SEQ ID NO: 2985594 - DNA, 14 bp, Homo sapiens
gaccaatacatttg

SEQ ID NO: 2985595 - DNA, 19 bp, Homo sapiens
gaccaatacatttgtattt

SEQ ID NO: 2985596 - DNA, 17 bp, Homo sapiens
gaccaataccccgactc

SEQ ID NO: 2985597 - DNA, 20 bp, Homo sapiens
gaccaattagtcactgctgc

SEQ ID NO: 2985598 - DNA, 20 bp, Homo sapiens
gaccacaccagcctcctggg

SEQ ID NO: 2985599 - DNA, 14 bp, Homo sapiens
gaccacagcacagc

SEQ ID NO: 2985600 - DNA, 22 bp, Homo sapiens
gaccactcttctctccaaggaa

SEQ ID NO: 2985601 - DNA, 13 bp, Homo sapiens
gaccactgggccc

SEQ ID NO: 2985602 - DNA, 23 bp, Homo sapiens
gaccactgggcccctcaggggaa

SEQ ID NO: 2985603 - DNA, 17 bp, Homo sapiens
gaccacttggaaataaa

SEQ ID NO: 2985604 - DNA, 22 bp, Homo sapiens
gaccagaaacagggacaaagaa

SEQ ID NO: 2985605 - DNA, 13 bp, Homo sapiens
gaccagagcaaaa

SEQ ID NO: 2985606 - DNA, 15 bp, Homo sapiens
gaccagaggagcctt

SEQ ID NO: 2985607 - DNA, 18 bp, Homo sapiens
gaccagaggagccttttt

SEQ ID NO: 2985608 - DNA, 21 bp, Homo sapiens
gaccagaggagcctttttaaa

SEQ ID NO: 2985609 - DNA, 20 bp, Homo sapiens
gaccagagggatgggagagt

SEQ ID NO: 2985610 - DNA, 18 bp, Homo sapiens
gaccagccgtgagcatgt

SEQ ID NO: 2985611 - DNA, 22 bp, Homo sapiens
gaccagcctggccaacatggta

SEQ ID NO: 2985612 - DNA, 15 bp, Homo sapiens
gaccagcctgtccaa

SEQ ID NO: 2985613 - DNA, 18 bp, Homo sapiens
gaccagcctgtccaacat

SEQ ID NO: 2985614 - DNA, 12 bp, Homo sapiens
gaccagcctttc

SEQ ID NO: 2985615 - DNA, 16 bp, Homo sapiens
gaccagcctttcttcc

SEQ ID NO: 2985616 - DNA, 21 bp, Homo sapiens
gaccagcggtccatgggtctg

SEQ ID NO: 2985617 - DNA, 14 bp, Homo sapiens
gaccagctcaggac

SEQ ID NO: 2985618 - DNA, 17 bp, Homo sapiens
gaccaggacccagggag

SEQ ID NO: 2985619 - DNA, 13 bp, Homo sapiens
gaccaggatccag

SEQ ID NO: 2985620 - DNA, 15 bp, Homo sapiens
gaccaggatccagcc

SEQ ID NO: 2985621 - DNA, 16 bp, Homo sapiens
gaccagggaagtgtgt

SEQ ID NO: 2985622 - DNA, 15 bp, Homo sapiens
gaccagggcagggcc

SEQ ID NO: 2985623 - DNA, 16 bp, Homo sapiens
gaccaggggaccagag

SEQ ID NO: 2985624 - DNA, 19 bp, Homo sapiens
gaccaggggaccagaggga

SEQ ID NO: 2985625 - DNA, 23 bp, Homo sapiens
gaccagtgaagacgtcaggggca

SEQ ID NO: 2985626 - DNA, 12 bp, Homo sapiens
gaccatgaaaca

SEQ ID NO: 2985627 - DNA, 13 bp, Homo sapiens
gaccatggggagg

SEQ ID NO: 2985628 - DNA, 19 bp, Homo sapiens
gacccaaaaatgttccctt

SEQ ID NO: 2985629 - DNA, 17 bp, Homo sapiens
gacccaaagcaggatga

SEQ ID NO: 2985630 - DNA, 16 bp, Homo sapiens
gacccaaggaaaactg

SEQ ID NO: 2985631 - DNA, 14 bp, Homo sapiens
gacccaaggaggaa

SEQ ID NO: 2985632 - DNA, 18 bp, Homo sapiens
gacccaatgtaggagctg

SEQ ID NO: 2985633 - DNA, 19 bp, Homo sapiens
gacccaatgtaggagctgc

SEQ ID NO: 2985634 - DNA, 23 bp, Homo sapiens
gactggtaggaggaggcatggaa

SEQ ID NO: 2985635 - DNA, 19 bp, Homo sapiens
gactggtgagagaagaaaa

SEQ ID NO: 2985636 - DNA, 16 bp, Homo sapiens
gactggttatcttgtt

SEQ ID NO: 2985637 - DNA, 15 bp, Homo sapiens
gactgtatttgtgac

SEQ ID NO: 2985638 - DNA, 20 bp, Homo sapiens
gactgtatttgtgactaatt

SEQ ID NO: 2985639 - DNA, 22 bp, Homo sapiens
gactgtatttgtgactaattgt

SEQ ID NO: 2985640 - DNA, 15 bp, Homo sapiens
gactgtcagggaggg

SEQ ID NO: 2985641 - DNA, 17 bp, Homo sapiens
gactgtcagggagggcc

SEQ ID NO: 2985642 - DNA, 21 bp, Homo sapiens
gactgtggcaaacaaaaccaa

SEQ ID NO: 2985643 - DNA, 22 bp, Homo sapiens
gactgtgtattctagttttgtc

SEQ ID NO: 2985644 - DNA, 15 bp, Homo sapiens
gactgttgatgtact

SEQ ID NO: 2985645 - DNA, 19 bp, Homo sapiens
gactgtttttcggacagtt

SEQ ID NO: 2985646 - DNA, 18 bp, Homo sapiens
gacttatcaacactataa

SEQ ID NO: 2985647 - DNA, 15 bp, Homo sapiens
gacttattcttttat

SEQ ID NO: 2985648 - DNA, 16 bp, Homo sapiens
gacttattcttttata

SEQ ID NO: 2985649 - DNA, 15 bp, Homo sapiens
gacttccaaagaatg

SEQ ID NO: 2985650 - DNA, 23 bp, Homo sapiens
gacttccacatttttgcacagat

SEQ ID NO: 2985651 - DNA, 12 bp, Homo sapiens
gacttcccagct

SEQ ID NO: 2985652 - DNA, 20 bp, Homo sapiens
gacttccccgcattccaggc

SEQ ID NO: 2985653 - DNA, 18 bp, Homo sapiens
gacttcctgtccagctcc

SEQ ID NO: 2985654 - DNA, 20 bp, Homo sapiens
gacttcctgtccagctccaa

SEQ ID NO: 2985655 - DNA, 21 bp, Homo sapiens
gacttcctgtccagctccaac

SEQ ID NO: 2985656 - DNA, 14 bp, Homo sapiens
gacttccttgagac

SEQ ID NO: 2985657 - DNA, 15 bp, Homo sapiens
gacttccttgagaca

SEQ ID NO: 2985658 - DNA, 23 bp, Homo sapiens
gacttctgaaaaatgaatgtaaa

SEQ ID NO: 2985659 - DNA, 18 bp, Homo sapiens
gacttcttggtgctgttg

SEQ ID NO: 2985660 - DNA, 12 bp, Homo sapiens
gacttcttttca

SEQ ID NO: 2985661 - DNA, 15 bp, Homo sapiens
gacttcttttcacat

SEQ ID NO: 2985662 - DNA, 16 bp, Homo sapiens
gacttcttttcacatt

SEQ ID NO: 2985663 - DNA, 14 bp, Homo sapiens
gacttgagccctgc

SEQ ID NO: 2985664 - DNA, 16 bp, Homo sapiens
gacttgagtctatttt

SEQ ID NO: 2985665 - DNA, 21 bp, Homo sapiens
gacttgccagagccgggcaca

SEQ ID NO: 2985666 - DNA, 23 bp, Homo sapiens
gacttgccatgtgactctggctt

SEQ ID NO: 2985667 - DNA, 11 bp, Homo sapiens
gacttgcttta

SEQ ID NO: 2985668 - DNA, 20 bp, Homo sapiens
gacttggagaatactgccaa

SEQ ID NO: 2985669 - DNA, 13 bp, Homo sapiens
gacttggatgagg

SEQ ID NO: 2985670 - DNA, 21 bp, Homo sapiens
gacttggtacagttgcaggag

SEQ ID NO: 2985671 - DNA, 17 bp, Homo sapiens
gacttgtaggaatctgc

SEQ ID NO: 2985672 - DNA, 19 bp, Homo sapiens
gacttgtaggaatctgcct

SEQ ID NO: 2985673 - DNA, 23 bp, Homo sapiens
gacttgtaggaatctgccttcca

SEQ ID NO: 2985674 - DNA, 15 bp, Homo sapiens
gacttgtttcctgtg

SEQ ID NO: 2985675 - DNA, 13 bp, Homo sapiens
gacttgttttaat

SEQ ID NO: 2985676 - DNA, 22 bp, Homo sapiens
gactttaaagatgattgttctt

SEQ ID NO: 2985677 - DNA, 23 bp, Homo sapiens
gactttaaagatgattgttcttt

SEQ ID NO: 2985678 - DNA, 15 bp, Homo sapiens
gactttaatttatgt

SEQ ID NO: 2985679 - DNA, 21 bp, Homo sapiens
gactttacactcggctttgga

SEQ ID NO: 2985680 - DNA, 19 bp, Homo sapiens
gactttagaaagctgacat

SEQ ID NO: 2985681 - DNA, 14 bp, Homo sapiens
gactttagtagttt

SEQ ID NO: 2985682 - DNA, 21 bp, Homo sapiens
gactttatctaatacctctgt

SEQ ID NO: 2985683 - DNA, 16 bp, Homo sapiens
gactttcctaaatgtt

SEQ ID NO: 2985684 - DNA, 17 bp, Homo sapiens
gactttctgaaactccc

SEQ ID NO: 2985685 - DNA, 13 bp, Homo sapiens
gacttttaaaatt

SEQ ID NO: 2985686 - DNA, 21 bp, Homo sapiens
gacttttaatgtcatttgtta

SEQ ID NO: 2985687 - DNA, 18 bp, Homo sapiens
gacttttagcattcgttt

SEQ ID NO: 2985688 - DNA, 13 bp, Homo sapiens
gacttttgaagaa

SEQ ID NO: 2985689 - DNA, 21 bp, Homo sapiens
gagaaaaaaaaacacacaaaa

SEQ ID NO: 2985690 - DNA, 23 bp, Homo sapiens
gagaaaaaaaaacacacaaaaag

SEQ ID NO: 2985691 - DNA, 18 bp, Homo sapiens
gagaaaaaatcactgttt

SEQ ID NO: 2985692 - DNA, 12 bp, Homo sapiens
gagaaaaagacc

SEQ ID NO: 2985693 - DNA, 11 bp, Homo sapiens
gagaaaataaa

SEQ ID NO: 2985694 - DNA, 13 bp, Homo sapiens
gagaaaataaaaa

SEQ ID NO: 2985695 - DNA, 15 bp, Homo sapiens
gagaaaataaaaagt

SEQ ID NO: 2985696 - DNA, 19 bp, Homo sapiens
gagaaaataaaaagttaaa

SEQ ID NO: 2985697 - DNA, 19 bp, Homo sapiens
gagaaaatttatcacctaa

SEQ ID NO: 2985698 - DNA, 21 bp, Homo sapiens
gagaaacactatttgtgactt

SEQ ID NO: 2985699 - DNA, 15 bp, Homo sapiens
gagaaagagacagag

SEQ ID NO: 2985700 - DNA, 18 bp, Homo sapiens
gagaaagcacaatttaaa

SEQ ID NO: 2985701 - DNA, 22 bp, Homo sapiens
gagaaagcacaatttaaaacaa

SEQ ID NO: 2985702 - DNA, 22 bp, Homo sapiens
gagaaagcccacctgggctggg

SEQ ID NO: 2985703 - DNA, 19 bp, Homo sapiens
gagaaagggcagaggaaga

SEQ ID NO: 2985704 - DNA, 18 bp, Homo sapiens
gagaaagtgtgagcaaac

SEQ ID NO: 2985705 - DNA, 11 bp, Homo sapiens
gagaaatgtaa

SEQ ID NO: 2985706 - DNA, 13 bp, Homo sapiens
gagaaatgtaatg

SEQ ID NO: 2985707 - DNA, 23 bp, Homo sapiens
gagaaatgtaatgcgattttatt

SEQ ID NO: 2985708 - DNA, 15 bp, Homo sapiens
gagaacaaagagtga

SEQ ID NO: 2985709 - DNA, 19 bp, Homo sapiens
gagaacaaagagtgaaata

SEQ ID NO: 2985710 - DNA, 13 bp, Homo sapiens
gagaacaaagatg

SEQ ID NO: 2985711 - DNA, 21 bp, Homo sapiens
gagaacctgggttgcagacag

SEQ ID NO: 2985712 - DNA, 23 bp, Homo sapiens
gagaacctgggttgcagacagga

SEQ ID NO: 2985713 - DNA, 21 bp, Homo sapiens
gagaacgggcgtcaggggtgc

SEQ ID NO: 2985714 - DNA, 13 bp, Homo sapiens
gagaactccagct

SEQ ID NO: 2985715 - DNA, 23 bp, Homo sapiens
gagaactccagctggtgccccca

SEQ ID NO: 2985716 - DNA, 16 bp, Homo sapiens
gagaactgaaaagaga

SEQ ID NO: 2985717 - DNA, 23 bp, Homo sapiens
gagaactgcatatgtttcgctga

SEQ ID NO: 2985718 - DNA, 20 bp, Homo sapiens
gagaacttatggccacagcc

SEQ ID NO: 2985719 - DNA, 14 bp, Homo sapiens
gagaagaaaacatt

SEQ ID NO: 2985720 - DNA, 20 bp, Homo sapiens
gagaagaattttcagacccc

SEQ ID NO: 2985721 - DNA, 21 bp, Homo sapiens
gagaagaattttcagacccca

SEQ ID NO: 2985722 - DNA, 14 bp, Homo sapiens
gagaagaggaggag

SEQ ID NO: 2985723 - DNA, 20 bp, Homo sapiens
gagaagccattgtcttcgga

SEQ ID NO: 2985724 - DNA, 16 bp, Homo sapiens
gagaaggaaaaagaaa

SEQ ID NO: 2985725 - DNA, 14 bp, Homo sapiens
gagaaggaaatgca

SEQ ID NO: 2985726 - DNA, 15 bp, Homo sapiens
gagaaggaaatgcag

SEQ ID NO: 2985727 - DNA, 12 bp, Homo sapiens
gagaaggcagga

SEQ ID NO: 2985728 - DNA, 23 bp, Homo sapiens
gagaaggcaggaatgtgtggcag

SEQ ID NO: 2985729 - DNA, 14 bp, Homo sapiens
gagaaggcctcccc

SEQ ID NO: 2985730 - DNA, 15 bp, Homo sapiens
gagaaggcctcccct

SEQ ID NO: 2985731 - DNA, 20 bp, Homo sapiens
gagaagggaatcctcctcca

SEQ ID NO: 2985732 - DNA, 17 bp, Homo sapiens
gagaaggggacttctct

SEQ ID NO: 2985733 - DNA, 18 bp, Homo sapiens
gagaaggggacttctctt

SEQ ID NO: 2985734 - DNA, 16 bp, Homo sapiens
gagaaggggtgtgcat

SEQ ID NO: 2985735 - DNA, 23 bp, Homo sapiens
gagaaggtactgaaataatgatc

SEQ ID NO: 2985736 - DNA, 18 bp, Homo sapiens
gagaagtctttcaagaat

SEQ ID NO: 2985737 - DNA, 19 bp, Homo sapiens
gagaagtgacagggaagct

SEQ ID NO: 2985738 - DNA, 23 bp, Homo sapiens
gagaagtgacagggaagctacag

SEQ ID NO: 2985739 - DNA, 24 bp, Homo sapiens
gagaagtgacagggaagctacagg

SEQ ID NO: 2985740 - DNA, 22 bp, Homo sapiens
gagaatactgccaaaacattta

SEQ ID NO: 2985741 - DNA, 15 bp, Homo sapiens
gagaatagagctgcc

SEQ ID NO: 2985742 - DNA, 20 bp, Homo sapiens
gagaatagagctgccactgg

SEQ ID NO: 2985743 - DNA, 20 bp, Homo sapiens
gagaatcagatcatttcaaa

SEQ ID NO: 2985744 - DNA, 21 bp, Homo sapiens
gagaatctacccccagatcca

SEQ ID NO: 2985745 - DNA, 13 bp, Homo sapiens
gagaatgaattca

SEQ ID NO: 2985746 - DNA, 16 bp, Homo sapiens
gagaattcttacatgt

SEQ ID NO: 2985747 - DNA, 13 bp, Homo sapiens
gagaattgcttga

SEQ ID NO: 2985748 - DNA, 19 bp, Homo sapiens
gagacaaaagaaaaaatat

SEQ ID NO: 2985749 - DNA, 15 bp, Homo sapiens
gagacaaagcaggag

SEQ ID NO: 2985750 - DNA, 14 bp, Homo sapiens
gagacaaatccttt

SEQ ID NO: 2985751 - DNA, 15 bp, Homo sapiens
gagacaaatcctttc

SEQ ID NO: 2985752 - DNA, 14 bp, Homo sapiens
gagacaatgtctgc

SEQ ID NO: 2985753 - DNA, 19 bp, Homo sapiens
gagacaatgtctgcagccc

SEQ ID NO: 2985754 - DNA, 18 bp, Homo sapiens
gagacacctgcacctccc

SEQ ID NO: 2985755 - DNA, 17 bp, Homo sapiens
gagacagatcactcctg

SEQ ID NO: 2985756 - DNA, 19 bp, Homo sapiens
gagacagcttgatcaaagg

SEQ ID NO: 2985757 - DNA, 15 bp, Homo sapiens
gagacaggaaagaat

SEQ ID NO: 2985758 - DNA, 16 bp, Homo sapiens
gagacaggcagagctg

SEQ ID NO: 2985759 - DNA, 18 bp, Homo sapiens
gagacagtgatgcctgcc

SEQ ID NO: 2985760 - DNA, 16 bp, Homo sapiens
gagacagtgggaaata

SEQ ID NO: 2985761 - DNA, 21 bp, Homo sapiens
gagacagtttactttgccaac

SEQ ID NO: 2985762 - DNA, 13 bp, Homo sapiens
gagaccagcctgg

SEQ ID NO: 2985763 - DNA, 13 bp, Homo sapiens
gagaccagccttt

SEQ ID NO: 2985764 - DNA, 15 bp, Homo sapiens
gagaccagcctttct

SEQ ID NO: 2985765 - DNA, 14 bp, Homo sapiens
gagaccaggccctg

SEQ ID NO: 2985766 - DNA, 22 bp, Homo sapiens
gagctgccactgggcacctgcg

SEQ ID NO: 2985767 - DNA, 19 bp, Homo sapiens
gagctgcccctctctgggc

SEQ ID NO: 2985768 - DNA, 21 bp, Homo sapiens
gagctgcccggcgcctgccct

SEQ ID NO: 2985769 - DNA, 22 bp, Homo sapiens
gagctgcccggcgcctgccctg

SEQ ID NO: 2985770 - DNA, 14 bp, Homo sapiens
gagctgcctgcagc

SEQ ID NO: 2985771 - DNA, 15 bp, Homo sapiens
gagctgcctgcagca

SEQ ID NO: 2985772 - DNA, 17 bp, Homo sapiens
gagctgcctgcagcaca

SEQ ID NO: 2985773 - DNA, 15 bp, Homo sapiens
gagctgccttggctc

SEQ ID NO: 2985774 - DNA, 18 bp, Homo sapiens
gagctgccttggctcaga

SEQ ID NO: 2985775 - DNA, 18 bp, Homo sapiens
gagctgcgggctgagggc

SEQ ID NO: 2985776 - DNA, 19 bp, Homo sapiens
gagctgcgggctgagggca

SEQ ID NO: 2985777 - DNA, 18 bp, Homo sapiens
gagctgctaaaataaacc

SEQ ID NO: 2985778 - DNA, 20 bp, Homo sapiens
gagctgctatagcctggggt

SEQ ID NO: 2985779 - DNA, 22 bp, Homo sapiens
gagctgctgagtgacagctttc

SEQ ID NO: 2985780 - DNA, 18 bp, Homo sapiens
gagctggccaaagagcct

SEQ ID NO: 2985781 - DNA, 23 bp, Homo sapiens
gagctggccaaagagcctttcca

SEQ ID NO: 2985782 - DNA, 13 bp, Homo sapiens
gagctggccccgc

SEQ ID NO: 2985783 - DNA, 16 bp, Homo sapiens
gagctggccccgccgc

SEQ ID NO: 2985784 - DNA, 17 bp, Homo sapiens
gagctggccccgccgcc

SEQ ID NO: 2985785 - DNA, 20 bp, Homo sapiens
gagctgggatcccacagccc

SEQ ID NO: 2985786 - DNA, 16 bp, Homo sapiens
gagctgggatcctaag

SEQ ID NO: 2985787 - DNA, 16 bp, Homo sapiens
gagctgggcccgacat

SEQ ID NO: 2985788 - DNA, 13 bp, Homo sapiens
gagctggggaggt

SEQ ID NO: 2985789 - DNA, 17 bp, Homo sapiens
gagctggggaggtggga

SEQ ID NO: 2985790 - DNA, 19 bp, Homo sapiens
gagctggggaggtgggagg

SEQ ID NO: 2985791 - DNA, 23 bp, Homo sapiens
gagctggggaggtgggaggccag

SEQ ID NO: 2985792 - DNA, 16 bp, Homo sapiens
gagctggtttcctgcc

SEQ ID NO: 2985793 - DNA, 18 bp, Homo sapiens
gagctgtattaagccact

SEQ ID NO: 2985794 - DNA, 16 bp, Homo sapiens
gagcttcatggcagaa

SEQ ID NO: 2985795 - DNA, 19 bp, Homo sapiens
gagcttcatggcagaaggc

SEQ ID NO: 2985796 - DNA, 20 bp, Homo sapiens
gagcttccagagctctgacc

SEQ ID NO: 2985797 - DNA, 20 bp, Homo sapiens
gagcttcccacacctgcctg

SEQ ID NO: 2985798 - DNA, 21 bp, Homo sapiens
gagcttcccacacctgcctgc

SEQ ID NO: 2985799 - DNA, 13 bp, Homo sapiens
gagcttccctgac

SEQ ID NO: 2985800 - DNA, 17 bp, Homo sapiens
gagcttccctgactcat

SEQ ID NO: 2985801 - DNA, 11 bp, Homo sapiens
gagcttctggg

SEQ ID NO: 2985802 - DNA, 19 bp, Homo sapiens
gagcttctggggtccccag

SEQ ID NO: 2985803 - DNA, 15 bp, Homo sapiens
gagcttctgtatttt

SEQ ID NO: 2985804 - DNA, 19 bp, Homo sapiens
gagcttctgtattttcaaa

SEQ ID NO: 2985805 - DNA, 22 bp, Homo sapiens
gagcttcttccaggtgcccagc

SEQ ID NO: 2985806 - DNA, 13 bp, Homo sapiens
gagcttgcttctt

SEQ ID NO: 2985807 - DNA, 19 bp, Homo sapiens
gagctttagacagcagagc

SEQ ID NO: 2985808 - DNA, 23 bp, Homo sapiens
gagctttcttgtttcttattagg

SEQ ID NO: 2985809 - DNA, 17 bp, Homo sapiens
gaggaaaaacaacaaat

SEQ ID NO: 2985810 - DNA, 22 bp, Homo sapiens
gaggaaaagtaaccatcactgg

SEQ ID NO: 2985811 - DNA, 14 bp, Homo sapiens
gaggaaactcagag

SEQ ID NO: 2985812 - DNA, 16 bp, Homo sapiens
gaggaaagggcctggc

SEQ ID NO: 2985813 - DNA, 16 bp, Homo sapiens
gaggaactcgcctcag

SEQ ID NO: 2985814 - DNA, 13 bp, Homo sapiens
gaggaagagaagc

SEQ ID NO: 2985815 - DNA, 23 bp, Homo sapiens
gaggaagatgctcatctgagcca

SEQ ID NO: 2985816 - DNA, 20 bp, Homo sapiens
gaggaagcgtgaaggccgag

SEQ ID NO: 2985817 - DNA, 19 bp, Homo sapiens
gaggaaggggccagaggct

SEQ ID NO: 2985818 - DNA, 20 bp, Homo sapiens
gaggaatctgtgggtctggg

SEQ ID NO: 2985819 - DNA, 15 bp, Homo sapiens
gaggaatgaaaaaag

SEQ ID NO: 2985820 - DNA, 17 bp, Homo sapiens
gaggacaagaccctctc

SEQ ID NO: 2985821 - DNA, 13 bp, Homo sapiens
gaggacagctgtc

SEQ ID NO: 2985822 - DNA, 14 bp, Homo sapiens
gaggacagctgtcc

SEQ ID NO: 2985823 - DNA, 12 bp, Homo sapiens
gaggacagtggg

SEQ ID NO: 2985824 - DNA, 16 bp, Homo sapiens
gaggaccagggtggag

SEQ ID NO: 2985825 - DNA, 23 bp, Homo sapiens
gaggaccgccccaccctggaatg

SEQ ID NO: 2985826 - DNA, 13 bp, Homo sapiens
gaggactggactg

SEQ ID NO: 2985827 - DNA, 13 bp, Homo sapiens
gaggactgtattt

SEQ ID NO: 2985828 - DNA, 23 bp, Homo sapiens
gaggactttggtcacccagacta

SEQ ID NO: 2985829 - DNA, 15 bp, Homo sapiens
gaggagaagtgggga

SEQ ID NO: 2985830 - DNA, 14 bp, Homo sapiens
gaggagaccagcgg

SEQ ID NO: 2985831 - DNA, 21 bp, Homo sapiens
gaggagaccagcggtccatgg

SEQ ID NO: 2985832 - DNA, 13 bp, Homo sapiens
gaggagagaagaa

SEQ ID NO: 2985833 - DNA, 20 bp, Homo sapiens
gaggagagatagcctgtggc

SEQ ID NO: 2985834 - DNA, 22 bp, Homo sapiens
gaggagagccagagaagtgaca

SEQ ID NO: 2985835 - DNA, 17 bp, Homo sapiens
gaggagatgctccttgg

SEQ ID NO: 2985836 - DNA, 15 bp, Homo sapiens
gaggagcaagggtgg

SEQ ID NO: 2985837 - DNA, 18 bp, Homo sapiens
gaggagcccagcggccca

SEQ ID NO: 2985838 - DNA, 14 bp, Homo sapiens
gaggagcccagtgg

SEQ ID NO: 2985839 - DNA, 18 bp, Homo sapiens
gaggagccccatctgtct

SEQ ID NO: 2985840 - DNA, 14 bp, Homo sapiens
gaggagcctcagaa

SEQ ID NO: 2985841 - DNA, 16 bp, Homo sapiens
gaggagcctcagaaga

SEQ ID NO: 2985842 - DNA, 16 bp, Homo sapiens
gaggagctgagggagg

SEQ ID NO: 2985843 - DNA, 17 bp, Homo sapiens
gaggagctgagggaggg

SEQ ID NO: 2985844 - DNA, 22 bp, Homo sapiens
gaggaggacttggttgatgttt

SEQ ID NO: 2985845 - DNA, 16 bp, Homo sapiens
gaggaggattgtgctg

SEQ ID NO: 2985846 - DNA, 15 bp, Homo sapiens
gaggaggcgcggcct

SEQ ID NO: 2985847 - DNA, 19 bp, Homo sapiens
gaggaggctgccctgaggg

SEQ ID NO: 2985848 - DNA, 21 bp, Homo sapiens
gaggaggggcccccctgccct

SEQ ID NO: 2985849 - DNA, 19 bp, Homo sapiens
gaggaggtaatgaattaaa

SEQ ID NO: 2985850 - DNA, 20 bp, Homo sapiens
gaggagtcaatttgcctctg

SEQ ID NO: 2985851 - DNA, 22 bp, Homo sapiens
gaggagtggttgggctgtgcct

SEQ ID NO: 2985852 - DNA, 22 bp, Homo sapiens
gaggatattcttctcttgcttt

SEQ ID NO: 2985853 - DNA, 18 bp, Homo sapiens
gaggatcctgagctgctg

SEQ ID NO: 2985854 - DNA, 22 bp, Homo sapiens
gaggatgagctctacccagggc

SEQ ID NO: 2985855 - DNA, 20 bp, Homo sapiens
gaggatgctctttcccagga

SEQ ID NO: 2985856 - DNA, 20 bp, Homo sapiens
gaggatgtcactcagatgga

SEQ ID NO: 2985857 - DNA, 12 bp, Homo sapiens
gaggatttagaa

SEQ ID NO: 2985858 - DNA, 18 bp, Homo sapiens
gaggatttgatttctgcc

SEQ ID NO: 2985859 - DNA, 16 bp, Homo sapiens
gaggcaaagctggctc

SEQ ID NO: 2985860 - DNA, 22 bp, Homo sapiens
gaggcaatgggagctgaggcca

SEQ ID NO: 2985861 - DNA, 13 bp, Homo sapiens
gaggcactgaagc

SEQ ID NO: 2985862 - DNA, 15 bp, Homo sapiens
gaggcactgaagccc

SEQ ID NO: 2985863 - DNA, 18 bp, Homo sapiens
gaggcagagcgggaggga

SEQ ID NO: 2985864 - DNA, 19 bp, Homo sapiens
gaggcagagcgggagggag

SEQ ID NO: 2985865 - DNA, 13 bp, Homo sapiens
gaggcagcagtgt

SEQ ID NO: 2985866 - DNA, 20 bp, Homo sapiens
gaggcagcagtgtgaggcca

SEQ ID NO: 2985867 - DNA, 21 bp, Homo sapiens
gaggcagcagtgtgaggccag

SEQ ID NO: 2985868 - DNA, 22 bp, Homo sapiens
gaggcagcagtgtgaggccagg

SEQ ID NO: 2985869 - DNA, 14 bp, Homo sapiens
gaggcaggctccag

SEQ ID NO: 2985870 - DNA, 22 bp, Homo sapiens
gaggcagggaagtccccaggcc

SEQ ID NO: 2985871 - DNA, 23 bp, Homo sapiens
gaggcagggccttgcccagagat

SEQ ID NO: 2985872 - DNA, 17 bp, Homo sapiens
gaggcaggttagaagaa

SEQ ID NO: 2985873 - DNA, 22 bp, Homo sapiens
gaggcatcatggaaagactggg

SEQ ID NO: 2985874 - DNA, 13 bp, Homo sapiens
gaggcatccagca

SEQ ID NO: 2985875 - DNA, 19 bp, Homo sapiens
gaggcatggggcatgtcct

SEQ ID NO: 2985876 - DNA, 23 bp, Homo sapiens
gaggcattgttagtttagtgtgt

SEQ ID NO: 2985877 - DNA, 17 bp, Homo sapiens
gaggccaacactgtggg

SEQ ID NO: 2985878 - DNA, 21 bp, Homo sapiens
gaggccaagcagtgcctgcct

SEQ ID NO: 2985879 - DNA, 18 bp, Homo sapiens
gaggccaggcgagcctga

SEQ ID NO: 2985880 - DNA, 22 bp, Homo sapiens
gaggccaggcgagcctgactct

SEQ ID NO: 2985881 - DNA, 15 bp, Homo sapiens
gaggccagtgagcca

SEQ ID NO: 2985882 - DNA, 14 bp, Homo sapiens
gaggccatggcgag

SEQ ID NO: 2985883 - DNA, 16 bp, Homo sapiens
gaggcccaggctggga

SEQ ID NO: 2985884 - DNA, 23 bp, Homo sapiens
gaggcccaggctgggaactcatc

SEQ ID NO: 2985885 - DNA, 20 bp, Homo sapiens
gaggcccctgtctcagggtg

SEQ ID NO: 2985886 - DNA, 17 bp, Homo sapiens
gaggccctcgctgccag

SEQ ID NO: 2985887 - DNA, 17 bp, Homo sapiens
gaggccctctggagtgg

SEQ ID NO: 2985888 - DNA, 14 bp, Homo sapiens
gaggccctgcatgg

SEQ ID NO: 2985889 - DNA, 15 bp, Homo sapiens
gaggccggccctgcc

SEQ ID NO: 2985890 - DNA, 16 bp, Homo sapiens
gaggccggccctgccc

SEQ ID NO: 2985891 - DNA, 23 bp, Homo sapiens
gaggcctcccttgagtaggccct

SEQ ID NO: 2985892 - DNA, 15 bp, Homo sapiens
gaggcctctctcagg

SEQ ID NO: 2985893 - DNA, 22 bp, Homo sapiens
gaggcctctctcaggagcaggg

SEQ ID NO: 2985894 - DNA, 17 bp, Homo sapiens
gaggcctgagacccagg

SEQ ID NO: 2985895 - DNA, 12 bp, Homo sapiens
gaggcctgtctg

SEQ ID NO: 2985896 - DNA, 11 bp, Homo sapiens
gaggccttcca

SEQ ID NO: 2985897 - DNA, 18 bp, Homo sapiens
gatccctcatctgtccct

SEQ ID NO: 2985898 - DNA, 21 bp, Homo sapiens
gatccctcccccccatgcact

SEQ ID NO: 2985899 - DNA, 17 bp, Homo sapiens
gatcctacaatatttta

SEQ ID NO: 2985900 - DNA, 15 bp, Homo sapiens
gatcctccatttttg

SEQ ID NO: 2985901 - DNA, 15 bp, Homo sapiens
gatcctctcacctca

SEQ ID NO: 2985902 - DNA, 13 bp, Homo sapiens
gatcctgagctgc

SEQ ID NO: 2985903 - DNA, 21 bp, Homo sapiens
gatcctgccaatctaatgtga

SEQ ID NO: 2985904 - DNA, 20 bp, Homo sapiens
gatcctgtattcagacagat

SEQ ID NO: 2985905 - DNA, 23 bp, Homo sapiens
gatcctgtgaggagccccatctg

SEQ ID NO: 2985906 - DNA, 13 bp, Homo sapiens
gatccttcccaag

SEQ ID NO: 2985907 - DNA, 15 bp, Homo sapiens
gatccttcccaaggt

SEQ ID NO: 2985908 - DNA, 23 bp, Homo sapiens
gatcgcaccactgcactccagcc

SEQ ID NO: 2985909 - DNA, 15 bp, Homo sapiens
gatcgcatggcagaa

SEQ ID NO: 2985910 - DNA, 16 bp, Homo sapiens
gatcgtgacgctgaat

SEQ ID NO: 2985911 - DNA, 23 bp, Homo sapiens
gatcgtgccgttactctccaacc

SEQ ID NO: 2985912 - DNA, 15 bp, Homo sapiens
gatctatttattatc

SEQ ID NO: 2985913 - DNA, 16 bp, Homo sapiens
gatctcaagtatatgt

SEQ ID NO: 2985914 - DNA, 23 bp, Homo sapiens
gatctcagtggttaagattccta

SEQ ID NO: 2985915 - DNA, 18 bp, Homo sapiens
gatctccctgccgcctca

SEQ ID NO: 2985916 - DNA, 20 bp, Homo sapiens
gatctcctgtttttttcagg

SEQ ID NO: 2985917 - DNA, 13 bp, Homo sapiens
gatctcgcctgga

SEQ ID NO: 2985918 - DNA, 20 bp, Homo sapiens
gatctctgcagggccgccag

SEQ ID NO: 2985919 - DNA, 21 bp, Homo sapiens
gatctgaacccagctgtgccc

SEQ ID NO: 2985920 - DNA, 22 bp, Homo sapiens
gatctgaacccagctgtgcccc

SEQ ID NO: 2985921 - DNA, 17 bp, Homo sapiens
gatctgcacagtcagaa

SEQ ID NO: 2985922 - DNA, 14 bp, Homo sapiens
gatctgctttctgt

SEQ ID NO: 2985923 - DNA, 17 bp, Homo sapiens
gatctgctttctgttca

SEQ ID NO: 2985924 - DNA, 21 bp, Homo sapiens
gatctggggactgagtgtggg

SEQ ID NO: 2985925 - DNA, 19 bp, Homo sapiens
gatctggggcatgaaaaaa

SEQ ID NO: 2985926 - DNA, 14 bp, Homo sapiens
gatctgtcctcagc

SEQ ID NO: 2985927 - DNA, 17 bp, Homo sapiens
gatctgtcctcagcctt

SEQ ID NO: 2985928 - DNA, 18 bp, Homo sapiens
gatctgtcctcagccttg

SEQ ID NO: 2985929 - DNA, 19 bp, Homo sapiens
gatcttaagaggctgacag

SEQ ID NO: 2985930 - DNA, 13 bp, Homo sapiens
gatcttatttgga

SEQ ID NO: 2985931 - DNA, 16 bp, Homo sapiens
gatcttatttggaatt

SEQ ID NO: 2985932 - DNA, 17 bp, Homo sapiens
gatcttgagagagaaat

SEQ ID NO: 2985933 - DNA, 15 bp, Homo sapiens
gatcttgatggtgtt

SEQ ID NO: 2985934 - DNA, 21 bp, Homo sapiens
gatctttcgttggttgtttct

SEQ ID NO: 2985935 - DNA, 22 bp, Homo sapiens
gatctttcgttggttgtttctc

SEQ ID NO: 2985936 - DNA, 16 bp, Homo sapiens
gatctttgtggccaag

SEQ ID NO: 2985937 - DNA, 16 bp, Homo sapiens
gatgaaactaaagcaa

SEQ ID NO: 2985938 - DNA, 17 bp, Homo sapiens
gatgaaactaaagcaat

SEQ ID NO: 2985939 - DNA, 17 bp, Homo sapiens
gatgaacttattctgta

SEQ ID NO: 2985940 - DNA, 19 bp, Homo sapiens
gatgaacttattctgtaga

SEQ ID NO: 2985941 - DNA, 17 bp, Homo sapiens
gatgaatctacatttgt

SEQ ID NO: 2985942 - DNA, 22 bp, Homo sapiens
gatgaattgcgttggtctctgc

SEQ ID NO: 2985943 - DNA, 19 bp, Homo sapiens
gatgaattgtcacatctat

SEQ ID NO: 2985944 - DNA, 18 bp, Homo sapiens
gatgacattgctaagatg

SEQ ID NO: 2985945 - DNA, 19 bp, Homo sapiens
gatgaccaaagtcccttcc

SEQ ID NO: 2985946 - DNA, 17 bp, Homo sapiens
gatgaccacgcacctcc

SEQ ID NO: 2985947 - DNA, 19 bp, Homo sapiens
gatgaccacgcacctccac

SEQ ID NO: 2985948 - DNA, 17 bp, Homo sapiens
gatgaccatactcagac

SEQ ID NO: 2985949 - DNA, 23 bp, Homo sapiens
gatgaccccatcaaccccagggc

SEQ ID NO: 2985950 - DNA, 22 bp, Homo sapiens
gatgactatgcagaggcctggg

SEQ ID NO: 2985951 - DNA, 23 bp, Homo sapiens
gatgacttgttcatttttctctc

SEQ ID NO: 2985952 - DNA, 22 bp, Homo sapiens
gatgactttgcagatggaaaga

SEQ ID NO: 2985953 - DNA, 18 bp, Homo sapiens
gatgagatattaaattct

SEQ ID NO: 2985954 - DNA, 16 bp, Homo sapiens
gatgagatttttaaaa

SEQ ID NO: 2985955 - DNA, 17 bp, Homo sapiens
gatgagcactcctgatt

SEQ ID NO: 2985956 - DNA, 16 bp, Homo sapiens
gatgagctctacccag

SEQ ID NO: 2985957 - DNA, 20 bp, Homo sapiens
gatgagctctacccagggcc

SEQ ID NO: 2985958 - DNA, 16 bp, Homo sapiens
gatgaggtattttttc

SEQ ID NO: 2985959 - DNA, 17 bp, Homo sapiens
gatgatacagtgttttt

SEQ ID NO: 2985960 - DNA, 22 bp, Homo sapiens
gatgatcaattatagtttctga

SEQ ID NO: 2985961 - DNA, 14 bp, Homo sapiens
gatgatgctgccag

SEQ ID NO: 2985962 - DNA, 21 bp, Homo sapiens
gatgatggtcttcagcctctt

SEQ ID NO: 2985963 - DNA, 13 bp, Homo sapiens
gatgattgcttga

SEQ ID NO: 2985964 - DNA, 18 bp, Homo sapiens
gatgatttcagaaggaga

SEQ ID NO: 2985965 - DNA, 13 bp, Homo sapiens
gatgatttgcaat

SEQ ID NO: 2985966 - DNA, 18 bp, Homo sapiens
gatgatttgcaatgggat

SEQ ID NO: 2985967 - DNA, 14 bp, Homo sapiens
gatgatttgtactt

SEQ ID NO: 2985968 - DNA, 23 bp, Homo sapiens
gatgcaaggattacagaaactga

SEQ ID NO: 2985969 - DNA, 15 bp, Homo sapiens
gatgcacggtttctg

SEQ ID NO: 2985970 - DNA, 16 bp, Homo sapiens
gatgcacggtttctgt

SEQ ID NO: 2985971 - DNA, 21 bp, Homo sapiens
gatgcacggtttctgttctgc

SEQ ID NO: 2985972 - DNA, 16 bp, Homo sapiens
gatgcagagtaagtat

SEQ ID NO: 2985973 - DNA, 18 bp, Homo sapiens
gatgcagagtaagtatta

SEQ ID NO: 2985974 - DNA, 22 bp, Homo sapiens
gatgcagcgccgtgtcctctct

SEQ ID NO: 2985975 - DNA, 14 bp, Homo sapiens
gatgcagctcaaga

SEQ ID NO: 2985976 - DNA, 12 bp, Homo sapiens
gatgcaggctcc

SEQ ID NO: 2985977 - DNA, 19 bp, Homo sapiens
gatgcaggctcccctgagg

SEQ ID NO: 2985978 - DNA, 18 bp, Homo sapiens
gatgcaggtttgaccagg

SEQ ID NO: 2985979 - DNA, 22 bp, Homo sapiens
gatgcaggtttgaccaggaaag

SEQ ID NO: 2985980 - DNA, 20 bp, Homo sapiens
gatgcatggagatagcccca

SEQ ID NO: 2985981 - DNA, 14 bp, Homo sapiens
gatgcatgtctttt

SEQ ID NO: 2985982 - DNA, 20 bp, Homo sapiens
gatgcattgtagtttaacca

SEQ ID NO: 2985983 - DNA, 15 bp, Homo sapiens
gatgccactcctccc

SEQ ID NO: 2985984 - DNA, 17 bp, Homo sapiens
gatgccactcctccctc

SEQ ID NO: 2985985 - DNA, 18 bp, Homo sapiens
gatgccactcctccctcc

SEQ ID NO: 2985986 - DNA, 17 bp, Homo sapiens
gatgcccaaatccttag

SEQ ID NO: 2985987 - DNA, 18 bp, Homo sapiens
gatgccctggaggtggct

SEQ ID NO: 2985988 - DNA, 19 bp, Homo sapiens
gatgccctggaggtggctg

SEQ ID NO: 2985989 - DNA, 17 bp, Homo sapiens
gatgcctccaccgctgc

SEQ ID NO: 2985990 - DNA, 23 bp, Homo sapiens
gatgcctttgctgtttagcttcc

SEQ ID NO: 2985991 - DNA, 22 bp, Homo sapiens
gatgcggccattcaaggggagc

SEQ ID NO: 2985992 - DNA, 19 bp, Homo sapiens
gatgcggggacaggctgga

SEQ ID NO: 2985993 - DNA, 16 bp, Homo sapiens
gatgcgtattctgtgg

SEQ ID NO: 2985994 - DNA, 17 bp, Homo sapiens
gatgcgtattctgtggc

SEQ ID NO: 2985995 - DNA, 16 bp, Homo sapiens
gatgcgttcgcctctg

SEQ ID NO: 2985996 - DNA, 16 bp, Homo sapiens
gatgctatttcagcca

SEQ ID NO: 2985997 - DNA, 17 bp, Homo sapiens
gatgctatttcagccaa

SEQ ID NO: 2985998 - DNA, 18 bp, Homo sapiens
gatgctatttcagccaat

SEQ ID NO: 2985999 - DNA, 16 bp, Homo sapiens
gatgctccaagattct

SEQ ID NO: 2986000 - DNA, 17 bp, Homo sapiens
gatgctccaagattcta

SEQ ID NO: 2986001 - DNA, 21 bp, Homo sapiens
gatgctccttgggccctttga

SEQ ID NO: 2986002 - DNA, 20 bp, Homo sapiens
gatgctgacattcacctgcc

SEQ ID NO: 2986003 - DNA, 12 bp, Homo sapiens
gatgctgagcca

SEQ ID NO: 2986004 - DNA, 16 bp, Homo sapiens
gatgctgatgttcagt

SEQ ID NO: 2986005 - DNA, 17 bp, Homo sapiens
gatgctgatgttcagtg

SEQ ID NO: 2986006 - DNA, 12 bp, Homo sapiens
gatgctgcccct

SEQ ID NO: 2986007 - DNA, 13 bp, Homo sapiens
gatgctgcccctc

SEQ ID NO: 2986008 - DNA, 14 bp, Homo sapiens
gatgctgctggcct

SEQ ID NO: 2986009 - DNA, 16 bp, Homo sapiens
gatgctggatgctcct

SEQ ID NO: 2986010 - DNA, 18 bp, Homo sapiens
gatgctggatgctccttc

SEQ ID NO: 2986011 - DNA, 19 bp, Homo sapiens
gatgctggcccagggccca

SEQ ID NO: 2986012 - DNA, 23 bp, Homo sapiens
gatgctggcccagggcccagagc

SEQ ID NO: 2986013 - DNA, 23 bp, Homo sapiens
gatgctggcctcttggcacctgc

SEQ ID NO: 2986014 - DNA, 17 bp, Homo sapiens
gatgctgtgtatatggt

SEQ ID NO: 2986015 - DNA, 13 bp, Homo sapiens
gatgctgtttgac

SEQ ID NO: 2986016 - DNA, 20 bp, Homo sapiens
gatgcttagagggatttctt

SEQ ID NO: 2986017 - DNA, 22 bp, Homo sapiens
gatgcttagagggatttctttg

SEQ ID NO: 2986018 - DNA, 19 bp, Homo sapiens
gatgcttggagcaatcaga

SEQ ID NO: 2986019 - DNA, 21 bp, Homo sapiens
gatgctttaccaaacagcaaa

SEQ ID NO: 2986020 - DNA, 18 bp, Homo sapiens
gatgctttggaagatgca

SEQ ID NO: 2986021 - DNA, 14 bp, Homo sapiens
gatgcttttaacag

SEQ ID NO: 2986022 - DNA, 15 bp, Homo sapiens
gatgcttttaacaga

SEQ ID NO: 2986023 - DNA, 22 bp, Homo sapiens
gatggaaagaggtgaaaatgaa

SEQ ID NO: 2986024 - DNA, 17 bp, Homo sapiens
gatggaacacggccaca

SEQ ID NO: 2986025 - DNA, 22 bp, Homo sapiens
gatggaaccgcaggaagctgct

SEQ ID NO: 2986026 - DNA, 23 bp, Homo sapiens
gatggaagaaaatggaattactc

SEQ ID NO: 2986027 - DNA, 17 bp, Homo sapiens
gatggacgcaggccctg

SEQ ID NO: 2986028 - DNA, 21 bp, Homo sapiens
gcaaagcaagggggaaggctg

SEQ ID NO: 2986029 - DNA, 22 bp, Homo sapiens
gcaaagcatcggtcatgtgtgt

SEQ ID NO: 2986030 - DNA, 19 bp, Homo sapiens
gcaaagctctgtggccaca

SEQ ID NO: 2986031 - DNA, 22 bp, Homo sapiens
gcaaaggagacaaagcaggagt

SEQ ID NO: 2986032 - DNA, 14 bp, Homo sapiens
gcaaaggcagagga

SEQ ID NO: 2986033 - DNA, 18 bp, Homo sapiens
gcaaaggcagtcccggga

SEQ ID NO: 2986034 - DNA, 14 bp, Homo sapiens
gcaaagggcatggg

SEQ ID NO: 2986035 - DNA, 22 bp, Homo sapiens
gcaaagggcatgggtcgggaga

SEQ ID NO: 2986036 - DNA, 13 bp, Homo sapiens
gcaaagtactgta

SEQ ID NO: 2986037 - DNA, 16 bp, Homo sapiens
gcaaagtatgccaggg

SEQ ID NO: 2986038 - DNA, 20 bp, Homo sapiens
gcaaagtattgtaaattata

SEQ ID NO: 2986039 - DNA, 17 bp, Homo sapiens
gcaaagtggaattaaag

SEQ ID NO: 2986040 - DNA, 22 bp, Homo sapiens
gcaaataatttcctggtgtgaa

SEQ ID NO: 2986041 - DNA, 14 bp, Homo sapiens
gcaaatagcaaatg

SEQ ID NO: 2986042 - DNA, 13 bp, Homo sapiens
gcaaatatagaaa

SEQ ID NO: 2986043 - DNA, 13 bp, Homo sapiens
gcaaatcagaaac

SEQ ID NO: 2986044 - DNA, 19 bp, Homo sapiens
gcaaatcctatgtgatttt

SEQ ID NO: 2986045 - DNA, 23 bp, Homo sapiens
gcaaatcctatgtgattttaact

SEQ ID NO: 2986046 - DNA, 12 bp, Homo sapiens
gcaaatcttgaa

SEQ ID NO: 2986047 - DNA, 19 bp, Homo sapiens
gcaaatctttctgtaaaca

SEQ ID NO: 2986048 - DNA, 21 bp, Homo sapiens
gcaaatgcattctatcgttat

SEQ ID NO: 2986049 - DNA, 23 bp, Homo sapiens
gcaaattatttttaaaagaaaaa

SEQ ID NO: 2986050 - DNA, 18 bp, Homo sapiens
gcaacacaacatttgtgt

SEQ ID NO: 2986051 - DNA, 16 bp, Homo sapiens
gcaacacagcctgggc

SEQ ID NO: 2986052 - DNA, 17 bp, Homo sapiens
gcaacagatctggaacc

SEQ ID NO: 2986053 - DNA, 19 bp, Homo sapiens
gcaacagcaaatcacgacc

SEQ ID NO: 2986054 - DNA, 13 bp, Homo sapiens
gcaacatccaaaa

SEQ ID NO: 2986055 - DNA, 21 bp, Homo sapiens
gcaacattgttcacctttgta

SEQ ID NO: 2986056 - DNA, 14 bp, Homo sapiens
gcaaccactaagaa

SEQ ID NO: 2986057 - DNA, 23 bp, Homo sapiens
gcaaccatttttagaaggaaaaa

SEQ ID NO: 2986058 - DNA, 22 bp, Homo sapiens
gcaacctccgcctcctgggttc

SEQ ID NO: 2986059 - DNA, 23 bp, Homo sapiens
gcaacctctgcctcccaggttcc

SEQ ID NO: 2986060 - DNA, 20 bp, Homo sapiens
gcaacctctgcttcccaggt

SEQ ID NO: 2986061 - DNA, 16 bp, Homo sapiens
gcaacctcttggcctg

SEQ ID NO: 2986062 - DNA, 16 bp, Homo sapiens
gcaacgccagtggcaa

SEQ ID NO: 2986063 - DNA, 14 bp, Homo sapiens
gcaacgtgttaatt

SEQ ID NO: 2986064 - DNA, 17 bp, Homo sapiens
gcaacgtgttaattata

SEQ ID NO: 2986065 - DNA, 18 bp, Homo sapiens
gcaacgttagtagaactt

SEQ ID NO: 2986066 - DNA, 17 bp, Homo sapiens
gcaactctggctccagg

SEQ ID NO: 2986067 - DNA, 22 bp, Homo sapiens
gcaactctggctccaggcagaa

SEQ ID NO: 2986068 - DNA, 15 bp, Homo sapiens
gcaacttgaagaaac

SEQ ID NO: 2986069 - DNA, 15 bp, Homo sapiens
gcaacttgcttctaa

SEQ ID NO: 2986070 - DNA, 20 bp, Homo sapiens
gcaagaaagcttgagtctca

SEQ ID NO: 2986071 - DNA, 16 bp, Homo sapiens
gcaagaactcatcact

SEQ ID NO: 2986072 - DNA, 16 bp, Homo sapiens
gcaagaccttttttta

SEQ ID NO: 2986073 - DNA, 16 bp, Homo sapiens
gcaagactgaattaat

SEQ ID NO: 2986074 - DNA, 13 bp, Homo sapiens
gcaagagagaacc

SEQ ID NO: 2986075 - DNA, 22 bp, Homo sapiens
gcaagagagaacctaactgtat

SEQ ID NO: 2986076 - DNA, 22 bp, Homo sapiens
gcaagagatattttgggcatgt

SEQ ID NO: 2986077 - DNA, 17 bp, Homo sapiens
gcaagattggaaagaca

SEQ ID NO: 2986078 - DNA, 22 bp, Homo sapiens
gcaagattggaaagacaggaag

SEQ ID NO: 2986079 - DNA, 22 bp, Homo sapiens
gcaagattttccacaagattcc

SEQ ID NO: 2986080 - DNA, 11 bp, Homo sapiens
gcaagcatgct

SEQ ID NO: 2986081 - DNA, 14 bp, Homo sapiens
gcaagccacagcct

SEQ ID NO: 2986082 - DNA, 15 bp, Homo sapiens
gcaagccacagcctg

SEQ ID NO: 2986083 - DNA, 16 bp, Homo sapiens
gcaagccacagcctgt

SEQ ID NO: 2986084 - DNA, 15 bp, Homo sapiens
gcaagcccacctcgg

SEQ ID NO: 2986085 - DNA, 20 bp, Homo sapiens
gcaagcccacctcggccctc

SEQ ID NO: 2986086 - DNA, 15 bp, Homo sapiens
gcaagcccctgctcc

SEQ ID NO: 2986087 - DNA, 15 bp, Homo sapiens
gcaagccctgttgac

SEQ ID NO: 2986088 - DNA, 10 bp, Homo sapiens
gcaagctgtg

SEQ ID NO: 2986089 - DNA, 12 bp, Homo sapiens
gcaaggaaggac

SEQ ID NO: 2986090 - DNA, 14 bp, Homo sapiens
gcaaggaaggactt

SEQ ID NO: 2986091 - DNA, 19 bp, Homo sapiens
gcaaggatatcagagctgg

SEQ ID NO: 2986092 - DNA, 20 bp, Homo sapiens
gcaaggatatcagagctggg

SEQ ID NO: 2986093 - DNA, 21 bp, Homo sapiens
gcaaggattacagaaactgat

SEQ ID NO: 2986094 - DNA, 23 bp, Homo sapiens
gcaaggattacagaaactgatgc

SEQ ID NO: 2986095 - DNA, 21 bp, Homo sapiens
gcaaggccgctgttcacccac

SEQ ID NO: 2986096 - DNA, 15 bp, Homo sapiens
gcaagggcccagagt

SEQ ID NO: 2986097 - DNA, 20 bp, Homo sapiens
gcaagggggaaggctgcaaa

SEQ ID NO: 2986098 - DNA, 18 bp, Homo sapiens
gcaaggtccggcccatcc

SEQ ID NO: 2986099 - DNA, 24 bp, Homo sapiens
gcaaggtttaggctggtggcccag

SEQ ID NO: 2986100 - DNA, 18 bp, Homo sapiens
gcaaggtttcgtggcagc

SEQ ID NO: 2986101 - DNA, 13 bp, Homo sapiens
gcaagtcagggtt

SEQ ID NO: 2986102 - DNA, 15 bp, Homo sapiens
gcaagtcatgtaaat

SEQ ID NO: 2986103 - DNA, 22 bp, Homo sapiens
gcaagtcccagacaaggagagc

SEQ ID NO: 2986104 - DNA, 18 bp, Homo sapiens
gcaagtccttttgtaaag

SEQ ID NO: 2986105 - DNA, 11 bp, Homo sapiens
gcaagtctctt

SEQ ID NO: 2986106 - DNA, 19 bp, Homo sapiens
gcaagtctctttatatggc

SEQ ID NO: 2986107 - DNA, 13 bp, Homo sapiens
gcaagtgaatttg

SEQ ID NO: 2986108 - DNA, 20 bp, Homo sapiens
gcaagtgaatttttctctaa

SEQ ID NO: 2986109 - DNA, 14 bp, Homo sapiens
gcaagtgagagggg

SEQ ID NO: 2986110 - DNA, 15 bp, Homo sapiens
gcaagtgagagggga

SEQ ID NO: 2986111 - DNA, 22 bp, Homo sapiens
gcaagtgagaggggagggaggg

SEQ ID NO: 2986112 - DNA, 16 bp, Homo sapiens
gcaagtgtctggagcg

SEQ ID NO: 2986113 - DNA, 22 bp, Homo sapiens
gcaagtgtctggagcggctgct

SEQ ID NO: 2986114 - DNA, 21 bp, Homo sapiens
gcaagtgttaataataactta

SEQ ID NO: 2986115 - DNA, 12 bp, Homo sapiens
gcaagttgcagt

SEQ ID NO: 2986116 - DNA, 13 bp, Homo sapiens
gcaataaagaaga

SEQ ID NO: 2986117 - DNA, 18 bp, Homo sapiens
gcaataaatctgacccag

SEQ ID NO: 2986118 - DNA, 13 bp, Homo sapiens
gcaataacttcta

SEQ ID NO: 2986119 - DNA, 22 bp, Homo sapiens
gcaataacttctatattttaat

SEQ ID NO: 2986120 - DNA, 15 bp, Homo sapiens
gcaataataaagtac

SEQ ID NO: 2986121 - DNA, 12 bp, Homo sapiens
gcaataatgcag

SEQ ID NO: 2986122 - DNA, 19 bp, Homo sapiens
gcaataatgcagtatggta

SEQ ID NO: 2986123 - DNA, 20 bp, Homo sapiens
gcaatacgggagtgacccag

SEQ ID NO: 2986124 - DNA, 21 bp, Homo sapiens
gcaatacgggagtgacccagc

SEQ ID NO: 2986125 - DNA, 18 bp, Homo sapiens
gcaatacgtttgtgcaga

SEQ ID NO: 2986126 - DNA, 10 bp, Homo sapiens
gcaatagaaa

SEQ ID NO: 2986127 - DNA, 17 bp, Homo sapiens
gcaatatatctaaattg

SEQ ID NO: 2986128 - DNA, 17 bp, Homo sapiens
gcaatatgggcgggcag

SEQ ID NO: 2986129 - DNA, 15 bp, Homo sapiens
gcaatcacagatgag

SEQ ID NO: 2986130 - DNA, 16 bp, Homo sapiens
gcaatcgcatcccggc

SEQ ID NO: 2986131 - DNA, 13 bp, Homo sapiens
gcaatctgaccct

SEQ ID NO: 2986132 - DNA, 17 bp, Homo sapiens
gcaatctttgaaagact

SEQ ID NO: 2986133 - DNA, 14 bp, Homo sapiens
gcaatgaacactta

SEQ ID NO: 2986134 - DNA, 14 bp, Homo sapiens
gcaatgaagaatat

SEQ ID NO: 2986135 - DNA, 17 bp, Homo sapiens
gcaatgatgaatgagaa

SEQ ID NO: 2986136 - DNA, 18 bp, Homo sapiens
gcaatgccatcatctcct

SEQ ID NO: 2986137 - DNA, 14 bp, Homo sapiens
gcaatgctgtgaat

SEQ ID NO: 2986138 - DNA, 15 bp, Homo sapiens
gcaatgctgtgaata

SEQ ID NO: 2986139 - DNA, 20 bp, Homo sapiens
gcaatgcttcgttttctaaa

SEQ ID NO: 2986140 - DNA, 19 bp, Homo sapiens
gcaatgggagctgaggcca

SEQ ID NO: 2986141 - DNA, 19 bp, Homo sapiens
gcaatgggggcctccgctt

SEQ ID NO: 2986142 - DNA, 19 bp, Homo sapiens
gcaatggtgactgatttca

SEQ ID NO: 2986143 - DNA, 19 bp, Homo sapiens
gcaatggtgcaatcacagc

SEQ ID NO: 2986144 - DNA, 15 bp, Homo sapiens
gcaatgtgattttgt

SEQ ID NO: 2986145 - DNA, 16 bp, Homo sapiens
gcaatgtgattttgta

SEQ ID NO: 2986146 - DNA, 14 bp, Homo sapiens
gcaattaaaaataa

SEQ ID NO: 2986147 - DNA, 13 bp, Homo sapiens
gcaattaactctg

SEQ ID NO: 2986148 - DNA, 15 bp, Homo sapiens
gcaattactgcctgc

SEQ ID NO: 2986149 - DNA, 22 bp, Homo sapiens
gcaattcaaaagttccaagagt

SEQ ID NO: 2986150 - DNA, 18 bp, Homo sapiens
gcaattcagtctgctctc

SEQ ID NO: 2986151 - DNA, 22 bp, Homo sapiens
gcaattcagtctgctctccctt

SEQ ID NO: 2986152 - DNA, 13 bp, Homo sapiens
gcaattcagtgtt

SEQ ID NO: 2986153 - DNA, 22 bp, Homo sapiens
gcaattctttttggaaaagagc

SEQ ID NO: 2986154 - DNA, 21 bp, Homo sapiens
gcaattgcgaccttaatttaa

SEQ ID NO: 2986155 - DNA, 14 bp, Homo sapiens
gcaattgctcccat

SEQ ID NO: 2986156 - DNA, 18 bp, Homo sapiens
gcaattgttaatcaaaga

SEQ ID NO: 2986157 - DNA, 21 bp, Homo sapiens
gcaattttgtatccatttaaa

SEQ ID NO: 2986158 - DNA, 17 bp, Homo sapiens
gcacaaacacaaggtca

SEQ ID NO: 2986159 - DNA, 23 bp, Homo sapiens
gcacaaagatgggtgaaggctgg

SEQ ID NO: 2986160 - DNA, 22 bp, Homo sapiens
gcaggtggcctctgctggtctc

SEQ ID NO: 2986161 - DNA, 21 bp, Homo sapiens
gcaggtggggagactgggctg

SEQ ID NO: 2986162 - DNA, 14 bp, Homo sapiens
gcaggttagaagaa

SEQ ID NO: 2986163 - DNA, 15 bp, Homo sapiens
gcaggttagagaaaa

SEQ ID NO: 2986164 - DNA, 19 bp, Homo sapiens
gcaggttcccaagctcaga

SEQ ID NO: 2986165 - DNA, 23 bp, Homo sapiens
gcagtaactgtccctgctttctg

SEQ ID NO: 2986166 - DNA, 13 bp, Homo sapiens
gcagtatggtaca

SEQ ID NO: 2986167 - DNA, 17 bp, Homo sapiens
gcagtattacagaggtc

SEQ ID NO: 2986168 - DNA, 13 bp, Homo sapiens
gcagtattttctg

SEQ ID NO: 2986169 - DNA, 18 bp, Homo sapiens
gcagtcaaggttgtcaat

SEQ ID NO: 2986170 - DNA, 17 bp, Homo sapiens
gcagtcacatctcttcc

SEQ ID NO: 2986171 - DNA, 21 bp, Homo sapiens
gcagtcacttcggccagagct

SEQ ID NO: 2986172 - DNA, 22 bp, Homo sapiens
gcagtcatcaacaatgattaat

SEQ ID NO: 2986173 - DNA, 23 bp, Homo sapiens
gcagtcatcaacaatgattaatc

SEQ ID NO: 2986174 - DNA, 13 bp, Homo sapiens
gcagtccagagct

SEQ ID NO: 2986175 - DNA, 16 bp, Homo sapiens
gcagtccatttctacc

SEQ ID NO: 2986176 - DNA, 18 bp, Homo sapiens
gcagtcccgggagaaaag

SEQ ID NO: 2986177 - DNA, 13 bp, Homo sapiens
gcagtcctggagc

SEQ ID NO: 2986178 - DNA, 14 bp, Homo sapiens
gcagtcgcttgcca

SEQ ID NO: 2986179 - DNA, 19 bp, Homo sapiens
gcagtcgcttgccaaagca

SEQ ID NO: 2986180 - DNA, 18 bp, Homo sapiens
gcagtctcgggtggctag

SEQ ID NO: 2986181 - DNA, 13 bp, Homo sapiens
gcagtctttcccc

SEQ ID NO: 2986182 - DNA, 19 bp, Homo sapiens
gcagtctttcccccaggaa

SEQ ID NO: 2986183 - DNA, 20 bp, Homo sapiens
gcagtgaatgattcagtgtt

SEQ ID NO: 2986184 - DNA, 22 bp, Homo sapiens
gcagtgactgtggccatggtcc

SEQ ID NO: 2986185 - DNA, 21 bp, Homo sapiens
gcagtgagccgcatcttctcc

SEQ ID NO: 2986186 - DNA, 15 bp, Homo sapiens
gcagtgccagccaat

SEQ ID NO: 2986187 - DNA, 12 bp, Homo sapiens
gcagtgccagct

SEQ ID NO: 2986188 - DNA, 14 bp, Homo sapiens
gcagtgccagctcc

SEQ ID NO: 2986189 - DNA, 17 bp, Homo sapiens
gcagtgccagctccctc

SEQ ID NO: 2986190 - DNA, 21 bp, Homo sapiens
gcagtggccccttaggccagt

SEQ ID NO: 2986191 - DNA, 23 bp, Homo sapiens
gcagtggcctggccgttcagcct

SEQ ID NO: 2986192 - DNA, 19 bp, Homo sapiens
gcagtggcgcattctaggc

SEQ ID NO: 2986193 - DNA, 14 bp, Homo sapiens
gcagtgggcaggtg

SEQ ID NO: 2986194 - DNA, 21 bp, Homo sapiens
gcagtggggtttcgcagcctg

SEQ ID NO: 2986195 - DNA, 20 bp, Homo sapiens
gcagtgtcttaaggagactg

SEQ ID NO: 2986196 - DNA, 23 bp, Homo sapiens
gcagtgtcttaaggagactggta

SEQ ID NO: 2986197 - DNA, 15 bp, Homo sapiens
gcagtgtgaggccag

SEQ ID NO: 2986198 - DNA, 21 bp, Homo sapiens
gcagtgtgaggccagggcaga

SEQ ID NO: 2986199 - DNA, 20 bp, Homo sapiens
gcagtgtgcactaaggggcc

SEQ ID NO: 2986200 - DNA, 14 bp, Homo sapiens
gcagtgtgtccatc

SEQ ID NO: 2986201 - DNA, 13 bp, Homo sapiens
gcagttgaggtgg

SEQ ID NO: 2986202 - DNA, 16 bp, Homo sapiens
gcagttgccgcttctg

SEQ ID NO: 2986203 - DNA, 20 bp, Homo sapiens
gcagtttatcattcaagtgt

SEQ ID NO: 2986204 - DNA, 22 bp, Homo sapiens
gcagtttgaaattctgaatttg

SEQ ID NO: 2986205 - DNA, 22 bp, Homo sapiens
gcagttttgacatcagccagct

SEQ ID NO: 2986206 - DNA, 15 bp, Homo sapiens
gcagttttgtaaatg

SEQ ID NO: 2986207 - DNA, 18 bp, Homo sapiens
gcagtttttctgccttta

SEQ ID NO: 2986208 - DNA, 13 bp, Homo sapiens
gcataagaaaaag

SEQ ID NO: 2986209 - DNA, 15 bp, Homo sapiens
gcataagaccaatct

SEQ ID NO: 2986210 - DNA, 16 bp, Homo sapiens
gcataatagtcaattt

SEQ ID NO: 2986211 - DNA, 13 bp, Homo sapiens
gcatacacacaca

SEQ ID NO: 2986212 - DNA, 21 bp, Homo sapiens
gcatacacacacacacacagc

SEQ ID NO: 2986213 - DNA, 23 bp, Homo sapiens
gcatacacacacacacacagcca

SEQ ID NO: 2986214 - DNA, 15 bp, Homo sapiens
gcatacagatattct

SEQ ID NO: 2986215 - DNA, 20 bp, Homo sapiens
gcatacgagagcagaggtct

SEQ ID NO: 2986216 - DNA, 16 bp, Homo sapiens
gcatacttcaaaagta

SEQ ID NO: 2986217 - DNA, 22 bp, Homo sapiens
gcatacttcaaaagtattttcc

SEQ ID NO: 2986218 - DNA, 18 bp, Homo sapiens
gcatagaattctagcttt

SEQ ID NO: 2986219 - DNA, 15 bp, Homo sapiens
gcatagcagctgcta

SEQ ID NO: 2986220 - DNA, 18 bp, Homo sapiens
gcatagctacgtggcact

SEQ ID NO: 2986221 - DNA, 16 bp, Homo sapiens
gcatagctttccagtt

SEQ ID NO: 2986222 - DNA, 19 bp, Homo sapiens
gcatatctctagtccctgt

SEQ ID NO: 2986223 - DNA, 14 bp, Homo sapiens
gcatatgttgaata

SEQ ID NO: 2986224 - DNA, 17 bp, Homo sapiens
gcatatgttgaatactt

SEQ ID NO: 2986225 - DNA, 21 bp, Homo sapiens
gcatatgtttcgctgatatat

SEQ ID NO: 2986226 - DNA, 15 bp, Homo sapiens
gcatattgtacactt

SEQ ID NO: 2986227 - DNA, 17 bp, Homo sapiens
gcatattgtacactttt

SEQ ID NO: 2986228 - DNA, 21 bp, Homo sapiens
gcatatttatccaaaatgtgt

SEQ ID NO: 2986229 - DNA, 21 bp, Homo sapiens
gcatcaaaagacaattcttta

SEQ ID NO: 2986230 - DNA, 17 bp, Homo sapiens
gcatcaagaactattgt

SEQ ID NO: 2986231 - DNA, 18 bp, Homo sapiens
gcatcaaggggtcactta

SEQ ID NO: 2986232 - DNA, 17 bp, Homo sapiens
gcatcacatgatgaaaa

SEQ ID NO: 2986233 - DNA, 15 bp, Homo sapiens
gcatcacccaggctg

SEQ ID NO: 2986234 - DNA, 15 bp, Homo sapiens
gcatcacctgcctgt

SEQ ID NO: 2986235 - DNA, 12 bp, Homo sapiens
gcatcagagggc

SEQ ID NO: 2986236 - DNA, 23 bp, Homo sapiens
gcatcagctgtctgtcatctgct

SEQ ID NO: 2986237 - DNA, 23 bp, Homo sapiens
gcatcaggatactcaaagtggaa

SEQ ID NO: 2986238 - DNA, 21 bp, Homo sapiens
gcatcatggaaagactgggac

SEQ ID NO: 2986239 - DNA, 21 bp, Homo sapiens
gcatcattgtccccatgcaac

SEQ ID NO: 2986240 - DNA, 23 bp, Homo sapiens
gcatccacttctttcagcagact

SEQ ID NO: 2986241 - DNA, 19 bp, Homo sapiens
gcatccagcagtctctgcc

SEQ ID NO: 2986242 - DNA, 18 bp, Homo sapiens
gcatccaggccagggctc

SEQ ID NO: 2986243 - DNA, 14 bp, Homo sapiens
gcatccattcctca

SEQ ID NO: 2986244 - DNA, 16 bp, Homo sapiens
gcatccattcctcagg

SEQ ID NO: 2986245 - DNA, 18 bp, Homo sapiens
gcatccattcctcaggga

SEQ ID NO: 2986246 - DNA, 13 bp, Homo sapiens
gcatcccacagga

SEQ ID NO: 2986247 - DNA, 22 bp, Homo sapiens
gcatccccacgacccctgcctc

SEQ ID NO: 2986248 - DNA, 18 bp, Homo sapiens
gcatcccggctgaccctg

SEQ ID NO: 2986249 - DNA, 17 bp, Homo sapiens
gcatccgcaggtgctgg

SEQ ID NO: 2986250 - DNA, 18 bp, Homo sapiens
gcatccgcaggtgctggt

SEQ ID NO: 2986251 - DNA, 20 bp, Homo sapiens
gcatccgcaggtgctggtcc

SEQ ID NO: 2986252 - DNA, 19 bp, Homo sapiens
gcatccgtagttccctgaa

SEQ ID NO: 2986253 - DNA, 17 bp, Homo sapiens
gcatcctccccaccaga

SEQ ID NO: 2986254 - DNA, 19 bp, Homo sapiens
gcatcctccccaccagagc

SEQ ID NO: 2986255 - DNA, 20 bp, Homo sapiens
gcatcctccccaccagagct

SEQ ID NO: 2986256 - DNA, 14 bp, Homo sapiens
gcatcctgtgaagt

SEQ ID NO: 2986257 - DNA, 17 bp, Homo sapiens
gcatccttgcctgtcta

SEQ ID NO: 2986258 - DNA, 23 bp, Homo sapiens
gcatccttgcctgtctaaagcct

SEQ ID NO: 2986259 - DNA, 22 bp, Homo sapiens
gcatcggacaagacccccagca

SEQ ID NO: 2986260 - DNA, 16 bp, Homo sapiens
gcatcggtcatgtgtg

SEQ ID NO: 2986261 - DNA, 17 bp, Homo sapiens
gcatcgtcccctccccc

SEQ ID NO: 2986262 - DNA, 20 bp, Homo sapiens
gcatctaattcttattttta

SEQ ID NO: 2986263 - DNA, 21 bp, Homo sapiens
gcatctacttgccagaaccaa

SEQ ID NO: 2986264 - DNA, 17 bp, Homo sapiens
gcatctcaaatgttttc

SEQ ID NO: 2986265 - DNA, 22 bp, Homo sapiens
gcatctccagcattctcagcca

SEQ ID NO: 2986266 - DNA, 21 bp, Homo sapiens
gcatctcccagataatgtgaa

SEQ ID NO: 2986267 - DNA, 14 bp, Homo sapiens
gcatctgaccagca

SEQ ID NO: 2986268 - DNA, 18 bp, Homo sapiens
gcatctgaccagcagcgc

SEQ ID NO: 2986269 - DNA, 18 bp, Homo sapiens
gcatctgaccatctgtga

SEQ ID NO: 2986270 - DNA, 20 bp, Homo sapiens
gcatctgcaggcaccgggct

SEQ ID NO: 2986271 - DNA, 21 bp, Homo sapiens
gcatctgcaggcaccgggctg

SEQ ID NO: 2986272 - DNA, 14 bp, Homo sapiens
gcatctgtgtgcgt

SEQ ID NO: 2986273 - DNA, 13 bp, Homo sapiens
gcatctgtgtgtg

SEQ ID NO: 2986274 - DNA, 13 bp, Homo sapiens
gcatcttctccat

SEQ ID NO: 2986275 - DNA, 16 bp, Homo sapiens
gcatctttggggaggt

SEQ ID NO: 2986276 - DNA, 14 bp, Homo sapiens
gcatgaaaggcttt

SEQ ID NO: 2986277 - DNA, 18 bp, Homo sapiens
gcatgaaattttgcctgc

SEQ ID NO: 2986278 - DNA, 16 bp, Homo sapiens
gcatgacaaaagtgac

SEQ ID NO: 2986279 - DNA, 14 bp, Homo sapiens
gcatgacatttctt

SEQ ID NO: 2986280 - DNA, 22 bp, Homo sapiens
gcatgagcattggatacagcag

SEQ ID NO: 2986281 - DNA, 19 bp, Homo sapiens
gcatgatccaagcaagact

SEQ ID NO: 2986282 - DNA, 22 bp, Homo sapiens
gcatgatccaagcaagactgag

SEQ ID NO: 2986283 - DNA, 18 bp, Homo sapiens
gcatgatgggaaaatatt

SEQ ID NO: 2986284 - DNA, 20 bp, Homo sapiens
gcatgattttaagaggcttt

SEQ ID NO: 2986285 - DNA, 14 bp, Homo sapiens
gcatgcacctgcaa

SEQ ID NO: 2986286 - DNA, 18 bp, Homo sapiens
gcatgcacgggcatgcac

SEQ ID NO: 2986287 - DNA, 19 bp, Homo sapiens
gcatgcacgggcatgcaca

SEQ ID NO: 2986288 - DNA, 22 bp, Homo sapiens
gcatgcactgttccccctgtgc

SEQ ID NO: 2986289 - DNA, 21 bp, Homo sapiens
gcatgccaacaagaatgcatt

SEQ ID NO: 2986290 - DNA, 23 bp, Homo sapiens
gcatgccaacgcagttcatgtac

SEQ ID NO: 2986291 - DNA, 20 bp, Homo sapiens
gccatgaggagttgctgttt

SEQ ID NO: 2986292 - DNA, 13 bp, Homo sapiens
gccatgatgcctc

SEQ ID NO: 2986293 - DNA, 17 bp, Homo sapiens
gccatgatttcccactg

SEQ ID NO: 2986294 - DNA, 17 bp, Homo sapiens
gccatgcctcagccctg

SEQ ID NO: 2986295 - DNA, 16 bp, Homo sapiens
gccatgcgcgcgctct

SEQ ID NO: 2986296 - DNA, 14 bp, Homo sapiens
gccatggaaggtgc

SEQ ID NO: 2986297 - DNA, 15 bp, Homo sapiens
gccatggaaggtgcc

SEQ ID NO: 2986298 - DNA, 18 bp, Homo sapiens
gccatggaaggtgccaga

SEQ ID NO: 2986299 - DNA, 23 bp, Homo sapiens
gccatggaaggtgccagaaggaa

SEQ ID NO: 2986300 - DNA, 14 bp, Homo sapiens
gccatggagtgaga

SEQ ID NO: 2986301 - DNA, 23 bp, Homo sapiens
gccatggccctcccagtgcctcc

SEQ ID NO: 2986302 - DNA, 18 bp, Homo sapiens
gccatggcgagatactgc

SEQ ID NO: 2986303 - DNA, 20 bp, Homo sapiens
gccatggcgagatactgcat

SEQ ID NO: 2986304 - DNA, 17 bp, Homo sapiens
gccatggctcagggtgg

SEQ ID NO: 2986305 - DNA, 16 bp, Homo sapiens
gccatggctttcatcc

SEQ ID NO: 2986306 - DNA, 13 bp, Homo sapiens
gccatgggtcctc

SEQ ID NO: 2986307 - DNA, 23 bp, Homo sapiens
gccatgggtcctcggcccatctg

SEQ ID NO: 2986308 - DNA, 12 bp, Homo sapiens
gccatgtagcag

SEQ ID NO: 2986309 - DNA, 17 bp, Homo sapiens
gccatgtcaaacaaata

SEQ ID NO: 2986310 - DNA, 15 bp, Homo sapiens
gccatgtctgtgctg

SEQ ID NO: 2986311 - DNA, 23 bp, Homo sapiens
gccatgtgactctggcttggcct

SEQ ID NO: 2986312 - DNA, 19 bp, Homo sapiens
gccatgtggcctgcccagc

SEQ ID NO: 2986313 - DNA, 19 bp, Homo sapiens
gccattacccagctaaata

SEQ ID NO: 2986314 - DNA, 20 bp, Homo sapiens
gccattagccagatttgtct

SEQ ID NO: 2986315 - DNA, 17 bp, Homo sapiens
gccattatagcgcctgt

SEQ ID NO: 2986316 - DNA, 21 bp, Homo sapiens
gccattatagcgcctgtataa

SEQ ID NO: 2986317 - DNA, 19 bp, Homo sapiens
gccattctcctgcctcagc

SEQ ID NO: 2986318 - DNA, 12 bp, Homo sapiens
gccattggagtc

SEQ ID NO: 2986319 - DNA, 16 bp, Homo sapiens
gccattggctactgac

SEQ ID NO: 2986320 - DNA, 20 bp, Homo sapiens
gccattggctatttaaaact

SEQ ID NO: 2986321 - DNA, 17 bp, Homo sapiens
gccattgtactccagcc

SEQ ID NO: 2986322 - DNA, 19 bp, Homo sapiens
gccattgtactccagcctg

SEQ ID NO: 2986323 - DNA, 13 bp, Homo sapiens
gccatttatttat

SEQ ID NO: 2986324 - DNA, 22 bp, Homo sapiens
gccatttcctcacgtgcaggac

SEQ ID NO: 2986325 - DNA, 11 bp, Homo sapiens
gccatttgaga

SEQ ID NO: 2986326 - DNA, 23 bp, Homo sapiens
gccatttttagtttaaaatcttg

SEQ ID NO: 2986327 - DNA, 18 bp, Homo sapiens
gcccaaaaatatggttga

SEQ ID NO: 2986328 - DNA, 20 bp, Homo sapiens
gcccaaagcttgtaaatatg

SEQ ID NO: 2986329 - DNA, 16 bp, Homo sapiens
gcccaaatggctctgt

SEQ ID NO: 2986330 - DNA, 18 bp, Homo sapiens
gcccaagggatctggtcc

SEQ ID NO: 2986331 - DNA, 14 bp, Homo sapiens
gcccaagtgaccag

SEQ ID NO: 2986332 - DNA, 20 bp, Homo sapiens
gcccaagtgaccagggaagt

SEQ ID NO: 2986333 - DNA, 22 bp, Homo sapiens
gcccaatccaggtacgcacaga

SEQ ID NO: 2986334 - DNA, 23 bp, Homo sapiens
gcccaatctcgtcaggctgccag

SEQ ID NO: 2986335 - DNA, 22 bp, Homo sapiens
gcccacaacttgtcacccaaag

SEQ ID NO: 2986336 - DNA, 23 bp, Homo sapiens
gcccacaacttgtcacccaaagc

SEQ ID NO: 2986337 - DNA, 11 bp, Homo sapiens
gcccacacaca

SEQ ID NO: 2986338 - DNA, 14 bp, Homo sapiens
gcccacacacactc

SEQ ID NO: 2986339 - DNA, 15 bp, Homo sapiens
gcccacacacaggtg

SEQ ID NO: 2986340 - DNA, 13 bp, Homo sapiens
gcccacagctccc

SEQ ID NO: 2986341 - DNA, 16 bp, Homo sapiens
gcccacagctcccacc

SEQ ID NO: 2986342 - DNA, 19 bp, Homo sapiens
gcccacagctcccacccca

SEQ ID NO: 2986343 - DNA, 15 bp, Homo sapiens
gcccacatttagtct

SEQ ID NO: 2986344 - DNA, 21 bp, Homo sapiens
gcccacatttagtctctttat

SEQ ID NO: 2986345 - DNA, 11 bp, Homo sapiens
gcccaccagga

SEQ ID NO: 2986346 - DNA, 19 bp, Homo sapiens
gcccacccagtccatgctc

SEQ ID NO: 2986347 - DNA, 17 bp, Homo sapiens
gcccacccccctcccca

SEQ ID NO: 2986348 - DNA, 20 bp, Homo sapiens
gcccacccccctccccaact

SEQ ID NO: 2986349 - DNA, 18 bp, Homo sapiens
gcccacccggtgggaccc

SEQ ID NO: 2986350 - DNA, 16 bp, Homo sapiens
gcccaccctgctgctg

SEQ ID NO: 2986351 - DNA, 18 bp, Homo sapiens
gcccaccctgctgctggt

SEQ ID NO: 2986352 - DNA, 19 bp, Homo sapiens
gcccaccctgctgctggtg

SEQ ID NO: 2986353 - DNA, 22 bp, Homo sapiens
gcccaccctgctgctggtgcac

SEQ ID NO: 2986354 - DNA, 21 bp, Homo sapiens
gcccacctcggccctccctgc

SEQ ID NO: 2986355 - DNA, 17 bp, Homo sapiens
gcccacctgaaagcctg

SEQ ID NO: 2986356 - DNA, 18 bp, Homo sapiens
gcccacctgaaagcctgt

SEQ ID NO: 2986357 - DNA, 19 bp, Homo sapiens
gcccacctgaaagcctgtc

SEQ ID NO: 2986358 - DNA, 14 bp, Homo sapiens
gcccacctgcctgg

SEQ ID NO: 2986359 - DNA, 16 bp, Homo sapiens
gcccactcaggggtca

SEQ ID NO: 2986360 - DNA, 12 bp, Homo sapiens
gcccactgcctc

SEQ ID NO: 2986361 - DNA, 13 bp, Homo sapiens
gcccactgcctcc

SEQ ID NO: 2986362 - DNA, 23 bp, Homo sapiens
gcccactgtcctgggcctgcaga

SEQ ID NO: 2986363 - DNA, 24 bp, Homo sapiens
gcccactgtcctgggcctgcagaa

SEQ ID NO: 2986364 - DNA, 16 bp, Homo sapiens
gcccagaatgaggctg

SEQ ID NO: 2986365 - DNA, 23 bp, Homo sapiens
gcccagacccagcccgcggcctg

SEQ ID NO: 2986366 - DNA, 20 bp, Homo sapiens
gcccagaccggcttctcggc

SEQ ID NO: 2986367 - DNA, 10 bp, Homo sapiens
gcccagagac

SEQ ID NO: 2986368 - DNA, 23 bp, Homo sapiens
gcccagagacatacttgaagggc

SEQ ID NO: 2986369 - DNA, 17 bp, Homo sapiens
gcccagagatgcctcca

SEQ ID NO: 2986370 - DNA, 16 bp, Homo sapiens
gcccagagcccagctc

SEQ ID NO: 2986371 - DNA, 16 bp, Homo sapiens
gcccagaggagcccag

SEQ ID NO: 2986372 - DNA, 18 bp, Homo sapiens
gcccagattgtgccactg

SEQ ID NO: 2986373 - DNA, 15 bp, Homo sapiens
gcccagcagcctgcc

SEQ ID NO: 2986374 - DNA, 16 bp, Homo sapiens
gcccagcagcctgcca

SEQ ID NO: 2986375 - DNA, 17 bp, Homo sapiens
gcccagcagcctgccag

SEQ ID NO: 2986376 - DNA, 15 bp, Homo sapiens
gcccagcatttcccg

SEQ ID NO: 2986377 - DNA, 20 bp, Homo sapiens
gcccagcatttcccgaaggc

SEQ ID NO: 2986378 - DNA, 13 bp, Homo sapiens
gcccagccacccc

SEQ ID NO: 2986379 - DNA, 16 bp, Homo sapiens
gcccagccactccaag

SEQ ID NO: 2986380 - DNA, 17 bp, Homo sapiens
gcccagccaggccccag

SEQ ID NO: 2986381 - DNA, 20 bp, Homo sapiens
gcccagcccaggagtttgag

SEQ ID NO: 2986382 - DNA, 16 bp, Homo sapiens
gcccagccgggcacag

SEQ ID NO: 2986383 - DNA, 19 bp, Homo sapiens
gcccagccgggcacagtgg

SEQ ID NO: 2986384 - DNA, 13 bp, Homo sapiens
gcccagcctgggg

SEQ ID NO: 2986385 - DNA, 15 bp, Homo sapiens
gcccagcggcccaag

SEQ ID NO: 2986386 - DNA, 18 bp, Homo sapiens
gcccagctatacctgtgc

SEQ ID NO: 2986387 - DNA, 12 bp, Homo sapiens
gcccagctccaa

SEQ ID NO: 2986388 - DNA, 13 bp, Homo sapiens
gcccagctcttgc

SEQ ID NO: 2986389 - DNA, 21 bp, Homo sapiens
gcccagctcttgctctcttgt

SEQ ID NO: 2986390 - DNA, 18 bp, Homo sapiens
gcccagctgggtcaggca

SEQ ID NO: 2986391 - DNA, 10 bp, Homo sapiens
gcccaggaga

SEQ ID NO: 2986392 - DNA, 18 bp, Homo sapiens
gcccaggagagccagccc

SEQ ID NO: 2986393 - DNA, 14 bp, Homo sapiens
gcccaggagctctg

SEQ ID NO: 2986394 - DNA, 23 bp, Homo sapiens
gcccaggagctctgcgccaggca

SEQ ID NO: 2986395 - DNA, 21 bp, Homo sapiens
gcccaggagtttgaggctgca

SEQ ID NO: 2986396 - DNA, 15 bp, Homo sapiens
gcccaggcactgcaa

SEQ ID NO: 2986397 - DNA, 12 bp, Homo sapiens
gcccaggcaggt

SEQ ID NO: 2986398 - DNA, 15 bp, Homo sapiens
gcccaggcaggtctg

SEQ ID NO: 2986399 - DNA, 19 bp, Homo sapiens
gcccaggcaggtctgcaag

SEQ ID NO: 2986400 - DNA, 21 bp, Homo sapiens
gcccaggcctccagctcagca

SEQ ID NO: 2986401 - DNA, 12 bp, Homo sapiens
gcccaggcctgg

SEQ ID NO: 2986402 - DNA, 16 bp, Homo sapiens
gcccaggcctggagcg

SEQ ID NO: 2986403 - DNA, 20 bp, Homo sapiens
gcccaggctggagtgcagtg

SEQ ID NO: 2986404 - DNA, 15 bp, Homo sapiens
gcccaggctgggaac

SEQ ID NO: 2986405 - DNA, 12 bp, Homo sapiens
gcccaggctggt

SEQ ID NO: 2986406 - DNA, 14 bp, Homo sapiens
gcccaggctggtct

SEQ ID NO: 2986407 - DNA, 16 bp, Homo sapiens
gcccagggagcggaaa

SEQ ID NO: 2986408 - DNA, 17 bp, Homo sapiens
gcccagggagcggaaag

SEQ ID NO: 2986409 - DNA, 20 bp, Homo sapiens
gcccagggagcggaaagcag

SEQ ID NO: 2986410 - DNA, 21 bp, Homo sapiens
gcccagggagcggaaagcagc

SEQ ID NO: 2986411 - DNA, 17 bp, Homo sapiens
gcccagggcccagagcc

SEQ ID NO: 2986412 - DNA, 19 bp, Homo sapiens
gcccagggcccagagccca

SEQ ID NO: 2986413 - DNA, 24 bp, Homo sapiens
gcccaggggagaatgcagcccacc

SEQ ID NO: 2986414 - DNA, 14 bp, Homo sapiens
gcccagggggcctg

SEQ ID NO: 2986415 - DNA, 20 bp, Homo sapiens
gcccagggggcctggagcat

SEQ ID NO: 2986416 - DNA, 15 bp, Homo sapiens
gcccagggtgcagtg

SEQ ID NO: 2986417 - DNA, 15 bp, Homo sapiens
gcccagtccttccac

SEQ ID NO: 2986418 - DNA, 18 bp, Homo sapiens
gcccagtccttccacctc

SEQ ID NO: 2986419 - DNA, 18 bp, Homo sapiens
gcccagtctttcatgtgt

SEQ ID NO: 2986420 - DNA, 11 bp, Homo sapiens
gcccagtgcat

SEQ ID NO: 2986421 - DNA, 14 bp, Homo sapiens
gcccagtgcatggt

SEQ ID NO: 2986422 - DNA, 13 bp, Homo sapiens
gcccagtgggctg

SEQ ID NO: 2986423 - DNA, 15 bp, Homo sapiens
gcccagtgggctgca

SEQ ID NO: 2986424 - DNA, 17 bp, Homo sapiens
gcctgacaattgcaaat

SEQ ID NO: 2986425 - DNA, 22 bp, Homo sapiens
gcctgacatttggagtgttccc

SEQ ID NO: 2986426 - DNA, 14 bp, Homo sapiens
gcctgacctccagt

SEQ ID NO: 2986427 - DNA, 19 bp, Homo sapiens
gcctgactagggagccatg

SEQ ID NO: 2986428 - DNA, 14 bp, Homo sapiens
gcctgactctgttg

SEQ ID NO: 2986429 - DNA, 12 bp, Homo sapiens
gcctgagaaaca

SEQ ID NO: 2986430 - DNA, 22 bp, Homo sapiens
gcctgagaatttaatttttaaa

SEQ ID NO: 2986431 - DNA, 14 bp, Homo sapiens
gcctgagcccctca

SEQ ID NO: 2986432 - DNA, 18 bp, Homo sapiens
gcctgagcctcccgaggc

SEQ ID NO: 2986433 - DNA, 18 bp, Homo sapiens
gcctgagtgacagagcga

SEQ ID NO: 2986434 - DNA, 16 bp, Homo sapiens
gcctgatcagaccacg

SEQ ID NO: 2986435 - DNA, 20 bp, Homo sapiens
gcctgatcagaccacggctc

SEQ ID NO: 2986436 - DNA, 19 bp, Homo sapiens
gcctgatgagactccactc

SEQ ID NO: 2986437 - DNA, 20 bp, Homo sapiens
gcctgatgagactccactca

SEQ ID NO: 2986438 - DNA, 18 bp, Homo sapiens
gcctgatttgttgggacc

SEQ ID NO: 2986439 - DNA, 13 bp, Homo sapiens
gcctgattttaaa

SEQ ID NO: 2986440 - DNA, 17 bp, Homo sapiens
gcctgcaaacgctgcct

SEQ ID NO: 2986441 - DNA, 18 bp, Homo sapiens
gcctgcaaacgctgcctg

SEQ ID NO: 2986442 - DNA, 22 bp, Homo sapiens
gcctgcaccctcttctcctctg

SEQ ID NO: 2986443 - DNA, 21 bp, Homo sapiens
gcctgcactccctggccttgc

SEQ ID NO: 2986444 - DNA, 15 bp, Homo sapiens
gcctgcagagctgcg

SEQ ID NO: 2986445 - DNA, 16 bp, Homo sapiens
gcctgcaggacctgcc

SEQ ID NO: 2986446 - DNA, 17 bp, Homo sapiens
gcctgcaggacctgcct

SEQ ID NO: 2986447 - DNA, 20 bp, Homo sapiens
gcctgcagggaagccccaca

SEQ ID NO: 2986448 - DNA, 18 bp, Homo sapiens
gcctgcagggccatggct

SEQ ID NO: 2986449 - DNA, 15 bp, Homo sapiens
gcctgccactcaggc

SEQ ID NO: 2986450 - DNA, 14 bp, Homo sapiens
gcctgccagctgca

SEQ ID NO: 2986451 - DNA, 16 bp, Homo sapiens
gcctgccatcttctcc

SEQ ID NO: 2986452 - DNA, 14 bp, Homo sapiens
gcctgcccacctgc

SEQ ID NO: 2986453 - DNA, 15 bp, Homo sapiens
gcctgcccacctgcc

SEQ ID NO: 2986454 - DNA, 16 bp, Homo sapiens
gcctgcccacctgcct

SEQ ID NO: 2986455 - DNA, 18 bp, Homo sapiens
gcctgcccacctgcctgg

SEQ ID NO: 2986456 - DNA, 20 bp, Homo sapiens
gcctgcccacctgcctggcc

SEQ ID NO: 2986457 - DNA, 22 bp, Homo sapiens
gcctgcccattctgccctgtgg

SEQ ID NO: 2986458 - DNA, 17 bp, Homo sapiens
gcctgcccgcaccctgg

SEQ ID NO: 2986459 - DNA, 18 bp, Homo sapiens
gcctgcccgcaccctggc

SEQ ID NO: 2986460 - DNA, 21 bp, Homo sapiens
gcctgcccgcaccctggcctg

SEQ ID NO: 2986461 - DNA, 22 bp, Homo sapiens
gcctgcccgcaccctggcctgg

SEQ ID NO: 2986462 - DNA, 23 bp, Homo sapiens
gcctgcccgcaccctggcctggt

SEQ ID NO: 2986463 - DNA, 20 bp, Homo sapiens
gcctgccctcccgcaccttc

SEQ ID NO: 2986464 - DNA, 15 bp, Homo sapiens
gcctgccctcctctc

SEQ ID NO: 2986465 - DNA, 16 bp, Homo sapiens
gcctgccctcctctcc

SEQ ID NO: 2986466 - DNA, 18 bp, Homo sapiens
gcctgccctcctctcccg

SEQ ID NO: 2986467 - DNA, 21 bp, Homo sapiens
gcctgccctcctctcccgtct

SEQ ID NO: 2986468 - DNA, 18 bp, Homo sapiens
gcctgccctgctatttca

SEQ ID NO: 2986469 - DNA, 21 bp, Homo sapiens
gcctgccggtaaacacgcctg

SEQ ID NO: 2986470 - DNA, 13 bp, Homo sapiens
gcctgcctcctgg

SEQ ID NO: 2986471 - DNA, 14 bp, Homo sapiens
gcctgcctcctggc

SEQ ID NO: 2986472 - DNA, 20 bp, Homo sapiens
gcctgcctcgccttgtgtta

SEQ ID NO: 2986473 - DNA, 15 bp, Homo sapiens
gcctgcctggcaggc

SEQ ID NO: 2986474 - DNA, 14 bp, Homo sapiens
gcctgccttttcta

SEQ ID NO: 2986475 - DNA, 15 bp, Homo sapiens
gcctgcgaccctggg

SEQ ID NO: 2986476 - DNA, 14 bp, Homo sapiens
gcctgcgctcggca

SEQ ID NO: 2986477 - DNA, 15 bp, Homo sapiens
gcctgcgtgcgctgg

SEQ ID NO: 2986478 - DNA, 13 bp, Homo sapiens
gcctgctccagac

SEQ ID NO: 2986479 - DNA, 15 bp, Homo sapiens
gcctgctcccccacc

SEQ ID NO: 2986480 - DNA, 23 bp, Homo sapiens
gcctgctgaatgatttccaaaga

SEQ ID NO: 2986481 - DNA, 11 bp, Homo sapiens
gcctgctgggc

SEQ ID NO: 2986482 - DNA, 12 bp, Homo sapiens
gcctgctgggct

SEQ ID NO: 2986483 - DNA, 14 bp, Homo sapiens
gcctgctgggctct

SEQ ID NO: 2986484 - DNA, 20 bp, Homo sapiens
gcctgctgggctctccacct

SEQ ID NO: 2986485 - DNA, 21 bp, Homo sapiens
gcctgctgggctctccacctc

SEQ ID NO: 2986486 - DNA, 15 bp, Homo sapiens
gcctgctgggctctt

SEQ ID NO: 2986487 - DNA, 13 bp, Homo sapiens
gcctgctgtgctg

SEQ ID NO: 2986488 - DNA, 15 bp, Homo sapiens
gcctgctgtgctggg

SEQ ID NO: 2986489 - DNA, 20 bp, Homo sapiens
gcctgctgttggtcctctct

SEQ ID NO: 2986490 - DNA, 21 bp, Homo sapiens
gcctgctgttggtcctctctc

SEQ ID NO: 2986491 - DNA, 20 bp, Homo sapiens
gcctgctttgacgggccagg

SEQ ID NO: 2986492 - DNA, 20 bp, Homo sapiens
gcctggaaacagaggtaaaa

SEQ ID NO: 2986493 - DNA, 23 bp, Homo sapiens
gcctggaacaccagcagcactgg

SEQ ID NO: 2986494 - DNA, 15 bp, Homo sapiens
gcctggacccctgga

SEQ ID NO: 2986495 - DNA, 13 bp, Homo sapiens
gcctggactgcta

SEQ ID NO: 2986496 - DNA, 17 bp, Homo sapiens
gcctggagcaggggtgg

SEQ ID NO: 2986497 - DNA, 14 bp, Homo sapiens
gcctggagcatgga

SEQ ID NO: 2986498 - DNA, 20 bp, Homo sapiens
gcctggagcatggacagtgt

SEQ ID NO: 2986499 - DNA, 13 bp, Homo sapiens
gcctggagcccca

SEQ ID NO: 2986500 - DNA, 20 bp, Homo sapiens
gcctggagccccactgccct

SEQ ID NO: 2986501 - DNA, 12 bp, Homo sapiens
gcctggagccct

SEQ ID NO: 2986502 - DNA, 17 bp, Homo sapiens
gcctggagtgctgtgct

SEQ ID NO: 2986503 - DNA, 22 bp, Homo sapiens
gcctggatacagtataaaaata

SEQ ID NO: 2986504 - DNA, 14 bp, Homo sapiens
gcctggcacacatc

SEQ ID NO: 2986505 - DNA, 13 bp, Homo sapiens
gcctggcatctgt

SEQ ID NO: 2986506 - DNA, 16 bp, Homo sapiens
gcctggcatctgtgcg

SEQ ID NO: 2986507 - DNA, 16 bp, Homo sapiens
gcctggcatctgtgtg

SEQ ID NO: 2986508 - DNA, 13 bp, Homo sapiens
gcctggccagaca

SEQ ID NO: 2986509 - DNA, 17 bp, Homo sapiens
gcctggccagacacagg

SEQ ID NO: 2986510 - DNA, 13 bp, Homo sapiens
gcctggccagtcc

SEQ ID NO: 2986511 - DNA, 14 bp, Homo sapiens
gcctggccagtcct

SEQ ID NO: 2986512 - DNA, 15 bp, Homo sapiens
gcctggccagtcctg

SEQ ID NO: 2986513 - DNA, 20 bp, Homo sapiens
gcctggccagtcctggtcct

SEQ ID NO: 2986514 - DNA, 23 bp, Homo sapiens
gcctggccagtcctggtcctggc

SEQ ID NO: 2986515 - DNA, 16 bp, Homo sapiens
gcctggccagtcttcc

SEQ ID NO: 2986516 - DNA, 19 bp, Homo sapiens
gcctggccagtcttcctct

SEQ ID NO: 2986517 - DNA, 13 bp, Homo sapiens
gcctggccggcca

SEQ ID NO: 2986518 - DNA, 18 bp, Homo sapiens
gcctggccgttcagcctg

SEQ ID NO: 2986519 - DNA, 14 bp, Homo sapiens
gcctggcctccagg

SEQ ID NO: 2986520 - DNA, 15 bp, Homo sapiens
gcctggcctccaggc

SEQ ID NO: 2986521 - DNA, 16 bp, Homo sapiens
gcctggcctccaggcc

SEQ ID NO: 2986522 - DNA, 13 bp, Homo sapiens
gcctggcctggca

SEQ ID NO: 2986523 - DNA, 18 bp, Homo sapiens
gcctgggaaataagcccc

SEQ ID NO: 2986524 - DNA, 22 bp, Homo sapiens
gcctgggcaacatagtgagacc

SEQ ID NO: 2986525 - DNA, 16 bp, Homo sapiens
gcctgggcaggaggga

SEQ ID NO: 2986526 - DNA, 12 bp, Homo sapiens
gcctgggcagtg

SEQ ID NO: 2986527 - DNA, 20 bp, Homo sapiens
gcctgggccccagctcgcgg

SEQ ID NO: 2986528 - DNA, 21 bp, Homo sapiens
gcctgggcccctcccctcaga

SEQ ID NO: 2986529 - DNA, 16 bp, Homo sapiens
gcctgggctgggcagc

SEQ ID NO: 2986530 - DNA, 18 bp, Homo sapiens
gcctgggctgggcagcct

SEQ ID NO: 2986531 - DNA, 23 bp, Homo sapiens
gcctggggctccgaaattccaag

SEQ ID NO: 2986532 - DNA, 20 bp, Homo sapiens
gcctggggcttgaatttgca

SEQ ID NO: 2986533 - DNA, 20 bp, Homo sapiens
gcctgggggacccctggctc

SEQ ID NO: 2986534 - DNA, 21 bp, Homo sapiens
gcctgggggacccctggctct

SEQ ID NO: 2986535 - DNA, 14 bp, Homo sapiens
gcctgggggagaga

SEQ ID NO: 2986536 - DNA, 17 bp, Homo sapiens
gcctgggggtgccagga

SEQ ID NO: 2986537 - DNA, 16 bp, Homo sapiens
gcctgggtaggcccca

SEQ ID NO: 2986538 - DNA, 18 bp, Homo sapiens
gcctgggtaggccccaca

SEQ ID NO: 2986539 - DNA, 20 bp, Homo sapiens
gcctgggtaggccccacaag

SEQ ID NO: 2986540 - DNA, 15 bp, Homo sapiens
gcctgggtcacagag

SEQ ID NO: 2986541 - DNA, 23 bp, Homo sapiens
gcctgggtcacagagtgagactc

SEQ ID NO: 2986542 - DNA, 20 bp, Homo sapiens
gcctgggtgacaaagcgaga

SEQ ID NO: 2986543 - DNA, 19 bp, Homo sapiens
gcctgggtgacagagcgag

SEQ ID NO: 2986544 - DNA, 16 bp, Homo sapiens
gcctgggtggggctgc

SEQ ID NO: 2986545 - DNA, 19 bp, Homo sapiens
gcctgggtggggctgctcc

SEQ ID NO: 2986546 - DNA, 20 bp, Homo sapiens
gcctgggtggggctgctcct

SEQ ID NO: 2986547 - DNA, 21 bp, Homo sapiens
gcctggtccctggtccttcac

SEQ ID NO: 2986548 - DNA, 16 bp, Homo sapiens
gcctggtgcacagggc

SEQ ID NO: 2986549 - DNA, 14 bp, Homo sapiens
gcctggttagaggc

SEQ ID NO: 2986550 - DNA, 15 bp, Homo sapiens
gcctggttgaagaag

SEQ ID NO: 2986551 - DNA, 16 bp, Homo sapiens
gcctgtaatcccagaa

SEQ ID NO: 2986552 - DNA, 18 bp, Homo sapiens
gcctgtaatcccagaact

SEQ ID NO: 2986553 - DNA, 16 bp, Homo sapiens
gcctgtaatcccagca

SEQ ID NO: 2986554 - DNA, 18 bp, Homo sapiens
gcctgtaatcccagcact

SEQ ID NO: 2986555 - DNA, 19 bp, Homo sapiens
gcctgtaatcccagcactt

SEQ ID NO: 2986556 - DNA, 20 bp, Homo sapiens
gcctgtaatcccagcacttt

SEQ ID NO: 2986557 - DNA, 22 bp, Homo sapiens
gctcaaagatgtgggttctttt

SEQ ID NO: 2986558 - DNA, 14 bp, Homo sapiens
gctcaaataaaaat

SEQ ID NO: 2986559 - DNA, 17 bp, Homo sapiens
gctcaaggaaaggcctg

SEQ ID NO: 2986560 - DNA, 19 bp, Homo sapiens
gctcaagggacaaggacac

SEQ ID NO: 2986561 - DNA, 22 bp, Homo sapiens
gctcaagtgatcctcacgcctt

SEQ ID NO: 2986562 - DNA, 21 bp, Homo sapiens
gctcaagtgttcacaacctgg

SEQ ID NO: 2986563 - DNA, 17 bp, Homo sapiens
gctcaatactctctgag

SEQ ID NO: 2986564 - DNA, 19 bp, Homo sapiens
gctcaatgccattgtgcag

SEQ ID NO: 2986565 - DNA, 13 bp, Homo sapiens
gctcaatttcagc

SEQ ID NO: 2986566 - DNA, 15 bp, Homo sapiens
gctcaatttcagcac

SEQ ID NO: 2986567 - DNA, 20 bp, Homo sapiens
gctcacaccctaccttcccc

SEQ ID NO: 2986568 - DNA, 23 bp, Homo sapiens
gctcacaccctaccttccccaga

SEQ ID NO: 2986569 - DNA, 14 bp, Homo sapiens
gctcacacctgtaa

SEQ ID NO: 2986570 - DNA, 13 bp, Homo sapiens
gctcacagttcct

SEQ ID NO: 2986571 - DNA, 21 bp, Homo sapiens
gctcacagttcctcgccctgg

SEQ ID NO: 2986572 - DNA, 16 bp, Homo sapiens
gctcacccccttctcc

SEQ ID NO: 2986573 - DNA, 20 bp, Homo sapiens
gctcacctgttgcttacaat

SEQ ID NO: 2986574 - DNA, 18 bp, Homo sapiens
gctcacgcttcacagtga

SEQ ID NO: 2986575 - DNA, 19 bp, Homo sapiens
gctcactgacctgcctgta

SEQ ID NO: 2986576 - DNA, 21 bp, Homo sapiens
gctcactgctaagaatatttg

SEQ ID NO: 2986577 - DNA, 14 bp, Homo sapiens
gctcagaagagcag

SEQ ID NO: 2986578 - DNA, 23 bp, Homo sapiens
gctcagacccccactctcattcc

SEQ ID NO: 2986579 - DNA, 21 bp, Homo sapiens
gctcagagagtacactgtgtc

SEQ ID NO: 2986580 - DNA, 17 bp, Homo sapiens
gctcagagccaaggggg

SEQ ID NO: 2986581 - DNA, 18 bp, Homo sapiens
gctcagaggcgcactgtg

SEQ ID NO: 2986582 - DNA, 19 bp, Homo sapiens
gctcagagggtgtcctgca

SEQ ID NO: 2986583 - DNA, 12 bp, Homo sapiens
gctcagccagca

SEQ ID NO: 2986584 - DNA, 16 bp, Homo sapiens
gctcagcccaccctcc

SEQ ID NO: 2986585 - DNA, 20 bp, Homo sapiens
gctcaggaaccgaggcaggg

SEQ ID NO: 2986586 - DNA, 17 bp, Homo sapiens
gctcaggaattgaagat

SEQ ID NO: 2986587 - DNA, 17 bp, Homo sapiens
gctcaggacagatgcca

SEQ ID NO: 2986588 - DNA, 18 bp, Homo sapiens
gctcaggactcagaagcc

SEQ ID NO: 2986589 - DNA, 19 bp, Homo sapiens
gctcaggactcagaagcct

SEQ ID NO: 2986590 - DNA, 21 bp, Homo sapiens
gctcaggagtttgagaccagg

SEQ ID NO: 2986591 - DNA, 15 bp, Homo sapiens
gctcagggaaaagca

SEQ ID NO: 2986592 - DNA, 17 bp, Homo sapiens
gctcagggaaaagcagc

SEQ ID NO: 2986593 - DNA, 16 bp, Homo sapiens
gctcagggcagtggct

SEQ ID NO: 2986594 - DNA, 19 bp, Homo sapiens
gctcaggtccctggggcta

SEQ ID NO: 2986595 - DNA, 19 bp, Homo sapiens
gctcagtctgttcactgca

SEQ ID NO: 2986596 - DNA, 18 bp, Homo sapiens
gctcagtgcaacctctgc

SEQ ID NO: 2986597 - DNA, 23 bp, Homo sapiens
gctcagttgtagaatgtattgta

SEQ ID NO: 2986598 - DNA, 16 bp, Homo sapiens
gctcagttttaaacgt

SEQ ID NO: 2986599 - DNA, 16 bp, Homo sapiens
gctcatcattctctgt

SEQ ID NO: 2986600 - DNA, 19 bp, Homo sapiens
gctcatcattctctgtctc

SEQ ID NO: 2986601 - DNA, 15 bp, Homo sapiens
gctcatctgagccag

SEQ ID NO: 2986602 - DNA, 16 bp, Homo sapiens
gctcatctgagccagc

SEQ ID NO: 2986603 - DNA, 19 bp, Homo sapiens
gctcatgtgtccctggcgc

SEQ ID NO: 2986604 - DNA, 23 bp, Homo sapiens
gctcattcattttatattgaaaa

SEQ ID NO: 2986605 - DNA, 15 bp, Homo sapiens
gctccaacctgcaaa

SEQ ID NO: 2986606 - DNA, 21 bp, Homo sapiens
gctccaactcctttcagccac

SEQ ID NO: 2986607 - DNA, 17 bp, Homo sapiens
gctccaagatgttctcc

SEQ ID NO: 2986608 - DNA, 19 bp, Homo sapiens
gctccaagatgttctcctg

SEQ ID NO: 2986609 - DNA, 17 bp, Homo sapiens
gctccaagattctagat

SEQ ID NO: 2986610 - DNA, 12 bp, Homo sapiens
gctccaagctgt

SEQ ID NO: 2986611 - DNA, 17 bp, Homo sapiens
gctccaagttgagactc

SEQ ID NO: 2986612 - DNA, 17 bp, Homo sapiens
gctccaataaaggaaca

SEQ ID NO: 2986613 - DNA, 20 bp, Homo sapiens
gctccaccagcatcacctgc

SEQ ID NO: 2986614 - DNA, 21 bp, Homo sapiens
gctccagacatacaaacataa

SEQ ID NO: 2986615 - DNA, 20 bp, Homo sapiens
gctccagagggcactctgct

SEQ ID NO: 2986616 - DNA, 18 bp, Homo sapiens
gctccagatgcagggcag

SEQ ID NO: 2986617 - DNA, 19 bp, Homo sapiens
gctccagcaacacagcctg

SEQ ID NO: 2986618 - DNA, 22 bp, Homo sapiens
gctccagcaagcaaacagggtg

SEQ ID NO: 2986619 - DNA, 19 bp, Homo sapiens
gctccagcccctttccaaa

SEQ ID NO: 2986620 - DNA, 18 bp, Homo sapiens
gctccagcgatggtgctg

SEQ ID NO: 2986621 - DNA, 22 bp, Homo sapiens
gctccagcgatggtgctgccca

SEQ ID NO: 2986622 - DNA, 23 bp, Homo sapiens
gctccagcgatggtgctgcccag

SEQ ID NO: 2986623 - DNA, 16 bp, Homo sapiens
gctccagctgccccgg

SEQ ID NO: 2986624 - DNA, 15 bp, Homo sapiens
gctccaggcagaagg

SEQ ID NO: 2986625 - DNA, 18 bp, Homo sapiens
gctccagggtcaggcgga

SEQ ID NO: 2986626 - DNA, 14 bp, Homo sapiens
gctccatagagcag

SEQ ID NO: 2986627 - DNA, 16 bp, Homo sapiens
gctcccacacttgtgc

SEQ ID NO: 2986628 - DNA, 13 bp, Homo sapiens
gctcccacagaac

SEQ ID NO: 2986629 - DNA, 22 bp, Homo sapiens
gctcccacctagtgccccagac

SEQ ID NO: 2986630 - DNA, 20 bp, Homo sapiens
gctcccacggggaccactgg

SEQ ID NO: 2986631 - DNA, 23 bp, Homo sapiens
gctcccacggggaccactgggcc

SEQ ID NO: 2986632 - DNA, 22 bp, Homo sapiens
gctcccagggacacctgggaga

SEQ ID NO: 2986633 - DNA, 18 bp, Homo sapiens
gctccccctctgcttctc

SEQ ID NO: 2986634 - DNA, 17 bp, Homo sapiens
gctcccctccatcccca

SEQ ID NO: 2986635 - DNA, 20 bp, Homo sapiens
gctcccctctgcacggacca

SEQ ID NO: 2986636 - DNA, 17 bp, Homo sapiens
gctccccttgcccttcc

SEQ ID NO: 2986637 - DNA, 19 bp, Homo sapiens
gctccccttgcccttcctg

SEQ ID NO: 2986638 - DNA, 20 bp, Homo sapiens
gctccccttgcccttcctga

SEQ ID NO: 2986639 - DNA, 14 bp, Homo sapiens
gctcccgtggcctg

SEQ ID NO: 2986640 - DNA, 15 bp, Homo sapiens
gctccctaccacctc

SEQ ID NO: 2986641 - DNA, 16 bp, Homo sapiens
gctccctaccacctcc

SEQ ID NO: 2986642 - DNA, 15 bp, Homo sapiens
gctccctcccaggac

SEQ ID NO: 2986643 - DNA, 18 bp, Homo sapiens
gctccctcccaggactct

SEQ ID NO: 2986644 - DNA, 15 bp, Homo sapiens
gctccctctccccct

SEQ ID NO: 2986645 - DNA, 21 bp, Homo sapiens
gctccctctctcctggactgg

SEQ ID NO: 2986646 - DNA, 14 bp, Homo sapiens
gctcccttggcttt

SEQ ID NO: 2986647 - DNA, 14 bp, Homo sapiens
gctccgaggactgg

SEQ ID NO: 2986648 - DNA, 17 bp, Homo sapiens
gctccgaggactggact

SEQ ID NO: 2986649 - DNA, 15 bp, Homo sapiens
gctccgctgccgtgc

SEQ ID NO: 2986650 - DNA, 13 bp, Homo sapiens
gctccgctgcctg

SEQ ID NO: 2986651 - DNA, 15 bp, Homo sapiens
gctccgctgcctgga

SEQ ID NO: 2986652 - DNA, 21 bp, Homo sapiens
gctccggcctctgcctttgca

SEQ ID NO: 2986653 - DNA, 15 bp, Homo sapiens
gctccggcctgcgtc

SEQ ID NO: 2986654 - DNA, 14 bp, Homo sapiens
gctccgtctctgtc

SEQ ID NO: 2986655 - DNA, 16 bp, Homo sapiens
gctccgtctctgtcct

SEQ ID NO: 2986656 - DNA, 21 bp, Homo sapiens
gctccgtggccccgccctcag

SEQ ID NO: 2986657 - DNA, 22 bp, Homo sapiens
gctccgtggccccgccctcagg

SEQ ID NO: 2986658 - DNA, 14 bp, Homo sapiens
gctcctagagggag

SEQ ID NO: 2986659 - DNA, 19 bp, Homo sapiens
gctcctagagggaggggcc

SEQ ID NO: 2986660 - DNA, 16 bp, Homo sapiens
gctcctattagaaaag

SEQ ID NO: 2986661 - DNA, 16 bp, Homo sapiens
gctcctcagcggctcc

SEQ ID NO: 2986662 - DNA, 14 bp, Homo sapiens
gctcctccagggcc

SEQ ID NO: 2986663 - DNA, 11 bp, Homo sapiens
gctcctcccct

SEQ ID NO: 2986664 - DNA, 18 bp, Homo sapiens
gctcctcccctgccgcct

SEQ ID NO: 2986665 - DNA, 20 bp, Homo sapiens
gctcctcccctgccgcctcc

SEQ ID NO: 2986666 - DNA, 23 bp, Homo sapiens
gctcctcccctgccgcctcccgg

SEQ ID NO: 2986667 - DNA, 22 bp, Homo sapiens
gctcctccctgcctcagtggct

SEQ ID NO: 2986668 - DNA, 20 bp, Homo sapiens
gctcctcctccctgcatctg

SEQ ID NO: 2986669 - DNA, 18 bp, Homo sapiens
gctcctcctcctgggcta

SEQ ID NO: 2986670 - DNA, 18 bp, Homo sapiens
gctcctcgagatcccaac

SEQ ID NO: 2986671 - DNA, 15 bp, Homo sapiens
gctcctctccccagc

SEQ ID NO: 2986672 - DNA, 18 bp, Homo sapiens
gctcctctccccagccca

SEQ ID NO: 2986673 - DNA, 22 bp, Homo sapiens
gctcctctccccagcccagaga

SEQ ID NO: 2986674 - DNA, 20 bp, Homo sapiens
gctcctctgtggtgtctgcc

SEQ ID NO: 2986675 - DNA, 17 bp, Homo sapiens
gctcctgagggagctcc

SEQ ID NO: 2986676 - DNA, 17 bp, Homo sapiens
gctcctggccttgctga

SEQ ID NO: 2986677 - DNA, 13 bp, Homo sapiens
gctcctggggaga

SEQ ID NO: 2986678 - DNA, 21 bp, Homo sapiens
gctcctgtggcagctgcccct

SEQ ID NO: 2986679 - DNA, 15 bp, Homo sapiens
gctccttaaggctct

SEQ ID NO: 2986680 - DNA, 22 bp, Homo sapiens
gctccttgaagacatatcatgt

SEQ ID NO: 2986681 - DNA, 21 bp, Homo sapiens
gctccttgggaggccccactg

SEQ ID NO: 2986682 - DNA, 19 bp, Homo sapiens
gctccttgggccctttgag

SEQ ID NO: 2986683 - DNA, 13 bp, Homo sapiens
gctcctttcccct

SEQ ID NO: 2986684 - DNA, 15 bp, Homo sapiens
gctccttttctgtga

SEQ ID NO: 2986685 - DNA, 17 bp, Homo sapiens
gctccttttctgtgaag

SEQ ID NO: 2986686 - DNA, 18 bp, Homo sapiens
gctcgaaatggcccctgt

SEQ ID NO: 2986687 - DNA, 17 bp, Homo sapiens
gctcgcccaggaaggcc

SEQ ID NO: 2986688 - DNA, 14 bp, Homo sapiens
gctggtggcctctg

SEQ ID NO: 2986689 - DNA, 17 bp, Homo sapiens
gctggtttcctgcccag

SEQ ID NO: 2986690 - DNA, 23 bp, Homo sapiens
gctggtttcctgcccagcctggg

SEQ ID NO: 2986691 - DNA, 15 bp, Homo sapiens
gctgtaagatgtctg

SEQ ID NO: 2986692 - DNA, 13 bp, Homo sapiens
gctgtaaggctct

SEQ ID NO: 2986693 - DNA, 16 bp, Homo sapiens
gctgtaaggctctaga

SEQ ID NO: 2986694 - DNA, 23 bp, Homo sapiens
gctgtaaggctctagatcataag

SEQ ID NO: 2986695 - DNA, 20 bp, Homo sapiens
gctgtacaagatgtagcacc

SEQ ID NO: 2986696 - DNA, 23 bp, Homo sapiens
gctgtacatctattttggattgt

SEQ ID NO: 2986697 - DNA, 15 bp, Homo sapiens
gctgtacctgttcct

SEQ ID NO: 2986698 - DNA, 12 bp, Homo sapiens
gctgtagagact

SEQ ID NO: 2986699 - DNA, 14 bp, Homo sapiens
gctgtagataaata

SEQ ID NO: 2986700 - DNA, 17 bp, Homo sapiens
gctgtagataacagcaa

SEQ ID NO: 2986701 - DNA, 14 bp, Homo sapiens
gctgtatcactgcc

SEQ ID NO: 2986702 - DNA, 14 bp, Homo sapiens
gctgtatgatttgt

SEQ ID NO: 2986703 - DNA, 15 bp, Homo sapiens
gctgtatgatttgtt

SEQ ID NO: 2986704 - DNA, 16 bp, Homo sapiens
gctgtatgatttgttt

SEQ ID NO: 2986705 - DNA, 18 bp, Homo sapiens
gctgtattcatgaatctt

SEQ ID NO: 2986706 - DNA, 13 bp, Homo sapiens
gctgtattcttct

SEQ ID NO: 2986707 - DNA, 18 bp, Homo sapiens
gctgtattgaatcatgta

SEQ ID NO: 2986708 - DNA, 22 bp, Homo sapiens
gctgtattttgagtttcagctg

SEQ ID NO: 2986709 - DNA, 23 bp, Homo sapiens
gctgtattttgagtttcagctgg

SEQ ID NO: 2986710 - DNA, 17 bp, Homo sapiens
gctgtcaccaaggaaac

SEQ ID NO: 2986711 - DNA, 14 bp, Homo sapiens
gctgtcatcaacat

SEQ ID NO: 2986712 - DNA, 21 bp, Homo sapiens
gctgtcatcaacattcttgtg

SEQ ID NO: 2986713 - DNA, 21 bp, Homo sapiens
gctgtcccaagctcccaagag

SEQ ID NO: 2986714 - DNA, 21 bp, Homo sapiens
gctgtccctgcactgtgcccc

SEQ ID NO: 2986715 - DNA, 22 bp, Homo sapiens
gctgtccctgcactgtgccccg

SEQ ID NO: 2986716 - DNA, 14 bp, Homo sapiens
gctgtccctgtcac

SEQ ID NO: 2986717 - DNA, 22 bp, Homo sapiens
gctgtcccttgcttgcctgcag

SEQ ID NO: 2986718 - DNA, 18 bp, Homo sapiens
gctgtcctcaggtggcca

SEQ ID NO: 2986719 - DNA, 12 bp, Homo sapiens
gctgtcctggtg

SEQ ID NO: 2986720 - DNA, 14 bp, Homo sapiens
gctgtcctttctag

SEQ ID NO: 2986721 - DNA, 16 bp, Homo sapiens
gctgtcgggggccact

SEQ ID NO: 2986722 - DNA, 21 bp, Homo sapiens
gctgtcgggggccactgtgtt

SEQ ID NO: 2986723 - DNA, 23 bp, Homo sapiens
gctgtcgggggccactgtgtttc

SEQ ID NO: 2986724 - DNA, 14 bp, Homo sapiens
gctgtctctctggg

SEQ ID NO: 2986725 - DNA, 12 bp, Homo sapiens
gctgtctgcagc

SEQ ID NO: 2986726 - DNA, 14 bp, Homo sapiens
gctgtctggatcct

SEQ ID NO: 2986727 - DNA, 17 bp, Homo sapiens
gctgtctggccaggcct

SEQ ID NO: 2986728 - DNA, 20 bp, Homo sapiens
gctgtcttggggtcccactg

SEQ ID NO: 2986729 - DNA, 17 bp, Homo sapiens
gctgtgaactgaaatta

SEQ ID NO: 2986730 - DNA, 18 bp, Homo sapiens
gctgtgaataaaaagaaa

SEQ ID NO: 2986731 - DNA, 18 bp, Homo sapiens
gctgtgaatgccaaagcc

SEQ ID NO: 2986732 - DNA, 20 bp, Homo sapiens
gctgtgaatgccaaagccat

SEQ ID NO: 2986733 - DNA, 17 bp, Homo sapiens
gctgtgactctgggcag

SEQ ID NO: 2986734 - DNA, 20 bp, Homo sapiens
gctgtgcaacgccgtgggct

SEQ ID NO: 2986735 - DNA, 19 bp, Homo sapiens
gctgtgcaacggtctcctg

SEQ ID NO: 2986736 - DNA, 23 bp, Homo sapiens
gctgtgcaattactgcctgcaga

SEQ ID NO: 2986737 - DNA, 18 bp, Homo sapiens
gctgtgcgtggaaaaaga

SEQ ID NO: 2986738 - DNA, 18 bp, Homo sapiens
gctgtgctacgtgtgaaa

SEQ ID NO: 2986739 - DNA, 20 bp, Homo sapiens
gctgtgctacgtgtgaaatc

SEQ ID NO: 2986740 - DNA, 14 bp, Homo sapiens
gctgtgctatgaat

SEQ ID NO: 2986741 - DNA, 16 bp, Homo sapiens
gctgtgctatgaattt

SEQ ID NO: 2986742 - DNA, 14 bp, Homo sapiens
gctgtgctcagaga

SEQ ID NO: 2986743 - DNA, 13 bp, Homo sapiens
gctgtgctgccct

SEQ ID NO: 2986744 - DNA, 16 bp, Homo sapiens
gctgtgctgccctgaa

SEQ ID NO: 2986745 - DNA, 17 bp, Homo sapiens
gctgtgctgccctgaag

SEQ ID NO: 2986746 - DNA, 14 bp, Homo sapiens
gctgtgctgtgttt

SEQ ID NO: 2986747 - DNA, 17 bp, Homo sapiens
gctgtgcttatggtacc

SEQ ID NO: 2986748 - DNA, 20 bp, Homo sapiens
gctgtgcttttgatctctgc

SEQ ID NO: 2986749 - DNA, 19 bp, Homo sapiens
gctgtggagacaatgtctg

SEQ ID NO: 2986750 - DNA, 20 bp, Homo sapiens
gctgtggagacaatgtctgc

SEQ ID NO: 2986751 - DNA, 21 bp, Homo sapiens
gctgtggagacaatgtctgca

SEQ ID NO: 2986752 - DNA, 21 bp, Homo sapiens
gctgtggccgcacgcctctcc

SEQ ID NO: 2986753 - DNA, 20 bp, Homo sapiens
gctgtggcctaacctgccga

SEQ ID NO: 2986754 - DNA, 12 bp, Homo sapiens
gctgtgggacca

SEQ ID NO: 2986755 - DNA, 14 bp, Homo sapiens
gctgtgggaccagg

SEQ ID NO: 2986756 - DNA, 18 bp, Homo sapiens
gctgtgggaccaggtctg

SEQ ID NO: 2986757 - DNA, 17 bp, Homo sapiens
gctgtggtcccacccag

SEQ ID NO: 2986758 - DNA, 15 bp, Homo sapiens
gctgtgtaaagttag

SEQ ID NO: 2986759 - DNA, 19 bp, Homo sapiens
gctgtgtcacactctgtgt

SEQ ID NO: 2986760 - DNA, 15 bp, Homo sapiens
gctgtgtctctgtat

SEQ ID NO: 2986761 - DNA, 15 bp, Homo sapiens
gctgtgtgagaccag

SEQ ID NO: 2986762 - DNA, 12 bp, Homo sapiens
gctgtgttactt

SEQ ID NO: 2986763 - DNA, 16 bp, Homo sapiens
gctgtgttacttgaag

SEQ ID NO: 2986764 - DNA, 14 bp, Homo sapiens
gctgttagagaaat

SEQ ID NO: 2986765 - DNA, 14 bp, Homo sapiens
gctgttcctgtgtt

SEQ ID NO: 2986766 - DNA, 19 bp, Homo sapiens
gctgttctcattcctgttc

SEQ ID NO: 2986767 - DNA, 14 bp, Homo sapiens
gctgttgaaagcaa

SEQ ID NO: 2986768 - DNA, 19 bp, Homo sapiens
gctgttgacatatttaatg

SEQ ID NO: 2986769 - DNA, 16 bp, Homo sapiens
gctgttgattgctaaa

SEQ ID NO: 2986770 - DNA, 22 bp, Homo sapiens
gctgttgccctgtttcctgctg

SEQ ID NO: 2986771 - DNA, 13 bp, Homo sapiens
gctgttgcctcat

SEQ ID NO: 2986772 - DNA, 17 bp, Homo sapiens
gctgttgggagaaagca

SEQ ID NO: 2986773 - DNA, 20 bp, Homo sapiens
gctgtttacagacaaggcag

SEQ ID NO: 2986774 - DNA, 20 bp, Homo sapiens
gctgtttgcttcaccgtgga

SEQ ID NO: 2986775 - DNA, 20 bp, Homo sapiens
gctgtttgtttgacaaagaa

SEQ ID NO: 2986776 - DNA, 18 bp, Homo sapiens
gctgttttagtgccaggc

SEQ ID NO: 2986777 - DNA, 20 bp, Homo sapiens
gctgttttcctcccttctgc

SEQ ID NO: 2986778 - DNA, 22 bp, Homo sapiens
gctgttttcctcccttctgcta

SEQ ID NO: 2986779 - DNA, 17 bp, Homo sapiens
gcttaaacttgacccag

SEQ ID NO: 2986780 - DNA, 20 bp, Homo sapiens
gcttaaacttgacccaggtg

SEQ ID NO: 2986781 - DNA, 16 bp, Homo sapiens
gcttaatcattttcat

SEQ ID NO: 2986782 - DNA, 21 bp, Homo sapiens
gcttaatcattttcattccta

SEQ ID NO: 2986783 - DNA, 14 bp, Homo sapiens
gcttaattcaaata

SEQ ID NO: 2986784 - DNA, 13 bp, Homo sapiens
gcttaattgtgaa

SEQ ID NO: 2986785 - DNA, 21 bp, Homo sapiens
gcttaattttaattggaggaa

SEQ ID NO: 2986786 - DNA, 13 bp, Homo sapiens
gcttacaagccag

SEQ ID NO: 2986787 - DNA, 12 bp, Homo sapiens
gcttacaatttt

SEQ ID NO: 2986788 - DNA, 21 bp, Homo sapiens
gcttacaatttttttaatttt

SEQ ID NO: 2986789 - DNA, 15 bp, Homo sapiens
gcttacattgaaaac

SEQ ID NO: 2986790 - DNA, 19 bp, Homo sapiens
gcttaccttgactgttgat

SEQ ID NO: 2986791 - DNA, 14 bp, Homo sapiens
gcttagctgccatc

SEQ ID NO: 2986792 - DNA, 22 bp, Homo sapiens
gcttaggagacagatcactcct

SEQ ID NO: 2986793 - DNA, 13 bp, Homo sapiens
gcttatcctgcta

SEQ ID NO: 2986794 - DNA, 21 bp, Homo sapiens
gcttatctcttttatatttgt

SEQ ID NO: 2986795 - DNA, 14 bp, Homo sapiens
gcttatctgaaact

SEQ ID NO: 2986796 - DNA, 22 bp, Homo sapiens
gcttatgatgggctccccagga

SEQ ID NO: 2986797 - DNA, 18 bp, Homo sapiens
gcttatgcttaaattcaa

SEQ ID NO: 2986798 - DNA, 20 bp, Homo sapiens
gcttatgtgttgcataaaca

SEQ ID NO: 2986799 - DNA, 15 bp, Homo sapiens
gcttatgtttcttat

SEQ ID NO: 2986800 - DNA, 22 bp, Homo sapiens
gcttatgtttcttattctctgt

SEQ ID NO: 2986801 - DNA, 16 bp, Homo sapiens
gcttatttagaaaaaa

SEQ ID NO: 2986802 - DNA, 20 bp, Homo sapiens
gcttatttagcacattttga

SEQ ID NO: 2986803 - DNA, 15 bp, Homo sapiens
gcttatttttctgtg

SEQ ID NO: 2986804 - DNA, 19 bp, Homo sapiens
gcttatttttctgtgaata

SEQ ID NO: 2986805 - DNA, 16 bp, Homo sapiens
gcttatttttttctac

SEQ ID NO: 2986806 - DNA, 13 bp, Homo sapiens
gcttcaaagccat

SEQ ID NO: 2986807 - DNA, 20 bp, Homo sapiens
gcttcaccccaatcccagct

SEQ ID NO: 2986808 - DNA, 22 bp, Homo sapiens
gcttcactctccctgacggctg

SEQ ID NO: 2986809 - DNA, 21 bp, Homo sapiens
gcttcagatgtggagccaggc

SEQ ID NO: 2986810 - DNA, 12 bp, Homo sapiens
gcttcagctcca

SEQ ID NO: 2986811 - DNA, 13 bp, Homo sapiens
gcttcagctccag

SEQ ID NO: 2986812 - DNA, 21 bp, Homo sapiens
gcttcaggtccaggctgtgtt

SEQ ID NO: 2986813 - DNA, 10 bp, Homo sapiens
gcttcataca

SEQ ID NO: 2986814 - DNA, 11 bp, Homo sapiens
gcttcatacac

SEQ ID NO: 2986815 - DNA, 19 bp, Homo sapiens
gcttcatcattccctctca

SEQ ID NO: 2986816 - DNA, 20 bp, Homo sapiens
gcttccagagctctgaccca

SEQ ID NO: 2986817 - DNA, 18 bp, Homo sapiens
gcttccatgattctattt

SEQ ID NO: 2986818 - DNA, 19 bp, Homo sapiens
gcttccatgattctattta

SEQ ID NO: 2986819 - DNA, 18 bp, Homo sapiens
gcttcccacacctgcctg

SEQ ID NO: 2986820 - DNA, 13 bp, Homo sapiens
ggaccggttccca

SEQ ID NO: 2986821 - DNA, 13 bp, Homo sapiens
ggacctcagcctg

SEQ ID NO: 2986822 - DNA, 16 bp, Homo sapiens
ggacctcagcctgcac

SEQ ID NO: 2986823 - DNA, 11 bp, Homo sapiens
ggacctcatcc

SEQ ID NO: 2986824 - DNA, 14 bp, Homo sapiens
ggacctctcccagg

SEQ ID NO: 2986825 - DNA, 14 bp, Homo sapiens
ggacctgcctgtag

SEQ ID NO: 2986826 - DNA, 14 bp, Homo sapiens
ggacctggctgcca

SEQ ID NO: 2986827 - DNA, 21 bp, Homo sapiens
ggaccttaggccttcctctct

SEQ ID NO: 2986828 - DNA, 17 bp, Homo sapiens
ggaccttcgggctgtgc

SEQ ID NO: 2986829 - DNA, 18 bp, Homo sapiens
ggaccttcgggctgtgcc

SEQ ID NO: 2986830 - DNA, 19 bp, Homo sapiens
ggaccttcgggctgtgccc

SEQ ID NO: 2986831 - DNA, 16 bp, Homo sapiens
ggaccttttgttttct

SEQ ID NO: 2986832 - DNA, 20 bp, Homo sapiens
ggacgcaggccctgtccagc

SEQ ID NO: 2986833 - DNA, 19 bp, Homo sapiens
ggacgcctgggggtgccag

SEQ ID NO: 2986834 - DNA, 20 bp, Homo sapiens
ggacgcctgggggtgccagg

SEQ ID NO: 2986835 - DNA, 17 bp, Homo sapiens
ggacggccaagaatgta

SEQ ID NO: 2986836 - DNA, 14 bp, Homo sapiens
ggacggctgtggga

SEQ ID NO: 2986837 - DNA, 18 bp, Homo sapiens
ggacgtggctcagccagc

SEQ ID NO: 2986838 - DNA, 21 bp, Homo sapiens
ggacgtgggccctgcaggctg

SEQ ID NO: 2986839 - DNA, 21 bp, Homo sapiens
ggacgtgttacccactgccat

SEQ ID NO: 2986840 - DNA, 12 bp, Homo sapiens
ggacgttggcct

SEQ ID NO: 2986841 - DNA, 19 bp, Homo sapiens
ggacgttggcctcagggcc

SEQ ID NO: 2986842 - DNA, 21 bp, Homo sapiens
ggactagagggacctctccca

SEQ ID NO: 2986843 - DNA, 20 bp, Homo sapiens
ggactagtgagtcagcacct

SEQ ID NO: 2986844 - DNA, 19 bp, Homo sapiens
ggactcactggcagcccca

SEQ ID NO: 2986845 - DNA, 18 bp, Homo sapiens
ggactccagaatctaaag

SEQ ID NO: 2986846 - DNA, 14 bp, Homo sapiens
ggactccaggccca

SEQ ID NO: 2986847 - DNA, 21 bp, Homo sapiens
ggactcctccccaccctcctg

SEQ ID NO: 2986848 - DNA, 22 bp, Homo sapiens
ggactcctccccaccctcctgg

SEQ ID NO: 2986849 - DNA, 20 bp, Homo sapiens
ggactctcagtctctgagca

SEQ ID NO: 2986850 - DNA, 22 bp, Homo sapiens
ggactctctgcttggattcact

SEQ ID NO: 2986851 - DNA, 18 bp, Homo sapiens
ggactgagcgaggaaaaa

SEQ ID NO: 2986852 - DNA, 21 bp, Homo sapiens
ggactgcagtcggcatgccag

SEQ ID NO: 2986853 - DNA, 19 bp, Homo sapiens
ggactgctaaataaaattt

SEQ ID NO: 2986854 - DNA, 23 bp, Homo sapiens
ggactgctacctttcaaagcttg

SEQ ID NO: 2986855 - DNA, 13 bp, Homo sapiens
ggactggaaaaat

SEQ ID NO: 2986856 - DNA, 15 bp, Homo sapiens
ggactggaaaaatga

SEQ ID NO: 2986857 - DNA, 19 bp, Homo sapiens
ggactgggccatgggtcct

SEQ ID NO: 2986858 - DNA, 22 bp, Homo sapiens
ggactgggtctgacctggtggg

SEQ ID NO: 2986859 - DNA, 14 bp, Homo sapiens
ggactggttatctt

SEQ ID NO: 2986860 - DNA, 18 bp, Homo sapiens
ggactggttatcttgtta

SEQ ID NO: 2986861 - DNA, 19 bp, Homo sapiens
ggactgtggcacttgcctg

SEQ ID NO: 2986862 - DNA, 16 bp, Homo sapiens
ggacttagccgactgc

SEQ ID NO: 2986863 - DNA, 13 bp, Homo sapiens
ggacttatttaaa

SEQ ID NO: 2986864 - DNA, 23 bp, Homo sapiens
ggacttcctgtccagctccaacc

SEQ ID NO: 2986865 - DNA, 18 bp, Homo sapiens
ggacttctgaagagacca

SEQ ID NO: 2986866 - DNA, 17 bp, Homo sapiens
ggacttcttttcacatt

SEQ ID NO: 2986867 - DNA, 16 bp, Homo sapiens
ggacttggaggtagct

SEQ ID NO: 2986868 - DNA, 15 bp, Homo sapiens
ggacttgtaggaatc

SEQ ID NO: 2986869 - DNA, 12 bp, Homo sapiens
ggacttgtttta

SEQ ID NO: 2986870 - DNA, 20 bp, Homo sapiens
ggactttcctaaatgtttaa

SEQ ID NO: 2986871 - DNA, 15 bp, Homo sapiens
ggagaaaaaatcact

SEQ ID NO: 2986872 - DNA, 12 bp, Homo sapiens
ggagaaaggaga

SEQ ID NO: 2986873 - DNA, 17 bp, Homo sapiens
ggagaaatgaaaagtaa

SEQ ID NO: 2986874 - DNA, 13 bp, Homo sapiens
ggagaagactgtg

SEQ ID NO: 2986875 - DNA, 18 bp, Homo sapiens
ggagaagatcgcatggca

SEQ ID NO: 2986876 - DNA, 16 bp, Homo sapiens
ggagaagcagtgagcc

SEQ ID NO: 2986877 - DNA, 12 bp, Homo sapiens
ggagaagccagg

SEQ ID NO: 2986878 - DNA, 15 bp, Homo sapiens
ggagaagccaggaat

SEQ ID NO: 2986879 - DNA, 12 bp, Homo sapiens
ggagaagccatt

SEQ ID NO: 2986880 - DNA, 12 bp, Homo sapiens
ggagaaggaaaa

SEQ ID NO: 2986881 - DNA, 20 bp, Homo sapiens
ggagaaggaaaaagaaagta

SEQ ID NO: 2986882 - DNA, 22 bp, Homo sapiens
ggagaaggaaggagactcacct

SEQ ID NO: 2986883 - DNA, 16 bp, Homo sapiens
ggagaaggcctcccct

SEQ ID NO: 2986884 - DNA, 13 bp, Homo sapiens
ggagaagggctgg

SEQ ID NO: 2986885 - DNA, 15 bp, Homo sapiens
ggagaaggtcagcga

SEQ ID NO: 2986886 - DNA, 21 bp, Homo sapiens
ggagaagtctttcaagaatga

SEQ ID NO: 2986887 - DNA, 21 bp, Homo sapiens
ggagaagtggggaccccaccc

SEQ ID NO: 2986888 - DNA, 12 bp, Homo sapiens
ggagaatactgc

SEQ ID NO: 2986889 - DNA, 19 bp, Homo sapiens
ggagaatcagcagaacctg

SEQ ID NO: 2986890 - DNA, 22 bp, Homo sapiens
ggagaattgaattctggaaact

SEQ ID NO: 2986891 - DNA, 18 bp, Homo sapiens
ggagacagcctgtctctc

SEQ ID NO: 2986892 - DNA, 21 bp, Homo sapiens
ggagacctggacacaggcctg

SEQ ID NO: 2986893 - DNA, 21 bp, Homo sapiens
ggagacggtttccagggaggg

SEQ ID NO: 2986894 - DNA, 9 bp, Homo sapiens
ggagactca

SEQ ID NO: 2986895 - DNA, 12 bp, Homo sapiens
ggagactggcag

SEQ ID NO: 2986896 - DNA, 16 bp, Homo sapiens
ggagactggcaggcgg

SEQ ID NO: 2986897 - DNA, 13 bp, Homo sapiens
ggagactgggctg

SEQ ID NO: 2986898 - DNA, 20 bp, Homo sapiens
ggagactgggctgagggagc

SEQ ID NO: 2986899 - DNA, 23 bp, Homo sapiens
ggagactgggctgagggagcctg

SEQ ID NO: 2986900 - DNA, 13 bp, Homo sapiens
ggagactggtagg

SEQ ID NO: 2986901 - DNA, 22 bp, Homo sapiens
ggagacttgccagagccgggca

SEQ ID NO: 2986902 - DNA, 16 bp, Homo sapiens
ggagagaaaatatatg

SEQ ID NO: 2986903 - DNA, 12 bp, Homo sapiens
ggagagacagct

SEQ ID NO: 2986904 - DNA, 17 bp, Homo sapiens
ggagagaccagcctttc

SEQ ID NO: 2986905 - DNA, 15 bp, Homo sapiens
ggagagacgggccct

SEQ ID NO: 2986906 - DNA, 17 bp, Homo sapiens
ggagagacgggccctgg

SEQ ID NO: 2986907 - DNA, 19 bp, Homo sapiens
ggagagacttggatgagga

SEQ ID NO: 2986908 - DNA, 19 bp, Homo sapiens
ggagagatagcctgtggcc

SEQ ID NO: 2986909 - DNA, 22 bp, Homo sapiens
ggagagatgacccctaccccct

SEQ ID NO: 2986910 - DNA, 22 bp, Homo sapiens
ggagagccaccaagagggacgc

SEQ ID NO: 2986911 - DNA, 16 bp, Homo sapiens
ggagagccagagaagt

SEQ ID NO: 2986912 - DNA, 21 bp, Homo sapiens
ggagagccagagaagtgacag

SEQ ID NO: 2986913 - DNA, 15 bp, Homo sapiens
ggagagccagccctc

SEQ ID NO: 2986914 - DNA, 23 bp, Homo sapiens
ggagagccagccctccctgtcct

SEQ ID NO: 2986915 - DNA, 16 bp, Homo sapiens
ggagagcgcctgcccc

SEQ ID NO: 2986916 - DNA, 20 bp, Homo sapiens
ggagagcgcctgcccctccc

SEQ ID NO: 2986917 - DNA, 13 bp, Homo sapiens
ggagaggaagaga

SEQ ID NO: 2986918 - DNA, 13 bp, Homo sapiens
ggagaggagagcc

SEQ ID NO: 2986919 - DNA, 14 bp, Homo sapiens
ggagagggtctgga

SEQ ID NO: 2986920 - DNA, 18 bp, Homo sapiens
ggagagggtctggagaag

SEQ ID NO: 2986921 - DNA, 21 bp, Homo sapiens
ggagagggtctggagaagcag

SEQ ID NO: 2986922 - DNA, 23 bp, Homo sapiens
ggagagggtctggagaagcagtg

SEQ ID NO: 2986923 - DNA, 15 bp, Homo sapiens
ggagaggttaaagca

SEQ ID NO: 2986924 - DNA, 21 bp, Homo sapiens
ggagaggttaaagcaaaccag

SEQ ID NO: 2986925 - DNA, 22 bp, Homo sapiens
ggagaggttaaagcaaaccagc

SEQ ID NO: 2986926 - DNA, 22 bp, Homo sapiens
ggagagtacattgaaggcctgg

SEQ ID NO: 2986927 - DNA, 13 bp, Homo sapiens
ggagagtgagagc

SEQ ID NO: 2986928 - DNA, 18 bp, Homo sapiens
ggagagtggccattcttt

SEQ ID NO: 2986929 - DNA, 12 bp, Homo sapiens
ggagagtgtcaa

SEQ ID NO: 2986930 - DNA, 19 bp, Homo sapiens
ggagagtgtcaaccagaca

SEQ ID NO: 2986931 - DNA, 21 bp, Homo sapiens
ggagagttggggaaggcaaga

SEQ ID NO: 2986932 - DNA, 19 bp, Homo sapiens
ggagatagatgactttgca

SEQ ID NO: 2986933 - DNA, 20 bp, Homo sapiens
ggagatagccccacaggagg

SEQ ID NO: 2986934 - DNA, 21 bp, Homo sapiens
ggagatcagaaaaatggagca

SEQ ID NO: 2986935 - DNA, 17 bp, Homo sapiens
ggagatctttgcttcct

SEQ ID NO: 2986936 - DNA, 15 bp, Homo sapiens
ggagatgcagccttc

SEQ ID NO: 2986937 - DNA, 14 bp, Homo sapiens
ggagcaagttgcag

SEQ ID NO: 2986938 - DNA, 14 bp, Homo sapiens
ggagcacacccagc

SEQ ID NO: 2986939 - DNA, 15 bp, Homo sapiens
ggagcacacccagcc

SEQ ID NO: 2986940 - DNA, 21 bp, Homo sapiens
ggagcacctggaccccctgcc

SEQ ID NO: 2986941 - DNA, 23 bp, Homo sapiens
ggagcacctggaccccctgcccg

SEQ ID NO: 2986942 - DNA, 12 bp, Homo sapiens
ggagcagagagg

SEQ ID NO: 2986943 - DNA, 12 bp, Homo sapiens
ggagcagccttt

SEQ ID NO: 2986944 - DNA, 22 bp, Homo sapiens
ggagcagggcggctgccgactc

SEQ ID NO: 2986945 - DNA, 21 bp, Homo sapiens
ggagcatttatgtagacattg

SEQ ID NO: 2986946 - DNA, 23 bp, Homo sapiens
ggagcatttatgtagacattgta

SEQ ID NO: 2986947 - DNA, 22 bp, Homo sapiens
ggagccaaaggcatccaggcca

SEQ ID NO: 2986948 - DNA, 16 bp, Homo sapiens
ggagccacaggcaggg

SEQ ID NO: 2986949 - DNA, 16 bp, Homo sapiens
ggagcccagcggccca

SEQ ID NO: 2986950 - DNA, 17 bp, Homo sapiens
ggagcccagtgggctgc

SEQ ID NO: 2986951 - DNA, 10 bp, Homo sapiens
ggagcccctg

SEQ ID NO: 2986952 - DNA, 17 bp, Homo sapiens
ggcccctttgggccctg

SEQ ID NO: 2986953 - DNA, 18 bp, Homo sapiens
ggcccctttgggccctgc

SEQ ID NO: 2986954 - DNA, 16 bp, Homo sapiens
ggcccgcggcctgcac

SEQ ID NO: 2986955 - DNA, 13 bp, Homo sapiens
ggcccgcgggcac

SEQ ID NO: 2986956 - DNA, 15 bp, Homo sapiens
ggcccgcgggcacag

SEQ ID NO: 2986957 - DNA, 16 bp, Homo sapiens
ggcccgcgggcacagc

SEQ ID NO: 2986958 - DNA, 19 bp, Homo sapiens
ggcccgcgggcacagccag

SEQ ID NO: 2986959 - DNA, 20 bp, Homo sapiens
ggcccgcgggcacagccagc

SEQ ID NO: 2986960 - DNA, 17 bp, Homo sapiens
ggcccggcccctcaccc

SEQ ID NO: 2986961 - DNA, 23 bp, Homo sapiens
ggcccggcgcggtggctcacgcc

SEQ ID NO: 2986962 - DNA, 17 bp, Homo sapiens
ggcccgggccgaccctg

SEQ ID NO: 2986963 - DNA, 20 bp, Homo sapiens
ggcccggtggcggcagggcc

SEQ ID NO: 2986964 - DNA, 15 bp, Homo sapiens
ggcccgtcggagctg

SEQ ID NO: 2986965 - DNA, 18 bp, Homo sapiens
ggcccgtcggagctgcct

SEQ ID NO: 2986966 - DNA, 23 bp, Homo sapiens
ggcccgtcggagctgcctgcagc

SEQ ID NO: 2986967 - DNA, 14 bp, Homo sapiens
ggcccgtctgtcca

SEQ ID NO: 2986968 - DNA, 15 bp, Homo sapiens
ggccctagctttacg

SEQ ID NO: 2986969 - DNA, 18 bp, Homo sapiens
ggccctatgtctcaggag

SEQ ID NO: 2986970 - DNA, 16 bp, Homo sapiens
ggccctcccaccaccc

SEQ ID NO: 2986971 - DNA, 11 bp, Homo sapiens
ggccctccctg

SEQ ID NO: 2986972 - DNA, 15 bp, Homo sapiens
ggccctccctgcgct

SEQ ID NO: 2986973 - DNA, 20 bp, Homo sapiens
ggccctccctgttccccaga

SEQ ID NO: 2986974 - DNA, 19 bp, Homo sapiens
ggccctcctaccctgcgcc

SEQ ID NO: 2986975 - DNA, 20 bp, Homo sapiens
ggccctcctaccctgcgccc

SEQ ID NO: 2986976 - DNA, 23 bp, Homo sapiens
ggccctcgctgccagctctgtat

SEQ ID NO: 2986977 - DNA, 11 bp, Homo sapiens
ggccctctgcc

SEQ ID NO: 2986978 - DNA, 14 bp, Homo sapiens
ggccctctgcctgc

SEQ ID NO: 2986979 - DNA, 20 bp, Homo sapiens
ggccctctgcctgcactccc

SEQ ID NO: 2986980 - DNA, 14 bp, Homo sapiens
ggccctctggagtg

SEQ ID NO: 2986981 - DNA, 18 bp, Homo sapiens
ggccctgagtctgggcag

SEQ ID NO: 2986982 - DNA, 19 bp, Homo sapiens
ggccctgagtctgggcagc

SEQ ID NO: 2986983 - DNA, 17 bp, Homo sapiens
ggccctgcaggagcagg

SEQ ID NO: 2986984 - DNA, 14 bp, Homo sapiens
ggccctgcaggctg

SEQ ID NO: 2986985 - DNA, 17 bp, Homo sapiens
ggccctgcaggctgcag

SEQ ID NO: 2986986 - DNA, 12 bp, Homo sapiens
ggccctgcccct

SEQ ID NO: 2986987 - DNA, 11 bp, Homo sapiens
ggccctgctgc

SEQ ID NO: 2986988 - DNA, 18 bp, Homo sapiens
ggccctgctgcccctccc

SEQ ID NO: 2986989 - DNA, 14 bp, Homo sapiens
ggccctggcctgct

SEQ ID NO: 2986990 - DNA, 14 bp, Homo sapiens
ggccctggcgggtg

SEQ ID NO: 2986991 - DNA, 19 bp, Homo sapiens
ggccctggcgggtggctgc

SEQ ID NO: 2986992 - DNA, 20 bp, Homo sapiens
ggccctggcgggtggctgca

SEQ ID NO: 2986993 - DNA, 22 bp, Homo sapiens
ggccctggggcgggcagccagg

SEQ ID NO: 2986994 - DNA, 18 bp, Homo sapiens
ggccctggggtgtgtctc

SEQ ID NO: 2986995 - DNA, 15 bp, Homo sapiens
ggccctggtaaaata

SEQ ID NO: 2986996 - DNA, 15 bp, Homo sapiens
ggccctggtcctggc

SEQ ID NO: 2986997 - DNA, 18 bp, Homo sapiens
ggccctggtcctggcctc

SEQ ID NO: 2986998 - DNA, 14 bp, Homo sapiens
ggccctgtcccctg

SEQ ID NO: 2986999 - DNA, 19 bp, Homo sapiens
ggccctgtgcagaccttac

SEQ ID NO: 2987000 - DNA, 20 bp, Homo sapiens
ggccctgtggagtccagctc

SEQ ID NO: 2987001 - DNA, 14 bp, Homo sapiens
ggccctgtgtgcag

SEQ ID NO: 2987002 - DNA, 14 bp, Homo sapiens
ggccctgttctcct

SEQ ID NO: 2987003 - DNA, 18 bp, Homo sapiens
ggcccttcagtccctgag

SEQ ID NO: 2987004 - DNA, 19 bp, Homo sapiens
ggcccttcccacaggacat

SEQ ID NO: 2987005 - DNA, 11 bp, Homo sapiens
ggccctttcct

SEQ ID NO: 2987006 - DNA, 17 bp, Homo sapiens
ggccgaccctgcggcct

SEQ ID NO: 2987007 - DNA, 16 bp, Homo sapiens
ggccgacggagccggg

SEQ ID NO: 2987008 - DNA, 15 bp, Homo sapiens
ggccgagaagcaaga

SEQ ID NO: 2987009 - DNA, 16 bp, Homo sapiens
ggccgagtccaagctg

SEQ ID NO: 2987010 - DNA, 20 bp, Homo sapiens
ggccgatgggagtctccctc

SEQ ID NO: 2987011 - DNA, 17 bp, Homo sapiens
ggccgcaagggcctgga

SEQ ID NO: 2987012 - DNA, 18 bp, Homo sapiens
ggccgcaagggcctggac

SEQ ID NO: 2987013 - DNA, 16 bp, Homo sapiens
ggccgcacgcctctcc

SEQ ID NO: 2987014 - DNA, 13 bp, Homo sapiens
ggccgcagagact

SEQ ID NO: 2987015 - DNA, 14 bp, Homo sapiens
ggccgcagagactg

SEQ ID NO: 2987016 - DNA, 13 bp, Homo sapiens
ggccgcggcccag

SEQ ID NO: 2987017 - DNA, 15 bp, Homo sapiens
ggccgcggcccagac

SEQ ID NO: 2987018 - DNA, 18 bp, Homo sapiens
ggccgcggcccagaccca

SEQ ID NO: 2987019 - DNA, 21 bp, Homo sapiens
ggccgcgtgccgggcccccac

SEQ ID NO: 2987020 - DNA, 20 bp, Homo sapiens
ggccggacgcaggtgctgcg

SEQ ID NO: 2987021 - DNA, 14 bp, Homo sapiens
ggccggccagccag

SEQ ID NO: 2987022 - DNA, 15 bp, Homo sapiens
ggccggccagcccct

SEQ ID NO: 2987023 - DNA, 17 bp, Homo sapiens
ggccggcgagccctgtg

SEQ ID NO: 2987024 - DNA, 19 bp, Homo sapiens
ggccggctgtgctcagaga

SEQ ID NO: 2987025 - DNA, 23 bp, Homo sapiens
ggccgggcctgtacagtctgtct

SEQ ID NO: 2987026 - DNA, 13 bp, Homo sapiens
ggccggggagggg

SEQ ID NO: 2987027 - DNA, 21 bp, Homo sapiens
ggccggggagggggcacggca

SEQ ID NO: 2987028 - DNA, 22 bp, Homo sapiens
ggccgtctcccttggcccagag

SEQ ID NO: 2987029 - DNA, 14 bp, Homo sapiens
ggccgtggctccag

SEQ ID NO: 2987030 - DNA, 14 bp, Homo sapiens
ggccgttcagcctg

SEQ ID NO: 2987031 - DNA, 15 bp, Homo sapiens
ggcctaacctgccga

SEQ ID NO: 2987032 - DNA, 22 bp, Homo sapiens
ggcctaacctgccgagagtcca

SEQ ID NO: 2987033 - DNA, 15 bp, Homo sapiens
ggcctaccttgtgag

SEQ ID NO: 2987034 - DNA, 19 bp, Homo sapiens
ggcctagctgctacaaaga

SEQ ID NO: 2987035 - DNA, 13 bp, Homo sapiens
ggcctaggattct

SEQ ID NO: 2987036 - DNA, 15 bp, Homo sapiens
ggcctaggattctaa

SEQ ID NO: 2987037 - DNA, 16 bp, Homo sapiens
ggcctaggtgcagctc

SEQ ID NO: 2987038 - DNA, 18 bp, Homo sapiens
ggcctaggtgcagctcct

SEQ ID NO: 2987039 - DNA, 13 bp, Homo sapiens
ggcctatctccta

SEQ ID NO: 2987040 - DNA, 12 bp, Homo sapiens
ggcctcaagatc

SEQ ID NO: 2987041 - DNA, 13 bp, Homo sapiens
ggcctcacccacc

SEQ ID NO: 2987042 - DNA, 18 bp, Homo sapiens
ggcctcacccacccctgc

SEQ ID NO: 2987043 - DNA, 19 bp, Homo sapiens
ggcctcactggctcatgcc

SEQ ID NO: 2987044 - DNA, 22 bp, Homo sapiens
ggcctcactggctcatgcccct

SEQ ID NO: 2987045 - DNA, 20 bp, Homo sapiens
ggcctcagactgcacccagg

SEQ ID NO: 2987046 - DNA, 22 bp, Homo sapiens
ggcctcagactgcacccaggag

SEQ ID NO: 2987047 - DNA, 13 bp, Homo sapiens
ggcctcagggaga

SEQ ID NO: 2987048 - DNA, 18 bp, Homo sapiens
ggcctcagggccaggaag

SEQ ID NO: 2987049 - DNA, 20 bp, Homo sapiens
ggcctcagggccaggaagga

SEQ ID NO: 2987050 - DNA, 12 bp, Homo sapiens
ggcctcagggtc

SEQ ID NO: 2987051 - DNA, 12 bp, Homo sapiens
ggcctccagctc

SEQ ID NO: 2987052 - DNA, 17 bp, Homo sapiens
ggcctcccacagactca

SEQ ID NO: 2987053 - DNA, 23 bp, Homo sapiens
ggcctccccgaggttgtggggag

SEQ ID NO: 2987054 - DNA, 11 bp, Homo sapiens
ggcctcccctg

SEQ ID NO: 2987055 - DNA, 13 bp, Homo sapiens
ggcctcccctgag

SEQ ID NO: 2987056 - DNA, 14 bp, Homo sapiens
ggcctcccgaggag

SEQ ID NO: 2987057 - DNA, 12 bp, Homo sapiens
ggcctccctccg

SEQ ID NO: 2987058 - DNA, 16 bp, Homo sapiens
ggcctccctccgtccc

SEQ ID NO: 2987059 - DNA, 19 bp, Homo sapiens
ggcctccctccgtccctct

SEQ ID NO: 2987060 - DNA, 15 bp, Homo sapiens
ggcctccctgcctca

SEQ ID NO: 2987061 - DNA, 22 bp, Homo sapiens
ggcctcccttgagtaggccctg

SEQ ID NO: 2987062 - DNA, 21 bp, Homo sapiens
ggcctccgcttatcctgctag

SEQ ID NO: 2987063 - DNA, 17 bp, Homo sapiens
ggcctccttcttccact

SEQ ID NO: 2987064 - DNA, 21 bp, Homo sapiens
ggcctccttcttccacttctc

SEQ ID NO: 2987065 - DNA, 23 bp, Homo sapiens
ggcctccttcttccacttctcca

SEQ ID NO: 2987066 - DNA, 14 bp, Homo sapiens
ggcctcgcctgccc

SEQ ID NO: 2987067 - DNA, 16 bp, Homo sapiens
ggcctcgcctgccctc

SEQ ID NO: 2987068 - DNA, 18 bp, Homo sapiens
ggcctcgcctgccctcct

SEQ ID NO: 2987069 - DNA, 22 bp, Homo sapiens
ggcctcgcctgccctcctctcc

SEQ ID NO: 2987070 - DNA, 23 bp, Homo sapiens
ggcctcgcctgccctcctctccc

SEQ ID NO: 2987071 - DNA, 22 bp, Homo sapiens
ggcctcggcagaactctctgtc

SEQ ID NO: 2987072 - DNA, 23 bp, Homo sapiens
ggcctctgcaactgctcagctct

SEQ ID NO: 2987073 - DNA, 15 bp, Homo sapiens
ggcctctgcctggga

SEQ ID NO: 2987074 - DNA, 13 bp, Homo sapiens
ggcctcttggcac

SEQ ID NO: 2987075 - DNA, 15 bp, Homo sapiens
ggcctcttggcacct

SEQ ID NO: 2987076 - DNA, 16 bp, Homo sapiens
ggcctgaaaggagccc

SEQ ID NO: 2987077 - DNA, 15 bp, Homo sapiens
ggcctgaacagatgt

SEQ ID NO: 2987078 - DNA, 13 bp, Homo sapiens
ggcctgaagagtc

SEQ ID NO: 2987079 - DNA, 15 bp, Homo sapiens
ggcctgacctccagt

SEQ ID NO: 2987080 - DNA, 19 bp, Homo sapiens
ggcctgacctccagtcctg

SEQ ID NO: 2987081 - DNA, 15 bp, Homo sapiens
ggcctgagcctcccg

SEQ ID NO: 2987082 - DNA, 20 bp, Homo sapiens
ggcctgatcagaccacggct

SEQ ID NO: 2987083 - DNA, 20 bp, Homo sapiens
ggcctgatgagactccactc

SEQ ID NO: 2987084 - DNA, 14 bp, Homo sapiens
ggcctgcacagtga

SEQ ID NO: 2987085 - DNA, 15 bp, Homo sapiens
gggaggctgcagcca

SEQ ID NO: 2987086 - DNA, 21 bp, Homo sapiens
gggaggctgcagccaggcctc

SEQ ID NO: 2987087 - DNA, 12 bp, Homo sapiens
gggagggagctg

SEQ ID NO: 2987088 - DNA, 17 bp, Homo sapiens
gggagggagctgaggcc

SEQ ID NO: 2987089 - DNA, 20 bp, Homo sapiens
gggagggggtacctcatgag

SEQ ID NO: 2987090 - DNA, 16 bp, Homo sapiens
gggaggtcgaggtagg

SEQ ID NO: 2987091 - DNA, 21 bp, Homo sapiens
gggagtcatctcaaccatccc

SEQ ID NO: 2987092 - DNA, 15 bp, Homo sapiens
gggagtctcaggagg

SEQ ID NO: 2987093 - DNA, 14 bp, Homo sapiens
gggagtctccctcc

SEQ ID NO: 2987094 - DNA, 14 bp, Homo sapiens
gggagtggggtaga

SEQ ID NO: 2987095 - DNA, 15 bp, Homo sapiens
gggagttaagacctg

SEQ ID NO: 2987096 - DNA, 20 bp, Homo sapiens
gggagttcgagaccaacctg

SEQ ID NO: 2987097 - DNA, 20 bp, Homo sapiens
gggatacaggcccctgggtt

SEQ ID NO: 2987098 - DNA, 22 bp, Homo sapiens
gggatagtctgggtcagaccca

SEQ ID NO: 2987099 - DNA, 12 bp, Homo sapiens
gggatatgctta

SEQ ID NO: 2987100 - DNA, 14 bp, Homo sapiens
gggatattttgaaa

SEQ ID NO: 2987101 - DNA, 16 bp, Homo sapiens
gggatattttgaaatg

SEQ ID NO: 2987102 - DNA, 17 bp, Homo sapiens
gggatcccacagcccta

SEQ ID NO: 2987103 - DNA, 20 bp, Homo sapiens
gggatccctcccccccatgc

SEQ ID NO: 2987104 - DNA, 16 bp, Homo sapiens
gggatgattgcttgag

SEQ ID NO: 2987105 - DNA, 16 bp, Homo sapiens
gggatgccctggaggt

SEQ ID NO: 2987106 - DNA, 22 bp, Homo sapiens
gggatggagaaagggcagagga

SEQ ID NO: 2987107 - DNA, 14 bp, Homo sapiens
gggatggaggagaa

SEQ ID NO: 2987108 - DNA, 18 bp, Homo sapiens
gggatggaggagaagaat

SEQ ID NO: 2987109 - DNA, 12 bp, Homo sapiens
gggatggggagg

SEQ ID NO: 2987110 - DNA, 18 bp, Homo sapiens
gggatggtggagggccac

SEQ ID NO: 2987111 - DNA, 19 bp, Homo sapiens
gggatggtgggcttcaggg

SEQ ID NO: 2987112 - DNA, 14 bp, Homo sapiens
gggatgtgacatgc

SEQ ID NO: 2987113 - DNA, 19 bp, Homo sapiens
gggatgtttacctggtgct

SEQ ID NO: 2987114 - DNA, 17 bp, Homo sapiens
gggattgctgccacttt

SEQ ID NO: 2987115 - DNA, 15 bp, Homo sapiens
gggattgggcccctg

SEQ ID NO: 2987116 - DNA, 13 bp, Homo sapiens
gggatttcttagg

SEQ ID NO: 2987117 - DNA, 22 bp, Homo sapiens
gggatttttttgttcttgttgt

SEQ ID NO: 2987118 - DNA, 21 bp, Homo sapiens
gggcaaaaaactcgaggactg

SEQ ID NO: 2987119 - DNA, 16 bp, Homo sapiens
gggcaagtgagagggg

SEQ ID NO: 2987120 - DNA, 17 bp, Homo sapiens
gggcaagtgagagggga

SEQ ID NO: 2987121 - DNA, 19 bp, Homo sapiens
gggcaagtgagaggggagg

SEQ ID NO: 2987122 - DNA, 22 bp, Homo sapiens
gggcaagtgagaggggagggag

SEQ ID NO: 2987123 - DNA, 17 bp, Homo sapiens
gggcaagtggatgggaa

SEQ ID NO: 2987124 - DNA, 19 bp, Homo sapiens
gggcacacgcctcccactg

SEQ ID NO: 2987125 - DNA, 15 bp, Homo sapiens
gggcacagcatctgt

SEQ ID NO: 2987126 - DNA, 13 bp, Homo sapiens
gggcacagccagc

SEQ ID NO: 2987127 - DNA, 13 bp, Homo sapiens
gggcacaggaggc

SEQ ID NO: 2987128 - DNA, 14 bp, Homo sapiens
gggcactcccccag

SEQ ID NO: 2987129 - DNA, 20 bp, Homo sapiens
gggcactggagctgggaggt

SEQ ID NO: 2987130 - DNA, 14 bp, Homo sapiens
gggcacttccctgc

SEQ ID NO: 2987131 - DNA, 18 bp, Homo sapiens
gggcacttccctgctgcc

SEQ ID NO: 2987132 - DNA, 15 bp, Homo sapiens
gggcagaatcctggg

SEQ ID NO: 2987133 - DNA, 20 bp, Homo sapiens
gggcagaatcctgggccccc

SEQ ID NO: 2987134 - DNA, 20 bp, Homo sapiens
gggcagaatgaattcgatgc

SEQ ID NO: 2987135 - DNA, 15 bp, Homo sapiens
gggcagaggaagaga

SEQ ID NO: 2987136 - DNA, 15 bp, Homo sapiens
gggcagaggctggag

SEQ ID NO: 2987137 - DNA, 15 bp, Homo sapiens
gggcagagggcagag

SEQ ID NO: 2987138 - DNA, 15 bp, Homo sapiens
gggcagagggctgga

SEQ ID NO: 2987139 - DNA, 22 bp, Homo sapiens
gggcagagggctggaggcccag

SEQ ID NO: 2987140 - DNA, 18 bp, Homo sapiens
gggcagatcttggactca

SEQ ID NO: 2987141 - DNA, 16 bp, Homo sapiens
gggcagcagcatccca

SEQ ID NO: 2987142 - DNA, 14 bp, Homo sapiens
gggcagcagggcta

SEQ ID NO: 2987143 - DNA, 12 bp, Homo sapiens
gggcagccacac

SEQ ID NO: 2987144 - DNA, 12 bp, Homo sapiens
gggcagccctcc

SEQ ID NO: 2987145 - DNA, 14 bp, Homo sapiens
gggcagccctcctt

SEQ ID NO: 2987146 - DNA, 15 bp, Homo sapiens
gggcagcctcccccg

SEQ ID NO: 2987147 - DNA, 13 bp, Homo sapiens
gggcagcgccagg

SEQ ID NO: 2987148 - DNA, 15 bp, Homo sapiens
gggcagctgtccctt

SEQ ID NO: 2987149 - DNA, 11 bp, Homo sapiens
gggcaggcagt

SEQ ID NO: 2987150 - DNA, 17 bp, Homo sapiens
gggcaggcgtgactcag

SEQ ID NO: 2987151 - DNA, 21 bp, Homo sapiens
gggcaggcgtgactcagcagc

SEQ ID NO: 2987152 - DNA, 15 bp, Homo sapiens
gggcagggagctggg

SEQ ID NO: 2987153 - DNA, 18 bp, Homo sapiens
gggcagggagctgggccc

SEQ ID NO: 2987154 - DNA, 20 bp, Homo sapiens
gggcagggagctgggcccga

SEQ ID NO: 2987155 - DNA, 13 bp, Homo sapiens
gggcagggcccct

SEQ ID NO: 2987156 - DNA, 16 bp, Homo sapiens
gggcaggggagccagg

SEQ ID NO: 2987157 - DNA, 12 bp, Homo sapiens
gggcaggtggcc

SEQ ID NO: 2987158 - DNA, 19 bp, Homo sapiens
gggcaggtggccgcccctg

SEQ ID NO: 2987159 - DNA, 17 bp, Homo sapiens
gggcaggtggcctctgc

SEQ ID NO: 2987160 - DNA, 13 bp, Homo sapiens
gggcagtcgctgc

SEQ ID NO: 2987161 - DNA, 21 bp, Homo sapiens
gggcagtcgctgcagggagca

SEQ ID NO: 2987162 - DNA, 11 bp, Homo sapiens
gggcagtgccc

SEQ ID NO: 2987163 - DNA, 13 bp, Homo sapiens
gggcatcatgcat

SEQ ID NO: 2987164 - DNA, 20 bp, Homo sapiens
gggcatgagcattggataca

SEQ ID NO: 2987165 - DNA, 22 bp, Homo sapiens
gggcatgcacacggctggtcac

SEQ ID NO: 2987166 - DNA, 23 bp, Homo sapiens
gggcatgcacacggctggtcact

SEQ ID NO: 2987167 - DNA, 16 bp, Homo sapiens
gggcatgtcctttcca

SEQ ID NO: 2987168 - DNA, 20 bp, Homo sapiens
gggcatgtcctttccatctg

SEQ ID NO: 2987169 - DNA, 23 bp, Homo sapiens
gggcattgatggggaaggaggct

SEQ ID NO: 2987170 - DNA, 13 bp, Homo sapiens
gggccaagcccag

SEQ ID NO: 2987171 - DNA, 14 bp, Homo sapiens
gggccacagggcaa

SEQ ID NO: 2987172 - DNA, 17 bp, Homo sapiens
gggccacgctccagctg

SEQ ID NO: 2987173 - DNA, 22 bp, Homo sapiens
gggccactggtccccaacaatg

SEQ ID NO: 2987174 - DNA, 12 bp, Homo sapiens
gggccagaggct

SEQ ID NO: 2987175 - DNA, 13 bp, Homo sapiens
gggccagatccag

SEQ ID NO: 2987176 - DNA, 16 bp, Homo sapiens
gggccagatccagcct

SEQ ID NO: 2987177 - DNA, 17 bp, Homo sapiens
gggccagcaggcagcgc

SEQ ID NO: 2987178 - DNA, 21 bp, Homo sapiens
gggccagcatactccgtgagg

SEQ ID NO: 2987179 - DNA, 21 bp, Homo sapiens
gggccaggccctggagggcag

SEQ ID NO: 2987180 - DNA, 14 bp, Homo sapiens
gggccaggccgggc

SEQ ID NO: 2987181 - DNA, 13 bp, Homo sapiens
gggccatggctca

SEQ ID NO: 2987182 - DNA, 22 bp, Homo sapiens
gggccatgggtcctcggcccat

SEQ ID NO: 2987183 - DNA, 23 bp, Homo sapiens
gggccatgggtcctcggcccatc

SEQ ID NO: 2987184 - DNA, 18 bp, Homo sapiens
gggccattctccacagca

SEQ ID NO: 2987185 - DNA, 12 bp, Homo sapiens
gggcccacaccc

SEQ ID NO: 2987186 - DNA, 19 bp, Homo sapiens
gggcccacagcccccaccc

SEQ ID NO: 2987187 - DNA, 20 bp, Homo sapiens
gggcccacagcccccacccc

SEQ ID NO: 2987188 - DNA, 13 bp, Homo sapiens
gggcccagagccc

SEQ ID NO: 2987189 - DNA, 16 bp, Homo sapiens
gggcccagagcccagc

SEQ ID NO: 2987190 - DNA, 19 bp, Homo sapiens
gggcccagagcccagctcc

SEQ ID NO: 2987191 - DNA, 12 bp, Homo sapiens
gggcccagagtg

SEQ ID NO: 2987192 - DNA, 14 bp, Homo sapiens
gggcccagcgctct

SEQ ID NO: 2987193 - DNA, 19 bp, Homo sapiens
gggcccagcgctctcctgg

SEQ ID NO: 2987194 - DNA, 20 bp, Homo sapiens
gggcccagcgctctcctgga

SEQ ID NO: 2987195 - DNA, 13 bp, Homo sapiens
gggcccaggcagg

SEQ ID NO: 2987196 - DNA, 11 bp, Homo sapiens
gggcccaggcc

SEQ ID NO: 2987197 - DNA, 12 bp, Homo sapiens
gggcccaggcca

SEQ ID NO: 2987198 - DNA, 15 bp, Homo sapiens
gggcccaggccatgt

SEQ ID NO: 2987199 - DNA, 16 bp, Homo sapiens
gggcccaggccatgtg

SEQ ID NO: 2987200 - DNA, 15 bp, Homo sapiens
gggcccaggcctgga

SEQ ID NO: 2987201 - DNA, 11 bp, Homo sapiens
gggcccagggg

SEQ ID NO: 2987202 - DNA, 14 bp, Homo sapiens
gggcccccaccgcc

SEQ ID NO: 2987203 - DNA, 15 bp, Homo sapiens
gggcccccagagacc

SEQ ID NO: 2987204 - DNA, 20 bp, Homo sapiens
gggcccccagagacctttgc

SEQ ID NO: 2987205 - DNA, 14 bp, Homo sapiens
gggcccccatctca

SEQ ID NO: 2987206 - DNA, 12 bp, Homo sapiens
gggccccccaac

SEQ ID NO: 2987207 - DNA, 15 bp, Homo sapiens
gggcccccctgccct

SEQ ID NO: 2987208 - DNA, 12 bp, Homo sapiens
gggcccctcagg

SEQ ID NO: 2987209 - DNA, 16 bp, Homo sapiens
gggcccctcaggggaa

SEQ ID NO: 2987210 - DNA, 22 bp, Homo sapiens
gggcccctcaggggaagctgct

SEQ ID NO: 2987211 - DNA, 21 bp, Homo sapiens
gggcccctcccctcagagccc

SEQ ID NO: 2987212 - DNA, 22 bp, Homo sapiens
gggcccctcccctcagagccca

SEQ ID NO: 2987213 - DNA, 16 bp, Homo sapiens
gggcccctggcccagg

SEQ ID NO: 2987214 - DNA, 18 bp, Homo sapiens
gggcccgacatggctccg

SEQ ID NO: 2987215 - DNA, 16 bp, Homo sapiens
gggcccggccagccat

SEQ ID NO: 2987216 - DNA, 22 bp, Homo sapiens
gggccctctctgcaccggacag

SEQ ID NO: 2987217 - DNA, 16 bp, Homo sapiens
gggccctctctgctct

SEQ ID NO: 2987218 - DNA, 17 bp, Homo sapiens
gggccctgcaggctgca

SEQ ID NO: 2987219 - DNA, 18 bp, Homo sapiens
ggtcctgggaggctgcag

SEQ ID NO: 2987220 - DNA, 22 bp, Homo sapiens
ggtcctgggaggctgcagccag

SEQ ID NO: 2987221 - DNA, 15 bp, Homo sapiens
ggtcctgtccccgca

SEQ ID NO: 2987222 - DNA, 15 bp, Homo sapiens
ggtcctgtctgtcct

SEQ ID NO: 2987223 - DNA, 15 bp, Homo sapiens
ggtccttgggcctgg

SEQ ID NO: 2987224 - DNA, 21 bp, Homo sapiens
ggtcctttgggaaaggagaag

SEQ ID NO: 2987225 - DNA, 16 bp, Homo sapiens
ggtcggaagcctgtcc

SEQ ID NO: 2987226 - DNA, 18 bp, Homo sapiens
ggtcggaagcctgtcctc

SEQ ID NO: 2987227 - DNA, 21 bp, Homo sapiens
ggtctaccaatacaaaatgta

SEQ ID NO: 2987228 - DNA, 18 bp, Homo sapiens
ggtctagccgctgccctg

SEQ ID NO: 2987229 - DNA, 14 bp, Homo sapiens
ggtctagggagaga

SEQ ID NO: 2987230 - DNA, 19 bp, Homo sapiens
ggtctatgtcgagagctgg

SEQ ID NO: 2987231 - DNA, 20 bp, Homo sapiens
ggtctatgtcgagagctggc

SEQ ID NO: 2987232 - DNA, 16 bp, Homo sapiens
ggtctattccagctca

SEQ ID NO: 2987233 - DNA, 17 bp, Homo sapiens
ggtctattccagctcat

SEQ ID NO: 2987234 - DNA, 17 bp, Homo sapiens
ggtctcaaactcctgac

SEQ ID NO: 2987235 - DNA, 23 bp, Homo sapiens
ggtctcaaactcctgacctcagg

SEQ ID NO: 2987236 - DNA, 19 bp, Homo sapiens
ggtctcacactcctcctgc

SEQ ID NO: 2987237 - DNA, 24 bp, Homo sapiens
ggtctcacactcctcctgccagct

SEQ ID NO: 2987238 - DNA, 20 bp, Homo sapiens
ggtctcacgcaacacatttt

SEQ ID NO: 2987239 - DNA, 20 bp, Homo sapiens
ggtctccatgaagaagctgg

SEQ ID NO: 2987240 - DNA, 19 bp, Homo sapiens
ggtctccctctcctgccta

SEQ ID NO: 2987241 - DNA, 16 bp, Homo sapiens
ggtctccttggaaatc

SEQ ID NO: 2987242 - DNA, 18 bp, Homo sapiens
ggtctcgatgctgctggc

SEQ ID NO: 2987243 - DNA, 19 bp, Homo sapiens
ggtctcgatgctgctggcc

SEQ ID NO: 2987244 - DNA, 21 bp, Homo sapiens
ggtctcgatgctgctggcctc

SEQ ID NO: 2987245 - DNA, 22 bp, Homo sapiens
ggtctcgatgctgctggcctcc

SEQ ID NO: 2987246 - DNA, 15 bp, Homo sapiens
ggtctctgagacagg

SEQ ID NO: 2987247 - DNA, 16 bp, Homo sapiens
ggtctctgctccagca

SEQ ID NO: 2987248 - DNA, 20 bp, Homo sapiens
ggtctcttcttggggcccag

SEQ ID NO: 2987249 - DNA, 14 bp, Homo sapiens
ggtctcttttctct

SEQ ID NO: 2987250 - DNA, 22 bp, Homo sapiens
ggtctgaaaagaggagccagag

SEQ ID NO: 2987251 - DNA, 17 bp, Homo sapiens
ggtctgagctgtcccaa

SEQ ID NO: 2987252 - DNA, 14 bp, Homo sapiens
ggtctgatttgcag

SEQ ID NO: 2987253 - DNA, 18 bp, Homo sapiens
ggtctgcaagggcccaga

SEQ ID NO: 2987254 - DNA, 19 bp, Homo sapiens
ggtctgcaagggcccagag

SEQ ID NO: 2987255 - DNA, 23 bp, Homo sapiens
ggtctgcctcttctgggagggca

SEQ ID NO: 2987256 - DNA, 22 bp, Homo sapiens
ggtctggagaagcagtgagccg

SEQ ID NO: 2987257 - DNA, 15 bp, Homo sapiens
ggtctggcagcctcc

SEQ ID NO: 2987258 - DNA, 20 bp, Homo sapiens
ggtctgggagtcacacagtg

SEQ ID NO: 2987259 - DNA, 14 bp, Homo sapiens
ggtctggtgtaaaa

SEQ ID NO: 2987260 - DNA, 22 bp, Homo sapiens
ggtctgtgtgtgtgtgtgtgcg

SEQ ID NO: 2987261 - DNA, 23 bp, Homo sapiens
ggtcttactttgtgcaaaagcag

SEQ ID NO: 2987262 - DNA, 16 bp, Homo sapiens
ggtcttagctctttct

SEQ ID NO: 2987263 - DNA, 13 bp, Homo sapiens
ggtcttaggtctt

SEQ ID NO: 2987264 - DNA, 21 bp, Homo sapiens
ggtcttgaactcctggactca

SEQ ID NO: 2987265 - DNA, 13 bp, Homo sapiens
ggtcttgggaaat

SEQ ID NO: 2987266 - DNA, 20 bp, Homo sapiens
ggtcttggttccagcctgcc

SEQ ID NO: 2987267 - DNA, 19 bp, Homo sapiens
ggtctttcctaaggctgca

SEQ ID NO: 2987268 - DNA, 22 bp, Homo sapiens
ggtcttttacatacagtgatat

SEQ ID NO: 2987269 - DNA, 16 bp, Homo sapiens
ggtcttttcatctggg

SEQ ID NO: 2987270 - DNA, 17 bp, Homo sapiens
ggtctttttgtaagtga

SEQ ID NO: 2987271 - DNA, 18 bp, Homo sapiens
ggtgaaaattagggttgg

SEQ ID NO: 2987272 - DNA, 19 bp, Homo sapiens
ggtgaacaaagcagccacg

SEQ ID NO: 2987273 - DNA, 15 bp, Homo sapiens
ggtgaacagctggtg

SEQ ID NO: 2987274 - DNA, 12 bp, Homo sapiens
ggtgaactttgt

SEQ ID NO: 2987275 - DNA, 18 bp, Homo sapiens
ggtgaagctatttatctg

SEQ ID NO: 2987276 - DNA, 13 bp, Homo sapiens
ggtgaaggcagga

SEQ ID NO: 2987277 - DNA, 19 bp, Homo sapiens
ggtgaagtgaggacaaaat

SEQ ID NO: 2987278 - DNA, 17 bp, Homo sapiens
ggtgacaagatagagag

SEQ ID NO: 2987279 - DNA, 18 bp, Homo sapiens
ggtgacaagatagagagc

SEQ ID NO: 2987280 - DNA, 13 bp, Homo sapiens
ggtgacagagcga

SEQ ID NO: 2987281 - DNA, 12 bp, Homo sapiens
ggtgacagtggc

SEQ ID NO: 2987282 - DNA, 23 bp, Homo sapiens
ggtgaccccatcactcgcaggac

SEQ ID NO: 2987283 - DNA, 15 bp, Homo sapiens
ggtgaccgcccagct

SEQ ID NO: 2987284 - DNA, 22 bp, Homo sapiens
ggtgactggttatcacaccatc

SEQ ID NO: 2987285 - DNA, 14 bp, Homo sapiens
ggtgactttctgaa

SEQ ID NO: 2987286 - DNA, 15 bp, Homo sapiens
ggtgactttctgaaa

SEQ ID NO: 2987287 - DNA, 23 bp, Homo sapiens
ggtgagaaacctgtatctttcta

SEQ ID NO: 2987288 - DNA, 17 bp, Homo sapiens
ggtgagaggaagggtgg

SEQ ID NO: 2987289 - DNA, 15 bp, Homo sapiens
ggtgaggcaataaaa

SEQ ID NO: 2987290 - DNA, 18 bp, Homo sapiens
ggtgaggccggccctgcc

SEQ ID NO: 2987291 - DNA, 19 bp, Homo sapiens
ggtgagtgtgagggcagca

SEQ ID NO: 2987292 - DNA, 15 bp, Homo sapiens
ggtgataaggacatg

SEQ ID NO: 2987293 - DNA, 19 bp, Homo sapiens
ggtgatcccgttttcccca

SEQ ID NO: 2987294 - DNA, 13 bp, Homo sapiens
ggtgatgccaggt

SEQ ID NO: 2987295 - DNA, 14 bp, Homo sapiens
ggtgatggaaaaag

SEQ ID NO: 2987296 - DNA, 14 bp, Homo sapiens
ggtgatggccagag

SEQ ID NO: 2987297 - DNA, 22 bp, Homo sapiens
ggtgcaaggccatctgcttacc

SEQ ID NO: 2987298 - DNA, 16 bp, Homo sapiens
ggtgcacacatcacca

SEQ ID NO: 2987299 - DNA, 18 bp, Homo sapiens
ggtgcacagtccacagct

SEQ ID NO: 2987300 - DNA, 11 bp, Homo sapiens
ggtgcagaggt

SEQ ID NO: 2987301 - DNA, 19 bp, Homo sapiens
ggtgcagaggtaccctggg

SEQ ID NO: 2987302 - DNA, 22 bp, Homo sapiens
ggtgcagaggtaccctgggtgt

SEQ ID NO: 2987303 - DNA, 13 bp, Homo sapiens
ggtgcagccagag

SEQ ID NO: 2987304 - DNA, 15 bp, Homo sapiens
ggtgcagctcctcag

SEQ ID NO: 2987305 - DNA, 17 bp, Homo sapiens
ggtgcagtttgaggggc

SEQ ID NO: 2987306 - DNA, 17 bp, Homo sapiens
ggtgcatgatcttgagc

SEQ ID NO: 2987307 - DNA, 19 bp, Homo sapiens
ggtgccaaatagccccaga

SEQ ID NO: 2987308 - DNA, 13 bp, Homo sapiens
ggtgcccacaggc

SEQ ID NO: 2987309 - DNA, 14 bp, Homo sapiens
ggtgcccacaggcc

SEQ ID NO: 2987310 - DNA, 13 bp, Homo sapiens
ggtgccccaggac

SEQ ID NO: 2987311 - DNA, 17 bp, Homo sapiens
ggtgccccaggaccagc

SEQ ID NO: 2987312 - DNA, 23 bp, Homo sapiens
ggtgccccaggaccagctcagga

SEQ ID NO: 2987313 - DNA, 19 bp, Homo sapiens
ggtgccctgaaagggccct

SEQ ID NO: 2987314 - DNA, 22 bp, Homo sapiens
ggtgcctgctttgacgggccag

SEQ ID NO: 2987315 - DNA, 18 bp, Homo sapiens
ggtgcctgggtggggctg

SEQ ID NO: 2987316 - DNA, 19 bp, Homo sapiens
ggtgcctgggtggggctgc

SEQ ID NO: 2987317 - DNA, 23 bp, Homo sapiens
ggtgcctgggtggggctgctcct

SEQ ID NO: 2987318 - DNA, 19 bp, Homo sapiens
ggtgcctgtgaggcagggg

SEQ ID NO: 2987319 - DNA, 21 bp, Homo sapiens
ggtgcctgtgaggcaggggcg

SEQ ID NO: 2987320 - DNA, 18 bp, Homo sapiens
ggtgcctttcaaatttag

SEQ ID NO: 2987321 - DNA, 14 bp, Homo sapiens
ggtgcgtctgggag

SEQ ID NO: 2987322 - DNA, 19 bp, Homo sapiens
ggtgcgtctgggaggttgg

SEQ ID NO: 2987323 - DNA, 13 bp, Homo sapiens
ggtgcgtttttac

SEQ ID NO: 2987324 - DNA, 17 bp, Homo sapiens
ggtgctaaagccaacca

SEQ ID NO: 2987325 - DNA, 13 bp, Homo sapiens
ggtgctaatattt

SEQ ID NO: 2987326 - DNA, 14 bp, Homo sapiens
ggtgctaatatttt

SEQ ID NO: 2987327 - DNA, 23 bp, Homo sapiens
ggtgctacacccttttccagctg

SEQ ID NO: 2987328 - DNA, 19 bp, Homo sapiens
ggtgctctgaggcctcact

SEQ ID NO: 2987329 - DNA, 20 bp, Homo sapiens
ggtgctgacaatactgctgc

SEQ ID NO: 2987330 - DNA, 16 bp, Homo sapiens
ggtgctgacggccagg

SEQ ID NO: 2987331 - DNA, 17 bp, Homo sapiens
ggtgctgcctctacctg

SEQ ID NO: 2987332 - DNA, 11 bp, Homo sapiens
ggtgctggccc

SEQ ID NO: 2987333 - DNA, 19 bp, Homo sapiens
ggtgctggcccagcatgga

SEQ ID NO: 2987334 - DNA, 15 bp, Homo sapiens
ggtgctgttgaaaat

SEQ ID NO: 2987335 - DNA, 22 bp, Homo sapiens
ggtgcttctagttctgccagga

SEQ ID NO: 2987336 - DNA, 17 bp, Homo sapiens
ggtgctttgcattttga

SEQ ID NO: 2987337 - DNA, 17 bp, Homo sapiens
ggtggaaaacagggtgc

SEQ ID NO: 2987338 - DNA, 11 bp, Homo sapiens
ggtggaagagc

SEQ ID NO: 2987339 - DNA, 18 bp, Homo sapiens
ggtggaagccctccttcc

SEQ ID NO: 2987340 - DNA, 15 bp, Homo sapiens
ggtggaattatttta

SEQ ID NO: 2987341 - DNA, 16 bp, Homo sapiens
ggtggaccctgtaaat

SEQ ID NO: 2987342 - DNA, 21 bp, Homo sapiens
ggtggacttgaactttcctgg

SEQ ID NO: 2987343 - DNA, 14 bp, Homo sapiens
ggtggagaagccat

SEQ ID NO: 2987344 - DNA, 16 bp, Homo sapiens
ggtggagagcactaga

SEQ ID NO: 2987345 - DNA, 18 bp, Homo sapiens
ggtggagctgagaagagg

SEQ ID NO: 2987346 - DNA, 13 bp, Homo sapiens
ggtggagggccac

SEQ ID NO: 2987347 - DNA, 23 bp, Homo sapiens
ggtggagggccacatgggaggct

SEQ ID NO: 2987348 - DNA, 17 bp, Homo sapiens
ggtggatcacagaggct

SEQ ID NO: 2987349 - DNA, 14 bp, Homo sapiens
ggtggatggtgact

SEQ ID NO: 2987350 - DNA, 15 bp, Homo sapiens
ggtggatggtgactt

SEQ ID NO: 2987351 - DNA, 17 bp, Homo sapiens
gtagcttaccagaagct

SEQ ID NO: 2987352 - DNA, 22 bp, Homo sapiens
gtagcttaccagaagcttccat

SEQ ID NO: 2987353 - DNA, 12 bp, Homo sapiens
gtagctttcctg

SEQ ID NO: 2987354 - DNA, 17 bp, Homo sapiens
gtagctttcctggaagt

SEQ ID NO: 2987355 - DNA, 14 bp, Homo sapiens
gtaggaaaaaaata

SEQ ID NO: 2987356 - DNA, 22 bp, Homo sapiens
gtaggaactcttaagcaatggt

SEQ ID NO: 2987357 - DNA, 18 bp, Homo sapiens
gtaggaatctgccttcca

SEQ ID NO: 2987358 - DNA, 18 bp, Homo sapiens
gtaggacccaagcagaga

SEQ ID NO: 2987359 - DNA, 16 bp, Homo sapiens
gtaggatcacctgagg

SEQ ID NO: 2987360 - DNA, 13 bp, Homo sapiens
gtaggattgctgg

SEQ ID NO: 2987361 - DNA, 14 bp, Homo sapiens
gtaggcagaggctg

SEQ ID NO: 2987362 - DNA, 15 bp, Homo sapiens
gtaggcatctaaaga

SEQ ID NO: 2987363 - DNA, 14 bp, Homo sapiens
gtaggccccacaag

SEQ ID NO: 2987364 - DNA, 20 bp, Homo sapiens
gtaggtactttttgtgaaga

SEQ ID NO: 2987365 - DNA, 22 bp, Homo sapiens
gtaggtactttttgtgaagacg

SEQ ID NO: 2987366 - DNA, 19 bp, Homo sapiens
gtagtaaaaattaaaaaaa

SEQ ID NO: 2987367 - DNA, 15 bp, Homo sapiens
gtagtaaaacacaga

SEQ ID NO: 2987368 - DNA, 17 bp, Homo sapiens
gtagtaaaacacagagg

SEQ ID NO: 2987369 - DNA, 15 bp, Homo sapiens
gtagtaattgacatg

SEQ ID NO: 2987370 - DNA, 13 bp, Homo sapiens
gtagtaccttgtt

SEQ ID NO: 2987371 - DNA, 20 bp, Homo sapiens
gtagtagtcaaggtgctcaa

SEQ ID NO: 2987372 - DNA, 16 bp, Homo sapiens
gtagtccgtgctgaca

SEQ ID NO: 2987373 - DNA, 19 bp, Homo sapiens
gtagtcttgtcttagctct

SEQ ID NO: 2987374 - DNA, 20 bp, Homo sapiens
gtagtgccgcagtggggtca

SEQ ID NO: 2987375 - DNA, 19 bp, Homo sapiens
gtagtgtccattttgtgaa

SEQ ID NO: 2987376 - DNA, 20 bp, Homo sapiens
gtagtgtccattttgtgaag

SEQ ID NO: 2987377 - DNA, 22 bp, Homo sapiens
gtagtgtgggaggctcctgtta

SEQ ID NO: 2987378 - DNA, 21 bp, Homo sapiens
gtagttaaaaaaaaaaaaagg

SEQ ID NO: 2987379 - DNA, 23 bp, Homo sapiens
gtagttaaaaaaaaaaaaaggaa

SEQ ID NO: 2987380 - DNA, 20 bp, Homo sapiens
gtagttacattaatgcccag

SEQ ID NO: 2987381 - DNA, 17 bp, Homo sapiens
gtagttccctgaaaacc

SEQ ID NO: 2987382 - DNA, 20 bp, Homo sapiens
gtagttccctgaaaacccag

SEQ ID NO: 2987383 - DNA, 23 bp, Homo sapiens
gtagttccctgaaaacccagaga

SEQ ID NO: 2987384 - DNA, 17 bp, Homo sapiens
gtagttctcttggtgtt

SEQ ID NO: 2987385 - DNA, 10 bp, Homo sapiens
gtagttgttt

SEQ ID NO: 2987386 - DNA, 21 bp, Homo sapiens
gtagtttatggcagaagggaa

SEQ ID NO: 2987387 - DNA, 23 bp, Homo sapiens
gtagtttgttatgtgtctggaag

SEQ ID NO: 2987388 - DNA, 20 bp, Homo sapiens
gtataaagctctcaaatgtg

SEQ ID NO: 2987389 - DNA, 15 bp, Homo sapiens
gtataaatgtctatt

SEQ ID NO: 2987390 - DNA, 13 bp, Homo sapiens
gtataacaggtta

SEQ ID NO: 2987391 - DNA, 15 bp, Homo sapiens
gtataacaggttatt

SEQ ID NO: 2987392 - DNA, 22 bp, Homo sapiens
gtataacaggttattttagttt

SEQ ID NO: 2987393 - DNA, 15 bp, Homo sapiens
gtataagtagatctg

SEQ ID NO: 2987394 - DNA, 23 bp, Homo sapiens
gtataagtagatctgctttctgt

SEQ ID NO: 2987395 - DNA, 15 bp, Homo sapiens
gtataatatttctta

SEQ ID NO: 2987396 - DNA, 19 bp, Homo sapiens
gtatacaaccctggcatta

SEQ ID NO: 2987397 - DNA, 13 bp, Homo sapiens
gtatacatttgtt

SEQ ID NO: 2987398 - DNA, 23 bp, Homo sapiens
gtatactagggagccatttgaga

SEQ ID NO: 2987399 - DNA, 14 bp, Homo sapiens
gtatagctgtattg

SEQ ID NO: 2987400 - DNA, 16 bp, Homo sapiens
gtatagctgtattgaa

SEQ ID NO: 2987401 - DNA, 17 bp, Homo sapiens
gtatagctgtattgaat

SEQ ID NO: 2987402 - DNA, 19 bp, Homo sapiens
gtatagctgtattgaatca

SEQ ID NO: 2987403 - DNA, 23 bp, Homo sapiens
gtatagctgtattgaatcatgta

SEQ ID NO: 2987404 - DNA, 18 bp, Homo sapiens
gtatataaagttttttta

SEQ ID NO: 2987405 - DNA, 13 bp, Homo sapiens
gtatataaatggg

SEQ ID NO: 2987406 - DNA, 14 bp, Homo sapiens
gtatatacacacat

SEQ ID NO: 2987407 - DNA, 13 bp, Homo sapiens
gtatatacttttt

SEQ ID NO: 2987408 - DNA, 18 bp, Homo sapiens
gtatatatatatatatgt

SEQ ID NO: 2987409 - DNA, 14 bp, Homo sapiens
gtatatatttaaaa

SEQ ID NO: 2987410 - DNA, 20 bp, Homo sapiens
gtatatgactgcatttgtgt

SEQ ID NO: 2987411 - DNA, 18 bp, Homo sapiens
gtatatgattctctgtgg

SEQ ID NO: 2987412 - DNA, 19 bp, Homo sapiens
gtatatgggcttttacctg

SEQ ID NO: 2987413 - DNA, 16 bp, Homo sapiens
gtatattatgtattta

SEQ ID NO: 2987414 - DNA, 22 bp, Homo sapiens
gtatattatttctaggaagaat

SEQ ID NO: 2987415 - DNA, 20 bp, Homo sapiens
gtatattcttccttgattgt

SEQ ID NO: 2987416 - DNA, 15 bp, Homo sapiens
gtatattcttgtaaa

SEQ ID NO: 2987417 - DNA, 13 bp, Homo sapiens
gtatattgtgttt

SEQ ID NO: 2987418 - DNA, 19 bp, Homo sapiens
gtatattgtgtttgtgtat

SEQ ID NO: 2987419 - DNA, 14 bp, Homo sapiens
gtatatttctcata

SEQ ID NO: 2987420 - DNA, 22 bp, Homo sapiens
gtatcaagtgttctaaaatgaa

SEQ ID NO: 2987421 - DNA, 14 bp, Homo sapiens
gtatcaggacccag

SEQ ID NO: 2987422 - DNA, 23 bp, Homo sapiens
gtatccagaggaattgattgtca

SEQ ID NO: 2987423 - DNA, 11 bp, Homo sapiens
gtatccagtca

SEQ ID NO: 2987424 - DNA, 17 bp, Homo sapiens
gtatccattatcatgtg

SEQ ID NO: 2987425 - DNA, 21 bp, Homo sapiens
gtatccattatcatgtgtaat

SEQ ID NO: 2987426 - DNA, 18 bp, Homo sapiens
gtatcctccctggcagac

SEQ ID NO: 2987427 - DNA, 18 bp, Homo sapiens
gtatcctgggggacccaa

SEQ ID NO: 2987428 - DNA, 14 bp, Homo sapiens
gtatcgaggcttgt

SEQ ID NO: 2987429 - DNA, 20 bp, Homo sapiens
gtatctaatcctttaatgat

SEQ ID NO: 2987430 - DNA, 15 bp, Homo sapiens
gtatctcctcgcaag

SEQ ID NO: 2987431 - DNA, 19 bp, Homo sapiens
gtatctgcatgtaaaatct

SEQ ID NO: 2987432 - DNA, 21 bp, Homo sapiens
gtatctgcatgtaaaatcttc

SEQ ID NO: 2987433 - DNA, 13 bp, Homo sapiens
gtatctgtctact

SEQ ID NO: 2987434 - DNA, 14 bp, Homo sapiens
gtatctgtctactt

SEQ ID NO: 2987435 - DNA, 19 bp, Homo sapiens
gtatctgtctactttctct

SEQ ID NO: 2987436 - DNA, 15 bp, Homo sapiens
gtatcttctattttt

SEQ ID NO: 2987437 - DNA, 15 bp, Homo sapiens
gtatctttccaggct

SEQ ID NO: 2987438 - DNA, 17 bp, Homo sapiens
gtatctttctatgctgc

SEQ ID NO: 2987439 - DNA, 19 bp, Homo sapiens
gtatctttctatgctgctt

SEQ ID NO: 2987440 - DNA, 20 bp, Homo sapiens
gtatctttctatgctgcttt

SEQ ID NO: 2987441 - DNA, 16 bp, Homo sapiens
gtatgaataattgcat

SEQ ID NO: 2987442 - DNA, 18 bp, Homo sapiens
gtatgatgtattagtaga

SEQ ID NO: 2987443 - DNA, 21 bp, Homo sapiens
gtatgatttgttttgaatttt

SEQ ID NO: 2987444 - DNA, 22 bp, Homo sapiens
gtatgatttgttttgaattttg

SEQ ID NO: 2987445 - DNA, 20 bp, Homo sapiens
gtatgcaagtgggagatgaa

SEQ ID NO: 2987446 - DNA, 21 bp, Homo sapiens
gtatgcgtgtccgtctgtctg

SEQ ID NO: 2987447 - DNA, 21 bp, Homo sapiens
gtatgctgatcatcgccagag

SEQ ID NO: 2987448 - DNA, 13 bp, Homo sapiens
gtatgcttcatac

SEQ ID NO: 2987449 - DNA, 21 bp, Homo sapiens
gtatgcttcatacagggatgg

SEQ ID NO: 2987450 - DNA, 17 bp, Homo sapiens
gtatggaaacacatact

SEQ ID NO: 2987451 - DNA, 15 bp, Homo sapiens
gtatggaatgcttct

SEQ ID NO: 2987452 - DNA, 16 bp, Homo sapiens
gtatggaatgcttctt

SEQ ID NO: 2987453 - DNA, 21 bp, Homo sapiens
gtatggtgctaatattttatt

SEQ ID NO: 2987454 - DNA, 14 bp, Homo sapiens
gtatgtaatttctg

SEQ ID NO: 2987455 - DNA, 16 bp, Homo sapiens
gtatgtaatttctgca

SEQ ID NO: 2987456 - DNA, 20 bp, Homo sapiens
gtatgtacagttcataaatt

SEQ ID NO: 2987457 - DNA, 22 bp, Homo sapiens
gtatgtacagttcataaatttg

SEQ ID NO: 2987458 - DNA, 18 bp, Homo sapiens
gtatgtatatacacacat

SEQ ID NO: 2987459 - DNA, 14 bp, Homo sapiens
gtatgtcatttcct

SEQ ID NO: 2987460 - DNA, 11 bp, Homo sapiens
gtatgtctgtc

SEQ ID NO: 2987461 - DNA, 12 bp, Homo sapiens
gtatgtgccagg

SEQ ID NO: 2987462 - DNA, 18 bp, Homo sapiens
gtatgtgccaggcttgcc

SEQ ID NO: 2987463 - DNA, 19 bp, Homo sapiens
gtatgtgccaggcttgcct

SEQ ID NO: 2987464 - DNA, 21 bp, Homo sapiens
gtattaaaaaacaattaactg

SEQ ID NO: 2987465 - DNA, 22 bp, Homo sapiens
gtattaaaaaacaattaactgc

SEQ ID NO: 2987466 - DNA, 19 bp, Homo sapiens
gtattaaacctttccattt

SEQ ID NO: 2987467 - DNA, 21 bp, Homo sapiens
gtattaactctgtaaaagtgt

SEQ ID NO: 2987468 - DNA, 19 bp, Homo sapiens
gtattaataaatagagcaa

SEQ ID NO: 2987469 - DNA, 13 bp, Homo sapiens
gtattactttaat

SEQ ID NO: 2987470 - DNA, 22 bp, Homo sapiens
gtattagctgtattatccattt

SEQ ID NO: 2987471 - DNA, 21 bp, Homo sapiens
gtattagtgatatttctctag

SEQ ID NO: 2987472 - DNA, 12 bp, Homo sapiens
gtattattgcaa

SEQ ID NO: 2987473 - DNA, 14 bp, Homo sapiens
gtattattttccaa

SEQ ID NO: 2987474 - DNA, 17 bp, Homo sapiens
gtattcaggcactgaga

SEQ ID NO: 2987475 - DNA, 12 bp, Homo sapiens
gtattccccttc

SEQ ID NO: 2987476 - DNA, 13 bp, Homo sapiens
gtattctgtggcc

SEQ ID NO: 2987477 - DNA, 14 bp, Homo sapiens
gtattctgtggccg

SEQ ID NO: 2987478 - DNA, 18 bp, Homo sapiens
gtattctttgatgttaac

SEQ ID NO: 2987479 - DNA, 17 bp, Homo sapiens
gtattgagatattacac

SEQ ID NO: 2987480 - DNA, 21 bp, Homo sapiens
gtattgccatcgggtgccaaa

SEQ ID NO: 2987481 - DNA, 17 bp, Homo sapiens
gtattgctgctgtgcgt

SEQ ID NO: 2987482 - DNA, 18 bp, Homo sapiens
gtattgctgctgtgcgtg

SEQ ID NO: 2987483 - DNA, 13 bp, Homo sapiens
gtcgagagctggc

SEQ ID NO: 2987484 - DNA, 14 bp, Homo sapiens
gtcgattagactgg

SEQ ID NO: 2987485 - DNA, 20 bp, Homo sapiens
gtcgccctgttcttgaggtc

SEQ ID NO: 2987486 - DNA, 17 bp, Homo sapiens
gtcgctcagtctgttca

SEQ ID NO: 2987487 - DNA, 16 bp, Homo sapiens
gtcgctgcagggagca

SEQ ID NO: 2987488 - DNA, 18 bp, Homo sapiens
gtcgctgcagggagcacc

SEQ ID NO: 2987489 - DNA, 18 bp, Homo sapiens
gtcgctgtaaattttatg

SEQ ID NO: 2987490 - DNA, 15 bp, Homo sapiens
gtcggagctgcctgc

SEQ ID NO: 2987491 - DNA, 16 bp, Homo sapiens
gtcggcatgccaggac

SEQ ID NO: 2987492 - DNA, 15 bp, Homo sapiens
gtcggctaagtggga

SEQ ID NO: 2987493 - DNA, 11 bp, Homo sapiens
gtcgggagagg

SEQ ID NO: 2987494 - DNA, 15 bp, Homo sapiens
gtcgggagaggggac

SEQ ID NO: 2987495 - DNA, 22 bp, Homo sapiens
gtcgggatatttgggtgcagag

SEQ ID NO: 2987496 - DNA, 21 bp, Homo sapiens
gtcgggggccactgtgtttct

SEQ ID NO: 2987497 - DNA, 18 bp, Homo sapiens
gtcgtcaaagctgaaatg

SEQ ID NO: 2987498 - DNA, 21 bp, Homo sapiens
gtctaaagatggagtttctaa

SEQ ID NO: 2987499 - DNA, 13 bp, Homo sapiens
gtctaaatttctt

SEQ ID NO: 2987500 - DNA, 16 bp, Homo sapiens
gtctaagattctagat

SEQ ID NO: 2987501 - DNA, 21 bp, Homo sapiens
gtctaagcagttttgtaaatg

SEQ ID NO: 2987502 - DNA, 23 bp, Homo sapiens
gtctaaggagcgctagtgccttg

SEQ ID NO: 2987503 - DNA, 22 bp, Homo sapiens
gtctaattaaaacactttcaaa

SEQ ID NO: 2987504 - DNA, 21 bp, Homo sapiens
gtctacaaaaaggtataaata

SEQ ID NO: 2987505 - DNA, 15 bp, Homo sapiens
gtctaccaatacaaa

SEQ ID NO: 2987506 - DNA, 17 bp, Homo sapiens
gtctacctgagcattca

SEQ ID NO: 2987507 - DNA, 18 bp, Homo sapiens
gtctactcttaagccatc

SEQ ID NO: 2987508 - DNA, 18 bp, Homo sapiens
gtctacttctgtgtctgt

SEQ ID NO: 2987509 - DNA, 15 bp, Homo sapiens
gtctactttctcttg

SEQ ID NO: 2987510 - DNA, 16 bp, Homo sapiens
gtctactttctcttgt

SEQ ID NO: 2987511 - DNA, 14 bp, Homo sapiens
gtctagactggcct

SEQ ID NO: 2987512 - DNA, 16 bp, Homo sapiens
gtctagactggcctag

SEQ ID NO: 2987513 - DNA, 19 bp, Homo sapiens
gtctagattcaaaggttct

SEQ ID NO: 2987514 - DNA, 15 bp, Homo sapiens
gtctagccgctgccc

SEQ ID NO: 2987515 - DNA, 17 bp, Homo sapiens
gtctagccgctgccctg

SEQ ID NO: 2987516 - DNA, 18 bp, Homo sapiens
gtctagccgctgccctgg

SEQ ID NO: 2987517 - DNA, 22 bp, Homo sapiens
gtctaggataacttgctttctt

SEQ ID NO: 2987518 - DNA, 17 bp, Homo sapiens
gtctatctctaataaaa

SEQ ID NO: 2987519 - DNA, 18 bp, Homo sapiens
gtctatctctaataaaaa

SEQ ID NO: 2987520 - DNA, 22 bp, Homo sapiens
gtctatgtcgagagctggccaa

SEQ ID NO: 2987521 - DNA, 15 bp, Homo sapiens
gtctattattatgaa

SEQ ID NO: 2987522 - DNA, 14 bp, Homo sapiens
gtctattccagctc

SEQ ID NO: 2987523 - DNA, 15 bp, Homo sapiens
gtctattccagctca

SEQ ID NO: 2987524 - DNA, 20 bp, Homo sapiens
gtctattccagctcattcat

SEQ ID NO: 2987525 - DNA, 21 bp, Homo sapiens
gtctattccagctcattcatt

SEQ ID NO: 2987526 - DNA, 18 bp, Homo sapiens
gtctatttttgtacaaaa

SEQ ID NO: 2987527 - DNA, 21 bp, Homo sapiens
gtctcaactctgtccccagga

SEQ ID NO: 2987528 - DNA, 20 bp, Homo sapiens
gtctcaagggtggcaggtca

SEQ ID NO: 2987529 - DNA, 21 bp, Homo sapiens
gtctcaatagctccaagctgt

SEQ ID NO: 2987530 - DNA, 16 bp, Homo sapiens
gtctcaattttgtatt

SEQ ID NO: 2987531 - DNA, 18 bp, Homo sapiens
gtctcacactcctcctgc

SEQ ID NO: 2987532 - DNA, 23 bp, Homo sapiens
gtctcacactcctcctgccagct

SEQ ID NO: 2987533 - DNA, 15 bp, Homo sapiens
gtctcacatttttac

SEQ ID NO: 2987534 - DNA, 23 bp, Homo sapiens
gtctcactgtgggaaggccagct

SEQ ID NO: 2987535 - DNA, 16 bp, Homo sapiens
gtctcaggaggaggct

SEQ ID NO: 2987536 - DNA, 19 bp, Homo sapiens
gtctcaggaggaggctgcc

SEQ ID NO: 2987537 - DNA, 22 bp, Homo sapiens
gtctcagtgattcgcttttggt

SEQ ID NO: 2987538 - DNA, 19 bp, Homo sapiens
gtctcattccgttgtctgt

SEQ ID NO: 2987539 - DNA, 20 bp, Homo sapiens
gtctcattccgttgtctgtg

SEQ ID NO: 2987540 - DNA, 23 bp, Homo sapiens
gtctcattttgtccatgtccccc

SEQ ID NO: 2987541 - DNA, 17 bp, Homo sapiens
gtctccagaagaaaatt

SEQ ID NO: 2987542 - DNA, 17 bp, Homo sapiens
gtctccagggcccccca

SEQ ID NO: 2987543 - DNA, 20 bp, Homo sapiens
gtctccagggccccccaact

SEQ ID NO: 2987544 - DNA, 18 bp, Homo sapiens
gtctcccctaccaggctg

SEQ ID NO: 2987545 - DNA, 19 bp, Homo sapiens
gtctccctctcctgcctac

SEQ ID NO: 2987546 - DNA, 21 bp, Homo sapiens
gtctcctaggggcttggtcct

SEQ ID NO: 2987547 - DNA, 12 bp, Homo sapiens
gtctcctcccct

SEQ ID NO: 2987548 - DNA, 20 bp, Homo sapiens
gtctcctcccctactctgcc

SEQ ID NO: 2987549 - DNA, 14 bp, Homo sapiens
gtctcctctcagct

SEQ ID NO: 2987550 - DNA, 16 bp, Homo sapiens
gtctcctctcagcttc

SEQ ID NO: 2987551 - DNA, 13 bp, Homo sapiens
gtctcctggacct

SEQ ID NO: 2987552 - DNA, 14 bp, Homo sapiens
gtctccttctcttc

SEQ ID NO: 2987553 - DNA, 18 bp, Homo sapiens
gtctccttctcttctctt

SEQ ID NO: 2987554 - DNA, 23 bp, Homo sapiens
gtctcgatgctgctggcctccct

SEQ ID NO: 2987555 - DNA, 11 bp, Homo sapiens
gtctcgcctgc

SEQ ID NO: 2987556 - DNA, 14 bp, Homo sapiens
gtctcgctctgtcg

SEQ ID NO: 2987557 - DNA, 23 bp, Homo sapiens
gtctcgggtggctagtcagagag

SEQ ID NO: 2987558 - DNA, 21 bp, Homo sapiens
gtctctaattctattaaagtg

SEQ ID NO: 2987559 - DNA, 17 bp, Homo sapiens
gtctctacccctttctg

SEQ ID NO: 2987560 - DNA, 22 bp, Homo sapiens
gtctctacttttccctgtactt

SEQ ID NO: 2987561 - DNA, 20 bp, Homo sapiens
gtctctatcattaaagttct

SEQ ID NO: 2987562 - DNA, 14 bp, Homo sapiens
gtctctatgtgaat

SEQ ID NO: 2987563 - DNA, 15 bp, Homo sapiens
gtctctatgtgaata

SEQ ID NO: 2987564 - DNA, 17 bp, Homo sapiens
gtctctcactgttgcag

SEQ ID NO: 2987565 - DNA, 13 bp, Homo sapiens
gtctctccagcct

SEQ ID NO: 2987566 - DNA, 14 bp, Homo sapiens
gtctctccagcctc

SEQ ID NO: 2987567 - DNA, 19 bp, Homo sapiens
gtctctccagcctcacaga

SEQ ID NO: 2987568 - DNA, 18 bp, Homo sapiens
gtctctccccctctgtct

SEQ ID NO: 2987569 - DNA, 18 bp, Homo sapiens
gtctctccttcctcttgg

SEQ ID NO: 2987570 - DNA, 12 bp, Homo sapiens
gtctctctgcct

SEQ ID NO: 2987571 - DNA, 14 bp, Homo sapiens
gtctctctgcctgc

SEQ ID NO: 2987572 - DNA, 19 bp, Homo sapiens
gtctctctgcctgctgggc

SEQ ID NO: 2987573 - DNA, 21 bp, Homo sapiens
gtctctctgcctgctgggctc

SEQ ID NO: 2987574 - DNA, 17 bp, Homo sapiens
gtctctcttgtcacatg

SEQ ID NO: 2987575 - DNA, 15 bp, Homo sapiens
gtctctgaacatcct

SEQ ID NO: 2987576 - DNA, 17 bp, Homo sapiens
gtctctgacaaagtgtg

SEQ ID NO: 2987577 - DNA, 19 bp, Homo sapiens
gtctctgcctggagcaggg

SEQ ID NO: 2987578 - DNA, 12 bp, Homo sapiens
gtctctgcttcc

SEQ ID NO: 2987579 - DNA, 13 bp, Homo sapiens
gtctctgcttcca

SEQ ID NO: 2987580 - DNA, 14 bp, Homo sapiens
gtctctgcttccat

SEQ ID NO: 2987581 - DNA, 17 bp, Homo sapiens
gtctctgcttccatggc

SEQ ID NO: 2987582 - DNA, 17 bp, Homo sapiens
gtctctggctcagctgt

SEQ ID NO: 2987583 - DNA, 19 bp, Homo sapiens
gtctctggctcagctgtgg

SEQ ID NO: 2987584 - DNA, 21 bp, Homo sapiens
gtctctggctcagctgtggtc

SEQ ID NO: 2987585 - DNA, 22 bp, Homo sapiens
gtctctgtgtaaccagctcagt

SEQ ID NO: 2987586 - DNA, 13 bp, Homo sapiens
gtctctgtttagt

SEQ ID NO: 2987587 - DNA, 22 bp, Homo sapiens
gtctcttcaagcatcctcagaa

SEQ ID NO: 2987588 - DNA, 20 bp, Homo sapiens
gtctcttcttggggcccagt

SEQ ID NO: 2987589 - DNA, 21 bp, Homo sapiens
gtctcttcttggggcccagtg

SEQ ID NO: 2987590 - DNA, 22 bp, Homo sapiens
gtctcttcttggggcccagtgc

SEQ ID NO: 2987591 - DNA, 20 bp, Homo sapiens
gtctcttgtgactcagcaga

SEQ ID NO: 2987592 - DNA, 11 bp, Homo sapiens
gtctgaacttt

SEQ ID NO: 2987593 - DNA, 14 bp, Homo sapiens
gtctgaagcagatg

SEQ ID NO: 2987594 - DNA, 15 bp, Homo sapiens
gtctgaagctcgcat

SEQ ID NO: 2987595 - DNA, 12 bp, Homo sapiens
gtctgacctggt

SEQ ID NO: 2987596 - DNA, 14 bp, Homo sapiens
gtctgacctggtgg

SEQ ID NO: 2987597 - DNA, 18 bp, Homo sapiens
gtctgacctggtgggagc

SEQ ID NO: 2987598 - DNA, 14 bp, Homo sapiens
gtctgagagaggcc

SEQ ID NO: 2987599 - DNA, 15 bp, Homo sapiens
gtctgagctgtccca

SEQ ID NO: 2987600 - DNA, 16 bp, Homo sapiens
gtctgagctgtcccaa

SEQ ID NO: 2987601 - DNA, 18 bp, Homo sapiens
gtctgagctgtcccaagt

SEQ ID NO: 2987602 - DNA, 15 bp, Homo sapiens
gtctgatcgacgtgg

SEQ ID NO: 2987603 - DNA, 22 bp, Homo sapiens
gtctgcaagattctgaaacatt

SEQ ID NO: 2987604 - DNA, 15 bp, Homo sapiens
gtctgcaagggccca

SEQ ID NO: 2987605 - DNA, 17 bp, Homo sapiens
gtctgcaagggcccaga

SEQ ID NO: 2987606 - DNA, 12 bp, Homo sapiens
gtctgcaggcag

SEQ ID NO: 2987607 - DNA, 13 bp, Homo sapiens
gtctgcaggcagg

SEQ ID NO: 2987608 - DNA, 21 bp, Homo sapiens
gtctgccaatttttgccttca

SEQ ID NO: 2987609 - DNA, 14 bp, Homo sapiens
gtctgccaggcccc

SEQ ID NO: 2987610 - DNA, 21 bp, Homo sapiens
gtctgccaggcccccaccaca

SEQ ID NO: 2987611 - DNA, 23 bp, Homo sapiens
gtctgccaggcccccaccacaca

SEQ ID NO: 2987612 - DNA, 11 bp, Homo sapiens
gtctgccaggg

SEQ ID NO: 2987613 - DNA, 11 bp, Homo sapiens
gtctgcctctt

SEQ ID NO: 2987614 - DNA, 13 bp, Homo sapiens
gtctgcctggagt

SEQ ID NO: 2987615 - DNA, 17 bp, Homo sapiens
gtgctaatattttattt

SEQ ID NO: 2987616 - DNA, 19 bp, Homo sapiens
gtgctaatattttatttga

SEQ ID NO: 2987617 - DNA, 22 bp, Homo sapiens
gtgctaatattttatttgaaaa

SEQ ID NO: 2987618 - DNA, 22 bp, Homo sapiens
gtgctaccagagttaaagcata

SEQ ID NO: 2987619 - DNA, 13 bp, Homo sapiens
gtgctagctttcc

SEQ ID NO: 2987620 - DNA, 15 bp, Homo sapiens
gtgctagtcactggc

SEQ ID NO: 2987621 - DNA, 13 bp, Homo sapiens
gtgctatgaattt

SEQ ID NO: 2987622 - DNA, 16 bp, Homo sapiens
gtgctatggtgctctg

SEQ ID NO: 2987623 - DNA, 19 bp, Homo sapiens
gtgctcaagcagcaaaatc

SEQ ID NO: 2987624 - DNA, 20 bp, Homo sapiens
gtgctcagagacctgaagtg

SEQ ID NO: 2987625 - DNA, 17 bp, Homo sapiens
gtgctcagtcgccctgt

SEQ ID NO: 2987626 - DNA, 19 bp, Homo sapiens
gtgctcagttgtagaatgt

SEQ ID NO: 2987627 - DNA, 16 bp, Homo sapiens
gtgctcatgtgtgtgg

SEQ ID NO: 2987628 - DNA, 17 bp, Homo sapiens
gtgctcatgtttggaaa

SEQ ID NO: 2987629 - DNA, 13 bp, Homo sapiens
gtgctccaacctg

SEQ ID NO: 2987630 - DNA, 17 bp, Homo sapiens
gtgctccatagagcagt

SEQ ID NO: 2987631 - DNA, 15 bp, Homo sapiens
gtgctccatctccgc

SEQ ID NO: 2987632 - DNA, 20 bp, Homo sapiens
gtgctccatctccgcctcca

SEQ ID NO: 2987633 - DNA, 16 bp, Homo sapiens
gtgctcccctctgaaa

SEQ ID NO: 2987634 - DNA, 22 bp, Homo sapiens
gtgctccctcccatcctccagc

SEQ ID NO: 2987635 - DNA, 14 bp, Homo sapiens
gtgctcgccccagc

SEQ ID NO: 2987636 - DNA, 16 bp, Homo sapiens
gtgctcgggaagggag

SEQ ID NO: 2987637 - DNA, 15 bp, Homo sapiens
gtgctctccaagccc

SEQ ID NO: 2987638 - DNA, 17 bp, Homo sapiens
gtgctctgaggcctcac

SEQ ID NO: 2987639 - DNA, 13 bp, Homo sapiens
gtgctctttcctg

SEQ ID NO: 2987640 - DNA, 18 bp, Homo sapiens
gtgctgacggccagggag

SEQ ID NO: 2987641 - DNA, 23 bp, Homo sapiens
gtgctgacggccagggagaagct

SEQ ID NO: 2987642 - DNA, 12 bp, Homo sapiens
gtgctgcctcta

SEQ ID NO: 2987643 - DNA, 19 bp, Homo sapiens
gtgctggaaagggagggag

SEQ ID NO: 2987644 - DNA, 15 bp, Homo sapiens
gtgctggcaaccact

SEQ ID NO: 2987645 - DNA, 22 bp, Homo sapiens
gtgctggcccacccagtccatg

SEQ ID NO: 2987646 - DNA, 18 bp, Homo sapiens
gtgctggcccagcatgga

SEQ ID NO: 2987647 - DNA, 14 bp, Homo sapiens
gtgctggcgacact

SEQ ID NO: 2987648 - DNA, 19 bp, Homo sapiens
gtgctggcgacactcaggg

SEQ ID NO: 2987649 - DNA, 23 bp, Homo sapiens
gtgctgggaggtataggggtcct

SEQ ID NO: 2987650 - DNA, 20 bp, Homo sapiens
gtgctgggattacaggcgtg

SEQ ID NO: 2987651 - DNA, 19 bp, Homo sapiens
gtgctggggagccaaaggc

SEQ ID NO: 2987652 - DNA, 20 bp, Homo sapiens
gtgctggtcccggggccagc

SEQ ID NO: 2987653 - DNA, 14 bp, Homo sapiens
gtgctggtttattt

SEQ ID NO: 2987654 - DNA, 12 bp, Homo sapiens
gtgctgtgtaaa

SEQ ID NO: 2987655 - DNA, 18 bp, Homo sapiens
gtgctgtgtaaagttagt

SEQ ID NO: 2987656 - DNA, 22 bp, Homo sapiens
gtgctgtgtaaagttagtctac

SEQ ID NO: 2987657 - DNA, 17 bp, Homo sapiens
gtgctgtttgggcagga

SEQ ID NO: 2987658 - DNA, 21 bp, Homo sapiens
gtgcttctagttctgccagga

SEQ ID NO: 2987659 - DNA, 21 bp, Homo sapiens
gtgcttcttgtaatatttctt

SEQ ID NO: 2987660 - DNA, 18 bp, Homo sapiens
gtgcttgatagaaatgcc

SEQ ID NO: 2987661 - DNA, 14 bp, Homo sapiens
gtgcttggccagga

SEQ ID NO: 2987662 - DNA, 13 bp, Homo sapiens
gtgcttgtgctca

SEQ ID NO: 2987663 - DNA, 13 bp, Homo sapiens
gtgcttgtgtaat

SEQ ID NO: 2987664 - DNA, 17 bp, Homo sapiens
gtgcttgtgtaatttat

SEQ ID NO: 2987665 - DNA, 18 bp, Homo sapiens
gtgcttgtgtaatttatg

SEQ ID NO: 2987666 - DNA, 16 bp, Homo sapiens
gtgctttgtggcttct

SEQ ID NO: 2987667 - DNA, 16 bp, Homo sapiens
gtggaaaacagggtgc

SEQ ID NO: 2987668 - DNA, 16 bp, Homo sapiens
gtggaaaggattctaa

SEQ ID NO: 2987669 - DNA, 19 bp, Homo sapiens
gtggaaaggattctaaaca

SEQ ID NO: 2987670 - DNA, 20 bp, Homo sapiens
gtggaaagtgtaaagcattc

SEQ ID NO: 2987671 - DNA, 23 bp, Homo sapiens
gtggaactacattagtacacagc

SEQ ID NO: 2987672 - DNA, 11 bp, Homo sapiens
gtggaagaaaa

SEQ ID NO: 2987673 - DNA, 17 bp, Homo sapiens
gtggaagagggctgcaa

SEQ ID NO: 2987674 - DNA, 13 bp, Homo sapiens
gtggaagccctcc

SEQ ID NO: 2987675 - DNA, 17 bp, Homo sapiens
gtggaagccctccttcc

SEQ ID NO: 2987676 - DNA, 16 bp, Homo sapiens
gtggaagtgttcctgt

SEQ ID NO: 2987677 - DNA, 20 bp, Homo sapiens
gtggaagtgttcctgtctca

SEQ ID NO: 2987678 - DNA, 21 bp, Homo sapiens
gtggaagtgttcctgtctcaa

SEQ ID NO: 2987679 - DNA, 22 bp, Homo sapiens
gtggaagtgttcctgtctcaat

SEQ ID NO: 2987680 - DNA, 19 bp, Homo sapiens
gtggaattattttaaaaga

SEQ ID NO: 2987681 - DNA, 19 bp, Homo sapiens
gtggacaagtcatggacat

SEQ ID NO: 2987682 - DNA, 21 bp, Homo sapiens
gtggacaagtcatggacattc

SEQ ID NO: 2987683 - DNA, 18 bp, Homo sapiens
gtggacagcgctgtattt

SEQ ID NO: 2987684 - DNA, 22 bp, Homo sapiens
gtggacaggatgaggacagagg

SEQ ID NO: 2987685 - DNA, 22 bp, Homo sapiens
gtggaccaaacccttagcagcc

SEQ ID NO: 2987686 - DNA, 14 bp, Homo sapiens
gtggaccaggacag

SEQ ID NO: 2987687 - DNA, 17 bp, Homo sapiens
gtggaccttaggccttc

SEQ ID NO: 2987688 - DNA, 17 bp, Homo sapiens
gtggactctgcacatgt

SEQ ID NO: 2987689 - DNA, 21 bp, Homo sapiens
gtggactgaccttgtaaaaga

SEQ ID NO: 2987690 - DNA, 12 bp, Homo sapiens
gtggacttctga

SEQ ID NO: 2987691 - DNA, 19 bp, Homo sapiens
gtggacttgaactttcctg

SEQ ID NO: 2987692 - DNA, 17 bp, Homo sapiens
gtggacttgttttaatt

SEQ ID NO: 2987693 - DNA, 17 bp, Homo sapiens
gtggagaaatgaaaagt

SEQ ID NO: 2987694 - DNA, 24 bp, Homo sapiens
gtggagaagcacactctggtcttg

SEQ ID NO: 2987695 - DNA, 20 bp, Homo sapiens
gtggagaagccattgtcttc

SEQ ID NO: 2987696 - DNA, 18 bp, Homo sapiens
gtggagacaatgtctgca

SEQ ID NO: 2987697 - DNA, 19 bp, Homo sapiens
gtggagacaatgtctgcag

SEQ ID NO: 2987698 - DNA, 22 bp, Homo sapiens
gtggagacaatgtctgcagccc

SEQ ID NO: 2987699 - DNA, 11 bp, Homo sapiens
gtggagacagc

SEQ ID NO: 2987700 - DNA, 17 bp, Homo sapiens
gtggagactttctgtta

SEQ ID NO: 2987701 - DNA, 18 bp, Homo sapiens
gtggagagaccagccttt

SEQ ID NO: 2987702 - DNA, 20 bp, Homo sapiens
gtggagagaccagcctttct

SEQ ID NO: 2987703 - DNA, 23 bp, Homo sapiens
gtggagagaccagcctttcttcc

SEQ ID NO: 2987704 - DNA, 22 bp, Homo sapiens
gtggagctgagaagaggaggag

SEQ ID NO: 2987705 - DNA, 20 bp, Homo sapiens
gtggaggagctgagggaggg

SEQ ID NO: 2987706 - DNA, 22 bp, Homo sapiens
gtggaggagctgagggagggag

SEQ ID NO: 2987707 - DNA, 21 bp, Homo sapiens
gtggaggttgagtgagccggg

SEQ ID NO: 2987708 - DNA, 19 bp, Homo sapiens
gtggaggttgcagtgagct

SEQ ID NO: 2987709 - DNA, 15 bp, Homo sapiens
gtggagtccagctct

SEQ ID NO: 2987710 - DNA, 14 bp, Homo sapiens
gtggagttcctgct

SEQ ID NO: 2987711 - DNA, 17 bp, Homo sapiens
gtggagtttccaacaga

SEQ ID NO: 2987712 - DNA, 14 bp, Homo sapiens
gtggatcacagagg

SEQ ID NO: 2987713 - DNA, 15 bp, Homo sapiens
gtggatgatgtttcg

SEQ ID NO: 2987714 - DNA, 15 bp, Homo sapiens
gtggatgctgtgcta

SEQ ID NO: 2987715 - DNA, 21 bp, Homo sapiens
gtggatgggttttatgagatg

SEQ ID NO: 2987716 - DNA, 18 bp, Homo sapiens
gtggatggtgacttttga

SEQ ID NO: 2987717 - DNA, 22 bp, Homo sapiens
gtggatgtctctgacaaagtgt

SEQ ID NO: 2987718 - DNA, 15 bp, Homo sapiens
gtggatgtgagcaga

SEQ ID NO: 2987719 - DNA, 18 bp, Homo sapiens
gtggattaaacttatgaa

SEQ ID NO: 2987720 - DNA, 15 bp, Homo sapiens
gtggatttttttgtc

SEQ ID NO: 2987721 - DNA, 17 bp, Homo sapiens
gtggcacgatctcagct

SEQ ID NO: 2987722 - DNA, 18 bp, Homo sapiens
gtggcactggggcagggg

SEQ ID NO: 2987723 - DNA, 20 bp, Homo sapiens
gtggcagctgcccctggcac

SEQ ID NO: 2987724 - DNA, 15 bp, Homo sapiens
gtggcagtttggcaa

SEQ ID NO: 2987725 - DNA, 18 bp, Homo sapiens
gtggcagtttttaaaatt

SEQ ID NO: 2987726 - DNA, 14 bp, Homo sapiens
gtggcatcacctta

SEQ ID NO: 2987727 - DNA, 14 bp, Homo sapiens
gtggcatccagagt

SEQ ID NO: 2987728 - DNA, 16 bp, Homo sapiens
gtggcatgcaaaagaa

SEQ ID NO: 2987729 - DNA, 14 bp, Homo sapiens
gtggcatggaaggg

SEQ ID NO: 2987730 - DNA, 21 bp, Homo sapiens
gtggcatttcaattcctggcc

SEQ ID NO: 2987731 - DNA, 19 bp, Homo sapiens
gtggccaccgggggtggct

SEQ ID NO: 2987732 - DNA, 15 bp, Homo sapiens
gtggccagcgccagg

SEQ ID NO: 2987733 - DNA, 18 bp, Homo sapiens
gtggccagcgccagggcc

SEQ ID NO: 2987734 - DNA, 21 bp, Homo sapiens
gtggccaggctgcctggcctt

SEQ ID NO: 2987735 - DNA, 23 bp, Homo sapiens
gtggccattctttttttcttggc

SEQ ID NO: 2987736 - DNA, 16 bp, Homo sapiens
gtggccccgccctcag

SEQ ID NO: 2987737 - DNA, 23 bp, Homo sapiens
gtggcccctgctgtctctctggg

SEQ ID NO: 2987738 - DNA, 18 bp, Homo sapiens
gtggccctggcctgctgg

SEQ ID NO: 2987739 - DNA, 18 bp, Homo sapiens
gtggccgcacgcctctcc

SEQ ID NO: 2987740 - DNA, 17 bp, Homo sapiens
gtggcctccttgcttgt

SEQ ID NO: 2987741 - DNA, 22 bp, Homo sapiens
gtggcctctgctggtctctggc

SEQ ID NO: 2987742 - DNA, 22 bp, Homo sapiens
gtggcctcttggataccagctc

SEQ ID NO: 2987743 - DNA, 13 bp, Homo sapiens
gtggcctgcccag

SEQ ID NO: 2987744 - DNA, 14 bp, Homo sapiens
gtggcctgcccagc

SEQ ID NO: 2987745 - DNA, 17 bp, Homo sapiens
gtggcctgcccagcctc

SEQ ID NO: 2987746 - DNA, 13 bp, Homo sapiens
gttcagagttttc

SEQ ID NO: 2987747 - DNA, 20 bp, Homo sapiens
gttcagcccctcctctgcca

SEQ ID NO: 2987748 - DNA, 22 bp, Homo sapiens
gttcagcccctcctctgccacc

SEQ ID NO: 2987749 - DNA, 13 bp, Homo sapiens
gttcagggagggg

SEQ ID NO: 2987750 - DNA, 22 bp, Homo sapiens
gttcagggaggggccggctggc

SEQ ID NO: 2987751 - DNA, 16 bp, Homo sapiens
gttcagtgtaaatagt

SEQ ID NO: 2987752 - DNA, 11 bp, Homo sapiens
gttcagttaca

SEQ ID NO: 2987753 - DNA, 13 bp, Homo sapiens
gttcagttacaga

SEQ ID NO: 2987754 - DNA, 15 bp, Homo sapiens
gttcagttacagaaa

SEQ ID NO: 2987755 - DNA, 16 bp, Homo sapiens
gttcagttccagcttt

SEQ ID NO: 2987756 - DNA, 19 bp, Homo sapiens
gttcatagatattggaaga

SEQ ID NO: 2987757 - DNA, 15 bp, Homo sapiens
gttcataggggcagg

SEQ ID NO: 2987758 - DNA, 16 bp, Homo sapiens
gttcatcatccctccc

SEQ ID NO: 2987759 - DNA, 19 bp, Homo sapiens
gttcatcatccctccctgc

SEQ ID NO: 2987760 - DNA, 21 bp, Homo sapiens
gttcatccatcatctgctgca

SEQ ID NO: 2987761 - DNA, 14 bp, Homo sapiens
gttcattccacagg

SEQ ID NO: 2987762 - DNA, 14 bp, Homo sapiens
gttcatttctgtct

SEQ ID NO: 2987763 - DNA, 19 bp, Homo sapiens
gttcatttttctctccctc

SEQ ID NO: 2987764 - DNA, 19 bp, Homo sapiens
gttccaaatgaatgttgtc

SEQ ID NO: 2987765 - DNA, 21 bp, Homo sapiens
gttccaacaaagaaaggtgcc

SEQ ID NO: 2987766 - DNA, 18 bp, Homo sapiens
gttccaagagtctaaaga

SEQ ID NO: 2987767 - DNA, 12 bp, Homo sapiens
gttccacagagt

SEQ ID NO: 2987768 - DNA, 20 bp, Homo sapiens
gttccacagagtaagacatt

SEQ ID NO: 2987769 - DNA, 14 bp, Homo sapiens
gttccagagctgct

SEQ ID NO: 2987770 - DNA, 17 bp, Homo sapiens
gttccagagctgcttct

SEQ ID NO: 2987771 - DNA, 19 bp, Homo sapiens
gttccagatacttcagctt

SEQ ID NO: 2987772 - DNA, 23 bp, Homo sapiens
gttccaggacacagattatcaac

SEQ ID NO: 2987773 - DNA, 19 bp, Homo sapiens
gttcccaaaacaatggtgt

SEQ ID NO: 2987774 - DNA, 19 bp, Homo sapiens
gttcccactgccctgggca

SEQ ID NO: 2987775 - DNA, 19 bp, Homo sapiens
gttcccattggatgcattt

SEQ ID NO: 2987776 - DNA, 23 bp, Homo sapiens
gttccccaccgctgagaggctgc

SEQ ID NO: 2987777 - DNA, 14 bp, Homo sapiens
gttccccagagaaa

SEQ ID NO: 2987778 - DNA, 12 bp, Homo sapiens
gttcccccatct

SEQ ID NO: 2987779 - DNA, 17 bp, Homo sapiens
gttccctgaaaacccag

SEQ ID NO: 2987780 - DNA, 20 bp, Homo sapiens
gttccctgaaaacccagaga

SEQ ID NO: 2987781 - DNA, 23 bp, Homo sapiens
gttcccttgaccattggctgcgc

SEQ ID NO: 2987782 - DNA, 17 bp, Homo sapiens
gttccgccaggcgctgc

SEQ ID NO: 2987783 - DNA, 17 bp, Homo sapiens
gttccggtccccacaga

SEQ ID NO: 2987784 - DNA, 22 bp, Homo sapiens
gttcctcaatggccttttgcta

SEQ ID NO: 2987785 - DNA, 13 bp, Homo sapiens
gttcctcgccctg

SEQ ID NO: 2987786 - DNA, 16 bp, Homo sapiens
gttcctcgccctgggt

SEQ ID NO: 2987787 - DNA, 13 bp, Homo sapiens
gttcctgctgcct

SEQ ID NO: 2987788 - DNA, 14 bp, Homo sapiens
gttcctgctgcctg

SEQ ID NO: 2987789 - DNA, 18 bp, Homo sapiens
gttcctgtctcaatagct

SEQ ID NO: 2987790 - DNA, 20 bp, Homo sapiens
gttcctgttcagtaataaaa

SEQ ID NO: 2987791 - DNA, 12 bp, Homo sapiens
gttcctgtttat

SEQ ID NO: 2987792 - DNA, 17 bp, Homo sapiens
gttcctttttaaatgtg

SEQ ID NO: 2987793 - DNA, 18 bp, Homo sapiens
gttcctttttaaatgtga

SEQ ID NO: 2987794 - DNA, 21 bp, Homo sapiens
gttcctttttcaacttggaaa

SEQ ID NO: 2987795 - DNA, 20 bp, Homo sapiens
gttcgcatggtcacacactg

SEQ ID NO: 2987796 - DNA, 15 bp, Homo sapiens
gttcggttccagaca

SEQ ID NO: 2987797 - DNA, 19 bp, Homo sapiens
gttcgtttcatcaggctct

SEQ ID NO: 2987798 - DNA, 15 bp, Homo sapiens
gttctaaaaagatgt

SEQ ID NO: 2987799 - DNA, 12 bp, Homo sapiens
gttctaaagttc

SEQ ID NO: 2987800 - DNA, 21 bp, Homo sapiens
gttctaaagttctaagattct

SEQ ID NO: 2987801 - DNA, 18 bp, Homo sapiens
gttctaaatatgaatgaa

SEQ ID NO: 2987802 - DNA, 20 bp, Homo sapiens
gttctaagactcaaatgttc

SEQ ID NO: 2987803 - DNA, 14 bp, Homo sapiens
gttctaagattcta

SEQ ID NO: 2987804 - DNA, 15 bp, Homo sapiens
gttctaagattctaa

SEQ ID NO: 2987805 - DNA, 11 bp, Homo sapiens
gttctaaggcc

SEQ ID NO: 2987806 - DNA, 13 bp, Homo sapiens
gttctaaggccta

SEQ ID NO: 2987807 - DNA, 14 bp, Homo sapiens
gttctaaggggacc

SEQ ID NO: 2987808 - DNA, 15 bp, Homo sapiens
gttctaagtttctaa

SEQ ID NO: 2987809 - DNA, 18 bp, Homo sapiens
gttctaagtttctaagat

SEQ ID NO: 2987810 - DNA, 19 bp, Homo sapiens
gttctaataatttctaatg

SEQ ID NO: 2987811 - DNA, 21 bp, Homo sapiens
gttctagacatggaggttcta

SEQ ID NO: 2987812 - DNA, 23 bp, Homo sapiens
gttctagacatggaggttctaag

SEQ ID NO: 2987813 - DNA, 22 bp, Homo sapiens
gttctaggtttcaaagatgctg

SEQ ID NO: 2987814 - DNA, 14 bp, Homo sapiens
gttctagttgcttg

SEQ ID NO: 2987815 - DNA, 12 bp, Homo sapiens
gttctatgttta

SEQ ID NO: 2987816 - DNA, 18 bp, Homo sapiens
gttctatttggaatttat

SEQ ID NO: 2987817 - DNA, 14 bp, Homo sapiens
gttctcaaatgtgt

SEQ ID NO: 2987818 - DNA, 15 bp, Homo sapiens
gttctcacagtgaca

SEQ ID NO: 2987819 - DNA, 19 bp, Homo sapiens
gttctcagcttgcagctgg

SEQ ID NO: 2987820 - DNA, 13 bp, Homo sapiens
gttctcagtgccg

SEQ ID NO: 2987821 - DNA, 19 bp, Homo sapiens
gttctcattcctgttcttt

SEQ ID NO: 2987822 - DNA, 16 bp, Homo sapiens
gttctccccctcctga

SEQ ID NO: 2987823 - DNA, 19 bp, Homo sapiens
gttctcctaatgctctgaa

SEQ ID NO: 2987824 - DNA, 12 bp, Homo sapiens
gttctcctgatt

SEQ ID NO: 2987825 - DNA, 16 bp, Homo sapiens
gttctctgtccagcag

SEQ ID NO: 2987826 - DNA, 16 bp, Homo sapiens
gttctgagctgccagt

SEQ ID NO: 2987827 - DNA, 14 bp, Homo sapiens
gttctgaggggtgt

SEQ ID NO: 2987828 - DNA, 23 bp, Homo sapiens
gttctgaggggtgtccgagaggc

SEQ ID NO: 2987829 - DNA, 13 bp, Homo sapiens
gttctgccaggag

SEQ ID NO: 2987830 - DNA, 17 bp, Homo sapiens
gttctgcctgccagctg

SEQ ID NO: 2987831 - DNA, 11 bp, Homo sapiens
gttctgcctta

SEQ ID NO: 2987832 - DNA, 19 bp, Homo sapiens
gttctgctagagcagacag

SEQ ID NO: 2987833 - DNA, 15 bp, Homo sapiens
gttctgcttttaagt

SEQ ID NO: 2987834 - DNA, 14 bp, Homo sapiens
gttctggggggacc

SEQ ID NO: 2987835 - DNA, 19 bp, Homo sapiens
gttctgtggaaagtgtaaa

SEQ ID NO: 2987836 - DNA, 18 bp, Homo sapiens
gttctgtttcaaggcact

SEQ ID NO: 2987837 - DNA, 22 bp, Homo sapiens
gttctgttttcgtaccttccca

SEQ ID NO: 2987838 - DNA, 22 bp, Homo sapiens
gttcttagattcaggggaaggg

SEQ ID NO: 2987839 - DNA, 23 bp, Homo sapiens
gttcttagattcaggggaagggc

SEQ ID NO: 2987840 - DNA, 15 bp, Homo sapiens
gttcttaggctgctg

SEQ ID NO: 2987841 - DNA, 18 bp, Homo sapiens
gttcttaggctgctggga

SEQ ID NO: 2987842 - DNA, 17 bp, Homo sapiens
gttcttatagaataaaa

SEQ ID NO: 2987843 - DNA, 23 bp, Homo sapiens
gttcttatagaataaaagctgtg

SEQ ID NO: 2987844 - DNA, 17 bp, Homo sapiens
gttcttcttcctgaagc

SEQ ID NO: 2987845 - DNA, 20 bp, Homo sapiens
gttcttgaggtctcttttct

SEQ ID NO: 2987846 - DNA, 23 bp, Homo sapiens
gttctttaaaatgtaaagccatg

SEQ ID NO: 2987847 - DNA, 11 bp, Homo sapiens
gttctttatat

SEQ ID NO: 2987848 - DNA, 20 bp, Homo sapiens
gttctttatatacaataatg

SEQ ID NO: 2987849 - DNA, 21 bp, Homo sapiens
gttctttatatacaataatgg

SEQ ID NO: 2987850 - DNA, 22 bp, Homo sapiens
gttctttatatacaataatgga

SEQ ID NO: 2987851 - DNA, 16 bp, Homo sapiens
gttctttgcaagctta

SEQ ID NO: 2987852 - DNA, 16 bp, Homo sapiens
gttctttgccagagac

SEQ ID NO: 2987853 - DNA, 16 bp, Homo sapiens
gttctttgggccagac

SEQ ID NO: 2987854 - DNA, 15 bp, Homo sapiens
gttctttgttcctgc

SEQ ID NO: 2987855 - DNA, 19 bp, Homo sapiens
gttcttttttgtacagtat

SEQ ID NO: 2987856 - DNA, 13 bp, Homo sapiens
gttgaatactttt

SEQ ID NO: 2987857 - DNA, 21 bp, Homo sapiens
gttgaataggaaataaaatta

SEQ ID NO: 2987858 - DNA, 14 bp, Homo sapiens
gttgaatgctgctt

SEQ ID NO: 2987859 - DNA, 19 bp, Homo sapiens
gttgacacagttgtagggt

SEQ ID NO: 2987860 - DNA, 22 bp, Homo sapiens
gttgacataccttttatttttt

SEQ ID NO: 2987861 - DNA, 14 bp, Homo sapiens
gttgacatatttaa

SEQ ID NO: 2987862 - DNA, 20 bp, Homo sapiens
gttgacatatttaatgtttt

SEQ ID NO: 2987863 - DNA, 13 bp, Homo sapiens
gttgaccactcca

SEQ ID NO: 2987864 - DNA, 14 bp, Homo sapiens
gttgaccccagagg

SEQ ID NO: 2987865 - DNA, 15 bp, Homo sapiens
gttgaccccagagga

SEQ ID NO: 2987866 - DNA, 18 bp, Homo sapiens
gttgactcaagtttttac

SEQ ID NO: 2987867 - DNA, 16 bp, Homo sapiens
gttgagaatcccaaat

SEQ ID NO: 2987868 - DNA, 19 bp, Homo sapiens
gttgagaatcccaaatttg

SEQ ID NO: 2987869 - DNA, 21 bp, Homo sapiens
gttgagagctttctgccttag

SEQ ID NO: 2987870 - DNA, 15 bp, Homo sapiens
gttgagagtgtgacc

SEQ ID NO: 2987871 - DNA, 22 bp, Homo sapiens
gttgagcatagagaacaaagta

SEQ ID NO: 2987872 - DNA, 21 bp, Homo sapiens
gttgagttcaggtagctgccc

SEQ ID NO: 2987873 - DNA, 14 bp, Homo sapiens
gttgataactttgc

SEQ ID NO: 2987874 - DNA, 13 bp, Homo sapiens
gttgataatttca

SEQ ID NO: 2987875 - DNA, 23 bp, Homo sapiens
gttgatagcaagtgaatttttct

SEQ ID NO: 2987876 - DNA, 23 bp, Homo sapiens
gttgatatcggtgctatgtgttt

SEQ ID NO: 2987877 - DNA, 22 bp, Homo sapiens
gttgatcatgtactttttagta

SEQ ID NO: 2987878 - DNA, 17 bp, Homo sapiens
taaaatcttcagctggt

SEQ ID NO: 2987879 - DNA, 18 bp, Homo sapiens
taaaatcttcagctggtg

SEQ ID NO: 2987880 - DNA, 21 bp, Homo sapiens
taaaatctttctttggggaaa

SEQ ID NO: 2987881 - DNA, 13 bp, Homo sapiens
taaaatgcaatca

SEQ ID NO: 2987882 - DNA, 15 bp, Homo sapiens
taaaatgcaatgtaa

SEQ ID NO: 2987883 - DNA, 18 bp, Homo sapiens
taaaatgcccatttcgaa

SEQ ID NO: 2987884 - DNA, 19 bp, Homo sapiens
taaaatgctcaatttcagc

SEQ ID NO: 2987885 - DNA, 14 bp, Homo sapiens
taaaatgtcttcaa

SEQ ID NO: 2987886 - DNA, 20 bp, Homo sapiens
taaaatgtgatgttctaagg

SEQ ID NO: 2987887 - DNA, 21 bp, Homo sapiens
taaaatgtgatgttctaaggc

SEQ ID NO: 2987888 - DNA, 17 bp, Homo sapiens
taaaatgttcacttttg

SEQ ID NO: 2987889 - DNA, 22 bp, Homo sapiens
taaaatgttcacttttgacaaa

SEQ ID NO: 2987890 - DNA, 16 bp, Homo sapiens
taaaatgttccttttg

SEQ ID NO: 2987891 - DNA, 19 bp, Homo sapiens
taaaatgttggtgcaatta

SEQ ID NO: 2987892 - DNA, 14 bp, Homo sapiens
taaaattaaagcta

SEQ ID NO: 2987893 - DNA, 18 bp, Homo sapiens
taaaattaagtagaacaa

SEQ ID NO: 2987894 - DNA, 13 bp, Homo sapiens
taaaattacaact

SEQ ID NO: 2987895 - DNA, 15 bp, Homo sapiens
taaaattacaactaa

SEQ ID NO: 2987896 - DNA, 15 bp, Homo sapiens
taaaattatatagca

SEQ ID NO: 2987897 - DNA, 16 bp, Homo sapiens
taaaattatatagcaa

SEQ ID NO: 2987898 - DNA, 19 bp, Homo sapiens
taaaattatatagcaaaga

SEQ ID NO: 2987899 - DNA, 22 bp, Homo sapiens
taaaattatatagcaaagatat

SEQ ID NO: 2987900 - DNA, 22 bp, Homo sapiens
taaaattcaaaaacaaaattag

SEQ ID NO: 2987901 - DNA, 13 bp, Homo sapiens
taaaattgctaac

SEQ ID NO: 2987902 - DNA, 12 bp, Homo sapiens
taaaatttacag

SEQ ID NO: 2987903 - DNA, 21 bp, Homo sapiens
taaaatttacagtcaatctat

SEQ ID NO: 2987904 - DNA, 17 bp, Homo sapiens
taaaatttacatttaat

SEQ ID NO: 2987905 - DNA, 21 bp, Homo sapiens
taaaatttacatttaatacag

SEQ ID NO: 2987906 - DNA, 15 bp, Homo sapiens
taaaatttgttgcat

SEQ ID NO: 2987907 - DNA, 16 bp, Homo sapiens
taaaatttttttggtc

SEQ ID NO: 2987908 - DNA, 20 bp, Homo sapiens
taaaattttttttcatgttt

SEQ ID NO: 2987909 - DNA, 11 bp, Homo sapiens
taaacaaaagt

SEQ ID NO: 2987910 - DNA, 18 bp, Homo sapiens
taaacaaaagtgtacctg

SEQ ID NO: 2987911 - DNA, 19 bp, Homo sapiens
taaacaaaagtgtacctgt

SEQ ID NO: 2987912 - DNA, 13 bp, Homo sapiens
taaacacattttg

SEQ ID NO: 2987913 - DNA, 18 bp, Homo sapiens
taaacacgcctgcaaacg

SEQ ID NO: 2987914 - DNA, 19 bp, Homo sapiens
taaacagaaatgctctgat

SEQ ID NO: 2987915 - DNA, 21 bp, Homo sapiens
taaacagaaatgctctgatta

SEQ ID NO: 2987916 - DNA, 12 bp, Homo sapiens
taaacagaagca

SEQ ID NO: 2987917 - DNA, 23 bp, Homo sapiens
taaacagaataaaagttcctctc

SEQ ID NO: 2987918 - DNA, 17 bp, Homo sapiens
taaacagatgtccctga

SEQ ID NO: 2987919 - DNA, 21 bp, Homo sapiens
taaacagcagggtttgagcac

SEQ ID NO: 2987920 - DNA, 12 bp, Homo sapiens
taaacagggtct

SEQ ID NO: 2987921 - DNA, 17 bp, Homo sapiens
taaacagtgcctgctga

SEQ ID NO: 2987922 - DNA, 18 bp, Homo sapiens
taaacattgaagtaatga

SEQ ID NO: 2987923 - DNA, 16 bp, Homo sapiens
taaaccaaaaactgaa

SEQ ID NO: 2987924 - DNA, 18 bp, Homo sapiens
taaaccaaatatgttaaa

SEQ ID NO: 2987925 - DNA, 22 bp, Homo sapiens
taaaccaaatatgttaaagttt

SEQ ID NO: 2987926 - DNA, 20 bp, Homo sapiens
taaaccactaatgcttgcca

SEQ ID NO: 2987927 - DNA, 14 bp, Homo sapiens
taaaccaggaaaaa

SEQ ID NO: 2987928 - DNA, 15 bp, Homo sapiens
taaaccctatctgtg

SEQ ID NO: 2987929 - DNA, 15 bp, Homo sapiens
taaacctcagttatt

SEQ ID NO: 2987930 - DNA, 19 bp, Homo sapiens
taaacctgtttttttttca

SEQ ID NO: 2987931 - DNA, 16 bp, Homo sapiens
taaaccttgtcaataa

SEQ ID NO: 2987932 - DNA, 13 bp, Homo sapiens
taaacctttccat

SEQ ID NO: 2987933 - DNA, 16 bp, Homo sapiens
taaacctttttcttga

SEQ ID NO: 2987934 - DNA, 22 bp, Homo sapiens
taaacgatttaattctcttgaa

SEQ ID NO: 2987935 - DNA, 14 bp, Homo sapiens
taaacgtaaatgtt

SEQ ID NO: 2987936 - DNA, 18 bp, Homo sapiens
taaacgtaagcactgttt

SEQ ID NO: 2987937 - DNA, 15 bp, Homo sapiens
taaacgtatgcatgt

SEQ ID NO: 2987938 - DNA, 20 bp, Homo sapiens
taaacgtatgcatgtgaaga

SEQ ID NO: 2987939 - DNA, 18 bp, Homo sapiens
taaacgttaaaagtgtac

SEQ ID NO: 2987940 - DNA, 18 bp, Homo sapiens
taaactaaccttttatca

SEQ ID NO: 2987941 - DNA, 22 bp, Homo sapiens
taaactactatttttctttcca

SEQ ID NO: 2987942 - DNA, 14 bp, Homo sapiens
taaactagatgacc

SEQ ID NO: 2987943 - DNA, 11 bp, Homo sapiens
taaactgaagc

SEQ ID NO: 2987944 - DNA, 20 bp, Homo sapiens
taaactggtatgaataattg

SEQ ID NO: 2987945 - DNA, 12 bp, Homo sapiens
taaactgtgcac

SEQ ID NO: 2987946 - DNA, 13 bp, Homo sapiens
taaactgttgctc

SEQ ID NO: 2987947 - DNA, 14 bp, Homo sapiens
taaacttatgaatg

SEQ ID NO: 2987948 - DNA, 17 bp, Homo sapiens
taaacttatgaatgttt

SEQ ID NO: 2987949 - DNA, 20 bp, Homo sapiens
taaagaaaaatatcttggcc

SEQ ID NO: 2987950 - DNA, 18 bp, Homo sapiens
taaagaaaagcctcagct

SEQ ID NO: 2987951 - DNA, 19 bp, Homo sapiens
taaagaaaagcctcagctc

SEQ ID NO: 2987952 - DNA, 19 bp, Homo sapiens
taaagaaaatatctgaaat

SEQ ID NO: 2987953 - DNA, 15 bp, Homo sapiens
taaagaaagagagaa

SEQ ID NO: 2987954 - DNA, 22 bp, Homo sapiens
taaagaaagagagaaaataaaa

SEQ ID NO: 2987955 - DNA, 16 bp, Homo sapiens
taaagaaagcaacttt

SEQ ID NO: 2987956 - DNA, 10 bp, Homo sapiens
taaagaaatt

SEQ ID NO: 2987957 - DNA, 14 bp, Homo sapiens
taaagaactgcaca

SEQ ID NO: 2987958 - DNA, 21 bp, Homo sapiens
taaagaagcaataaagaagag

SEQ ID NO: 2987959 - DNA, 13 bp, Homo sapiens
taaagaatacttg

SEQ ID NO: 2987960 - DNA, 20 bp, Homo sapiens
taaagaatacttgaacttgt

SEQ ID NO: 2987961 - DNA, 19 bp, Homo sapiens
taaagaatatgacttttta

SEQ ID NO: 2987962 - DNA, 11 bp, Homo sapiens
taaagacaaag

SEQ ID NO: 2987963 - DNA, 22 bp, Homo sapiens
taaagacaaagacaaattctgt

SEQ ID NO: 2987964 - DNA, 15 bp, Homo sapiens
taaagacacctggtt

SEQ ID NO: 2987965 - DNA, 9 bp, Homo sapiens
taaagacag

SEQ ID NO: 2987966 - DNA, 14 bp, Homo sapiens
taaagactggcttt

SEQ ID NO: 2987967 - DNA, 15 bp, Homo sapiens
taaagactggctttt

SEQ ID NO: 2987968 - DNA, 15 bp, Homo sapiens
taaagagataaagaa

SEQ ID NO: 2987969 - DNA, 20 bp, Homo sapiens
taaagaggcgttgctttcac

SEQ ID NO: 2987970 - DNA, 18 bp, Homo sapiens
taaagagtagccattctt

SEQ ID NO: 2987971 - DNA, 19 bp, Homo sapiens
taaagagtctagattcaaa

SEQ ID NO: 2987972 - DNA, 22 bp, Homo sapiens
taaagatatttttattcaaact

SEQ ID NO: 2987973 - DNA, 17 bp, Homo sapiens
taaagatgattgttctt

SEQ ID NO: 2987974 - DNA, 13 bp, Homo sapiens
taaagatggaaaa

SEQ ID NO: 2987975 - DNA, 17 bp, Homo sapiens
taaagatggagtttcta

SEQ ID NO: 2987976 - DNA, 14 bp, Homo sapiens
taaagatgggagga

SEQ ID NO: 2987977 - DNA, 13 bp, Homo sapiens
taaagatgtgaaa

SEQ ID NO: 2987978 - DNA, 16 bp, Homo sapiens
taaagatgtgaaaact

SEQ ID NO: 2987979 - DNA, 19 bp, Homo sapiens
taaagattctatagttcta

SEQ ID NO: 2987980 - DNA, 20 bp, Homo sapiens
taaagattctatagttctag

SEQ ID NO: 2987981 - DNA, 24 bp, Homo sapiens
taaagattctatagttctagacat

SEQ ID NO: 2987982 - DNA, 19 bp, Homo sapiens
taaagcaaaccagcctcag

SEQ ID NO: 2987983 - DNA, 21 bp, Homo sapiens
taaagcaaagtcacttctcca

SEQ ID NO: 2987984 - DNA, 16 bp, Homo sapiens
taaagcaataaaattt

SEQ ID NO: 2987985 - DNA, 15 bp, Homo sapiens
taaagcaatatgcat

SEQ ID NO: 2987986 - DNA, 20 bp, Homo sapiens
taaagcactattgtttagat

SEQ ID NO: 2987987 - DNA, 16 bp, Homo sapiens
taaagcagcttatgtt

SEQ ID NO: 2987988 - DNA, 16 bp, Homo sapiens
taaagcattccaacaa

SEQ ID NO: 2987989 - DNA, 12 bp, Homo sapiens
taaagccaagaa

SEQ ID NO: 2987990 - DNA, 13 bp, Homo sapiens
taaagccaagaat

SEQ ID NO: 2987991 - DNA, 10 bp, Homo sapiens
taaagccagt

SEQ ID NO: 2987992 - DNA, 13 bp, Homo sapiens
taaagccagtcat

SEQ ID NO: 2987993 - DNA, 14 bp, Homo sapiens
taaagctctgacat

SEQ ID NO: 2987994 - DNA, 16 bp, Homo sapiens
taaagctgttattctt

SEQ ID NO: 2987995 - DNA, 14 bp, Homo sapiens
taaagctgttctca

SEQ ID NO: 2987996 - DNA, 11 bp, Homo sapiens
taaagcttgtc

SEQ ID NO: 2987997 - DNA, 13 bp, Homo sapiens
taaaggaaaagca

SEQ ID NO: 2987998 - DNA, 16 bp, Homo sapiens
taaaggaaaagcacaa

SEQ ID NO: 2987999 - DNA, 12 bp, Homo sapiens
taaaggatgagg

SEQ ID NO: 2988000 - DNA, 16 bp, Homo sapiens
taaaggatgctgctgt

SEQ ID NO: 2988001 - DNA, 14 bp, Homo sapiens
taaaggatggaaaa

SEQ ID NO: 2988002 - DNA, 16 bp, Homo sapiens
taaaggatgtgattgt

SEQ ID NO: 2988003 - DNA, 22 bp, Homo sapiens
taaaggatgtgattgtggaatg

SEQ ID NO: 2988004 - DNA, 20 bp, Homo sapiens
taaaggcagtccagagcttt

SEQ ID NO: 2988005 - DNA, 15 bp, Homo sapiens
taaaggcattccaca

SEQ ID NO: 2988006 - DNA, 16 bp, Homo sapiens
taaaggcattccacag

SEQ ID NO: 2988007 - DNA, 19 bp, Homo sapiens
taaaggcattccacaggat

SEQ ID NO: 2988008 - DNA, 22 bp, Homo sapiens
taaaggcctttaataagtcatt

SEQ ID NO: 2988009 - DNA, 15 bp, Homo sapiens
taaagggataaagaa

SEQ ID NO: 2988010 - DNA, 22 bp, Homo sapiens
taaaggtccacaggtctagact

SEQ ID NO: 2988011 - DNA, 13 bp, Homo sapiens
taaaggtggattt

SEQ ID NO: 2988012 - DNA, 19 bp, Homo sapiens
taagttcctgctgcctggg

SEQ ID NO: 2988013 - DNA, 20 bp, Homo sapiens
taagttcctgctgcctgggt

SEQ ID NO: 2988014 - DNA, 18 bp, Homo sapiens
taagttcgaacatgtttc

SEQ ID NO: 2988015 - DNA, 18 bp, Homo sapiens
taagttgtaaaatgtcaa

SEQ ID NO: 2988016 - DNA, 19 bp, Homo sapiens
taagtttaactttaaaact

SEQ ID NO: 2988017 - DNA, 18 bp, Homo sapiens
taagtttctaagattcta

SEQ ID NO: 2988018 - DNA, 19 bp, Homo sapiens
taagtttctaagattctaa

SEQ ID NO: 2988019 - DNA, 20 bp, Homo sapiens
taagtttctaagattctaaa

SEQ ID NO: 2988020 - DNA, 21 bp, Homo sapiens
taagtttctaagattctaaag

SEQ ID NO: 2988021 - DNA, 23 bp, Homo sapiens
taagtttctaagattctaaaggt

SEQ ID NO: 2988022 - DNA, 21 bp, Homo sapiens
taataaaaaacaagaaaccaa

SEQ ID NO: 2988023 - DNA, 14 bp, Homo sapiens
taataaaaagaaag

SEQ ID NO: 2988024 - DNA, 13 bp, Homo sapiens
taataaaaaggca

SEQ ID NO: 2988025 - DNA, 21 bp, Homo sapiens
taataaaaatgacagactgaa

SEQ ID NO: 2988026 - DNA, 14 bp, Homo sapiens
taataaaaattgta

SEQ ID NO: 2988027 - DNA, 13 bp, Homo sapiens
taataaaatactt

SEQ ID NO: 2988028 - DNA, 20 bp, Homo sapiens
taataaacgaagataaatca

SEQ ID NO: 2988029 - DNA, 13 bp, Homo sapiens
taataaagacagg

SEQ ID NO: 2988030 - DNA, 12 bp, Homo sapiens
taataaagtact

SEQ ID NO: 2988031 - DNA, 17 bp, Homo sapiens
taataataattgaagaa

SEQ ID NO: 2988032 - DNA, 18 bp, Homo sapiens
taataatcattttagaat

SEQ ID NO: 2988033 - DNA, 15 bp, Homo sapiens
taataattgaagaat

SEQ ID NO: 2988034 - DNA, 21 bp, Homo sapiens
taatacagataagtgttcttc

SEQ ID NO: 2988035 - DNA, 13 bp, Homo sapiens
taatacctctgtg

SEQ ID NO: 2988036 - DNA, 14 bp, Homo sapiens
taatacctctgtgt

SEQ ID NO: 2988037 - DNA, 14 bp, Homo sapiens
taatactaccttga

SEQ ID NO: 2988038 - DNA, 14 bp, Homo sapiens
taatactgctgaga

SEQ ID NO: 2988039 - DNA, 21 bp, Homo sapiens
taatactggtatttttactta

SEQ ID NO: 2988040 - DNA, 19 bp, Homo sapiens
taatactggttatcctgtg

SEQ ID NO: 2988041 - DNA, 20 bp, Homo sapiens
taatagaaataaattcctaa

SEQ ID NO: 2988042 - DNA, 14 bp, Homo sapiens
taatagaggagctg

SEQ ID NO: 2988043 - DNA, 17 bp, Homo sapiens
taatagaggagctgctt

SEQ ID NO: 2988044 - DNA, 12 bp, Homo sapiens
taatagctcaga

SEQ ID NO: 2988045 - DNA, 18 bp, Homo sapiens
taatagcttttgattagt

SEQ ID NO: 2988046 - DNA, 13 bp, Homo sapiens
taatagtgttaat

SEQ ID NO: 2988047 - DNA, 20 bp, Homo sapiens
taatagtgttaatcaattta

SEQ ID NO: 2988048 - DNA, 20 bp, Homo sapiens
taatataagtttctttagaa

SEQ ID NO: 2988049 - DNA, 13 bp, Homo sapiens
taatatatcaata

SEQ ID NO: 2988050 - DNA, 17 bp, Homo sapiens
taatatattttctgttt

SEQ ID NO: 2988051 - DNA, 22 bp, Homo sapiens
taatatccaggtcaacagaatg

SEQ ID NO: 2988052 - DNA, 15 bp, Homo sapiens
taatatctaaagtta

SEQ ID NO: 2988053 - DNA, 16 bp, Homo sapiens
taatatctaaagttat

SEQ ID NO: 2988054 - DNA, 21 bp, Homo sapiens
taatatctaaagttatatttc

SEQ ID NO: 2988055 - DNA, 17 bp, Homo sapiens
taatatgctttttactc

SEQ ID NO: 2988056 - DNA, 22 bp, Homo sapiens
taatatggccacagtagtcttg

SEQ ID NO: 2988057 - DNA, 11 bp, Homo sapiens
taatatgttga

SEQ ID NO: 2988058 - DNA, 12 bp, Homo sapiens
taatattaaaag

SEQ ID NO: 2988059 - DNA, 19 bp, Homo sapiens
taatattgagaaagaaact

SEQ ID NO: 2988060 - DNA, 21 bp, Homo sapiens
taatattgtattgctgctgtg

SEQ ID NO: 2988061 - DNA, 23 bp, Homo sapiens
taatattgtattgctgctgtgcg

SEQ ID NO: 2988062 - DNA, 17 bp, Homo sapiens
taatatttcttaatttg

SEQ ID NO: 2988063 - DNA, 13 bp, Homo sapiens
taatatttcttca

SEQ ID NO: 2988064 - DNA, 22 bp, Homo sapiens
taatatttcttcaagtgagtgg

SEQ ID NO: 2988065 - DNA, 22 bp, Homo sapiens
taatatttgaagcagctctgcc

SEQ ID NO: 2988066 - DNA, 14 bp, Homo sapiens
taatatttgtgctt

SEQ ID NO: 2988067 - DNA, 18 bp, Homo sapiens
taatatttgtgctttgaa

SEQ ID NO: 2988068 - DNA, 19 bp, Homo sapiens
taatatttgtgctttgaaa

SEQ ID NO: 2988069 - DNA, 12 bp, Homo sapiens
taatattttatt

SEQ ID NO: 2988070 - DNA, 19 bp, Homo sapiens
taatattttatttgaaaaa

SEQ ID NO: 2988071 - DNA, 13 bp, Homo sapiens
taatattttgcac

SEQ ID NO: 2988072 - DNA, 18 bp, Homo sapiens
taatcaagagtctctcca

SEQ ID NO: 2988073 - DNA, 19 bp, Homo sapiens
taatcaagagtctctccag

SEQ ID NO: 2988074 - DNA, 21 bp, Homo sapiens
taatcaagagtctctccagcc

SEQ ID NO: 2988075 - DNA, 20 bp, Homo sapiens
taatcaagtacctatattga

SEQ ID NO: 2988076 - DNA, 14 bp, Homo sapiens
taatcaatgtgaca

SEQ ID NO: 2988077 - DNA, 20 bp, Homo sapiens
taatcaatttaaacccattt

SEQ ID NO: 2988078 - DNA, 17 bp, Homo sapiens
taatcactccaaccctg

SEQ ID NO: 2988079 - DNA, 18 bp, Homo sapiens
taatcagctgttgcaggc

SEQ ID NO: 2988080 - DNA, 21 bp, Homo sapiens
taatcagctgttgcaggcagt

SEQ ID NO: 2988081 - DNA, 21 bp, Homo sapiens
taatcagtgactgaaaccatt

SEQ ID NO: 2988082 - DNA, 13 bp, Homo sapiens
taatcataacata

SEQ ID NO: 2988083 - DNA, 22 bp, Homo sapiens
taatcataacatagttgaaaaa

SEQ ID NO: 2988084 - DNA, 17 bp, Homo sapiens
taatcatatttgaaaac

SEQ ID NO: 2988085 - DNA, 22 bp, Homo sapiens
taatcatatttgaaaaccatat

SEQ ID NO: 2988086 - DNA, 13 bp, Homo sapiens
taatcatgaaatt

SEQ ID NO: 2988087 - DNA, 15 bp, Homo sapiens
taatcatgagcctgt

SEQ ID NO: 2988088 - DNA, 17 bp, Homo sapiens
taatcattagttttaga

SEQ ID NO: 2988089 - DNA, 19 bp, Homo sapiens
taatcatttgtttacattt

SEQ ID NO: 2988090 - DNA, 21 bp, Homo sapiens
taatcattttagaattaaaat

SEQ ID NO: 2988091 - DNA, 13 bp, Homo sapiens
taatcattttcat

SEQ ID NO: 2988092 - DNA, 17 bp, Homo sapiens
taatccaggcagatcca

SEQ ID NO: 2988093 - DNA, 14 bp, Homo sapiens
taatcccagcactt

SEQ ID NO: 2988094 - DNA, 20 bp, Homo sapiens
taatcccagctactcaggag

SEQ ID NO: 2988095 - DNA, 17 bp, Homo sapiens
taatcctattgtacgct

SEQ ID NO: 2988096 - DNA, 20 bp, Homo sapiens
taatcgtcttcaaattaaag

SEQ ID NO: 2988097 - DNA, 21 bp, Homo sapiens
taatcgtcttcaaattaaagt

SEQ ID NO: 2988098 - DNA, 13 bp, Homo sapiens
taatctcaatgca

SEQ ID NO: 2988099 - DNA, 15 bp, Homo sapiens
taatctcaatgcaag

SEQ ID NO: 2988100 - DNA, 22 bp, Homo sapiens
taatctcacaaaacatatttta

SEQ ID NO: 2988101 - DNA, 14 bp, Homo sapiens
taatctgttgtttg

SEQ ID NO: 2988102 - DNA, 17 bp, Homo sapiens
taatcttaaatcagaat

SEQ ID NO: 2988103 - DNA, 14 bp, Homo sapiens
taatcttgctctgc

SEQ ID NO: 2988104 - DNA, 16 bp, Homo sapiens
taatcttttacattga

SEQ ID NO: 2988105 - DNA, 13 bp, Homo sapiens
taatctttttctc

SEQ ID NO: 2988106 - DNA, 17 bp, Homo sapiens
taatgaaataatcagtg

SEQ ID NO: 2988107 - DNA, 13 bp, Homo sapiens
taatgaacaaatg

SEQ ID NO: 2988108 - DNA, 14 bp, Homo sapiens
taatgaacaaatgg

SEQ ID NO: 2988109 - DNA, 15 bp, Homo sapiens
taatgaattgaaatt

SEQ ID NO: 2988110 - DNA, 21 bp, Homo sapiens
taatgaatttttatgatattc

SEQ ID NO: 2988111 - DNA, 16 bp, Homo sapiens
taatgacacaccttgg

SEQ ID NO: 2988112 - DNA, 23 bp, Homo sapiens
taatgagacttgagtctattttt

SEQ ID NO: 2988113 - DNA, 23 bp, Homo sapiens
taatgaggagagaaaatatatgt

SEQ ID NO: 2988114 - DNA, 14 bp, Homo sapiens
taatgatcttggac

SEQ ID NO: 2988115 - DNA, 22 bp, Homo sapiens
taatgatgttatcttaacactg

SEQ ID NO: 2988116 - DNA, 23 bp, Homo sapiens
taatgatgttatcttaacactga

SEQ ID NO: 2988117 - DNA, 21 bp, Homo sapiens
taatgatgttgataatttcag

SEQ ID NO: 2988118 - DNA, 17 bp, Homo sapiens
taatgatttttgtgtat

SEQ ID NO: 2988119 - DNA, 13 bp, Homo sapiens
taatgcactttct

SEQ ID NO: 2988120 - DNA, 15 bp, Homo sapiens
taatgcagaagtatt

SEQ ID NO: 2988121 - DNA, 20 bp, Homo sapiens
taatgccattttaaggaaaa

SEQ ID NO: 2988122 - DNA, 13 bp, Homo sapiens
taatgcccagcca

SEQ ID NO: 2988123 - DNA, 14 bp, Homo sapiens
taatgcccagccag

SEQ ID NO: 2988124 - DNA, 18 bp, Homo sapiens
taatgcctataacttttt

SEQ ID NO: 2988125 - DNA, 15 bp, Homo sapiens
taatgcgattttatt

SEQ ID NO: 2988126 - DNA, 17 bp, Homo sapiens
taatgctaaatgtgtaa

SEQ ID NO: 2988127 - DNA, 18 bp, Homo sapiens
taatgctaaatgtgtaat

SEQ ID NO: 2988128 - DNA, 22 bp, Homo sapiens
taatgctaaatgtgtaataatg

SEQ ID NO: 2988129 - DNA, 16 bp, Homo sapiens
taatgctacgtgtgat

SEQ ID NO: 2988130 - DNA, 17 bp, Homo sapiens
taatgctacgtgtgatt

SEQ ID NO: 2988131 - DNA, 17 bp, Homo sapiens
taatgctatttgaacaa

SEQ ID NO: 2988132 - DNA, 16 bp, Homo sapiens
taatgctgtaaaatat

SEQ ID NO: 2988133 - DNA, 16 bp, Homo sapiens
taatgctgttgcctca

SEQ ID NO: 2988134 - DNA, 17 bp, Homo sapiens
taatgctgttgcctcat

SEQ ID NO: 2988135 - DNA, 20 bp, Homo sapiens
taatgcttatgtgttgcata

SEQ ID NO: 2988136 - DNA, 19 bp, Homo sapiens
taatgcttgtttatgatat

SEQ ID NO: 2988137 - DNA, 22 bp, Homo sapiens
taatggaaaaaaaaaaaagagg

SEQ ID NO: 2988138 - DNA, 23 bp, Homo sapiens
taatggccggctggaaatgctgg

SEQ ID NO: 2988139 - DNA, 13 bp, Homo sapiens
taatgggattaga

SEQ ID NO: 2988140 - DNA, 17 bp, Homo sapiens
taatgggattagaaaca

SEQ ID NO: 2988141 - DNA, 22 bp, Homo sapiens
taatggggtcctggccatccca

SEQ ID NO: 2988142 - DNA, 16 bp, Homo sapiens
taatggtaccagataa

SEQ ID NO: 2988143 - DNA, 19 bp, Homo sapiens
taatgtagttctttgttcc

SEQ ID NO: 2988144 - DNA, 21 bp, Homo sapiens
tacgtgaccctctgctgaaga

SEQ ID NO: 2988145 - DNA, 22 bp, Homo sapiens
tacgtgaccctctgctgaagac

SEQ ID NO: 2988146 - DNA, 19 bp, Homo sapiens
tacgtgggcattgtctttt

SEQ ID NO: 2988147 - DNA, 12 bp, Homo sapiens
tacgtgtgaaat

SEQ ID NO: 2988148 - DNA, 15 bp, Homo sapiens
tacgtgtgatttttc

SEQ ID NO: 2988149 - DNA, 20 bp, Homo sapiens
tacgttgtttcttatagatt

SEQ ID NO: 2988150 - DNA, 19 bp, Homo sapiens
tacgtttgtgcagaatctc

SEQ ID NO: 2988151 - DNA, 20 bp, Homo sapiens
tacgtttgtgcagaatctct

SEQ ID NO: 2988152 - DNA, 23 bp, Homo sapiens
tactaacaatcagctccttcctg

SEQ ID NO: 2988153 - DNA, 18 bp, Homo sapiens
tactaactgctgattttg

SEQ ID NO: 2988154 - DNA, 19 bp, Homo sapiens
tactaagatgacattgcta

SEQ ID NO: 2988155 - DNA, 19 bp, Homo sapiens
tactaagccaggaggcttt

SEQ ID NO: 2988156 - DNA, 19 bp, Homo sapiens
tactaaggagaattaaact

SEQ ID NO: 2988157 - DNA, 15 bp, Homo sapiens
tactaaggctttcct

SEQ ID NO: 2988158 - DNA, 21 bp, Homo sapiens
tactaaggtgactttctgaaa

SEQ ID NO: 2988159 - DNA, 14 bp, Homo sapiens
tactaagtttcctt

SEQ ID NO: 2988160 - DNA, 15 bp, Homo sapiens
tactacagctatgaa

SEQ ID NO: 2988161 - DNA, 13 bp, Homo sapiens
tactacctagaag

SEQ ID NO: 2988162 - DNA, 14 bp, Homo sapiens
tactacctagaagt

SEQ ID NO: 2988163 - DNA, 14 bp, Homo sapiens
tactaccttgaaaa

SEQ ID NO: 2988164 - DNA, 14 bp, Homo sapiens
tactacttgtttca

SEQ ID NO: 2988165 - DNA, 14 bp, Homo sapiens
tactagctctttga

SEQ ID NO: 2988166 - DNA, 21 bp, Homo sapiens
tactagggatccctcatctgt

SEQ ID NO: 2988167 - DNA, 19 bp, Homo sapiens
tactagttacacatcttca

SEQ ID NO: 2988168 - DNA, 22 bp, Homo sapiens
tactataaaatgcagtaacatt

SEQ ID NO: 2988169 - DNA, 22 bp, Homo sapiens
tactatagaccaaaaggagaga

SEQ ID NO: 2988170 - DNA, 13 bp, Homo sapiens
tactatgcctgtg

SEQ ID NO: 2988171 - DNA, 22 bp, Homo sapiens
tactattcagtggcgagaaata

SEQ ID NO: 2988172 - DNA, 18 bp, Homo sapiens
tactattcccactttcat

SEQ ID NO: 2988173 - DNA, 21 bp, Homo sapiens
tactattcccactttcattca

SEQ ID NO: 2988174 - DNA, 19 bp, Homo sapiens
tactcaagcaggtttcttg

SEQ ID NO: 2988175 - DNA, 18 bp, Homo sapiens
tactcaccatatttgaat

SEQ ID NO: 2988176 - DNA, 14 bp, Homo sapiens
tactcacttttcac

SEQ ID NO: 2988177 - DNA, 18 bp, Homo sapiens
tactcacttttcacttgt

SEQ ID NO: 2988178 - DNA, 23 bp, Homo sapiens
tactcagataaggtaaaatgcca

SEQ ID NO: 2988179 - DNA, 19 bp, Homo sapiens
tactcagcagcagagagcc

SEQ ID NO: 2988180 - DNA, 20 bp, Homo sapiens
tactcagcagcagagagccc

SEQ ID NO: 2988181 - DNA, 14 bp, Homo sapiens
tactcagcagccct

SEQ ID NO: 2988182 - DNA, 17 bp, Homo sapiens
tactcagcagccctcct

SEQ ID NO: 2988183 - DNA, 20 bp, Homo sapiens
tactcagcagccctcctcac

SEQ ID NO: 2988184 - DNA, 12 bp, Homo sapiens
tactcagccctg

SEQ ID NO: 2988185 - DNA, 14 bp, Homo sapiens
tactcaggaagaac

SEQ ID NO: 2988186 - DNA, 12 bp, Homo sapiens
tactcaggaggc

SEQ ID NO: 2988187 - DNA, 20 bp, Homo sapiens
tactcaggggatgtttacct

SEQ ID NO: 2988188 - DNA, 14 bp, Homo sapiens
tactcataatgtga

SEQ ID NO: 2988189 - DNA, 21 bp, Homo sapiens
tactcatcgggcccagggaca

SEQ ID NO: 2988190 - DNA, 15 bp, Homo sapiens
tactcatctttatcc

SEQ ID NO: 2988191 - DNA, 20 bp, Homo sapiens
tactcatgtgtatgggcaaa

SEQ ID NO: 2988192 - DNA, 22 bp, Homo sapiens
tactcatgtgtatgggcaaaaa

SEQ ID NO: 2988193 - DNA, 14 bp, Homo sapiens
tactccagcctggg

SEQ ID NO: 2988194 - DNA, 14 bp, Homo sapiens
tactcctcacactt

SEQ ID NO: 2988195 - DNA, 15 bp, Homo sapiens
tactcctcacactta

SEQ ID NO: 2988196 - DNA, 20 bp, Homo sapiens
tactcctggctcaagccctg

SEQ ID NO: 2988197 - DNA, 22 bp, Homo sapiens
tactcctggctcaagccctgaa

SEQ ID NO: 2988198 - DNA, 13 bp, Homo sapiens
tactcgagcccac

SEQ ID NO: 2988199 - DNA, 20 bp, Homo sapiens
tactctaagatcttagattc

SEQ ID NO: 2988200 - DNA, 22 bp, Homo sapiens
tactctaagatcttagattctc

SEQ ID NO: 2988201 - DNA, 14 bp, Homo sapiens
tactctagatgaag

SEQ ID NO: 2988202 - DNA, 22 bp, Homo sapiens
tactctccccacgagggctggc

SEQ ID NO: 2988203 - DNA, 15 bp, Homo sapiens
tactctcttcccttt

SEQ ID NO: 2988204 - DNA, 18 bp, Homo sapiens
tactctgcaaaccttggt

SEQ ID NO: 2988205 - DNA, 15 bp, Homo sapiens
tactctgtgtaaata

SEQ ID NO: 2988206 - DNA, 19 bp, Homo sapiens
tactctgttccttcacatc

SEQ ID NO: 2988207 - DNA, 16 bp, Homo sapiens
tactctgttgcctcct

SEQ ID NO: 2988208 - DNA, 18 bp, Homo sapiens
tactctgttgcctcctct

SEQ ID NO: 2988209 - DNA, 15 bp, Homo sapiens
tactcttaagccatc

SEQ ID NO: 2988210 - DNA, 20 bp, Homo sapiens
tactcttaagccatcttggt

SEQ ID NO: 2988211 - DNA, 17 bp, Homo sapiens
tactcttaatgatgtta

SEQ ID NO: 2988212 - DNA, 21 bp, Homo sapiens
tactcttaatgatgttatctt

SEQ ID NO: 2988213 - DNA, 14 bp, Homo sapiens
tactctttctgtat

SEQ ID NO: 2988214 - DNA, 16 bp, Homo sapiens
tactctttctgtatat

SEQ ID NO: 2988215 - DNA, 18 bp, Homo sapiens
tactctttgctttgtagt

SEQ ID NO: 2988216 - DNA, 17 bp, Homo sapiens
tactgaatttctttgat

SEQ ID NO: 2988217 - DNA, 16 bp, Homo sapiens
tactgacaatgtattt

SEQ ID NO: 2988218 - DNA, 21 bp, Homo sapiens
tactgacaatgtattttggaa

SEQ ID NO: 2988219 - DNA, 18 bp, Homo sapiens
tactgattcactgcatgg

SEQ ID NO: 2988220 - DNA, 16 bp, Homo sapiens
tactgattgagaagtt

SEQ ID NO: 2988221 - DNA, 17 bp, Homo sapiens
tactgccaaaacattta

SEQ ID NO: 2988222 - DNA, 18 bp, Homo sapiens
tactgccaaaacatttat

SEQ ID NO: 2988223 - DNA, 12 bp, Homo sapiens
tactgccagatg

SEQ ID NO: 2988224 - DNA, 15 bp, Homo sapiens
tactgccagatgctg

SEQ ID NO: 2988225 - DNA, 16 bp, Homo sapiens
tactgccagatgctga

SEQ ID NO: 2988226 - DNA, 18 bp, Homo sapiens
tactgccagatgctgatg

SEQ ID NO: 2988227 - DNA, 15 bp, Homo sapiens
tactgcctgaataaa

SEQ ID NO: 2988228 - DNA, 13 bp, Homo sapiens
tactgcctgcaga

SEQ ID NO: 2988229 - DNA, 15 bp, Homo sapiens
tactgcctgcagaga

SEQ ID NO: 2988230 - DNA, 13 bp, Homo sapiens
tactgctgacctt

SEQ ID NO: 2988231 - DNA, 19 bp, Homo sapiens
tactgctgatgctgaaata

SEQ ID NO: 2988232 - DNA, 15 bp, Homo sapiens
tactgctgctgtgct

SEQ ID NO: 2988233 - DNA, 13 bp, Homo sapiens
tactgcttaattc

SEQ ID NO: 2988234 - DNA, 17 bp, Homo sapiens
tactgcttgcttacaat

SEQ ID NO: 2988235 - DNA, 22 bp, Homo sapiens
tactggcaaaaggatctttgtg

SEQ ID NO: 2988236 - DNA, 21 bp, Homo sapiens
tactggcgtggattaaactta

SEQ ID NO: 2988237 - DNA, 23 bp, Homo sapiens
tactgggccctgagtctgggcag

SEQ ID NO: 2988238 - DNA, 15 bp, Homo sapiens
tactggggctgggga

SEQ ID NO: 2988239 - DNA, 21 bp, Homo sapiens
tactggggctggggaaggaag

SEQ ID NO: 2988240 - DNA, 19 bp, Homo sapiens
tactggtgtaatctcaatg

SEQ ID NO: 2988241 - DNA, 13 bp, Homo sapiens
tactggtttgtat

SEQ ID NO: 2988242 - DNA, 16 bp, Homo sapiens
tactgtaaagaaagag

SEQ ID NO: 2988243 - DNA, 23 bp, Homo sapiens
tactgtaaagaaagagagaaaat

SEQ ID NO: 2988244 - DNA, 12 bp, Homo sapiens
tactgtaagaat

SEQ ID NO: 2988245 - DNA, 13 bp, Homo sapiens
tactgtaattcct

SEQ ID NO: 2988246 - DNA, 15 bp, Homo sapiens
tactgtaattcctca

SEQ ID NO: 2988247 - DNA, 23 bp, Homo sapiens
tactgtattttgtattgtttcaa

SEQ ID NO: 2988248 - DNA, 14 bp, Homo sapiens
tactgtctcactga

SEQ ID NO: 2988249 - DNA, 21 bp, Homo sapiens
tactgtctgctgatataatat

SEQ ID NO: 2988250 - DNA, 23 bp, Homo sapiens
tactgtgagcttacattgaaaac

SEQ ID NO: 2988251 - DNA, 21 bp, Homo sapiens
tactgtggcaaatgccaactg

SEQ ID NO: 2988252 - DNA, 18 bp, Homo sapiens
tactgtgtcactgtccag

SEQ ID NO: 2988253 - DNA, 14 bp, Homo sapiens
tactgtgtgtgtga

SEQ ID NO: 2988254 - DNA, 17 bp, Homo sapiens
tactgtgtgtgtgaatg

SEQ ID NO: 2988255 - DNA, 18 bp, Homo sapiens
tactgtgtgtgtgaatga

SEQ ID NO: 2988256 - DNA, 19 bp, Homo sapiens
tactgtgtgtgtgaatgaa

SEQ ID NO: 2988257 - DNA, 18 bp, Homo sapiens
tactgttactgggccctg

SEQ ID NO: 2988258 - DNA, 16 bp, Homo sapiens
tactgttatccatatt

SEQ ID NO: 2988259 - DNA, 13 bp, Homo sapiens
tactgttctaaag

SEQ ID NO: 2988260 - DNA, 20 bp, Homo sapiens
tactgttgataattcttatt

SEQ ID NO: 2988261 - DNA, 22 bp, Homo sapiens
tactgttgataattcttatttt

SEQ ID NO: 2988262 - DNA, 12 bp, Homo sapiens
tacttaaagatt

SEQ ID NO: 2988263 - DNA, 14 bp, Homo sapiens
tacttaaagattta

SEQ ID NO: 2988264 - DNA, 19 bp, Homo sapiens
tacttaaagatttatcaaa

SEQ ID NO: 2988265 - DNA, 17 bp, Homo sapiens
tacttaagattcagttt

SEQ ID NO: 2988266 - DNA, 16 bp, Homo sapiens
tacttaataaaacatt

SEQ ID NO: 2988267 - DNA, 20 bp, Homo sapiens
tacttaatactgaatttctt

SEQ ID NO: 2988268 - DNA, 16 bp, Homo sapiens
tacttacaaaaatggg

SEQ ID NO: 2988269 - DNA, 12 bp, Homo sapiens
tacttacatgtt

SEQ ID NO: 2988270 - DNA, 18 bp, Homo sapiens
tacttagatatttcatgt

SEQ ID NO: 2988271 - DNA, 16 bp, Homo sapiens
tacttcaaaagtattt

SEQ ID NO: 2988272 - DNA, 23 bp, Homo sapiens
tacttcaaaagtattttcctgta

SEQ ID NO: 2988273 - DNA, 15 bp, Homo sapiens
tacttcagcaagaga

SEQ ID NO: 2988274 - DNA, 14 bp, Homo sapiens
tacttcagctttgt

SEQ ID NO: 2988275 - DNA, 17 bp, Homo sapiens
tacttccagcaaaatcc

SEQ ID NO: 2988276 - DNA, 16 bp, Homo sapiens
taggtaaatctagagt

SEQ ID NO: 2988277 - DNA, 23 bp, Homo sapiens
taggtaaatctagagtttataca

SEQ ID NO: 2988278 - DNA, 19 bp, Homo sapiens
taggtatctttatagttgt

SEQ ID NO: 2988279 - DNA, 15 bp, Homo sapiens
taggtcattgcacct

SEQ ID NO: 2988280 - DNA, 19 bp, Homo sapiens
taggtcattttcagtgact

SEQ ID NO: 2988281 - DNA, 16 bp, Homo sapiens
taggtcttattgaaat

SEQ ID NO: 2988282 - DNA, 14 bp, Homo sapiens
taggtcttcctgtg

SEQ ID NO: 2988283 - DNA, 19 bp, Homo sapiens
taggtgcccttggaggcca

SEQ ID NO: 2988284 - DNA, 12 bp, Homo sapiens
taggttataaga

SEQ ID NO: 2988285 - DNA, 15 bp, Homo sapiens
taggttctaaagttc

SEQ ID NO: 2988286 - DNA, 20 bp, Homo sapiens
taggttctaaagttctaaga

SEQ ID NO: 2988287 - DNA, 21 bp, Homo sapiens
taggttctgtagagccaatta

SEQ ID NO: 2988288 - DNA, 18 bp, Homo sapiens
taggttctttgctgcatt

SEQ ID NO: 2988289 - DNA, 11 bp, Homo sapiens
taggtttcaaa

SEQ ID NO: 2988290 - DNA, 14 bp, Homo sapiens
taggtttcaaagat

SEQ ID NO: 2988291 - DNA, 16 bp, Homo sapiens
taggtttgtgtcttaa

SEQ ID NO: 2988292 - DNA, 16 bp, Homo sapiens
taggttttgtttgcta

SEQ ID NO: 2988293 - DNA, 14 bp, Homo sapiens
tagtaaaacacaga

SEQ ID NO: 2988294 - DNA, 21 bp, Homo sapiens
tagtaaagtatttttgattaa

SEQ ID NO: 2988295 - DNA, 11 bp, Homo sapiens
tagtaaatgtt

SEQ ID NO: 2988296 - DNA, 13 bp, Homo sapiens
tagtaaatgttat

SEQ ID NO: 2988297 - DNA, 17 bp, Homo sapiens
tagtaactttttatgta

SEQ ID NO: 2988298 - DNA, 15 bp, Homo sapiens
tagtaatcacagttg

SEQ ID NO: 2988299 - DNA, 21 bp, Homo sapiens
tagtaatgctacgtgtgattt

SEQ ID NO: 2988300 - DNA, 14 bp, Homo sapiens
tagtaattgacatg

SEQ ID NO: 2988301 - DNA, 21 bp, Homo sapiens
tagtaatttctttttttcctt

SEQ ID NO: 2988302 - DNA, 14 bp, Homo sapiens
tagtactaagcatt

SEQ ID NO: 2988303 - DNA, 14 bp, Homo sapiens
tagtagaacaatgt

SEQ ID NO: 2988304 - DNA, 14 bp, Homo sapiens
tagtagattaaaaa

SEQ ID NO: 2988305 - DNA, 21 bp, Homo sapiens
tagtagccaaagttaaatgta

SEQ ID NO: 2988306 - DNA, 18 bp, Homo sapiens
tagtataccggaattact

SEQ ID NO: 2988307 - DNA, 21 bp, Homo sapiens
tagtatcaaatattagatgtg

SEQ ID NO: 2988308 - DNA, 23 bp, Homo sapiens
tagtattcaggcactgagaatga

SEQ ID NO: 2988309 - DNA, 22 bp, Homo sapiens
tagtattgaatacttacattct

SEQ ID NO: 2988310 - DNA, 13 bp, Homo sapiens
tagtcaagctcct

SEQ ID NO: 2988311 - DNA, 16 bp, Homo sapiens
tagtcaataaacttgt

SEQ ID NO: 2988312 - DNA, 19 bp, Homo sapiens
tagtcaccgacagcggcct

SEQ ID NO: 2988313 - DNA, 18 bp, Homo sapiens
tagtcactgctgctactg

SEQ ID NO: 2988314 - DNA, 13 bp, Homo sapiens
tagtcactttttt

SEQ ID NO: 2988315 - DNA, 15 bp, Homo sapiens
tagtcattaaaaaca

SEQ ID NO: 2988316 - DNA, 21 bp, Homo sapiens
tagtccgtgctgacagctgct

SEQ ID NO: 2988317 - DNA, 22 bp, Homo sapiens
tagtccgtgctgacagctgctc

SEQ ID NO: 2988318 - DNA, 12 bp, Homo sapiens
tagtctagtttc

SEQ ID NO: 2988319 - DNA, 14 bp, Homo sapiens
tagtctattagcca

SEQ ID NO: 2988320 - DNA, 17 bp, Homo sapiens
tagtctctgttcttcat

SEQ ID NO: 2988321 - DNA, 12 bp, Homo sapiens
tagtctctttat

SEQ ID NO: 2988322 - DNA, 19 bp, Homo sapiens
tagtctgagcttctttagc

SEQ ID NO: 2988323 - DNA, 18 bp, Homo sapiens
tagtctttgccagtcatt

SEQ ID NO: 2988324 - DNA, 17 bp, Homo sapiens
tagtgaacctcaccccg

SEQ ID NO: 2988325 - DNA, 18 bp, Homo sapiens
tagtgaactaagttattg

SEQ ID NO: 2988326 - DNA, 15 bp, Homo sapiens
tagtgacatttaatg

SEQ ID NO: 2988327 - DNA, 13 bp, Homo sapiens
tagtgagcccaga

SEQ ID NO: 2988328 - DNA, 14 bp, Homo sapiens
tagtgaggctggcc

SEQ ID NO: 2988329 - DNA, 16 bp, Homo sapiens
tagtgagtcagcacct

SEQ ID NO: 2988330 - DNA, 17 bp, Homo sapiens
tagtgatatttctctag

SEQ ID NO: 2988331 - DNA, 19 bp, Homo sapiens
tagtgcatctttgcctctc

SEQ ID NO: 2988332 - DNA, 20 bp, Homo sapiens
tagtgcattgtttctgtggg

SEQ ID NO: 2988333 - DNA, 13 bp, Homo sapiens
tagtgccaatgtt

SEQ ID NO: 2988334 - DNA, 17 bp, Homo sapiens
tagtgccaatgttgtgt

SEQ ID NO: 2988335 - DNA, 13 bp, Homo sapiens
tagtgccaccaca

SEQ ID NO: 2988336 - DNA, 16 bp, Homo sapiens
tagtgccttctaaagg

SEQ ID NO: 2988337 - DNA, 19 bp, Homo sapiens
tagtgccttctaaaggtgt

SEQ ID NO: 2988338 - DNA, 22 bp, Homo sapiens
tagtgctccatagtttggcatt

SEQ ID NO: 2988339 - DNA, 22 bp, Homo sapiens
tagtgctttaagaatgaacaca

SEQ ID NO: 2988340 - DNA, 23 bp, Homo sapiens
tagtgctttccttttttaaaaat

SEQ ID NO: 2988341 - DNA, 22 bp, Homo sapiens
tagtggaccacttggaaataaa

SEQ ID NO: 2988342 - DNA, 19 bp, Homo sapiens
tagtggacttgttttaatt

SEQ ID NO: 2988343 - DNA, 21 bp, Homo sapiens
tagtgggccttcattaaatgt

SEQ ID NO: 2988344 - DNA, 18 bp, Homo sapiens
tagtggggtctccctctc

SEQ ID NO: 2988345 - DNA, 20 bp, Homo sapiens
tagtggggtctccctctcct

SEQ ID NO: 2988346 - DNA, 21 bp, Homo sapiens
tagtggtctctactgtggcaa

SEQ ID NO: 2988347 - DNA, 18 bp, Homo sapiens
tagtgtaagctagaagaa

SEQ ID NO: 2988348 - DNA, 18 bp, Homo sapiens
tagtgtacatttctataa

SEQ ID NO: 2988349 - DNA, 14 bp, Homo sapiens
tagtgtagtattct

SEQ ID NO: 2988350 - DNA, 21 bp, Homo sapiens
tagtgtcacctttcttcttgt

SEQ ID NO: 2988351 - DNA, 19 bp, Homo sapiens
tagtgtccattttgtgaag

SEQ ID NO: 2988352 - DNA, 19 bp, Homo sapiens
tagtgtggtatttgctgtc

SEQ ID NO: 2988353 - DNA, 18 bp, Homo sapiens
tagtgtgtcctgtgtaaa

SEQ ID NO: 2988354 - DNA, 14 bp, Homo sapiens
tagtgttaaagaga

SEQ ID NO: 2988355 - DNA, 22 bp, Homo sapiens
tagttaaccaatcgcaaagcaa

SEQ ID NO: 2988356 - DNA, 19 bp, Homo sapiens
tagttaagacatgatttcc

SEQ ID NO: 2988357 - DNA, 12 bp, Homo sapiens
tagttactcaag

SEQ ID NO: 2988358 - DNA, 16 bp, Homo sapiens
tagttagaattggaaa

SEQ ID NO: 2988359 - DNA, 21 bp, Homo sapiens
tagttaggatgctcagttgct

SEQ ID NO: 2988360 - DNA, 14 bp, Homo sapiens
tagttatttaagaa

SEQ ID NO: 2988361 - DNA, 16 bp, Homo sapiens
tagttatttacttgaa

SEQ ID NO: 2988362 - DNA, 17 bp, Homo sapiens
tagttatttacttgaaa

SEQ ID NO: 2988363 - DNA, 18 bp, Homo sapiens
tagttatttacttgaaag

SEQ ID NO: 2988364 - DNA, 22 bp, Homo sapiens
tagttcagcatccgcaggtgct

SEQ ID NO: 2988365 - DNA, 17 bp, Homo sapiens
tagttcatgtctgctat

SEQ ID NO: 2988366 - DNA, 15 bp, Homo sapiens
tagttctaagactca

SEQ ID NO: 2988367 - DNA, 16 bp, Homo sapiens
tagttctaggcactgt

SEQ ID NO: 2988368 - DNA, 18 bp, Homo sapiens
tagttctcttatctttga

SEQ ID NO: 2988369 - DNA, 18 bp, Homo sapiens
tagttctttgttcctgct

SEQ ID NO: 2988370 - DNA, 14 bp, Homo sapiens
tagttgaactgata

SEQ ID NO: 2988371 - DNA, 22 bp, Homo sapiens
tagttgcgtggactctgcacat

SEQ ID NO: 2988372 - DNA, 15 bp, Homo sapiens
tagttggtgagaaac

SEQ ID NO: 2988373 - DNA, 14 bp, Homo sapiens
tagttgtctttctt

SEQ ID NO: 2988374 - DNA, 22 bp, Homo sapiens
tagttgtgaccttagtgtttct

SEQ ID NO: 2988375 - DNA, 17 bp, Homo sapiens
tagtttcaaatctgtaa

SEQ ID NO: 2988376 - DNA, 17 bp, Homo sapiens
tagtttcataattgtgt

SEQ ID NO: 2988377 - DNA, 17 bp, Homo sapiens
tagtttctgttctgtgg

SEQ ID NO: 2988378 - DNA, 12 bp, Homo sapiens
tagtttgctttg

SEQ ID NO: 2988379 - DNA, 11 bp, Homo sapiens
tagtttggatt

SEQ ID NO: 2988380 - DNA, 11 bp, Homo sapiens
tagttttctcc

SEQ ID NO: 2988381 - DNA, 15 bp, Homo sapiens
tagttttggttttta

SEQ ID NO: 2988382 - DNA, 20 bp, Homo sapiens
tataaaaaccccaaactgtt

SEQ ID NO: 2988383 - DNA, 20 bp, Homo sapiens
tataaaaggcaaatgtgtac

SEQ ID NO: 2988384 - DNA, 22 bp, Homo sapiens
tataaaagtgattgttggcaca

SEQ ID NO: 2988385 - DNA, 21 bp, Homo sapiens
tataaaatatgaagacataaa

SEQ ID NO: 2988386 - DNA, 13 bp, Homo sapiens
tataaacagcagg

SEQ ID NO: 2988387 - DNA, 17 bp, Homo sapiens
tataaagatggctgact

SEQ ID NO: 2988388 - DNA, 16 bp, Homo sapiens
tataaagctagatgct

SEQ ID NO: 2988389 - DNA, 12 bp, Homo sapiens
tataaagctgtt

SEQ ID NO: 2988390 - DNA, 18 bp, Homo sapiens
tataaagctgttattctt

SEQ ID NO: 2988391 - DNA, 22 bp, Homo sapiens
tataaagtcaggacctggcttg

SEQ ID NO: 2988392 - DNA, 17 bp, Homo sapiens
tataaagtgcttgtgta

SEQ ID NO: 2988393 - DNA, 19 bp, Homo sapiens
tataaagtgcttgtgtaat

SEQ ID NO: 2988394 - DNA, 12 bp, Homo sapiens
tataaagtggac

SEQ ID NO: 2988395 - DNA, 19 bp, Homo sapiens
tataaagttttatttgaat

SEQ ID NO: 2988396 - DNA, 14 bp, Homo sapiens
tataaataataata

SEQ ID NO: 2988397 - DNA, 21 bp, Homo sapiens
tataaatacaaatctgtataa

SEQ ID NO: 2988398 - DNA, 16 bp, Homo sapiens
tataaatatccccagg

SEQ ID NO: 2988399 - DNA, 10 bp, Homo sapiens
tataaatatg

SEQ ID NO: 2988400 - DNA, 14 bp, Homo sapiens
tataaatctgatca

SEQ ID NO: 2988401 - DNA, 17 bp, Homo sapiens
tataaatgacaaagtgt

SEQ ID NO: 2988402 - DNA, 18 bp, Homo sapiens
tataaatgacaaagtgtt

SEQ ID NO: 2988403 - DNA, 17 bp, Homo sapiens
tataaatgggaacattt

SEQ ID NO: 2988404 - DNA, 12 bp, Homo sapiens
tataaatgtcta

SEQ ID NO: 2988405 - DNA, 18 bp, Homo sapiens
tataaatgtctattatta

SEQ ID NO: 2988406 - DNA, 22 bp, Homo sapiens
tataaatgtctattattatgaa

SEQ ID NO: 2988407 - DNA, 16 bp, Homo sapiens
tataaatgtttggaaa

SEQ ID NO: 2988408 - DNA, 23 bp, Homo sapiens
tataaatgtttggaaaggttcta

SEQ ID NO: 2988409 - DNA, 12 bp, Homo sapiens
tatctaaagtta

SEQ ID NO: 2988410 - DNA, 13 bp, Homo sapiens
tatctaaagttat

SEQ ID NO: 2988411 - DNA, 16 bp, Homo sapiens
tatctaaatcaccaga

SEQ ID NO: 2988412 - DNA, 13 bp, Homo sapiens
tatctaaattgaa

SEQ ID NO: 2988413 - DNA, 16 bp, Homo sapiens
tatctaaattgaataa

SEQ ID NO: 2988414 - DNA, 18 bp, Homo sapiens
tatctaagaatacagctt

SEQ ID NO: 2988415 - DNA, 23 bp, Homo sapiens
tatctaagttaatttaaagttgt

SEQ ID NO: 2988416 - DNA, 16 bp, Homo sapiens
tatctaatacctctgt

SEQ ID NO: 2988417 - DNA, 20 bp, Homo sapiens
tatctacctgttctgtagct

SEQ ID NO: 2988418 - DNA, 17 bp, Homo sapiens
tatctaggcaacatagt

SEQ ID NO: 2988419 - DNA, 15 bp, Homo sapiens
tatctatatatgtgt

SEQ ID NO: 2988420 - DNA, 22 bp, Homo sapiens
tatctatatatgtgtatgtacg

SEQ ID NO: 2988421 - DNA, 16 bp, Homo sapiens
tatctatatgtacttg

SEQ ID NO: 2988422 - DNA, 14 bp, Homo sapiens
tatctattaaccat

SEQ ID NO: 2988423 - DNA, 19 bp, Homo sapiens
tatctattctgagaaaaca

SEQ ID NO: 2988424 - DNA, 23 bp, Homo sapiens
tatctattctgagaaaacaagca

SEQ ID NO: 2988425 - DNA, 16 bp, Homo sapiens
tatctcagccatccgc

SEQ ID NO: 2988426 - DNA, 16 bp, Homo sapiens
tatctccatactttgg

SEQ ID NO: 2988427 - DNA, 13 bp, Homo sapiens
tatctccctgctt

SEQ ID NO: 2988428 - DNA, 14 bp, Homo sapiens
tatctccctgcttc

SEQ ID NO: 2988429 - DNA, 17 bp, Homo sapiens
tatctctatttgagaat

SEQ ID NO: 2988430 - DNA, 21 bp, Homo sapiens
tatctcttttatatttgtagg

SEQ ID NO: 2988431 - DNA, 19 bp, Homo sapiens
tatctgaagacctaccagg

SEQ ID NO: 2988432 - DNA, 20 bp, Homo sapiens
tatctgagcgtttaaagtac

SEQ ID NO: 2988433 - DNA, 21 bp, Homo sapiens
tatctgagcgtttaaagtact

SEQ ID NO: 2988434 - DNA, 23 bp, Homo sapiens
tatctgggattatggttttgtga

SEQ ID NO: 2988435 - DNA, 23 bp, Homo sapiens
tatctggtatggtgctaatattt

SEQ ID NO: 2988436 - DNA, 22 bp, Homo sapiens
tatctggtcaacctcctggaca

SEQ ID NO: 2988437 - DNA, 18 bp, Homo sapiens
tatctgtaagttttgaat

SEQ ID NO: 2988438 - DNA, 22 bp, Homo sapiens
tatctgtgctcaggactcagaa

SEQ ID NO: 2988439 - DNA, 21 bp, Homo sapiens
tatctgtggagttcctgctcc

SEQ ID NO: 2988440 - DNA, 17 bp, Homo sapiens
tatctgtgtttttgaaa

SEQ ID NO: 2988441 - DNA, 16 bp, Homo sapiens
tatctgtttacagtgt

SEQ ID NO: 2988442 - DNA, 17 bp, Homo sapiens
tatctgtttacagtgtt

SEQ ID NO: 2988443 - DNA, 13 bp, Homo sapiens
tatcttaattttg

SEQ ID NO: 2988444 - DNA, 21 bp, Homo sapiens
tatcttctcaagttctaagat

SEQ ID NO: 2988445 - DNA, 22 bp, Homo sapiens
tatcttgaggtggtagtaaaac

SEQ ID NO: 2988446 - DNA, 15 bp, Homo sapiens
tatcttgctctgtaa

SEQ ID NO: 2988447 - DNA, 17 bp, Homo sapiens
tatcttgctctgtaatc

SEQ ID NO: 2988448 - DNA, 11 bp, Homo sapiens
tatcttggcct

SEQ ID NO: 2988449 - DNA, 20 bp, Homo sapiens
tatctttatacttaaacagc

SEQ ID NO: 2988450 - DNA, 13 bp, Homo sapiens
tatcttttcttta

SEQ ID NO: 2988451 - DNA, 13 bp, Homo sapiens
tatctttttattc

SEQ ID NO: 2988452 - DNA, 19 bp, Homo sapiens
tatgaaactctacatttaa

SEQ ID NO: 2988453 - DNA, 14 bp, Homo sapiens
tatgaaagctgggg

SEQ ID NO: 2988454 - DNA, 16 bp, Homo sapiens
tatgaaaggaataaaa

SEQ ID NO: 2988455 - DNA, 15 bp, Homo sapiens
tatgaaatattttga

SEQ ID NO: 2988456 - DNA, 18 bp, Homo sapiens
tatgaagaaacgcaacaa

SEQ ID NO: 2988457 - DNA, 21 bp, Homo sapiens
tatgaagaattgccaatcttg

SEQ ID NO: 2988458 - DNA, 14 bp, Homo sapiens
tatgaagcaagctg

SEQ ID NO: 2988459 - DNA, 16 bp, Homo sapiens
tatgaagcaagctgtg

SEQ ID NO: 2988460 - DNA, 20 bp, Homo sapiens
tatgaagcaagctgtgttac

SEQ ID NO: 2988461 - DNA, 17 bp, Homo sapiens
tatgaagctcacctgtt

SEQ ID NO: 2988462 - DNA, 14 bp, Homo sapiens
tatgaagtaaagaa

SEQ ID NO: 2988463 - DNA, 20 bp, Homo sapiens
tatgaagtaaagaactgcac

SEQ ID NO: 2988464 - DNA, 23 bp, Homo sapiens
tatgaagtaaagaactgcacatg

SEQ ID NO: 2988465 - DNA, 20 bp, Homo sapiens
tatgaagtatctaaaagtgt

SEQ ID NO: 2988466 - DNA, 16 bp, Homo sapiens
tatgaatacagcagca

SEQ ID NO: 2988467 - DNA, 17 bp, Homo sapiens
tatgaatacagcagcaa

SEQ ID NO: 2988468 - DNA, 22 bp, Homo sapiens
tatgaatacagcagcaagaaaa

SEQ ID NO: 2988469 - DNA, 18 bp, Homo sapiens
tatgaattcaagaaagga

SEQ ID NO: 2988470 - DNA, 23 bp, Homo sapiens
tatgacaagctgtatcactgcct

SEQ ID NO: 2988471 - DNA, 13 bp, Homo sapiens
tatgacacaatga

SEQ ID NO: 2988472 - DNA, 16 bp, Homo sapiens
tatgacatgaaaagtt

SEQ ID NO: 2988473 - DNA, 21 bp, Homo sapiens
tatgaccagagcaaaaatgta

SEQ ID NO: 2988474 - DNA, 17 bp, Homo sapiens
tatgaccttccaagttt

SEQ ID NO: 2988475 - DNA, 13 bp, Homo sapiens
tatgactttttat

SEQ ID NO: 2988476 - DNA, 22 bp, Homo sapiens
tatgactttttataaaatggct

SEQ ID NO: 2988477 - DNA, 16 bp, Homo sapiens
tatgagaaatgtaatg

SEQ ID NO: 2988478 - DNA, 23 bp, Homo sapiens
tatgagaactggttcttgccttc

SEQ ID NO: 2988479 - DNA, 18 bp, Homo sapiens
tatgagaagtactttgtg

SEQ ID NO: 2988480 - DNA, 22 bp, Homo sapiens
tatgagacccttacgtgattgt

SEQ ID NO: 2988481 - DNA, 18 bp, Homo sapiens
tatgagtggaaaaagcca

SEQ ID NO: 2988482 - DNA, 18 bp, Homo sapiens
tatgagtgtgagtgtgtg

SEQ ID NO: 2988483 - DNA, 17 bp, Homo sapiens
tatgataagattgaaat

SEQ ID NO: 2988484 - DNA, 15 bp, Homo sapiens
tatgataatagattc

SEQ ID NO: 2988485 - DNA, 16 bp, Homo sapiens
tatgatgacaatcaaa

SEQ ID NO: 2988486 - DNA, 21 bp, Homo sapiens
tatgatggaacagtgaaagtc

SEQ ID NO: 2988487 - DNA, 16 bp, Homo sapiens
tatgatgggctcccca

SEQ ID NO: 2988488 - DNA, 16 bp, Homo sapiens
tatgattctagtacat

SEQ ID NO: 2988489 - DNA, 17 bp, Homo sapiens
tatgattctagtacata

SEQ ID NO: 2988490 - DNA, 20 bp, Homo sapiens
tatgattctagtacataatt

SEQ ID NO: 2988491 - DNA, 22 bp, Homo sapiens
tatgattctagtacataattga

SEQ ID NO: 2988492 - DNA, 14 bp, Homo sapiens
tatgattctctgtg

SEQ ID NO: 2988493 - DNA, 13 bp, Homo sapiens
tatgattctctta

SEQ ID NO: 2988494 - DNA, 17 bp, Homo sapiens
tatgatttaaaacatgt

SEQ ID NO: 2988495 - DNA, 17 bp, Homo sapiens
tatgatttataaacaga

SEQ ID NO: 2988496 - DNA, 14 bp, Homo sapiens
tatgatttcaacat

SEQ ID NO: 2988497 - DNA, 20 bp, Homo sapiens
tatgatttgttttgaatttt

SEQ ID NO: 2988498 - DNA, 22 bp, Homo sapiens
tatgatttgttttgaattttgt

SEQ ID NO: 2988499 - DNA, 11 bp, Homo sapiens
tatgcaaaagg

SEQ ID NO: 2988500 - DNA, 23 bp, Homo sapiens
tatgcaagtgggagatgaaaacc

SEQ ID NO: 2988501 - DNA, 15 bp, Homo sapiens
tatgcaatatatcta

SEQ ID NO: 2988502 - DNA, 16 bp, Homo sapiens
tatgcaattcagtgtt

SEQ ID NO: 2988503 - DNA, 19 bp, Homo sapiens
tatgcacatatggactctg

SEQ ID NO: 2988504 - DNA, 18 bp, Homo sapiens
tatgcaccttgtgtctgt

SEQ ID NO: 2988505 - DNA, 19 bp, Homo sapiens
tatgcacttataattttcc

SEQ ID NO: 2988506 - DNA, 15 bp, Homo sapiens
tatgcataaagtcag

SEQ ID NO: 2988507 - DNA, 23 bp, Homo sapiens
tatgcatggtgccccaggaccag

SEQ ID NO: 2988508 - DNA, 16 bp, Homo sapiens
tatgcatgtgaagaaa

SEQ ID NO: 2988509 - DNA, 12 bp, Homo sapiens
tatgcattgtct

SEQ ID NO: 2988510 - DNA, 15 bp, Homo sapiens
tatgcccacatttag

SEQ ID NO: 2988511 - DNA, 21 bp, Homo sapiens
tatgcccctagtaactgctgt

SEQ ID NO: 2988512 - DNA, 19 bp, Homo sapiens
tatgcctctcctttgtata

SEQ ID NO: 2988513 - DNA, 20 bp, Homo sapiens
tatgcctctcctttgtatat

SEQ ID NO: 2988514 - DNA, 21 bp, Homo sapiens
tatgcctctcctttgtatatt

SEQ ID NO: 2988515 - DNA, 18 bp, Homo sapiens
tatgcctgctatttgaag

SEQ ID NO: 2988516 - DNA, 18 bp, Homo sapiens
tatgcggtgacggcgggg

SEQ ID NO: 2988517 - DNA, 17 bp, Homo sapiens
tatgctaaaatacattt

SEQ ID NO: 2988518 - DNA, 16 bp, Homo sapiens
tatgctacttttactt

SEQ ID NO: 2988519 - DNA, 19 bp, Homo sapiens
tatgctctcgcacctttcc

SEQ ID NO: 2988520 - DNA, 14 bp, Homo sapiens
tatgctgacagctc

SEQ ID NO: 2988521 - DNA, 22 bp, Homo sapiens
tatgctgcttttatatctgtat

SEQ ID NO: 2988522 - DNA, 14 bp, Homo sapiens
tatggaaacccgag

SEQ ID NO: 2988523 - DNA, 17 bp, Homo sapiens
tatggaaacccgagggt

SEQ ID NO: 2988524 - DNA, 13 bp, Homo sapiens
tatggaaggattt

SEQ ID NO: 2988525 - DNA, 21 bp, Homo sapiens
tatggaagtaaaggcattcca

SEQ ID NO: 2988526 - DNA, 23 bp, Homo sapiens
tatggaagtaaaggcattccaca

SEQ ID NO: 2988527 - DNA, 19 bp, Homo sapiens
tatggaatttataattcag

SEQ ID NO: 2988528 - DNA, 16 bp, Homo sapiens
tatggacactgtgaca

SEQ ID NO: 2988529 - DNA, 20 bp, Homo sapiens
tatggacactgtgacaatga

SEQ ID NO: 2988530 - DNA, 19 bp, Homo sapiens
tatggacatcgatatgaaa

SEQ ID NO: 2988531 - DNA, 22 bp, Homo sapiens
tatggattcatttataagaaga

SEQ ID NO: 2988532 - DNA, 23 bp, Homo sapiens
tatggcatctcattgaggacaaa

SEQ ID NO: 2988533 - DNA, 16 bp, Homo sapiens
tatgggaatcaagatt

SEQ ID NO: 2988534 - DNA, 18 bp, Homo sapiens
tatggggatagtctgggt

SEQ ID NO: 2988535 - DNA, 19 bp, Homo sapiens
tatggggatagtctgggtc

SEQ ID NO: 2988536 - DNA, 20 bp, Homo sapiens
tatgggggagattgaacttt

SEQ ID NO: 2988537 - DNA, 14 bp, Homo sapiens
tatgggtgggaata

SEQ ID NO: 2988538 - DNA, 22 bp, Homo sapiens
tatgggttagatgttgccatgt

SEQ ID NO: 2988539 - DNA, 21 bp, Homo sapiens
tatggtacatttttcaacttt

SEQ ID NO: 2988540 - DNA, 14 bp, Homo sapiens
tcaatccatcagca

SEQ ID NO: 2988541 - DNA, 20 bp, Homo sapiens
tcaatccatccatgtacttc

SEQ ID NO: 2988542 - DNA, 16 bp, Homo sapiens
tcaatctcgtttagtg

SEQ ID NO: 2988543 - DNA, 18 bp, Homo sapiens
tcaatctcgtttagtgcc

SEQ ID NO: 2988544 - DNA, 23 bp, Homo sapiens
tcaatgaaatatgtgaagcccag

SEQ ID NO: 2988545 - DNA, 18 bp, Homo sapiens
tcaatgaattaattcaga

SEQ ID NO: 2988546 - DNA, 20 bp, Homo sapiens
tcaatggatttgatgctgtt

SEQ ID NO: 2988547 - DNA, 20 bp, Homo sapiens
tcaatgggattttctagttt

SEQ ID NO: 2988548 - DNA, 12 bp, Homo sapiens
tcaatggtagat

SEQ ID NO: 2988549 - DNA, 22 bp, Homo sapiens
tcaatggtagattcgctgtccc

SEQ ID NO: 2988550 - DNA, 16 bp, Homo sapiens
tcaatgtgacatttac

SEQ ID NO: 2988551 - DNA, 19 bp, Homo sapiens
tcaattaaaattacaaaag

SEQ ID NO: 2988552 - DNA, 21 bp, Homo sapiens
tcaattatattgttagtggac

SEQ ID NO: 2988553 - DNA, 19 bp, Homo sapiens
tcaattccgtagccagctg

SEQ ID NO: 2988554 - DNA, 17 bp, Homo sapiens
tcaattgcaaaatgcgt

SEQ ID NO: 2988555 - DNA, 18 bp, Homo sapiens
tcaattgcatctcccaga

SEQ ID NO: 2988556 - DNA, 13 bp, Homo sapiens
tcaatttaaatgt

SEQ ID NO: 2988557 - DNA, 17 bp, Homo sapiens
tcaatttaaatgtttac

SEQ ID NO: 2988558 - DNA, 20 bp, Homo sapiens
tcaatttaaatgtttactat

SEQ ID NO: 2988559 - DNA, 22 bp, Homo sapiens
tcaatttactttttaaacagtg

SEQ ID NO: 2988560 - DNA, 14 bp, Homo sapiens
tcaatttatttggg

SEQ ID NO: 2988561 - DNA, 13 bp, Homo sapiens
tcaatttggatat

SEQ ID NO: 2988562 - DNA, 22 bp, Homo sapiens
tcaatttggatatttggaggag

SEQ ID NO: 2988563 - DNA, 17 bp, Homo sapiens
tcaattttgtatttaat

SEQ ID NO: 2988564 - DNA, 15 bp, Homo sapiens
tcaattttttaaacc

SEQ ID NO: 2988565 - DNA, 22 bp, Homo sapiens
tcacaaaacagcctttgggaaa

SEQ ID NO: 2988566 - DNA, 21 bp, Homo sapiens
tcacaaaacatattttacatc

SEQ ID NO: 2988567 - DNA, 18 bp, Homo sapiens
tcacaaaagctgtgtctc

SEQ ID NO: 2988568 - DNA, 20 bp, Homo sapiens
tcacaaaagctgtgtctctg

SEQ ID NO: 2988569 - DNA, 12 bp, Homo sapiens
tcacaaactgtg

SEQ ID NO: 2988570 - DNA, 12 bp, Homo sapiens
tcacaaataata

SEQ ID NO: 2988571 - DNA, 14 bp, Homo sapiens
tcacaacctgaacc

SEQ ID NO: 2988572 - DNA, 16 bp, Homo sapiens
tcacaacctgaaccta

SEQ ID NO: 2988573 - DNA, 12 bp, Homo sapiens
tcacaactcctt

SEQ ID NO: 2988574 - DNA, 20 bp, Homo sapiens
tcacaactccttccatcctt

SEQ ID NO: 2988575 - DNA, 22 bp, Homo sapiens
tcacaagtgaaaaacatccaga

SEQ ID NO: 2988576 - DNA, 17 bp, Homo sapiens
tcacacactttctcttc

SEQ ID NO: 2988577 - DNA, 18 bp, Homo sapiens
tcacaccctaccttcccc

SEQ ID NO: 2988578 - DNA, 20 bp, Homo sapiens
tcacaccctaccttccccag

SEQ ID NO: 2988579 - DNA, 20 bp, Homo sapiens
tcacacgtttaatcccagca

SEQ ID NO: 2988580 - DNA, 22 bp, Homo sapiens
tcacacgtttaatcccagcact

SEQ ID NO: 2988581 - DNA, 24 bp, Homo sapiens
tcacactccagaattacccttcct

SEQ ID NO: 2988582 - DNA, 11 bp, Homo sapiens
tcacactccta

SEQ ID NO: 2988583 - DNA, 18 bp, Homo sapiens
tcacactcctcctgccag

SEQ ID NO: 2988584 - DNA, 22 bp, Homo sapiens
tcacactcctcctgccagctct

SEQ ID NO: 2988585 - DNA, 14 bp, Homo sapiens
tcacactctgtgtt

SEQ ID NO: 2988586 - DNA, 21 bp, Homo sapiens
tcacactgcaagagccttggt

SEQ ID NO: 2988587 - DNA, 16 bp, Homo sapiens
tcacactgggtggtgg

SEQ ID NO: 2988588 - DNA, 17 bp, Homo sapiens
tcacactggttctcaat

SEQ ID NO: 2988589 - DNA, 20 bp, Homo sapiens
tcacactggttctcaatgaa

SEQ ID NO: 2988590 - DNA, 20 bp, Homo sapiens
tcacacttactgtaagacat

SEQ ID NO: 2988591 - DNA, 20 bp, Homo sapiens
tcacagacgctcctgaagtt

SEQ ID NO: 2988592 - DNA, 18 bp, Homo sapiens
tcacagactcttccacca

SEQ ID NO: 2988593 - DNA, 16 bp, Homo sapiens
tcacagagcacgcctg

SEQ ID NO: 2988594 - DNA, 17 bp, Homo sapiens
tcacagaggcttcttca

SEQ ID NO: 2988595 - DNA, 19 bp, Homo sapiens
tcacagagtgagactccat

SEQ ID NO: 2988596 - DNA, 23 bp, Homo sapiens
tcacagagtgagactccatctca

SEQ ID NO: 2988597 - DNA, 14 bp, Homo sapiens
tcacagatgctggc

SEQ ID NO: 2988598 - DNA, 21 bp, Homo sapiens
tcacagatgctggcctcttgg

SEQ ID NO: 2988599 - DNA, 22 bp, Homo sapiens
tcacagatgctggcctcttggc

SEQ ID NO: 2988600 - DNA, 15 bp, Homo sapiens
tcacagatgctgtgt

SEQ ID NO: 2988601 - DNA, 15 bp, Homo sapiens
tcacaggaaggaaac

SEQ ID NO: 2988602 - DNA, 23 bp, Homo sapiens
tcacagggactgaaaacctctcc

SEQ ID NO: 2988603 - DNA, 12 bp, Homo sapiens
tcacagggtggg

SEQ ID NO: 2988604 - DNA, 17 bp, Homo sapiens
tcacaggtttgtttctt

SEQ ID NO: 2988605 - DNA, 18 bp, Homo sapiens
tcacaggtttgtttcttg

SEQ ID NO: 2988606 - DNA, 23 bp, Homo sapiens
tcacagttcaaaattctaaatgt

SEQ ID NO: 2988607 - DNA, 13 bp, Homo sapiens
tcacagttcctcg

SEQ ID NO: 2988608 - DNA, 18 bp, Homo sapiens
tcacagttcctcgccctg

SEQ ID NO: 2988609 - DNA, 20 bp, Homo sapiens
tcacagttctttgggccaga

SEQ ID NO: 2988610 - DNA, 19 bp, Homo sapiens
tcacataaatgcagcccat

SEQ ID NO: 2988611 - DNA, 16 bp, Homo sapiens
tcacatagccaactct

SEQ ID NO: 2988612 - DNA, 20 bp, Homo sapiens
tcacatagccaactctccca

SEQ ID NO: 2988613 - DNA, 18 bp, Homo sapiens
tcacatcatttgggatac

SEQ ID NO: 2988614 - DNA, 17 bp, Homo sapiens
tcacatcctgtgtttct

SEQ ID NO: 2988615 - DNA, 20 bp, Homo sapiens
tcacatctatccacactgtc

SEQ ID NO: 2988616 - DNA, 22 bp, Homo sapiens
tcacatctcccttccacctcac

SEQ ID NO: 2988617 - DNA, 19 bp, Homo sapiens
tcacatcttttaagacaaa

SEQ ID NO: 2988618 - DNA, 18 bp, Homo sapiens
tcacatgaccacatagca

SEQ ID NO: 2988619 - DNA, 14 bp, Homo sapiens
tcacatgcttgaat

SEQ ID NO: 2988620 - DNA, 22 bp, Homo sapiens
tcacatggaatctacatgtgtt

SEQ ID NO: 2988621 - DNA, 16 bp, Homo sapiens
tcacatggagctcttc

SEQ ID NO: 2988622 - DNA, 19 bp, Homo sapiens
tcacattactgtatatact

SEQ ID NO: 2988623 - DNA, 22 bp, Homo sapiens
tcacattagaagacaattgaca

SEQ ID NO: 2988624 - DNA, 13 bp, Homo sapiens
tcacattcttata

SEQ ID NO: 2988625 - DNA, 14 bp, Homo sapiens
tcacattcttggct

SEQ ID NO: 2988626 - DNA, 12 bp, Homo sapiens
tcacatttaaat

SEQ ID NO: 2988627 - DNA, 19 bp, Homo sapiens
tcacatttttacttggtgt

SEQ ID NO: 2988628 - DNA, 20 bp, Homo sapiens
tcaccaatgttgtacagaga

SEQ ID NO: 2988629 - DNA, 23 bp, Homo sapiens
tcaccaatgttgtacagagaaga

SEQ ID NO: 2988630 - DNA, 21 bp, Homo sapiens
tcaccacatcttgtcttttcc

SEQ ID NO: 2988631 - DNA, 18 bp, Homo sapiens
tcaccacctcatgtcatt

SEQ ID NO: 2988632 - DNA, 14 bp, Homo sapiens
tcaccaccttccca

SEQ ID NO: 2988633 - DNA, 15 bp, Homo sapiens
tcaccaccttcccag

SEQ ID NO: 2988634 - DNA, 15 bp, Homo sapiens
tcaccagacttttct

SEQ ID NO: 2988635 - DNA, 16 bp, Homo sapiens
tcaccagacttttctc

SEQ ID NO: 2988636 - DNA, 19 bp, Homo sapiens
tcaccagaggaatcactct

SEQ ID NO: 2988637 - DNA, 21 bp, Homo sapiens
tcaccagcccatcgccacaaa

SEQ ID NO: 2988638 - DNA, 13 bp, Homo sapiens
tcaccagctgcaa

SEQ ID NO: 2988639 - DNA, 15 bp, Homo sapiens
tcaccagctgcaaag

SEQ ID NO: 2988640 - DNA, 19 bp, Homo sapiens
tcaccagctgcaaagtgtt

SEQ ID NO: 2988641 - DNA, 13 bp, Homo sapiens
tcaccatatttga

SEQ ID NO: 2988642 - DNA, 22 bp, Homo sapiens
tcaccatatttgaattggcctg

SEQ ID NO: 2988643 - DNA, 14 bp, Homo sapiens
tcaccatgatgggg

SEQ ID NO: 2988644 - DNA, 19 bp, Homo sapiens
tcaccatgatggggcccta

SEQ ID NO: 2988645 - DNA, 11 bp, Homo sapiens
tcaccatgcaa

SEQ ID NO: 2988646 - DNA, 15 bp, Homo sapiens
tcaccatgttggcca

SEQ ID NO: 2988647 - DNA, 20 bp, Homo sapiens
tcaccattgacttcttggtg

SEQ ID NO: 2988648 - DNA, 23 bp, Homo sapiens
tcaccatttggcaatgccatcat

SEQ ID NO: 2988649 - DNA, 20 bp, Homo sapiens
tcacccaaagcctgtcccag

SEQ ID NO: 2988650 - DNA, 22 bp, Homo sapiens
tcacccacaaccctctggaagt

SEQ ID NO: 2988651 - DNA, 11 bp, Homo sapiens
tcacccacagg

SEQ ID NO: 2988652 - DNA, 12 bp, Homo sapiens
tcacccacaggg

SEQ ID NO: 2988653 - DNA, 14 bp, Homo sapiens
tcacccaccctgtg

SEQ ID NO: 2988654 - DNA, 16 bp, Homo sapiens
tcacccaccctgtggc

SEQ ID NO: 2988655 - DNA, 13 bp, Homo sapiens
tcacccagactag

SEQ ID NO: 2988656 - DNA, 20 bp, Homo sapiens
tcacccatgcaagcagagga

SEQ ID NO: 2988657 - DNA, 21 bp, Homo sapiens
tcacccatgcaagcagaggac

SEQ ID NO: 2988658 - DNA, 21 bp, Homo sapiens
tcaccccaaacccagaacatg

SEQ ID NO: 2988659 - DNA, 18 bp, Homo sapiens
tcaccccagagccacaca

SEQ ID NO: 2988660 - DNA, 16 bp, Homo sapiens
tcaccccagggcctga

SEQ ID NO: 2988661 - DNA, 15 bp, Homo sapiens
tcacccccctgctta

SEQ ID NO: 2988662 - DNA, 16 bp, Homo sapiens
tcacccccctgcttag

SEQ ID NO: 2988663 - DNA, 22 bp, Homo sapiens
tcacccccttctccatccacat

SEQ ID NO: 2988664 - DNA, 15 bp, Homo sapiens
tcaccctagccctct

SEQ ID NO: 2988665 - DNA, 20 bp, Homo sapiens
tcaccctctgtccccacgag

SEQ ID NO: 2988666 - DNA, 15 bp, Homo sapiens
tcaccctggccacca

SEQ ID NO: 2988667 - DNA, 17 bp, Homo sapiens
tcaccctggccaccacc

SEQ ID NO: 2988668 - DNA, 12 bp, Homo sapiens
tcaccctgtgac

SEQ ID NO: 2988669 - DNA, 15 bp, Homo sapiens
tcacccttcctggcc

SEQ ID NO: 2988670 - DNA, 19 bp, Homo sapiens
tcacccttggtagagttta

SEQ ID NO: 2988671 - DNA, 15 bp, Homo sapiens
tcaccgacagcggcc

SEQ ID NO: 2988672 - DNA, 23 bp, Homo sapiens
tcatgagtctacctgagcattca

SEQ ID NO: 2988673 - DNA, 13 bp, Homo sapiens
tcatgatctccct

SEQ ID NO: 2988674 - DNA, 14 bp, Homo sapiens
tcatgatctccctg

SEQ ID NO: 2988675 - DNA, 15 bp, Homo sapiens
tcatgatctccctgc

SEQ ID NO: 2988676 - DNA, 17 bp, Homo sapiens
tcatgatctccctgccg

SEQ ID NO: 2988677 - DNA, 14 bp, Homo sapiens
tcatgattagcaag

SEQ ID NO: 2988678 - DNA, 16 bp, Homo sapiens
tcatgattagcaagtt

SEQ ID NO: 2988679 - DNA, 17 bp, Homo sapiens
tcatgcatgtcaaacat

SEQ ID NO: 2988680 - DNA, 14 bp, Homo sapiens
tcatgccctcctct

SEQ ID NO: 2988681 - DNA, 15 bp, Homo sapiens
tcatgcctgatgaaa

SEQ ID NO: 2988682 - DNA, 23 bp, Homo sapiens
tcatgcctggaagctttgtcccc

SEQ ID NO: 2988683 - DNA, 16 bp, Homo sapiens
tcatgctaaaattcta

SEQ ID NO: 2988684 - DNA, 22 bp, Homo sapiens
tcatgctatatatcttttgtaa

SEQ ID NO: 2988685 - DNA, 21 bp, Homo sapiens
tcatggaaagactgggacagc

SEQ ID NO: 2988686 - DNA, 17 bp, Homo sapiens
tcatggaacacaaacac

SEQ ID NO: 2988687 - DNA, 18 bp, Homo sapiens
tcatggaacacaaacaca

SEQ ID NO: 2988688 - DNA, 12 bp, Homo sapiens
tcatggaatggt

SEQ ID NO: 2988689 - DNA, 21 bp, Homo sapiens
tcatggaatggttataaaagt

SEQ ID NO: 2988690 - DNA, 22 bp, Homo sapiens
tcatggaatggttataaaagtg

SEQ ID NO: 2988691 - DNA, 22 bp, Homo sapiens
tcatggcaagttgccattttgt

SEQ ID NO: 2988692 - DNA, 14 bp, Homo sapiens
tcatggccacactg

SEQ ID NO: 2988693 - DNA, 15 bp, Homo sapiens
tcatggccacactgt

SEQ ID NO: 2988694 - DNA, 14 bp, Homo sapiens
tcatggcttaggat

SEQ ID NO: 2988695 - DNA, 19 bp, Homo sapiens
tcatgggaacgcagcctcc

SEQ ID NO: 2988696 - DNA, 21 bp, Homo sapiens
tcatgggaacgcagcctccag

SEQ ID NO: 2988697 - DNA, 14 bp, Homo sapiens
tcatgggctgtgtg

SEQ ID NO: 2988698 - DNA, 15 bp, Homo sapiens
tcatgtaatcctcaa

SEQ ID NO: 2988699 - DNA, 22 bp, Homo sapiens
tcatgtactttttagtaatttc

SEQ ID NO: 2988700 - DNA, 22 bp, Homo sapiens
tcatgtctttccacttctctgg

SEQ ID NO: 2988701 - DNA, 14 bp, Homo sapiens
tcatgtgactcttt

SEQ ID NO: 2988702 - DNA, 18 bp, Homo sapiens
tcatgtgactctttccaa

SEQ ID NO: 2988703 - DNA, 14 bp, Homo sapiens
tcatgtgcagattg

SEQ ID NO: 2988704 - DNA, 19 bp, Homo sapiens
tcatgtggaatataaagat

SEQ ID NO: 2988705 - DNA, 16 bp, Homo sapiens
tcatgtggcttttaat

SEQ ID NO: 2988706 - DNA, 12 bp, Homo sapiens
tcatgtgtatga

SEQ ID NO: 2988707 - DNA, 22 bp, Homo sapiens
tcatgtgtgtattttttcatag

SEQ ID NO: 2988708 - DNA, 21 bp, Homo sapiens
tcatgtgtgtccacgactgtc

SEQ ID NO: 2988709 - DNA, 15 bp, Homo sapiens
tcatgttataaagca

SEQ ID NO: 2988710 - DNA, 15 bp, Homo sapiens
tcatgttcatgtgat

SEQ ID NO: 2988711 - DNA, 20 bp, Homo sapiens
tcatgttcgagcttacctac

SEQ ID NO: 2988712 - DNA, 19 bp, Homo sapiens
tcatgttgatcatgtactt

SEQ ID NO: 2988713 - DNA, 21 bp, Homo sapiens
tcatgttgatcatgtactttt

SEQ ID NO: 2988714 - DNA, 11 bp, Homo sapiens
tcatgtttctt

SEQ ID NO: 2988715 - DNA, 15 bp, Homo sapiens
tcatgtttcttaaat

SEQ ID NO: 2988716 - DNA, 16 bp, Homo sapiens
tcatgtttcttaaatg

SEQ ID NO: 2988717 - DNA, 22 bp, Homo sapiens
tcatgttttaaatgtacagttt

SEQ ID NO: 2988718 - DNA, 22 bp, Homo sapiens
tcatgttttccattgtttgaaa

SEQ ID NO: 2988719 - DNA, 15 bp, Homo sapiens
tcatgttttggtgaa

SEQ ID NO: 2988720 - DNA, 20 bp, Homo sapiens
tcatgttttttctgcaatga

SEQ ID NO: 2988721 - DNA, 20 bp, Homo sapiens
tcattaaaaacatagaaaaa

SEQ ID NO: 2988722 - DNA, 22 bp, Homo sapiens
tcattaaaaacatagaaaaatg

SEQ ID NO: 2988723 - DNA, 14 bp, Homo sapiens
tcattaaacttgaa

SEQ ID NO: 2988724 - DNA, 15 bp, Homo sapiens
tcattaaacttgaag

SEQ ID NO: 2988725 - DNA, 16 bp, Homo sapiens
tcattaaacttgaagc

SEQ ID NO: 2988726 - DNA, 12 bp, Homo sapiens
tcattaaagttc

SEQ ID NO: 2988727 - DNA, 13 bp, Homo sapiens
tcattaaagttct

SEQ ID NO: 2988728 - DNA, 17 bp, Homo sapiens
tcattaaatattctgta

SEQ ID NO: 2988729 - DNA, 18 bp, Homo sapiens
tcattaaatggtgatttc

SEQ ID NO: 2988730 - DNA, 19 bp, Homo sapiens
tcattaaatggtgatttct

SEQ ID NO: 2988731 - DNA, 14 bp, Homo sapiens
tcattaacacattg

SEQ ID NO: 2988732 - DNA, 15 bp, Homo sapiens
tcattaacacattgt

SEQ ID NO: 2988733 - DNA, 23 bp, Homo sapiens
tcattaaccgatgctttaccaaa

SEQ ID NO: 2988734 - DNA, 22 bp, Homo sapiens
tcattaatgacacttgtcccca

SEQ ID NO: 2988735 - DNA, 14 bp, Homo sapiens
tcattacaaatggt

SEQ ID NO: 2988736 - DNA, 20 bp, Homo sapiens
tcattagactggaacttgaa

SEQ ID NO: 2988737 - DNA, 23 bp, Homo sapiens
tcattattcgtagatattggaca

SEQ ID NO: 2988738 - DNA, 16 bp, Homo sapiens
tcattatttgataaca

SEQ ID NO: 2988739 - DNA, 22 bp, Homo sapiens
tcattatttgataacattttgt

SEQ ID NO: 2988740 - DNA, 18 bp, Homo sapiens
tcattcaaaagttgaaat

SEQ ID NO: 2988741 - DNA, 14 bp, Homo sapiens
tcattcacatttca

SEQ ID NO: 2988742 - DNA, 13 bp, Homo sapiens
tcattcagaaaaa

SEQ ID NO: 2988743 - DNA, 13 bp, Homo sapiens
tcattcaggaaaa

SEQ ID NO: 2988744 - DNA, 22 bp, Homo sapiens
tcattcataaaagtttgcatgt

SEQ ID NO: 2988745 - DNA, 13 bp, Homo sapiens
tcattccacactg

SEQ ID NO: 2988746 - DNA, 15 bp, Homo sapiens
tcattccacactgtt

SEQ ID NO: 2988747 - DNA, 19 bp, Homo sapiens
tcattccacaggacgaatg

SEQ ID NO: 2988748 - DNA, 12 bp, Homo sapiens
tcattccccagg

SEQ ID NO: 2988749 - DNA, 14 bp, Homo sapiens
tcattccccaggtg

SEQ ID NO: 2988750 - DNA, 16 bp, Homo sapiens
tcattcctaatgcatt

SEQ ID NO: 2988751 - DNA, 14 bp, Homo sapiens
tcattcctgttctt

SEQ ID NO: 2988752 - DNA, 18 bp, Homo sapiens
tcattcctgttctttctt

SEQ ID NO: 2988753 - DNA, 23 bp, Homo sapiens
tcattctcctcctcctccctcct

SEQ ID NO: 2988754 - DNA, 16 bp, Homo sapiens
tcattctctgtctcat

SEQ ID NO: 2988755 - DNA, 19 bp, Homo sapiens
tcattctctgtctcatcca

SEQ ID NO: 2988756 - DNA, 16 bp, Homo sapiens
tcattctgcaagtata

SEQ ID NO: 2988757 - DNA, 14 bp, Homo sapiens
tcattgaaatgtaa

SEQ ID NO: 2988758 - DNA, 21 bp, Homo sapiens
tcattgaaatgtaatttcagt

SEQ ID NO: 2988759 - DNA, 23 bp, Homo sapiens
tcattgaaatgtaatttcagttc

SEQ ID NO: 2988760 - DNA, 19 bp, Homo sapiens
tcattgaggacaaagaaaa

SEQ ID NO: 2988761 - DNA, 15 bp, Homo sapiens
tcattgatttcctgt

SEQ ID NO: 2988762 - DNA, 17 bp, Homo sapiens
tcattgatttcctgtgt

SEQ ID NO: 2988763 - DNA, 12 bp, Homo sapiens
tcattgcaaagt

SEQ ID NO: 2988764 - DNA, 20 bp, Homo sapiens
tcattgcacctatctcagcc

SEQ ID NO: 2988765 - DNA, 24 bp, Homo sapiens
tcattgcacctatctcagccatag

SEQ ID NO: 2988766 - DNA, 19 bp, Homo sapiens
tcattgccaagggcccaaa

SEQ ID NO: 2988767 - DNA, 15 bp, Homo sapiens
tcattgctgagcctc

SEQ ID NO: 2988768 - DNA, 17 bp, Homo sapiens
tcattgctgagcctctg

SEQ ID NO: 2988769 - DNA, 22 bp, Homo sapiens
tcattgctgagcctctgctccc

SEQ ID NO: 2988770 - DNA, 23 bp, Homo sapiens
tcattgctgagcctctgctcccc

SEQ ID NO: 2988771 - DNA, 21 bp, Homo sapiens
tcattgctgtctgcagccttg

SEQ ID NO: 2988772 - DNA, 18 bp, Homo sapiens
tcattggataaatttgaa

SEQ ID NO: 2988773 - DNA, 22 bp, Homo sapiens
tcattggcattctttgcaatac

SEQ ID NO: 2988774 - DNA, 23 bp, Homo sapiens
tcattggtggtagccatcaagca

SEQ ID NO: 2988775 - DNA, 18 bp, Homo sapiens
tcattgtctgtgtagagt

SEQ ID NO: 2988776 - DNA, 22 bp, Homo sapiens
tcatttaaaatgtaaactcttc

SEQ ID NO: 2988777 - DNA, 22 bp, Homo sapiens
tcatttactcaaaatctgtcat

SEQ ID NO: 2988778 - DNA, 13 bp, Homo sapiens
tcatttagagttt

SEQ ID NO: 2988779 - DNA, 14 bp, Homo sapiens
tcatttcatcctgt

SEQ ID NO: 2988780 - DNA, 21 bp, Homo sapiens
tcatttcctttgttgtctaca

SEQ ID NO: 2988781 - DNA, 18 bp, Homo sapiens
tcatttctcatggatttg

SEQ ID NO: 2988782 - DNA, 19 bp, Homo sapiens
tcatttctccagattatct

SEQ ID NO: 2988783 - DNA, 14 bp, Homo sapiens
tcatttctgtctcc

SEQ ID NO: 2988784 - DNA, 15 bp, Homo sapiens
tcatttcttatgaat

SEQ ID NO: 2988785 - DNA, 18 bp, Homo sapiens
tcatttgcttttgtcact

SEQ ID NO: 2988786 - DNA, 23 bp, Homo sapiens
tcatttggaggaaaaaaagcatg

SEQ ID NO: 2988787 - DNA, 20 bp, Homo sapiens
tcatttggttcattaattct

SEQ ID NO: 2988788 - DNA, 21 bp, Homo sapiens
tcatttgtggcagtcccttat

SEQ ID NO: 2988789 - DNA, 15 bp, Homo sapiens
tcatttgtttacatt

SEQ ID NO: 2988790 - DNA, 16 bp, Homo sapiens
tcattttatattgaaa

SEQ ID NO: 2988791 - DNA, 17 bp, Homo sapiens
tcattttatattgaaaa

SEQ ID NO: 2988792 - DNA, 17 bp, Homo sapiens
tcattttcacttttaaa

SEQ ID NO: 2988793 - DNA, 12 bp, Homo sapiens
tcattttcagag

SEQ ID NO: 2988794 - DNA, 13 bp, Homo sapiens
tcattttcagagt

SEQ ID NO: 2988795 - DNA, 15 bp, Homo sapiens
tcattttgtccatgt

SEQ ID NO: 2988796 - DNA, 13 bp, Homo sapiens
tcatttttaacta

SEQ ID NO: 2988797 - DNA, 16 bp, Homo sapiens
tcatttttaatcatga

SEQ ID NO: 2988798 - DNA, 18 bp, Homo sapiens
tcatttttaatcatgaaa

SEQ ID NO: 2988799 - DNA, 17 bp, Homo sapiens
tcatttttatcccttcc

SEQ ID NO: 2988800 - DNA, 11 bp, Homo sapiens
tcatttttcca

SEQ ID NO: 2988801 - DNA, 18 bp, Homo sapiens
tcatttttctctccctct

SEQ ID NO: 2988802 - DNA, 22 bp, Homo sapiens
tcatttttgtgggggctagaaa

SEQ ID NO: 2988803 - DNA, 23 bp, Homo sapiens
tcatttttgtttttggtttctta

SEQ ID NO: 2988804 - DNA, 18 bp, Homo sapiens
tcccatcccactgctccc

SEQ ID NO: 2988805 - DNA, 18 bp, Homo sapiens
tcccatgcaccaacccac

SEQ ID NO: 2988806 - DNA, 16 bp, Homo sapiens
tcccatggtccctagc

SEQ ID NO: 2988807 - DNA, 17 bp, Homo sapiens
tcccatggtccctagca

SEQ ID NO: 2988808 - DNA, 15 bp, Homo sapiens
tcccatgtaacagaa

SEQ ID NO: 2988809 - DNA, 16 bp, Homo sapiens
tcccatgtaacagaaa

SEQ ID NO: 2988810 - DNA, 17 bp, Homo sapiens
tcccatgtaacagaaag

SEQ ID NO: 2988811 - DNA, 15 bp, Homo sapiens
tcccatgtagccccc

SEQ ID NO: 2988812 - DNA, 17 bp, Homo sapiens
tcccattcctgaagaac

SEQ ID NO: 2988813 - DNA, 14 bp, Homo sapiens
tcccattgccctgg

SEQ ID NO: 2988814 - DNA, 16 bp, Homo sapiens
tcccattgtccctctg

SEQ ID NO: 2988815 - DNA, 19 bp, Homo sapiens
tcccattgtccctctgccc

SEQ ID NO: 2988816 - DNA, 21 bp, Homo sapiens
tcccattgtccctctgcccca

SEQ ID NO: 2988817 - DNA, 16 bp, Homo sapiens
tcccatttgttgctgc

SEQ ID NO: 2988818 - DNA, 12 bp, Homo sapiens
tcccattttggt

SEQ ID NO: 2988819 - DNA, 22 bp, Homo sapiens
tcccattttggtgtgcatctgt

SEQ ID NO: 2988820 - DNA, 14 bp, Homo sapiens
tccccaaaaattga

SEQ ID NO: 2988821 - DNA, 17 bp, Homo sapiens
tccccaaagccactgga

SEQ ID NO: 2988822 - DNA, 20 bp, Homo sapiens
tccccaaagccactggaagg

SEQ ID NO: 2988823 - DNA, 21 bp, Homo sapiens
tccccaaagccactggaagga

SEQ ID NO: 2988824 - DNA, 22 bp, Homo sapiens
tccccaaagccactggaaggag

SEQ ID NO: 2988825 - DNA, 16 bp, Homo sapiens
tccccaacagtgtgaa

SEQ ID NO: 2988826 - DNA, 16 bp, Homo sapiens
tccccaacatggatgt

SEQ ID NO: 2988827 - DNA, 20 bp, Homo sapiens
tccccaagcgcctggctgct

SEQ ID NO: 2988828 - DNA, 21 bp, Homo sapiens
tccccaataattgcagaacta

SEQ ID NO: 2988829 - DNA, 23 bp, Homo sapiens
tccccaatccatttggcagaact

SEQ ID NO: 2988830 - DNA, 21 bp, Homo sapiens
tccccaatgagacttgccttc

SEQ ID NO: 2988831 - DNA, 17 bp, Homo sapiens
tccccacagactgcccc

SEQ ID NO: 2988832 - DNA, 15 bp, Homo sapiens
tccccaccagagctg

SEQ ID NO: 2988833 - DNA, 20 bp, Homo sapiens
tccccaccagagctgcctcc

SEQ ID NO: 2988834 - DNA, 21 bp, Homo sapiens
tccccaccagagctgcctccc

SEQ ID NO: 2988835 - DNA, 16 bp, Homo sapiens
tccccacgagggctgg

SEQ ID NO: 2988836 - DNA, 16 bp, Homo sapiens
tccccagactctgcct

SEQ ID NO: 2988837 - DNA, 11 bp, Homo sapiens
tccccagagaa

SEQ ID NO: 2988838 - DNA, 22 bp, Homo sapiens
tccccagagaaaggggagccca

SEQ ID NO: 2988839 - DNA, 17 bp, Homo sapiens
tccccagagcccagctc

SEQ ID NO: 2988840 - DNA, 20 bp, Homo sapiens
tccccagagcccagctcttg

SEQ ID NO: 2988841 - DNA, 23 bp, Homo sapiens
tccccagcagggtcttttcatct

SEQ ID NO: 2988842 - DNA, 12 bp, Homo sapiens
tccccagcccag

SEQ ID NO: 2988843 - DNA, 14 bp, Homo sapiens
tccccagcccagag

SEQ ID NO: 2988844 - DNA, 16 bp, Homo sapiens
tccccagcccagagac

SEQ ID NO: 2988845 - DNA, 20 bp, Homo sapiens
tccccagcctctcctccttg

SEQ ID NO: 2988846 - DNA, 16 bp, Homo sapiens
tccccaggcacctcac

SEQ ID NO: 2988847 - DNA, 13 bp, Homo sapiens
tccccaggcccca

SEQ ID NO: 2988848 - DNA, 20 bp, Homo sapiens
tccccaggccccaggaagcc

SEQ ID NO: 2988849 - DNA, 14 bp, Homo sapiens
tccccaggcctggc

SEQ ID NO: 2988850 - DNA, 15 bp, Homo sapiens
tccccaggcctggct

SEQ ID NO: 2988851 - DNA, 16 bp, Homo sapiens
tccccaggcctggctc

SEQ ID NO: 2988852 - DNA, 17 bp, Homo sapiens
tccccaggcctggctcc

SEQ ID NO: 2988853 - DNA, 23 bp, Homo sapiens
tccccaggggagagggtctggag

SEQ ID NO: 2988854 - DNA, 17 bp, Homo sapiens
tccccatatttgtgttc

SEQ ID NO: 2988855 - DNA, 19 bp, Homo sapiens
tccccatatttgtgttcag

SEQ ID NO: 2988856 - DNA, 16 bp, Homo sapiens
tccccatcggccctgt

SEQ ID NO: 2988857 - DNA, 21 bp, Homo sapiens
tccccatcggccctgtcccct

SEQ ID NO: 2988858 - DNA, 22 bp, Homo sapiens
tccccatcggccctgtcccctg

SEQ ID NO: 2988859 - DNA, 13 bp, Homo sapiens
tccccatgcctgt

SEQ ID NO: 2988860 - DNA, 24 bp, Homo sapiens
tccccattagctttcaattccgta

SEQ ID NO: 2988861 - DNA, 23 bp, Homo sapiens
tcccccaaacatctggcatggct

SEQ ID NO: 2988862 - DNA, 18 bp, Homo sapiens
tcccccaaagggcctcct

SEQ ID NO: 2988863 - DNA, 22 bp, Homo sapiens
tcccccaacaccccgcctgcct

SEQ ID NO: 2988864 - DNA, 20 bp, Homo sapiens
tcccccaaccaaggaaggag

SEQ ID NO: 2988865 - DNA, 13 bp, Homo sapiens
tcccccaccctgg

SEQ ID NO: 2988866 - DNA, 20 bp, Homo sapiens
tcccccacgtctctctgcct

SEQ ID NO: 2988867 - DNA, 23 bp, Homo sapiens
tcccccagcagaatggaggcagg

SEQ ID NO: 2988868 - DNA, 23 bp, Homo sapiens
tcccccatctcgctccctcccag

SEQ ID NO: 2988869 - DNA, 13 bp, Homo sapiens
tccccccactgca

SEQ ID NO: 2988870 - DNA, 19 bp, Homo sapiens
tccccccactgcaggcccc

SEQ ID NO: 2988871 - DNA, 23 bp, Homo sapiens
tccccccactgcaggccccgctt

SEQ ID NO: 2988872 - DNA, 18 bp, Homo sapiens
tcccccccatgcactgtg

SEQ ID NO: 2988873 - DNA, 14 bp, Homo sapiens
tccccccccaggcc

SEQ ID NO: 2988874 - DNA, 18 bp, Homo sapiens
tccccccccaggccctcc

SEQ ID NO: 2988875 - DNA, 21 bp, Homo sapiens
tccccccccaggccctcccac

SEQ ID NO: 2988876 - DNA, 12 bp, Homo sapiens
tcccccctcact

SEQ ID NO: 2988877 - DNA, 22 bp, Homo sapiens
tcccccctcctctgaaacagct

SEQ ID NO: 2988878 - DNA, 20 bp, Homo sapiens
tccccctctcacgccacccc

SEQ ID NO: 2988879 - DNA, 12 bp, Homo sapiens
tccccctctgct

SEQ ID NO: 2988880 - DNA, 15 bp, Homo sapiens
tccccctctgtccag

SEQ ID NO: 2988881 - DNA, 14 bp, Homo sapiens
tccccctctgtctt

SEQ ID NO: 2988882 - DNA, 13 bp, Homo sapiens
tccccctgcagct

SEQ ID NO: 2988883 - DNA, 14 bp, Homo sapiens
tccccctgcagcta

SEQ ID NO: 2988884 - DNA, 13 bp, Homo sapiens
tccccctgccctg

SEQ ID NO: 2988885 - DNA, 22 bp, Homo sapiens
tcccccttcacaaagcccaagg

SEQ ID NO: 2988886 - DNA, 18 bp, Homo sapiens
tcccccttccgccttctc

SEQ ID NO: 2988887 - DNA, 14 bp, Homo sapiens
tccccgaggctgcc

SEQ ID NO: 2988888 - DNA, 17 bp, Homo sapiens
tccccgaggctgcccca

SEQ ID NO: 2988889 - DNA, 21 bp, Homo sapiens
tccccgaggctgccccaggcc

SEQ ID NO: 2988890 - DNA, 12 bp, Homo sapiens
tccccgagggct

SEQ ID NO: 2988891 - DNA, 19 bp, Homo sapiens
tccccgaggttgtggggag

SEQ ID NO: 2988892 - DNA, 16 bp, Homo sapiens
tccccgcattccaggc

SEQ ID NO: 2988893 - DNA, 22 bp, Homo sapiens
tccccgctccgtctctgtcctc

SEQ ID NO: 2988894 - DNA, 13 bp, Homo sapiens
tccccgctctgcc

SEQ ID NO: 2988895 - DNA, 15 bp, Homo sapiens
tccccgctctgccgc

SEQ ID NO: 2988896 - DNA, 22 bp, Homo sapiens
tccccggcatgagactcagtgc

SEQ ID NO: 2988897 - DNA, 15 bp, Homo sapiens
tccccggggcccagg

SEQ ID NO: 2988898 - DNA, 17 bp, Homo sapiens
tccccggggcccagggg

SEQ ID NO: 2988899 - DNA, 23 bp, Homo sapiens
tccccgggtctctcactgttgca

SEQ ID NO: 2988900 - DNA, 15 bp, Homo sapiens
tcccctacggaccag

SEQ ID NO: 2988901 - DNA, 16 bp, Homo sapiens
tcccctacggaccagg

SEQ ID NO: 2988902 - DNA, 20 bp, Homo sapiens
tcccctcacagactcttcca

SEQ ID NO: 2988903 - DNA, 15 bp, Homo sapiens
tcccctcagagccca

SEQ ID NO: 2988904 - DNA, 13 bp, Homo sapiens
tcccctcccagag

SEQ ID NO: 2988905 - DNA, 16 bp, Homo sapiens
tcccctccccatctgt

SEQ ID NO: 2988906 - DNA, 20 bp, Homo sapiens
tcccctcccccacccctgct

SEQ ID NO: 2988907 - DNA, 20 bp, Homo sapiens
tcccctcccccactcctcta

SEQ ID NO: 2988908 - DNA, 17 bp, Homo sapiens
tcccctccgccaggcga

SEQ ID NO: 2988909 - DNA, 15 bp, Homo sapiens
tcccctctccttcct

SEQ ID NO: 2988910 - DNA, 14 bp, Homo sapiens
tcccctgccagggc

SEQ ID NO: 2988911 - DNA, 15 bp, Homo sapiens
tcccctgccagggca

SEQ ID NO: 2988912 - DNA, 22 bp, Homo sapiens
tcccctgcccctttacggacac

SEQ ID NO: 2988913 - DNA, 18 bp, Homo sapiens
tcccctgccgcctcccgg

SEQ ID NO: 2988914 - DNA, 16 bp, Homo sapiens
tcccctggagtgtgtc

SEQ ID NO: 2988915 - DNA, 23 bp, Homo sapiens
tcccctggagtgtgtcagagccc

SEQ ID NO: 2988916 - DNA, 14 bp, Homo sapiens
tcccctggggaccc

SEQ ID NO: 2988917 - DNA, 13 bp, Homo sapiens
tcccctgtttcaa

SEQ ID NO: 2988918 - DNA, 22 bp, Homo sapiens
tccccttactgagcgcaagcca

SEQ ID NO: 2988919 - DNA, 16 bp, Homo sapiens
tccccttcccaggggc

SEQ ID NO: 2988920 - DNA, 15 bp, Homo sapiens
tccccttgcccttcc

SEQ ID NO: 2988921 - DNA, 16 bp, Homo sapiens
tccccttgcccttcct

SEQ ID NO: 2988922 - DNA, 20 bp, Homo sapiens
tccccttgcccttcctgacc

SEQ ID NO: 2988923 - DNA, 16 bp, Homo sapiens
tccccttgtccctggg

SEQ ID NO: 2988924 - DNA, 16 bp, Homo sapiens
tcccctttcgcccaca

SEQ ID NO: 2988925 - DNA, 19 bp, Homo sapiens
tcccctttcgcccacagtc

SEQ ID NO: 2988926 - DNA, 23 bp, Homo sapiens
tcccgaaccccaaggagggagat

SEQ ID NO: 2988927 - DNA, 21 bp, Homo sapiens
tcccgagtagctgggattaca

SEQ ID NO: 2988928 - DNA, 15 bp, Homo sapiens
tcccgccccgggctg

SEQ ID NO: 2988929 - DNA, 17 bp, Homo sapiens
tcccgccccgggctggc

SEQ ID NO: 2988930 - DNA, 14 bp, Homo sapiens
tcccgcctcagcct

SEQ ID NO: 2988931 - DNA, 16 bp, Homo sapiens
tcccgcctcagcctct

SEQ ID NO: 2988932 - DNA, 23 bp, Homo sapiens
tcccgcttagcgctctggacaga

SEQ ID NO: 2988933 - DNA, 21 bp, Homo sapiens
tcccggagggaaactgtgaat

SEQ ID NO: 2988934 - DNA, 18 bp, Homo sapiens
tcccggctgaccctgtgc

SEQ ID NO: 2988935 - DNA, 23 bp, Homo sapiens
tcccgggaagcatcctccccacc

SEQ ID NO: 2988936 - DNA, 22 bp, Homo sapiens
tcctggactggttatcttgtta

SEQ ID NO: 2988937 - DNA, 20 bp, Homo sapiens
tcctggagcagaaagtgcct

SEQ ID NO: 2988938 - DNA, 15 bp, Homo sapiens
tcctggaggcccagt

SEQ ID NO: 2988939 - DNA, 18 bp, Homo sapiens
tcctggagggcgcccagc

SEQ ID NO: 2988940 - DNA, 22 bp, Homo sapiens
tcctggagggcgcccagcagcc

SEQ ID NO: 2988941 - DNA, 23 bp, Homo sapiens
tcctggagggcgcccagcagcct

SEQ ID NO: 2988942 - DNA, 14 bp, Homo sapiens
tcctggagttgcat

SEQ ID NO: 2988943 - DNA, 16 bp, Homo sapiens
tcctggagttgcattg

SEQ ID NO: 2988944 - DNA, 17 bp, Homo sapiens
tcctggataaaaaagaa

SEQ ID NO: 2988945 - DNA, 21 bp, Homo sapiens
tcctggataaaaaagaaaaca

SEQ ID NO: 2988946 - DNA, 20 bp, Homo sapiens
tcctggccatcccacaagtg

SEQ ID NO: 2988947 - DNA, 15 bp, Homo sapiens
tcctggcctcagact

SEQ ID NO: 2988948 - DNA, 12 bp, Homo sapiens
tcctggcctcct

SEQ ID NO: 2988949 - DNA, 19 bp, Homo sapiens
tcctggctcaggcccagct

SEQ ID NO: 2988950 - DNA, 21 bp, Homo sapiens
tcctggctgtgaatgccaaag

SEQ ID NO: 2988951 - DNA, 14 bp, Homo sapiens
tcctggcttcaggc

SEQ ID NO: 2988952 - DNA, 16 bp, Homo sapiens
tcctgggaaatattcc

SEQ ID NO: 2988953 - DNA, 20 bp, Homo sapiens
tcctgggaaatattccctag

SEQ ID NO: 2988954 - DNA, 22 bp, Homo sapiens
tcctgggaggctgcagccaggc

SEQ ID NO: 2988955 - DNA, 16 bp, Homo sapiens
tcctgggccctctctg

SEQ ID NO: 2988956 - DNA, 17 bp, Homo sapiens
tcctgggccctctctgc

SEQ ID NO: 2988957 - DNA, 21 bp, Homo sapiens
tcctgggccctctctgctctg

SEQ ID NO: 2988958 - DNA, 15 bp, Homo sapiens
tcctgggcctgcaga

SEQ ID NO: 2988959 - DNA, 16 bp, Homo sapiens
tcctgggcctgcagaa

SEQ ID NO: 2988960 - DNA, 22 bp, Homo sapiens
tcctgggccttctcagctctcc

SEQ ID NO: 2988961 - DNA, 20 bp, Homo sapiens
tcctgggctgggtggcccct

SEQ ID NO: 2988962 - DNA, 12 bp, Homo sapiens
tcctggggccag

SEQ ID NO: 2988963 - DNA, 14 bp, Homo sapiens
tcctggggccaggc

SEQ ID NO: 2988964 - DNA, 15 bp, Homo sapiens
tcctggggccaggcc

SEQ ID NO: 2988965 - DNA, 15 bp, Homo sapiens
tcctggggcgtccag

SEQ ID NO: 2988966 - DNA, 21 bp, Homo sapiens
tcctgggtggtctgcaggcag

SEQ ID NO: 2988967 - DNA, 14 bp, Homo sapiens
tcctgggtttccat

SEQ ID NO: 2988968 - DNA, 17 bp, Homo sapiens
tcctggtcctggctgca

SEQ ID NO: 2988969 - DNA, 19 bp, Homo sapiens
tcctggtggctgggcccag

SEQ ID NO: 2988970 - DNA, 15 bp, Homo sapiens
tcctggtgtcacccc

SEQ ID NO: 2988971 - DNA, 24 bp, Homo sapiens
tcctggtgtcaccccagagccaca

SEQ ID NO: 2988972 - DNA, 22 bp, Homo sapiens
tcctggtttcataacttcctgt

SEQ ID NO: 2988973 - DNA, 16 bp, Homo sapiens
tcctggtttttgccta

SEQ ID NO: 2988974 - DNA, 21 bp, Homo sapiens
tcctgtagttgcgtggactct

SEQ ID NO: 2988975 - DNA, 22 bp, Homo sapiens
tcctgtagttgcgtggactctg

SEQ ID NO: 2988976 - DNA, 15 bp, Homo sapiens
tcctgtatgtctgtc

SEQ ID NO: 2988977 - DNA, 20 bp, Homo sapiens
tcctgtattcagacagatga

SEQ ID NO: 2988978 - DNA, 21 bp, Homo sapiens
tcctgtattcagacagatgag

SEQ ID NO: 2988979 - DNA, 18 bp, Homo sapiens
tcctgtccaacctaaccc

SEQ ID NO: 2988980 - DNA, 17 bp, Homo sapiens
tcctgtccacacccagc

SEQ ID NO: 2988981 - DNA, 14 bp, Homo sapiens
tcctgtccagctcc

SEQ ID NO: 2988982 - DNA, 16 bp, Homo sapiens
tcctgtccagctccaa

SEQ ID NO: 2988983 - DNA, 20 bp, Homo sapiens
tcctgtccccatctgtcggc

SEQ ID NO: 2988984 - DNA, 16 bp, Homo sapiens
tcctgtctcaatagct

SEQ ID NO: 2988985 - DNA, 18 bp, Homo sapiens
tcctgtctcaatagctcc

SEQ ID NO: 2988986 - DNA, 20 bp, Homo sapiens
tcctgtctcaatagctccaa

SEQ ID NO: 2988987 - DNA, 15 bp, Homo sapiens
tcctgtctccctcct

SEQ ID NO: 2988988 - DNA, 22 bp, Homo sapiens
tcctgtctttctgagcacactt

SEQ ID NO: 2988989 - DNA, 17 bp, Homo sapiens
tcctgtgatcttatttt

SEQ ID NO: 2988990 - DNA, 15 bp, Homo sapiens
tcctgtgcctttcct

SEQ ID NO: 2988991 - DNA, 21 bp, Homo sapiens
tcctgtgcctttcctatcacc

SEQ ID NO: 2988992 - DNA, 14 bp, Homo sapiens
tcctgtgctacaga

SEQ ID NO: 2988993 - DNA, 21 bp, Homo sapiens
tcctgtggcatgcaaaagaaa

SEQ ID NO: 2988994 - DNA, 15 bp, Homo sapiens
tcctgtgtcccctga

SEQ ID NO: 2988995 - DNA, 22 bp, Homo sapiens
tcctgtgtcccctgacctgtcc

SEQ ID NO: 2988996 - DNA, 23 bp, Homo sapiens
tcctgtgtcccctgacctgtcca

SEQ ID NO: 2988997 - DNA, 14 bp, Homo sapiens
tcctgttacctgtc

SEQ ID NO: 2988998 - DNA, 22 bp, Homo sapiens
tcctgttacttgcttctgctgt

SEQ ID NO: 2988999 - DNA, 19 bp, Homo sapiens
tcctgttaggccaactgcc

SEQ ID NO: 2989000 - DNA, 22 bp, Homo sapiens
tcctgttaggccaactgcctcc

SEQ ID NO: 2989001 - DNA, 18 bp, Homo sapiens
tcctgttcagtaataaaa

SEQ ID NO: 2989002 - DNA, 12 bp, Homo sapiens
tcctgttctgtg

SEQ ID NO: 2989003 - DNA, 19 bp, Homo sapiens
tcctgttggctgctgccac

SEQ ID NO: 2989004 - DNA, 17 bp, Homo sapiens
tcctgtttctgaaaaga

SEQ ID NO: 2989005 - DNA, 19 bp, Homo sapiens
tcctgtttctgaaaagaaa

SEQ ID NO: 2989006 - DNA, 21 bp, Homo sapiens
tcctgtttctgaaaagaaata

SEQ ID NO: 2989007 - DNA, 14 bp, Homo sapiens
tcctgttttctaaa

SEQ ID NO: 2989008 - DNA, 14 bp, Homo sapiens
tccttaaaatgtgg

SEQ ID NO: 2989009 - DNA, 19 bp, Homo sapiens
tccttaaggctcttttgta

SEQ ID NO: 2989010 - DNA, 20 bp, Homo sapiens
tccttaatttacctgttgtt

SEQ ID NO: 2989011 - DNA, 13 bp, Homo sapiens
tccttacattaaa

SEQ ID NO: 2989012 - DNA, 14 bp, Homo sapiens
tccttacccatctg

SEQ ID NO: 2989013 - DNA, 21 bp, Homo sapiens
tccttacctttaccccatccc

SEQ ID NO: 2989014 - DNA, 22 bp, Homo sapiens
tccttactcagagctgcgggct

SEQ ID NO: 2989015 - DNA, 15 bp, Homo sapiens
tccttactgtctctc

SEQ ID NO: 2989016 - DNA, 17 bp, Homo sapiens
tccttagaccttccata

SEQ ID NO: 2989017 - DNA, 14 bp, Homo sapiens
tccttagctgccaa

SEQ ID NO: 2989018 - DNA, 20 bp, Homo sapiens
tccttatagggaaaaatgca

SEQ ID NO: 2989019 - DNA, 21 bp, Homo sapiens
tccttatcactgacacaaaaa

SEQ ID NO: 2989020 - DNA, 14 bp, Homo sapiens
tccttattccacag

SEQ ID NO: 2989021 - DNA, 17 bp, Homo sapiens
tccttattccacagata

SEQ ID NO: 2989022 - DNA, 23 bp, Homo sapiens
tccttatttcaagggttgcttct

SEQ ID NO: 2989023 - DNA, 19 bp, Homo sapiens
tccttcactggcgccttct

SEQ ID NO: 2989024 - DNA, 20 bp, Homo sapiens
tccttcactggcgccttctc

SEQ ID NO: 2989025 - DNA, 20 bp, Homo sapiens
tccttcatcttttaaagaaa

SEQ ID NO: 2989026 - DNA, 20 bp, Homo sapiens
tccttccaacaggagctggg

SEQ ID NO: 2989027 - DNA, 15 bp, Homo sapiens
tccttccatccttga

SEQ ID NO: 2989028 - DNA, 13 bp, Homo sapiens
tccttccatgaaa

SEQ ID NO: 2989029 - DNA, 19 bp, Homo sapiens
tccttcccaagaagagaga

SEQ ID NO: 2989030 - DNA, 23 bp, Homo sapiens
tccttcccaagaagagagaactt

SEQ ID NO: 2989031 - DNA, 24 bp, Homo sapiens
tccttccccttgtccctggggcac

SEQ ID NO: 2989032 - DNA, 14 bp, Homo sapiens
tccttccctggctt

SEQ ID NO: 2989033 - DNA, 15 bp, Homo sapiens
tccttccctggcttg

SEQ ID NO: 2989034 - DNA, 16 bp, Homo sapiens
tccttccttccctggc

SEQ ID NO: 2989035 - DNA, 23 bp, Homo sapiens
tccttccttgttacccatgaaaa

SEQ ID NO: 2989036 - DNA, 14 bp, Homo sapiens
tccttctccacccc

SEQ ID NO: 2989037 - DNA, 19 bp, Homo sapiens
tccttctgcaactgaaatt

SEQ ID NO: 2989038 - DNA, 13 bp, Homo sapiens
tccttctgtgaag

SEQ ID NO: 2989039 - DNA, 14 bp, Homo sapiens
tccttctgtgaaga

SEQ ID NO: 2989040 - DNA, 21 bp, Homo sapiens
tccttctgtgaagaagccctg

SEQ ID NO: 2989041 - DNA, 14 bp, Homo sapiens
tccttcttccactt

SEQ ID NO: 2989042 - DNA, 12 bp, Homo sapiens
tccttctttaaa

SEQ ID NO: 2989043 - DNA, 22 bp, Homo sapiens
tccttctttctagttcagctgc

SEQ ID NO: 2989044 - DNA, 20 bp, Homo sapiens
tccttgaagacatatcatgt

SEQ ID NO: 2989045 - DNA, 13 bp, Homo sapiens
tccttgatgaatc

SEQ ID NO: 2989046 - DNA, 17 bp, Homo sapiens
tccttgcacctgcatcc

SEQ ID NO: 2989047 - DNA, 15 bp, Homo sapiens
tccttgcctgtctaa

SEQ ID NO: 2989048 - DNA, 17 bp, Homo sapiens
tccttgctcctggcctt

SEQ ID NO: 2989049 - DNA, 15 bp, Homo sapiens
tccttgcttgttaca

SEQ ID NO: 2989050 - DNA, 14 bp, Homo sapiens
tccttgcttttatg

SEQ ID NO: 2989051 - DNA, 13 bp, Homo sapiens
tccttggaggaca

SEQ ID NO: 2989052 - DNA, 17 bp, Homo sapiens
tccttggagtcccaggg

SEQ ID NO: 2989053 - DNA, 17 bp, Homo sapiens
tccttggcaactttctt

SEQ ID NO: 2989054 - DNA, 21 bp, Homo sapiens
tccttgggaggccccactggg

SEQ ID NO: 2989055 - DNA, 14 bp, Homo sapiens
tccttgggcagggt

SEQ ID NO: 2989056 - DNA, 13 bp, Homo sapiens
tccttgggccctt

SEQ ID NO: 2989057 - DNA, 14 bp, Homo sapiens
tccttgggcctggc

SEQ ID NO: 2989058 - DNA, 17 bp, Homo sapiens
tccttgggcctggccag

SEQ ID NO: 2989059 - DNA, 14 bp, Homo sapiens
tccttgtttcctta

SEQ ID NO: 2989060 - DNA, 15 bp, Homo sapiens
tcctttaactctgcg

SEQ ID NO: 2989061 - DNA, 18 bp, Homo sapiens
tcctttataagttgcttt

SEQ ID NO: 2989062 - DNA, 22 bp, Homo sapiens
tcctttataagttgctttcctc

SEQ ID NO: 2989063 - DNA, 14 bp, Homo sapiens
tcctttatactgtg

SEQ ID NO: 2989064 - DNA, 16 bp, Homo sapiens
tcctttcacacatctg

SEQ ID NO: 2989065 - DNA, 13 bp, Homo sapiens
tcctttccatctg

SEQ ID NO: 2989066 - DNA, 16 bp, Homo sapiens
tcctttccccttcctt

SEQ ID NO: 2989067 - DNA, 14 bp, Homo sapiens
tcctttctctgtat

SEQ ID NO: 2989068 - DNA, 16 bp, Homo sapiens
tctactcttaagccat

SEQ ID NO: 2989069 - DNA, 16 bp, Homo sapiens
tctactcttaatgatg

SEQ ID NO: 2989070 - DNA, 14 bp, Homo sapiens
tctactcttttgaa

SEQ ID NO: 2989071 - DNA, 12 bp, Homo sapiens
tctactgtggca

SEQ ID NO: 2989072 - DNA, 14 bp, Homo sapiens
tctacttctgtgtc

SEQ ID NO: 2989073 - DNA, 13 bp, Homo sapiens
tctactttctctt

SEQ ID NO: 2989074 - DNA, 20 bp, Homo sapiens
tctactttctcttgtttaaa

SEQ ID NO: 2989075 - DNA, 20 bp, Homo sapiens
tctactttgaagtcatacca

SEQ ID NO: 2989076 - DNA, 16 bp, Homo sapiens
tctactttgtttattt

SEQ ID NO: 2989077 - DNA, 19 bp, Homo sapiens
tctagaaaagcttcctagc

SEQ ID NO: 2989078 - DNA, 19 bp, Homo sapiens
tctagaacatccctgccag

SEQ ID NO: 2989079 - DNA, 20 bp, Homo sapiens
tctagaacatccctgccagc

SEQ ID NO: 2989080 - DNA, 18 bp, Homo sapiens
tctagaacattcagattt

SEQ ID NO: 2989081 - DNA, 15 bp, Homo sapiens
tctagaatcctgctt

SEQ ID NO: 2989082 - DNA, 16 bp, Homo sapiens
tctagaatcctgcttt

SEQ ID NO: 2989083 - DNA, 12 bp, Homo sapiens
tctagaatggtt

SEQ ID NO: 2989084 - DNA, 18 bp, Homo sapiens
tctagacatggaggttct

SEQ ID NO: 2989085 - DNA, 20 bp, Homo sapiens
tctagacatggaggttctaa

SEQ ID NO: 2989086 - DNA, 14 bp, Homo sapiens
tctagagcactgcc

SEQ ID NO: 2989087 - DNA, 15 bp, Homo sapiens
tctagagtccaaggt

SEQ ID NO: 2989088 - DNA, 14 bp, Homo sapiens
tctagagttcagag

SEQ ID NO: 2989089 - DNA, 19 bp, Homo sapiens
tctagagtttatacagtgt

SEQ ID NO: 2989090 - DNA, 22 bp, Homo sapiens
tctagatacctaaaacataaga

SEQ ID NO: 2989091 - DNA, 16 bp, Homo sapiens
tctagatcagatgctc

SEQ ID NO: 2989092 - DNA, 20 bp, Homo sapiens
tctagatcagatgctccaag

SEQ ID NO: 2989093 - DNA, 21 bp, Homo sapiens
tctagatcagatgctccaaga

SEQ ID NO: 2989094 - DNA, 14 bp, Homo sapiens
tctagatcataagg

SEQ ID NO: 2989095 - DNA, 21 bp, Homo sapiens
tctagatgaagttttacattg

SEQ ID NO: 2989096 - DNA, 16 bp, Homo sapiens
tctagatgatcaacat

SEQ ID NO: 2989097 - DNA, 22 bp, Homo sapiens
tctagatgtttattcttctaga

SEQ ID NO: 2989098 - DNA, 20 bp, Homo sapiens
tctagattcaaaggttctag

SEQ ID NO: 2989099 - DNA, 22 bp, Homo sapiens
tctagattcaaaggttctaggt

SEQ ID NO: 2989100 - DNA, 19 bp, Homo sapiens
tctagattccattggtcca

SEQ ID NO: 2989101 - DNA, 22 bp, Homo sapiens
tctagattccattggtccaaga

SEQ ID NO: 2989102 - DNA, 16 bp, Homo sapiens
tctagcaaatgttatg

SEQ ID NO: 2989103 - DNA, 19 bp, Homo sapiens
tctagcatgccaacaagaa

SEQ ID NO: 2989104 - DNA, 20 bp, Homo sapiens
tctagcatgccaacaagaat

SEQ ID NO: 2989105 - DNA, 17 bp, Homo sapiens
tctagccgctgccctgg

SEQ ID NO: 2989106 - DNA, 21 bp, Homo sapiens
tctagcctggggcttgaattt

SEQ ID NO: 2989107 - DNA, 20 bp, Homo sapiens
tctagccttagtcaataaac

SEQ ID NO: 2989108 - DNA, 18 bp, Homo sapiens
tctagctctatttacttc

SEQ ID NO: 2989109 - DNA, 15 bp, Homo sapiens
tctaggaagacattt

SEQ ID NO: 2989110 - DNA, 20 bp, Homo sapiens
tctaggagtcaactggctgg

SEQ ID NO: 2989111 - DNA, 15 bp, Homo sapiens
tctaggcactgtagt

SEQ ID NO: 2989112 - DNA, 21 bp, Homo sapiens
tctaggcactgtagttctaag

SEQ ID NO: 2989113 - DNA, 24 bp, Homo sapiens
tctaggcactgtagttctaagact

SEQ ID NO: 2989114 - DNA, 14 bp, Homo sapiens
tctaggctctgcct

SEQ ID NO: 2989115 - DNA, 17 bp, Homo sapiens
tctagggaaatgaaaga

SEQ ID NO: 2989116 - DNA, 15 bp, Homo sapiens
tctagggcagggtgg

SEQ ID NO: 2989117 - DNA, 22 bp, Homo sapiens
tctagggcggagaggctgcact

SEQ ID NO: 2989118 - DNA, 18 bp, Homo sapiens
tctagggtttcttaaata

SEQ ID NO: 2989119 - DNA, 17 bp, Homo sapiens
tctaggtaggaaatgtg

SEQ ID NO: 2989120 - DNA, 16 bp, Homo sapiens
tctaggtttctcttgt

SEQ ID NO: 2989121 - DNA, 14 bp, Homo sapiens
tctagtacataatt

SEQ ID NO: 2989122 - DNA, 14 bp, Homo sapiens
tctagtactagaaa

SEQ ID NO: 2989123 - DNA, 13 bp, Homo sapiens
tctagtagaacaa

SEQ ID NO: 2989124 - DNA, 16 bp, Homo sapiens
tctagtagaacaatgt

SEQ ID NO: 2989125 - DNA, 17 bp, Homo sapiens
tctagtagaacaatgta

SEQ ID NO: 2989126 - DNA, 22 bp, Homo sapiens
tctagtatgtcttgaaacatgt

SEQ ID NO: 2989127 - DNA, 23 bp, Homo sapiens
tctagtgccttctaaaggtgttg

SEQ ID NO: 2989128 - DNA, 12 bp, Homo sapiens
tctagtgggaag

SEQ ID NO: 2989129 - DNA, 23 bp, Homo sapiens
tctagtgtctgggtttggcccaa

SEQ ID NO: 2989130 - DNA, 18 bp, Homo sapiens
tctagttaactttttcca

SEQ ID NO: 2989131 - DNA, 14 bp, Homo sapiens
tctagttctgccag

SEQ ID NO: 2989132 - DNA, 19 bp, Homo sapiens
tctagttgaaaataaagtg

SEQ ID NO: 2989133 - DNA, 12 bp, Homo sapiens
tctagtttcctg

SEQ ID NO: 2989134 - DNA, 17 bp, Homo sapiens
tctagttttatacaaag

SEQ ID NO: 2989135 - DNA, 13 bp, Homo sapiens
tctataaggccat

SEQ ID NO: 2989136 - DNA, 22 bp, Homo sapiens
tctataaggccataaaacaggt

SEQ ID NO: 2989137 - DNA, 13 bp, Homo sapiens
tctataatttaaa

SEQ ID NO: 2989138 - DNA, 18 bp, Homo sapiens
tctataggaacatatgaa

SEQ ID NO: 2989139 - DNA, 15 bp, Homo sapiens
tctatatatgtgtat

SEQ ID NO: 2989140 - DNA, 18 bp, Homo sapiens
tctatatgtacttgtcaa

SEQ ID NO: 2989141 - DNA, 17 bp, Homo sapiens
tctatattttaatagaa

SEQ ID NO: 2989142 - DNA, 17 bp, Homo sapiens
tctatcaaatgtgatgg

SEQ ID NO: 2989143 - DNA, 19 bp, Homo sapiens
tctatcaaccccagacact

SEQ ID NO: 2989144 - DNA, 15 bp, Homo sapiens
tctatcattaaagtt

SEQ ID NO: 2989145 - DNA, 16 bp, Homo sapiens
tctatcattaaagttc

SEQ ID NO: 2989146 - DNA, 20 bp, Homo sapiens
tctatcgttattataaatgt

SEQ ID NO: 2989147 - DNA, 21 bp, Homo sapiens
tctatctgcaatgtttttgtg

SEQ ID NO: 2989148 - DNA, 23 bp, Homo sapiens
tctatctgcaatgtttttgtgta

SEQ ID NO: 2989149 - DNA, 17 bp, Homo sapiens
tctatcttgctctgtaa

SEQ ID NO: 2989150 - DNA, 19 bp, Homo sapiens
tctatcttgttccaaggcc

SEQ ID NO: 2989151 - DNA, 13 bp, Homo sapiens
tctatgaacctga

SEQ ID NO: 2989152 - DNA, 13 bp, Homo sapiens
tctatgatgtttc

SEQ ID NO: 2989153 - DNA, 22 bp, Homo sapiens
tctatgcagaacaggcagaaat

SEQ ID NO: 2989154 - DNA, 12 bp, Homo sapiens
tctatgctctcg

SEQ ID NO: 2989155 - DNA, 14 bp, Homo sapiens
tctatgtatattct

SEQ ID NO: 2989156 - DNA, 12 bp, Homo sapiens
tctatgtatgtg

SEQ ID NO: 2989157 - DNA, 22 bp, Homo sapiens
tctatgtatgtgccaattttgt

SEQ ID NO: 2989158 - DNA, 12 bp, Homo sapiens
tctatgtgaata

SEQ ID NO: 2989159 - DNA, 16 bp, Homo sapiens
tctatgtgaatatttg

SEQ ID NO: 2989160 - DNA, 20 bp, Homo sapiens
tctatgtgaatatttgtaaa

SEQ ID NO: 2989161 - DNA, 22 bp, Homo sapiens
tctatgtttacaaatggacata

SEQ ID NO: 2989162 - DNA, 19 bp, Homo sapiens
tctattaatcacctctctg

SEQ ID NO: 2989163 - DNA, 19 bp, Homo sapiens
tctattacccctcatttaa

SEQ ID NO: 2989164 - DNA, 14 bp, Homo sapiens
tctattccagctca

SEQ ID NO: 2989165 - DNA, 19 bp, Homo sapiens
tctattccagctcattcat

SEQ ID NO: 2989166 - DNA, 18 bp, Homo sapiens
tctattctgagaaaacaa

SEQ ID NO: 2989167 - DNA, 20 bp, Homo sapiens
tctattgtaattttgttcct

SEQ ID NO: 2989168 - DNA, 20 bp, Homo sapiens
tctatttaattaggaaaaaa

SEQ ID NO: 2989169 - DNA, 15 bp, Homo sapiens
tctatttatgtttgc

SEQ ID NO: 2989170 - DNA, 22 bp, Homo sapiens
tctatttattatcgcatacaga

SEQ ID NO: 2989171 - DNA, 13 bp, Homo sapiens
tctatttggaatt

SEQ ID NO: 2989172 - DNA, 13 bp, Homo sapiens
tctcaaaagaact

SEQ ID NO: 2989173 - DNA, 15 bp, Homo sapiens
tctcaaagctgggat

SEQ ID NO: 2989174 - DNA, 13 bp, Homo sapiens
tctcaaatgtttt

SEQ ID NO: 2989175 - DNA, 18 bp, Homo sapiens
tctcaagtatatgtcatt

SEQ ID NO: 2989176 - DNA, 15 bp, Homo sapiens
tctcaagttctaaga

SEQ ID NO: 2989177 - DNA, 16 bp, Homo sapiens
tctcaatacagcctga

SEQ ID NO: 2989178 - DNA, 22 bp, Homo sapiens
tctcaatagctccaagctgtta

SEQ ID NO: 2989179 - DNA, 18 bp, Homo sapiens
tctcaatcctgcagtggg

SEQ ID NO: 2989180 - DNA, 13 bp, Homo sapiens
tctcaatgtacat

SEQ ID NO: 2989181 - DNA, 12 bp, Homo sapiens
tctcaatttatt

SEQ ID NO: 2989182 - DNA, 18 bp, Homo sapiens
tctcacactcctcctgcc

SEQ ID NO: 2989183 - DNA, 22 bp, Homo sapiens
tctcacactggttctcaatgaa

SEQ ID NO: 2989184 - DNA, 22 bp, Homo sapiens
tctcacatggtgctacgcctgc

SEQ ID NO: 2989185 - DNA, 23 bp, Homo sapiens
tctcacatggtgctacgcctgca

SEQ ID NO: 2989186 - DNA, 22 bp, Homo sapiens
tctcacccatgcaagcagagga

SEQ ID NO: 2989187 - DNA, 21 bp, Homo sapiens
tctcacccccaccctagcctc

SEQ ID NO: 2989188 - DNA, 12 bp, Homo sapiens
tctcacctcagc

SEQ ID NO: 2989189 - DNA, 16 bp, Homo sapiens
tctcactataccagta

SEQ ID NO: 2989190 - DNA, 12 bp, Homo sapiens
tctcactccacc

SEQ ID NO: 2989191 - DNA, 20 bp, Homo sapiens
tctcactccttttggtgtgt

SEQ ID NO: 2989192 - DNA, 23 bp, Homo sapiens
tctcagaaggggatggtgttgtc

SEQ ID NO: 2989193 - DNA, 21 bp, Homo sapiens
tctcagccataggtgcagttt

SEQ ID NO: 2989194 - DNA, 22 bp, Homo sapiens
tctcagccccatcgccccaact

SEQ ID NO: 2989195 - DNA, 14 bp, Homo sapiens
tctcagctcccagg

SEQ ID NO: 2989196 - DNA, 15 bp, Homo sapiens
tctcagctcccaggc

SEQ ID NO: 2989197 - DNA, 15 bp, Homo sapiens
tctcagcttctaatt

SEQ ID NO: 2989198 - DNA, 20 bp, Homo sapiens
tctcaggaggaggctgccct

SEQ ID NO: 2989199 - DNA, 16 bp, Homo sapiens
tctcaggatccaagct

SEQ ID NO: 2989200 - DNA, 13 bp, Homo sapiens
tcttaaggagact

SEQ ID NO: 2989201 - DNA, 18 bp, Homo sapiens
tcttaaggtgaggcctgt

SEQ ID NO: 2989202 - DNA, 18 bp, Homo sapiens
tcttaatgatgttatctt

SEQ ID NO: 2989203 - DNA, 14 bp, Homo sapiens
tcttaattctgatg

SEQ ID NO: 2989204 - DNA, 17 bp, Homo sapiens
tcttaatttggataata

SEQ ID NO: 2989205 - DNA, 21 bp, Homo sapiens
tcttaattttggttgtattct

SEQ ID NO: 2989206 - DNA, 21 bp, Homo sapiens
tcttacaaggcaggcctttcc

SEQ ID NO: 2989207 - DNA, 22 bp, Homo sapiens
tcttacaaggcaggcctttcct

SEQ ID NO: 2989208 - DNA, 20 bp, Homo sapiens
tcttacagcacatcacctct

SEQ ID NO: 2989209 - DNA, 14 bp, Homo sapiens
tcttacatgttttc

SEQ ID NO: 2989210 - DNA, 18 bp, Homo sapiens
tcttaccaggttcactta

SEQ ID NO: 2989211 - DNA, 16 bp, Homo sapiens
tcttaccagtctcctc

SEQ ID NO: 2989212 - DNA, 22 bp, Homo sapiens
tcttacttcccccaccctgggt

SEQ ID NO: 2989213 - DNA, 13 bp, Homo sapiens
tcttactttgtgc

SEQ ID NO: 2989214 - DNA, 21 bp, Homo sapiens
tcttagaagtggaccaggaca

SEQ ID NO: 2989215 - DNA, 20 bp, Homo sapiens
tcttagaagtgttgtaaaag

SEQ ID NO: 2989216 - DNA, 14 bp, Homo sapiens
tcttagactacatt

SEQ ID NO: 2989217 - DNA, 20 bp, Homo sapiens
tcttagactacatttagaga

SEQ ID NO: 2989218 - DNA, 22 bp, Homo sapiens
tcttagatacactaaaaatctg

SEQ ID NO: 2989219 - DNA, 18 bp, Homo sapiens
tcttagatggattctcca

SEQ ID NO: 2989220 - DNA, 21 bp, Homo sapiens
tcttagattctctgtgtctaa

SEQ ID NO: 2989221 - DNA, 19 bp, Homo sapiens
tcttagattgggccatggc

SEQ ID NO: 2989222 - DNA, 15 bp, Homo sapiens
tcttagcctctggat

SEQ ID NO: 2989223 - DNA, 18 bp, Homo sapiens
tcttagcctctggatcta

SEQ ID NO: 2989224 - DNA, 23 bp, Homo sapiens
tcttagcctctggatctagaagg

SEQ ID NO: 2989225 - DNA, 20 bp, Homo sapiens
tcttagctactgtatgcaaa

SEQ ID NO: 2989226 - DNA, 20 bp, Homo sapiens
tcttagctatcattgcttcc

SEQ ID NO: 2989227 - DNA, 12 bp, Homo sapiens
tcttagctctgg

SEQ ID NO: 2989228 - DNA, 19 bp, Homo sapiens
tcttagctctggacgtgaa

SEQ ID NO: 2989229 - DNA, 19 bp, Homo sapiens
tcttagtgtggtatttgct

SEQ ID NO: 2989230 - DNA, 21 bp, Homo sapiens
tcttataaagtggacttctga

SEQ ID NO: 2989231 - DNA, 23 bp, Homo sapiens
tcttataaagtggacttctgaaa

SEQ ID NO: 2989232 - DNA, 11 bp, Homo sapiens
tcttataaata

SEQ ID NO: 2989233 - DNA, 19 bp, Homo sapiens
tcttatacgcttttctttg

SEQ ID NO: 2989234 - DNA, 15 bp, Homo sapiens
tcttatactgtacaa

SEQ ID NO: 2989235 - DNA, 18 bp, Homo sapiens
tcttatactgtacaataa

SEQ ID NO: 2989236 - DNA, 23 bp, Homo sapiens
tcttatagaataaaagctgtgga

SEQ ID NO: 2989237 - DNA, 13 bp, Homo sapiens
tcttatagttcta

SEQ ID NO: 2989238 - DNA, 16 bp, Homo sapiens
tcttatagttctaggc

SEQ ID NO: 2989239 - DNA, 17 bp, Homo sapiens
tcttatatctgaagatt

SEQ ID NO: 2989240 - DNA, 20 bp, Homo sapiens
tcttatcttgctttggagga

SEQ ID NO: 2989241 - DNA, 14 bp, Homo sapiens
tcttatgccttttc

SEQ ID NO: 2989242 - DNA, 18 bp, Homo sapiens
tcttatggaattgatttg

SEQ ID NO: 2989243 - DNA, 15 bp, Homo sapiens
tcttatggattcatt

SEQ ID NO: 2989244 - DNA, 16 bp, Homo sapiens
tcttattcaaagatga

SEQ ID NO: 2989245 - DNA, 14 bp, Homo sapiens
tcttatttggaatt

SEQ ID NO: 2989246 - DNA, 14 bp, Homo sapiens
tcttattttgtgga

SEQ ID NO: 2989247 - DNA, 18 bp, Homo sapiens
tcttatttttaatttttc

SEQ ID NO: 2989248 - DNA, 16 bp, Homo sapiens
tcttatttttctaaac

SEQ ID NO: 2989249 - DNA, 22 bp, Homo sapiens
tcttcaaattaaagtgctgttt

SEQ ID NO: 2989250 - DNA, 22 bp, Homo sapiens
tcttcaagagacccttcaaact

SEQ ID NO: 2989251 - DNA, 19 bp, Homo sapiens
tcttcaatttgttaacaga

SEQ ID NO: 2989252 - DNA, 23 bp, Homo sapiens
tcttcacctgattcaactaaaaa

SEQ ID NO: 2989253 - DNA, 15 bp, Homo sapiens
tcttcaccttggttt

SEQ ID NO: 2989254 - DNA, 19 bp, Homo sapiens
tcttcaccttggtttatga

SEQ ID NO: 2989255 - DNA, 14 bp, Homo sapiens
tcttcactcttagg

SEQ ID NO: 2989256 - DNA, 15 bp, Homo sapiens
tcttcactcttaggc

SEQ ID NO: 2989257 - DNA, 21 bp, Homo sapiens
tcttcactcttaggcactttg

SEQ ID NO: 2989258 - DNA, 15 bp, Homo sapiens
tcttcactgcaattt

SEQ ID NO: 2989259 - DNA, 17 bp, Homo sapiens
tcttcacttacaagaaa

SEQ ID NO: 2989260 - DNA, 15 bp, Homo sapiens
tcttcacttcctcca

SEQ ID NO: 2989261 - DNA, 23 bp, Homo sapiens
tcttcacttcctccagaagcctc

SEQ ID NO: 2989262 - DNA, 15 bp, Homo sapiens
tcttcacttttgcaa

SEQ ID NO: 2989263 - DNA, 22 bp, Homo sapiens
tcttcagaggagcatcagctgt

SEQ ID NO: 2989264 - DNA, 23 bp, Homo sapiens
tcttcagagtttgtcatatactg

SEQ ID NO: 2989265 - DNA, 22 bp, Homo sapiens
tcttcagcctctttctgtccct

SEQ ID NO: 2989266 - DNA, 11 bp, Homo sapiens
tcttcagctgg

SEQ ID NO: 2989267 - DNA, 12 bp, Homo sapiens
tcttcagctggt

SEQ ID NO: 2989268 - DNA, 14 bp, Homo sapiens
tcttcagctggtgg

SEQ ID NO: 2989269 - DNA, 19 bp, Homo sapiens
tcttcagtggaacacaaat

SEQ ID NO: 2989270 - DNA, 23 bp, Homo sapiens
tcttcagtggaacacaaatgaaa

SEQ ID NO: 2989271 - DNA, 13 bp, Homo sapiens
tcttcagttaatt

SEQ ID NO: 2989272 - DNA, 14 bp, Homo sapiens
tcttcatctccctg

SEQ ID NO: 2989273 - DNA, 13 bp, Homo sapiens
tcttcatcttcac

SEQ ID NO: 2989274 - DNA, 18 bp, Homo sapiens
tcttcatgcctgatgaaa

SEQ ID NO: 2989275 - DNA, 23 bp, Homo sapiens
tcttcattggctatataaaatgt

SEQ ID NO: 2989276 - DNA, 17 bp, Homo sapiens
tcttccagaagtgtgat

SEQ ID NO: 2989277 - DNA, 20 bp, Homo sapiens
tcttccagaagtgtgattgg

SEQ ID NO: 2989278 - DNA, 16 bp, Homo sapiens
tcttccagatgtgatg

SEQ ID NO: 2989279 - DNA, 11 bp, Homo sapiens
tcttccagcca

SEQ ID NO: 2989280 - DNA, 20 bp, Homo sapiens
tcttccaggactctctgctt

SEQ ID NO: 2989281 - DNA, 23 bp, Homo sapiens
tcttccaggagccaccttgccac

SEQ ID NO: 2989282 - DNA, 17 bp, Homo sapiens
tcttccagtttctgtaa

SEQ ID NO: 2989283 - DNA, 17 bp, Homo sapiens
tcttccattccttcatg

SEQ ID NO: 2989284 - DNA, 16 bp, Homo sapiens
tcttcccatcactgga

SEQ ID NO: 2989285 - DNA, 17 bp, Homo sapiens
tcttcccgcctcagcct

SEQ ID NO: 2989286 - DNA, 21 bp, Homo sapiens
tcttccctgcccctgtgcctc

SEQ ID NO: 2989287 - DNA, 22 bp, Homo sapiens
tcttccctgcccctgtgcctct

SEQ ID NO: 2989288 - DNA, 22 bp, Homo sapiens
tcttcccttttacatactgctg

SEQ ID NO: 2989289 - DNA, 15 bp, Homo sapiens
tcttccgggagctgg

SEQ ID NO: 2989290 - DNA, 17 bp, Homo sapiens
tcttcctacctatccca

SEQ ID NO: 2989291 - DNA, 15 bp, Homo sapiens
tcttcctcatcctgc

SEQ ID NO: 2989292 - DNA, 21 bp, Homo sapiens
tcttcctcatcctgcttctct

SEQ ID NO: 2989293 - DNA, 18 bp, Homo sapiens
tcttcctccagtctgttc

SEQ ID NO: 2989294 - DNA, 21 bp, Homo sapiens
tcttcctccagtctgttctca

SEQ ID NO: 2989295 - DNA, 18 bp, Homo sapiens
tcttcctccgaggccagt

SEQ ID NO: 2989296 - DNA, 22 bp, Homo sapiens
tcttcctgcagtgttttgcata

SEQ ID NO: 2989297 - DNA, 21 bp, Homo sapiens
tcttcctgtggctccctctct

SEQ ID NO: 2989298 - DNA, 19 bp, Homo sapiens
tcttcctgttctgtgactg

SEQ ID NO: 2989299 - DNA, 9 bp, Homo sapiens
tcttccttg

SEQ ID NO: 2989300 - DNA, 14 bp, Homo sapiens
tcttcctttcagaa

SEQ ID NO: 2989301 - DNA, 19 bp, Homo sapiens
tcttcggccgagctggttt

SEQ ID NO: 2989302 - DNA, 20 bp, Homo sapiens
tcttcggccgagctggtttc

SEQ ID NO: 2989303 - DNA, 13 bp, Homo sapiens
tcttcgtatatac

SEQ ID NO: 2989304 - DNA, 14 bp, Homo sapiens
tcttcgtcttcact

SEQ ID NO: 2989305 - DNA, 18 bp, Homo sapiens
tcttcgtcttcactctta

SEQ ID NO: 2989306 - DNA, 16 bp, Homo sapiens
tcttctaaaacttgta

SEQ ID NO: 2989307 - DNA, 20 bp, Homo sapiens
tcttctaatcataacatagt

SEQ ID NO: 2989308 - DNA, 21 bp, Homo sapiens
tcttctagaagataacatttt

SEQ ID NO: 2989309 - DNA, 14 bp, Homo sapiens
tcttctagagttca

SEQ ID NO: 2989310 - DNA, 18 bp, Homo sapiens
tcttctcaagttctaaga

SEQ ID NO: 2989311 - DNA, 21 bp, Homo sapiens
tcttctcaagttctaagattc

SEQ ID NO: 2989312 - DNA, 12 bp, Homo sapiens
tcttctccatct

SEQ ID NO: 2989313 - DNA, 17 bp, Homo sapiens
tcttctccttcaaaaca

SEQ ID NO: 2989314 - DNA, 21 bp, Homo sapiens
tcttctctggcgacagttttc

SEQ ID NO: 2989315 - DNA, 21 bp, Homo sapiens
tcttctcttccttttatcagt

SEQ ID NO: 2989316 - DNA, 15 bp, Homo sapiens
tcttctcttctttgg

SEQ ID NO: 2989317 - DNA, 19 bp, Homo sapiens
tcttctcttgacagtctga

SEQ ID NO: 2989318 - DNA, 20 bp, Homo sapiens
tcttctgaagtgctgctcca

SEQ ID NO: 2989319 - DNA, 22 bp, Homo sapiens
tcttctgccctaacctgacaga

SEQ ID NO: 2989320 - DNA, 18 bp, Homo sapiens
tcttctgggcagagcctg

SEQ ID NO: 2989321 - DNA, 20 bp, Homo sapiens
tcttctgggcagagcctgtc

SEQ ID NO: 2989322 - DNA, 19 bp, Homo sapiens
tcttctgtatactgtggag

SEQ ID NO: 2989323 - DNA, 13 bp, Homo sapiens
tcttctgtggacc

SEQ ID NO: 2989324 - DNA, 21 bp, Homo sapiens
tcttctgtgtttataaaatat

SEQ ID NO: 2989325 - DNA, 18 bp, Homo sapiens
tcttcttaacagtttagt

SEQ ID NO: 2989326 - DNA, 19 bp, Homo sapiens
tcttcttcctgaagctgag

SEQ ID NO: 2989327 - DNA, 19 bp, Homo sapiens
tcttcttggggcccagtgc

SEQ ID NO: 2989328 - DNA, 15 bp, Homo sapiens
tcttcttgtttctcc

SEQ ID NO: 2989329 - DNA, 17 bp, Homo sapiens
tcttctttcagacttgc

SEQ ID NO: 2989330 - DNA, 19 bp, Homo sapiens
tcttctttcagacttgcca

SEQ ID NO: 2989331 - DNA, 12 bp, Homo sapiens
tgaaggaaacag

SEQ ID NO: 2989332 - DNA, 20 bp, Homo sapiens
tgaaggaaatgagtggccag

SEQ ID NO: 2989333 - DNA, 18 bp, Homo sapiens
tgaaggacttagccgact

SEQ ID NO: 2989334 - DNA, 22 bp, Homo sapiens
tgaaggctcatttacttgaaat

SEQ ID NO: 2989335 - DNA, 15 bp, Homo sapiens
tgaaggcttctctct

SEQ ID NO: 2989336 - DNA, 23 bp, Homo sapiens
tgaagggaaggcaaaggcagagg

SEQ ID NO: 2989337 - DNA, 13 bp, Homo sapiens
tgaagggagaaag

SEQ ID NO: 2989338 - DNA, 12 bp, Homo sapiens
tgaagggccaga

SEQ ID NO: 2989339 - DNA, 16 bp, Homo sapiens
tgaagggccagagcca

SEQ ID NO: 2989340 - DNA, 18 bp, Homo sapiens
tgaagggccagagccagg

SEQ ID NO: 2989341 - DNA, 19 bp, Homo sapiens
tgaagggccagagccaggg

SEQ ID NO: 2989342 - DNA, 23 bp, Homo sapiens
tgaaggggcaaattcttttgaat

SEQ ID NO: 2989343 - DNA, 22 bp, Homo sapiens
tgaaggggccaaggagggtgag

SEQ ID NO: 2989344 - DNA, 22 bp, Homo sapiens
tgaaggtctgtcataggactct

SEQ ID NO: 2989345 - DNA, 15 bp, Homo sapiens
tgaaggtgctgacgg

SEQ ID NO: 2989346 - DNA, 20 bp, Homo sapiens
tgaaggtgctgacggccagg

SEQ ID NO: 2989347 - DNA, 15 bp, Homo sapiens
tgaaggtgtgctaca

SEQ ID NO: 2989348 - DNA, 16 bp, Homo sapiens
tgaaggtttgagagca

SEQ ID NO: 2989349 - DNA, 20 bp, Homo sapiens
tgaagtaactataacaaaaa

SEQ ID NO: 2989350 - DNA, 20 bp, Homo sapiens
tgaagtaatgaatttttatg

SEQ ID NO: 2989351 - DNA, 16 bp, Homo sapiens
tgaagtacttttaacg

SEQ ID NO: 2989352 - DNA, 15 bp, Homo sapiens
tgaagtatactgtat

SEQ ID NO: 2989353 - DNA, 13 bp, Homo sapiens
tgaagtccaggac

SEQ ID NO: 2989354 - DNA, 16 bp, Homo sapiens
tgaagtccaggactgg

SEQ ID NO: 2989355 - DNA, 18 bp, Homo sapiens
tgaagtcttgcattgaat

SEQ ID NO: 2989356 - DNA, 17 bp, Homo sapiens
tgaagtctttaatattt

SEQ ID NO: 2989357 - DNA, 21 bp, Homo sapiens
tgaagtgaggacaaaatcaca

SEQ ID NO: 2989358 - DNA, 14 bp, Homo sapiens
tgaagtgcttgcag

SEQ ID NO: 2989359 - DNA, 20 bp, Homo sapiens
tgaagtgggaaagcattttc

SEQ ID NO: 2989360 - DNA, 16 bp, Homo sapiens
tgaagtggttcagtct

SEQ ID NO: 2989361 - DNA, 16 bp, Homo sapiens
tgaagtgtgtttcctt

SEQ ID NO: 2989362 - DNA, 17 bp, Homo sapiens
tgaagtgttaatactag

SEQ ID NO: 2989363 - DNA, 16 bp, Homo sapiens
tgaagttacatgcata

SEQ ID NO: 2989364 - DNA, 18 bp, Homo sapiens
tgaagttacatgcataaa

SEQ ID NO: 2989365 - DNA, 21 bp, Homo sapiens
tgaagttagaattccttcagg

SEQ ID NO: 2989366 - DNA, 15 bp, Homo sapiens
tgaagttgttttttt

SEQ ID NO: 2989367 - DNA, 16 bp, Homo sapiens
tgaagtttggagatag

SEQ ID NO: 2989368 - DNA, 17 bp, Homo sapiens
tgaagttttacattgtt

SEQ ID NO: 2989369 - DNA, 12 bp, Homo sapiens
tgaataaaccaa

SEQ ID NO: 2989370 - DNA, 14 bp, Homo sapiens
tgaataaaccaaga

SEQ ID NO: 2989371 - DNA, 18 bp, Homo sapiens
tgaataaagaatacttga

SEQ ID NO: 2989372 - DNA, 19 bp, Homo sapiens
tgaataaagaatacttgaa

SEQ ID NO: 2989373 - DNA, 18 bp, Homo sapiens
tgaataaagcctgctttt

SEQ ID NO: 2989374 - DNA, 20 bp, Homo sapiens
tgaataaagggaacatgcag

SEQ ID NO: 2989375 - DNA, 17 bp, Homo sapiens
tgaataataaatacaca

SEQ ID NO: 2989376 - DNA, 20 bp, Homo sapiens
tgaatacagcagcaagaaaa

SEQ ID NO: 2989377 - DNA, 21 bp, Homo sapiens
tgaatacagcagcaagaaaaa

SEQ ID NO: 2989378 - DNA, 15 bp, Homo sapiens
tgaatactttataaa

SEQ ID NO: 2989379 - DNA, 17 bp, Homo sapiens
tgaatagtcctaaaaag

SEQ ID NO: 2989380 - DNA, 22 bp, Homo sapiens
tgaatataatatatttgtgtat

SEQ ID NO: 2989381 - DNA, 16 bp, Homo sapiens
tgaatatgcctgtaat

SEQ ID NO: 2989382 - DNA, 19 bp, Homo sapiens
tgaatatggaagtaaaggc

SEQ ID NO: 2989383 - DNA, 21 bp, Homo sapiens
tgaatatggactcagttttct

SEQ ID NO: 2989384 - DNA, 11 bp, Homo sapiens
tgaatattaaa

SEQ ID NO: 2989385 - DNA, 16 bp, Homo sapiens
tgaatattaagaaaca

SEQ ID NO: 2989386 - DNA, 16 bp, Homo sapiens
tgaatcaataatatat

SEQ ID NO: 2989387 - DNA, 22 bp, Homo sapiens
tgaatcaataatatattttctg

SEQ ID NO: 2989388 - DNA, 13 bp, Homo sapiens
tgaatcaatgtat

SEQ ID NO: 2989389 - DNA, 16 bp, Homo sapiens
tgaatcaatgtattaa

SEQ ID NO: 2989390 - DNA, 22 bp, Homo sapiens
tgaatcagaacagatgctgagc

SEQ ID NO: 2989391 - DNA, 18 bp, Homo sapiens
tgaatcagaccctacccc

SEQ ID NO: 2989392 - DNA, 16 bp, Homo sapiens
tgaatcaggaaactca

SEQ ID NO: 2989393 - DNA, 19 bp, Homo sapiens
tgaatcatgtagtatcaaa

SEQ ID NO: 2989394 - DNA, 19 bp, Homo sapiens
tgaatccaaatctgtcctc

SEQ ID NO: 2989395 - DNA, 16 bp, Homo sapiens
tgaatccatgggtctg

SEQ ID NO: 2989396 - DNA, 17 bp, Homo sapiens
tgaatccattgaaagtg

SEQ ID NO: 2989397 - DNA, 16 bp, Homo sapiens
tgaatctatttaagta

SEQ ID NO: 2989398 - DNA, 22 bp, Homo sapiens
tgaatctgggtgggataatgga

SEQ ID NO: 2989399 - DNA, 17 bp, Homo sapiens
tgaatgaaaataactga

SEQ ID NO: 2989400 - DNA, 21 bp, Homo sapiens
tgaatgaaaataactgaacca

SEQ ID NO: 2989401 - DNA, 16 bp, Homo sapiens
tgaatgaaacccccac

SEQ ID NO: 2989402 - DNA, 21 bp, Homo sapiens
tgaatgaaacccccacacaca

SEQ ID NO: 2989403 - DNA, 11 bp, Homo sapiens
tgaatgaacac

SEQ ID NO: 2989404 - DNA, 12 bp, Homo sapiens
tgaatgaacact

SEQ ID NO: 2989405 - DNA, 13 bp, Homo sapiens
tgaatgaatggga

SEQ ID NO: 2989406 - DNA, 14 bp, Homo sapiens
tgaatgagaatcta

SEQ ID NO: 2989407 - DNA, 17 bp, Homo sapiens
tgaatgaggaacaatca

SEQ ID NO: 2989408 - DNA, 21 bp, Homo sapiens
tgaatgaggaacaatcacaaa

SEQ ID NO: 2989409 - DNA, 23 bp, Homo sapiens
tgaatgagtctgttgtgtgtcat

SEQ ID NO: 2989410 - DNA, 18 bp, Homo sapiens
tgaatgcagcactgctgc

SEQ ID NO: 2989411 - DNA, 17 bp, Homo sapiens
tgaatgcttctgattta

SEQ ID NO: 2989412 - DNA, 14 bp, Homo sapiens
tgaatgctttgcat

SEQ ID NO: 2989413 - DNA, 21 bp, Homo sapiens
tgaatgctttgcatttggaat

SEQ ID NO: 2989414 - DNA, 19 bp, Homo sapiens
tgaatggaggacttttctg

SEQ ID NO: 2989415 - DNA, 14 bp, Homo sapiens
tgaatggctttgtc

SEQ ID NO: 2989416 - DNA, 20 bp, Homo sapiens
tgaatgggatcatgaaagta

SEQ ID NO: 2989417 - DNA, 18 bp, Homo sapiens
tgaatggtctagaaacat

SEQ ID NO: 2989418 - DNA, 22 bp, Homo sapiens
tgaatggttccactcaaatgtc

SEQ ID NO: 2989419 - DNA, 19 bp, Homo sapiens
tgaatgtatgcttcataca

SEQ ID NO: 2989420 - DNA, 23 bp, Homo sapiens
tgaatgtatgcttcatacaggga

SEQ ID NO: 2989421 - DNA, 23 bp, Homo sapiens
tgaatgtatttatttgggagacc

SEQ ID NO: 2989422 - DNA, 17 bp, Homo sapiens
tgaatgtccaaaattta

SEQ ID NO: 2989423 - DNA, 15 bp, Homo sapiens
tgaatgtcttccttt

SEQ ID NO: 2989424 - DNA, 19 bp, Homo sapiens
tgaatgtcttccttttctt

SEQ ID NO: 2989425 - DNA, 22 bp, Homo sapiens
tgaatgtcttttttcaaacttt

SEQ ID NO: 2989426 - DNA, 18 bp, Homo sapiens
tgaatgtggcttgagaaa

SEQ ID NO: 2989427 - DNA, 12 bp, Homo sapiens
tgaatgtgtgag

SEQ ID NO: 2989428 - DNA, 17 bp, Homo sapiens
tgaatgtttacatgtca

SEQ ID NO: 2989429 - DNA, 11 bp, Homo sapiens
tgaatgtttcc

SEQ ID NO: 2989430 - DNA, 21 bp, Homo sapiens
tgaatgtttgtgtctgtggtt

SEQ ID NO: 2989431 - DNA, 15 bp, Homo sapiens
tgaattaaataaata

SEQ ID NO: 2989432 - DNA, 16 bp, Homo sapiens
tgaattaaattaggaa

SEQ ID NO: 2989433 - DNA, 14 bp, Homo sapiens
tgaattaattcaga

SEQ ID NO: 2989434 - DNA, 23 bp, Homo sapiens
tgaattacagcagttgactcaga

SEQ ID NO: 2989435 - DNA, 21 bp, Homo sapiens
tgaattaggggacactgtctt

SEQ ID NO: 2989436 - DNA, 16 bp, Homo sapiens
tgaattcatactctgt

SEQ ID NO: 2989437 - DNA, 18 bp, Homo sapiens
tgaattcctagaattaaa

SEQ ID NO: 2989438 - DNA, 21 bp, Homo sapiens
tgaattcctgtcttccaaatt

SEQ ID NO: 2989439 - DNA, 14 bp, Homo sapiens
tgaattgaaatttt

SEQ ID NO: 2989440 - DNA, 16 bp, Homo sapiens
tgaattgcgttggtct

SEQ ID NO: 2989441 - DNA, 13 bp, Homo sapiens
tgaattggcctga

SEQ ID NO: 2989442 - DNA, 20 bp, Homo sapiens
tgaattggcctgaacagatg

SEQ ID NO: 2989443 - DNA, 18 bp, Homo sapiens
tgaattgtaactgttctt

SEQ ID NO: 2989444 - DNA, 17 bp, Homo sapiens
tgaatttaagcatgagt

SEQ ID NO: 2989445 - DNA, 19 bp, Homo sapiens
tgaatttaataatctgtag

SEQ ID NO: 2989446 - DNA, 13 bp, Homo sapiens
tgaatttagtcat

SEQ ID NO: 2989447 - DNA, 18 bp, Homo sapiens
tgaatttcttcttttcct

SEQ ID NO: 2989448 - DNA, 21 bp, Homo sapiens
tgaatttcttcttttcctgca

SEQ ID NO: 2989449 - DNA, 21 bp, Homo sapiens
tgaatttgagtttgctgtttt

SEQ ID NO: 2989450 - DNA, 21 bp, Homo sapiens
tgaatttgcaaagtactgtaa

SEQ ID NO: 2989451 - DNA, 18 bp, Homo sapiens
tgaatttgccctgggaaa

SEQ ID NO: 2989452 - DNA, 22 bp, Homo sapiens
tgaatttgtaagcaacttgctt

SEQ ID NO: 2989453 - DNA, 14 bp, Homo sapiens
tgaattttaaaaca

SEQ ID NO: 2989454 - DNA, 14 bp, Homo sapiens
tgaattttaagggt

SEQ ID NO: 2989455 - DNA, 15 bp, Homo sapiens
tgaatttttatttct

SEQ ID NO: 2989456 - DNA, 15 bp, Homo sapiens
tgaatttttctctaa

SEQ ID NO: 2989457 - DNA, 15 bp, Homo sapiens
tgaatttttgcaata

SEQ ID NO: 2989458 - DNA, 16 bp, Homo sapiens
tgaatttttgcaataa

SEQ ID NO: 2989459 - DNA, 23 bp, Homo sapiens
tgaatttttgcaataatgcagta

SEQ ID NO: 2989460 - DNA, 22 bp, Homo sapiens
tgacaaacccaggagtttgtgt

SEQ ID NO: 2989461 - DNA, 15 bp, Homo sapiens
tgacaaagaaaccca

SEQ ID NO: 2989462 - DNA, 19 bp, Homo sapiens
tgacaaagaaacccaagtg

SEQ ID NO: 2989463 - DNA, 22 bp, Homo sapiens
tgaggcatgagttactgtgcat

SEQ ID NO: 2989464 - DNA, 23 bp, Homo sapiens
tgaggccaccagtaaaagacatt

SEQ ID NO: 2989465 - DNA, 16 bp, Homo sapiens
tgaggccgcggcctcc

SEQ ID NO: 2989466 - DNA, 15 bp, Homo sapiens
tgaggccggccctgc

SEQ ID NO: 2989467 - DNA, 16 bp, Homo sapiens
tgaggccggccctgcc

SEQ ID NO: 2989468 - DNA, 18 bp, Homo sapiens
tgaggccggccctgcccc

SEQ ID NO: 2989469 - DNA, 19 bp, Homo sapiens
tgaggccggccctgcccct

SEQ ID NO: 2989470 - DNA, 13 bp, Homo sapiens
tgaggcctccctt

SEQ ID NO: 2989471 - DNA, 19 bp, Homo sapiens
tgaggcctgtctgtgacct

SEQ ID NO: 2989472 - DNA, 18 bp, Homo sapiens
tgaggccttgtgtgtcag

SEQ ID NO: 2989473 - DNA, 22 bp, Homo sapiens
tgaggccttgtgtgtcaggccc

SEQ ID NO: 2989474 - DNA, 14 bp, Homo sapiens
tgaggctgctgcca

SEQ ID NO: 2989475 - DNA, 20 bp, Homo sapiens
tgaggctgctttccaaagcc

SEQ ID NO: 2989476 - DNA, 14 bp, Homo sapiens
tgaggctggcacag

SEQ ID NO: 2989477 - DNA, 17 bp, Homo sapiens
tgaggctggcacaggac

SEQ ID NO: 2989478 - DNA, 14 bp, Homo sapiens
tgaggctttccatg

SEQ ID NO: 2989479 - DNA, 19 bp, Homo sapiens
tgaggctttccatgggacc

SEQ ID NO: 2989480 - DNA, 23 bp, Homo sapiens
tgaggctttggatttgacattgc

SEQ ID NO: 2989481 - DNA, 16 bp, Homo sapiens
tgagggaacagacagg

SEQ ID NO: 2989482 - DNA, 20 bp, Homo sapiens
tgagggaacagacaggagaa

SEQ ID NO: 2989483 - DNA, 15 bp, Homo sapiens
tgagggaatgacacc

SEQ ID NO: 2989484 - DNA, 19 bp, Homo sapiens
tgagggaatgacaccatca

SEQ ID NO: 2989485 - DNA, 22 bp, Homo sapiens
tgagggaccaaaaaaggacgta

SEQ ID NO: 2989486 - DNA, 20 bp, Homo sapiens
tgagggagagaactgagcat

SEQ ID NO: 2989487 - DNA, 14 bp, Homo sapiens
tgagggagatccca

SEQ ID NO: 2989488 - DNA, 17 bp, Homo sapiens
tgagggagggagccatg

SEQ ID NO: 2989489 - DNA, 15 bp, Homo sapiens
tgagggcatctctga

SEQ ID NO: 2989490 - DNA, 17 bp, Homo sapiens
tgagggcatctctgagt

SEQ ID NO: 2989491 - DNA, 23 bp, Homo sapiens
tgagggcgtggggaatgggcagg

SEQ ID NO: 2989492 - DNA, 22 bp, Homo sapiens
tgaggggcccctggcccaggag

SEQ ID NO: 2989493 - DNA, 17 bp, Homo sapiens
tgaggggctggggaggg

SEQ ID NO: 2989494 - DNA, 22 bp, Homo sapiens
tgagggggaatagtctagatgg

SEQ ID NO: 2989495 - DNA, 22 bp, Homo sapiens
tgaggggtccctagcagcccac

SEQ ID NO: 2989496 - DNA, 22 bp, Homo sapiens
tgaggggtgtccgagaggctgg

SEQ ID NO: 2989497 - DNA, 16 bp, Homo sapiens
tgaggtactggtccct

SEQ ID NO: 2989498 - DNA, 16 bp, Homo sapiens
tgaggtattttttcct

SEQ ID NO: 2989499 - DNA, 16 bp, Homo sapiens
tgaggtctcttttctc

SEQ ID NO: 2989500 - DNA, 18 bp, Homo sapiens
tgaggtctcttttctcta

SEQ ID NO: 2989501 - DNA, 16 bp, Homo sapiens
tgaggtcttttacata

SEQ ID NO: 2989502 - DNA, 18 bp, Homo sapiens
tgaggtcttttacataca

SEQ ID NO: 2989503 - DNA, 16 bp, Homo sapiens
tgaggtggaagccctc

SEQ ID NO: 2989504 - DNA, 17 bp, Homo sapiens
tgaggtggaagccctcc

SEQ ID NO: 2989505 - DNA, 18 bp, Homo sapiens
tgaggttcccgacaccag

SEQ ID NO: 2989506 - DNA, 13 bp, Homo sapiens
tgaggtttcccaa

SEQ ID NO: 2989507 - DNA, 14 bp, Homo sapiens
tgaggtttcccaat

SEQ ID NO: 2989508 - DNA, 22 bp, Homo sapiens
tgagtaaaccctatctgtgatt

SEQ ID NO: 2989509 - DNA, 14 bp, Homo sapiens
tgagtacattgtgc

SEQ ID NO: 2989510 - DNA, 17 bp, Homo sapiens
tgagtacattgtgccct

SEQ ID NO: 2989511 - DNA, 13 bp, Homo sapiens
tgagtagctggat

SEQ ID NO: 2989512 - DNA, 13 bp, Homo sapiens
tgagtaggccctg

SEQ ID NO: 2989513 - DNA, 14 bp, Homo sapiens
tgagtaggccctgc

SEQ ID NO: 2989514 - DNA, 13 bp, Homo sapiens
tgagtatcagaat

SEQ ID NO: 2989515 - DNA, 14 bp, Homo sapiens
tgagtatcagaatt

SEQ ID NO: 2989516 - DNA, 13 bp, Homo sapiens
tgagtcagcacct

SEQ ID NO: 2989517 - DNA, 15 bp, Homo sapiens
tgagtcagcaccttg

SEQ ID NO: 2989518 - DNA, 20 bp, Homo sapiens
tgagtcagcaccttggccca

SEQ ID NO: 2989519 - DNA, 21 bp, Homo sapiens
tgagtcagcaccttggcccag

SEQ ID NO: 2989520 - DNA, 23 bp, Homo sapiens
tgagtcagctgaccccctccccc

SEQ ID NO: 2989521 - DNA, 22 bp, Homo sapiens
tgagtcatgatctccctgccgc

SEQ ID NO: 2989522 - DNA, 21 bp, Homo sapiens
tgagtccgcctgcgcctccat

SEQ ID NO: 2989523 - DNA, 16 bp, Homo sapiens
tgagtcctagagctac

SEQ ID NO: 2989524 - DNA, 13 bp, Homo sapiens
tgagtcctggccc

SEQ ID NO: 2989525 - DNA, 16 bp, Homo sapiens
tgagtctcaagggtgg

SEQ ID NO: 2989526 - DNA, 20 bp, Homo sapiens
tgagtctcaagggtggcagg

SEQ ID NO: 2989527 - DNA, 16 bp, Homo sapiens
tgagtctggtggagga

SEQ ID NO: 2989528 - DNA, 18 bp, Homo sapiens
tgagtctggtggaggagc

SEQ ID NO: 2989529 - DNA, 14 bp, Homo sapiens
tgagtgagccggga

SEQ ID NO: 2989530 - DNA, 15 bp, Homo sapiens
tgagtgcagtcctga

SEQ ID NO: 2989531 - DNA, 15 bp, Homo sapiens
tgagtgccttttgca

SEQ ID NO: 2989532 - DNA, 19 bp, Homo sapiens
tgagtgctctgatccctct

SEQ ID NO: 2989533 - DNA, 22 bp, Homo sapiens
tgagtggagtttccaacagagg

SEQ ID NO: 2989534 - DNA, 22 bp, Homo sapiens
tgagtggcatgtgggttgtgat

SEQ ID NO: 2989535 - DNA, 19 bp, Homo sapiens
tgagtggccagcgccaggg

SEQ ID NO: 2989536 - DNA, 23 bp, Homo sapiens
tgagtggccccacctgtgtcccc

SEQ ID NO: 2989537 - DNA, 16 bp, Homo sapiens
tgagtgtctctgcctg

SEQ ID NO: 2989538 - DNA, 14 bp, Homo sapiens
tgagtgtgagggca

SEQ ID NO: 2989539 - DNA, 17 bp, Homo sapiens
tgagtgtgtgtgcatgg

SEQ ID NO: 2989540 - DNA, 16 bp, Homo sapiens
tgagtgttatgtgaat

SEQ ID NO: 2989541 - DNA, 24 bp, Homo sapiens
tgagtgttcctttttaaatgtgaa

SEQ ID NO: 2989542 - DNA, 14 bp, Homo sapiens
tgagtgtttctatg

SEQ ID NO: 2989543 - DNA, 23 bp, Homo sapiens
tgagttgcaccattctttcttgg

SEQ ID NO: 2989544 - DNA, 20 bp, Homo sapiens
tgagttgttcctagaggaga

SEQ ID NO: 2989545 - DNA, 16 bp, Homo sapiens
tgagttgttgtgggtt

SEQ ID NO: 2989546 - DNA, 23 bp, Homo sapiens
tgagttgttttcagactcagact

SEQ ID NO: 2989547 - DNA, 12 bp, Homo sapiens
tgagtttaaaaa

SEQ ID NO: 2989548 - DNA, 20 bp, Homo sapiens
tgagtttaaaaatcaacttt

SEQ ID NO: 2989549 - DNA, 17 bp, Homo sapiens
tgagttttaaagaagtc

SEQ ID NO: 2989550 - DNA, 20 bp, Homo sapiens
tgagttttgttttaaaatta

SEQ ID NO: 2989551 - DNA, 19 bp, Homo sapiens
tgagtttttacaagatgta

SEQ ID NO: 2989552 - DNA, 21 bp, Homo sapiens
tgagtttttattttgtctctg

SEQ ID NO: 2989553 - DNA, 18 bp, Homo sapiens
tgataaaatgttcctttt

SEQ ID NO: 2989554 - DNA, 13 bp, Homo sapiens
tgataaagcctca

SEQ ID NO: 2989555 - DNA, 22 bp, Homo sapiens
tgataaaggagaggttaaagca

SEQ ID NO: 2989556 - DNA, 20 bp, Homo sapiens
tgataaagttgagagacagt

SEQ ID NO: 2989557 - DNA, 16 bp, Homo sapiens
tgataaagtttctcag

SEQ ID NO: 2989558 - DNA, 21 bp, Homo sapiens
tgataaagtttctcagatcct

SEQ ID NO: 2989559 - DNA, 22 bp, Homo sapiens
tgataaagtttctcagatcctt

SEQ ID NO: 2989560 - DNA, 17 bp, Homo sapiens
tgataacaagcaaggat

SEQ ID NO: 2989561 - DNA, 15 bp, Homo sapiens
tgataacattttgtt

SEQ ID NO: 2989562 - DNA, 15 bp, Homo sapiens
tgataagagcagtgg

SEQ ID NO: 2989563 - DNA, 12 bp, Homo sapiens
tgataataataa

SEQ ID NO: 2989564 - DNA, 18 bp, Homo sapiens
tgataatgtattgcagtg

SEQ ID NO: 2989565 - DNA, 15 bp, Homo sapiens
tgataattctcagta

SEQ ID NO: 2989566 - DNA, 16 bp, Homo sapiens
tgataattcttatttt

SEQ ID NO: 2989567 - DNA, 14 bp, Homo sapiens
tgataattgcattc

SEQ ID NO: 2989568 - DNA, 16 bp, Homo sapiens
tgataattgcattcat

SEQ ID NO: 2989569 - DNA, 12 bp, Homo sapiens
tgataatttcag

SEQ ID NO: 2989570 - DNA, 14 bp, Homo sapiens
tgataatttcaggg

SEQ ID NO: 2989571 - DNA, 22 bp, Homo sapiens
tgataatttcagggaaattaat

SEQ ID NO: 2989572 - DNA, 15 bp, Homo sapiens
tgatacagaactctt

SEQ ID NO: 2989573 - DNA, 22 bp, Homo sapiens
tgatacagtgttttttaggaaa

SEQ ID NO: 2989574 - DNA, 22 bp, Homo sapiens
tgatacatccaaagcagacagc

SEQ ID NO: 2989575 - DNA, 12 bp, Homo sapiens
tgataccttcaa

SEQ ID NO: 2989576 - DNA, 13 bp, Homo sapiens
tgataccttcaat

SEQ ID NO: 2989577 - DNA, 13 bp, Homo sapiens
tgatactgatgcc

SEQ ID NO: 2989578 - DNA, 16 bp, Homo sapiens
tgatactgcaataaat

SEQ ID NO: 2989579 - DNA, 19 bp, Homo sapiens
tgatagaaatgccaagcac

SEQ ID NO: 2989580 - DNA, 17 bp, Homo sapiens
tgatagaactgtactgt

SEQ ID NO: 2989581 - DNA, 21 bp, Homo sapiens
tgatagacacatatgaggggg

SEQ ID NO: 2989582 - DNA, 12 bp, Homo sapiens
tgatagatttga

SEQ ID NO: 2989583 - DNA, 17 bp, Homo sapiens
tgatagatttgacctcc

SEQ ID NO: 2989584 - DNA, 18 bp, Homo sapiens
tgatagatttgacctcct

SEQ ID NO: 2989585 - DNA, 19 bp, Homo sapiens
tgatagatttgacctcctc

SEQ ID NO: 2989586 - DNA, 23 bp, Homo sapiens
tgatagggtctaccaatacaaaa

SEQ ID NO: 2989587 - DNA, 12 bp, Homo sapiens
tgatagttactg

SEQ ID NO: 2989588 - DNA, 13 bp, Homo sapiens
tgatagttactgt

SEQ ID NO: 2989589 - DNA, 14 bp, Homo sapiens
tgatagttactgtt

SEQ ID NO: 2989590 - DNA, 21 bp, Homo sapiens
tgatagttactgttgtgacct

SEQ ID NO: 2989591 - DNA, 14 bp, Homo sapiens
tgatagttttctag

SEQ ID NO: 2989592 - DNA, 14 bp, Homo sapiens
tgatataatatcat

SEQ ID NO: 2989593 - DNA, 13 bp, Homo sapiens
tgatatatgtgtt

SEQ ID NO: 2989594 - DNA, 20 bp, Homo sapiens
tgatatcggtgctatgtgtt

SEQ ID NO: 2989595 - DNA, 18 bp, Homo sapiens
tgcaggtttgaccaggaa

SEQ ID NO: 2989596 - DNA, 21 bp, Homo sapiens
tgcagtaaatcttttacaact

SEQ ID NO: 2989597 - DNA, 17 bp, Homo sapiens
tgcagtaacattctact

SEQ ID NO: 2989598 - DNA, 14 bp, Homo sapiens
tgcagtatatttct

SEQ ID NO: 2989599 - DNA, 22 bp, Homo sapiens
tgcagtatggtacatttttcaa

SEQ ID NO: 2989600 - DNA, 23 bp, Homo sapiens
tgcagtatttttaaatatgtata

SEQ ID NO: 2989601 - DNA, 17 bp, Homo sapiens
tgcagtcatcaacaatg

SEQ ID NO: 2989602 - DNA, 19 bp, Homo sapiens
tgcagtcatcaacaatgat

SEQ ID NO: 2989603 - DNA, 19 bp, Homo sapiens
tgcagtcctgatcagagcc

SEQ ID NO: 2989604 - DNA, 15 bp, Homo sapiens
tgcagtcgcttgcca

SEQ ID NO: 2989605 - DNA, 20 bp, Homo sapiens
tgcagtcgcttgccaaagca

SEQ ID NO: 2989606 - DNA, 21 bp, Homo sapiens
tgcagtcgcttgccaaagcag

SEQ ID NO: 2989607 - DNA, 18 bp, Homo sapiens
tgcagtcggcatgccagg

SEQ ID NO: 2989608 - DNA, 19 bp, Homo sapiens
tgcagtcggcatgccagga

SEQ ID NO: 2989609 - DNA, 20 bp, Homo sapiens
tgcagtcggcatgccaggac

SEQ ID NO: 2989610 - DNA, 13 bp, Homo sapiens
tgcagtctaaccc

SEQ ID NO: 2989611 - DNA, 20 bp, Homo sapiens
tgcagtctccgcctcctgag

SEQ ID NO: 2989612 - DNA, 13 bp, Homo sapiens
tgcagtctgggtg

SEQ ID NO: 2989613 - DNA, 20 bp, Homo sapiens
tgcagtctgtattttccacc

SEQ ID NO: 2989614 - DNA, 17 bp, Homo sapiens
tgcagtctttcccccag

SEQ ID NO: 2989615 - DNA, 19 bp, Homo sapiens
tgcagtctttcccccagga

SEQ ID NO: 2989616 - DNA, 13 bp, Homo sapiens
tgcagtctttttt

SEQ ID NO: 2989617 - DNA, 17 bp, Homo sapiens
tgcagtgccagctccct

SEQ ID NO: 2989618 - DNA, 17 bp, Homo sapiens
tgcagtggcctggccgt

SEQ ID NO: 2989619 - DNA, 14 bp, Homo sapiens
tgcagtgttttgca

SEQ ID NO: 2989620 - DNA, 17 bp, Homo sapiens
tgcagttctagtttgca

SEQ ID NO: 2989621 - DNA, 18 bp, Homo sapiens
tgcagttctagtttgcat

SEQ ID NO: 2989622 - DNA, 19 bp, Homo sapiens
tgcagttctagtttgcatt

SEQ ID NO: 2989623 - DNA, 17 bp, Homo sapiens
tgcagttcttgagttgc

SEQ ID NO: 2989624 - DNA, 12 bp, Homo sapiens
tgcagtttaaga

SEQ ID NO: 2989625 - DNA, 10 bp, Homo sapiens
tgcagtttat

SEQ ID NO: 2989626 - DNA, 12 bp, Homo sapiens
tgcagtttatca

SEQ ID NO: 2989627 - DNA, 11 bp, Homo sapiens
tgcagtttgaa

SEQ ID NO: 2989628 - DNA, 15 bp, Homo sapiens
tgcagtttgaaattc

SEQ ID NO: 2989629 - DNA, 21 bp, Homo sapiens
tgcagttttgtttggtttact

SEQ ID NO: 2989630 - DNA, 20 bp, Homo sapiens
tgcataaaagggtcaaacct

SEQ ID NO: 2989631 - DNA, 17 bp, Homo sapiens
tgcataacaattcctct

SEQ ID NO: 2989632 - DNA, 18 bp, Homo sapiens
tgcataacaattcctcta

SEQ ID NO: 2989633 - DNA, 21 bp, Homo sapiens
tgcatacacacacacacacag

SEQ ID NO: 2989634 - DNA, 14 bp, Homo sapiens
tgcataccaacctg

SEQ ID NO: 2989635 - DNA, 18 bp, Homo sapiens
tgcataccaacctgggca

SEQ ID NO: 2989636 - DNA, 18 bp, Homo sapiens
tgcatactaacctatttt

SEQ ID NO: 2989637 - DNA, 16 bp, Homo sapiens
tgcatacttcaaaagt

SEQ ID NO: 2989638 - DNA, 21 bp, Homo sapiens
tgcatagcagctgctactagc

SEQ ID NO: 2989639 - DNA, 14 bp, Homo sapiens
tgcatagcgtcctg

SEQ ID NO: 2989640 - DNA, 15 bp, Homo sapiens
tgcatatagaaaaca

SEQ ID NO: 2989641 - DNA, 17 bp, Homo sapiens
tgcatatgttgaatact

SEQ ID NO: 2989642 - DNA, 13 bp, Homo sapiens
tgcatatgtttcg

SEQ ID NO: 2989643 - DNA, 18 bp, Homo sapiens
tgcatcaagaactattgt

SEQ ID NO: 2989644 - DNA, 19 bp, Homo sapiens
tgcatcaagaactattgtg

SEQ ID NO: 2989645 - DNA, 16 bp, Homo sapiens
tgcatccaactccagg

SEQ ID NO: 2989646 - DNA, 18 bp, Homo sapiens
tgcatcgtcccctccccc

SEQ ID NO: 2989647 - DNA, 12 bp, Homo sapiens
tgcatctaagcc

SEQ ID NO: 2989648 - DNA, 21 bp, Homo sapiens
tgcatctgcaggcaccgggct

SEQ ID NO: 2989649 - DNA, 14 bp, Homo sapiens
tgcatctgtgtgtg

SEQ ID NO: 2989650 - DNA, 23 bp, Homo sapiens
tgcatctgtgtgtgtgtgcgtgt

SEQ ID NO: 2989651 - DNA, 17 bp, Homo sapiens
tgcatgaaagcacaagg

SEQ ID NO: 2989652 - DNA, 19 bp, Homo sapiens
tgcatgaaattttgcctgc

SEQ ID NO: 2989653 - DNA, 15 bp, Homo sapiens
tgcatgataaacatt

SEQ ID NO: 2989654 - DNA, 22 bp, Homo sapiens
tgcatgcactgttccccctgtg

SEQ ID NO: 2989655 - DNA, 15 bp, Homo sapiens
tgcatgctaaattat

SEQ ID NO: 2989656 - DNA, 18 bp, Homo sapiens
tgcatgctctctgcagcc

SEQ ID NO: 2989657 - DNA, 15 bp, Homo sapiens
tgcatggagtgtttg

SEQ ID NO: 2989658 - DNA, 17 bp, Homo sapiens
tgcatgggccagcccct

SEQ ID NO: 2989659 - DNA, 19 bp, Homo sapiens
tgcatgggctaatgaagat

SEQ ID NO: 2989660 - DNA, 19 bp, Homo sapiens
tgcatggtgccccaggacc

SEQ ID NO: 2989661 - DNA, 20 bp, Homo sapiens
tgcatggtgccccaggacca

SEQ ID NO: 2989662 - DNA, 14 bp, Homo sapiens
tgcatgtcttttaa

SEQ ID NO: 2989663 - DNA, 15 bp, Homo sapiens
tgcatgtgcgtggaa

SEQ ID NO: 2989664 - DNA, 20 bp, Homo sapiens
tgcatgtgcgtggaagtgtt

SEQ ID NO: 2989665 - DNA, 16 bp, Homo sapiens
tgcatgtttgctgttc

SEQ ID NO: 2989666 - DNA, 17 bp, Homo sapiens
tgcattaaattcacaaa

SEQ ID NO: 2989667 - DNA, 21 bp, Homo sapiens
tgcattaaattcacaaacttt

SEQ ID NO: 2989668 - DNA, 22 bp, Homo sapiens
tgcattagggatgcctcctttc

SEQ ID NO: 2989669 - DNA, 21 bp, Homo sapiens
tgcattataattttttaaaca

SEQ ID NO: 2989670 - DNA, 20 bp, Homo sapiens
tgcattcaccttagtgcaac

SEQ ID NO: 2989671 - DNA, 23 bp, Homo sapiens
tgcattccagagttaaaatgttt

SEQ ID NO: 2989672 - DNA, 16 bp, Homo sapiens
tgcattcctgtaactt

SEQ ID NO: 2989673 - DNA, 20 bp, Homo sapiens
tgcattcctttttcttcact

SEQ ID NO: 2989674 - DNA, 23 bp, Homo sapiens
tgcattcgcggttaagatactca

SEQ ID NO: 2989675 - DNA, 19 bp, Homo sapiens
tgcattctgataggagggg

SEQ ID NO: 2989676 - DNA, 14 bp, Homo sapiens
tgcattctgcctct

SEQ ID NO: 2989677 - DNA, 15 bp, Homo sapiens
tgcattctgcctctc

SEQ ID NO: 2989678 - DNA, 22 bp, Homo sapiens
tgcattcttaacaaactcttca

SEQ ID NO: 2989679 - DNA, 12 bp, Homo sapiens
tgcattcttata

SEQ ID NO: 2989680 - DNA, 23 bp, Homo sapiens
tgcattgaacacaaactgtaaat

SEQ ID NO: 2989681 - DNA, 22 bp, Homo sapiens
tgcattgaatttagtcattatt

SEQ ID NO: 2989682 - DNA, 14 bp, Homo sapiens
tgcattgacattat

SEQ ID NO: 2989683 - DNA, 20 bp, Homo sapiens
tgcattgaccgcgactaatt

SEQ ID NO: 2989684 - DNA, 17 bp, Homo sapiens
tgcattgagaactgcat

SEQ ID NO: 2989685 - DNA, 22 bp, Homo sapiens
tgcattgatattgtgaacattt

SEQ ID NO: 2989686 - DNA, 17 bp, Homo sapiens
tgcattgccgaagtcca

SEQ ID NO: 2989687 - DNA, 21 bp, Homo sapiens
tgcatttctatgccattttta

SEQ ID NO: 2989688 - DNA, 22 bp, Homo sapiens
tgcatttgggtggtttttattt

SEQ ID NO: 2989689 - DNA, 22 bp, Homo sapiens
tgcatttttaaaggacaaacag

SEQ ID NO: 2989690 - DNA, 17 bp, Homo sapiens
tgcatttttctgcagaa

SEQ ID NO: 2989691 - DNA, 20 bp, Homo sapiens
tgcatttttttagtttgttt

SEQ ID NO: 2989692 - DNA, 22 bp, Homo sapiens
tgcatttttttagtttgttttt

SEQ ID NO: 2989693 - DNA, 14 bp, Homo sapiens
tgccaaaaccaaga

SEQ ID NO: 2989694 - DNA, 17 bp, Homo sapiens
tgccaaaatgctctagt

SEQ ID NO: 2989695 - DNA, 15 bp, Homo sapiens
tgccaaagaaagtgg

SEQ ID NO: 2989696 - DNA, 21 bp, Homo sapiens
tgccaaatagccccagactgg

SEQ ID NO: 2989697 - DNA, 16 bp, Homo sapiens
tgccaacaagaatgca

SEQ ID NO: 2989698 - DNA, 20 bp, Homo sapiens
tgccaacaagaatgcattga

SEQ ID NO: 2989699 - DNA, 16 bp, Homo sapiens
tgccaaccccacccag

SEQ ID NO: 2989700 - DNA, 23 bp, Homo sapiens
tgccaaccccacccagctccagg

SEQ ID NO: 2989701 - DNA, 15 bp, Homo sapiens
tgccaactgtggctg

SEQ ID NO: 2989702 - DNA, 13 bp, Homo sapiens
tgccaacttgcca

SEQ ID NO: 2989703 - DNA, 13 bp, Homo sapiens
tgccaagaaatcg

SEQ ID NO: 2989704 - DNA, 18 bp, Homo sapiens
tgccaagccccatcctgc

SEQ ID NO: 2989705 - DNA, 17 bp, Homo sapiens
tgccaaggctgatgcag

SEQ ID NO: 2989706 - DNA, 17 bp, Homo sapiens
tgccaagtcctagctcc

SEQ ID NO: 2989707 - DNA, 21 bp, Homo sapiens
tgccaagtcctagctcctcct

SEQ ID NO: 2989708 - DNA, 17 bp, Homo sapiens
tgccaagtcctgccttt

SEQ ID NO: 2989709 - DNA, 14 bp, Homo sapiens
tgccaagtgcctgc

SEQ ID NO: 2989710 - DNA, 16 bp, Homo sapiens
tgccaataattacatc

SEQ ID NO: 2989711 - DNA, 23 bp, Homo sapiens
tgccaatccttaaatatgtgaaa

SEQ ID NO: 2989712 - DNA, 16 bp, Homo sapiens
tgccaatctcaacacc

SEQ ID NO: 2989713 - DNA, 15 bp, Homo sapiens
tgccaatcttgtttt

SEQ ID NO: 2989714 - DNA, 14 bp, Homo sapiens
tgccaatgttgtgt

SEQ ID NO: 2989715 - DNA, 21 bp, Homo sapiens
tgccaatttttgccttcatta

SEQ ID NO: 2989716 - DNA, 14 bp, Homo sapiens
tgccacaaaaatgt

SEQ ID NO: 2989717 - DNA, 16 bp, Homo sapiens
tgccacaaaaatgttc

SEQ ID NO: 2989718 - DNA, 16 bp, Homo sapiens
tgccacaaggacttcc

SEQ ID NO: 2989719 - DNA, 19 bp, Homo sapiens
tgccacaaggacttcctgt

SEQ ID NO: 2989720 - DNA, 13 bp, Homo sapiens
tgccacagcctcc

SEQ ID NO: 2989721 - DNA, 22 bp, Homo sapiens
tgccacagcctcccctgccagg

SEQ ID NO: 2989722 - DNA, 22 bp, Homo sapiens
tgccacatctgtgtctctggaa

SEQ ID NO: 2989723 - DNA, 17 bp, Homo sapiens
tgccacattagaacttc

SEQ ID NO: 2989724 - DNA, 18 bp, Homo sapiens
tgccacattagaacttct

SEQ ID NO: 2989725 - DNA, 18 bp, Homo sapiens
tgccacccacctccctgc

SEQ ID NO: 2989726 - DNA, 19 bp, Homo sapiens
tgccacccacctccctgcc

SEQ ID NO: 2989727 - DNA, 13 bp, Homo sapiens
tgctaaatgtgta

SEQ ID NO: 2989728 - DNA, 14 bp, Homo sapiens
tgctaaatgtgtaa

SEQ ID NO: 2989729 - DNA, 14 bp, Homo sapiens
tgctaaattattat

SEQ ID NO: 2989730 - DNA, 15 bp, Homo sapiens
tgctaactgaacttt

SEQ ID NO: 2989731 - DNA, 21 bp, Homo sapiens
tgctaagaatatttgaatgta

SEQ ID NO: 2989732 - DNA, 13 bp, Homo sapiens
tgctaagatgctc

SEQ ID NO: 2989733 - DNA, 15 bp, Homo sapiens
tgctaagtgtaggat

SEQ ID NO: 2989734 - DNA, 19 bp, Homo sapiens
tgctaatattttatttgaa

SEQ ID NO: 2989735 - DNA, 20 bp, Homo sapiens
tgctaatattttatttgaaa

SEQ ID NO: 2989736 - DNA, 11 bp, Homo sapiens
tgctaattaat

SEQ ID NO: 2989737 - DNA, 14 bp, Homo sapiens
tgctacagaaagca

SEQ ID NO: 2989738 - DNA, 18 bp, Homo sapiens
tgctacagagaaaatcaa

SEQ ID NO: 2989739 - DNA, 13 bp, Homo sapiens
tgctacgcctgca

SEQ ID NO: 2989740 - DNA, 20 bp, Homo sapiens
tgctacgcctgcatgtaaac

SEQ ID NO: 2989741 - DNA, 14 bp, Homo sapiens
tgctacgtgcctcc

SEQ ID NO: 2989742 - DNA, 16 bp, Homo sapiens
tgctacgtgtgaaatc

SEQ ID NO: 2989743 - DNA, 17 bp, Homo sapiens
tgctacgtgtgaaatct

SEQ ID NO: 2989744 - DNA, 22 bp, Homo sapiens
tgctacgtgtgaaatctgtctt

SEQ ID NO: 2989745 - DNA, 23 bp, Homo sapiens
tgctacgtgtgaaatctgtcttt

SEQ ID NO: 2989746 - DNA, 15 bp, Homo sapiens
tgctacgtgtgattt

SEQ ID NO: 2989747 - DNA, 19 bp, Homo sapiens
tgctacgtgtgatttttct

SEQ ID NO: 2989748 - DNA, 19 bp, Homo sapiens
tgctactgcccctctccga

SEQ ID NO: 2989749 - DNA, 20 bp, Homo sapiens
tgctagagcagacaggcctg

SEQ ID NO: 2989750 - DNA, 20 bp, Homo sapiens
tgctagcaaatggcagaacc

SEQ ID NO: 2989751 - DNA, 14 bp, Homo sapiens
tgctagcaggcccc

SEQ ID NO: 2989752 - DNA, 19 bp, Homo sapiens
tgctagcaggccccctagg

SEQ ID NO: 2989753 - DNA, 19 bp, Homo sapiens
tgctagcgcgttgcctgtc

SEQ ID NO: 2989754 - DNA, 22 bp, Homo sapiens
tgctagctttcctttacagctg

SEQ ID NO: 2989755 - DNA, 18 bp, Homo sapiens
tgctaggcccctgtgtag

SEQ ID NO: 2989756 - DNA, 20 bp, Homo sapiens
tgctaggcccctgtgtagta

SEQ ID NO: 2989757 - DNA, 14 bp, Homo sapiens
tgctaggggaagga

SEQ ID NO: 2989758 - DNA, 22 bp, Homo sapiens
tgctaggggaaggactggccgt

SEQ ID NO: 2989759 - DNA, 21 bp, Homo sapiens
tgctagtcactggcagcctgc

SEQ ID NO: 2989760 - DNA, 22 bp, Homo sapiens
tgctagtcactggcagcctgca

SEQ ID NO: 2989761 - DNA, 20 bp, Homo sapiens
tgctataaattttttgaaac

SEQ ID NO: 2989762 - DNA, 16 bp, Homo sapiens
tgctataatcattagt

SEQ ID NO: 2989763 - DNA, 20 bp, Homo sapiens
tgctatagtatttgattcaa

SEQ ID NO: 2989764 - DNA, 22 bp, Homo sapiens
tgctatagtatttgattcaaaa

SEQ ID NO: 2989765 - DNA, 19 bp, Homo sapiens
tgctatcaacaataaaatt

SEQ ID NO: 2989766 - DNA, 23 bp, Homo sapiens
tgctatcggcagatgatgctttg

SEQ ID NO: 2989767 - DNA, 20 bp, Homo sapiens
tgctatcggggaagccagac

SEQ ID NO: 2989768 - DNA, 16 bp, Homo sapiens
tgctatcttaattttg

SEQ ID NO: 2989769 - DNA, 22 bp, Homo sapiens
tgctatcttttttagtgttaaa

SEQ ID NO: 2989770 - DNA, 20 bp, Homo sapiens
tgctatgaaaggaataaaac

SEQ ID NO: 2989771 - DNA, 16 bp, Homo sapiens
tgctatggatggcttc

SEQ ID NO: 2989772 - DNA, 15 bp, Homo sapiens
tgctatgtgcacagc

SEQ ID NO: 2989773 - DNA, 12 bp, Homo sapiens
tgctatgtgttt

SEQ ID NO: 2989774 - DNA, 17 bp, Homo sapiens
tgctatgtgtttggttt

SEQ ID NO: 2989775 - DNA, 12 bp, Homo sapiens
tgctattaaagt

SEQ ID NO: 2989776 - DNA, 17 bp, Homo sapiens
tgctattgtaaggtctt

SEQ ID NO: 2989777 - DNA, 20 bp, Homo sapiens
tgctattgtaaggtctttgt

SEQ ID NO: 2989778 - DNA, 16 bp, Homo sapiens
tgctatttcaggccct

SEQ ID NO: 2989779 - DNA, 20 bp, Homo sapiens
tgctatttgaacaagtgggc

SEQ ID NO: 2989780 - DNA, 23 bp, Homo sapiens
tgctcaaaacacttccagtctgg

SEQ ID NO: 2989781 - DNA, 21 bp, Homo sapiens
tgctcaagcagcaaaatcctt

SEQ ID NO: 2989782 - DNA, 14 bp, Homo sapiens
tgctcacctggggt

SEQ ID NO: 2989783 - DNA, 22 bp, Homo sapiens
tgctcacggaccccatgttgga

SEQ ID NO: 2989784 - DNA, 14 bp, Homo sapiens
tgctcactcaacaa

SEQ ID NO: 2989785 - DNA, 14 bp, Homo sapiens
tgctcagaccagct

SEQ ID NO: 2989786 - DNA, 16 bp, Homo sapiens
tgctcagaccagctct

SEQ ID NO: 2989787 - DNA, 18 bp, Homo sapiens
tgctcagctctgggccat

SEQ ID NO: 2989788 - DNA, 21 bp, Homo sapiens
tgctcagctctggtccaggcc

SEQ ID NO: 2989789 - DNA, 21 bp, Homo sapiens
tgctcagcttctcctgtgtga

SEQ ID NO: 2989790 - DNA, 13 bp, Homo sapiens
tgctcaggtactt

SEQ ID NO: 2989791 - DNA, 16 bp, Homo sapiens
tgctcagtcgccctgt

SEQ ID NO: 2989792 - DNA, 19 bp, Homo sapiens
tgctcagtgtctggctgca

SEQ ID NO: 2989793 - DNA, 12 bp, Homo sapiens
tgctcagttgct

SEQ ID NO: 2989794 - DNA, 19 bp, Homo sapiens
tgctcagttgctaaacact

SEQ ID NO: 2989795 - DNA, 16 bp, Homo sapiens
tgctcagttgtagaat

SEQ ID NO: 2989796 - DNA, 18 bp, Homo sapiens
tgctcagttgtagaatgt

SEQ ID NO: 2989797 - DNA, 22 bp, Homo sapiens
tgctcagttgtagaatgtattg

SEQ ID NO: 2989798 - DNA, 18 bp, Homo sapiens
tgctcatgtgtgtggtca

SEQ ID NO: 2989799 - DNA, 19 bp, Homo sapiens
tgctccaagatgttctcct

SEQ ID NO: 2989800 - DNA, 20 bp, Homo sapiens
tgctccaagatgttctcctg

SEQ ID NO: 2989801 - DNA, 14 bp, Homo sapiens
tgctccaagattct

SEQ ID NO: 2989802 - DNA, 18 bp, Homo sapiens
tgctccaagattctagat

SEQ ID NO: 2989803 - DNA, 13 bp, Homo sapiens
tgctccaataaag

SEQ ID NO: 2989804 - DNA, 18 bp, Homo sapiens
tgctccaataaaggaaca

SEQ ID NO: 2989805 - DNA, 22 bp, Homo sapiens
tgctccacctttcagcccacgt

SEQ ID NO: 2989806 - DNA, 19 bp, Homo sapiens
tgctccagcaacacagcct

SEQ ID NO: 2989807 - DNA, 23 bp, Homo sapiens
tgctccagcaacacagcctgggc

SEQ ID NO: 2989808 - DNA, 15 bp, Homo sapiens
tgctccagggtcagg

SEQ ID NO: 2989809 - DNA, 23 bp, Homo sapiens
tgctccatagagcagtgcacatc

SEQ ID NO: 2989810 - DNA, 18 bp, Homo sapiens
tgctccattttcttgtca

SEQ ID NO: 2989811 - DNA, 23 bp, Homo sapiens
tgctcccaagcaaaggaaatgca

SEQ ID NO: 2989812 - DNA, 23 bp, Homo sapiens
tgctcccacacttgtgccagccc

SEQ ID NO: 2989813 - DNA, 21 bp, Homo sapiens
tgctcccacggggaccactgg

SEQ ID NO: 2989814 - DNA, 22 bp, Homo sapiens
tgctcccacggggaccactggg

SEQ ID NO: 2989815 - DNA, 21 bp, Homo sapiens
tgctcccccaccccctcccca

SEQ ID NO: 2989816 - DNA, 20 bp, Homo sapiens
tgctccctaccacctcccca

SEQ ID NO: 2989817 - DNA, 20 bp, Homo sapiens
tgctcccttcgctctgctgg

SEQ ID NO: 2989818 - DNA, 14 bp, Homo sapiens
tgctccgctgcctg

SEQ ID NO: 2989819 - DNA, 15 bp, Homo sapiens
tgctccgctgcctgg

SEQ ID NO: 2989820 - DNA, 18 bp, Homo sapiens
tgctccgctgcctggaac

SEQ ID NO: 2989821 - DNA, 17 bp, Homo sapiens
tgctccggcctgcgtct

SEQ ID NO: 2989822 - DNA, 15 bp, Homo sapiens
tgctccgtggactgc

SEQ ID NO: 2989823 - DNA, 20 bp, Homo sapiens
tgctcctagagggaggggcc

SEQ ID NO: 2989824 - DNA, 24 bp, Homo sapiens
tgctcctagagggaggggcctagg

SEQ ID NO: 2989825 - DNA, 14 bp, Homo sapiens
tgctcctcatctgc

SEQ ID NO: 2989826 - DNA, 20 bp, Homo sapiens
tgctcctcatctgcctggaa

SEQ ID NO: 2989827 - DNA, 12 bp, Homo sapiens
tgctcctccagg

SEQ ID NO: 2989828 - DNA, 21 bp, Homo sapiens
tgctcctccagggccacgtgc

SEQ ID NO: 2989829 - DNA, 14 bp, Homo sapiens
tgctcctctttccc

SEQ ID NO: 2989830 - DNA, 14 bp, Homo sapiens
tgctcctgcccagc

SEQ ID NO: 2989831 - DNA, 16 bp, Homo sapiens
tgctcctgcccagcca

SEQ ID NO: 2989832 - DNA, 21 bp, Homo sapiens
tgctcctgcccagccacccct

SEQ ID NO: 2989833 - DNA, 22 bp, Homo sapiens
tgctcctggggagaaagagggg

SEQ ID NO: 2989834 - DNA, 23 bp, Homo sapiens
tgctcctggggagaaagaggggc

SEQ ID NO: 2989835 - DNA, 16 bp, Homo sapiens
tgctccttagctgcca

SEQ ID NO: 2989836 - DNA, 20 bp, Homo sapiens
tgctccttagctgccaagcc

SEQ ID NO: 2989837 - DNA, 21 bp, Homo sapiens
tgctccttccaacaggagctg

SEQ ID NO: 2989838 - DNA, 14 bp, Homo sapiens
tgctccttgggccc

SEQ ID NO: 2989839 - DNA, 16 bp, Homo sapiens
tgctccttgggccctt

SEQ ID NO: 2989840 - DNA, 19 bp, Homo sapiens
tgctccttgggccctttga

SEQ ID NO: 2989841 - DNA, 14 bp, Homo sapiens
tgctcgcccaggaa

SEQ ID NO: 2989842 - DNA, 12 bp, Homo sapiens
tgctctaaaata

SEQ ID NO: 2989843 - DNA, 17 bp, Homo sapiens
tgctctaccatgtttaa

SEQ ID NO: 2989844 - DNA, 15 bp, Homo sapiens
tgctctaggaagaca

SEQ ID NO: 2989845 - DNA, 14 bp, Homo sapiens
tgctctatcttgct

SEQ ID NO: 2989846 - DNA, 17 bp, Homo sapiens
tgctctctgcagccagc

SEQ ID NO: 2989847 - DNA, 20 bp, Homo sapiens
tgctctctgcagccagccca

SEQ ID NO: 2989848 - DNA, 17 bp, Homo sapiens
tgctctgaggcctcact

SEQ ID NO: 2989849 - DNA, 19 bp, Homo sapiens
tgctctgatccctctacag

SEQ ID NO: 2989850 - DNA, 12 bp, Homo sapiens
tgctctgcctct

SEQ ID NO: 2989851 - DNA, 20 bp, Homo sapiens
tgctctgcctctaactccct

SEQ ID NO: 2989852 - DNA, 23 bp, Homo sapiens
tgctctgcgtgtcacctgtgctt

SEQ ID NO: 2989853 - DNA, 16 bp, Homo sapiens
tgctctgctctaccat

SEQ ID NO: 2989854 - DNA, 14 bp, Homo sapiens
tgctcttcaagaaa

SEQ ID NO: 2989855 - DNA, 19 bp, Homo sapiens
tgctcttgtagcccaggct

SEQ ID NO: 2989856 - DNA, 18 bp, Homo sapiens
tgctcttgttctgttcct

SEQ ID NO: 2989857 - DNA, 23 bp, Homo sapiens
tgctcttgtttctaacaaggact

SEQ ID NO: 2989858 - DNA, 15 bp, Homo sapiens
tggagatctttgctt

SEQ ID NO: 2989859 - DNA, 18 bp, Homo sapiens
tggagcaaagtggtaggt

SEQ ID NO: 2989860 - DNA, 20 bp, Homo sapiens
tggagcaacctactgtctaa

SEQ ID NO: 2989861 - DNA, 18 bp, Homo sapiens
tggagcagaaagtgcctt

SEQ ID NO: 2989862 - DNA, 12 bp, Homo sapiens
tggagcagaggg

SEQ ID NO: 2989863 - DNA, 15 bp, Homo sapiens
tggagcatttatgta

SEQ ID NO: 2989864 - DNA, 19 bp, Homo sapiens
tggagcatttatgtagaca

SEQ ID NO: 2989865 - DNA, 21 bp, Homo sapiens
tggagcatttatgtagacatt

SEQ ID NO: 2989866 - DNA, 22 bp, Homo sapiens
tggagccacaggcaggggtgag

SEQ ID NO: 2989867 - DNA, 12 bp, Homo sapiens
tggagccaggcg

SEQ ID NO: 2989868 - DNA, 15 bp, Homo sapiens
tggagcccagggagc

SEQ ID NO: 2989869 - DNA, 20 bp, Homo sapiens
tggagcccagggagcggaaa

SEQ ID NO: 2989870 - DNA, 15 bp, Homo sapiens
tggagcccctcctcc

SEQ ID NO: 2989871 - DNA, 14 bp, Homo sapiens
tggagcccgcactg

SEQ ID NO: 2989872 - DNA, 11 bp, Homo sapiens
tggagcctgca

SEQ ID NO: 2989873 - DNA, 16 bp, Homo sapiens
tggagcctgcagagct

SEQ ID NO: 2989874 - DNA, 23 bp, Homo sapiens
tggagcggaatttacctgatttc

SEQ ID NO: 2989875 - DNA, 16 bp, Homo sapiens
tggagcgtttgctgtg

SEQ ID NO: 2989876 - DNA, 16 bp, Homo sapiens
tggagctctggggggc

SEQ ID NO: 2989877 - DNA, 23 bp, Homo sapiens
tggagctctgtgggtctctggaa

SEQ ID NO: 2989878 - DNA, 19 bp, Homo sapiens
tggagctgagaagaggagg

SEQ ID NO: 2989879 - DNA, 23 bp, Homo sapiens
tggagctgagaagaggaggaggt

SEQ ID NO: 2989880 - DNA, 15 bp, Homo sapiens
tggagctttctgtat

SEQ ID NO: 2989881 - DNA, 14 bp, Homo sapiens
tggaggagaagaat

SEQ ID NO: 2989882 - DNA, 14 bp, Homo sapiens
tggaggagctgagg

SEQ ID NO: 2989883 - DNA, 16 bp, Homo sapiens
tggaggagctgaggga

SEQ ID NO: 2989884 - DNA, 17 bp, Homo sapiens
tggaggagctgagggag

SEQ ID NO: 2989885 - DNA, 11 bp, Homo sapiens
tggaggcaggg

SEQ ID NO: 2989886 - DNA, 15 bp, Homo sapiens
tggaggcagtgtcat

SEQ ID NO: 2989887 - DNA, 18 bp, Homo sapiens
tggaggcccaggctggga

SEQ ID NO: 2989888 - DNA, 15 bp, Homo sapiens
tggaggcctcaggga

SEQ ID NO: 2989889 - DNA, 17 bp, Homo sapiens
tggaggcgggcttggaa

SEQ ID NO: 2989890 - DNA, 20 bp, Homo sapiens
tggaggctcagcccaccctc

SEQ ID NO: 2989891 - DNA, 12 bp, Homo sapiens
tggagggaagcc

SEQ ID NO: 2989892 - DNA, 15 bp, Homo sapiens
tggagggcagagaca

SEQ ID NO: 2989893 - DNA, 23 bp, Homo sapiens
tggagggcgcccagcagcctgcc

SEQ ID NO: 2989894 - DNA, 21 bp, Homo sapiens
tggaggggccctccgagggtg

SEQ ID NO: 2989895 - DNA, 21 bp, Homo sapiens
tggaggggtcatccttgccca

SEQ ID NO: 2989896 - DNA, 20 bp, Homo sapiens
tggagggtgctaggcccctg

SEQ ID NO: 2989897 - DNA, 14 bp, Homo sapiens
tggaggtacactct

SEQ ID NO: 2989898 - DNA, 20 bp, Homo sapiens
tggaggtgctggtagctgag

SEQ ID NO: 2989899 - DNA, 16 bp, Homo sapiens
tggaggttaaggcata

SEQ ID NO: 2989900 - DNA, 14 bp, Homo sapiens
tggaggttgataac

SEQ ID NO: 2989901 - DNA, 13 bp, Homo sapiens
tggagtatttgga

SEQ ID NO: 2989902 - DNA, 18 bp, Homo sapiens
tggagtccagctctacta

SEQ ID NO: 2989903 - DNA, 22 bp, Homo sapiens
tggagtcccagagctgcacagg

SEQ ID NO: 2989904 - DNA, 17 bp, Homo sapiens
tggagtcccaggggcag

SEQ ID NO: 2989905 - DNA, 21 bp, Homo sapiens
tggagtgcagctaacatgagt

SEQ ID NO: 2989906 - DNA, 17 bp, Homo sapiens
tggagtgctgcttgtgc

SEQ ID NO: 2989907 - DNA, 14 bp, Homo sapiens
tggagtgctgtgct

SEQ ID NO: 2989908 - DNA, 13 bp, Homo sapiens
tggagtggccact

SEQ ID NO: 2989909 - DNA, 13 bp, Homo sapiens
tggagtgtaaacc

SEQ ID NO: 2989910 - DNA, 18 bp, Homo sapiens
tggagtgtgctgaacaca

SEQ ID NO: 2989911 - DNA, 20 bp, Homo sapiens
tggagtgtgtcagagcccag

SEQ ID NO: 2989912 - DNA, 12 bp, Homo sapiens
tggagtgtttga

SEQ ID NO: 2989913 - DNA, 22 bp, Homo sapiens
tggagtgtttgacgaagaaaca

SEQ ID NO: 2989914 - DNA, 15 bp, Homo sapiens
tggagttcttgtgcc

SEQ ID NO: 2989915 - DNA, 14 bp, Homo sapiens
tggagttgaaaatc

SEQ ID NO: 2989916 - DNA, 22 bp, Homo sapiens
tggagttgatctggaacccaga

SEQ ID NO: 2989917 - DNA, 14 bp, Homo sapiens
tggagtttccaaca

SEQ ID NO: 2989918 - DNA, 16 bp, Homo sapiens
tggagtttctaaggtc

SEQ ID NO: 2989919 - DNA, 21 bp, Homo sapiens
tggataaatttgaactccatg

SEQ ID NO: 2989920 - DNA, 14 bp, Homo sapiens
tggataacaaagat

SEQ ID NO: 2989921 - DNA, 16 bp, Homo sapiens
tggataacaaagatat

SEQ ID NO: 2989922 - DNA, 15 bp, Homo sapiens
tggataataaaaatt

SEQ ID NO: 2989923 - DNA, 15 bp, Homo sapiens
tggatacagcagtag

SEQ ID NO: 2989924 - DNA, 19 bp, Homo sapiens
tggatagccttgaaaacaa

SEQ ID NO: 2989925 - DNA, 20 bp, Homo sapiens
tggatagccttgaaaacaaa

SEQ ID NO: 2989926 - DNA, 16 bp, Homo sapiens
tggatcagtcctttga

SEQ ID NO: 2989927 - DNA, 18 bp, Homo sapiens
tggatcataaactggaaa

SEQ ID NO: 2989928 - DNA, 21 bp, Homo sapiens
tggatcccaaagcaaggagat

SEQ ID NO: 2989929 - DNA, 20 bp, Homo sapiens
tggatcccgttcagaaaacc

SEQ ID NO: 2989930 - DNA, 20 bp, Homo sapiens
tggatcctgaaatagaggct

SEQ ID NO: 2989931 - DNA, 14 bp, Homo sapiens
tggatctcagtttt

SEQ ID NO: 2989932 - DNA, 23 bp, Homo sapiens
tggatctgggaccctttccttcc

SEQ ID NO: 2989933 - DNA, 15 bp, Homo sapiens
tggatgagccctcag

SEQ ID NO: 2989934 - DNA, 16 bp, Homo sapiens
tggatgcatcaagaac

SEQ ID NO: 2989935 - DNA, 20 bp, Homo sapiens
tggatgccaatattaaatct

SEQ ID NO: 2989936 - DNA, 13 bp, Homo sapiens
tggatgctgtgct

SEQ ID NO: 2989937 - DNA, 21 bp, Homo sapiens
tggatgggggaactcagatcc

SEQ ID NO: 2989938 - DNA, 12 bp, Homo sapiens
tggatggtgact

SEQ ID NO: 2989939 - DNA, 17 bp, Homo sapiens
tggatggtgacttttga

SEQ ID NO: 2989940 - DNA, 20 bp, Homo sapiens
tggatggtgacttttgaaga

SEQ ID NO: 2989941 - DNA, 20 bp, Homo sapiens
tggatgtctgccaatttttg

SEQ ID NO: 2989942 - DNA, 15 bp, Homo sapiens
tggatgtgagcagaa

SEQ ID NO: 2989943 - DNA, 13 bp, Homo sapiens
tggatgttttaat

SEQ ID NO: 2989944 - DNA, 14 bp, Homo sapiens
tggattaaacttat

SEQ ID NO: 2989945 - DNA, 20 bp, Homo sapiens
tggattaaacttatgaatgt

SEQ ID NO: 2989946 - DNA, 13 bp, Homo sapiens
tggattaggtctc

SEQ ID NO: 2989947 - DNA, 17 bp, Homo sapiens
tggattcatttataaga

SEQ ID NO: 2989948 - DNA, 12 bp, Homo sapiens
tggattccaaac

SEQ ID NO: 2989949 - DNA, 20 bp, Homo sapiens
tggattccaaagcattttca

SEQ ID NO: 2989950 - DNA, 21 bp, Homo sapiens
tggattcctaaatattttcaa

SEQ ID NO: 2989951 - DNA, 17 bp, Homo sapiens
tggattctccctgggcc

SEQ ID NO: 2989952 - DNA, 21 bp, Homo sapiens
tggattctcttagctactgta

SEQ ID NO: 2989953 - DNA, 16 bp, Homo sapiens
tggattctgagagctg

SEQ ID NO: 2989954 - DNA, 22 bp, Homo sapiens
tggattgggcagaatcctgggc

SEQ ID NO: 2989955 - DNA, 18 bp, Homo sapiens
tggatttacgactgaaga

SEQ ID NO: 2989956 - DNA, 14 bp, Homo sapiens
tggatttcagaaag

SEQ ID NO: 2989957 - DNA, 22 bp, Homo sapiens
tggatttcctttatactgtgaa

SEQ ID NO: 2989958 - DNA, 14 bp, Homo sapiens
tggatttgacattg

SEQ ID NO: 2989959 - DNA, 13 bp, Homo sapiens
tggatttgcagaa

SEQ ID NO: 2989960 - DNA, 19 bp, Homo sapiens
tggatttgtccaaacaggt

SEQ ID NO: 2989961 - DNA, 15 bp, Homo sapiens
tggatttgtttaaaa

SEQ ID NO: 2989962 - DNA, 16 bp, Homo sapiens
tggatttgtttaaaag

SEQ ID NO: 2989963 - DNA, 17 bp, Homo sapiens
tggatttgtttaaaagg

SEQ ID NO: 2989964 - DNA, 15 bp, Homo sapiens
tggatttttaattaa

SEQ ID NO: 2989965 - DNA, 17 bp, Homo sapiens
tggatttttaattaaaa

SEQ ID NO: 2989966 - DNA, 20 bp, Homo sapiens
tggcaaaacactatgtatag

SEQ ID NO: 2989967 - DNA, 22 bp, Homo sapiens
tggcaaacatgtgcaactcttg

SEQ ID NO: 2989968 - DNA, 14 bp, Homo sapiens
tggcaacaaaatgt

SEQ ID NO: 2989969 - DNA, 15 bp, Homo sapiens
tggcaacagatctgg

SEQ ID NO: 2989970 - DNA, 20 bp, Homo sapiens
tggcaacagatctggaacct

SEQ ID NO: 2989971 - DNA, 14 bp, Homo sapiens
tggcacaggacatg

SEQ ID NO: 2989972 - DNA, 21 bp, Homo sapiens
tggcacaggagtgtcctcttc

SEQ ID NO: 2989973 - DNA, 15 bp, Homo sapiens
tggcacatcctatgc

SEQ ID NO: 2989974 - DNA, 14 bp, Homo sapiens
tggcacccaagacc

SEQ ID NO: 2989975 - DNA, 20 bp, Homo sapiens
tggcacctaatccaggcaga

SEQ ID NO: 2989976 - DNA, 14 bp, Homo sapiens
tggcacctgcctag

SEQ ID NO: 2989977 - DNA, 18 bp, Homo sapiens
tggcacctgcctagctct

SEQ ID NO: 2989978 - DNA, 20 bp, Homo sapiens
tggcacctgcctagctcttg

SEQ ID NO: 2989979 - DNA, 15 bp, Homo sapiens
tggcactagggatca

SEQ ID NO: 2989980 - DNA, 14 bp, Homo sapiens
tggcactattttta

SEQ ID NO: 2989981 - DNA, 15 bp, Homo sapiens
tggcactcaacatga

SEQ ID NO: 2989982 - DNA, 19 bp, Homo sapiens
tggcactccctccagcaca

SEQ ID NO: 2989983 - DNA, 19 bp, Homo sapiens
tggcactgcatacaatctg

SEQ ID NO: 2989984 - DNA, 14 bp, Homo sapiens
tggcacttgcctgg

SEQ ID NO: 2989985 - DNA, 18 bp, Homo sapiens
tggcacttgcctgggtca

SEQ ID NO: 2989986 - DNA, 20 bp, Homo sapiens
tggcagaaaaaatgtctgta

SEQ ID NO: 2989987 - DNA, 21 bp, Homo sapiens
tggcagaaaaaatgtctgtaa

SEQ ID NO: 2989988 - DNA, 15 bp, Homo sapiens
tggcagaactgctgg

SEQ ID NO: 2989989 - DNA, 18 bp, Homo sapiens
tggcagaactgctggggc

SEQ ID NO: 2989990 - DNA, 20 bp, Homo sapiens
tggcagaactgctggggctg

SEQ ID NO: 2989991 - DNA, 19 bp, Homo sapiens
tgggcaggagtcaccatgc

SEQ ID NO: 2989992 - DNA, 19 bp, Homo sapiens
tgggcagggtctctgctcc

SEQ ID NO: 2989993 - DNA, 22 bp, Homo sapiens
tgggcaggtggccgcccctgag

SEQ ID NO: 2989994 - DNA, 23 bp, Homo sapiens
tgggcaggtggccgcccctgagg

SEQ ID NO: 2989995 - DNA, 17 bp, Homo sapiens
tgggcagttacatgcat

SEQ ID NO: 2989996 - DNA, 12 bp, Homo sapiens
tgggcatggtgc

SEQ ID NO: 2989997 - DNA, 15 bp, Homo sapiens
tgggcatgtgggctt

SEQ ID NO: 2989998 - DNA, 15 bp, Homo sapiens
tgggcattgctttcc

SEQ ID NO: 2989999 - DNA, 20 bp, Homo sapiens
tgggcattgctttccactga

SEQ ID NO: 2990000 - DNA, 17 bp, Homo sapiens
tgggccacccctcctag

SEQ ID NO: 2990001 - DNA, 13 bp, Homo sapiens
tgggccagacatg

SEQ ID NO: 2990002 - DNA, 18 bp, Homo sapiens
tgggccagacatgccaca

SEQ ID NO: 2990003 - DNA, 20 bp, Homo sapiens
tgggccatgggtcctcggcc

SEQ ID NO: 2990004 - DNA, 19 bp, Homo sapiens
tgggccattctccacagca

SEQ ID NO: 2990005 - DNA, 20 bp, Homo sapiens
tgggccattctccacagcaa

SEQ ID NO: 2990006 - DNA, 18 bp, Homo sapiens
tgggcccacaaaggcaaa

SEQ ID NO: 2990007 - DNA, 14 bp, Homo sapiens
tgggcccaggcagg

SEQ ID NO: 2990008 - DNA, 17 bp, Homo sapiens
tgggccccaccacctag

SEQ ID NO: 2990009 - DNA, 14 bp, Homo sapiens
tgggcccccagaga

SEQ ID NO: 2990010 - DNA, 22 bp, Homo sapiens
tgggcccccagagacctttgcc

SEQ ID NO: 2990011 - DNA, 12 bp, Homo sapiens
tgggcccctcag

SEQ ID NO: 2990012 - DNA, 13 bp, Homo sapiens
tgggcccctcagg

SEQ ID NO: 2990013 - DNA, 16 bp, Homo sapiens
tgggcccctcagggga

SEQ ID NO: 2990014 - DNA, 17 bp, Homo sapiens
tgggcccctcccctcag

SEQ ID NO: 2990015 - DNA, 15 bp, Homo sapiens
tgggcccctggcact

SEQ ID NO: 2990016 - DNA, 22 bp, Homo sapiens
tgggccctgagtctgggcagct

SEQ ID NO: 2990017 - DNA, 11 bp, Homo sapiens
tgggccctgca

SEQ ID NO: 2990018 - DNA, 13 bp, Homo sapiens
tgggccctgcagg

SEQ ID NO: 2990019 - DNA, 12 bp, Homo sapiens
tgggccctgcat

SEQ ID NO: 2990020 - DNA, 14 bp, Homo sapiens
tgggccctgcatgt

SEQ ID NO: 2990021 - DNA, 17 bp, Homo sapiens
tgggccgtggcttgggc

SEQ ID NO: 2990022 - DNA, 15 bp, Homo sapiens
tgggcctgacctcca

SEQ ID NO: 2990023 - DNA, 13 bp, Homo sapiens
tgggcctgcagaa

SEQ ID NO: 2990024 - DNA, 19 bp, Homo sapiens
tgggcctgctccagacctg

SEQ ID NO: 2990025 - DNA, 18 bp, Homo sapiens
tgggcctggccagtcttc

SEQ ID NO: 2990026 - DNA, 20 bp, Homo sapiens
tgggcctggccagtcttcct

SEQ ID NO: 2990027 - DNA, 22 bp, Homo sapiens
tgggccttcattaaatgtttgt

SEQ ID NO: 2990028 - DNA, 17 bp, Homo sapiens
tgggccttgtgacaatc

SEQ ID NO: 2990029 - DNA, 21 bp, Homo sapiens
tgggcggacaaaagggccagg

SEQ ID NO: 2990030 - DNA, 16 bp, Homo sapiens
tgggcgggcccagcac

SEQ ID NO: 2990031 - DNA, 19 bp, Homo sapiens
tgggcgtacgctggtgctg

SEQ ID NO: 2990032 - DNA, 15 bp, Homo sapiens
tgggcgtctgactcc

SEQ ID NO: 2990033 - DNA, 16 bp, Homo sapiens
tgggcgtctgactccc

SEQ ID NO: 2990034 - DNA, 19 bp, Homo sapiens
tgggcgtctgactccctcc

SEQ ID NO: 2990035 - DNA, 20 bp, Homo sapiens
tgggcgttaggggcaggcag

SEQ ID NO: 2990036 - DNA, 12 bp, Homo sapiens
tgggctaacatt

SEQ ID NO: 2990037 - DNA, 19 bp, Homo sapiens
tgggctactgtagatttgt

SEQ ID NO: 2990038 - DNA, 12 bp, Homo sapiens
tgggctatattc

SEQ ID NO: 2990039 - DNA, 14 bp, Homo sapiens
tgggctccccagga

SEQ ID NO: 2990040 - DNA, 13 bp, Homo sapiens
tgggctcctccag

SEQ ID NO: 2990041 - DNA, 15 bp, Homo sapiens
tgggctcctccaggg

SEQ ID NO: 2990042 - DNA, 14 bp, Homo sapiens
tgggctctggctct

SEQ ID NO: 2990043 - DNA, 18 bp, Homo sapiens
tgggctgagccaaagcca

SEQ ID NO: 2990044 - DNA, 21 bp, Homo sapiens
tgggctgagccaaagccagag

SEQ ID NO: 2990045 - DNA, 16 bp, Homo sapiens
tgggctgagggagcct

SEQ ID NO: 2990046 - DNA, 19 bp, Homo sapiens
tgggctgcacgctcccctc

SEQ ID NO: 2990047 - DNA, 16 bp, Homo sapiens
tgggctgggcagcctt

SEQ ID NO: 2990048 - DNA, 17 bp, Homo sapiens
tgggctgggcagccttg

SEQ ID NO: 2990049 - DNA, 18 bp, Homo sapiens
tgggctgggtggcccctg

SEQ ID NO: 2990050 - DNA, 17 bp, Homo sapiens
tgggctgggtttgctgt

SEQ ID NO: 2990051 - DNA, 18 bp, Homo sapiens
tgggctggtattctctct

SEQ ID NO: 2990052 - DNA, 23 bp, Homo sapiens
tgggctggtattctctctatgca

SEQ ID NO: 2990053 - DNA, 21 bp, Homo sapiens
tgggctgtgattactgcaatc

SEQ ID NO: 2990054 - DNA, 18 bp, Homo sapiens
tgggctgtgttgactgct

SEQ ID NO: 2990055 - DNA, 19 bp, Homo sapiens
tgggcttcagcctagtggc

SEQ ID NO: 2990056 - DNA, 22 bp, Homo sapiens
tgggcttcagcctagtggcttg

SEQ ID NO: 2990057 - DNA, 14 bp, Homo sapiens
tgggcttgattctg

SEQ ID NO: 2990058 - DNA, 16 bp, Homo sapiens
tgggcttttgttctga

SEQ ID NO: 2990059 - DNA, 20 bp, Homo sapiens
tgggcttttgttctgagggg

SEQ ID NO: 2990060 - DNA, 22 bp, Homo sapiens
tgggcttttgttctgaggggtg

SEQ ID NO: 2990061 - DNA, 21 bp, Homo sapiens
tggggaaagacactgcctggg

SEQ ID NO: 2990062 - DNA, 22 bp, Homo sapiens
tggggaaagacactgcctgggc

SEQ ID NO: 2990063 - DNA, 13 bp, Homo sapiens
tggggaaggaggc

SEQ ID NO: 2990064 - DNA, 17 bp, Homo sapiens
tggggacctcagcctgc

SEQ ID NO: 2990065 - DNA, 19 bp, Homo sapiens
tggggacctgatggagagt

SEQ ID NO: 2990066 - DNA, 21 bp, Homo sapiens
tggggacgctccgctgccgtg

SEQ ID NO: 2990067 - DNA, 20 bp, Homo sapiens
tggggagaaagaggggcctg

SEQ ID NO: 2990068 - DNA, 13 bp, Homo sapiens
tggggagagacgg

SEQ ID NO: 2990069 - DNA, 14 bp, Homo sapiens
tggggagagggcat

SEQ ID NO: 2990070 - DNA, 21 bp, Homo sapiens
tggggagccgagggcgtcaga

SEQ ID NO: 2990071 - DNA, 13 bp, Homo sapiens
tggggaggaagag

SEQ ID NO: 2990072 - DNA, 12 bp, Homo sapiens
tggggaggctga

SEQ ID NO: 2990073 - DNA, 21 bp, Homo sapiens
tggggaggtggcactagggat

SEQ ID NO: 2990074 - DNA, 19 bp, Homo sapiens
tggggaggtgggaggccag

SEQ ID NO: 2990075 - DNA, 16 bp, Homo sapiens
tggggaggtgttcact

SEQ ID NO: 2990076 - DNA, 18 bp, Homo sapiens
tggggagtttagggtggg

SEQ ID NO: 2990077 - DNA, 20 bp, Homo sapiens
tggggatccctcccccccat

SEQ ID NO: 2990078 - DNA, 20 bp, Homo sapiens
tggggattgggcccctgcca

SEQ ID NO: 2990079 - DNA, 14 bp, Homo sapiens
tggggcactgggcg

SEQ ID NO: 2990080 - DNA, 23 bp, Homo sapiens
tggggcactgggcgtctgactcc

SEQ ID NO: 2990081 - DNA, 14 bp, Homo sapiens
tggggcagggagct

SEQ ID NO: 2990082 - DNA, 18 bp, Homo sapiens
tggggcaggggccggggg

SEQ ID NO: 2990083 - DNA, 22 bp, Homo sapiens
tggggcatgacccagtgaagat

SEQ ID NO: 2990084 - DNA, 14 bp, Homo sapiens
tggggcatgtcctt

SEQ ID NO: 2990085 - DNA, 13 bp, Homo sapiens
tggggcccagtgc

SEQ ID NO: 2990086 - DNA, 20 bp, Homo sapiens
tggggcccatggaggagaca

SEQ ID NO: 2990087 - DNA, 12 bp, Homo sapiens
tggggccctaat

SEQ ID NO: 2990088 - DNA, 13 bp, Homo sapiens
tggggcctcagac

SEQ ID NO: 2990089 - DNA, 14 bp, Homo sapiens
tggggcctcagacg

SEQ ID NO: 2990090 - DNA, 15 bp, Homo sapiens
tggggctgagctggg

SEQ ID NO: 2990091 - DNA, 14 bp, Homo sapiens
tggggctggcctcc

SEQ ID NO: 2990092 - DNA, 13 bp, Homo sapiens
tggggctggcttt

SEQ ID NO: 2990093 - DNA, 17 bp, Homo sapiens
tggggctggtgaggccg

SEQ ID NO: 2990094 - DNA, 23 bp, Homo sapiens
tggggctggtgaggccggccctg

SEQ ID NO: 2990095 - DNA, 22 bp, Homo sapiens
tggggctttcgtccacagcttc

SEQ ID NO: 2990096 - DNA, 15 bp, Homo sapiens
tgggggaaaaagcca

SEQ ID NO: 2990097 - DNA, 18 bp, Homo sapiens
tgggggaactcagatcca

SEQ ID NO: 2990098 - DNA, 20 bp, Homo sapiens
tgggggaactcagatccagg

SEQ ID NO: 2990099 - DNA, 14 bp, Homo sapiens
tgggggaagccctg

SEQ ID NO: 2990100 - DNA, 19 bp, Homo sapiens
tgggggagaaaaaatcact

SEQ ID NO: 2990101 - DNA, 11 bp, Homo sapiens
tgggggagaga

SEQ ID NO: 2990102 - DNA, 20 bp, Homo sapiens
tgggggcaggtcaggaccag

SEQ ID NO: 2990103 - DNA, 22 bp, Homo sapiens
tgggggcaggtcaggaccagga

SEQ ID NO: 2990104 - DNA, 12 bp, Homo sapiens
tgggggccaggc

SEQ ID NO: 2990105 - DNA, 21 bp, Homo sapiens
tgggggcggggtgggaaagat

SEQ ID NO: 2990106 - DNA, 14 bp, Homo sapiens
tgggggctcccctt

SEQ ID NO: 2990107 - DNA, 17 bp, Homo sapiens
tgggggctggaggtgct

SEQ ID NO: 2990108 - DNA, 18 bp, Homo sapiens
tgggggctggaggtgctg

SEQ ID NO: 2990109 - DNA, 20 bp, Homo sapiens
tgggggctgtctttgcaggg

SEQ ID NO: 2990110 - DNA, 19 bp, Homo sapiens
tgggggctttcggggaggg

SEQ ID NO: 2990111 - DNA, 21 bp, Homo sapiens
tgggggctttcggggagggcg

SEQ ID NO: 2990112 - DNA, 16 bp, Homo sapiens
tggggggaccaaatag

SEQ ID NO: 2990113 - DNA, 21 bp, Homo sapiens
tggggggaccaaatagccacc

SEQ ID NO: 2990114 - DNA, 19 bp, Homo sapiens
tggggggacccagtgcaga

SEQ ID NO: 2990115 - DNA, 22 bp, Homo sapiens
tgggggggagaaggcctcccct

SEQ ID NO: 2990116 - DNA, 14 bp, Homo sapiens
tgggggggctgcct

SEQ ID NO: 2990117 - DNA, 16 bp, Homo sapiens
tgggggtgggccaggc

SEQ ID NO: 2990118 - DNA, 14 bp, Homo sapiens
tggggtaccagcca

SEQ ID NO: 2990119 - DNA, 18 bp, Homo sapiens
tggggtagctagaggaac

SEQ ID NO: 2990120 - DNA, 19 bp, Homo sapiens
tggggtcaagctgagctgg

SEQ ID NO: 2990121 - DNA, 20 bp, Homo sapiens
tggggtcatgccctcctctc

SEQ ID NO: 2990122 - DNA, 14 bp, Homo sapiens
tggggtccagggag

SEQ ID NO: 2990123 - DNA, 12 bp, Homo sapiens
tggggtccccag

SEQ ID NO: 2990124 - DNA, 11 bp, Homo sapiens
tgtactttgtg

SEQ ID NO: 2990125 - DNA, 13 bp, Homo sapiens
tgtactttgtgct

SEQ ID NO: 2990126 - DNA, 23 bp, Homo sapiens
tgtacttttaccagtttctttgt

SEQ ID NO: 2990127 - DNA, 13 bp, Homo sapiens
tgtacttttcatt

SEQ ID NO: 2990128 - DNA, 15 bp, Homo sapiens
tgtactttttagtaa

SEQ ID NO: 2990129 - DNA, 20 bp, Homo sapiens
tgtactttttagtaatttct

SEQ ID NO: 2990130 - DNA, 15 bp, Homo sapiens
tgtagaaacatttag

SEQ ID NO: 2990131 - DNA, 15 bp, Homo sapiens
tgtagaactgatttt

SEQ ID NO: 2990132 - DNA, 17 bp, Homo sapiens
tgtagaataaatgaaga

SEQ ID NO: 2990133 - DNA, 18 bp, Homo sapiens
tgtagaatagcctgtggc

SEQ ID NO: 2990134 - DNA, 18 bp, Homo sapiens
tgtagaatgtattgtacc

SEQ ID NO: 2990135 - DNA, 11 bp, Homo sapiens
tgtagacattg

SEQ ID NO: 2990136 - DNA, 23 bp, Homo sapiens
tgtagagaacacgcgtatttaca

SEQ ID NO: 2990137 - DNA, 12 bp, Homo sapiens
tgtagagacttc

SEQ ID NO: 2990138 - DNA, 20 bp, Homo sapiens
tgtagagacttccgtcaccc

SEQ ID NO: 2990139 - DNA, 16 bp, Homo sapiens
tgtagagccagccttg

SEQ ID NO: 2990140 - DNA, 18 bp, Homo sapiens
tgtagagccagccttggt

SEQ ID NO: 2990141 - DNA, 21 bp, Homo sapiens
tgtagataaataatgtagttt

SEQ ID NO: 2990142 - DNA, 12 bp, Homo sapiens
tgtagatgatgt

SEQ ID NO: 2990143 - DNA, 13 bp, Homo sapiens
tgtagatgcagaa

SEQ ID NO: 2990144 - DNA, 14 bp, Homo sapiens
tgtagattcagtgg

SEQ ID NO: 2990145 - DNA, 15 bp, Homo sapiens
tgtagattctgtgga

SEQ ID NO: 2990146 - DNA, 13 bp, Homo sapiens
tgtagccacacca

SEQ ID NO: 2990147 - DNA, 14 bp, Homo sapiens
tgtagccaggtccc

SEQ ID NO: 2990148 - DNA, 16 bp, Homo sapiens
tgtagcccactctgct

SEQ ID NO: 2990149 - DNA, 22 bp, Homo sapiens
tgtagcccactctgctcgcctt

SEQ ID NO: 2990150 - DNA, 17 bp, Homo sapiens
tgtagccccctggcctc

SEQ ID NO: 2990151 - DNA, 18 bp, Homo sapiens
tgtagccccctggcctct

SEQ ID NO: 2990152 - DNA, 15 bp, Homo sapiens
tgtagccctcccact

SEQ ID NO: 2990153 - DNA, 22 bp, Homo sapiens
tgtagcctcgccgtctgtgaat

SEQ ID NO: 2990154 - DNA, 23 bp, Homo sapiens
tgtagcctggatattattcttgt

SEQ ID NO: 2990155 - DNA, 14 bp, Homo sapiens
tgtagcctgtgcat

SEQ ID NO: 2990156 - DNA, 15 bp, Homo sapiens
tgtagcctgtgcatg

SEQ ID NO: 2990157 - DNA, 20 bp, Homo sapiens
tgtagcctgtgcatgtatgt

SEQ ID NO: 2990158 - DNA, 13 bp, Homo sapiens
tgtagctttcctg

SEQ ID NO: 2990159 - DNA, 17 bp, Homo sapiens
tgtagctttcctggaag

SEQ ID NO: 2990160 - DNA, 14 bp, Homo sapiens
tgtagctttctgga

SEQ ID NO: 2990161 - DNA, 18 bp, Homo sapiens
tgtaggaatctgccttcc

SEQ ID NO: 2990162 - DNA, 16 bp, Homo sapiens
tgtaggacttttaaac

SEQ ID NO: 2990163 - DNA, 13 bp, Homo sapiens
tgtaggagacttg

SEQ ID NO: 2990164 - DNA, 18 bp, Homo sapiens
tgtaggagacttgccaga

SEQ ID NO: 2990165 - DNA, 22 bp, Homo sapiens
tgtaggagacttgccagagccg

SEQ ID NO: 2990166 - DNA, 12 bp, Homo sapiens
tgtaggagctgc

SEQ ID NO: 2990167 - DNA, 17 bp, Homo sapiens
tgtaggcatcatgcatg

SEQ ID NO: 2990168 - DNA, 20 bp, Homo sapiens
tgtagggagatggagaaaat

SEQ ID NO: 2990169 - DNA, 16 bp, Homo sapiens
tgtagggttacagaga

SEQ ID NO: 2990170 - DNA, 14 bp, Homo sapiens
tgtaggttatttta

SEQ ID NO: 2990171 - DNA, 19 bp, Homo sapiens
tgtagtaaagccgttgttt

SEQ ID NO: 2990172 - DNA, 20 bp, Homo sapiens
tgtagtaggcatttttacca

SEQ ID NO: 2990173 - DNA, 21 bp, Homo sapiens
tgtagtatcaaatattagatg

SEQ ID NO: 2990174 - DNA, 23 bp, Homo sapiens
tgtagtatcaaatattagatgtg

SEQ ID NO: 2990175 - DNA, 15 bp, Homo sapiens
tgtagtcaataaaac

SEQ ID NO: 2990176 - DNA, 20 bp, Homo sapiens
tgtagtccgtgctgacagct

SEQ ID NO: 2990177 - DNA, 12 bp, Homo sapiens
tgtagtcttgtc

SEQ ID NO: 2990178 - DNA, 14 bp, Homo sapiens
tgtagtgagccaag

SEQ ID NO: 2990179 - DNA, 13 bp, Homo sapiens
tgtagtgagcgag

SEQ ID NO: 2990180 - DNA, 16 bp, Homo sapiens
tgtagttactcaagca

SEQ ID NO: 2990181 - DNA, 18 bp, Homo sapiens
tgtagttctttgttcctg

SEQ ID NO: 2990182 - DNA, 20 bp, Homo sapiens
tgtagttgaactgatagtta

SEQ ID NO: 2990183 - DNA, 15 bp, Homo sapiens
tgtagttgcgtggac

SEQ ID NO: 2990184 - DNA, 21 bp, Homo sapiens
tgtagttgcgtggactctgca

SEQ ID NO: 2990185 - DNA, 21 bp, Homo sapiens
tgtagttgttcgttggttata

SEQ ID NO: 2990186 - DNA, 19 bp, Homo sapiens
tgtagtttacctctttaaa

SEQ ID NO: 2990187 - DNA, 14 bp, Homo sapiens
tgtagttttgttta

SEQ ID NO: 2990188 - DNA, 14 bp, Homo sapiens
tgtataacaggtta

SEQ ID NO: 2990189 - DNA, 14 bp, Homo sapiens
tgtataacatcact

SEQ ID NO: 2990190 - DNA, 16 bp, Homo sapiens
tgtataacatcactgt

SEQ ID NO: 2990191 - DNA, 22 bp, Homo sapiens
tgtataagtagatctgctttct

SEQ ID NO: 2990192 - DNA, 21 bp, Homo sapiens
tgtataatgacttttaaaatt

SEQ ID NO: 2990193 - DNA, 15 bp, Homo sapiens
tgtataattgtatcg

SEQ ID NO: 2990194 - DNA, 21 bp, Homo sapiens
tgtataccagcctactgtact

SEQ ID NO: 2990195 - DNA, 15 bp, Homo sapiens
tgtatagtgccacca

SEQ ID NO: 2990196 - DNA, 15 bp, Homo sapiens
tgtatataaatatat

SEQ ID NO: 2990197 - DNA, 20 bp, Homo sapiens
tgtatataaatatattttct

SEQ ID NO: 2990198 - DNA, 17 bp, Homo sapiens
tgtatatacgcatctat

SEQ ID NO: 2990199 - DNA, 14 bp, Homo sapiens
tgtatatatatgtg

SEQ ID NO: 2990200 - DNA, 20 bp, Homo sapiens
tgtatatatgtcaaattgtc

SEQ ID NO: 2990201 - DNA, 14 bp, Homo sapiens
tgtatatgactgca

SEQ ID NO: 2990202 - DNA, 21 bp, Homo sapiens
tgtatatggtatatatacata

SEQ ID NO: 2990203 - DNA, 12 bp, Homo sapiens
tgtatatgtgct

SEQ ID NO: 2990204 - DNA, 19 bp, Homo sapiens
tgtatattaaggtgtggct

SEQ ID NO: 2990205 - DNA, 12 bp, Homo sapiens
tgtatattattt

SEQ ID NO: 2990206 - DNA, 14 bp, Homo sapiens
tgtatattatttct

SEQ ID NO: 2990207 - DNA, 22 bp, Homo sapiens
tgtatattatttctaggaagaa

SEQ ID NO: 2990208 - DNA, 15 bp, Homo sapiens
tgtatattgggctca

SEQ ID NO: 2990209 - DNA, 20 bp, Homo sapiens
tgtatattgtgtttgtgtat

SEQ ID NO: 2990210 - DNA, 18 bp, Homo sapiens
tgtatatttgtaaagcta

SEQ ID NO: 2990211 - DNA, 23 bp, Homo sapiens
tgtatcactgccttcgtttatat

SEQ ID NO: 2990212 - DNA, 13 bp, Homo sapiens
tgtatcataatta

SEQ ID NO: 2990213 - DNA, 16 bp, Homo sapiens
tgtatccagaggaatt

SEQ ID NO: 2990214 - DNA, 14 bp, Homo sapiens
tgtatccatgtaat

SEQ ID NO: 2990215 - DNA, 18 bp, Homo sapiens
tgtatccattatcatgtg

SEQ ID NO: 2990216 - DNA, 19 bp, Homo sapiens
tgtatccattatcatgtgt

SEQ ID NO: 2990217 - DNA, 21 bp, Homo sapiens
tgtatcgtatagctgtattga

SEQ ID NO: 2990218 - DNA, 13 bp, Homo sapiens
tgtatctgtctac

SEQ ID NO: 2990219 - DNA, 14 bp, Homo sapiens
tgtatctgtctact

SEQ ID NO: 2990220 - DNA, 16 bp, Homo sapiens
tgtatgagaagtactt

SEQ ID NO: 2990221 - DNA, 13 bp, Homo sapiens
tgtatgatttgtt

SEQ ID NO: 2990222 - DNA, 15 bp, Homo sapiens
tgtatgcactgctca

SEQ ID NO: 2990223 - DNA, 15 bp, Homo sapiens
tgtatgctgatcatc

SEQ ID NO: 2990224 - DNA, 23 bp, Homo sapiens
tgtatgctgatcatcgccagagg

SEQ ID NO: 2990225 - DNA, 15 bp, Homo sapiens
tgtatgggcaaaaaa

SEQ ID NO: 2990226 - DNA, 21 bp, Homo sapiens
tgtatgtaacaattgtttgtt

SEQ ID NO: 2990227 - DNA, 15 bp, Homo sapiens
tgtatgtagaagcat

SEQ ID NO: 2990228 - DNA, 21 bp, Homo sapiens
tgtatgtatgagacagaaact

SEQ ID NO: 2990229 - DNA, 19 bp, Homo sapiens
tgtattagtgatatttctc

SEQ ID NO: 2990230 - DNA, 20 bp, Homo sapiens
tgtattagtgatatttctct

SEQ ID NO: 2990231 - DNA, 22 bp, Homo sapiens
tgtattagtgatatttctctag

SEQ ID NO: 2990232 - DNA, 13 bp, Homo sapiens
tgtattattgcaa

SEQ ID NO: 2990233 - DNA, 21 bp, Homo sapiens
tgtattatttcattatgtaaa

SEQ ID NO: 2990234 - DNA, 15 bp, Homo sapiens
tgtattcatgttcat

SEQ ID NO: 2990235 - DNA, 21 bp, Homo sapiens
tgtattcatgttcatgtgatt

SEQ ID NO: 2990236 - DNA, 21 bp, Homo sapiens
tgtattctctgagctgtgcag

SEQ ID NO: 2990237 - DNA, 14 bp, Homo sapiens
tgtattctttaaga

SEQ ID NO: 2990238 - DNA, 16 bp, Homo sapiens
tgtattctttgatgtt

SEQ ID NO: 2990239 - DNA, 18 bp, Homo sapiens
tgtattctttgatgttaa

SEQ ID NO: 2990240 - DNA, 21 bp, Homo sapiens
tgtattctttgatgttaacac

SEQ ID NO: 2990241 - DNA, 23 bp, Homo sapiens
tgtattgccatcgggtgccaaat

SEQ ID NO: 2990242 - DNA, 17 bp, Homo sapiens
tgtattgctgctgtgcg

SEQ ID NO: 2990243 - DNA, 22 bp, Homo sapiens
tgtattgctgctgtgcgtggaa

SEQ ID NO: 2990244 - DNA, 15 bp, Homo sapiens
tgtattggtgaaaga

SEQ ID NO: 2990245 - DNA, 21 bp, Homo sapiens
tgtattgtaccttttaacacc

SEQ ID NO: 2990246 - DNA, 23 bp, Homo sapiens
tgtatttacgctttgattcatag

SEQ ID NO: 2990247 - DNA, 13 bp, Homo sapiens
tgtatttatatat

SEQ ID NO: 2990248 - DNA, 20 bp, Homo sapiens
tgtatttatatataaaaaga

SEQ ID NO: 2990249 - DNA, 18 bp, Homo sapiens
tgtatttatttaaaagat

SEQ ID NO: 2990250 - DNA, 13 bp, Homo sapiens
tgtatttcttata

SEQ ID NO: 2990251 - DNA, 15 bp, Homo sapiens
tgtatttgatgtctt

SEQ ID NO: 2990252 - DNA, 16 bp, Homo sapiens
tgtatttgtgactaat

SEQ ID NO: 2990253 - DNA, 18 bp, Homo sapiens
tgtatttgtgactaattg

SEQ ID NO: 2990254 - DNA, 15 bp, Homo sapiens
tgtattttaaaatag

SEQ ID NO: 2990255 - DNA, 16 bp, Homo sapiens
tgtattttcaaagact

SEQ ID NO: 2990256 - DNA, 12 bp, Homo sapiens
tgtattttccaa

SEQ ID NO: 2990257 - DNA, 20 bp, Homo sapiens
tgtgcggcacaggaaacagc

SEQ ID NO: 2990258 - DNA, 16 bp, Homo sapiens
tgtgcgtggaaaaaga

SEQ ID NO: 2990259 - DNA, 22 bp, Homo sapiens
tgtgcgtggaagtgttcctgtc

SEQ ID NO: 2990260 - DNA, 15 bp, Homo sapiens
tgtgcgttcccttca

SEQ ID NO: 2990261 - DNA, 21 bp, Homo sapiens
tgtgctacagagaaaatcaaa

SEQ ID NO: 2990262 - DNA, 15 bp, Homo sapiens
tgtgctacgtgtgaa

SEQ ID NO: 2990263 - DNA, 21 bp, Homo sapiens
tgtgctacgtgtgaaatctgt

SEQ ID NO: 2990264 - DNA, 16 bp, Homo sapiens
tgtgctagtcactggc

SEQ ID NO: 2990265 - DNA, 18 bp, Homo sapiens
tgtgctcaggactcagaa

SEQ ID NO: 2990266 - DNA, 21 bp, Homo sapiens
tgtgctcagtcgccctgttct

SEQ ID NO: 2990267 - DNA, 14 bp, Homo sapiens
tgtgctcatgtgtg

SEQ ID NO: 2990268 - DNA, 16 bp, Homo sapiens
tgtgctccatagagca

SEQ ID NO: 2990269 - DNA, 20 bp, Homo sapiens
tgtgctccatagagcagtgc

SEQ ID NO: 2990270 - DNA, 14 bp, Homo sapiens
tgtgctcccacggg

SEQ ID NO: 2990271 - DNA, 19 bp, Homo sapiens
tgtgctctccaagcccagt

SEQ ID NO: 2990272 - DNA, 19 bp, Homo sapiens
tgtgctctttcctgccctt

SEQ ID NO: 2990273 - DNA, 21 bp, Homo sapiens
tgtgctgaacataacttctca

SEQ ID NO: 2990274 - DNA, 18 bp, Homo sapiens
tgtgctgccctgaagaat

SEQ ID NO: 2990275 - DNA, 18 bp, Homo sapiens
tgtgctgctcactcaaca

SEQ ID NO: 2990276 - DNA, 15 bp, Homo sapiens
tgtgctggttctgtt

SEQ ID NO: 2990277 - DNA, 16 bp, Homo sapiens
tgtgctgtgtaaagtt

SEQ ID NO: 2990278 - DNA, 13 bp, Homo sapiens
tgtgcttatattc

SEQ ID NO: 2990279 - DNA, 19 bp, Homo sapiens
tgtgcttatggtaccagat

SEQ ID NO: 2990280 - DNA, 20 bp, Homo sapiens
tgtgctttctttagaaacac

SEQ ID NO: 2990281 - DNA, 13 bp, Homo sapiens
tgtgctttgaaaa

SEQ ID NO: 2990282 - DNA, 15 bp, Homo sapiens
tgtggaaaagaaaca

SEQ ID NO: 2990283 - DNA, 20 bp, Homo sapiens
tgtggaaaagaaacacgcac

SEQ ID NO: 2990284 - DNA, 20 bp, Homo sapiens
tgtggaaaagccatctcagg

SEQ ID NO: 2990285 - DNA, 13 bp, Homo sapiens
tgtggaagtccct

SEQ ID NO: 2990286 - DNA, 22 bp, Homo sapiens
tgtggacaccactgagctctgc

SEQ ID NO: 2990287 - DNA, 18 bp, Homo sapiens
tgtggaggcagtgtcatt

SEQ ID NO: 2990288 - DNA, 17 bp, Homo sapiens
tgtggaggcctcaggga

SEQ ID NO: 2990289 - DNA, 13 bp, Homo sapiens
tgtggagtgtgct

SEQ ID NO: 2990290 - DNA, 19 bp, Homo sapiens
tgtggagttcctgctccgt

SEQ ID NO: 2990291 - DNA, 16 bp, Homo sapiens
tgtggataacaaagat

SEQ ID NO: 2990292 - DNA, 18 bp, Homo sapiens
tgtggataacaaagatat

SEQ ID NO: 2990293 - DNA, 19 bp, Homo sapiens
tgtggatgagccctcagaa

SEQ ID NO: 2990294 - DNA, 14 bp, Homo sapiens
tgtggatgggaggg

SEQ ID NO: 2990295 - DNA, 18 bp, Homo sapiens
tgtggattgagtaatggg

SEQ ID NO: 2990296 - DNA, 15 bp, Homo sapiens
tgtggatttcagttt

SEQ ID NO: 2990297 - DNA, 15 bp, Homo sapiens
tgtggcaactaaacc

SEQ ID NO: 2990298 - DNA, 17 bp, Homo sapiens
tgtggcaaggaaaaaca

SEQ ID NO: 2990299 - DNA, 15 bp, Homo sapiens
tgtggcacgcacctg

SEQ ID NO: 2990300 - DNA, 19 bp, Homo sapiens
tgtggcactggggcagggg

SEQ ID NO: 2990301 - DNA, 19 bp, Homo sapiens
tgtggcacttgcctgggtc

SEQ ID NO: 2990302 - DNA, 16 bp, Homo sapiens
tgtggcagcaggcagc

SEQ ID NO: 2990303 - DNA, 19 bp, Homo sapiens
tgtggcatccagagtccct

SEQ ID NO: 2990304 - DNA, 21 bp, Homo sapiens
tgtggcatccagagtccctgc

SEQ ID NO: 2990305 - DNA, 15 bp, Homo sapiens
tgtggcatgcaaaag

SEQ ID NO: 2990306 - DNA, 12 bp, Homo sapiens
tgtggccaggct

SEQ ID NO: 2990307 - DNA, 19 bp, Homo sapiens
tgtggccatcactcagccc

SEQ ID NO: 2990308 - DNA, 20 bp, Homo sapiens
tgtggccatcactcagcccc

SEQ ID NO: 2990309 - DNA, 21 bp, Homo sapiens
tgtggccatcactcagcccct

SEQ ID NO: 2990310 - DNA, 20 bp, Homo sapiens
tgtggccctggcctgctggg

SEQ ID NO: 2990311 - DNA, 15 bp, Homo sapiens
tgtggccgccatctg

SEQ ID NO: 2990312 - DNA, 17 bp, Homo sapiens
tgtggccgccatctgcg

SEQ ID NO: 2990313 - DNA, 22 bp, Homo sapiens
tgtggctcacgtgagagtgtct

SEQ ID NO: 2990314 - DNA, 19 bp, Homo sapiens
tgtggctccctctctcctg

SEQ ID NO: 2990315 - DNA, 11 bp, Homo sapiens
tgtggctgtgc

SEQ ID NO: 2990316 - DNA, 15 bp, Homo sapiens
tgtgggaaaaaagaa

SEQ ID NO: 2990317 - DNA, 18 bp, Homo sapiens
tgtgggaaaaaagaaaaa

SEQ ID NO: 2990318 - DNA, 15 bp, Homo sapiens
tgtgggaagggagag

SEQ ID NO: 2990319 - DNA, 22 bp, Homo sapiens
tgtgggacacctcaaatacata

SEQ ID NO: 2990320 - DNA, 21 bp, Homo sapiens
tgtgggactccaggccagctc

SEQ ID NO: 2990321 - DNA, 22 bp, Homo sapiens
tgtgggactccaggccagctcc

SEQ ID NO: 2990322 - DNA, 16 bp, Homo sapiens
tgtgggaggctcctgt

SEQ ID NO: 2990323 - DNA, 18 bp, Homo sapiens
tgtggggacctcagcctg

SEQ ID NO: 2990324 - DNA, 19 bp, Homo sapiens
tgtggggacctcagcctgc

SEQ ID NO: 2990325 - DNA, 18 bp, Homo sapiens
tgtgggggctagaaaaaa

SEQ ID NO: 2990326 - DNA, 15 bp, Homo sapiens
tgtgggtacctgtat

SEQ ID NO: 2990327 - DNA, 13 bp, Homo sapiens
tgtgggtgggaga

SEQ ID NO: 2990328 - DNA, 16 bp, Homo sapiens
tgtggtaaatgccaca

SEQ ID NO: 2990329 - DNA, 23 bp, Homo sapiens
tgtggtaaatgccacacaccttt

SEQ ID NO: 2990330 - DNA, 21 bp, Homo sapiens
tgtggtctcgatgctgctggc

SEQ ID NO: 2990331 - DNA, 13 bp, Homo sapiens
tgtggtctgccaa

SEQ ID NO: 2990332 - DNA, 16 bp, Homo sapiens
tgtggtgatgtgcctg

SEQ ID NO: 2990333 - DNA, 21 bp, Homo sapiens
tgtggtgtttcctgcaggcca

SEQ ID NO: 2990334 - DNA, 21 bp, Homo sapiens
tgtggttaatccaatcaattt

SEQ ID NO: 2990335 - DNA, 20 bp, Homo sapiens
tgtggttcatccatcatctg

SEQ ID NO: 2990336 - DNA, 13 bp, Homo sapiens
tgtggtttttagt

SEQ ID NO: 2990337 - DNA, 17 bp, Homo sapiens
tgtgtaaaatgtaatgc

SEQ ID NO: 2990338 - DNA, 20 bp, Homo sapiens
tgtgtaaagatctacatgaa

SEQ ID NO: 2990339 - DNA, 21 bp, Homo sapiens
tgtgtaaatatttttccctcc

SEQ ID NO: 2990340 - DNA, 23 bp, Homo sapiens
tgtgtaaccattttataaagtgc

SEQ ID NO: 2990341 - DNA, 20 bp, Homo sapiens
tgtgtaataatgtaacatga

SEQ ID NO: 2990342 - DNA, 19 bp, Homo sapiens
tgtgtaatttatgtgaaaa

SEQ ID NO: 2990343 - DNA, 19 bp, Homo sapiens
tgtgtacaaagaaataaca

SEQ ID NO: 2990344 - DNA, 13 bp, Homo sapiens
tgtgtacacaaag

SEQ ID NO: 2990345 - DNA, 15 bp, Homo sapiens
tgtgtacacaaagga

SEQ ID NO: 2990346 - DNA, 18 bp, Homo sapiens
tgtgtaccacaccctgcc

SEQ ID NO: 2990347 - DNA, 19 bp, Homo sapiens
tgtgtaccacaccctgcct

SEQ ID NO: 2990348 - DNA, 22 bp, Homo sapiens
tgtgtaccacaccctgcctgct

SEQ ID NO: 2990349 - DNA, 17 bp, Homo sapiens
tgtgtagaaaaaaaaac

SEQ ID NO: 2990350 - DNA, 16 bp, Homo sapiens
tgtgtagacaaatatt

SEQ ID NO: 2990351 - DNA, 22 bp, Homo sapiens
tgtgtagagtggcgattgaatg

SEQ ID NO: 2990352 - DNA, 23 bp, Homo sapiens
tgtgtagctgctcttttgtctct

SEQ ID NO: 2990353 - DNA, 15 bp, Homo sapiens
tgtgtagtagtgcat

SEQ ID NO: 2990354 - DNA, 21 bp, Homo sapiens
tgtgtatatatatatatatgt

SEQ ID NO: 2990355 - DNA, 17 bp, Homo sapiens
tgtgtatatatgtcaaa

SEQ ID NO: 2990356 - DNA, 20 bp, Homo sapiens
tgtgtatccagtatgcacgt

SEQ ID NO: 2990357 - DNA, 18 bp, Homo sapiens
tgtgtatccattatcatg

SEQ ID NO: 2990358 - DNA, 22 bp, Homo sapiens
tgtgtatgagaagtactttgtg

SEQ ID NO: 2990359 - DNA, 15 bp, Homo sapiens
tgtgtattcatactg

SEQ ID NO: 2990360 - DNA, 15 bp, Homo sapiens
tgtgtatttacgctt

SEQ ID NO: 2990361 - DNA, 14 bp, Homo sapiens
tgtgtatttatata

SEQ ID NO: 2990362 - DNA, 17 bp, Homo sapiens
tgtgtatttctctgtga

SEQ ID NO: 2990363 - DNA, 19 bp, Homo sapiens
tgtgtatttctctgtgaat

SEQ ID NO: 2990364 - DNA, 20 bp, Homo sapiens
tgtgtatttctctgtgaatc

SEQ ID NO: 2990365 - DNA, 16 bp, Homo sapiens
tgtgtcaataaagtca

SEQ ID NO: 2990366 - DNA, 14 bp, Homo sapiens
tgtgtcaatccaga

SEQ ID NO: 2990367 - DNA, 18 bp, Homo sapiens
tgtgtcaccatcaggcca

SEQ ID NO: 2990368 - DNA, 12 bp, Homo sapiens
tgtgtcagagcc

SEQ ID NO: 2990369 - DNA, 19 bp, Homo sapiens
tgtgtcagagcccagggga

SEQ ID NO: 2990370 - DNA, 22 bp, Homo sapiens
tgtgtcagtggggctctctgag

SEQ ID NO: 2990371 - DNA, 18 bp, Homo sapiens
tgtgtcatattttaaaat

SEQ ID NO: 2990372 - DNA, 18 bp, Homo sapiens
tgtgtccatcatattaaa

SEQ ID NO: 2990373 - DNA, 19 bp, Homo sapiens
tgtgtcccaggcagggaga

SEQ ID NO: 2990374 - DNA, 16 bp, Homo sapiens
tgtgtccccctctgtc

SEQ ID NO: 2990375 - DNA, 18 bp, Homo sapiens
tgtgtccccttcatcctt

SEQ ID NO: 2990376 - DNA, 17 bp, Homo sapiens
tgtgtccctgctggggt

SEQ ID NO: 2990377 - DNA, 16 bp, Homo sapiens
tgtgtctaagattcta

SEQ ID NO: 2990378 - DNA, 17 bp, Homo sapiens
tgtgtctaagattctag

SEQ ID NO: 2990379 - DNA, 18 bp, Homo sapiens
tgtgtctaagattctaga

SEQ ID NO: 2990380 - DNA, 19 bp, Homo sapiens
tgtgtctaagattctagat

SEQ ID NO: 2990381 - DNA, 15 bp, Homo sapiens
tgtgtctcaaaaata

SEQ ID NO: 2990382 - DNA, 15 bp, Homo sapiens
tgtgtctctgtatat

SEQ ID NO: 2990383 - DNA, 17 bp, Homo sapiens
tgtgtctgcgaagtcct

SEQ ID NO: 2990384 - DNA, 12 bp, Homo sapiens
tgtgtctggaag

SEQ ID NO: 2990385 - DNA, 13 bp, Homo sapiens
tgtgtctggaaga

SEQ ID NO: 2990386 - DNA, 15 bp, Homo sapiens
tgtgtctgtggttgc

SEQ ID NO: 2990387 - DNA, 21 bp, Homo sapiens
tgtgtcttttataaaaagttt

SEQ ID NO: 2990388 - DNA, 18 bp, Homo sapiens
tgtgtgaaacctacagca

SEQ ID NO: 2990389 - DNA, 17 bp, Homo sapiens
ttaaaattatatagcaa

SEQ ID NO: 2990390 - DNA, 12 bp, Homo sapiens
ttaaacaaatga

SEQ ID NO: 2990391 - DNA, 13 bp, Homo sapiens
ttaaacaagtatt

SEQ ID NO: 2990392 - DNA, 18 bp, Homo sapiens
ttaaacagggtctcactc

SEQ ID NO: 2990393 - DNA, 21 bp, Homo sapiens
ttaaacagggtctcactctgt

SEQ ID NO: 2990394 - DNA, 21 bp, Homo sapiens
ttaaacatcattggataaatt

SEQ ID NO: 2990395 - DNA, 21 bp, Homo sapiens
ttaaacctgtttttttttcat

SEQ ID NO: 2990396 - DNA, 15 bp, Homo sapiens
ttaaacgattagtga

SEQ ID NO: 2990397 - DNA, 22 bp, Homo sapiens
ttaaacgattagtgatgtcctt

SEQ ID NO: 2990398 - DNA, 20 bp, Homo sapiens
ttaaacgtatgcatgtgaag

SEQ ID NO: 2990399 - DNA, 16 bp, Homo sapiens
ttaaactagatgacct

SEQ ID NO: 2990400 - DNA, 22 bp, Homo sapiens
ttaaactctgttgcaagtgcaa

SEQ ID NO: 2990401 - DNA, 16 bp, Homo sapiens
ttaaacttatgaatgt

SEQ ID NO: 2990402 - DNA, 15 bp, Homo sapiens
ttaaacttgacccag

SEQ ID NO: 2990403 - DNA, 17 bp, Homo sapiens
ttaaagaaaatgtgtct

SEQ ID NO: 2990404 - DNA, 18 bp, Homo sapiens
ttaaagaagtctcttaat

SEQ ID NO: 2990405 - DNA, 20 bp, Homo sapiens
ttaaagaatatgacttttta

SEQ ID NO: 2990406 - DNA, 14 bp, Homo sapiens
ttaaagagtctaga

SEQ ID NO: 2990407 - DNA, 15 bp, Homo sapiens
ttaaagagtctagat

SEQ ID NO: 2990408 - DNA, 23 bp, Homo sapiens
ttaaagagtctagattcaaaggt

SEQ ID NO: 2990409 - DNA, 19 bp, Homo sapiens
ttaaagatatttttattca

SEQ ID NO: 2990410 - DNA, 14 bp, Homo sapiens
ttaaagatttatca

SEQ ID NO: 2990411 - DNA, 15 bp, Homo sapiens
ttaaagcaaagtcac

SEQ ID NO: 2990412 - DNA, 22 bp, Homo sapiens
ttaaagcaaagtcacttctcca

SEQ ID NO: 2990413 - DNA, 16 bp, Homo sapiens
ttaaagcacatgccag

SEQ ID NO: 2990414 - DNA, 21 bp, Homo sapiens
ttaaagcacatgccagggaaa

SEQ ID NO: 2990415 - DNA, 16 bp, Homo sapiens
ttaaagccagtcatca

SEQ ID NO: 2990416 - DNA, 11 bp, Homo sapiens
ttaaaggaaaa

SEQ ID NO: 2990417 - DNA, 14 bp, Homo sapiens
ttaaaggaaaagca

SEQ ID NO: 2990418 - DNA, 15 bp, Homo sapiens
ttaaaggacaaacag

SEQ ID NO: 2990419 - DNA, 13 bp, Homo sapiens
ttaaagtattctt

SEQ ID NO: 2990420 - DNA, 22 bp, Homo sapiens
ttaaagtgctaaggttctaagg

SEQ ID NO: 2990421 - DNA, 13 bp, Homo sapiens
ttaaagtgctgtt

SEQ ID NO: 2990422 - DNA, 21 bp, Homo sapiens
ttaaagtgctgtttagattta

SEQ ID NO: 2990423 - DNA, 13 bp, Homo sapiens
ttaaataacatgt

SEQ ID NO: 2990424 - DNA, 14 bp, Homo sapiens
ttaaataagattct

SEQ ID NO: 2990425 - DNA, 15 bp, Homo sapiens
ttaaataagattcta

SEQ ID NO: 2990426 - DNA, 16 bp, Homo sapiens
ttaaataagattctaa

SEQ ID NO: 2990427 - DNA, 13 bp, Homo sapiens
ttaaatattttct

SEQ ID NO: 2990428 - DNA, 14 bp, Homo sapiens
ttaaatcagaataa

SEQ ID NO: 2990429 - DNA, 16 bp, Homo sapiens
ttaaatccttgtgtaa

SEQ ID NO: 2990430 - DNA, 16 bp, Homo sapiens
ttaaatctgaatttta

SEQ ID NO: 2990431 - DNA, 11 bp, Homo sapiens
ttaaatgaaag

SEQ ID NO: 2990432 - DNA, 16 bp, Homo sapiens
ttaaatgtgaattttt

SEQ ID NO: 2990433 - DNA, 11 bp, Homo sapiens
ttaaatgtgtt

SEQ ID NO: 2990434 - DNA, 23 bp, Homo sapiens
ttaaatgtttactatagaccaaa

SEQ ID NO: 2990435 - DNA, 18 bp, Homo sapiens
ttaaattaattgaatcta

SEQ ID NO: 2990436 - DNA, 15 bp, Homo sapiens
ttaaattacaatttt

SEQ ID NO: 2990437 - DNA, 17 bp, Homo sapiens
ttaaattacaattttat

SEQ ID NO: 2990438 - DNA, 11 bp, Homo sapiens
ttaaattacct

SEQ ID NO: 2990439 - DNA, 21 bp, Homo sapiens
ttaaattatgtttttattaag

SEQ ID NO: 2990440 - DNA, 12 bp, Homo sapiens
ttaaattattat

SEQ ID NO: 2990441 - DNA, 20 bp, Homo sapiens
ttaaattattatcttcttaa

SEQ ID NO: 2990442 - DNA, 23 bp, Homo sapiens
ttaaattctctctaacataacaa

SEQ ID NO: 2990443 - DNA, 19 bp, Homo sapiens
ttaaattcttactctggag

SEQ ID NO: 2990444 - DNA, 15 bp, Homo sapiens
ttaaattctttttca

SEQ ID NO: 2990445 - DNA, 16 bp, Homo sapiens
ttaaattttctccagt

SEQ ID NO: 2990446 - DNA, 18 bp, Homo sapiens
ttaacaaactcttcagtt

SEQ ID NO: 2990447 - DNA, 16 bp, Homo sapiens
ttaacaagaagatgaa

SEQ ID NO: 2990448 - DNA, 17 bp, Homo sapiens
ttaacaagaagatgaat

SEQ ID NO: 2990449 - DNA, 17 bp, Homo sapiens
ttaacacaatgtgaatt

SEQ ID NO: 2990450 - DNA, 11 bp, Homo sapiens
ttaacacattt

SEQ ID NO: 2990451 - DNA, 23 bp, Homo sapiens
ttaacagagcaaatttgaataat

SEQ ID NO: 2990452 - DNA, 20 bp, Homo sapiens
ttaacaggttttcttctaat

SEQ ID NO: 2990453 - DNA, 14 bp, Homo sapiens
ttaacatcatgaat

SEQ ID NO: 2990454 - DNA, 17 bp, Homo sapiens
ttaacattccaagactc

SEQ ID NO: 2990455 - DNA, 17 bp, Homo sapiens
ttaaccaagttgtttat

SEQ ID NO: 2990456 - DNA, 22 bp, Homo sapiens
ttaaccagatctagtcaatcaa

SEQ ID NO: 2990457 - DNA, 15 bp, Homo sapiens
ttaaccctaatcttt

SEQ ID NO: 2990458 - DNA, 16 bp, Homo sapiens
ttaaccgtttttcaag

SEQ ID NO: 2990459 - DNA, 18 bp, Homo sapiens
ttaaccgtttttcaagaa

SEQ ID NO: 2990460 - DNA, 17 bp, Homo sapiens
ttaacctcttaaacatg

SEQ ID NO: 2990461 - DNA, 18 bp, Homo sapiens
ttaaccttgccttagaaa

SEQ ID NO: 2990462 - DNA, 14 bp, Homo sapiens
ttaacgaggaagac

SEQ ID NO: 2990463 - DNA, 21 bp, Homo sapiens
ttaacgtatgtatttcattgc

SEQ ID NO: 2990464 - DNA, 20 bp, Homo sapiens
ttaactactatattgattgt

SEQ ID NO: 2990465 - DNA, 19 bp, Homo sapiens
ttaactatcttctttggac

SEQ ID NO: 2990466 - DNA, 12 bp, Homo sapiens
ttaactctgtct

SEQ ID NO: 2990467 - DNA, 20 bp, Homo sapiens
ttaactgaagaaagagaagt

SEQ ID NO: 2990468 - DNA, 22 bp, Homo sapiens
ttaactggtgcactttgtaaat

SEQ ID NO: 2990469 - DNA, 14 bp, Homo sapiens
ttaactgtgaataa

SEQ ID NO: 2990470 - DNA, 21 bp, Homo sapiens
ttaacttatttatatgaagca

SEQ ID NO: 2990471 - DNA, 23 bp, Homo sapiens
ttaacttatttatatgaagcaag

SEQ ID NO: 2990472 - DNA, 19 bp, Homo sapiens
ttaacttgtttggtagtta

SEQ ID NO: 2990473 - DNA, 15 bp, Homo sapiens
ttaactttaaaactg

SEQ ID NO: 2990474 - DNA, 16 bp, Homo sapiens
ttaactttaaaactgt

SEQ ID NO: 2990475 - DNA, 20 bp, Homo sapiens
ttaagaaacaatttaaattg

SEQ ID NO: 2990476 - DNA, 22 bp, Homo sapiens
ttaagaaatctgtttttgttta

SEQ ID NO: 2990477 - DNA, 19 bp, Homo sapiens
ttaagaaatgtataaactt

SEQ ID NO: 2990478 - DNA, 16 bp, Homo sapiens
ttaagaatttcacaag

SEQ ID NO: 2990479 - DNA, 21 bp, Homo sapiens
ttaagacctactgttctaaag

SEQ ID NO: 2990480 - DNA, 22 bp, Homo sapiens
ttaagacctactgttctaaagc

SEQ ID NO: 2990481 - DNA, 17 bp, Homo sapiens
ttaagacttgacagtgg

SEQ ID NO: 2990482 - DNA, 11 bp, Homo sapiens
ttaagagactc

SEQ ID NO: 2990483 - DNA, 15 bp, Homo sapiens
ttaagagcagtccat

SEQ ID NO: 2990484 - DNA, 16 bp, Homo sapiens
ttaagagcagtccatt

SEQ ID NO: 2990485 - DNA, 23 bp, Homo sapiens
ttaagagccatataagtttgaag

SEQ ID NO: 2990486 - DNA, 14 bp, Homo sapiens
ttaagagtccaaga

SEQ ID NO: 2990487 - DNA, 22 bp, Homo sapiens
ttaagatatccatctttttctt

SEQ ID NO: 2990488 - DNA, 22 bp, Homo sapiens
ttaagatgtttattaatagaat

SEQ ID NO: 2990489 - DNA, 13 bp, Homo sapiens
ttaagcaaatgca

SEQ ID NO: 2990490 - DNA, 14 bp, Homo sapiens
ttaagcagagataa

SEQ ID NO: 2990491 - DNA, 22 bp, Homo sapiens
ttaagcagctaaattttctgaa

SEQ ID NO: 2990492 - DNA, 15 bp, Homo sapiens
ttaagccaggaaaca

SEQ ID NO: 2990493 - DNA, 15 bp, Homo sapiens
ttaagctccagcttt

SEQ ID NO: 2990494 - DNA, 22 bp, Homo sapiens
ttaaggaagagagaattctgtt

SEQ ID NO: 2990495 - DNA, 20 bp, Homo sapiens
ttaaggagggagaaaggaga

SEQ ID NO: 2990496 - DNA, 17 bp, Homo sapiens
ttaaggcatacttttaa

SEQ ID NO: 2990497 - DNA, 20 bp, Homo sapiens
ttaaggtatctttttattca

SEQ ID NO: 2990498 - DNA, 16 bp, Homo sapiens
ttaaggtctttcagta

SEQ ID NO: 2990499 - DNA, 14 bp, Homo sapiens
ttaaggtgtagcca

SEQ ID NO: 2990500 - DNA, 17 bp, Homo sapiens
ttaaggtgtagccacac

SEQ ID NO: 2990501 - DNA, 15 bp, Homo sapiens
ttaagtacccgaggc

SEQ ID NO: 2990502 - DNA, 16 bp, Homo sapiens
ttaagtagaacaaaaa

SEQ ID NO: 2990503 - DNA, 16 bp, Homo sapiens
ttaagtataaacctta

SEQ ID NO: 2990504 - DNA, 23 bp, Homo sapiens
ttaagtcctaaaagttctcaatg

SEQ ID NO: 2990505 - DNA, 16 bp, Homo sapiens
ttaagtgggcattttg

SEQ ID NO: 2990506 - DNA, 12 bp, Homo sapiens
ttaagtgttgaa

SEQ ID NO: 2990507 - DNA, 13 bp, Homo sapiens
ttaagttcacttt

SEQ ID NO: 2990508 - DNA, 14 bp, Homo sapiens
ttaagttcctgctg

SEQ ID NO: 2990509 - DNA, 17 bp, Homo sapiens
ttaagttcctgctgcct

SEQ ID NO: 2990510 - DNA, 18 bp, Homo sapiens
ttaagttcctgctgcctg

SEQ ID NO: 2990511 - DNA, 20 bp, Homo sapiens
ttaagttcgaacatgtttca

SEQ ID NO: 2990512 - DNA, 19 bp, Homo sapiens
ttaagttgtttgcatgtga

SEQ ID NO: 2990513 - DNA, 16 bp, Homo sapiens
ttaagtttgtgaatgt

SEQ ID NO: 2990514 - DNA, 23 bp, Homo sapiens
ttaagtttttattcaaagcagct

SEQ ID NO: 2990515 - DNA, 20 bp, Homo sapiens
ttaagtttttctctttttca

SEQ ID NO: 2990516 - DNA, 21 bp, Homo sapiens
ttaataaaaacttacactctt

SEQ ID NO: 2990517 - DNA, 14 bp, Homo sapiens
ttaataaaaaggca

SEQ ID NO: 2990518 - DNA, 13 bp, Homo sapiens
ttaataaaacatt

SEQ ID NO: 2990519 - DNA, 17 bp, Homo sapiens
ttaataaacgaagataa

SEQ ID NO: 2990520 - DNA, 18 bp, Homo sapiens
ttaataaacgaagataaa

SEQ ID NO: 2990521 - DNA, 14 bp, Homo sapiens
ttaataaagacagg

SEQ ID NO: 2990522 - DNA, 18 bp, Homo sapiens
ttatcatccacattgttt

SEQ ID NO: 2990523 - DNA, 12 bp, Homo sapiens
ttatcatgtgta

SEQ ID NO: 2990524 - DNA, 18 bp, Homo sapiens
ttatcatgtgtaatcaat

SEQ ID NO: 2990525 - DNA, 23 bp, Homo sapiens
ttatcattaaccacttatcagtg

SEQ ID NO: 2990526 - DNA, 18 bp, Homo sapiens
ttatccaaaatgtgtatt

SEQ ID NO: 2990527 - DNA, 15 bp, Homo sapiens
ttatccagaagtatt

SEQ ID NO: 2990528 - DNA, 22 bp, Homo sapiens
ttatccatattacgttgtttct

SEQ ID NO: 2990529 - DNA, 17 bp, Homo sapiens
ttatccatattgagtca

SEQ ID NO: 2990530 - DNA, 13 bp, Homo sapiens
ttatccctgccca

SEQ ID NO: 2990531 - DNA, 12 bp, Homo sapiens
ttatccctgctt

SEQ ID NO: 2990532 - DNA, 13 bp, Homo sapiens
ttatccctgctta

SEQ ID NO: 2990533 - DNA, 22 bp, Homo sapiens
ttatcctagattatatcaaagt

SEQ ID NO: 2990534 - DNA, 20 bp, Homo sapiens
ttatcctcctgttctgaaac

SEQ ID NO: 2990535 - DNA, 12 bp, Homo sapiens
ttatcctgcaag

SEQ ID NO: 2990536 - DNA, 20 bp, Homo sapiens
ttatcctgcaagggacagga

SEQ ID NO: 2990537 - DNA, 15 bp, Homo sapiens
ttatcgcatacagat

SEQ ID NO: 2990538 - DNA, 24 bp, Homo sapiens
ttatcggcccatagctaataagta

SEQ ID NO: 2990539 - DNA, 20 bp, Homo sapiens
ttatctacccagtcatgtac

SEQ ID NO: 2990540 - DNA, 19 bp, Homo sapiens
ttatctacctgttctgtag

SEQ ID NO: 2990541 - DNA, 18 bp, Homo sapiens
ttatctatgatgtttctt

SEQ ID NO: 2990542 - DNA, 17 bp, Homo sapiens
ttatctccatactttgg

SEQ ID NO: 2990543 - DNA, 14 bp, Homo sapiens
ttatctccctgctt

SEQ ID NO: 2990544 - DNA, 16 bp, Homo sapiens
ttatctccctgcttca

SEQ ID NO: 2990545 - DNA, 17 bp, Homo sapiens
ttatctccctgcttcat

SEQ ID NO: 2990546 - DNA, 19 bp, Homo sapiens
ttatctcttttatatttgt

SEQ ID NO: 2990547 - DNA, 20 bp, Homo sapiens
ttatctcttttatatttgta

SEQ ID NO: 2990548 - DNA, 23 bp, Homo sapiens
ttatctgggattatggttttgtg

SEQ ID NO: 2990549 - DNA, 18 bp, Homo sapiens
ttatctgtgtttttgaaa

SEQ ID NO: 2990550 - DNA, 15 bp, Homo sapiens
ttatctgttcttttg

SEQ ID NO: 2990551 - DNA, 12 bp, Homo sapiens
ttatctgtttcc

SEQ ID NO: 2990552 - DNA, 15 bp, Homo sapiens
ttatcttaacactga

SEQ ID NO: 2990553 - DNA, 12 bp, Homo sapiens
ttatcttcttaa

SEQ ID NO: 2990554 - DNA, 14 bp, Homo sapiens
ttatcttgagtgtt

SEQ ID NO: 2990555 - DNA, 17 bp, Homo sapiens
ttatcttgagtgttatg

SEQ ID NO: 2990556 - DNA, 22 bp, Homo sapiens
ttatcttgagtgttatgtgaat

SEQ ID NO: 2990557 - DNA, 18 bp, Homo sapiens
ttatcttgttattattgt

SEQ ID NO: 2990558 - DNA, 17 bp, Homo sapiens
ttatctttcgtgataaa

SEQ ID NO: 2990559 - DNA, 21 bp, Homo sapiens
ttatgaagaattgccaatctt

SEQ ID NO: 2990560 - DNA, 15 bp, Homo sapiens
ttatgaagtgctaca

SEQ ID NO: 2990561 - DNA, 23 bp, Homo sapiens
ttatgacacaatgacacatttgt

SEQ ID NO: 2990562 - DNA, 14 bp, Homo sapiens
ttatgaccagagca

SEQ ID NO: 2990563 - DNA, 22 bp, Homo sapiens
ttatgaccagagcaaaaatgta

SEQ ID NO: 2990564 - DNA, 22 bp, Homo sapiens
ttatgagaacatggtgtgtgtc

SEQ ID NO: 2990565 - DNA, 16 bp, Homo sapiens
ttatgagaactggttc

SEQ ID NO: 2990566 - DNA, 21 bp, Homo sapiens
ttatgagaactggttcttgcc

SEQ ID NO: 2990567 - DNA, 19 bp, Homo sapiens
ttatgagggtcctctactt

SEQ ID NO: 2990568 - DNA, 16 bp, Homo sapiens
ttatgagtttgccctc

SEQ ID NO: 2990569 - DNA, 17 bp, Homo sapiens
ttatgataatagattct

SEQ ID NO: 2990570 - DNA, 21 bp, Homo sapiens
ttatgatagtgcaaggaatga

SEQ ID NO: 2990571 - DNA, 17 bp, Homo sapiens
ttatgatgacaatcaaa

SEQ ID NO: 2990572 - DNA, 21 bp, Homo sapiens
ttatgatggaagacaggaaag

SEQ ID NO: 2990573 - DNA, 19 bp, Homo sapiens
ttatgatgggctccccagg

SEQ ID NO: 2990574 - DNA, 21 bp, Homo sapiens
ttatgattcaggcttataaca

SEQ ID NO: 2990575 - DNA, 17 bp, Homo sapiens
ttatgcaattcagtgtt

SEQ ID NO: 2990576 - DNA, 20 bp, Homo sapiens
ttatgcagaagcagagatga

SEQ ID NO: 2990577 - DNA, 19 bp, Homo sapiens
ttatgctctcactgtttgt

SEQ ID NO: 2990578 - DNA, 21 bp, Homo sapiens
ttatggaattgatttgcattg

SEQ ID NO: 2990579 - DNA, 23 bp, Homo sapiens
ttatggaattgatttgcattgaa

SEQ ID NO: 2990580 - DNA, 15 bp, Homo sapiens
ttatgggcccctggc

SEQ ID NO: 2990581 - DNA, 23 bp, Homo sapiens
ttatgggtgggaataaaatttct

SEQ ID NO: 2990582 - DNA, 11 bp, Homo sapiens
ttatggttttg

SEQ ID NO: 2990583 - DNA, 20 bp, Homo sapiens
ttatgtaaaaggccaaacct

SEQ ID NO: 2990584 - DNA, 16 bp, Homo sapiens
ttatgtaaaatgtttt

SEQ ID NO: 2990585 - DNA, 23 bp, Homo sapiens
ttatgtaacatagtccagagaac

SEQ ID NO: 2990586 - DNA, 17 bp, Homo sapiens
ttatgtatcttgatgtt

SEQ ID NO: 2990587 - DNA, 17 bp, Homo sapiens
ttatgtatgtaaataga

SEQ ID NO: 2990588 - DNA, 15 bp, Homo sapiens
ttatgtccactgtgt

SEQ ID NO: 2990589 - DNA, 13 bp, Homo sapiens
ttatgtgagagaa

SEQ ID NO: 2990590 - DNA, 19 bp, Homo sapiens
ttatgtggcttttatttca

SEQ ID NO: 2990591 - DNA, 20 bp, Homo sapiens
ttatgtggttttagattttc

SEQ ID NO: 2990592 - DNA, 15 bp, Homo sapiens
ttatgttcttataga

SEQ ID NO: 2990593 - DNA, 18 bp, Homo sapiens
ttatgttcttatagaata

SEQ ID NO: 2990594 - DNA, 15 bp, Homo sapiens
ttatgttgttagaga

SEQ ID NO: 2990595 - DNA, 15 bp, Homo sapiens
ttatgtttgtacaca

SEQ ID NO: 2990596 - DNA, 22 bp, Homo sapiens
ttatgttttttaaaatatttat

SEQ ID NO: 2990597 - DNA, 20 bp, Homo sapiens
ttattaaaacagaaattaat

SEQ ID NO: 2990598 - DNA, 22 bp, Homo sapiens
ttattaaacgtatgcatgtgaa

SEQ ID NO: 2990599 - DNA, 14 bp, Homo sapiens
ttattaaatcgttt

SEQ ID NO: 2990600 - DNA, 13 bp, Homo sapiens
ttattaaatctga

SEQ ID NO: 2990601 - DNA, 21 bp, Homo sapiens
ttattaaattaattgaatcta

SEQ ID NO: 2990602 - DNA, 17 bp, Homo sapiens
ttattaatgcactttct

SEQ ID NO: 2990603 - DNA, 18 bp, Homo sapiens
ttattaatgcactttcta

SEQ ID NO: 2990604 - DNA, 18 bp, Homo sapiens
ttattacatctttcacat

SEQ ID NO: 2990605 - DNA, 15 bp, Homo sapiens
ttattacatgtaatt

SEQ ID NO: 2990606 - DNA, 19 bp, Homo sapiens
ttattacccaagtcttctc

SEQ ID NO: 2990607 - DNA, 19 bp, Homo sapiens
ttattaccccctccttcag

SEQ ID NO: 2990608 - DNA, 12 bp, Homo sapiens
ttattagatgaa

SEQ ID NO: 2990609 - DNA, 12 bp, Homo sapiens
ttattagatgtt

SEQ ID NO: 2990610 - DNA, 18 bp, Homo sapiens
ttattaggcctcagaaag

SEQ ID NO: 2990611 - DNA, 15 bp, Homo sapiens
ttattagtttacatc

SEQ ID NO: 2990612 - DNA, 23 bp, Homo sapiens
ttattatatatttaacatgtgga

SEQ ID NO: 2990613 - DNA, 14 bp, Homo sapiens
ttattatatttaca

SEQ ID NO: 2990614 - DNA, 17 bp, Homo sapiens
ttattatatttgacatg

SEQ ID NO: 2990615 - DNA, 16 bp, Homo sapiens
ttattattatttttta

SEQ ID NO: 2990616 - DNA, 14 bp, Homo sapiens
ttattatttaactc

SEQ ID NO: 2990617 - DNA, 12 bp, Homo sapiens
ttattatttgta

SEQ ID NO: 2990618 - DNA, 13 bp, Homo sapiens
ttattcaaatgaa

SEQ ID NO: 2990619 - DNA, 13 bp, Homo sapiens
ttattcacaaaac

SEQ ID NO: 2990620 - DNA, 14 bp, Homo sapiens
ttattcacttttgt

SEQ ID NO: 2990621 - DNA, 16 bp, Homo sapiens
ttattcacttttgtaa

SEQ ID NO: 2990622 - DNA, 13 bp, Homo sapiens
ttattcagtgtca

SEQ ID NO: 2990623 - DNA, 14 bp, Homo sapiens
ttattcagtgtcac

SEQ ID NO: 2990624 - DNA, 15 bp, Homo sapiens
ttattccacagatat

SEQ ID NO: 2990625 - DNA, 17 bp, Homo sapiens
ttattccagaatgctgt

SEQ ID NO: 2990626 - DNA, 17 bp, Homo sapiens
ttattccgtattacatt

SEQ ID NO: 2990627 - DNA, 19 bp, Homo sapiens
ttattcctgtatgttgtcc

SEQ ID NO: 2990628 - DNA, 19 bp, Homo sapiens
ttattcgtagatattggac

SEQ ID NO: 2990629 - DNA, 16 bp, Homo sapiens
ttattctacttttaaa

SEQ ID NO: 2990630 - DNA, 13 bp, Homo sapiens
ttattctcataat

SEQ ID NO: 2990631 - DNA, 12 bp, Homo sapiens
ttattctgttcc

SEQ ID NO: 2990632 - DNA, 13 bp, Homo sapiens
ttattctgttccc

SEQ ID NO: 2990633 - DNA, 14 bp, Homo sapiens
ttattcttctagag

SEQ ID NO: 2990634 - DNA, 12 bp, Homo sapiens
ttattcttgtta

SEQ ID NO: 2990635 - DNA, 13 bp, Homo sapiens
ttattcttgttat

SEQ ID NO: 2990636 - DNA, 15 bp, Homo sapiens
ttattcttttccaga

SEQ ID NO: 2990637 - DNA, 16 bp, Homo sapiens
ttattcttttccagaa

SEQ ID NO: 2990638 - DNA, 20 bp, Homo sapiens
ttattgaatctatttaagta

SEQ ID NO: 2990639 - DNA, 19 bp, Homo sapiens
ttattgacacagaaaatgt

SEQ ID NO: 2990640 - DNA, 15 bp, Homo sapiens
ttattgcacattgtt

SEQ ID NO: 2990641 - DNA, 17 bp, Homo sapiens
ttattgcacattgttca

SEQ ID NO: 2990642 - DNA, 22 bp, Homo sapiens
ttattgcagtttatcattcaag

SEQ ID NO: 2990643 - DNA, 12 bp, Homo sapiens
ttattgcatttg

SEQ ID NO: 2990644 - DNA, 21 bp, Homo sapiens
ttattgccattatagcgcctg

SEQ ID NO: 2990645 - DNA, 19 bp, Homo sapiens
ttattgcctgggcagtgcc

SEQ ID NO: 2990646 - DNA, 20 bp, Homo sapiens
ttattgcctgggcagtgccc

SEQ ID NO: 2990647 - DNA, 22 bp, Homo sapiens
ttattgccttctcaccagctgc

SEQ ID NO: 2990648 - DNA, 12 bp, Homo sapiens
ttattgtacttg

SEQ ID NO: 2990649 - DNA, 14 bp, Homo sapiens
ttattgtatattga

SEQ ID NO: 2990650 - DNA, 14 bp, Homo sapiens
ttattgtattttga

SEQ ID NO: 2990651 - DNA, 19 bp, Homo sapiens
ttattgtggataacaaaga

SEQ ID NO: 2990652 - DNA, 23 bp, Homo sapiens
ttattgtggataacaaagatatc

SEQ ID NO: 2990653 - DNA, 19 bp, Homo sapiens
ttattgtgtgcgctgcctg

SEQ ID NO: 2990654 - DNA, 20 bp, Homo sapiens
ttattgtgtgcgctgcctgg

SEQ ID NO: 2990655 - DNA, 19 bp, Homo sapiens
ttcccagagacaggaaaat

SEQ ID NO: 2990656 - DNA, 18 bp, Homo sapiens
ttcccagctctccctctg

SEQ ID NO: 2990657 - DNA, 11 bp, Homo sapiens
ttcccaggacc

SEQ ID NO: 2990658 - DNA, 19 bp, Homo sapiens
ttcccaggaccctgaaggg

SEQ ID NO: 2990659 - DNA, 15 bp, Homo sapiens
ttcccaggccagggc

SEQ ID NO: 2990660 - DNA, 15 bp, Homo sapiens
ttcccagtgggctgt

SEQ ID NO: 2990661 - DNA, 17 bp, Homo sapiens
ttcccatgtagccccct

SEQ ID NO: 2990662 - DNA, 17 bp, Homo sapiens
ttcccatttgtaatttg

SEQ ID NO: 2990663 - DNA, 19 bp, Homo sapiens
ttcccatttgttgctgctg

SEQ ID NO: 2990664 - DNA, 22 bp, Homo sapiens
ttcccatttgttgctgctgctg

SEQ ID NO: 2990665 - DNA, 20 bp, Homo sapiens
ttccccaacagtgtgaagtt

SEQ ID NO: 2990666 - DNA, 23 bp, Homo sapiens
ttccccaacagtgtgaagttaga

SEQ ID NO: 2990667 - DNA, 13 bp, Homo sapiens
ttccccaattaat

SEQ ID NO: 2990668 - DNA, 22 bp, Homo sapiens
ttccccacttctgtgccacccc

SEQ ID NO: 2990669 - DNA, 11 bp, Homo sapiens
ttccccagaga

SEQ ID NO: 2990670 - DNA, 19 bp, Homo sapiens
ttccccagcctctcctcct

SEQ ID NO: 2990671 - DNA, 19 bp, Homo sapiens
ttccccatatttgtgttca

SEQ ID NO: 2990672 - DNA, 12 bp, Homo sapiens
ttccccatgaca

SEQ ID NO: 2990673 - DNA, 14 bp, Homo sapiens
ttcccccactaccg

SEQ ID NO: 2990674 - DNA, 11 bp, Homo sapiens
ttcccccactc

SEQ ID NO: 2990675 - DNA, 19 bp, Homo sapiens
ttcccccaggcgcctgcgc

SEQ ID NO: 2990676 - DNA, 14 bp, Homo sapiens
ttccccctgccctg

SEQ ID NO: 2990677 - DNA, 17 bp, Homo sapiens
ttcccccttcacaaagc

SEQ ID NO: 2990678 - DNA, 12 bp, Homo sapiens
ttcccctcattg

SEQ ID NO: 2990679 - DNA, 18 bp, Homo sapiens
ttcccctcattgcattta

SEQ ID NO: 2990680 - DNA, 21 bp, Homo sapiens
ttcccctcccccactcctcta

SEQ ID NO: 2990681 - DNA, 16 bp, Homo sapiens
ttcccctggggaccca

SEQ ID NO: 2990682 - DNA, 21 bp, Homo sapiens
ttccccttccactgagggcag

SEQ ID NO: 2990683 - DNA, 18 bp, Homo sapiens
ttccccttgaacctcatt

SEQ ID NO: 2990684 - DNA, 22 bp, Homo sapiens
ttcccgaggaactcgcctcagc

SEQ ID NO: 2990685 - DNA, 17 bp, Homo sapiens
ttcccgcctcagcctct

SEQ ID NO: 2990686 - DNA, 20 bp, Homo sapiens
ttcccgcctcagcctctcaa

SEQ ID NO: 2990687 - DNA, 22 bp, Homo sapiens
ttcccggagggaaactgtgaat

SEQ ID NO: 2990688 - DNA, 17 bp, Homo sapiens
ttccctccctctcttcc

SEQ ID NO: 2990689 - DNA, 23 bp, Homo sapiens
ttccctccgggcaggggagccag

SEQ ID NO: 2990690 - DNA, 13 bp, Homo sapiens
ttccctgactcat

SEQ ID NO: 2990691 - DNA, 17 bp, Homo sapiens
ttccctgacttgcttta

SEQ ID NO: 2990692 - DNA, 22 bp, Homo sapiens
ttccctgcccctgtgcctctgt

SEQ ID NO: 2990693 - DNA, 16 bp, Homo sapiens
ttccctgcctccagct

SEQ ID NO: 2990694 - DNA, 12 bp, Homo sapiens
ttccctgttctt

SEQ ID NO: 2990695 - DNA, 15 bp, Homo sapiens
ttcccttcctctgat

SEQ ID NO: 2990696 - DNA, 16 bp, Homo sapiens
ttcccttcctctgatt

SEQ ID NO: 2990697 - DNA, 22 bp, Homo sapiens
ttcccttcttggtttccaaagg

SEQ ID NO: 2990698 - DNA, 12 bp, Homo sapiens
ttcccttgacca

SEQ ID NO: 2990699 - DNA, 13 bp, Homo sapiens
ttcccttgaccat

SEQ ID NO: 2990700 - DNA, 14 bp, Homo sapiens
ttcccttgaccatt

SEQ ID NO: 2990701 - DNA, 21 bp, Homo sapiens
ttcccttttaaacacattttg

SEQ ID NO: 2990702 - DNA, 21 bp, Homo sapiens
ttcccttttacatactgctgt

SEQ ID NO: 2990703 - DNA, 16 bp, Homo sapiens
ttcccttttttttctg

SEQ ID NO: 2990704 - DNA, 20 bp, Homo sapiens
ttccgcactacctgaacatt

SEQ ID NO: 2990705 - DNA, 22 bp, Homo sapiens
ttccggatcctaagcatctaag

SEQ ID NO: 2990706 - DNA, 19 bp, Homo sapiens
ttccgtaggttattttcag

SEQ ID NO: 2990707 - DNA, 21 bp, Homo sapiens
ttccgtcaacgttgtactgta

SEQ ID NO: 2990708 - DNA, 15 bp, Homo sapiens
ttccgtcacccttgg

SEQ ID NO: 2990709 - DNA, 19 bp, Homo sapiens
ttccgtccccccccaggcc

SEQ ID NO: 2990710 - DNA, 14 bp, Homo sapiens
ttccgttgtctgtg

SEQ ID NO: 2990711 - DNA, 17 bp, Homo sapiens
ttccgtttgcttttgtt

SEQ ID NO: 2990712 - DNA, 18 bp, Homo sapiens
ttcctaaatattatgaga

SEQ ID NO: 2990713 - DNA, 11 bp, Homo sapiens
ttcctaactta

SEQ ID NO: 2990714 - DNA, 18 bp, Homo sapiens
ttcctaagacctggggtt

SEQ ID NO: 2990715 - DNA, 15 bp, Homo sapiens
ttcctaataaagttc

SEQ ID NO: 2990716 - DNA, 16 bp, Homo sapiens
ttcctaataaagttct

SEQ ID NO: 2990717 - DNA, 22 bp, Homo sapiens
ttcctaataaagttctgtactc

SEQ ID NO: 2990718 - DNA, 19 bp, Homo sapiens
ttcctacaacttaatggaa

SEQ ID NO: 2990719 - DNA, 14 bp, Homo sapiens
ttcctagccaccgc

SEQ ID NO: 2990720 - DNA, 21 bp, Homo sapiens
ttcctagccaccgcctcctac

SEQ ID NO: 2990721 - DNA, 21 bp, Homo sapiens
ttcctagcttatctccctgct

SEQ ID NO: 2990722 - DNA, 23 bp, Homo sapiens
ttcctaggaaatcacaggcttct

SEQ ID NO: 2990723 - DNA, 21 bp, Homo sapiens
ttcctagttggtgagaaacct

SEQ ID NO: 2990724 - DNA, 22 bp, Homo sapiens
ttcctagttggtgagaaacctg

SEQ ID NO: 2990725 - DNA, 20 bp, Homo sapiens
ttcctatatacctaataccc

SEQ ID NO: 2990726 - DNA, 13 bp, Homo sapiens
ttcctatcacctc

SEQ ID NO: 2990727 - DNA, 14 bp, Homo sapiens
ttcctatgtaactg

SEQ ID NO: 2990728 - DNA, 15 bp, Homo sapiens
ttcctatttcttata

SEQ ID NO: 2990729 - DNA, 22 bp, Homo sapiens
ttcctatttttaaataatttcc

SEQ ID NO: 2990730 - DNA, 16 bp, Homo sapiens
ttcctcaaaaagcaga

SEQ ID NO: 2990731 - DNA, 18 bp, Homo sapiens
ttcctcaagtatcttcta

SEQ ID NO: 2990732 - DNA, 16 bp, Homo sapiens
ttcctcagcttatctc

SEQ ID NO: 2990733 - DNA, 19 bp, Homo sapiens
ttcctcagcttatctcttt

SEQ ID NO: 2990734 - DNA, 18 bp, Homo sapiens
ttcctcaggaattccaat

SEQ ID NO: 2990735 - DNA, 18 bp, Homo sapiens
ttcctcagggtgtcctga

SEQ ID NO: 2990736 - DNA, 22 bp, Homo sapiens
ttcctcatcctcagatgctcaa

SEQ ID NO: 2990737 - DNA, 17 bp, Homo sapiens
ttcctcatcctgcttct

SEQ ID NO: 2990738 - DNA, 19 bp, Homo sapiens
ttcctcatcctgcttctct

SEQ ID NO: 2990739 - DNA, 14 bp, Homo sapiens
ttcctcattaaatt

SEQ ID NO: 2990740 - DNA, 14 bp, Homo sapiens
ttcctcccctcgcc

SEQ ID NO: 2990741 - DNA, 18 bp, Homo sapiens
ttcctcccttctgctact

SEQ ID NO: 2990742 - DNA, 10 bp, Homo sapiens
ttcctcctcc

SEQ ID NO: 2990743 - DNA, 21 bp, Homo sapiens
ttcctcctcccagtgccttct

SEQ ID NO: 2990744 - DNA, 14 bp, Homo sapiens
ttcctcctttctct

SEQ ID NO: 2990745 - DNA, 16 bp, Homo sapiens
ttcctcctttctctgt

SEQ ID NO: 2990746 - DNA, 17 bp, Homo sapiens
ttcctcctttctctgta

SEQ ID NO: 2990747 - DNA, 19 bp, Homo sapiens
ttcctcctttctctgtata

SEQ ID NO: 2990748 - DNA, 10 bp, Homo sapiens
ttcctctccc

SEQ ID NO: 2990749 - DNA, 12 bp, Homo sapiens
ttcctctctgtc

SEQ ID NO: 2990750 - DNA, 15 bp, Homo sapiens
ttcctcttagcctct

SEQ ID NO: 2990751 - DNA, 17 bp, Homo sapiens
ttcctcttagcctctgg

SEQ ID NO: 2990752 - DNA, 22 bp, Homo sapiens
ttcctcttagcctctggatcta

SEQ ID NO: 2990753 - DNA, 14 bp, Homo sapiens
ttcctctttgcttt

SEQ ID NO: 2990754 - DNA, 15 bp, Homo sapiens
ttcctctttgctttg

SEQ ID NO: 2990755 - DNA, 18 bp, Homo sapiens
ttcctgaaacaacttgga

SEQ ID NO: 2990756 - DNA, 22 bp, Homo sapiens
ttcctgaaagttggggcccagt

SEQ ID NO: 2990757 - DNA, 15 bp, Homo sapiens
ttcctgaagaaccag

SEQ ID NO: 2990758 - DNA, 11 bp, Homo sapiens
ttcctgaagct

SEQ ID NO: 2990759 - DNA, 22 bp, Homo sapiens
ttcctgaatctaaaataaaaat

SEQ ID NO: 2990760 - DNA, 18 bp, Homo sapiens
ttcctgacttgagtgttc

SEQ ID NO: 2990761 - DNA, 20 bp, Homo sapiens
ttcctgagaaagcccacctg

SEQ ID NO: 2990762 - DNA, 15 bp, Homo sapiens
ttcctgagcagtccc

SEQ ID NO: 2990763 - DNA, 16 bp, Homo sapiens
ttcctgagcagtccct

SEQ ID NO: 2990764 - DNA, 20 bp, Homo sapiens
ttcctgatatgatttaaaac

SEQ ID NO: 2990765 - DNA, 16 bp, Homo sapiens
ttcctgcccagcctgg

SEQ ID NO: 2990766 - DNA, 16 bp, Homo sapiens
ttcctgccttcagagt

SEQ ID NO: 2990767 - DNA, 21 bp, Homo sapiens
ttcctgccttggcctcccaag

SEQ ID NO: 2990768 - DNA, 19 bp, Homo sapiens
ttcctgctccgtggactgc

SEQ ID NO: 2990769 - DNA, 18 bp, Homo sapiens
ttcctgctctcccactgc

SEQ ID NO: 2990770 - DNA, 14 bp, Homo sapiens
ttcctgctgtcctg

SEQ ID NO: 2990771 - DNA, 17 bp, Homo sapiens
ttcctgctgtcctggtg

SEQ ID NO: 2990772 - DNA, 23 bp, Homo sapiens
ttcctgctgtcctggtggctggg

SEQ ID NO: 2990773 - DNA, 15 bp, Homo sapiens
ttcctggaagcagag

SEQ ID NO: 2990774 - DNA, 22 bp, Homo sapiens
ttcctggaagtcaaataaatgt

SEQ ID NO: 2990775 - DNA, 14 bp, Homo sapiens
ttcctggcttctta

SEQ ID NO: 2990776 - DNA, 18 bp, Homo sapiens
ttcctggctttttaactc

SEQ ID NO: 2990777 - DNA, 21 bp, Homo sapiens
ttcctgggaaatattccctag

SEQ ID NO: 2990778 - DNA, 23 bp, Homo sapiens
ttcctggttctgtctagactggc

SEQ ID NO: 2990779 - DNA, 15 bp, Homo sapiens
ttcctgtaactttta

SEQ ID NO: 2990780 - DNA, 17 bp, Homo sapiens
ttcctgtccagctccaa

SEQ ID NO: 2990781 - DNA, 22 bp, Homo sapiens
ttcctgtccagctccaacctgc

SEQ ID NO: 2990782 - DNA, 18 bp, Homo sapiens
ttcctgtccccatctgtc

SEQ ID NO: 2990783 - DNA, 13 bp, Homo sapiens
ttcctgtctcctt

SEQ ID NO: 2990784 - DNA, 11 bp, Homo sapiens
ttcctgtctga

SEQ ID NO: 2990785 - DNA, 22 bp, Homo sapiens
ttcctgtggctccctctctcct

SEQ ID NO: 2990786 - DNA, 13 bp, Homo sapiens
ttcctgtgtcaat

SEQ ID NO: 2990787 - DNA, 13 bp, Homo sapiens
ttctgcttgagaa

SEQ ID NO: 2990788 - DNA, 17 bp, Homo sapiens
ttctgcttgagaatatt

SEQ ID NO: 2990789 - DNA, 14 bp, Homo sapiens
ttctgcttgtccca

SEQ ID NO: 2990790 - DNA, 20 bp, Homo sapiens
ttctgctttaaattaaaatt

SEQ ID NO: 2990791 - DNA, 21 bp, Homo sapiens
ttctgctttctattacccctc

SEQ ID NO: 2990792 - DNA, 14 bp, Homo sapiens
ttctgcttttaagt

SEQ ID NO: 2990793 - DNA, 16 bp, Homo sapiens
ttctgcttttaagttt

SEQ ID NO: 2990794 - DNA, 21 bp, Homo sapiens
ttctggagcaatctgaccctt

SEQ ID NO: 2990795 - DNA, 20 bp, Homo sapiens
ttctggaggttgataacttt

SEQ ID NO: 2990796 - DNA, 14 bp, Homo sapiens
ttctggccaggaag

SEQ ID NO: 2990797 - DNA, 22 bp, Homo sapiens
ttctggctctcccatttcctga

SEQ ID NO: 2990798 - DNA, 21 bp, Homo sapiens
ttctggctttgttcttgtcat

SEQ ID NO: 2990799 - DNA, 22 bp, Homo sapiens
ttctgggagacacccaaagggt

SEQ ID NO: 2990800 - DNA, 15 bp, Homo sapiens
ttctgggcctgacca

SEQ ID NO: 2990801 - DNA, 23 bp, Homo sapiens
ttctgggggaaaaagccatatca

SEQ ID NO: 2990802 - DNA, 23 bp, Homo sapiens
ttctggggggacccagtgcagaa

SEQ ID NO: 2990803 - DNA, 13 bp, Homo sapiens
ttctgggtgattt

SEQ ID NO: 2990804 - DNA, 16 bp, Homo sapiens
ttctgggtgttgacca

SEQ ID NO: 2990805 - DNA, 22 bp, Homo sapiens
ttctgggtgttgaccactccag

SEQ ID NO: 2990806 - DNA, 19 bp, Homo sapiens
ttctggtcctgttttctaa

SEQ ID NO: 2990807 - DNA, 15 bp, Homo sapiens
ttctgtaagaaacct

SEQ ID NO: 2990808 - DNA, 19 bp, Homo sapiens
ttctgtaagaaacctactg

SEQ ID NO: 2990809 - DNA, 16 bp, Homo sapiens
ttctgtaaggggcagc

SEQ ID NO: 2990810 - DNA, 22 bp, Homo sapiens
ttctgtaaggggcagcagttga

SEQ ID NO: 2990811 - DNA, 17 bp, Homo sapiens
ttctgtagctttctgga

SEQ ID NO: 2990812 - DNA, 13 bp, Homo sapiens
ttctgtatacaac

SEQ ID NO: 2990813 - DNA, 23 bp, Homo sapiens
ttctgtatacaaccctggcatta

SEQ ID NO: 2990814 - DNA, 17 bp, Homo sapiens
ttctgtatataaatggg

SEQ ID NO: 2990815 - DNA, 18 bp, Homo sapiens
ttctgtatataaatggga

SEQ ID NO: 2990816 - DNA, 21 bp, Homo sapiens
ttctgtatataaatgggaaca

SEQ ID NO: 2990817 - DNA, 17 bp, Homo sapiens
ttctgtatatacttttt

SEQ ID NO: 2990818 - DNA, 13 bp, Homo sapiens
ttctgtcactcag

SEQ ID NO: 2990819 - DNA, 14 bp, Homo sapiens
ttctgtcccttctg

SEQ ID NO: 2990820 - DNA, 21 bp, Homo sapiens
ttctgtccttggcaactttct

SEQ ID NO: 2990821 - DNA, 15 bp, Homo sapiens
ttctgtctctctctt

SEQ ID NO: 2990822 - DNA, 22 bp, Homo sapiens
ttctgtgaagccctttgcctgt

SEQ ID NO: 2990823 - DNA, 23 bp, Homo sapiens
ttctgtgaagccctttgcctgta

SEQ ID NO: 2990824 - DNA, 21 bp, Homo sapiens
ttctgtgcagataaacagaaa

SEQ ID NO: 2990825 - DNA, 20 bp, Homo sapiens
ttctgtggaaagtgtaaagc

SEQ ID NO: 2990826 - DNA, 20 bp, Homo sapiens
ttctgtggccgccatctgcg

SEQ ID NO: 2990827 - DNA, 17 bp, Homo sapiens
ttctgtgtaaccatttt

SEQ ID NO: 2990828 - DNA, 18 bp, Homo sapiens
ttctgtgtaagcttttaa

SEQ ID NO: 2990829 - DNA, 21 bp, Homo sapiens
ttctgtgtgtatctaaaggat

SEQ ID NO: 2990830 - DNA, 23 bp, Homo sapiens
ttctgttaactgaagatattcca

SEQ ID NO: 2990831 - DNA, 22 bp, Homo sapiens
ttctgttcatctctttgtcctg

SEQ ID NO: 2990832 - DNA, 23 bp, Homo sapiens
ttctgttcatctctttgtcctga

SEQ ID NO: 2990833 - DNA, 19 bp, Homo sapiens
ttctgttcgaagttcattt

SEQ ID NO: 2990834 - DNA, 11 bp, Homo sapiens
ttctgttctaa

SEQ ID NO: 2990835 - DNA, 13 bp, Homo sapiens
ttctgttctactt

SEQ ID NO: 2990836 - DNA, 16 bp, Homo sapiens
ttctgttctgtggaaa

SEQ ID NO: 2990837 - DNA, 11 bp, Homo sapiens
ttctgtttctt

SEQ ID NO: 2990838 - DNA, 23 bp, Homo sapiens
ttctgttttgtttggcaaggaaa

SEQ ID NO: 2990839 - DNA, 13 bp, Homo sapiens
ttctgtttttaat

SEQ ID NO: 2990840 - DNA, 17 bp, Homo sapiens
ttcttaaaaaattgaaa

SEQ ID NO: 2990841 - DNA, 19 bp, Homo sapiens
ttcttaaagcaaagtcact

SEQ ID NO: 2990842 - DNA, 13 bp, Homo sapiens
ttcttaaatcttt

SEQ ID NO: 2990843 - DNA, 22 bp, Homo sapiens
ttcttaagtatgttattttctg

SEQ ID NO: 2990844 - DNA, 16 bp, Homo sapiens
ttcttaatacaggaga

SEQ ID NO: 2990845 - DNA, 21 bp, Homo sapiens
ttcttacagcacatcacctct

SEQ ID NO: 2990846 - DNA, 13 bp, Homo sapiens
ttcttacatgttt

SEQ ID NO: 2990847 - DNA, 12 bp, Homo sapiens
ttcttaccagtc

SEQ ID NO: 2990848 - DNA, 15 bp, Homo sapiens
ttcttataaatatga

SEQ ID NO: 2990849 - DNA, 13 bp, Homo sapiens
ttcttatagaata

SEQ ID NO: 2990850 - DNA, 13 bp, Homo sapiens
ttcttatagattt

SEQ ID NO: 2990851 - DNA, 11 bp, Homo sapiens
ttcttcagaga

SEQ ID NO: 2990852 - DNA, 18 bp, Homo sapiens
ttcttcagagtttgtcat

SEQ ID NO: 2990853 - DNA, 18 bp, Homo sapiens
ttcttcagtgtaatgtga

SEQ ID NO: 2990854 - DNA, 19 bp, Homo sapiens
ttcttcccatcactggagc

SEQ ID NO: 2990855 - DNA, 17 bp, Homo sapiens
ttcttcccccttcacat

SEQ ID NO: 2990856 - DNA, 22 bp, Homo sapiens
ttcttcccttttaaacacattt

SEQ ID NO: 2990857 - DNA, 21 bp, Homo sapiens
ttcttcccttttacatactgc

SEQ ID NO: 2990858 - DNA, 20 bp, Homo sapiens
ttcttcctccagtctgttct

SEQ ID NO: 2990859 - DNA, 18 bp, Homo sapiens
ttcttcctttcttccttg

SEQ ID NO: 2990860 - DNA, 22 bp, Homo sapiens
ttcttctagaagataacatttt

SEQ ID NO: 2990861 - DNA, 14 bp, Homo sapiens
ttcttctagagttc

SEQ ID NO: 2990862 - DNA, 15 bp, Homo sapiens
ttcttctagagttca

SEQ ID NO: 2990863 - DNA, 21 bp, Homo sapiens
ttcttctgaagtgctgctcca

SEQ ID NO: 2990864 - DNA, 21 bp, Homo sapiens
ttcttctgtgtttataaaata

SEQ ID NO: 2990865 - DNA, 13 bp, Homo sapiens
ttcttcttcctga

SEQ ID NO: 2990866 - DNA, 21 bp, Homo sapiens
ttcttgaatttaataatctgt

SEQ ID NO: 2990867 - DNA, 20 bp, Homo sapiens
ttcttgactgtcttccctct

SEQ ID NO: 2990868 - DNA, 15 bp, Homo sapiens
ttcttgagctgttgt

SEQ ID NO: 2990869 - DNA, 13 bp, Homo sapiens
ttcttgatcttaa

SEQ ID NO: 2990870 - DNA, 16 bp, Homo sapiens
ttcttgatcttaaaga

SEQ ID NO: 2990871 - DNA, 12 bp, Homo sapiens
ttcttgcattga

SEQ ID NO: 2990872 - DNA, 12 bp, Homo sapiens
ttcttgccttcc

SEQ ID NO: 2990873 - DNA, 19 bp, Homo sapiens
ttcttgcttcccgtccccc

SEQ ID NO: 2990874 - DNA, 12 bp, Homo sapiens
ttcttgctttca

SEQ ID NO: 2990875 - DNA, 15 bp, Homo sapiens
ttcttgctttcaatt

SEQ ID NO: 2990876 - DNA, 19 bp, Homo sapiens
ttcttggaactgtcccagc

SEQ ID NO: 2990877 - DNA, 17 bp, Homo sapiens
ttcttggggcccagtgc

SEQ ID NO: 2990878 - DNA, 18 bp, Homo sapiens
ttcttggggcccagtgca

SEQ ID NO: 2990879 - DNA, 19 bp, Homo sapiens
ttcttggggcccagtgcat

SEQ ID NO: 2990880 - DNA, 14 bp, Homo sapiens
ttcttggtaaagtc

SEQ ID NO: 2990881 - DNA, 14 bp, Homo sapiens
ttcttggttattct

SEQ ID NO: 2990882 - DNA, 16 bp, Homo sapiens
ttcttggttgaggaaa

SEQ ID NO: 2990883 - DNA, 22 bp, Homo sapiens
ttcttgtaaatgtgttggacaa

SEQ ID NO: 2990884 - DNA, 11 bp, Homo sapiens
ttcttgtgaag

SEQ ID NO: 2990885 - DNA, 22 bp, Homo sapiens
ttcttgtgccatagtcacatgg

SEQ ID NO: 2990886 - DNA, 13 bp, Homo sapiens
ttcttgtgtctgt

SEQ ID NO: 2990887 - DNA, 13 bp, Homo sapiens
ttcttgtttctta

SEQ ID NO: 2990888 - DNA, 19 bp, Homo sapiens
ttcttgtttcttattaggc

SEQ ID NO: 2990889 - DNA, 13 bp, Homo sapiens
ttcttgtttgtca

SEQ ID NO: 2990890 - DNA, 14 bp, Homo sapiens
ttctttaaaaaaga

SEQ ID NO: 2990891 - DNA, 19 bp, Homo sapiens
ttctttaaaagaatgggca

SEQ ID NO: 2990892 - DNA, 20 bp, Homo sapiens
ttctttaaaatgtaaagcca

SEQ ID NO: 2990893 - DNA, 14 bp, Homo sapiens
ttctttaaagccag

SEQ ID NO: 2990894 - DNA, 13 bp, Homo sapiens
ttctttaaattat

SEQ ID NO: 2990895 - DNA, 15 bp, Homo sapiens
ttctttaaattatgt

SEQ ID NO: 2990896 - DNA, 16 bp, Homo sapiens
ttctttaccttcattt

SEQ ID NO: 2990897 - DNA, 19 bp, Homo sapiens
ttctttagagaactgaaaa

SEQ ID NO: 2990898 - DNA, 21 bp, Homo sapiens
ttctttagagaactgaaaaga

SEQ ID NO: 2990899 - DNA, 18 bp, Homo sapiens
ttctttatacaacagtgc

SEQ ID NO: 2990900 - DNA, 20 bp, Homo sapiens
ttctttatactctcttccct

SEQ ID NO: 2990901 - DNA, 17 bp, Homo sapiens
ttctttatataaggtca

SEQ ID NO: 2990902 - DNA, 16 bp, Homo sapiens
ttctttccaagtcatt

SEQ ID NO: 2990903 - DNA, 22 bp, Homo sapiens
ttctttccagtatggaaggatt

SEQ ID NO: 2990904 - DNA, 13 bp, Homo sapiens
ttctttctagttt

SEQ ID NO: 2990905 - DNA, 13 bp, Homo sapiens
ttctttcttggtg

SEQ ID NO: 2990906 - DNA, 14 bp, Homo sapiens
ttctttcttggtgc

SEQ ID NO: 2990907 - DNA, 18 bp, Homo sapiens
ttctttgatgttaacaca

SEQ ID NO: 2990908 - DNA, 22 bp, Homo sapiens
ttctttgatgttaacacatttt

SEQ ID NO: 2990909 - DNA, 12 bp, Homo sapiens
ttctttgcaata

SEQ ID NO: 2990910 - DNA, 17 bp, Homo sapiens
ttctttgcaatactgct

SEQ ID NO: 2990911 - DNA, 14 bp, Homo sapiens
ttctttgcctgttc

SEQ ID NO: 2990912 - DNA, 17 bp, Homo sapiens
ttctttgcctgttcagt

SEQ ID NO: 2990913 - DNA, 15 bp, Homo sapiens
ttcttttatttgtta

SEQ ID NO: 2990914 - DNA, 17 bp, Homo sapiens
ttcttttcacattctta

SEQ ID NO: 2990915 - DNA, 19 bp, Homo sapiens
ttcttttcacattcttata

SEQ ID NO: 2990916 - DNA, 17 bp, Homo sapiens
ttcttttccagaaagaa

SEQ ID NO: 2990917 - DNA, 12 bp, Homo sapiens
ttcttttgaatt

SEQ ID NO: 2990918 - DNA, 13 bp, Homo sapiens
ttcttttgcaatt

SEQ ID NO: 2990919 - DNA, 13 bp, Homo sapiens
ttcttttggtaaa

SEQ ID NO: 2990920 - DNA, 15 bp, Homo sapiens
ttggcccaggagctc

SEQ ID NO: 2990921 - DNA, 15 bp, Homo sapiens
ttggcccctggaacc

SEQ ID NO: 2990922 - DNA, 12 bp, Homo sapiens
ttggccctgccc

SEQ ID NO: 2990923 - DNA, 17 bp, Homo sapiens
ttggccctgcccctccc

SEQ ID NO: 2990924 - DNA, 17 bp, Homo sapiens
ttggccctttaatattt

SEQ ID NO: 2990925 - DNA, 19 bp, Homo sapiens
ttggccggctgtgctcaga

SEQ ID NO: 2990926 - DNA, 19 bp, Homo sapiens
ttggcctgatcagaccacg

SEQ ID NO: 2990927 - DNA, 21 bp, Homo sapiens
ttggccttcgattttaaatat

SEQ ID NO: 2990928 - DNA, 20 bp, Homo sapiens
ttggccttgcagctggccca

SEQ ID NO: 2990929 - DNA, 13 bp, Homo sapiens
ttggcgctgaggt

SEQ ID NO: 2990930 - DNA, 21 bp, Homo sapiens
ttggcgggggcacgtgtgggc

SEQ ID NO: 2990931 - DNA, 14 bp, Homo sapiens
ttggcgttgtgggc

SEQ ID NO: 2990932 - DNA, 17 bp, Homo sapiens
ttggctaaagtgcattt

SEQ ID NO: 2990933 - DNA, 22 bp, Homo sapiens
ttggctactgactgtattttgt

SEQ ID NO: 2990934 - DNA, 23 bp, Homo sapiens
ttggctagagcttctgtattttc

SEQ ID NO: 2990935 - DNA, 22 bp, Homo sapiens
ttggctctattggatttgtcca

SEQ ID NO: 2990936 - DNA, 14 bp, Homo sapiens
ttggctctgaagaa

SEQ ID NO: 2990937 - DNA, 19 bp, Homo sapiens
ttggctgcgctaaccccca

SEQ ID NO: 2990938 - DNA, 20 bp, Homo sapiens
ttggctgcgctaacccccag

SEQ ID NO: 2990939 - DNA, 18 bp, Homo sapiens
ttggcttgttttattttg

SEQ ID NO: 2990940 - DNA, 22 bp, Homo sapiens
ttgggaccctgctttagagcta

SEQ ID NO: 2990941 - DNA, 22 bp, Homo sapiens
ttgggactgctaaataaaattt

SEQ ID NO: 2990942 - DNA, 21 bp, Homo sapiens
ttgggatgctatttcagccaa

SEQ ID NO: 2990943 - DNA, 21 bp, Homo sapiens
ttgggcagggtctctgctcca

SEQ ID NO: 2990944 - DNA, 12 bp, Homo sapiens
ttgggccctgca

SEQ ID NO: 2990945 - DNA, 11 bp, Homo sapiens
ttgggccctgg

SEQ ID NO: 2990946 - DNA, 13 bp, Homo sapiens
ttgggcctgacct

SEQ ID NO: 2990947 - DNA, 19 bp, Homo sapiens
ttgggcctggccagtcttc

SEQ ID NO: 2990948 - DNA, 23 bp, Homo sapiens
ttggggacaggggcaggaggaag

SEQ ID NO: 2990949 - DNA, 20 bp, Homo sapiens
ttggggacctgatggagagt

SEQ ID NO: 2990950 - DNA, 19 bp, Homo sapiens
ttggggagttaagacctgg

SEQ ID NO: 2990951 - DNA, 16 bp, Homo sapiens
ttggggcaagtcatgt

SEQ ID NO: 2990952 - DNA, 15 bp, Homo sapiens
ttggggcccagtgca

SEQ ID NO: 2990953 - DNA, 18 bp, Homo sapiens
ttgggggacagccttcag

SEQ ID NO: 2990954 - DNA, 22 bp, Homo sapiens
ttggggggaaataccttgagca

SEQ ID NO: 2990955 - DNA, 17 bp, Homo sapiens
ttgggggggctgccttt

SEQ ID NO: 2990956 - DNA, 17 bp, Homo sapiens
ttggggtctggcagcct

SEQ ID NO: 2990957 - DNA, 22 bp, Homo sapiens
ttggggtgcccctctccttctt

SEQ ID NO: 2990958 - DNA, 15 bp, Homo sapiens
ttggggtgggggcca

SEQ ID NO: 2990959 - DNA, 15 bp, Homo sapiens
ttggggttgtgttgt

SEQ ID NO: 2990960 - DNA, 16 bp, Homo sapiens
ttggggttgtgttgtc

SEQ ID NO: 2990961 - DNA, 22 bp, Homo sapiens
ttggggtttgatttgcttttga

SEQ ID NO: 2990962 - DNA, 19 bp, Homo sapiens
ttgggtcacccctccagga

SEQ ID NO: 2990963 - DNA, 23 bp, Homo sapiens
ttgggtcagagaaaatgagaaag

SEQ ID NO: 2990964 - DNA, 16 bp, Homo sapiens
ttgggtggagaagcca

SEQ ID NO: 2990965 - DNA, 19 bp, Homo sapiens
ttgggtggagaagccattg

SEQ ID NO: 2990966 - DNA, 22 bp, Homo sapiens
ttgggtggggggcttcatacac

SEQ ID NO: 2990967 - DNA, 23 bp, Homo sapiens
ttggtaaatttccccaacagtgt

SEQ ID NO: 2990968 - DNA, 15 bp, Homo sapiens
ttggtaagagttaaa

SEQ ID NO: 2990969 - DNA, 15 bp, Homo sapiens
ttggtacaaaaataa

SEQ ID NO: 2990970 - DNA, 12 bp, Homo sapiens
ttggtagagttt

SEQ ID NO: 2990971 - DNA, 16 bp, Homo sapiens
ttggtagatcttcaat

SEQ ID NO: 2990972 - DNA, 13 bp, Homo sapiens
ttggtaggtaaat

SEQ ID NO: 2990973 - DNA, 13 bp, Homo sapiens
ttggtagtttctg

SEQ ID NO: 2990974 - DNA, 15 bp, Homo sapiens
ttggtatgtgccagg

SEQ ID NO: 2990975 - DNA, 14 bp, Homo sapiens
ttggtccaaaaaaa

SEQ ID NO: 2990976 - DNA, 17 bp, Homo sapiens
ttggtcttactttgtgc

SEQ ID NO: 2990977 - DNA, 18 bp, Homo sapiens
ttggtcttactttgtgca

SEQ ID NO: 2990978 - DNA, 19 bp, Homo sapiens
ttggtcttaggtcttcctg

SEQ ID NO: 2990979 - DNA, 19 bp, Homo sapiens
ttggtgatggaaaaagcgc

SEQ ID NO: 2990980 - DNA, 12 bp, Homo sapiens
ttggtgcctggc

SEQ ID NO: 2990981 - DNA, 22 bp, Homo sapiens
ttggtgcctggcctggcacaca

SEQ ID NO: 2990982 - DNA, 18 bp, Homo sapiens
ttggtgctgctcatactg

SEQ ID NO: 2990983 - DNA, 21 bp, Homo sapiens
ttggtgggcgtgcccctgaag

SEQ ID NO: 2990984 - DNA, 20 bp, Homo sapiens
ttggtggtagccatcaagca

SEQ ID NO: 2990985 - DNA, 21 bp, Homo sapiens
ttggtggtctgagctgtccca

SEQ ID NO: 2990986 - DNA, 12 bp, Homo sapiens
ttggtggttttt

SEQ ID NO: 2990987 - DNA, 16 bp, Homo sapiens
ttggttaatcagtgtt

SEQ ID NO: 2990988 - DNA, 23 bp, Homo sapiens
ttggttatgatggaaaggaagaa

SEQ ID NO: 2990989 - DNA, 20 bp, Homo sapiens
ttggttcagacacctgttca

SEQ ID NO: 2990990 - DNA, 13 bp, Homo sapiens
ttggttctaagga

SEQ ID NO: 2990991 - DNA, 13 bp, Homo sapiens
ttggttgtttctc

SEQ ID NO: 2990992 - DNA, 18 bp, Homo sapiens
ttggtttttaaaacccag

SEQ ID NO: 2990993 - DNA, 14 bp, Homo sapiens
ttgtaaaaatatac

SEQ ID NO: 2990994 - DNA, 18 bp, Homo sapiens
ttgtaaaacaaaatttga

SEQ ID NO: 2990995 - DNA, 14 bp, Homo sapiens
ttgtaaaagatgca

SEQ ID NO: 2990996 - DNA, 20 bp, Homo sapiens
ttgtaaacacagtgtggtta

SEQ ID NO: 2990997 - DNA, 20 bp, Homo sapiens
ttgtaaataaagtctatttt

SEQ ID NO: 2990998 - DNA, 18 bp, Homo sapiens
ttgtaaataggattttta

SEQ ID NO: 2990999 - DNA, 13 bp, Homo sapiens
ttgtaaatgtact

SEQ ID NO: 2991000 - DNA, 22 bp, Homo sapiens
ttgtaaatgtactggtaattgt

SEQ ID NO: 2991001 - DNA, 22 bp, Homo sapiens
ttgtaaatgtgttggacaaatg

SEQ ID NO: 2991002 - DNA, 14 bp, Homo sapiens
ttgtaaattatatt

SEQ ID NO: 2991003 - DNA, 14 bp, Homo sapiens
ttgtaactccacca

SEQ ID NO: 2991004 - DNA, 14 bp, Homo sapiens
ttgtaaggctttga

SEQ ID NO: 2991005 - DNA, 16 bp, Homo sapiens
ttgtaagtgagtgtgc

SEQ ID NO: 2991006 - DNA, 19 bp, Homo sapiens
ttgtaagtgagtgtgctgc

SEQ ID NO: 2991007 - DNA, 22 bp, Homo sapiens
ttgtaatatttcttcaagtgag

SEQ ID NO: 2991008 - DNA, 18 bp, Homo sapiens
ttgtaatgaattcctaga

SEQ ID NO: 2991009 - DNA, 13 bp, Homo sapiens
ttgtaattgtgta

SEQ ID NO: 2991010 - DNA, 14 bp, Homo sapiens
ttgtaattgtgtaa

SEQ ID NO: 2991011 - DNA, 13 bp, Homo sapiens
ttgtaattttgaa

SEQ ID NO: 2991012 - DNA, 16 bp, Homo sapiens
ttgtacagagaagaag

SEQ ID NO: 2991013 - DNA, 22 bp, Homo sapiens
ttgtacattttggatttcttta

SEQ ID NO: 2991014 - DNA, 23 bp, Homo sapiens
ttgtacatttttaaattcttact

SEQ ID NO: 2991015 - DNA, 21 bp, Homo sapiens
ttgtaccacagtttcttctgt

SEQ ID NO: 2991016 - DNA, 12 bp, Homo sapiens
ttgtaccagtga

SEQ ID NO: 2991017 - DNA, 23 bp, Homo sapiens
ttgtactaaagccaaacatatat

SEQ ID NO: 2991018 - DNA, 16 bp, Homo sapiens
ttgtactaagccagga

SEQ ID NO: 2991019 - DNA, 13 bp, Homo sapiens
ttgtactccagcc

SEQ ID NO: 2991020 - DNA, 18 bp, Homo sapiens
ttgtagctttcctggaag

SEQ ID NO: 2991021 - DNA, 19 bp, Homo sapiens
ttgtagctttcctggaagt

SEQ ID NO: 2991022 - DNA, 15 bp, Homo sapiens
ttgtaggagacttgc

SEQ ID NO: 2991023 - DNA, 16 bp, Homo sapiens
ttgtaggttattttat

SEQ ID NO: 2991024 - DNA, 15 bp, Homo sapiens
ttgtagtcagttttg

SEQ ID NO: 2991025 - DNA, 14 bp, Homo sapiens
ttgtagtcttgtct

SEQ ID NO: 2991026 - DNA, 12 bp, Homo sapiens
ttgtagtgttct

SEQ ID NO: 2991027 - DNA, 17 bp, Homo sapiens
ttgtagttactcaagca

SEQ ID NO: 2991028 - DNA, 21 bp, Homo sapiens
ttgtataaatgacaaagtgtt

SEQ ID NO: 2991029 - DNA, 22 bp, Homo sapiens
ttgtataaatgacaaagtgttg

SEQ ID NO: 2991030 - DNA, 15 bp, Homo sapiens
ttgtataacaggtta

SEQ ID NO: 2991031 - DNA, 15 bp, Homo sapiens
ttgtataacatcact

SEQ ID NO: 2991032 - DNA, 16 bp, Homo sapiens
ttgtatattgattata

SEQ ID NO: 2991033 - DNA, 14 bp, Homo sapiens
ttgtatattgtatt

SEQ ID NO: 2991034 - DNA, 19 bp, Homo sapiens
ttgtatattgtgtttgtgt

SEQ ID NO: 2991035 - DNA, 20 bp, Homo sapiens
ttgtatcgtatagctgtatt

SEQ ID NO: 2991036 - DNA, 22 bp, Homo sapiens
ttgtatcgtatagctgtattga

SEQ ID NO: 2991037 - DNA, 15 bp, Homo sapiens
ttgtatgaagtactt

SEQ ID NO: 2991038 - DNA, 19 bp, Homo sapiens
ttgtatgaagtacttttaa

SEQ ID NO: 2991039 - DNA, 17 bp, Homo sapiens
ttgtattcatgttcatg

SEQ ID NO: 2991040 - DNA, 15 bp, Homo sapiens
ttgtattctctgagc

SEQ ID NO: 2991041 - DNA, 20 bp, Homo sapiens
ttgtattctctgagctgtgc

SEQ ID NO: 2991042 - DNA, 22 bp, Homo sapiens
ttgtattctctgagctgtgcag

SEQ ID NO: 2991043 - DNA, 14 bp, Homo sapiens
ttgtatttatgtat

SEQ ID NO: 2991044 - DNA, 23 bp, Homo sapiens
ttgtattttccaagtgtgcatat

SEQ ID NO: 2991045 - DNA, 22 bp, Homo sapiens
ttgtcaaactgtagaaatgatg

SEQ ID NO: 2991046 - DNA, 13 bp, Homo sapiens
ttgtcaacattgt

SEQ ID NO: 2991047 - DNA, 17 bp, Homo sapiens
ttgtcacaaactgtggt

SEQ ID NO: 2991048 - DNA, 17 bp, Homo sapiens
ttgtcactgcttttggc

SEQ ID NO: 2991049 - DNA, 12 bp, Homo sapiens
ttgtcagcatct

SEQ ID NO: 2991050 - DNA, 16 bp, Homo sapiens
ttgtcagcatctgacc

SEQ ID NO: 2991051 - DNA, 21 bp, Homo sapiens
ttgtcagcatctgaccatctg

SEQ ID NO: 2991052 - DNA, 23 bp, Homo sapiens
ttgtttgtcagcatctgaccatc

SEQ ID NO: 2991053 - DNA, 13 bp, Homo sapiens
ttgtttgtttttg

SEQ ID NO: 2991054 - DNA, 14 bp, Homo sapiens
ttgttttaaaactg

SEQ ID NO: 2991055 - DNA, 18 bp, Homo sapiens
ttgttttaaaattaaagc

SEQ ID NO: 2991056 - DNA, 14 bp, Homo sapiens
ttgttttgaaacta

SEQ ID NO: 2991057 - DNA, 20 bp, Homo sapiens
ttgttttgcacactttgcca

SEQ ID NO: 2991058 - DNA, 13 bp, Homo sapiens
ttgttttgccagt

SEQ ID NO: 2991059 - DNA, 13 bp, Homo sapiens
ttgttttgtattg

SEQ ID NO: 2991060 - DNA, 19 bp, Homo sapiens
ttgtttttaaaaagcaaat

SEQ ID NO: 2991061 - DNA, 18 bp, Homo sapiens
ttgtttttgagttttctt

SEQ ID NO: 2991062 - DNA, 16 bp, Homo sapiens
ttgtttttgctttctg

SEQ ID NO: 2991063 - DNA, 17 bp, Homo sapiens
ttgtttttggaaagaaa

SEQ ID NO: 2991064 - DNA, 18 bp, Homo sapiens
ttgtttttggaaagaaat

SEQ ID NO: 2991065 - DNA, 19 bp, Homo sapiens
ttgttttttcatagtgcct

SEQ ID NO: 2991066 - DNA, 23 bp, Homo sapiens
ttgtttttttaaatcgccttgaa

SEQ ID NO: 2991067 - DNA, 16 bp, Homo sapiens
tttaaaaaaaatgtga

SEQ ID NO: 2991068 - DNA, 18 bp, Homo sapiens
tttaaaaaaacaaataaa

SEQ ID NO: 2991069 - DNA, 18 bp, Homo sapiens
tttaaaaaaattccaagt

SEQ ID NO: 2991070 - DNA, 22 bp, Homo sapiens
tttaaaaaagaaattatcttta

SEQ ID NO: 2991071 - DNA, 16 bp, Homo sapiens
tttaaaaaatattttc

SEQ ID NO: 2991072 - DNA, 16 bp, Homo sapiens
tttaaaaagaaaaaaa

SEQ ID NO: 2991073 - DNA, 23 bp, Homo sapiens
tttaaaaagaaaatcagttgatt

SEQ ID NO: 2991074 - DNA, 21 bp, Homo sapiens
tttaaaaagaaacaagatgct

SEQ ID NO: 2991075 - DNA, 13 bp, Homo sapiens
tttaaaaagattt

SEQ ID NO: 2991076 - DNA, 14 bp, Homo sapiens
tttaaaaagcaaat

SEQ ID NO: 2991077 - DNA, 20 bp, Homo sapiens
tttaaaaaggaactgcagca

SEQ ID NO: 2991078 - DNA, 21 bp, Homo sapiens
tttaaaaatacaattattgta

SEQ ID NO: 2991079 - DNA, 16 bp, Homo sapiens
tttaaaaatagaaaca

SEQ ID NO: 2991080 - DNA, 17 bp, Homo sapiens
tttaaaaatagacactc

SEQ ID NO: 2991081 - DNA, 12 bp, Homo sapiens
tttaaaaatatt

SEQ ID NO: 2991082 - DNA, 16 bp, Homo sapiens
tttaaaaatcaacttt

SEQ ID NO: 2991083 - DNA, 11 bp, Homo sapiens
tttaaaaatga

SEQ ID NO: 2991084 - DNA, 12 bp, Homo sapiens
tttaaaaatgca

SEQ ID NO: 2991085 - DNA, 17 bp, Homo sapiens
tttaaaaatgtcttgct

SEQ ID NO: 2991086 - DNA, 13 bp, Homo sapiens
tttaaaacacatg

SEQ ID NO: 2991087 - DNA, 14 bp, Homo sapiens
tttaaaacatgtaa

SEQ ID NO: 2991088 - DNA, 23 bp, Homo sapiens
tttaaaaccactatgcaaagaac

SEQ ID NO: 2991089 - DNA, 17 bp, Homo sapiens
tttaaaagaatgggcag

SEQ ID NO: 2991090 - DNA, 16 bp, Homo sapiens
tttaaaagattcattt

SEQ ID NO: 2991091 - DNA, 16 bp, Homo sapiens
tttaaaatatttatct

SEQ ID NO: 2991092 - DNA, 16 bp, Homo sapiens
tttaaaatcttgcatg

SEQ ID NO: 2991093 - DNA, 23 bp, Homo sapiens
tttaaaatcttgcatggcattaa

SEQ ID NO: 2991094 - DNA, 18 bp, Homo sapiens
tttaaaatgtaaagccat

SEQ ID NO: 2991095 - DNA, 16 bp, Homo sapiens
tttaaaattacaacta

SEQ ID NO: 2991096 - DNA, 14 bp, Homo sapiens
tttaaaattctctt

SEQ ID NO: 2991097 - DNA, 17 bp, Homo sapiens
tttaaacaaatgagtat

SEQ ID NO: 2991098 - DNA, 22 bp, Homo sapiens
tttaaacactcttcagagaaat

SEQ ID NO: 2991099 - DNA, 20 bp, Homo sapiens
tttaaacagatattccctct

SEQ ID NO: 2991100 - DNA, 17 bp, Homo sapiens
tttaaacccattttagt

SEQ ID NO: 2991101 - DNA, 16 bp, Homo sapiens
tttaaactacaggtag

SEQ ID NO: 2991102 - DNA, 19 bp, Homo sapiens
tttaaactagatgacctca

SEQ ID NO: 2991103 - DNA, 13 bp, Homo sapiens
tttaaactctttt

SEQ ID NO: 2991104 - DNA, 16 bp, Homo sapiens
tttaaactctttttgg

SEQ ID NO: 2991105 - DNA, 15 bp, Homo sapiens
tttaaactgattcat

SEQ ID NO: 2991106 - DNA, 11 bp, Homo sapiens
tttaaagaaaa

SEQ ID NO: 2991107 - DNA, 13 bp, Homo sapiens
tttaaagaagtct

SEQ ID NO: 2991108 - DNA, 15 bp, Homo sapiens
tttaaagagtctaga

SEQ ID NO: 2991109 - DNA, 18 bp, Homo sapiens
tttaaagagtctagattc

SEQ ID NO: 2991110 - DNA, 17 bp, Homo sapiens
tttaaagccagtcatca

SEQ ID NO: 2991111 - DNA, 14 bp, Homo sapiens
tttaaagctttgaa

SEQ ID NO: 2991112 - DNA, 15 bp, Homo sapiens
tttaaagctttgaat

SEQ ID NO: 2991113 - DNA, 17 bp, Homo sapiens
tttaaaggacaaacagt

SEQ ID NO: 2991114 - DNA, 19 bp, Homo sapiens
tttaaagtaaatctctttt

SEQ ID NO: 2991115 - DNA, 15 bp, Homo sapiens
tttaaagtactgagc

SEQ ID NO: 2991116 - DNA, 17 bp, Homo sapiens
tttaaagttgtttgtgc

SEQ ID NO: 2991117 - DNA, 19 bp, Homo sapiens
tttaaataaattatgaata

SEQ ID NO: 2991118 - DNA, 20 bp, Homo sapiens
tttaaatactccctttttga

SEQ ID NO: 2991119 - DNA, 17 bp, Homo sapiens
tttaaatattttctatt

SEQ ID NO: 2991120 - DNA, 19 bp, Homo sapiens
tttaaatattttctatttt

SEQ ID NO: 2991121 - DNA, 17 bp, Homo sapiens
tttaaatgaaaggagtt

SEQ ID NO: 2991122 - DNA, 17 bp, Homo sapiens
tttaaatgcttttaaat

SEQ ID NO: 2991123 - DNA, 20 bp, Homo sapiens
tttaaatgtacagtttgggg

SEQ ID NO: 2991124 - DNA, 22 bp, Homo sapiens
tttaaatgtacttatattaaga

SEQ ID NO: 2991125 - DNA, 11 bp, Homo sapiens
tttaaatgtga

SEQ ID NO: 2991126 - DNA, 16 bp, Homo sapiens
tttaaatgtgaatttt

SEQ ID NO: 2991127 - DNA, 17 bp, Homo sapiens
tttaaatgtgaattttt

SEQ ID NO: 2991128 - DNA, 13 bp, Homo sapiens
tttaaatgtttac

SEQ ID NO: 2991129 - DNA, 14 bp, Homo sapiens
tttaaatgtttact

SEQ ID NO: 2991130 - DNA, 15 bp, Homo sapiens
tttaaatgtttacta

SEQ ID NO: 2991131 - DNA, 19 bp, Homo sapiens
tttaaattaaaattttatg

SEQ ID NO: 2991132 - DNA, 22 bp, Homo sapiens
tttaaattatgtttttattaag

SEQ ID NO: 2991133 - DNA, 15 bp, Homo sapiens
tttaaattattatct

SEQ ID NO: 2991134 - DNA, 22 bp, Homo sapiens
tttaaattttaccctttagact

SEQ ID NO: 2991135 - DNA, 22 bp, Homo sapiens
tttaaattttctccagtccctg

SEQ ID NO: 2991136 - DNA, 16 bp, Homo sapiens
tttaaattttcttttt

SEQ ID NO: 2991137 - DNA, 15 bp, Homo sapiens
tttaaattttgtaat

SEQ ID NO: 2991138 - DNA, 17 bp, Homo sapiens
tttaacacctgatgtgt

SEQ ID NO: 2991139 - DNA, 21 bp, Homo sapiens
tttaacacctgatgtgtacat

SEQ ID NO: 2991140 - DNA, 20 bp, Homo sapiens
tttaacaggttttcttctaa

SEQ ID NO: 2991141 - DNA, 21 bp, Homo sapiens
tttaacatcagaactgaaata

SEQ ID NO: 2991142 - DNA, 18 bp, Homo sapiens
tttaaccctaatctttca

SEQ ID NO: 2991143 - DNA, 16 bp, Homo sapiens
tttaaccgtttttcaa

SEQ ID NO: 2991144 - DNA, 19 bp, Homo sapiens
tttaaccgtttttcaagaa

SEQ ID NO: 2991145 - DNA, 19 bp, Homo sapiens
tttaacgtatgtatttcat

SEQ ID NO: 2991146 - DNA, 21 bp, Homo sapiens
tttaacgtgggattcagagaa

SEQ ID NO: 2991147 - DNA, 18 bp, Homo sapiens
tttaactcccctgtttca

SEQ ID NO: 2991148 - DNA, 12 bp, Homo sapiens
tttaactctgtc

SEQ ID NO: 2991149 - DNA, 13 bp, Homo sapiens
tttaactctgtct

SEQ ID NO: 2991150 - DNA, 14 bp, Homo sapiens
tttaactctgtctt

SEQ ID NO: 2991151 - DNA, 12 bp, Homo sapiens
tttaactcttaa

SEQ ID NO: 2991152 - DNA, 21 bp, Homo sapiens
tttaactgattcttatgatta

SEQ ID NO: 2991153 - DNA, 23 bp, Homo sapiens
tttaacttatttatatgaagcaa

SEQ ID NO: 2991154 - DNA, 16 bp, Homo sapiens
tttaactttaaaactg

SEQ ID NO: 2991155 - DNA, 23 bp, Homo sapiens
tttaagaaccttattttgataaa

SEQ ID NO: 2991156 - DNA, 19 bp, Homo sapiens
tttaagacgtgtttgtgtt

SEQ ID NO: 2991157 - DNA, 22 bp, Homo sapiens
tttaagactagtcccttggata

SEQ ID NO: 2991158 - DNA, 23 bp, Homo sapiens
tttaagactagtcccttggataa

SEQ ID NO: 2991159 - DNA, 23 bp, Homo sapiens
tttaagactctcgcatcttccca

SEQ ID NO: 2991160 - DNA, 19 bp, Homo sapiens
tttaagcaaatgcattcta

SEQ ID NO: 2991161 - DNA, 17 bp, Homo sapiens
tttaagcaacatctttt

SEQ ID NO: 2991162 - DNA, 17 bp, Homo sapiens
tttaagcagctctaaaa

SEQ ID NO: 2991163 - DNA, 17 bp, Homo sapiens
tttaagcctgcattctt

SEQ ID NO: 2991164 - DNA, 21 bp, Homo sapiens
tttaagcctgcattcttaaca

SEQ ID NO: 2991165 - DNA, 18 bp, Homo sapiens
tttaagctccagacatac

SEQ ID NO: 2991166 - DNA, 17 bp, Homo sapiens
tttaagctccagcttta

SEQ ID NO: 2991167 - DNA, 13 bp, Homo sapiens
tttaagcttcatt

SEQ ID NO: 2991168 - DNA, 23 bp, Homo sapiens
tttaaggaaaaaagatttttaaa

SEQ ID NO: 2991169 - DNA, 14 bp, Homo sapiens
tttaaggaaaacta

SEQ ID NO: 2991170 - DNA, 19 bp, Homo sapiens
tttaaggaatcaaatctta

SEQ ID NO: 2991171 - DNA, 16 bp, Homo sapiens
tttaagggttgtgagc

SEQ ID NO: 2991172 - DNA, 12 bp, Homo sapiens
tttaaggtgcta

SEQ ID NO: 2991173 - DNA, 16 bp, Homo sapiens
tttaaggttgaaaaga

SEQ ID NO: 2991174 - DNA, 17 bp, Homo sapiens
tttaagttaatagattt

SEQ ID NO: 2991175 - DNA, 23 bp, Homo sapiens
tttaagttcactttttttgttct

SEQ ID NO: 2991176 - DNA, 15 bp, Homo sapiens
tttaagttcctgctg

SEQ ID NO: 2991177 - DNA, 20 bp, Homo sapiens
tttaagttggctagagcttc

SEQ ID NO: 2991178 - DNA, 21 bp, Homo sapiens
tttaagttgtttgcatgtgaa

SEQ ID NO: 2991179 - DNA, 14 bp, Homo sapiens
tttaagttttattt

SEQ ID NO: 2991180 - DNA, 16 bp, Homo sapiens
tttaagttttatttaa

SEQ ID NO: 2991181 - DNA, 20 bp, Homo sapiens
tttaagttttatttaacttt

SEQ ID NO: 2991182 - DNA, 21 bp, Homo sapiens
tttaataaatgacaaatgtat

SEQ ID NO: 2991183 - DNA, 19 bp, Homo sapiens
tttaataacatatctaaag

SEQ ID NO: 2991184 - DNA, 19 bp, Homo sapiens
tttctctgagctttgttac

SEQ ID NO: 2991185 - DNA, 22 bp, Homo sapiens
tttctcttctgtccatcagtgc

SEQ ID NO: 2991186 - DNA, 15 bp, Homo sapiens
tttctcttctgttct

SEQ ID NO: 2991187 - DNA, 14 bp, Homo sapiens
tttctcttgtcctt

SEQ ID NO: 2991188 - DNA, 18 bp, Homo sapiens
tttctcttgtcttaaaat

SEQ ID NO: 2991189 - DNA, 14 bp, Homo sapiens
tttctcttgtttaa

SEQ ID NO: 2991190 - DNA, 15 bp, Homo sapiens
tttctcttgtttaaa

SEQ ID NO: 2991191 - DNA, 15 bp, Homo sapiens
tttctctttaaaaga

SEQ ID NO: 2991192 - DNA, 14 bp, Homo sapiens
tttctgaaaagaaa

SEQ ID NO: 2991193 - DNA, 20 bp, Homo sapiens
tttctgaaactcccttgtgt

SEQ ID NO: 2991194 - DNA, 21 bp, Homo sapiens
tttctgaaactcccttgtgtt

SEQ ID NO: 2991195 - DNA, 22 bp, Homo sapiens
tttctgaaagtattcacatcat

SEQ ID NO: 2991196 - DNA, 23 bp, Homo sapiens
tttctgaaagtattcacatcatt

SEQ ID NO: 2991197 - DNA, 16 bp, Homo sapiens
tttctgagcaaagcat

SEQ ID NO: 2991198 - DNA, 16 bp, Homo sapiens
tttctgaggagaaaca

SEQ ID NO: 2991199 - DNA, 16 bp, Homo sapiens
tttctgataagacatg

SEQ ID NO: 2991200 - DNA, 17 bp, Homo sapiens
tttctgatcaaggcctt

SEQ ID NO: 2991201 - DNA, 14 bp, Homo sapiens
tttctgcagaaaca

SEQ ID NO: 2991202 - DNA, 17 bp, Homo sapiens
tttctgcatatgttgaa

SEQ ID NO: 2991203 - DNA, 21 bp, Homo sapiens
tttctgcccggctacatcagc

SEQ ID NO: 2991204 - DNA, 16 bp, Homo sapiens
tttctgcctataaatt

SEQ ID NO: 2991205 - DNA, 19 bp, Homo sapiens
tttctgctggaaacagact

SEQ ID NO: 2991206 - DNA, 21 bp, Homo sapiens
tttctggaggttgataacttt

SEQ ID NO: 2991207 - DNA, 22 bp, Homo sapiens
tttctggaggttgataactttg

SEQ ID NO: 2991208 - DNA, 23 bp, Homo sapiens
tttctggattccccatctcaggc

SEQ ID NO: 2991209 - DNA, 21 bp, Homo sapiens
tttctggggaaagacactgcc

SEQ ID NO: 2991210 - DNA, 15 bp, Homo sapiens
tttctgggtagaagc

SEQ ID NO: 2991211 - DNA, 20 bp, Homo sapiens
tttctgggtgaaagagtcac

SEQ ID NO: 2991212 - DNA, 15 bp, Homo sapiens
tttctgtaaatgaag

SEQ ID NO: 2991213 - DNA, 15 bp, Homo sapiens
tttctgtcccttctg

SEQ ID NO: 2991214 - DNA, 12 bp, Homo sapiens
tttctgtgaata

SEQ ID NO: 2991215 - DNA, 12 bp, Homo sapiens
tttctgttcatc

SEQ ID NO: 2991216 - DNA, 14 bp, Homo sapiens
tttctgttcatctc

SEQ ID NO: 2991217 - DNA, 11 bp, Homo sapiens
tttctgttctg

SEQ ID NO: 2991218 - DNA, 14 bp, Homo sapiens
tttctgttctgccc

SEQ ID NO: 2991219 - DNA, 16 bp, Homo sapiens
tttctgttctgtggaa

SEQ ID NO: 2991220 - DNA, 17 bp, Homo sapiens
tttctgttctgtggaaa

SEQ ID NO: 2991221 - DNA, 22 bp, Homo sapiens
tttctgttctgtggaaagtgta

SEQ ID NO: 2991222 - DNA, 18 bp, Homo sapiens
tttctgtttttatgtttt

SEQ ID NO: 2991223 - DNA, 22 bp, Homo sapiens
tttcttaaatctttcttcaaat

SEQ ID NO: 2991224 - DNA, 18 bp, Homo sapiens
tttcttaaatttttcaac

SEQ ID NO: 2991225 - DNA, 17 bp, Homo sapiens
tttcttaccagtctcct

SEQ ID NO: 2991226 - DNA, 17 bp, Homo sapiens
tttcttatccaactttt

SEQ ID NO: 2991227 - DNA, 15 bp, Homo sapiens
tttcttattctctgt

SEQ ID NO: 2991228 - DNA, 15 bp, Homo sapiens
tttcttattctgtat

SEQ ID NO: 2991229 - DNA, 19 bp, Homo sapiens
tttcttcaagtgagtggca

SEQ ID NO: 2991230 - DNA, 23 bp, Homo sapiens
tttcttcaagtgagtggcatgtg

SEQ ID NO: 2991231 - DNA, 19 bp, Homo sapiens
tttcttcagctgccagtgt

SEQ ID NO: 2991232 - DNA, 16 bp, Homo sapiens
tttcttcagggctgct

SEQ ID NO: 2991233 - DNA, 20 bp, Homo sapiens
tttcttcatgcctgatgaaa

SEQ ID NO: 2991234 - DNA, 14 bp, Homo sapiens
tttcttcccatcac

SEQ ID NO: 2991235 - DNA, 15 bp, Homo sapiens
tttcttcctccagtc

SEQ ID NO: 2991236 - DNA, 22 bp, Homo sapiens
tttcttcctccagtctgttctc

SEQ ID NO: 2991237 - DNA, 12 bp, Homo sapiens
tttcttcctggc

SEQ ID NO: 2991238 - DNA, 13 bp, Homo sapiens
tttcttcttcatg

SEQ ID NO: 2991239 - DNA, 15 bp, Homo sapiens
tttcttgatcttaaa

SEQ ID NO: 2991240 - DNA, 14 bp, Homo sapiens
tttcttgtttctta

SEQ ID NO: 2991241 - DNA, 14 bp, Homo sapiens
tttcttgtttgtca

SEQ ID NO: 2991242 - DNA, 18 bp, Homo sapiens
tttcttgtttgtcagcat

SEQ ID NO: 2991243 - DNA, 15 bp, Homo sapiens
tttctttaaaaaaca

SEQ ID NO: 2991244 - DNA, 15 bp, Homo sapiens
tttctttaaaaaaga

SEQ ID NO: 2991245 - DNA, 19 bp, Homo sapiens
tttctttaaagccagtcat

SEQ ID NO: 2991246 - DNA, 17 bp, Homo sapiens
tttctttaaatcagtat

SEQ ID NO: 2991247 - DNA, 20 bp, Homo sapiens
tttctttagagaactgaaaa

SEQ ID NO: 2991248 - DNA, 18 bp, Homo sapiens
tttctttatataaggtca

SEQ ID NO: 2991249 - DNA, 23 bp, Homo sapiens
tttctttatcacctggcttgttt

SEQ ID NO: 2991250 - DNA, 19 bp, Homo sapiens
tttctttcaacttgcatcc

SEQ ID NO: 2991251 - DNA, 13 bp, Homo sapiens
tttctttcttcca

SEQ ID NO: 2991252 - DNA, 15 bp, Homo sapiens
tttctttctttctgt

SEQ ID NO: 2991253 - DNA, 17 bp, Homo sapiens
tttctttgatttaactg

SEQ ID NO: 2991254 - DNA, 20 bp, Homo sapiens
tttctttggggaaaaattct

SEQ ID NO: 2991255 - DNA, 17 bp, Homo sapiens
tttctttgtgtttgctt

SEQ ID NO: 2991256 - DNA, 14 bp, Homo sapiens
tttcttttcacata

SEQ ID NO: 2991257 - DNA, 15 bp, Homo sapiens
tttcttttcttcctg

SEQ ID NO: 2991258 - DNA, 22 bp, Homo sapiens
tttgaaaaggtctaagcaagtg

SEQ ID NO: 2991259 - DNA, 16 bp, Homo sapiens
tttgaaaagtatcagg

SEQ ID NO: 2991260 - DNA, 16 bp, Homo sapiens
tttgaaacaatactca

SEQ ID NO: 2991261 - DNA, 22 bp, Homo sapiens
tttgaaagtgggtttcaattta

SEQ ID NO: 2991262 - DNA, 22 bp, Homo sapiens
tttgaaatacctttgtagttac

SEQ ID NO: 2991263 - DNA, 11 bp, Homo sapiens
tttgaaattct

SEQ ID NO: 2991264 - DNA, 14 bp, Homo sapiens
tttgaaattctgaa

SEQ ID NO: 2991265 - DNA, 21 bp, Homo sapiens
tttgaaattgtattacaaatc

SEQ ID NO: 2991266 - DNA, 13 bp, Homo sapiens
tttgaacgtgcca

SEQ ID NO: 2991267 - DNA, 13 bp, Homo sapiens
tttgaacttgtca

SEQ ID NO: 2991268 - DNA, 19 bp, Homo sapiens
tttgaagaacaaaaggctt

SEQ ID NO: 2991269 - DNA, 17 bp, Homo sapiens
tttgaagaacatgtgag

SEQ ID NO: 2991270 - DNA, 16 bp, Homo sapiens
tttgaagatctgattt

SEQ ID NO: 2991271 - DNA, 12 bp, Homo sapiens
tttgaagcagct

SEQ ID NO: 2991272 - DNA, 14 bp, Homo sapiens
tttgaagcagctct

SEQ ID NO: 2991273 - DNA, 16 bp, Homo sapiens
tttgaagcagctctgc

SEQ ID NO: 2991274 - DNA, 18 bp, Homo sapiens
tttgaagcagctctgcct

SEQ ID NO: 2991275 - DNA, 18 bp, Homo sapiens
tttgaagctactgtgtgt

SEQ ID NO: 2991276 - DNA, 22 bp, Homo sapiens
tttgaaggaaatgagtggccag

SEQ ID NO: 2991277 - DNA, 21 bp, Homo sapiens
tttgaataaagaatacttgaa

SEQ ID NO: 2991278 - DNA, 22 bp, Homo sapiens
tttgaatccaaatctgtcctct

SEQ ID NO: 2991279 - DNA, 11 bp, Homo sapiens
tttgaatgtta

SEQ ID NO: 2991280 - DNA, 14 bp, Homo sapiens
tttgaattggcctg

SEQ ID NO: 2991281 - DNA, 22 bp, Homo sapiens
tttgaattggcctgaacagatg

SEQ ID NO: 2991282 - DNA, 23 bp, Homo sapiens
tttgacacaatgttgcactgaaa

SEQ ID NO: 2991283 - DNA, 18 bp, Homo sapiens
tttgacattgatgtgttc

SEQ ID NO: 2991284 - DNA, 20 bp, Homo sapiens
tttgacattgcgtttgacct

SEQ ID NO: 2991285 - DNA, 18 bp, Homo sapiens
tttgaccatggaaagaaa

SEQ ID NO: 2991286 - DNA, 18 bp, Homo sapiens
tttgaccttcatttcatg

SEQ ID NO: 2991287 - DNA, 14 bp, Homo sapiens
tttgacgaagaaac

SEQ ID NO: 2991288 - DNA, 18 bp, Homo sapiens
tttgacgggccaggccct

SEQ ID NO: 2991289 - DNA, 21 bp, Homo sapiens
tttgacgtcactgatattttt

SEQ ID NO: 2991290 - DNA, 17 bp, Homo sapiens
tttgactaattttacat

SEQ ID NO: 2991291 - DNA, 19 bp, Homo sapiens
tttgactagatgatggatg

SEQ ID NO: 2991292 - DNA, 15 bp, Homo sapiens
tttgactggatattc

SEQ ID NO: 2991293 - DNA, 16 bp, Homo sapiens
tttgagaccagcctgg

SEQ ID NO: 2991294 - DNA, 19 bp, Homo sapiens
tttgagaccaggctgggca

SEQ ID NO: 2991295 - DNA, 23 bp, Homo sapiens
tttgagagagagaacctttccac

SEQ ID NO: 2991296 - DNA, 17 bp, Homo sapiens
tttgagatactattttc

SEQ ID NO: 2991297 - DNA, 23 bp, Homo sapiens
tttgagattaagaatgccaggaa

SEQ ID NO: 2991298 - DNA, 22 bp, Homo sapiens
tttgagattcctgtaaatgtga

SEQ ID NO: 2991299 - DNA, 17 bp, Homo sapiens
tttgagcacaatctgtt

SEQ ID NO: 2991300 - DNA, 16 bp, Homo sapiens
tttgagcctgggaaat

SEQ ID NO: 2991301 - DNA, 16 bp, Homo sapiens
tttgaggggaaaacac

SEQ ID NO: 2991302 - DNA, 16 bp, Homo sapiens
tttgaggtggaagagg

SEQ ID NO: 2991303 - DNA, 14 bp, Homo sapiens
tttgagtacagata

SEQ ID NO: 2991304 - DNA, 13 bp, Homo sapiens
tttgagtgctctg

SEQ ID NO: 2991305 - DNA, 20 bp, Homo sapiens
tttgagtggatgatgtttcg

SEQ ID NO: 2991306 - DNA, 21 bp, Homo sapiens
tttgagtttgctgttttaaat

SEQ ID NO: 2991307 - DNA, 12 bp, Homo sapiens
tttgataacatt

SEQ ID NO: 2991308 - DNA, 23 bp, Homo sapiens
tttgataacattttgtttatgtt

SEQ ID NO: 2991309 - DNA, 23 bp, Homo sapiens
tttgataatagataactgctctt

SEQ ID NO: 2991310 - DNA, 16 bp, Homo sapiens
tttgatacatatgtga

SEQ ID NO: 2991311 - DNA, 17 bp, Homo sapiens
tttgatcagacagcttg

SEQ ID NO: 2991312 - DNA, 15 bp, Homo sapiens
tttgatcttcaggat

SEQ ID NO: 2991313 - DNA, 23 bp, Homo sapiens
tttgatgactggcattttataga

SEQ ID NO: 2991314 - DNA, 20 bp, Homo sapiens
tttgatgagatattaaattc

SEQ ID NO: 2991315 - DNA, 17 bp, Homo sapiens
tttgatgcatgtctttt

SEQ ID NO: 2991316 - DNA, 14 bp, Homo sapiens
ttttgttctcttct

SEQ ID NO: 2991317 - DNA, 16 bp, Homo sapiens
ttttgttcttgttgta

SEQ ID NO: 2991318 - DNA, 18 bp, Homo sapiens
ttttgttgagtctctgaa

SEQ ID NO: 2991319 - DNA, 13 bp, Homo sapiens
ttttgtttcactg

SEQ ID NO: 2991320 - DNA, 14 bp, Homo sapiens
ttttgtttcactgg

SEQ ID NO: 2991321 - DNA, 18 bp, Homo sapiens
ttttgtttgtttgtttat

SEQ ID NO: 2991322 - DNA, 22 bp, Homo sapiens
ttttgttttaaaactggacctg

SEQ ID NO: 2991323 - DNA, 16 bp, Homo sapiens
ttttgttttaaaatta

SEQ ID NO: 2991324 - DNA, 15 bp, Homo sapiens
ttttgttttcctttt

SEQ ID NO: 2991325 - DNA, 20 bp, Homo sapiens
ttttgtttttattttcaaga

SEQ ID NO: 2991326 - DNA, 20 bp, Homo sapiens
ttttgtttttccagttccag

SEQ ID NO: 2991327 - DNA, 17 bp, Homo sapiens
tttttaaaaaaaatgtg

SEQ ID NO: 2991328 - DNA, 22 bp, Homo sapiens
tttttaaaaaaaatgtgaaatt

SEQ ID NO: 2991329 - DNA, 22 bp, Homo sapiens
tttttaaaaaagacatttaaag

SEQ ID NO: 2991330 - DNA, 21 bp, Homo sapiens
tttttaaaaagaaaatcagtt

SEQ ID NO: 2991331 - DNA, 20 bp, Homo sapiens
tttttaaaaatgcaaatcct

SEQ ID NO: 2991332 - DNA, 23 bp, Homo sapiens
tttttaaaagaaaaaaaccaaag

SEQ ID NO: 2991333 - DNA, 23 bp, Homo sapiens
tttttaaaagatcttcaaaagta

SEQ ID NO: 2991334 - DNA, 16 bp, Homo sapiens
tttttaaaatatttat

SEQ ID NO: 2991335 - DNA, 13 bp, Homo sapiens
tttttaaaattgg

SEQ ID NO: 2991336 - DNA, 14 bp, Homo sapiens
tttttaaatgtgaa

SEQ ID NO: 2991337 - DNA, 15 bp, Homo sapiens
tttttaaatgtgaat

SEQ ID NO: 2991338 - DNA, 20 bp, Homo sapiens
tttttaaattcttactctgg

SEQ ID NO: 2991339 - DNA, 19 bp, Homo sapiens
tttttaaattttctccagt

SEQ ID NO: 2991340 - DNA, 16 bp, Homo sapiens
tttttaactactgtat

SEQ ID NO: 2991341 - DNA, 12 bp, Homo sapiens
tttttaactgat

SEQ ID NO: 2991342 - DNA, 23 bp, Homo sapiens
tttttaactgattcttatgatta

SEQ ID NO: 2991343 - DNA, 12 bp, Homo sapiens
tttttaactgta

SEQ ID NO: 2991344 - DNA, 18 bp, Homo sapiens
tttttaataaaaaggcac

SEQ ID NO: 2991345 - DNA, 14 bp, Homo sapiens
tttttaataggatt

SEQ ID NO: 2991346 - DNA, 17 bp, Homo sapiens
tttttaatgtgctgtgt

SEQ ID NO: 2991347 - DNA, 21 bp, Homo sapiens
tttttaatgtgctgtgtaaag

SEQ ID NO: 2991348 - DNA, 23 bp, Homo sapiens
tttttaatttacaaaaatataaa

SEQ ID NO: 2991349 - DNA, 15 bp, Homo sapiens
tttttactagaaatt

SEQ ID NO: 2991350 - DNA, 16 bp, Homo sapiens
tttttactcaaccaaa

SEQ ID NO: 2991351 - DNA, 11 bp, Homo sapiens
tttttactgtg

SEQ ID NO: 2991352 - DNA, 14 bp, Homo sapiens
tttttagacacctt

SEQ ID NO: 2991353 - DNA, 12 bp, Homo sapiens
tttttagagcat

SEQ ID NO: 2991354 - DNA, 16 bp, Homo sapiens
tttttagagcattaaa

SEQ ID NO: 2991355 - DNA, 16 bp, Homo sapiens
tttttaggaaaagcat

SEQ ID NO: 2991356 - DNA, 14 bp, Homo sapiens
tttttagtgttaaa

SEQ ID NO: 2991357 - DNA, 12 bp, Homo sapiens
tttttagtttaa

SEQ ID NO: 2991358 - DNA, 21 bp, Homo sapiens
tttttatatacgtttatataa

SEQ ID NO: 2991359 - DNA, 18 bp, Homo sapiens
tttttatattttatactg

SEQ ID NO: 2991360 - DNA, 14 bp, Homo sapiens
tttttatcttgagt

SEQ ID NO: 2991361 - DNA, 13 bp, Homo sapiens
tttttatttatat

SEQ ID NO: 2991362 - DNA, 18 bp, Homo sapiens
tttttatttatatgtact

SEQ ID NO: 2991363 - DNA, 16 bp, Homo sapiens
tttttcaactttgaat

SEQ ID NO: 2991364 - DNA, 22 bp, Homo sapiens
tttttcacctgggaaggaaaca

SEQ ID NO: 2991365 - DNA, 19 bp, Homo sapiens
tttttcagatataaatact

SEQ ID NO: 2991366 - DNA, 18 bp, Homo sapiens
tttttcatgttttaacaa

SEQ ID NO: 2991367 - DNA, 13 bp, Homo sapiens
tttttcatttttc

SEQ ID NO: 2991368 - DNA, 19 bp, Homo sapiens
tttttccaaaaaaatactg

SEQ ID NO: 2991369 - DNA, 20 bp, Homo sapiens
tttttccaattttagaaaat

SEQ ID NO: 2991370 - DNA, 13 bp, Homo sapiens
tttttccatcttt

SEQ ID NO: 2991371 - DNA, 14 bp, Homo sapiens
tttttccgtaaaaa

SEQ ID NO: 2991372 - DNA, 15 bp, Homo sapiens
tttttccgtaaaaat

SEQ ID NO: 2991373 - DNA, 16 bp, Homo sapiens
tttttccgtaaaaatg

SEQ ID NO: 2991374 - DNA, 20 bp, Homo sapiens
tttttcctcctttctctgta

SEQ ID NO: 2991375 - DNA, 17 bp, Homo sapiens
tttttcctgtgtattaa

SEQ ID NO: 2991376 - DNA, 17 bp, Homo sapiens
tttttctacataattgt

SEQ ID NO: 2991377 - DNA, 21 bp, Homo sapiens
tttttctcgctgtcctttcta

SEQ ID NO: 2991378 - DNA, 11 bp, Homo sapiens
tttttctctaa

SEQ ID NO: 2991379 - DNA, 21 bp, Homo sapiens
tttttctggaggttgataact

SEQ ID NO: 2991380 - DNA, 14 bp, Homo sapiens
tttttcttctttta

SEQ ID NO: 2991381 - DNA, 12 bp, Homo sapiens
tttttctttatc

SEQ ID NO: 2991382 - DNA, 23 bp, Homo sapiens
tttttctttttaaccctaatctt

SEQ ID NO: 2991383 - DNA, 14 bp, Homo sapiens
tttttgaaatacct

SEQ ID NO: 2991384 - DNA, 13 bp, Homo sapiens
tttttgaccagtt

SEQ ID NO: 2991385 - DNA, 16 bp, Homo sapiens
tttttgaccagtttct

SEQ ID NO: 2991386 - DNA, 21 bp, Homo sapiens
tttttgataaagtttctcaga

SEQ ID NO: 2991387 - DNA, 17 bp, Homo sapiens
tttttgataatccaaag

SEQ ID NO: 2991388 - DNA, 15 bp, Homo sapiens
tttttgataccttca

SEQ ID NO: 2991389 - DNA, 14 bp, Homo sapiens
tttttgatggctaa

SEQ ID NO: 2991390 - DNA, 20 bp, Homo sapiens
tttttgctataatcattagt

SEQ ID NO: 2991391 - DNA, 14 bp, Homo sapiens
tttttggagtgtta

SEQ ID NO: 2991392 - DNA, 19 bp, Homo sapiens
tttttggagtgttatgtat

SEQ ID NO: 2991393 - DNA, 12 bp, Homo sapiens
tttttggggata

SEQ ID NO: 2991394 - DNA, 21 bp, Homo sapiens
tttttggggggaatgacatgt

SEQ ID NO: 2991395 - DNA, 20 bp, Homo sapiens
tttttggtaatatatatatt

SEQ ID NO: 2991396 - DNA, 14 bp, Homo sapiens
tttttggtttctta

SEQ ID NO: 2991397 - DNA, 14 bp, Homo sapiens
tttttgtaaagtgt

SEQ ID NO: 2991398 - DNA, 14 bp, Homo sapiens
tttttgtacagtat

SEQ ID NO: 2991399 - DNA, 15 bp, Homo sapiens
tttttgtacagtatt

SEQ ID NO: 2991400 - DNA, 12 bp, Homo sapiens
tttttgtatgtt

SEQ ID NO: 2991401 - DNA, 17 bp, Homo sapiens
tttttgtcaacattgtg

SEQ ID NO: 2991402 - DNA, 12 bp, Homo sapiens
tttttgtcatca

SEQ ID NO: 2991403 - DNA, 21 bp, Homo sapiens
tttttgtgaagacggcacggt

SEQ ID NO: 2991404 - DNA, 12 bp, Homo sapiens
ttttttaggaaa

SEQ ID NO: 2991405 - DNA, 21 bp, Homo sapiens
ttttttagtatttatttatgt

SEQ ID NO: 2991406 - DNA, 22 bp, Homo sapiens
ttttttccatctttacaaaact

SEQ ID NO: 2991407 - DNA, 15 bp, Homo sapiens
ttttttcctgtttct

SEQ ID NO: 2991408 - DNA, 19 bp, Homo sapiens
ttttttcctgtttctgaaa

SEQ ID NO: 2991409 - DNA, 13 bp, Homo sapiens
tttttttaactgt

SEQ ID NO: 2991410 - DNA, 13 bp, Homo sapiens
tttttttcctttt

SEQ ID NO: 2991411 - DNA, 13 bp, Homo sapiens
ttttttttaatgt

SEQ ID NO: 2991412 - DNA, 11 bp, Homo sapiens
ttttttttcat

SEQ ID NO: 2991413 - DNA, 13 bp, Homo sapiens
ttttttttccctc

SEQ ID NO: 2991414 - DNA, 11 bp, Homo sapiens
ttttttttggt

SEQ ID NO: 2991415 - DNA, 13 bp, Homo sapiens
aaaagttactgca

SEQ ID NO: 2991416 - DNA, 13 bp, Homo sapiens
aaaagttatttat

SEQ ID NO: 2991417 - DNA, 16 bp, Homo sapiens
aaaagttatttatgct

SEQ ID NO: 2991418 - DNA, 13 bp, Homo sapiens
aaaagttccaaga

SEQ ID NO: 2991419 - DNA, 11 bp, Homo sapiens
aaaagttcttt

SEQ ID NO: 2991420 - DNA, 12 bp, Homo sapiens
aaaagttgaaat

SEQ ID NO: 2991421 - DNA, 12 bp, Homo sapiens
aaaagtttgtcc

SEQ ID NO: 2991422 - DNA, 16 bp, Homo sapiens
aaaagtttgttacttt

SEQ ID NO: 2991423 - DNA, 11 bp, Homo sapiens
aaaataaaaac

SEQ ID NO: 2991424 - DNA, 13 bp, Homo sapiens
aaaataaaccaaa

SEQ ID NO: 2991425 - DNA, 13 bp, Homo sapiens
aaaataaatacca

SEQ ID NO: 2991426 - DNA, 12 bp, Homo sapiens
aaaataaattta

SEQ ID NO: 2991427 - DNA, 20 bp, Homo sapiens
aaaataaatttatatgaaaa

SEQ ID NO: 2991428 - DNA, 19 bp, Homo sapiens
aaaataaccggatatatac

SEQ ID NO: 2991429 - DNA, 20 bp, Homo sapiens
aaaataactatcaggcagaa

SEQ ID NO: 2991430 - DNA, 13 bp, Homo sapiens
aaaataagtcaaa

SEQ ID NO: 2991431 - DNA, 16 bp, Homo sapiens
aaaataatactgctga

SEQ ID NO: 2991432 - DNA, 14 bp, Homo sapiens
aaaataatcaagat

SEQ ID NO: 2991433 - DNA, 14 bp, Homo sapiens
aaaatacaattatt

SEQ ID NO: 2991434 - DNA, 24 bp, Homo sapiens
aaaatacaattattgtatattgat

SEQ ID NO: 2991435 - DNA, 15 bp, Homo sapiens
aaaatactgccagat

SEQ ID NO: 2991436 - DNA, 15 bp, Homo sapiens
aaaatagaaaagtta

SEQ ID NO: 2991437 - DNA, 12 bp, Homo sapiens
aaaatagaaaca

SEQ ID NO: 2991438 - DNA, 20 bp, Homo sapiens
aaaatagagtgtagtttaca

SEQ ID NO: 2991439 - DNA, 14 bp, Homo sapiens
aaaatagatgtttt

SEQ ID NO: 2991440 - DNA, 22 bp, Homo sapiens
aaaatagatgttttaacttatt

SEQ ID NO: 2991441 - DNA, 21 bp, Homo sapiens
aaaatagctatggttgtaaca

SEQ ID NO: 2991442 - DNA, 15 bp, Homo sapiens
aaaataggatttctt

SEQ ID NO: 2991443 - DNA, 20 bp, Homo sapiens
aaaatagtggatctcagttt

SEQ ID NO: 2991444 - DNA, 16 bp, Homo sapiens
aaaatataaacaaaga

SEQ ID NO: 2991445 - DNA, 13 bp, Homo sapiens
aaaatatactgta

SEQ ID NO: 2991446 - DNA, 16 bp, Homo sapiens
aaaatatactgtaaag

SEQ ID NO: 2991447 - DNA, 20 bp, Homo sapiens
aaaatatactgtaaagaaag

SEQ ID NO: 2991448 - DNA, 22 bp, Homo sapiens
aaaatatactgtaaagaaagag

SEQ ID NO: 2991449 - DNA, 16 bp, Homo sapiens
aaaatatatgtatttt

SEQ ID NO: 2991450 - DNA, 12 bp, Homo sapiens
aaaatatatgtt

SEQ ID NO: 2991451 - DNA, 19 bp, Homo sapiens
aaaatatcaagtactacat

SEQ ID NO: 2991452 - DNA, 13 bp, Homo sapiens
aaaatatcccttt

SEQ ID NO: 2991453 - DNA, 15 bp, Homo sapiens
aaaatatctttgcat

SEQ ID NO: 2991454 - DNA, 14 bp, Homo sapiens
aaaatatgtaccaa

SEQ ID NO: 2991455 - DNA, 15 bp, Homo sapiens
aaaatattctgattg

SEQ ID NO: 2991456 - DNA, 16 bp, Homo sapiens
aaaatatttaaaaatg

SEQ ID NO: 2991457 - DNA, 14 bp, Homo sapiens
aaaatatttaaagg

SEQ ID NO: 2991458 - DNA, 13 bp, Homo sapiens
aaaatatttcaga

SEQ ID NO: 2991459 - DNA, 14 bp, Homo sapiens
aaaatatttcagat

SEQ ID NO: 2991460 - DNA, 19 bp, Homo sapiens
aaaatatttcagatatcaa

SEQ ID NO: 2991461 - DNA, 13 bp, Homo sapiens
aaaatattttctc

SEQ ID NO: 2991462 - DNA, 12 bp, Homo sapiens
aaaatattttga

SEQ ID NO: 2991463 - DNA, 20 bp, Homo sapiens
aaaatattttgttgccttca

SEQ ID NO: 2991464 - DNA, 13 bp, Homo sapiens
aaaatcaactttt

SEQ ID NO: 2991465 - DNA, 21 bp, Homo sapiens
aaaatcaactttttattgcct

SEQ ID NO: 2991466 - DNA, 23 bp, Homo sapiens
aaaatcaactttttattgccttc

SEQ ID NO: 2991467 - DNA, 23 bp, Homo sapiens
aaaatcacactgtaaatatgaat

SEQ ID NO: 2991468 - DNA, 17 bp, Homo sapiens
aaaatcagttgattaag

SEQ ID NO: 2991469 - DNA, 17 bp, Homo sapiens
aaaatcatggaatggtt

SEQ ID NO: 2991470 - DNA, 15 bp, Homo sapiens
aaaatccaaactgct

SEQ ID NO: 2991471 - DNA, 17 bp, Homo sapiens
aaaatccaaactgctgt

SEQ ID NO: 2991472 - DNA, 19 bp, Homo sapiens
aaaatccaaactgctgtct

SEQ ID NO: 2991473 - DNA, 18 bp, Homo sapiens
aaaatctgagaaactcta

SEQ ID NO: 2991474 - DNA, 20 bp, Homo sapiens
aaaatctgtcacgtagaact

SEQ ID NO: 2991475 - DNA, 18 bp, Homo sapiens
aaaatctgtcactacaat

SEQ ID NO: 2991476 - DNA, 21 bp, Homo sapiens
aaaatcttgtaggtcattgca

SEQ ID NO: 2991477 - DNA, 21 bp, Homo sapiens
aaaatgaactgtattattgca

SEQ ID NO: 2991478 - DNA, 15 bp, Homo sapiens
aaaatgaatgtaaaa

SEQ ID NO: 2991479 - DNA, 16 bp, Homo sapiens
aaaatgaattggttgg

SEQ ID NO: 2991480 - DNA, 19 bp, Homo sapiens
aaaatgagtgaaatttaaa

SEQ ID NO: 2991481 - DNA, 13 bp, Homo sapiens
aaaatgatgttat

SEQ ID NO: 2991482 - DNA, 16 bp, Homo sapiens
aaaatgatgttcattt

SEQ ID NO: 2991483 - DNA, 14 bp, Homo sapiens
aaaatgcaaatcct

SEQ ID NO: 2991484 - DNA, 20 bp, Homo sapiens
aaaatgcaaatcctatgtga

SEQ ID NO: 2991485 - DNA, 17 bp, Homo sapiens
aaaatgccataatacaa

SEQ ID NO: 2991486 - DNA, 21 bp, Homo sapiens
aaaatgccataatacaaaagg

SEQ ID NO: 2991487 - DNA, 23 bp, Homo sapiens
aaaatgccatgatgcctctgtct

SEQ ID NO: 2991488 - DNA, 16 bp, Homo sapiens
aaaatgctcaatttca

SEQ ID NO: 2991489 - DNA, 19 bp, Homo sapiens
aaaatgctcaatttcagca

SEQ ID NO: 2991490 - DNA, 12 bp, Homo sapiens
aaaatgcttctt

SEQ ID NO: 2991491 - DNA, 15 bp, Homo sapiens
aaaatggaaaaaaac

SEQ ID NO: 2991492 - DNA, 21 bp, Homo sapiens
aaaatggatgccttgaataat

SEQ ID NO: 2991493 - DNA, 23 bp, Homo sapiens
aaaatggatgccttgaataataa

SEQ ID NO: 2991494 - DNA, 23 bp, Homo sapiens
aaaatggtataagtaactttatt

SEQ ID NO: 2991495 - DNA, 22 bp, Homo sapiens
aaaatggtcctatttttgtgaa

SEQ ID NO: 2991496 - DNA, 24 bp, Homo sapiens
aaaatggtcctatttttgtgaaga

SEQ ID NO: 2991497 - DNA, 21 bp, Homo sapiens
aaaatggtggcttcagctcca

SEQ ID NO: 2991498 - DNA, 15 bp, Homo sapiens
aaaatgtaaaaaaca

SEQ ID NO: 2991499 - DNA, 14 bp, Homo sapiens
aaaatgtaaagcca

SEQ ID NO: 2991500 - DNA, 22 bp, Homo sapiens
aaaatgtaagattatagattct

SEQ ID NO: 2991501 - DNA, 14 bp, Homo sapiens
aaaatgtataatga

SEQ ID NO: 2991502 - DNA, 13 bp, Homo sapiens
aaaatgtatattt

SEQ ID NO: 2991503 - DNA, 17 bp, Homo sapiens
aaaatgtatattttgat

SEQ ID NO: 2991504 - DNA, 19 bp, Homo sapiens
aaaatgtatccagaggaat

SEQ ID NO: 2991505 - DNA, 11 bp, Homo sapiens
aaaatgtcttg

SEQ ID NO: 2991506 - DNA, 21 bp, Homo sapiens
aaaatgtcttgtgtatttctc

SEQ ID NO: 2991507 - DNA, 18 bp, Homo sapiens
aaaatgtcttgtgttacc

SEQ ID NO: 2991508 - DNA, 11 bp, Homo sapiens
aaaatgtgaaa

SEQ ID NO: 2991509 - DNA, 13 bp, Homo sapiens
aaaatgtgaaatt

SEQ ID NO: 2991510 - DNA, 12 bp, Homo sapiens
aaaatgtgtctg

SEQ ID NO: 2991511 - DNA, 21 bp, Homo sapiens
aaaatgtgtctgcaacatgga

SEQ ID NO: 2991512 - DNA, 22 bp, Homo sapiens
aaaatgtgtctgcaacatggat

SEQ ID NO: 2991513 - DNA, 11 bp, Homo sapiens
aaaatgtgttc

SEQ ID NO: 2991514 - DNA, 22 bp, Homo sapiens
aaaatgttatcttctcaagttc

SEQ ID NO: 2991515 - DNA, 13 bp, Homo sapiens
aaaatgttcactt

SEQ ID NO: 2991516 - DNA, 20 bp, Homo sapiens
aaaatgttcccttgaccatt

SEQ ID NO: 2991517 - DNA, 18 bp, Homo sapiens
aaaatgttggtgcaatta

SEQ ID NO: 2991518 - DNA, 12 bp, Homo sapiens
aaaatgtttact

SEQ ID NO: 2991519 - DNA, 13 bp, Homo sapiens
aaaatgtttactg

SEQ ID NO: 2991520 - DNA, 21 bp, Homo sapiens
aaaatgttttttcatgtgttt

SEQ ID NO: 2991521 - DNA, 11 bp, Homo sapiens
aaaattaaagc

SEQ ID NO: 2991522 - DNA, 14 bp, Homo sapiens
aaaattaagtagaa

SEQ ID NO: 2991523 - DNA, 19 bp, Homo sapiens
aaaattaagtagaacaaaa

SEQ ID NO: 2991524 - DNA, 14 bp, Homo sapiens
aaaattaatagctt

SEQ ID NO: 2991525 - DNA, 15 bp, Homo sapiens
aaaattaatagcttt

SEQ ID NO: 2991526 - DNA, 23 bp, Homo sapiens
aaaattataggaatatcaatata

SEQ ID NO: 2991527 - DNA, 15 bp, Homo sapiens
aaaattctaaatgta

SEQ ID NO: 2991528 - DNA, 16 bp, Homo sapiens
aaaattctagctgtat

SEQ ID NO: 2991529 - DNA, 19 bp, Homo sapiens
aaaattctagctgtatgat

SEQ ID NO: 2991530 - DNA, 18 bp, Homo sapiens
aaaattgacttagatatt

SEQ ID NO: 2991531 - DNA, 23 bp, Homo sapiens
aaaattgctaacgttttttcttc

SEQ ID NO: 2991532 - DNA, 16 bp, Homo sapiens
aaaattgtagcttttt

SEQ ID NO: 2991533 - DNA, 16 bp, Homo sapiens
aaaattgtataaatta

SEQ ID NO: 2991534 - DNA, 16 bp, Homo sapiens
aaaattgtcttcatgt

SEQ ID NO: 2991535 - DNA, 19 bp, Homo sapiens
aaaatttacatttaataca

SEQ ID NO: 2991536 - DNA, 13 bp, Homo sapiens
aaaatttgtattt

SEQ ID NO: 2991537 - DNA, 15 bp, Homo sapiens
aaaatttttgcaaat

SEQ ID NO: 2991538 - DNA, 17 bp, Homo sapiens
aaaatttttttaaggaa

SEQ ID NO: 2991539 - DNA, 21 bp, Homo sapiens
aaaatttttttggtctttttg

SEQ ID NO: 2991540 - DNA, 16 bp, Homo sapiens
aaacaaaaattgtctt

SEQ ID NO: 2991541 - DNA, 20 bp, Homo sapiens
aaacaaaaccaattcatgaa

SEQ ID NO: 2991542 - DNA, 13 bp, Homo sapiens
aaacaaaccagaa

SEQ ID NO: 2991543 - DNA, 12 bp, Homo sapiens
aaacaaagccag

SEQ ID NO: 2991544 - DNA, 23 bp, Homo sapiens
aaacaaagcttagcaggagagga

SEQ ID NO: 2991545 - DNA, 23 bp, Homo sapiens
aaacaaaggagcattaagcccaa

SEQ ID NO: 2991546 - DNA, 16 bp, Homo sapiens
aaacaaatcaaacaca

SEQ ID NO: 2991547 - DNA, 12 bp, Homo sapiens
aaacaacaaaaa

SEQ ID NO: 2991548 - DNA, 12 bp, Homo sapiens
aaacaacaaata

SEQ ID NO: 2991549 - DNA, 22 bp, Homo sapiens
aaacaacaatttctactttgaa

SEQ ID NO: 2991550 - DNA, 19 bp, Homo sapiens
aaacaacattttgagaaca

SEQ ID NO: 2991551 - DNA, 21 bp, Homo sapiens
aaacaacattttgagaacaaa

SEQ ID NO: 2991552 - DNA, 15 bp, Homo sapiens
aaacaaccttcagct

SEQ ID NO: 2991553 - DNA, 15 bp, Homo sapiens
aaactgctgtctctt

SEQ ID NO: 2991554 - DNA, 11 bp, Homo sapiens
aaactggaaat

SEQ ID NO: 2991555 - DNA, 18 bp, Homo sapiens
aaactggggcctccagaa

SEQ ID NO: 2991556 - DNA, 20 bp, Homo sapiens
aaactggggcctccagaact

SEQ ID NO: 2991557 - DNA, 21 bp, Homo sapiens
aaactggtatgaataattgca

SEQ ID NO: 2991558 - DNA, 11 bp, Homo sapiens
aaactgtgaat

SEQ ID NO: 2991559 - DNA, 12 bp, Homo sapiens
aaactgtgcacc

SEQ ID NO: 2991560 - DNA, 20 bp, Homo sapiens
aaactgttcccacctgctgg

SEQ ID NO: 2991561 - DNA, 12 bp, Homo sapiens
aaacttatgaat

SEQ ID NO: 2991562 - DNA, 18 bp, Homo sapiens
aaacttccattctttctt

SEQ ID NO: 2991563 - DNA, 17 bp, Homo sapiens
aaacttctggctccctc

SEQ ID NO: 2991564 - DNA, 18 bp, Homo sapiens
aaacttctgtaaggggca

SEQ ID NO: 2991565 - DNA, 16 bp, Homo sapiens
aaacttgtaatttttt

SEQ ID NO: 2991566 - DNA, 18 bp, Homo sapiens
aaacttgtcacttgcatg

SEQ ID NO: 2991567 - DNA, 20 bp, Homo sapiens
aaacttgtcacttgcatgtc

SEQ ID NO: 2991568 - DNA, 12 bp, Homo sapiens
aaactttaagaa

SEQ ID NO: 2991569 - DNA, 19 bp, Homo sapiens
aaactttactaagatgaca

SEQ ID NO: 2991570 - DNA, 20 bp, Homo sapiens
aaactttcctcttcctgcct

SEQ ID NO: 2991571 - DNA, 18 bp, Homo sapiens
aaactttgagtacagata

SEQ ID NO: 2991572 - DNA, 23 bp, Homo sapiens
aaactttggaagcactttttctg

SEQ ID NO: 2991573 - DNA, 14 bp, Homo sapiens
aaacttttaaacta

SEQ ID NO: 2991574 - DNA, 12 bp, Homo sapiens
aaacttttctca

SEQ ID NO: 2991575 - DNA, 17 bp, Homo sapiens
aaagaaaaaaaccaaag

SEQ ID NO: 2991576 - DNA, 14 bp, Homo sapiens
aaagaaaagcctca

SEQ ID NO: 2991577 - DNA, 16 bp, Homo sapiens
aaagaaaatgtgtctg

SEQ ID NO: 2991578 - DNA, 15 bp, Homo sapiens
aaagaaaccacttct

SEQ ID NO: 2991579 - DNA, 13 bp, Homo sapiens
aaagaaagagaga

SEQ ID NO: 2991580 - DNA, 14 bp, Homo sapiens
aaagaaagcaaatt

SEQ ID NO: 2991581 - DNA, 22 bp, Homo sapiens
aaagaaagcaaattatttttaa

SEQ ID NO: 2991582 - DNA, 14 bp, Homo sapiens
aaagaaagcaactt

SEQ ID NO: 2991583 - DNA, 23 bp, Homo sapiens
aaagaaagtggtcttaagaaatg

SEQ ID NO: 2991584 - DNA, 10 bp, Homo sapiens
aaagaaatat

SEQ ID NO: 2991585 - DNA, 14 bp, Homo sapiens
aaagaaattctgaa

SEQ ID NO: 2991586 - DNA, 12 bp, Homo sapiens
aaagaacttacc

SEQ ID NO: 2991587 - DNA, 21 bp, Homo sapiens
aaagaagacatgttttagaca

SEQ ID NO: 2991588 - DNA, 21 bp, Homo sapiens
aaagaagagccggagcctcca

SEQ ID NO: 2991589 - DNA, 14 bp, Homo sapiens
aaagaagatctgta

SEQ ID NO: 2991590 - DNA, 15 bp, Homo sapiens
aaagaagatctgtaa

SEQ ID NO: 2991591 - DNA, 13 bp, Homo sapiens
aaagaagcttcat

SEQ ID NO: 2991592 - DNA, 23 bp, Homo sapiens
aaagaagtctcttaattctgatg

SEQ ID NO: 2991593 - DNA, 16 bp, Homo sapiens
aaagaatacttgaact

SEQ ID NO: 2991594 - DNA, 20 bp, Homo sapiens
aaagaatatgactttttata

SEQ ID NO: 2991595 - DNA, 13 bp, Homo sapiens
aaagaatgaaaga

SEQ ID NO: 2991596 - DNA, 17 bp, Homo sapiens
aaagacaaacaccttat

SEQ ID NO: 2991597 - DNA, 19 bp, Homo sapiens
aaagacaatcactgaaaca

SEQ ID NO: 2991598 - DNA, 13 bp, Homo sapiens
aaagacactgcct

SEQ ID NO: 2991599 - DNA, 19 bp, Homo sapiens
aaagacactgcctgggctg

SEQ ID NO: 2991600 - DNA, 16 bp, Homo sapiens
aaagacactggtgtat

SEQ ID NO: 2991601 - DNA, 22 bp, Homo sapiens
aaagacactggtgtatctcaga

SEQ ID NO: 2991602 - DNA, 22 bp, Homo sapiens
aaagacagcagacaaaatgaaa

SEQ ID NO: 2991603 - DNA, 22 bp, Homo sapiens
aaagacagggctgataagctaa

SEQ ID NO: 2991604 - DNA, 18 bp, Homo sapiens
aaagacagggtcttgcta

SEQ ID NO: 2991605 - DNA, 13 bp, Homo sapiens
aaagacagtgaaa

SEQ ID NO: 2991606 - DNA, 23 bp, Homo sapiens
aaagacatctttctcttttctaa

SEQ ID NO: 2991607 - DNA, 18 bp, Homo sapiens
aaagacattatttctcat

SEQ ID NO: 2991608 - DNA, 15 bp, Homo sapiens
aaagacatttaaaga

SEQ ID NO: 2991609 - DNA, 16 bp, Homo sapiens
aaagacgatgtttatg

SEQ ID NO: 2991610 - DNA, 15 bp, Homo sapiens
aaagactcttgggag

SEQ ID NO: 2991611 - DNA, 13 bp, Homo sapiens
aaagactggcttt

SEQ ID NO: 2991612 - DNA, 21 bp, Homo sapiens
aaagactggcttttattaatg

SEQ ID NO: 2991613 - DNA, 23 bp, Homo sapiens
aaagactggcttttattaatgca

SEQ ID NO: 2991614 - DNA, 12 bp, Homo sapiens
aaagagagaaaa

SEQ ID NO: 2991615 - DNA, 13 bp, Homo sapiens
aaagagagaaaat

SEQ ID NO: 2991616 - DNA, 14 bp, Homo sapiens
aaagagagaaaata

SEQ ID NO: 2991617 - DNA, 20 bp, Homo sapiens
aaagagatgatgaaaatatt

SEQ ID NO: 2991618 - DNA, 22 bp, Homo sapiens
aaagagatgatgaaaatattta

SEQ ID NO: 2991619 - DNA, 23 bp, Homo sapiens
aaagagcaagtctggatctggga

SEQ ID NO: 2991620 - DNA, 17 bp, Homo sapiens
aaagagctactcagaaa

SEQ ID NO: 2991621 - DNA, 22 bp, Homo sapiens
aaagagctttcttcccgaaccc

SEQ ID NO: 2991622 - DNA, 14 bp, Homo sapiens
aaagaggaaagaat

SEQ ID NO: 2991623 - DNA, 20 bp, Homo sapiens
aaagaggatgatttcagaag

SEQ ID NO: 2991624 - DNA, 12 bp, Homo sapiens
aaagaggcctgt

SEQ ID NO: 2991625 - DNA, 17 bp, Homo sapiens
aaagaggcctgttcata

SEQ ID NO: 2991626 - DNA, 17 bp, Homo sapiens
aaagaggtgaaaatgaa

SEQ ID NO: 2991627 - DNA, 13 bp, Homo sapiens
aaagaggtgtgca

SEQ ID NO: 2991628 - DNA, 19 bp, Homo sapiens
aaagagtaaaggaaatgat

SEQ ID NO: 2991629 - DNA, 13 bp, Homo sapiens
aaagagtagaaag

SEQ ID NO: 2991630 - DNA, 13 bp, Homo sapiens
aaagagtagaatt

SEQ ID NO: 2991631 - DNA, 14 bp, Homo sapiens
aaagagtctagatt

SEQ ID NO: 2991632 - DNA, 17 bp, Homo sapiens
aaagagtctctggctca

SEQ ID NO: 2991633 - DNA, 22 bp, Homo sapiens
aaagagtctctggctcagctgt

SEQ ID NO: 2991634 - DNA, 15 bp, Homo sapiens
aaagataaatattat

SEQ ID NO: 2991635 - DNA, 15 bp, Homo sapiens
aaagataagaaatac

SEQ ID NO: 2991636 - DNA, 21 bp, Homo sapiens
aaagatacagaactctttcaa

SEQ ID NO: 2991637 - DNA, 14 bp, Homo sapiens
aaagatatttttat

SEQ ID NO: 2991638 - DNA, 16 bp, Homo sapiens
aaagatatttttattc

SEQ ID NO: 2991639 - DNA, 15 bp, Homo sapiens
aaagatctacatgaa

SEQ ID NO: 2991640 - DNA, 15 bp, Homo sapiens
aaagatcttcaaaag

SEQ ID NO: 2991641 - DNA, 21 bp, Homo sapiens
aaagatgcagagtaagtatta

SEQ ID NO: 2991642 - DNA, 21 bp, Homo sapiens
aaagatggagtttacaaagat

SEQ ID NO: 2991643 - DNA, 19 bp, Homo sapiens
aaagatggagtttctaagg

SEQ ID NO: 2991644 - DNA, 13 bp, Homo sapiens
aaagatggataaa

SEQ ID NO: 2991645 - DNA, 19 bp, Homo sapiens
aaagatgggtgaaggctgg

SEQ ID NO: 2991646 - DNA, 13 bp, Homo sapiens
aaagattatttaa

SEQ ID NO: 2991647 - DNA, 19 bp, Homo sapiens
aaagattcaggtatgttgc

SEQ ID NO: 2991648 - DNA, 15 bp, Homo sapiens
aaagattcatgattt

SEQ ID NO: 2991649 - DNA, 13 bp, Homo sapiens
aaagcaaaaatgc

SEQ ID NO: 2991650 - DNA, 17 bp, Homo sapiens
aaagcaaaaatgctaat

SEQ ID NO: 2991651 - DNA, 15 bp, Homo sapiens
aaagcaaaggaagca

SEQ ID NO: 2991652 - DNA, 15 bp, Homo sapiens
aaagcaaaggcagtc

SEQ ID NO: 2991653 - DNA, 21 bp, Homo sapiens
aaatattgtcattacaaatct

SEQ ID NO: 2991654 - DNA, 14 bp, Homo sapiens
aaatatttaaacct

SEQ ID NO: 2991655 - DNA, 12 bp, Homo sapiens
aaatatttatct

SEQ ID NO: 2991656 - DNA, 17 bp, Homo sapiens
aaatatttcagatatca

SEQ ID NO: 2991657 - DNA, 12 bp, Homo sapiens
aaatatttctga

SEQ ID NO: 2991658 - DNA, 13 bp, Homo sapiens
aaatatttcttaa

SEQ ID NO: 2991659 - DNA, 14 bp, Homo sapiens
aaatatttgatcac

SEQ ID NO: 2991660 - DNA, 15 bp, Homo sapiens
aaatattttcaagaa

SEQ ID NO: 2991661 - DNA, 12 bp, Homo sapiens
aaatattttcta

SEQ ID NO: 2991662 - DNA, 12 bp, Homo sapiens
aaatattttctc

SEQ ID NO: 2991663 - DNA, 15 bp, Homo sapiens
aaatattttctctgt

SEQ ID NO: 2991664 - DNA, 13 bp, Homo sapiens
aaatattttgaat

SEQ ID NO: 2991665 - DNA, 21 bp, Homo sapiens
aaatattttgaatcaataata

SEQ ID NO: 2991666 - DNA, 22 bp, Homo sapiens
aaatattttgaatcaataatat

SEQ ID NO: 2991667 - DNA, 17 bp, Homo sapiens
aaatatttttaaaagat

SEQ ID NO: 2991668 - DNA, 22 bp, Homo sapiens
aaatatttttggtcattgtaat

SEQ ID NO: 2991669 - DNA, 19 bp, Homo sapiens
aaatattttttccttttgt

SEQ ID NO: 2991670 - DNA, 18 bp, Homo sapiens
aaatcaaaaacttttgca

SEQ ID NO: 2991671 - DNA, 12 bp, Homo sapiens
aaatcaaacaca

SEQ ID NO: 2991672 - DNA, 13 bp, Homo sapiens
aaatcaaacccac

SEQ ID NO: 2991673 - DNA, 21 bp, Homo sapiens
aaatcaaactgtagttgtttt

SEQ ID NO: 2991674 - DNA, 11 bp, Homo sapiens
aaatcaacttt

SEQ ID NO: 2991675 - DNA, 23 bp, Homo sapiens
aaatcaactttttattgccttct

SEQ ID NO: 2991676 - DNA, 18 bp, Homo sapiens
aaatcaagtatttgggaa

SEQ ID NO: 2991677 - DNA, 20 bp, Homo sapiens
aaatcaatctgtaaaactaa

SEQ ID NO: 2991678 - DNA, 13 bp, Homo sapiens
aaatcaatttttt

SEQ ID NO: 2991679 - DNA, 16 bp, Homo sapiens
aaatcacattctgcat

SEQ ID NO: 2991680 - DNA, 23 bp, Homo sapiens
aaatcacccacaaccctctggaa

SEQ ID NO: 2991681 - DNA, 12 bp, Homo sapiens
aaatcactgttt

SEQ ID NO: 2991682 - DNA, 12 bp, Homo sapiens
aaatcagaataa

SEQ ID NO: 2991683 - DNA, 14 bp, Homo sapiens
aaatcagaataaat

SEQ ID NO: 2991684 - DNA, 20 bp, Homo sapiens
aaatcagagcatacaaaata

SEQ ID NO: 2991685 - DNA, 22 bp, Homo sapiens
aaatcagtcagtgcaaatgtca

SEQ ID NO: 2991686 - DNA, 18 bp, Homo sapiens
aaatcagtgtttaaataa

SEQ ID NO: 2991687 - DNA, 21 bp, Homo sapiens
aaatcatgttttttctgcaat

SEQ ID NO: 2991688 - DNA, 14 bp, Homo sapiens
aaatccaaactgct

SEQ ID NO: 2991689 - DNA, 15 bp, Homo sapiens
aaatccaaactgctg

SEQ ID NO: 2991690 - DNA, 21 bp, Homo sapiens
aaatccaaactgctgtctctt

SEQ ID NO: 2991691 - DNA, 19 bp, Homo sapiens
aaatccgaacctcctctgt

SEQ ID NO: 2991692 - DNA, 16 bp, Homo sapiens
aaatccgccagtgttt

SEQ ID NO: 2991693 - DNA, 14 bp, Homo sapiens
aaatcctatgtgat

SEQ ID NO: 2991694 - DNA, 23 bp, Homo sapiens
aaatcctatgtgattttaactct

SEQ ID NO: 2991695 - DNA, 12 bp, Homo sapiens
aaatcctctggc

SEQ ID NO: 2991696 - DNA, 12 bp, Homo sapiens
aaatccttgtta

SEQ ID NO: 2991697 - DNA, 16 bp, Homo sapiens
aaatcgccataggcca

SEQ ID NO: 2991698 - DNA, 17 bp, Homo sapiens
aaatcgggaaggatggg

SEQ ID NO: 2991699 - DNA, 16 bp, Homo sapiens
aaatcgtttaatgttt

SEQ ID NO: 2991700 - DNA, 19 bp, Homo sapiens
aaatcgtttaatgtttata

SEQ ID NO: 2991701 - DNA, 14 bp, Homo sapiens
aacgaaacacttca

SEQ ID NO: 2991702 - DNA, 16 bp, Homo sapiens
aacgagtcaatcccct

SEQ ID NO: 2991703 - DNA, 17 bp, Homo sapiens
aacgatttaattctctt

SEQ ID NO: 2991704 - DNA, 22 bp, Homo sapiens
aacgccgccttggccttgcagc

SEQ ID NO: 2991705 - DNA, 17 bp, Homo sapiens
aacgcctcccctgcccc

SEQ ID NO: 2991706 - DNA, 13 bp, Homo sapiens
aacgcgcagatgt

SEQ ID NO: 2991707 - DNA, 23 bp, Homo sapiens
aacgcgcagatgtgcagcagatt

SEQ ID NO: 2991708 - DNA, 23 bp, Homo sapiens
aacgctgaagcggtcagactgga

SEQ ID NO: 2991709 - DNA, 15 bp, Homo sapiens
aacgctgcctgcccg

SEQ ID NO: 2991710 - DNA, 23 bp, Homo sapiens
aacggaggcctgcgaccctgggg

SEQ ID NO: 2991711 - DNA, 11 bp, Homo sapiens
aacggatgctc

SEQ ID NO: 2991712 - DNA, 15 bp, Homo sapiens
aacgtaataaaccag

SEQ ID NO: 2991713 - DNA, 15 bp, Homo sapiens
aacgtatcaatacag

SEQ ID NO: 2991714 - DNA, 18 bp, Homo sapiens
aacgtatgcatgtgaaga

SEQ ID NO: 2991715 - DNA, 21 bp, Homo sapiens
aacgtatgcatgtgaagaaag

SEQ ID NO: 2991716 - DNA, 19 bp, Homo sapiens
aacgtatggaatgcttctt

SEQ ID NO: 2991717 - DNA, 21 bp, Homo sapiens
aacgtcacccaaaagcacaaa

SEQ ID NO: 2991718 - DNA, 15 bp, Homo sapiens
aacgtccatctctct

SEQ ID NO: 2991719 - DNA, 13 bp, Homo sapiens
aacgtctcccaga

SEQ ID NO: 2991720 - DNA, 20 bp, Homo sapiens
aacgtgcaactgacactccc

SEQ ID NO: 2991721 - DNA, 14 bp, Homo sapiens
aacgtgtcccgagc

SEQ ID NO: 2991722 - DNA, 19 bp, Homo sapiens
aacgtgttaattataaaca

SEQ ID NO: 2991723 - DNA, 22 bp, Homo sapiens
aacgtgttaattataaacagca

SEQ ID NO: 2991724 - DNA, 16 bp, Homo sapiens
aacgttaaaagtgtac

SEQ ID NO: 2991725 - DNA, 15 bp, Homo sapiens
aactaaactcattta

SEQ ID NO: 2991726 - DNA, 16 bp, Homo sapiens
aactaaagcaatagaa

SEQ ID NO: 2991727 - DNA, 19 bp, Homo sapiens
aactaaagcaatagaaaca

SEQ ID NO: 2991728 - DNA, 15 bp, Homo sapiens
aactaagaaacttaa

SEQ ID NO: 2991729 - DNA, 14 bp, Homo sapiens
aactaagactcccg

SEQ ID NO: 2991730 - DNA, 16 bp, Homo sapiens
aactaagttattgtta

SEQ ID NO: 2991731 - DNA, 21 bp, Homo sapiens
aactaagttttgtgtgtatat

SEQ ID NO: 2991732 - DNA, 11 bp, Homo sapiens
aactaatttct

SEQ ID NO: 2991733 - DNA, 19 bp, Homo sapiens
aactacaaacaaaagcagc

SEQ ID NO: 2991734 - DNA, 13 bp, Homo sapiens
aactacaaatcaa

SEQ ID NO: 2991735 - DNA, 22 bp, Homo sapiens
aactacatgagaacaaacagat

SEQ ID NO: 2991736 - DNA, 16 bp, Homo sapiens
aactacccaaaacaag

SEQ ID NO: 2991737 - DNA, 23 bp, Homo sapiens
aactacctgtatttaaaaataga

SEQ ID NO: 2991738 - DNA, 21 bp, Homo sapiens
aactactgtagaactgatttt

SEQ ID NO: 2991739 - DNA, 14 bp, Homo sapiens
aactacttgatttt

SEQ ID NO: 2991740 - DNA, 20 bp, Homo sapiens
aactagaaatctgtcctgtg

SEQ ID NO: 2991741 - DNA, 15 bp, Homo sapiens
aactagatgacctca

SEQ ID NO: 2991742 - DNA, 14 bp, Homo sapiens
aactagcctcatct

SEQ ID NO: 2991743 - DNA, 17 bp, Homo sapiens
aactagggccaagccca

SEQ ID NO: 2991744 - DNA, 17 bp, Homo sapiens
aactagtagttctcttg

SEQ ID NO: 2991745 - DNA, 16 bp, Homo sapiens
aactataaatacaaat

SEQ ID NO: 2991746 - DNA, 17 bp, Homo sapiens
aactataaatacaaatc

SEQ ID NO: 2991747 - DNA, 17 bp, Homo sapiens
aactatcaggcagaaga

SEQ ID NO: 2991748 - DNA, 18 bp, Homo sapiens
aactatcaggcagaagaa

SEQ ID NO: 2991749 - DNA, 23 bp, Homo sapiens
aactatcccctgcgctttgaacg

SEQ ID NO: 2991750 - DNA, 18 bp, Homo sapiens
aactatcttctttggact

SEQ ID NO: 2991751 - DNA, 23 bp, Homo sapiens
aactatcttctttggacttctga

SEQ ID NO: 2991752 - DNA, 23 bp, Homo sapiens
aactatgcatggtgccccaggac

SEQ ID NO: 2991753 - DNA, 17 bp, Homo sapiens
aactatgtattaattta

SEQ ID NO: 2991754 - DNA, 15 bp, Homo sapiens
aactattccatgttt

SEQ ID NO: 2991755 - DNA, 14 bp, Homo sapiens
aactattttcagat

SEQ ID NO: 2991756 - DNA, 23 bp, Homo sapiens
aactcacattggcaagtgtaaaa

SEQ ID NO: 2991757 - DNA, 14 bp, Homo sapiens
aactcactttcctc

SEQ ID NO: 2991758 - DNA, 12 bp, Homo sapiens
aactcagatcca

SEQ ID NO: 2991759 - DNA, 13 bp, Homo sapiens
aactcagatccag

SEQ ID NO: 2991760 - DNA, 15 bp, Homo sapiens
aactcagccaagcac

SEQ ID NO: 2991761 - DNA, 17 bp, Homo sapiens
aactcagccaagcacag

SEQ ID NO: 2991762 - DNA, 18 bp, Homo sapiens
aactcagccaagcacagt

SEQ ID NO: 2991763 - DNA, 20 bp, Homo sapiens
aactcagccaagcacagtgg

SEQ ID NO: 2991764 - DNA, 21 bp, Homo sapiens
aactcatctttagagcaacag

SEQ ID NO: 2991765 - DNA, 19 bp, Homo sapiens
aactcatgactgagtctgg

SEQ ID NO: 2991766 - DNA, 12 bp, Homo sapiens
aacatgtatgtg

SEQ ID NO: 2991767 - DNA, 22 bp, Homo sapiens
aacatgtgcaactcttgtattg

SEQ ID NO: 2991768 - DNA, 22 bp, Homo sapiens
aacatgtgttttcatcatttca

SEQ ID NO: 2991769 - DNA, 22 bp, Homo sapiens
aacatgttgtacatttcaccat

SEQ ID NO: 2991770 - DNA, 17 bp, Homo sapiens
aacatgtttctctataa

SEQ ID NO: 2991771 - DNA, 23 bp, Homo sapiens
aacattagataattaaatagtga

SEQ ID NO: 2991772 - DNA, 20 bp, Homo sapiens
aacattagtatacgttttta

SEQ ID NO: 2991773 - DNA, 17 bp, Homo sapiens
aacattccaagactcta

SEQ ID NO: 2991774 - DNA, 17 bp, Homo sapiens
aacattctacttgctta

SEQ ID NO: 2991775 - DNA, 16 bp, Homo sapiens
aacattgaagtaatga

SEQ ID NO: 2991776 - DNA, 15 bp, Homo sapiens
aacattgatgaatga

SEQ ID NO: 2991777 - DNA, 18 bp, Homo sapiens
aacattgatgaatgagga

SEQ ID NO: 2991778 - DNA, 22 bp, Homo sapiens
aacattgcctttgaatgttaat

SEQ ID NO: 2991779 - DNA, 15 bp, Homo sapiens
aacattgtgatgtat

SEQ ID NO: 2991780 - DNA, 22 bp, Homo sapiens
aacattgtgatgtatattcctt

SEQ ID NO: 2991781 - DNA, 18 bp, Homo sapiens
aacatttaggagaagttg

SEQ ID NO: 2991782 - DNA, 19 bp, Homo sapiens
aacatttaggagaagttgg

SEQ ID NO: 2991783 - DNA, 22 bp, Homo sapiens
aacatttatatattgtctgtaa

SEQ ID NO: 2991784 - DNA, 22 bp, Homo sapiens
aacatttcaagggcaataccgt

SEQ ID NO: 2991785 - DNA, 12 bp, Homo sapiens
aacatttgtgat

SEQ ID NO: 2991786 - DNA, 15 bp, Homo sapiens
aacatttgtgtgtta

SEQ ID NO: 2991787 - DNA, 13 bp, Homo sapiens
aacattttaagtt

SEQ ID NO: 2991788 - DNA, 22 bp, Homo sapiens
aacattttgaaaacccctggct

SEQ ID NO: 2991789 - DNA, 18 bp, Homo sapiens
aaccaaagagtctctggc

SEQ ID NO: 2991790 - DNA, 19 bp, Homo sapiens
aaccaaagcgaattttaaa

SEQ ID NO: 2991791 - DNA, 20 bp, Homo sapiens
aaccaaagtacttttggtgt

SEQ ID NO: 2991792 - DNA, 20 bp, Homo sapiens
aaccaacccccatctcccta

SEQ ID NO: 2991793 - DNA, 15 bp, Homo sapiens
aaccaacctttctga

SEQ ID NO: 2991794 - DNA, 18 bp, Homo sapiens
aaccaacctttctgacat

SEQ ID NO: 2991795 - DNA, 20 bp, Homo sapiens
aaccaacctttctgacatca

SEQ ID NO: 2991796 - DNA, 15 bp, Homo sapiens
aaccaagagattgct

SEQ ID NO: 2991797 - DNA, 15 bp, Homo sapiens
aaccaagcctctgga

SEQ ID NO: 2991798 - DNA, 17 bp, Homo sapiens
aaccacctgatgacatg

SEQ ID NO: 2991799 - DNA, 14 bp, Homo sapiens
aaccacgcaggaag

SEQ ID NO: 2991800 - DNA, 22 bp, Homo sapiens
aaccacgtaccaagccaccgca

SEQ ID NO: 2991801 - DNA, 23 bp, Homo sapiens
aaccactgcaagtccttttgtaa

SEQ ID NO: 2991802 - DNA, 16 bp, Homo sapiens
aaccagaatccctcta

SEQ ID NO: 2991803 - DNA, 23 bp, Homo sapiens
aaccagatctagtcaatcaagtc

SEQ ID NO: 2991804 - DNA, 18 bp, Homo sapiens
aaccagcctcatgctctg

SEQ ID NO: 2991805 - DNA, 21 bp, Homo sapiens
aaccagcctcatgctctgatt

SEQ ID NO: 2991806 - DNA, 19 bp, Homo sapiens
aaccagctcagtgttttgg

SEQ ID NO: 2991807 - DNA, 16 bp, Homo sapiens
aaccaggggtaccagg

SEQ ID NO: 2991808 - DNA, 19 bp, Homo sapiens
aaccaggggtaccaggcac

SEQ ID NO: 2991809 - DNA, 19 bp, Homo sapiens
aaccagtcagctggccaga

SEQ ID NO: 2991810 - DNA, 15 bp, Homo sapiens
aaccagtttaaattg

SEQ ID NO: 2991811 - DNA, 16 bp, Homo sapiens
aaccagttttgctgct

SEQ ID NO: 2991812 - DNA, 23 bp, Homo sapiens
aaccataggactgtggcaaacaa

SEQ ID NO: 2991813 - DNA, 22 bp, Homo sapiens
aaccatagttatttacttgaaa

SEQ ID NO: 2991814 - DNA, 23 bp, Homo sapiens
aaccatagttatttacttgaaag

SEQ ID NO: 2991815 - DNA, 17 bp, Homo sapiens
aaccatcagaattcaga

SEQ ID NO: 2991816 - DNA, 23 bp, Homo sapiens
aaccatctttaatcaatgtgaca

SEQ ID NO: 2991817 - DNA, 22 bp, Homo sapiens
aaccatgctcttgttctgttcc

SEQ ID NO: 2991818 - DNA, 19 bp, Homo sapiens
aaccatgtgactaaaaatg

SEQ ID NO: 2991819 - DNA, 17 bp, Homo sapiens
aaccattaaccagatct

SEQ ID NO: 2991820 - DNA, 13 bp, Homo sapiens
aaccattggacag

SEQ ID NO: 2991821 - DNA, 16 bp, Homo sapiens
aaccattggacagatt

SEQ ID NO: 2991822 - DNA, 16 bp, Homo sapiens
aaccatttgttaactg

SEQ ID NO: 2991823 - DNA, 20 bp, Homo sapiens
aaccattttataaagtgctt

SEQ ID NO: 2991824 - DNA, 12 bp, Homo sapiens
aaccatttttga

SEQ ID NO: 2991825 - DNA, 16 bp, Homo sapiens
aacccaagcttagaac

SEQ ID NO: 2991826 - DNA, 14 bp, Homo sapiens
aacccacctgctga

SEQ ID NO: 2991827 - DNA, 12 bp, Homo sapiens
aacccactgccc

SEQ ID NO: 2991828 - DNA, 11 bp, Homo sapiens
aacccaggagg

SEQ ID NO: 2991829 - DNA, 12 bp, Homo sapiens
aacccaggaggt

SEQ ID NO: 2991830 - DNA, 13 bp, Homo sapiens
aacccagtggctg

SEQ ID NO: 2991831 - DNA, 15 bp, Homo sapiens
aacccagttgccatc

SEQ ID NO: 2991832 - DNA, 22 bp, Homo sapiens
aacccataggcccacacacagg

SEQ ID NO: 2991833 - DNA, 23 bp, Homo sapiens
aacccataggcccacacacaggt

SEQ ID NO: 2991834 - DNA, 20 bp, Homo sapiens
aacccatcaacaaaaattgt

SEQ ID NO: 2991835 - DNA, 19 bp, Homo sapiens
aaatggtagctgaaaaaac

SEQ ID NO: 2991836 - DNA, 14 bp, Homo sapiens
aaatggtccaggag

SEQ ID NO: 2991837 - DNA, 21 bp, Homo sapiens
aaatggtcctatttttgtgaa

SEQ ID NO: 2991838 - DNA, 14 bp, Homo sapiens
aaatgtaaaaaaca

SEQ ID NO: 2991839 - DNA, 16 bp, Homo sapiens
aaatgtaaaaaacaaa

SEQ ID NO: 2991840 - DNA, 17 bp, Homo sapiens
aaatgtaaaaaacaaaa

SEQ ID NO: 2991841 - DNA, 17 bp, Homo sapiens
aaatgtaacagtctgat

SEQ ID NO: 2991842 - DNA, 18 bp, Homo sapiens
aaatgtaactgtgccagt

SEQ ID NO: 2991843 - DNA, 22 bp, Homo sapiens
aaatgtaagatcgttctctgcc

SEQ ID NO: 2991844 - DNA, 18 bp, Homo sapiens
aaatgtaatgcgatttta

SEQ ID NO: 2991845 - DNA, 16 bp, Homo sapiens
aaatgtacagacatat

SEQ ID NO: 2991846 - DNA, 19 bp, Homo sapiens
aaatgtacagacatattta

SEQ ID NO: 2991847 - DNA, 15 bp, Homo sapiens
aaatgtactggtaat

SEQ ID NO: 2991848 - DNA, 22 bp, Homo sapiens
aaatgtactggtaattgtacaa

SEQ ID NO: 2991849 - DNA, 23 bp, Homo sapiens
aaatgtactggtaattgtacaat

SEQ ID NO: 2991850 - DNA, 17 bp, Homo sapiens
aaatgtattggcacagt

SEQ ID NO: 2991851 - DNA, 15 bp, Homo sapiens
aaatgtatttcctga

SEQ ID NO: 2991852 - DNA, 20 bp, Homo sapiens
aaatgtcagatacaatgtat

SEQ ID NO: 2991853 - DNA, 22 bp, Homo sapiens
aaatgtcagatacaatgtattt

SEQ ID NO: 2991854 - DNA, 14 bp, Homo sapiens
aaatgtctgtaaat

SEQ ID NO: 2991855 - DNA, 12 bp, Homo sapiens
aaatgtcttgct

SEQ ID NO: 2991856 - DNA, 22 bp, Homo sapiens
aaatgtcttgctgttgacatat

SEQ ID NO: 2991857 - DNA, 12 bp, Homo sapiens
aaatgtgaaatt

SEQ ID NO: 2991858 - DNA, 15 bp, Homo sapiens
aaatgtgaaattttt

SEQ ID NO: 2991859 - DNA, 12 bp, Homo sapiens
aaatgtgaattt

SEQ ID NO: 2991860 - DNA, 23 bp, Homo sapiens
aaatgtgtcccagtgaacagttt

SEQ ID NO: 2991861 - DNA, 14 bp, Homo sapiens
aaatgttagttcta

SEQ ID NO: 2991862 - DNA, 20 bp, Homo sapiens
aaatgttatcttatactgta

SEQ ID NO: 2991863 - DNA, 21 bp, Homo sapiens
aaatgttatcttatactgtac

SEQ ID NO: 2991864 - DNA, 22 bp, Homo sapiens
aaatgttcacttcgaaattctg

SEQ ID NO: 2991865 - DNA, 14 bp, Homo sapiens
aaatgttctaagtt

SEQ ID NO: 2991866 - DNA, 17 bp, Homo sapiens
aaatgttctaagtttct

SEQ ID NO: 2991867 - DNA, 19 bp, Homo sapiens
aaatgttctaagtttctaa

SEQ ID NO: 2991868 - DNA, 16 bp, Homo sapiens
aaatgtttactataga

SEQ ID NO: 2991869 - DNA, 14 bp, Homo sapiens
aaatgtttactgta

SEQ ID NO: 2991870 - DNA, 15 bp, Homo sapiens
aaatgtttactgtaa

SEQ ID NO: 2991871 - DNA, 17 bp, Homo sapiens
aaatgtttactgtaaat

SEQ ID NO: 2991872 - DNA, 18 bp, Homo sapiens
aaatgtttactgtaaatt

SEQ ID NO: 2991873 - DNA, 20 bp, Homo sapiens
aaatgtttatgttttcaact

SEQ ID NO: 2991874 - DNA, 16 bp, Homo sapiens
aaatgtttctgtgtca

SEQ ID NO: 2991875 - DNA, 12 bp, Homo sapiens
aaatgtttggaa

SEQ ID NO: 2991876 - DNA, 13 bp, Homo sapiens
aaatgtttggaaa

SEQ ID NO: 2991877 - DNA, 18 bp, Homo sapiens
aaatgttttagcaattta

SEQ ID NO: 2991878 - DNA, 21 bp, Homo sapiens
aaatgttttctgcagaaaaaa

SEQ ID NO: 2991879 - DNA, 22 bp, Homo sapiens
aaatgttttctgcagaaaaaaa

SEQ ID NO: 2991880 - DNA, 17 bp, Homo sapiens
aaattaaaaaagctgct

SEQ ID NO: 2991881 - DNA, 14 bp, Homo sapiens
aaattaaaatggat

SEQ ID NO: 2991882 - DNA, 15 bp, Homo sapiens
aaattaaagtgctgt

SEQ ID NO: 2991883 - DNA, 17 bp, Homo sapiens
aaattaaattctctcta

SEQ ID NO: 2991884 - DNA, 21 bp, Homo sapiens
aaattaaattctctctaacat

SEQ ID NO: 2991885 - DNA, 20 bp, Homo sapiens
aaattaactcactatggttt

SEQ ID NO: 2991886 - DNA, 14 bp, Homo sapiens
aaattaagaaggca

SEQ ID NO: 2991887 - DNA, 23 bp, Homo sapiens
aaattaatatttgtgctttgaaa

SEQ ID NO: 2991888 - DNA, 15 bp, Homo sapiens
aaattaattcctatc

SEQ ID NO: 2991889 - DNA, 17 bp, Homo sapiens
aaattaattgaatctag

SEQ ID NO: 2991890 - DNA, 18 bp, Homo sapiens
aaattaatttgttaatta

SEQ ID NO: 2991891 - DNA, 23 bp, Homo sapiens
aaattaatttgttaattaaatat

SEQ ID NO: 2991892 - DNA, 15 bp, Homo sapiens
aaattacaaaagaga

SEQ ID NO: 2991893 - DNA, 19 bp, Homo sapiens
aaattacaaagaaaataat

SEQ ID NO: 2991894 - DNA, 16 bp, Homo sapiens
aaattacaattttatc

SEQ ID NO: 2991895 - DNA, 16 bp, Homo sapiens
aaattacactttattc

SEQ ID NO: 2991896 - DNA, 18 bp, Homo sapiens
aaattacactttattctt

SEQ ID NO: 2991897 - DNA, 20 bp, Homo sapiens
aaattagaaacaccattcat

SEQ ID NO: 2991898 - DNA, 20 bp, Homo sapiens
aaattagacaaatgctacat

SEQ ID NO: 2991899 - DNA, 15 bp, Homo sapiens
aaattaggaataaat

SEQ ID NO: 2991900 - DNA, 23 bp, Homo sapiens
aaattagtgtacctattaaaagt

SEQ ID NO: 2991901 - DNA, 17 bp, Homo sapiens
aaattatagcttttaag

SEQ ID NO: 2991902 - DNA, 17 bp, Homo sapiens
aaattatagtagcttat

SEQ ID NO: 2991903 - DNA, 14 bp, Homo sapiens
aaattatatagcaa

SEQ ID NO: 2991904 - DNA, 18 bp, Homo sapiens
aaattatatttgtgctat

SEQ ID NO: 2991905 - DNA, 22 bp, Homo sapiens
aaattatatttgtgctatagta

SEQ ID NO: 2991906 - DNA, 18 bp, Homo sapiens
aaattatgaatattaaag

SEQ ID NO: 2991907 - DNA, 17 bp, Homo sapiens
aaattatgagatttttt

SEQ ID NO: 2991908 - DNA, 14 bp, Homo sapiens
aaattattaatgaa

SEQ ID NO: 2991909 - DNA, 21 bp, Homo sapiens
aaattatttttaaaagaaaaa

SEQ ID NO: 2991910 - DNA, 17 bp, Homo sapiens
aaattccaagtgattga

SEQ ID NO: 2991911 - DNA, 12 bp, Homo sapiens
aaattccatgtt

SEQ ID NO: 2991912 - DNA, 18 bp, Homo sapiens
aaattcctctttgctttg

SEQ ID NO: 2991913 - DNA, 19 bp, Homo sapiens
aaattcgcatgtttaatgt

SEQ ID NO: 2991914 - DNA, 21 bp, Homo sapiens
aaattcgctgcaacctgttga

SEQ ID NO: 2991915 - DNA, 14 bp, Homo sapiens
aaattctaaatgta

SEQ ID NO: 2991916 - DNA, 17 bp, Homo sapiens
aaattctactaagttat

SEQ ID NO: 2991917 - DNA, 23 bp, Homo sapiens
aaattctactaagttattttatg

SEQ ID NO: 2991918 - DNA, 23 bp, Homo sapiens
aaattctctcctaatgatgactt

SEQ ID NO: 2991919 - DNA, 12 bp, Homo sapiens
aaattctcttct

SEQ ID NO: 2991920 - DNA, 14 bp, Homo sapiens
aaattctgaatttg

SEQ ID NO: 2991921 - DNA, 18 bp, Homo sapiens
aaattctgaatttgcaaa

SEQ ID NO: 2991922 - DNA, 20 bp, Homo sapiens
aaattctgaatttgcaaagt

SEQ ID NO: 2991923 - DNA, 13 bp, Homo sapiens
aaattctgtttct

SEQ ID NO: 2991924 - DNA, 23 bp, Homo sapiens
aaattcttaatttggatctattt

SEQ ID NO: 2991925 - DNA, 21 bp, Homo sapiens
aaattcttggttattctgcca

SEQ ID NO: 2991926 - DNA, 20 bp, Homo sapiens
aaattgaaaggcattctctg

SEQ ID NO: 2991927 - DNA, 23 bp, Homo sapiens
aaattgaataatggtaccagata

SEQ ID NO: 2991928 - DNA, 21 bp, Homo sapiens
aaattgagacagtgcacatga

SEQ ID NO: 2991929 - DNA, 18 bp, Homo sapiens
aaattgagcttgcttctt

SEQ ID NO: 2991930 - DNA, 14 bp, Homo sapiens
aaattgcatttcta

SEQ ID NO: 2991931 - DNA, 15 bp, Homo sapiens
aaattgcatttctat

SEQ ID NO: 2991932 - DNA, 20 bp, Homo sapiens
aaattgcctatcctgctgtt

SEQ ID NO: 2991933 - DNA, 14 bp, Homo sapiens
aaattgcctttaaa

SEQ ID NO: 2991934 - DNA, 15 bp, Homo sapiens
aaattgggaaaggag

SEQ ID NO: 2991935 - DNA, 20 bp, Homo sapiens
aaattgggaaaggagtagaa

SEQ ID NO: 2991936 - DNA, 20 bp, Homo sapiens
aaattggttttgtactggat

SEQ ID NO: 2991937 - DNA, 15 bp, Homo sapiens
aaattgtaccttttt

SEQ ID NO: 2991938 - DNA, 20 bp, Homo sapiens
aaattgtagctttttattaa

SEQ ID NO: 2991939 - DNA, 12 bp, Homo sapiens
aaatttaatgta

SEQ ID NO: 2991940 - DNA, 18 bp, Homo sapiens
aaatttaattcatgtttc

SEQ ID NO: 2991941 - DNA, 17 bp, Homo sapiens
aaatttacatttaatac

SEQ ID NO: 2991942 - DNA, 17 bp, Homo sapiens
aaatttactgtcttaaa

SEQ ID NO: 2991943 - DNA, 20 bp, Homo sapiens
aaatttattctacttttaaa

SEQ ID NO: 2991944 - DNA, 17 bp, Homo sapiens
aaatttcagcagctgca

SEQ ID NO: 2991945 - DNA, 17 bp, Homo sapiens
aaatttccccaacagtg

SEQ ID NO: 2991946 - DNA, 10 bp, Homo sapiens
aaatttgaat

SEQ ID NO: 2991947 - DNA, 14 bp, Homo sapiens
aaatttgaataatt

SEQ ID NO: 2991948 - DNA, 17 bp, Homo sapiens
aaatttgactaatttta

SEQ ID NO: 2991949 - DNA, 18 bp, Homo sapiens
aaatttgactaattttac

SEQ ID NO: 2991950 - DNA, 11 bp, Homo sapiens
aaatttgtaga

SEQ ID NO: 2991951 - DNA, 12 bp, Homo sapiens
aaatttgtagaa

SEQ ID NO: 2991952 - DNA, 19 bp, Homo sapiens
aaatttgttattttgcaac

SEQ ID NO: 2991953 - DNA, 14 bp, Homo sapiens
aaatttgttgcata

SEQ ID NO: 2991954 - DNA, 13 bp, Homo sapiens
aaattttcagcat

SEQ ID NO: 2991955 - DNA, 15 bp, Homo sapiens
aaattttctccagtc

SEQ ID NO: 2991956 - DNA, 12 bp, Homo sapiens
aaattttctttt

SEQ ID NO: 2991957 - DNA, 17 bp, Homo sapiens
aaattttgaggtctttt

SEQ ID NO: 2991958 - DNA, 21 bp, Homo sapiens
aaattttgctatcaacaataa

SEQ ID NO: 2991959 - DNA, 20 bp, Homo sapiens
aaattttgtgcaaaaaggac

SEQ ID NO: 2991960 - DNA, 22 bp, Homo sapiens
aaattttgtgcaaaaaggactg

SEQ ID NO: 2991961 - DNA, 16 bp, Homo sapiens
aaatttttccacacta

SEQ ID NO: 2991962 - DNA, 13 bp, Homo sapiens
aaatttttgcaaa

SEQ ID NO: 2991963 - DNA, 14 bp, Homo sapiens
aaatttttgcaaat

SEQ ID NO: 2991964 - DNA, 14 bp, Homo sapiens
aaatttttgtaaat

SEQ ID NO: 2991965 - DNA, 13 bp, Homo sapiens
aaattttttgaaa

SEQ ID NO: 2991966 - DNA, 14 bp, Homo sapiens
aaatttttttggtc

SEQ ID NO: 2991967 - DNA, 12 bp, Homo sapiens
aacaaaaactat

SEQ ID NO: 2991968 - DNA, 16 bp, Homo sapiens
aagtcaaaaggaacaa

SEQ ID NO: 2991969 - DNA, 16 bp, Homo sapiens
aagtcaaaaggtgcct

SEQ ID NO: 2991970 - DNA, 18 bp, Homo sapiens
aagtcaaaatatttttaa

SEQ ID NO: 2991971 - DNA, 16 bp, Homo sapiens
aagtcaaataaatgtt

SEQ ID NO: 2991972 - DNA, 19 bp, Homo sapiens
aagtcaaataaatgtttcc

SEQ ID NO: 2991973 - DNA, 16 bp, Homo sapiens
aagtcaaccaatgtag

SEQ ID NO: 2991974 - DNA, 16 bp, Homo sapiens
aagtcaacctgcctga

SEQ ID NO: 2991975 - DNA, 18 bp, Homo sapiens
aagtcagaatttttaact

SEQ ID NO: 2991976 - DNA, 18 bp, Homo sapiens
aagtcagagaaaacactt

SEQ ID NO: 2991977 - DNA, 16 bp, Homo sapiens
aagtcaggacctggct

SEQ ID NO: 2991978 - DNA, 15 bp, Homo sapiens
aagtcaggtccaatt

SEQ ID NO: 2991979 - DNA, 14 bp, Homo sapiens
aagtcaggtggggt

SEQ ID NO: 2991980 - DNA, 20 bp, Homo sapiens
aagtcagtgcccaactgtta

SEQ ID NO: 2991981 - DNA, 21 bp, Homo sapiens
aagtcagtgcccaactgttat

SEQ ID NO: 2991982 - DNA, 18 bp, Homo sapiens
aagtcagtgggaacgtga

SEQ ID NO: 2991983 - DNA, 21 bp, Homo sapiens
aagtcatctatagttgatatg

SEQ ID NO: 2991984 - DNA, 12 bp, Homo sapiens
aagtccaatgtg

SEQ ID NO: 2991985 - DNA, 18 bp, Homo sapiens
aagtccaattttaattta

SEQ ID NO: 2991986 - DNA, 19 bp, Homo sapiens
aagtccaattttaatttag

SEQ ID NO: 2991987 - DNA, 17 bp, Homo sapiens
aagtccagctttctgca

SEQ ID NO: 2991988 - DNA, 14 bp, Homo sapiens
aagtccccaggccc

SEQ ID NO: 2991989 - DNA, 23 bp, Homo sapiens
aagtccccaggccccaggaagcc

SEQ ID NO: 2991990 - DNA, 16 bp, Homo sapiens
aagtttttactagaaa

SEQ ID NO: 2991991 - DNA, 13 bp, Homo sapiens
aagtttttctctt

SEQ ID NO: 2991992 - DNA, 17 bp, Homo sapiens
aagtttttctctttttc

SEQ ID NO: 2991993 - DNA, 15 bp, Homo sapiens
aagtttttgaaatac

SEQ ID NO: 2991994 - DNA, 17 bp, Homo sapiens
aagtttttgaaatacct

SEQ ID NO: 2991995 - DNA, 19 bp, Homo sapiens
aataaaaaacaagaaacca

SEQ ID NO: 2991996 - DNA, 14 bp, Homo sapiens
aataaaaaattatg

SEQ ID NO: 2991997 - DNA, 23 bp, Homo sapiens
aataaaaacattgcctttgaatg

SEQ ID NO: 2991998 - DNA, 22 bp, Homo sapiens
aataaaaaccaagaagatgtct

SEQ ID NO: 2991999 - DNA, 11 bp, Homo sapiens
aataaaaaggc

SEQ ID NO: 2992000 - DNA, 22 bp, Homo sapiens
aataaaaagggcagccctcctt

SEQ ID NO: 2992001 - DNA, 14 bp, Homo sapiens
aataaaaagttaaa

SEQ ID NO: 2992002 - DNA, 12 bp, Homo sapiens
aataaaaatcaa

SEQ ID NO: 2992003 - DNA, 14 bp, Homo sapiens
aataaaacaaaggg

SEQ ID NO: 2992004 - DNA, 17 bp, Homo sapiens
aataaaacataatagaa

SEQ ID NO: 2992005 - DNA, 22 bp, Homo sapiens
aataaaagatagcaatatgaga

SEQ ID NO: 2992006 - DNA, 16 bp, Homo sapiens
aataaaagatataaat

SEQ ID NO: 2992007 - DNA, 20 bp, Homo sapiens
aataaaaggaagccaaagag

SEQ ID NO: 2992008 - DNA, 23 bp, Homo sapiens
aataaaagttcctctcccttccc

SEQ ID NO: 2992009 - DNA, 13 bp, Homo sapiens
aataaaatgttta

SEQ ID NO: 2992010 - DNA, 15 bp, Homo sapiens
aataaaattaatgaa

SEQ ID NO: 2992011 - DNA, 16 bp, Homo sapiens
aataaaattacacagt

SEQ ID NO: 2992012 - DNA, 16 bp, Homo sapiens
aataaaattcatttct

SEQ ID NO: 2992013 - DNA, 12 bp, Homo sapiens
aataaaatttgt

SEQ ID NO: 2992014 - DNA, 13 bp, Homo sapiens
aataaaatttgtt

SEQ ID NO: 2992015 - DNA, 18 bp, Homo sapiens
aataaaattttttttcat

SEQ ID NO: 2992016 - DNA, 13 bp, Homo sapiens
aataaaccaaata

SEQ ID NO: 2992017 - DNA, 14 bp, Homo sapiens
aataaactagggtt

SEQ ID NO: 2992018 - DNA, 10 bp, Homo sapiens
aataaactgg

SEQ ID NO: 2992019 - DNA, 19 bp, Homo sapiens
aataaacttagaggaaaat

SEQ ID NO: 2992020 - DNA, 12 bp, Homo sapiens
aataaagacagg

SEQ ID NO: 2992021 - DNA, 15 bp, Homo sapiens
aataaagcactattg

SEQ ID NO: 2992022 - DNA, 18 bp, Homo sapiens
aataaagcactattgttt

SEQ ID NO: 2992023 - DNA, 11 bp, Homo sapiens
aataaagccct

SEQ ID NO: 2992024 - DNA, 22 bp, Homo sapiens
aataaagctgttctcattcctg

SEQ ID NO: 2992025 - DNA, 13 bp, Homo sapiens
aataaagtctatt

SEQ ID NO: 2992026 - DNA, 12 bp, Homo sapiens
aataaagtgtat

SEQ ID NO: 2992027 - DNA, 14 bp, Homo sapiens
aataaataaaagcc

SEQ ID NO: 2992028 - DNA, 13 bp, Homo sapiens
aataaataaataa

SEQ ID NO: 2992029 - DNA, 14 bp, Homo sapiens
aataaatagagcaa

SEQ ID NO: 2992030 - DNA, 20 bp, Homo sapiens
aataaatatgcctctccttt

SEQ ID NO: 2992031 - DNA, 17 bp, Homo sapiens
aataaatctgacccagt

SEQ ID NO: 2992032 - DNA, 20 bp, Homo sapiens
aataaatctgacccagtgcc

SEQ ID NO: 2992033 - DNA, 14 bp, Homo sapiens
aataaatgtttcaa

SEQ ID NO: 2992034 - DNA, 15 bp, Homo sapiens
aataaatgtttcaaa

SEQ ID NO: 2992035 - DNA, 21 bp, Homo sapiens
aataaattaatattgtattgc

SEQ ID NO: 2992036 - DNA, 16 bp, Homo sapiens
aataaattatgaatat

SEQ ID NO: 2992037 - DNA, 18 bp, Homo sapiens
aataaatttatatgaaaa

SEQ ID NO: 2992038 - DNA, 15 bp, Homo sapiens
aataacaaagccctt

SEQ ID NO: 2992039 - DNA, 21 bp, Homo sapiens
aataacaatgaaagttgataa

SEQ ID NO: 2992040 - DNA, 21 bp, Homo sapiens
aataactatataagacattaa

SEQ ID NO: 2992041 - DNA, 13 bp, Homo sapiens
aataactgaacca

SEQ ID NO: 2992042 - DNA, 21 bp, Homo sapiens
aataactgaaccaaattgcac

SEQ ID NO: 2992043 - DNA, 11 bp, Homo sapiens
aataacttcta

SEQ ID NO: 2992044 - DNA, 18 bp, Homo sapiens
aataacttctatatttta

SEQ ID NO: 2992045 - DNA, 22 bp, Homo sapiens
aataagaaacaactctttgaga

SEQ ID NO: 2992046 - DNA, 13 bp, Homo sapiens
aataagaatagaa

SEQ ID NO: 2992047 - DNA, 18 bp, Homo sapiens
aataagaatagaaataaa

SEQ ID NO: 2992048 - DNA, 17 bp, Homo sapiens
aataagactcttaccta

SEQ ID NO: 2992049 - DNA, 22 bp, Homo sapiens
aataagagtctccttctcttct

SEQ ID NO: 2992050 - DNA, 14 bp, Homo sapiens
aataagattctaac

SEQ ID NO: 2992051 - DNA, 14 bp, Homo sapiens
aataagcaggatgt

SEQ ID NO: 2992052 - DNA, 21 bp, Homo sapiens
aataaggacaagcctaacttc

SEQ ID NO: 2992053 - DNA, 21 bp, Homo sapiens
aataagtcaaaaggaacaaaa

SEQ ID NO: 2992054 - DNA, 15 bp, Homo sapiens
aataagttaaaggca

SEQ ID NO: 2992055 - DNA, 11 bp, Homo sapiens
aataagttatt

SEQ ID NO: 2992056 - DNA, 14 bp, Homo sapiens
aataagttattgca

SEQ ID NO: 2992057 - DNA, 13 bp, Homo sapiens
aataagtttttct

SEQ ID NO: 2992058 - DNA, 17 bp, Homo sapiens
aataagtttttctttaa

SEQ ID NO: 2992059 - DNA, 13 bp, Homo sapiens
aataataaaatac

SEQ ID NO: 2992060 - DNA, 13 bp, Homo sapiens
aataataaaatca

SEQ ID NO: 2992061 - DNA, 14 bp, Homo sapiens
aataataaagatgt

SEQ ID NO: 2992062 - DNA, 15 bp, Homo sapiens
aataataaagtactt

SEQ ID NO: 2992063 - DNA, 19 bp, Homo sapiens
aataataaagtacttgact

SEQ ID NO: 2992064 - DNA, 12 bp, Homo sapiens
aataataataat

SEQ ID NO: 2992065 - DNA, 22 bp, Homo sapiens
aataatatccaggtcaacagaa

SEQ ID NO: 2992066 - DNA, 14 bp, Homo sapiens
aataatcaagattt

SEQ ID NO: 2992067 - DNA, 18 bp, Homo sapiens
aataatcaagattttagg

SEQ ID NO: 2992068 - DNA, 15 bp, Homo sapiens
aataatcatgtgaaa

SEQ ID NO: 2992069 - DNA, 12 bp, Homo sapiens
aataatccattt

SEQ ID NO: 2992070 - DNA, 18 bp, Homo sapiens
aataatccattttcacta

SEQ ID NO: 2992071 - DNA, 21 bp, Homo sapiens
aataatcctaaacatatgaat

SEQ ID NO: 2992072 - DNA, 13 bp, Homo sapiens
aataatcggccca

SEQ ID NO: 2992073 - DNA, 22 bp, Homo sapiens
aataatgcagtatggtacattt

SEQ ID NO: 2992074 - DNA, 15 bp, Homo sapiens
aataatgcttaataa

SEQ ID NO: 2992075 - DNA, 15 bp, Homo sapiens
aataatggaaaaaaa

SEQ ID NO: 2992076 - DNA, 20 bp, Homo sapiens
aataatggtaccagataaaa

SEQ ID NO: 2992077 - DNA, 15 bp, Homo sapiens
aataatgtaacatga

SEQ ID NO: 2992078 - DNA, 16 bp, Homo sapiens
aataatgtaacatgat

SEQ ID NO: 2992079 - DNA, 18 bp, Homo sapiens
aataatgtaacatgattt

SEQ ID NO: 2992080 - DNA, 14 bp, Homo sapiens
aataattattatta

SEQ ID NO: 2992081 - DNA, 21 bp, Homo sapiens
aataattgtggttgtgttctt

SEQ ID NO: 2992082 - DNA, 16 bp, Homo sapiens
aataatttaagttggc

SEQ ID NO: 2992083 - DNA, 13 bp, Homo sapiens
aataatttatagt

SEQ ID NO: 2992084 - DNA, 13 bp, Homo sapiens
aataattttaaaa

SEQ ID NO: 2992085 - DNA, 18 bp, Homo sapiens
aataattttctagtatgt

SEQ ID NO: 2992086 - DNA, 14 bp, Homo sapiens
aatacaaaaatttg

SEQ ID NO: 2992087 - DNA, 14 bp, Homo sapiens
aatacaaatctgta

SEQ ID NO: 2992088 - DNA, 15 bp, Homo sapiens
aatacaattattgta

SEQ ID NO: 2992089 - DNA, 22 bp, Homo sapiens
aatacacatctctgtcagtgtg

SEQ ID NO: 2992090 - DNA, 12 bp, Homo sapiens
aatacacatttc

SEQ ID NO: 2992091 - DNA, 16 bp, Homo sapiens
aatacacatttcacat

SEQ ID NO: 2992092 - DNA, 14 bp, Homo sapiens
aatacagcagcaag

SEQ ID NO: 2992093 - DNA, 20 bp, Homo sapiens
aatacagcctgaataaacca

SEQ ID NO: 2992094 - DNA, 16 bp, Homo sapiens
aatacagtacaggcag

SEQ ID NO: 2992095 - DNA, 17 bp, Homo sapiens
aatacagtacaggcagc

SEQ ID NO: 2992096 - DNA, 17 bp, Homo sapiens
aatacagttctgtcata

SEQ ID NO: 2992097 - DNA, 21 bp, Homo sapiens
aatacagtttataaagccaag

SEQ ID NO: 2992098 - DNA, 22 bp, Homo sapiens
aatacagtttataaagccaaga

SEQ ID NO: 2992099 - DNA, 18 bp, Homo sapiens
aatacataaaacaaaagc

SEQ ID NO: 2992100 - DNA, 20 bp, Homo sapiens
aatacatcctttttctgcta

SEQ ID NO: 2992101 - DNA, 23 bp, Homo sapiens
aataccattttttaaggaaacaa

SEQ ID NO: 2992102 - DNA, 18 bp, Homo sapiens
aatacctacaataaactg

SEQ ID NO: 2992103 - DNA, 15 bp, Homo sapiens
aatacctctgtgtgc

SEQ ID NO: 2992104 - DNA, 13 bp, Homo sapiens
aatacctttgtag

SEQ ID NO: 2992105 - DNA, 22 bp, Homo sapiens
aatacctttgtagttactcaag

SEQ ID NO: 2992106 - DNA, 14 bp, Homo sapiens
aatactaccttgaa

SEQ ID NO: 2992107 - DNA, 17 bp, Homo sapiens
aatactaccttgaaaat

SEQ ID NO: 2992108 - DNA, 21 bp, Homo sapiens
aatactaccttgaaaataaga

SEQ ID NO: 2992109 - DNA, 17 bp, Homo sapiens
aatactcataatgtgaa

SEQ ID NO: 2992110 - DNA, 18 bp, Homo sapiens
aatactcataatgtgaag

SEQ ID NO: 2992111 - DNA, 15 bp, Homo sapiens
accctgggcctggag

SEQ ID NO: 2992112 - DNA, 22 bp, Homo sapiens
accctgggcctggcagctcagc

SEQ ID NO: 2992113 - DNA, 22 bp, Homo sapiens
accctgggggcacaggaggcag

SEQ ID NO: 2992114 - DNA, 17 bp, Homo sapiens
accctggtggttgctgt

SEQ ID NO: 2992115 - DNA, 22 bp, Homo sapiens
accctgtgcaattcagtctgct

SEQ ID NO: 2992116 - DNA, 14 bp, Homo sapiens
accctgtggctcac

SEQ ID NO: 2992117 - DNA, 19 bp, Homo sapiens
accctgtttggatttttaa

SEQ ID NO: 2992118 - DNA, 13 bp, Homo sapiens
acccttacagtag

SEQ ID NO: 2992119 - DNA, 13 bp, Homo sapiens
acccttagcagcc

SEQ ID NO: 2992120 - DNA, 16 bp, Homo sapiens
acccttagcagcccag

SEQ ID NO: 2992121 - DNA, 21 bp, Homo sapiens
acccttcaacgtttcttcact

SEQ ID NO: 2992122 - DNA, 13 bp, Homo sapiens
acccttccctgcc

SEQ ID NO: 2992123 - DNA, 13 bp, Homo sapiens
acccttcctcatc

SEQ ID NO: 2992124 - DNA, 14 bp, Homo sapiens
acccttcctcatct

SEQ ID NO: 2992125 - DNA, 18 bp, Homo sapiens
acccttcctcatctgtgc

SEQ ID NO: 2992126 - DNA, 19 bp, Homo sapiens
acccttcctcatctgtgcc

SEQ ID NO: 2992127 - DNA, 24 bp, Homo sapiens
acccttcctcatctgtgcctgtct

SEQ ID NO: 2992128 - DNA, 17 bp, Homo sapiens
acccttcctggcccagg

SEQ ID NO: 2992129 - DNA, 16 bp, Homo sapiens
acccttctccaaaggc

SEQ ID NO: 2992130 - DNA, 15 bp, Homo sapiens
acccttctcctcttg

SEQ ID NO: 2992131 - DNA, 23 bp, Homo sapiens
acccttctcctcttgtaaataaa

SEQ ID NO: 2992132 - DNA, 13 bp, Homo sapiens
acccttctgcttt

SEQ ID NO: 2992133 - DNA, 15 bp, Homo sapiens
acccttctgctttct

SEQ ID NO: 2992134 - DNA, 19 bp, Homo sapiens
accctttaagatatccatc

SEQ ID NO: 2992135 - DNA, 23 bp, Homo sapiens
accctttccttccttccctggct

SEQ ID NO: 2992136 - DNA, 22 bp, Homo sapiens
accctttctgtttggacccatg

SEQ ID NO: 2992137 - DNA, 13 bp, Homo sapiens
acccttttaacat

SEQ ID NO: 2992138 - DNA, 16 bp, Homo sapiens
accgaccccgggccgg

SEQ ID NO: 2992139 - DNA, 16 bp, Homo sapiens
accgacccgaggccca

SEQ ID NO: 2992140 - DNA, 20 bp, Homo sapiens
accgacccgaggcccagatc

SEQ ID NO: 2992141 - DNA, 16 bp, Homo sapiens
accgagctctgtggga

SEQ ID NO: 2992142 - DNA, 13 bp, Homo sapiens
accgatgctttac

SEQ ID NO: 2992143 - DNA, 14 bp, Homo sapiens
accgatggtcccag

SEQ ID NO: 2992144 - DNA, 16 bp, Homo sapiens
accgcagcctgtcagc

SEQ ID NO: 2992145 - DNA, 14 bp, Homo sapiens
accgcagctgctgc

SEQ ID NO: 2992146 - DNA, 16 bp, Homo sapiens
accgcagctgctgcca

SEQ ID NO: 2992147 - DNA, 18 bp, Homo sapiens
accgcagctgctgccact

SEQ ID NO: 2992148 - DNA, 12 bp, Homo sapiens
accgcaggaagc

SEQ ID NO: 2992149 - DNA, 20 bp, Homo sapiens
accgcatggcagctgggccc

SEQ ID NO: 2992150 - DNA, 14 bp, Homo sapiens
accgccagcagcgc

SEQ ID NO: 2992151 - DNA, 20 bp, Homo sapiens
accgccccaaagtaaaagaa

SEQ ID NO: 2992152 - DNA, 15 bp, Homo sapiens
accgcccgtctgtgt

SEQ ID NO: 2992153 - DNA, 17 bp, Homo sapiens
accgccctgcgggccac

SEQ ID NO: 2992154 - DNA, 16 bp, Homo sapiens
accgcctcctgctctg

SEQ ID NO: 2992155 - DNA, 15 bp, Homo sapiens
accgcctcgtgccag

SEQ ID NO: 2992156 - DNA, 21 bp, Homo sapiens
accgcctcgtgccagcagcct

SEQ ID NO: 2992157 - DNA, 22 bp, Homo sapiens
accgcctcgtgccagcagcctc

SEQ ID NO: 2992158 - DNA, 22 bp, Homo sapiens
accgcctgccctcccgcacctt

SEQ ID NO: 2992159 - DNA, 20 bp, Homo sapiens
accgcgactaatttcaaaat

SEQ ID NO: 2992160 - DNA, 19 bp, Homo sapiens
accgctgcctaagtggctg

SEQ ID NO: 2992161 - DNA, 20 bp, Homo sapiens
accgctgcctaagtggctgc

SEQ ID NO: 2992162 - DNA, 21 bp, Homo sapiens
accgctgcctaagtggctgct

SEQ ID NO: 2992163 - DNA, 17 bp, Homo sapiens
accgctttggcctgagt

SEQ ID NO: 2992164 - DNA, 14 bp, Homo sapiens
accggatcctgggt

SEQ ID NO: 2992165 - DNA, 16 bp, Homo sapiens
accggatcctgggtgg

SEQ ID NO: 2992166 - DNA, 13 bp, Homo sapiens
accgggacccgag

SEQ ID NO: 2992167 - DNA, 15 bp, Homo sapiens
accgggcactcccgg

SEQ ID NO: 2992168 - DNA, 21 bp, Homo sapiens
accgggcactcccgggatggg

SEQ ID NO: 2992169 - DNA, 12 bp, Homo sapiens
accgggctgcag

SEQ ID NO: 2992170 - DNA, 18 bp, Homo sapiens
accggggaccgggacccg

SEQ ID NO: 2992171 - DNA, 19 bp, Homo sapiens
accggggcctgggcaggag

SEQ ID NO: 2992172 - DNA, 13 bp, Homo sapiens
accggtacagaaa

SEQ ID NO: 2992173 - DNA, 19 bp, Homo sapiens
accgtcctttcacacatct

SEQ ID NO: 2992174 - DNA, 21 bp, Homo sapiens
accgtgccattgtactccagc

SEQ ID NO: 2992175 - DNA, 22 bp, Homo sapiens
accgtgccattgtactccagcc

SEQ ID NO: 2992176 - DNA, 20 bp, Homo sapiens
accgtgcccggctaattttt

SEQ ID NO: 2992177 - DNA, 19 bp, Homo sapiens
accgtggcctgggcttggc

SEQ ID NO: 2992178 - DNA, 18 bp, Homo sapiens
accgtgggcagggagcgg

SEQ ID NO: 2992179 - DNA, 21 bp, Homo sapiens
accgtgttggttttgactgga

SEQ ID NO: 2992180 - DNA, 12 bp, Homo sapiens
accgtttttcaa

SEQ ID NO: 2992181 - DNA, 14 bp, Homo sapiens
accgtttttcaaga

SEQ ID NO: 2992182 - DNA, 18 bp, Homo sapiens
acctaacccctttcctgc

SEQ ID NO: 2992183 - DNA, 12 bp, Homo sapiens
acctaactgtat

SEQ ID NO: 2992184 - DNA, 15 bp, Homo sapiens
acctaactgtatctt

SEQ ID NO: 2992185 - DNA, 15 bp, Homo sapiens
acctaagggacatgt

SEQ ID NO: 2992186 - DNA, 16 bp, Homo sapiens
acctaagggacatgtt

SEQ ID NO: 2992187 - DNA, 17 bp, Homo sapiens
acctaatacccagttta

SEQ ID NO: 2992188 - DNA, 22 bp, Homo sapiens
acctaatccaggcagatccagg

SEQ ID NO: 2992189 - DNA, 17 bp, Homo sapiens
acctacaataaactggt

SEQ ID NO: 2992190 - DNA, 18 bp, Homo sapiens
acctacaataaactggta

SEQ ID NO: 2992191 - DNA, 16 bp, Homo sapiens
acctacacactgtcat

SEQ ID NO: 2992192 - DNA, 24 bp, Homo sapiens
acctacctgttgagcatcacagaa

SEQ ID NO: 2992193 - DNA, 17 bp, Homo sapiens
acctacgtttgcaccgc

SEQ ID NO: 2992194 - DNA, 21 bp, Homo sapiens
acctacgtttgcaccgcctgc

SEQ ID NO: 2992195 - DNA, 23 bp, Homo sapiens
acctactgcccaggcactgcaaa

SEQ ID NO: 2992196 - DNA, 18 bp, Homo sapiens
acctactgttctaaagct

SEQ ID NO: 2992197 - DNA, 20 bp, Homo sapiens
acctactgttctaaagctct

SEQ ID NO: 2992198 - DNA, 22 bp, Homo sapiens
acctagaaattgacacaagtgg

SEQ ID NO: 2992199 - DNA, 19 bp, Homo sapiens
acctagaagtaagaagagg

SEQ ID NO: 2992200 - DNA, 18 bp, Homo sapiens
acctagagtatacctgtg

SEQ ID NO: 2992201 - DNA, 14 bp, Homo sapiens
acctagcagcaccg

SEQ ID NO: 2992202 - DNA, 18 bp, Homo sapiens
acctaggcaatgaagaat

SEQ ID NO: 2992203 - DNA, 19 bp, Homo sapiens
acctaggcagtaggccggt

SEQ ID NO: 2992204 - DNA, 17 bp, Homo sapiens
acctaggccactcctcc

SEQ ID NO: 2992205 - DNA, 12 bp, Homo sapiens
acctaggctagg

SEQ ID NO: 2992206 - DNA, 17 bp, Homo sapiens
acctaggctagggtggg

SEQ ID NO: 2992207 - DNA, 16 bp, Homo sapiens
acctagtcgacactaa

SEQ ID NO: 2992208 - DNA, 18 bp, Homo sapiens
acctagtgccccagactg

SEQ ID NO: 2992209 - DNA, 15 bp, Homo sapiens
acctataaaacaggt

SEQ ID NO: 2992210 - DNA, 14 bp, Homo sapiens
acctataaaattgt

SEQ ID NO: 2992211 - DNA, 14 bp, Homo sapiens
acctatagaaatgt

SEQ ID NO: 2992212 - DNA, 13 bp, Homo sapiens
acctatattcctt

SEQ ID NO: 2992213 - DNA, 15 bp, Homo sapiens
acctattaaaagttg

SEQ ID NO: 2992214 - DNA, 13 bp, Homo sapiens
acctattgccagg

SEQ ID NO: 2992215 - DNA, 23 bp, Homo sapiens
acctattgccaggaatgtttcag

SEQ ID NO: 2992216 - DNA, 19 bp, Homo sapiens
acctcaagtttttgttttg

SEQ ID NO: 2992217 - DNA, 19 bp, Homo sapiens
acctcaccccgaggccctg

SEQ ID NO: 2992218 - DNA, 21 bp, Homo sapiens
acctcaccccgaggccctgca

SEQ ID NO: 2992219 - DNA, 22 bp, Homo sapiens
acctcaccccgaggccctgcat

SEQ ID NO: 2992220 - DNA, 22 bp, Homo sapiens
acctcacgcacctcccatccta

SEQ ID NO: 2992221 - DNA, 11 bp, Homo sapiens
acctcagcctg

SEQ ID NO: 2992222 - DNA, 14 bp, Homo sapiens
acctcagcctgcac

SEQ ID NO: 2992223 - DNA, 20 bp, Homo sapiens
acctcagcctgcacagtgtc

SEQ ID NO: 2992224 - DNA, 16 bp, Homo sapiens
acctcagcctggccag

SEQ ID NO: 2992225 - DNA, 12 bp, Homo sapiens
acctcagggcac

SEQ ID NO: 2992226 - DNA, 23 bp, Homo sapiens
acctcagggtattgcttgccact

SEQ ID NO: 2992227 - DNA, 13 bp, Homo sapiens
acctcatccaaac

SEQ ID NO: 2992228 - DNA, 13 bp, Homo sapiens
acctcattctgaa

SEQ ID NO: 2992229 - DNA, 16 bp, Homo sapiens
acctccacgccactgc

SEQ ID NO: 2992230 - DNA, 17 bp, Homo sapiens
acctccagtcctgctgg

SEQ ID NO: 2992231 - DNA, 22 bp, Homo sapiens
acctccagtcctgctggcctgc

SEQ ID NO: 2992232 - DNA, 23 bp, Homo sapiens
acctccagtcctgctggcctgct

SEQ ID NO: 2992233 - DNA, 16 bp, Homo sapiens
acctccatatgctgta

SEQ ID NO: 2992234 - DNA, 16 bp, Homo sapiens
acctccccccactgca

SEQ ID NO: 2992235 - DNA, 17 bp, Homo sapiens
acctccccccactgcag

SEQ ID NO: 2992236 - DNA, 22 bp, Homo sapiens
acctccccccactgcaggcccc

SEQ ID NO: 2992237 - DNA, 18 bp, Homo sapiens
acctcccctatccaccca

SEQ ID NO: 2992238 - DNA, 22 bp, Homo sapiens
acctccctgttcaaggcccctg

SEQ ID NO: 2992239 - DNA, 21 bp, Homo sapiens
acctcccttaagcagcaacag

SEQ ID NO: 2992240 - DNA, 15 bp, Homo sapiens
acctcctccctgtta

SEQ ID NO: 2992241 - DNA, 12 bp, Homo sapiens
acctcctctcag

SEQ ID NO: 2992242 - DNA, 16 bp, Homo sapiens
acctcctctcagtgtt

SEQ ID NO: 2992243 - DNA, 22 bp, Homo sapiens
acctcctgacaacgtctcttca

SEQ ID NO: 2992244 - DNA, 15 bp, Homo sapiens
acctcctgcccagga

SEQ ID NO: 2992245 - DNA, 18 bp, Homo sapiens
acctcctgcccaggagag

SEQ ID NO: 2992246 - DNA, 20 bp, Homo sapiens
acctcctgcccaggagagcc

SEQ ID NO: 2992247 - DNA, 21 bp, Homo sapiens
accccacaatttctttaaaaa

SEQ ID NO: 2992248 - DNA, 16 bp, Homo sapiens
accccacacctgcagt

SEQ ID NO: 2992249 - DNA, 14 bp, Homo sapiens
accccacccagctc

SEQ ID NO: 2992250 - DNA, 20 bp, Homo sapiens
accccacccagctccaggcc

SEQ ID NO: 2992251 - DNA, 12 bp, Homo sapiens
accccaccccct

SEQ ID NO: 2992252 - DNA, 14 bp, Homo sapiens
accccacccctcat

SEQ ID NO: 2992253 - DNA, 18 bp, Homo sapiens
accccacccctcatcagg

SEQ ID NO: 2992254 - DNA, 19 bp, Homo sapiens
accccaccctgtttggatt

SEQ ID NO: 2992255 - DNA, 15 bp, Homo sapiens
accccagcacagctc

SEQ ID NO: 2992256 - DNA, 23 bp, Homo sapiens
accccagcattctcaggcaccag

SEQ ID NO: 2992257 - DNA, 21 bp, Homo sapiens
accccagctccgacctctctc

SEQ ID NO: 2992258 - DNA, 17 bp, Homo sapiens
accccaggaaaagcaca

SEQ ID NO: 2992259 - DNA, 11 bp, Homo sapiens
accccagggcc

SEQ ID NO: 2992260 - DNA, 15 bp, Homo sapiens
accccagttttttga

SEQ ID NO: 2992261 - DNA, 21 bp, Homo sapiens
accccatcactcgcaggacca

SEQ ID NO: 2992262 - DNA, 17 bp, Homo sapiens
accccatccctgtcttt

SEQ ID NO: 2992263 - DNA, 20 bp, Homo sapiens
accccatgctgttgattgct

SEQ ID NO: 2992264 - DNA, 16 bp, Homo sapiens
accccattttctgtgg

SEQ ID NO: 2992265 - DNA, 15 bp, Homo sapiens
acccccacacacaca

SEQ ID NO: 2992266 - DNA, 22 bp, Homo sapiens
acccccaccctagcctccacca

SEQ ID NO: 2992267 - DNA, 17 bp, Homo sapiens
acccccactctcattcc

SEQ ID NO: 2992268 - DNA, 18 bp, Homo sapiens
acccccactctcattccc

SEQ ID NO: 2992269 - DNA, 21 bp, Homo sapiens
acccccactctcattccccag

SEQ ID NO: 2992270 - DNA, 14 bp, Homo sapiens
acccccagcccaca

SEQ ID NO: 2992271 - DNA, 16 bp, Homo sapiens
acccccagcccacaga

SEQ ID NO: 2992272 - DNA, 14 bp, Homo sapiens
acccccagccccca

SEQ ID NO: 2992273 - DNA, 18 bp, Homo sapiens
acccccagctccggcctg

SEQ ID NO: 2992274 - DNA, 21 bp, Homo sapiens
acccccaggtttttgcccatc

SEQ ID NO: 2992275 - DNA, 16 bp, Homo sapiens
acccccatctccctag

SEQ ID NO: 2992276 - DNA, 17 bp, Homo sapiens
acccccatctccctagc

SEQ ID NO: 2992277 - DNA, 17 bp, Homo sapiens
acccccctccccaactc

SEQ ID NO: 2992278 - DNA, 19 bp, Homo sapiens
acccccgccccctgccctc

SEQ ID NO: 2992279 - DNA, 21 bp, Homo sapiens
acccccgccccctgccctccc

SEQ ID NO: 2992280 - DNA, 19 bp, Homo sapiens
acccccgggatcctgcccc

SEQ ID NO: 2992281 - DNA, 20 bp, Homo sapiens
acccccgggatcctgccccc

SEQ ID NO: 2992282 - DNA, 16 bp, Homo sapiens
accccctcatccccca

SEQ ID NO: 2992283 - DNA, 12 bp, Homo sapiens
accccctcccca

SEQ ID NO: 2992284 - DNA, 22 bp, Homo sapiens
accccctccccaaagccactgg

SEQ ID NO: 2992285 - DNA, 16 bp, Homo sapiens
accccctccccagggg

SEQ ID NO: 2992286 - DNA, 11 bp, Homo sapiens
accccctcctt

SEQ ID NO: 2992287 - DNA, 16 bp, Homo sapiens
accccctcgcttggac

SEQ ID NO: 2992288 - DNA, 15 bp, Homo sapiens
accccctctcctgga

SEQ ID NO: 2992289 - DNA, 13 bp, Homo sapiens
accccctgtgcct

SEQ ID NO: 2992290 - DNA, 18 bp, Homo sapiens
acccccttcagtgcccac

SEQ ID NO: 2992291 - DNA, 16 bp, Homo sapiens
accccgaggccctgca

SEQ ID NO: 2992292 - DNA, 13 bp, Homo sapiens
accccgcctgcct

SEQ ID NO: 2992293 - DNA, 15 bp, Homo sapiens
accccgcctgcctcc

SEQ ID NO: 2992294 - DNA, 20 bp, Homo sapiens
accccgcctgcctcctggct

SEQ ID NO: 2992295 - DNA, 15 bp, Homo sapiens
accccgcggcccaga

SEQ ID NO: 2992296 - DNA, 15 bp, Homo sapiens
accccgggccggacc

SEQ ID NO: 2992297 - DNA, 20 bp, Homo sapiens
accccggggtgcccacaggc

SEQ ID NO: 2992298 - DNA, 21 bp, Homo sapiens
accccggtggcggccccagca

SEQ ID NO: 2992299 - DNA, 23 bp, Homo sapiens
accccgtctggggttcagcccct

SEQ ID NO: 2992300 - DNA, 13 bp, Homo sapiens
acccctaccccct

SEQ ID NO: 2992301 - DNA, 15 bp, Homo sapiens
acccctaccccctca

SEQ ID NO: 2992302 - DNA, 17 bp, Homo sapiens
acccctaccccctcatc

SEQ ID NO: 2992303 - DNA, 23 bp, Homo sapiens
acccctaccgatggtcccaggaa

SEQ ID NO: 2992304 - DNA, 17 bp, Homo sapiens
acccctagagacagtga

SEQ ID NO: 2992305 - DNA, 10 bp, Homo sapiens
acccctcacc

SEQ ID NO: 2992306 - DNA, 13 bp, Homo sapiens
acccctcaccacc

SEQ ID NO: 2992307 - DNA, 17 bp, Homo sapiens
acccctcctggggccag

SEQ ID NO: 2992308 - DNA, 17 bp, Homo sapiens
acccctgccactcaccc

SEQ ID NO: 2992309 - DNA, 13 bp, Homo sapiens
acccctgccctgc

SEQ ID NO: 2992310 - DNA, 14 bp, Homo sapiens
acccctgccctgct

SEQ ID NO: 2992311 - DNA, 16 bp, Homo sapiens
acccctgcccttgtcc

SEQ ID NO: 2992312 - DNA, 22 bp, Homo sapiens
acccctgcctcgagggccgcct

SEQ ID NO: 2992313 - DNA, 12 bp, Homo sapiens
acccctggctct

SEQ ID NO: 2992314 - DNA, 21 bp, Homo sapiens
acccctggctgaacagtgctc

SEQ ID NO: 2992315 - DNA, 24 bp, Homo sapiens
acccctggctgaacagtgctctgc

SEQ ID NO: 2992316 - DNA, 22 bp, Homo sapiens
acccctggggctgagtctccag

SEQ ID NO: 2992317 - DNA, 15 bp, Homo sapiens
acccctgggggctct

SEQ ID NO: 2992318 - DNA, 17 bp, Homo sapiens
acccctgggggctctca

SEQ ID NO: 2992319 - DNA, 18 bp, Homo sapiens
accccttaagccctggcc

SEQ ID NO: 2992320 - DNA, 20 bp, Homo sapiens
accccttaagccctggcccc

SEQ ID NO: 2992321 - DNA, 22 bp, Homo sapiens
accccttaccccaaagagaaag

SEQ ID NO: 2992322 - DNA, 22 bp, Homo sapiens
accccttcataccgcctcgtgc

SEQ ID NO: 2992323 - DNA, 13 bp, Homo sapiens
accccttcccacg

SEQ ID NO: 2992324 - DNA, 14 bp, Homo sapiens
accccttctctgtg

SEQ ID NO: 2992325 - DNA, 20 bp, Homo sapiens
accccttctctgtgacccac

SEQ ID NO: 2992326 - DNA, 21 bp, Homo sapiens
acccctttaaggttcagactt

SEQ ID NO: 2992327 - DNA, 18 bp, Homo sapiens
acccctttccccagcctc

SEQ ID NO: 2992328 - DNA, 16 bp, Homo sapiens
acccgacagagggaag

SEQ ID NO: 2992329 - DNA, 21 bp, Homo sapiens
acccgacagagggaagaaaag

SEQ ID NO: 2992330 - DNA, 21 bp, Homo sapiens
acccgaccccccgtgggctcc

SEQ ID NO: 2992331 - DNA, 13 bp, Homo sapiens
acccgaggaaact

SEQ ID NO: 2992332 - DNA, 15 bp, Homo sapiens
acccgagggttgatt

SEQ ID NO: 2992333 - DNA, 13 bp, Homo sapiens
acccgccagcccc

SEQ ID NO: 2992334 - DNA, 16 bp, Homo sapiens
acccgccagccccgct

SEQ ID NO: 2992335 - DNA, 16 bp, Homo sapiens
acccggattggccctg

SEQ ID NO: 2992336 - DNA, 21 bp, Homo sapiens
acccggcggtcccctccgcca

SEQ ID NO: 2992337 - DNA, 15 bp, Homo sapiens
acccgggaaggaagg

SEQ ID NO: 2992338 - DNA, 18 bp, Homo sapiens
acccggtgctccctctgt

SEQ ID NO: 2992339 - DNA, 17 bp, Homo sapiens
acccgtgacagtggctg

SEQ ID NO: 2992340 - DNA, 15 bp, Homo sapiens
acccgtgcctgggcc

SEQ ID NO: 2992341 - DNA, 20 bp, Homo sapiens
acccgtgcctgggcccctcc

SEQ ID NO: 2992342 - DNA, 21 bp, Homo sapiens
acccgtgcctgggcccctccc

SEQ ID NO: 2992343 - DNA, 16 bp, Homo sapiens
accctaagggcagccc

SEQ ID NO: 2992344 - DNA, 17 bp, Homo sapiens
accctaagggcagccct

SEQ ID NO: 2992345 - DNA, 21 bp, Homo sapiens
accctaagggcagccctccat

SEQ ID NO: 2992346 - DNA, 21 bp, Homo sapiens
accctaatctttcacttgaaa

SEQ ID NO: 2992347 - DNA, 18 bp, Homo sapiens
accctaccttccccagac

SEQ ID NO: 2992348 - DNA, 21 bp, Homo sapiens
accctaggcctctcacctctg

SEQ ID NO: 2992349 - DNA, 15 bp, Homo sapiens
accctatctgtgatt

SEQ ID NO: 2992350 - DNA, 22 bp, Homo sapiens
accctcaggtgtagctgagctg

SEQ ID NO: 2992351 - DNA, 16 bp, Homo sapiens
accctcatctttcttc

SEQ ID NO: 2992352 - DNA, 15 bp, Homo sapiens
accctccacaaagca

SEQ ID NO: 2992353 - DNA, 22 bp, Homo sapiens
accctccagcttttcctcaggg

SEQ ID NO: 2992354 - DNA, 19 bp, Homo sapiens
accctcctggcctcagact

SEQ ID NO: 2992355 - DNA, 18 bp, Homo sapiens
accctcgaggcggatctt

SEQ ID NO: 2992356 - DNA, 12 bp, Homo sapiens
accctctcactt

SEQ ID NO: 2992357 - DNA, 19 bp, Homo sapiens
accctctcaggctgtccca

SEQ ID NO: 2992358 - DNA, 21 bp, Homo sapiens
accctctccgcacacctctgg

SEQ ID NO: 2992359 - DNA, 22 bp, Homo sapiens
accctctccgcacacctctggc

SEQ ID NO: 2992360 - DNA, 23 bp, Homo sapiens
accctctctccaaggtgtttcta

SEQ ID NO: 2992361 - DNA, 12 bp, Homo sapiens
accctctgtacc

SEQ ID NO: 2992362 - DNA, 16 bp, Homo sapiens
accctctgtccccacg

SEQ ID NO: 2992363 - DNA, 19 bp, Homo sapiens
accctctgtccccaggcct

SEQ ID NO: 2992364 - DNA, 22 bp, Homo sapiens
accctctgtccccaggcctggc

SEQ ID NO: 2992365 - DNA, 24 bp, Homo sapiens
accctctgtccccaggcctggctc

SEQ ID NO: 2992366 - DNA, 20 bp, Homo sapiens
accctctttcttgtttgtca

SEQ ID NO: 2992367 - DNA, 21 bp, Homo sapiens
accctctttcttgtttgtcag

SEQ ID NO: 2992368 - DNA, 22 bp, Homo sapiens
accctgaagcagaggcctttat

SEQ ID NO: 2992369 - DNA, 17 bp, Homo sapiens
accctgagttttgtttt

SEQ ID NO: 2992370 - DNA, 16 bp, Homo sapiens
accctgccctcatggg

SEQ ID NO: 2992371 - DNA, 13 bp, Homo sapiens
accctgccctcct

SEQ ID NO: 2992372 - DNA, 13 bp, Homo sapiens
accctgcctgctg

SEQ ID NO: 2992373 - DNA, 14 bp, Homo sapiens
accctgcctgctgt

SEQ ID NO: 2992374 - DNA, 22 bp, Homo sapiens
accctgcctgctgtggagccca

SEQ ID NO: 2992375 - DNA, 20 bp, Homo sapiens
accctggaccagtggtctca

SEQ ID NO: 2992376 - DNA, 15 bp, Homo sapiens
accctggccaccacc

SEQ ID NO: 2992377 - DNA, 16 bp, Homo sapiens
accctggccaccaccc

SEQ ID NO: 2992378 - DNA, 17 bp, Homo sapiens
accctggccaccaccca

SEQ ID NO: 2992379 - DNA, 21 bp, Homo sapiens
accctggccaccacccaacct

SEQ ID NO: 2992380 - DNA, 18 bp, Homo sapiens
accctggccgagtccaag

SEQ ID NO: 2992381 - DNA, 19 bp, Homo sapiens
accctggcctggtccctgg

SEQ ID NO: 2992382 - DNA, 23 bp, Homo sapiens
accctggcctggtccctggtcct

SEQ ID NO: 2992383 - DNA, 15 bp, Homo sapiens
accagcattcctttt

SEQ ID NO: 2992384 - DNA, 16 bp, Homo sapiens
accagccctgctgctt

SEQ ID NO: 2992385 - DNA, 22 bp, Homo sapiens
accagccctgctgcttcctaac

SEQ ID NO: 2992386 - DNA, 19 bp, Homo sapiens
accagccgtgagcatgttt

SEQ ID NO: 2992387 - DNA, 22 bp, Homo sapiens
accagccgtgagcatgtttgga

SEQ ID NO: 2992388 - DNA, 11 bp, Homo sapiens
accagcctggc

SEQ ID NO: 2992389 - DNA, 12 bp, Homo sapiens
accagcctggcc

SEQ ID NO: 2992390 - DNA, 20 bp, Homo sapiens
accagcctgtccaacatggt

SEQ ID NO: 2992391 - DNA, 15 bp, Homo sapiens
accagctcaggacag

SEQ ID NO: 2992392 - DNA, 16 bp, Homo sapiens
accagctcaggacaga

SEQ ID NO: 2992393 - DNA, 23 bp, Homo sapiens
accagctcaggacagatgccaca

SEQ ID NO: 2992394 - DNA, 18 bp, Homo sapiens
accagctcaggggacact

SEQ ID NO: 2992395 - DNA, 22 bp, Homo sapiens
accagctctgccgtctctggag

SEQ ID NO: 2992396 - DNA, 12 bp, Homo sapiens
accagctgcaaa

SEQ ID NO: 2992397 - DNA, 14 bp, Homo sapiens
accagctgcaaagt

SEQ ID NO: 2992398 - DNA, 19 bp, Homo sapiens
accagctgcaaagtgtttt

SEQ ID NO: 2992399 - DNA, 14 bp, Homo sapiens
accaggacaggacc

SEQ ID NO: 2992400 - DNA, 17 bp, Homo sapiens
accaggacaggaccaga

SEQ ID NO: 2992401 - DNA, 20 bp, Homo sapiens
accaggacccagggagaggc

SEQ ID NO: 2992402 - DNA, 15 bp, Homo sapiens
accaggagcacctgg

SEQ ID NO: 2992403 - DNA, 18 bp, Homo sapiens
accaggagcacctggacc

SEQ ID NO: 2992404 - DNA, 19 bp, Homo sapiens
accaggagcacctggaccc

SEQ ID NO: 2992405 - DNA, 22 bp, Homo sapiens
accaggcacgaacccacctgct

SEQ ID NO: 2992406 - DNA, 23 bp, Homo sapiens
accaggcacgaacccacctgctg

SEQ ID NO: 2992407 - DNA, 11 bp, Homo sapiens
accaggcaggg

SEQ ID NO: 2992408 - DNA, 14 bp, Homo sapiens
accaggcctcactg

SEQ ID NO: 2992409 - DNA, 15 bp, Homo sapiens
accaggcctcactgg

SEQ ID NO: 2992410 - DNA, 16 bp, Homo sapiens
accaggcctcactggc

SEQ ID NO: 2992411 - DNA, 14 bp, Homo sapiens
accaggctgggcat

SEQ ID NO: 2992412 - DNA, 13 bp, Homo sapiens
accagggaccctg

SEQ ID NO: 2992413 - DNA, 21 bp, Homo sapiens
accagggccttttctggcacc

SEQ ID NO: 2992414 - DNA, 23 bp, Homo sapiens
accagggccttttctggcaccgc

SEQ ID NO: 2992415 - DNA, 17 bp, Homo sapiens
accaggggaccagaggg

SEQ ID NO: 2992416 - DNA, 17 bp, Homo sapiens
accaggggtaccaggca

SEQ ID NO: 2992417 - DNA, 20 bp, Homo sapiens
accagggttgaccccagagg

SEQ ID NO: 2992418 - DNA, 19 bp, Homo sapiens
accaggtccattttgcctg

SEQ ID NO: 2992419 - DNA, 20 bp, Homo sapiens
accaggtccattttgcctga

SEQ ID NO: 2992420 - DNA, 23 bp, Homo sapiens
accaggtcctgctccgctgcctg

SEQ ID NO: 2992421 - DNA, 15 bp, Homo sapiens
accagtccccccacc

SEQ ID NO: 2992422 - DNA, 20 bp, Homo sapiens
accagtgcaggctggccagc

SEQ ID NO: 2992423 - DNA, 21 bp, Homo sapiens
accagtgcaggctggccagcc

SEQ ID NO: 2992424 - DNA, 12 bp, Homo sapiens
accagtttcttt

SEQ ID NO: 2992425 - DNA, 17 bp, Homo sapiens
accagtttcttttcttt

SEQ ID NO: 2992426 - DNA, 14 bp, Homo sapiens
accatatagcaaaa

SEQ ID NO: 2992427 - DNA, 15 bp, Homo sapiens
accatatgaatgaaa

SEQ ID NO: 2992428 - DNA, 19 bp, Homo sapiens
accatatgcccacatttag

SEQ ID NO: 2992429 - DNA, 15 bp, Homo sapiens
accatatttgaattg

SEQ ID NO: 2992430 - DNA, 16 bp, Homo sapiens
accatcagaattcaga

SEQ ID NO: 2992431 - DNA, 20 bp, Homo sapiens
accatccaacagacctggtg

SEQ ID NO: 2992432 - DNA, 16 bp, Homo sapiens
accatcgctggcccct

SEQ ID NO: 2992433 - DNA, 22 bp, Homo sapiens
accatctactcttttgaagtgt

SEQ ID NO: 2992434 - DNA, 23 bp, Homo sapiens
accatctactcttttgaagtgtt

SEQ ID NO: 2992435 - DNA, 16 bp, Homo sapiens
accatctatgtgaata

SEQ ID NO: 2992436 - DNA, 23 bp, Homo sapiens
accatctcatcctattacttttc

SEQ ID NO: 2992437 - DNA, 19 bp, Homo sapiens
accatgatggccaggctga

SEQ ID NO: 2992438 - DNA, 22 bp, Homo sapiens
accatgcccagctaattttgta

SEQ ID NO: 2992439 - DNA, 20 bp, Homo sapiens
accatgcctcactaattttt

SEQ ID NO: 2992440 - DNA, 16 bp, Homo sapiens
accatgtgcggagcag

SEQ ID NO: 2992441 - DNA, 21 bp, Homo sapiens
accatgtgcggagcagccttt

SEQ ID NO: 2992442 - DNA, 17 bp, Homo sapiens
accattcatctctaaca

SEQ ID NO: 2992443 - DNA, 12 bp, Homo sapiens
accattgctgct

SEQ ID NO: 2992444 - DNA, 16 bp, Homo sapiens
accattgctgctcctt

SEQ ID NO: 2992445 - DNA, 22 bp, Homo sapiens
accattggacagatttcagtaa

SEQ ID NO: 2992446 - DNA, 17 bp, Homo sapiens
accattggctgcgctaa

SEQ ID NO: 2992447 - DNA, 13 bp, Homo sapiens
accatttgtagtg

SEQ ID NO: 2992448 - DNA, 20 bp, Homo sapiens
accatttgtattaccattac

SEQ ID NO: 2992449 - DNA, 23 bp, Homo sapiens
accatttgtccttttctgcaaca

SEQ ID NO: 2992450 - DNA, 15 bp, Homo sapiens
accatttgttaactg

SEQ ID NO: 2992451 - DNA, 23 bp, Homo sapiens
accattttcccatcatcctttgt

SEQ ID NO: 2992452 - DNA, 21 bp, Homo sapiens
accatttttagaaggaaaaag

SEQ ID NO: 2992453 - DNA, 12 bp, Homo sapiens
acccaaaagcac

SEQ ID NO: 2992454 - DNA, 15 bp, Homo sapiens
acccaaaagcacaaa

SEQ ID NO: 2992455 - DNA, 17 bp, Homo sapiens
acccaaaagcacaaaat

SEQ ID NO: 2992456 - DNA, 17 bp, Homo sapiens
acccaaaccccttccca

SEQ ID NO: 2992457 - DNA, 13 bp, Homo sapiens
acccaaagcagga

SEQ ID NO: 2992458 - DNA, 14 bp, Homo sapiens
acccaaagcaggat

SEQ ID NO: 2992459 - DNA, 22 bp, Homo sapiens
acccaaagctgagcctgcaggg

SEQ ID NO: 2992460 - DNA, 19 bp, Homo sapiens
acccaaccccaagccagcc

SEQ ID NO: 2992461 - DNA, 15 bp, Homo sapiens
acccaacctgtcctt

SEQ ID NO: 2992462 - DNA, 22 bp, Homo sapiens
acccaacctgtccttactcaga

SEQ ID NO: 2992463 - DNA, 18 bp, Homo sapiens
acccaactgacctgccag

SEQ ID NO: 2992464 - DNA, 21 bp, Homo sapiens
acccaaggaaaactgcatgga

SEQ ID NO: 2992465 - DNA, 17 bp, Homo sapiens
acccaagtagctgctac

SEQ ID NO: 2992466 - DNA, 14 bp, Homo sapiens
acccaagtcttctc

SEQ ID NO: 2992467 - DNA, 16 bp, Homo sapiens
acccaagtgggggcag

SEQ ID NO: 2992468 - DNA, 13 bp, Homo sapiens
acccaatgattca

SEQ ID NO: 2992469 - DNA, 16 bp, Homo sapiens
acccacagtggagagg

SEQ ID NO: 2992470 - DNA, 16 bp, Homo sapiens
acccacatgtgacaca

SEQ ID NO: 2992471 - DNA, 12 bp, Homo sapiens
acccacccctgc

SEQ ID NO: 2992472 - DNA, 15 bp, Homo sapiens
acccacccctgcaca

SEQ ID NO: 2992473 - DNA, 15 bp, Homo sapiens
acccaccctgtggct

SEQ ID NO: 2992474 - DNA, 23 bp, Homo sapiens
acccacctacttagatatttcat

SEQ ID NO: 2992475 - DNA, 14 bp, Homo sapiens
acccacctccctgc

SEQ ID NO: 2992476 - DNA, 16 bp, Homo sapiens
acccacctccctgcct

SEQ ID NO: 2992477 - DNA, 18 bp, Homo sapiens
acccacctccctgcctcc

SEQ ID NO: 2992478 - DNA, 23 bp, Homo sapiens
acccacctggccccctcagctct

SEQ ID NO: 2992479 - DNA, 14 bp, Homo sapiens
acccacgtggctgc

SEQ ID NO: 2992480 - DNA, 20 bp, Homo sapiens
acccacttctcatcacacac

SEQ ID NO: 2992481 - DNA, 22 bp, Homo sapiens
acccagacggctccactaggac

SEQ ID NO: 2992482 - DNA, 15 bp, Homo sapiens
acccagattcccttc

SEQ ID NO: 2992483 - DNA, 22 bp, Homo sapiens
acccagcccattctctctcctg

SEQ ID NO: 2992484 - DNA, 14 bp, Homo sapiens
acccagcccgcggc

SEQ ID NO: 2992485 - DNA, 19 bp, Homo sapiens
acccagcccgcggcctgga

SEQ ID NO: 2992486 - DNA, 21 bp, Homo sapiens
acccagcccgcggcctggacc

SEQ ID NO: 2992487 - DNA, 16 bp, Homo sapiens
acccagccctcatccc

SEQ ID NO: 2992488 - DNA, 18 bp, Homo sapiens
acccaggaagggagggag

SEQ ID NO: 2992489 - DNA, 18 bp, Homo sapiens
acccaggaggggaacact

SEQ ID NO: 2992490 - DNA, 14 bp, Homo sapiens
acccaggaggtgga

SEQ ID NO: 2992491 - DNA, 16 bp, Homo sapiens
acccaggagtttgtgt

SEQ ID NO: 2992492 - DNA, 19 bp, Homo sapiens
acccaggagtttgtgtgtc

SEQ ID NO: 2992493 - DNA, 18 bp, Homo sapiens
acccaggctggagtgcag

SEQ ID NO: 2992494 - DNA, 12 bp, Homo sapiens
acccagggcctg

SEQ ID NO: 2992495 - DNA, 21 bp, Homo sapiens
acccaggtcccccgactgcct

SEQ ID NO: 2992496 - DNA, 15 bp, Homo sapiens
acccagtattactgc

SEQ ID NO: 2992497 - DNA, 19 bp, Homo sapiens
acccagtattactgctgct

SEQ ID NO: 2992498 - DNA, 20 bp, Homo sapiens
acccagtattactgctgctg

SEQ ID NO: 2992499 - DNA, 23 bp, Homo sapiens
acccagtattactgctgctgtgc

SEQ ID NO: 2992500 - DNA, 15 bp, Homo sapiens
acccagtccatgctc

SEQ ID NO: 2992501 - DNA, 18 bp, Homo sapiens
acccagtccatgctccag

SEQ ID NO: 2992502 - DNA, 14 bp, Homo sapiens
acccagtccctggg

SEQ ID NO: 2992503 - DNA, 15 bp, Homo sapiens
acccagtccctgggg

SEQ ID NO: 2992504 - DNA, 15 bp, Homo sapiens
acccagtcctctgcc

SEQ ID NO: 2992505 - DNA, 16 bp, Homo sapiens
acccagtcctctgcct

SEQ ID NO: 2992506 - DNA, 18 bp, Homo sapiens
acccagtctctgctccac

SEQ ID NO: 2992507 - DNA, 14 bp, Homo sapiens
acccatcagaagga

SEQ ID NO: 2992508 - DNA, 18 bp, Homo sapiens
acccatcagaaggagaag

SEQ ID NO: 2992509 - DNA, 20 bp, Homo sapiens
acccatctgcacccccctgg

SEQ ID NO: 2992510 - DNA, 16 bp, Homo sapiens
acccatcttgcttcca

SEQ ID NO: 2992511 - DNA, 21 bp, Homo sapiens
acccatgagttggggtctggc

SEQ ID NO: 2992512 - DNA, 20 bp, Homo sapiens
acccatgatgagctcctctt

SEQ ID NO: 2992513 - DNA, 17 bp, Homo sapiens
acccatgggggctgtct

SEQ ID NO: 2992514 - DNA, 13 bp, Homo sapiens
acccattcctatt

SEQ ID NO: 2992515 - DNA, 23 bp, Homo sapiens
accccaagcggccttttccaaat

SEQ ID NO: 2992516 - DNA, 19 bp, Homo sapiens
accccaatatatgtatttt

SEQ ID NO: 2992517 - DNA, 23 bp, Homo sapiens
accccaatatatgtattttttga

SEQ ID NO: 2992518 - DNA, 15 bp, Homo sapiens
accccacaatttctt

SEQ ID NO: 2992519 - DNA, 15 bp, Homo sapiens
acatttgtttgtatt

SEQ ID NO: 2992520 - DNA, 13 bp, Homo sapiens
acattttaacaag

SEQ ID NO: 2992521 - DNA, 17 bp, Homo sapiens
acattttaacaagaaga

SEQ ID NO: 2992522 - DNA, 18 bp, Homo sapiens
acattttaacaagaagat

SEQ ID NO: 2992523 - DNA, 20 bp, Homo sapiens
acattttaacagtacctgtg

SEQ ID NO: 2992524 - DNA, 22 bp, Homo sapiens
acattttaggatctcgcctgga

SEQ ID NO: 2992525 - DNA, 22 bp, Homo sapiens
acattttctctcgttaattttc

SEQ ID NO: 2992526 - DNA, 19 bp, Homo sapiens
acattttctctttaaaaga

SEQ ID NO: 2992527 - DNA, 21 bp, Homo sapiens
acattttcttttgttcttgat

SEQ ID NO: 2992528 - DNA, 18 bp, Homo sapiens
acattttgacacaatgtt

SEQ ID NO: 2992529 - DNA, 12 bp, Homo sapiens
acattttgagaa

SEQ ID NO: 2992530 - DNA, 16 bp, Homo sapiens
acattttggatttctt

SEQ ID NO: 2992531 - DNA, 12 bp, Homo sapiens
acattttgtata

SEQ ID NO: 2992532 - DNA, 16 bp, Homo sapiens
acattttgtataattg

SEQ ID NO: 2992533 - DNA, 19 bp, Homo sapiens
acatttttaaattcttact

SEQ ID NO: 2992534 - DNA, 24 bp, Homo sapiens
acatttttaaattcttactctgga

SEQ ID NO: 2992535 - DNA, 19 bp, Homo sapiens
acatttttccgtttgcttt

SEQ ID NO: 2992536 - DNA, 21 bp, Homo sapiens
acatttttccgtttgcttttg

SEQ ID NO: 2992537 - DNA, 18 bp, Homo sapiens
acatttttcctctctgca

SEQ ID NO: 2992538 - DNA, 18 bp, Homo sapiens
acatttttgcacagatta

SEQ ID NO: 2992539 - DNA, 18 bp, Homo sapiens
acatttttgtatgtgtgt

SEQ ID NO: 2992540 - DNA, 11 bp, Homo sapiens
accaaaaatat

SEQ ID NO: 2992541 - DNA, 13 bp, Homo sapiens
accaaaaatcaac

SEQ ID NO: 2992542 - DNA, 19 bp, Homo sapiens
accaaaaatcaacctatca

SEQ ID NO: 2992543 - DNA, 18 bp, Homo sapiens
accaaaactgtgcagagt

SEQ ID NO: 2992544 - DNA, 19 bp, Homo sapiens
accaaaaggccgtgtgttt

SEQ ID NO: 2992545 - DNA, 23 bp, Homo sapiens
accaaaagttacatgtttgcacc

SEQ ID NO: 2992546 - DNA, 13 bp, Homo sapiens
accaaacaattat

SEQ ID NO: 2992547 - DNA, 21 bp, Homo sapiens
accaaacccttagcagcccag

SEQ ID NO: 2992548 - DNA, 23 bp, Homo sapiens
accaaacccttagcagcccagca

SEQ ID NO: 2992549 - DNA, 18 bp, Homo sapiens
accaaactgttaaatgtg

SEQ ID NO: 2992550 - DNA, 17 bp, Homo sapiens
accaaagagtctctggc

SEQ ID NO: 2992551 - DNA, 18 bp, Homo sapiens
accaaagagtctctggct

SEQ ID NO: 2992552 - DNA, 16 bp, Homo sapiens
accaaagcgaatttta

SEQ ID NO: 2992553 - DNA, 15 bp, Homo sapiens
accaaaggtttttaa

SEQ ID NO: 2992554 - DNA, 16 bp, Homo sapiens
accaaagtcccttcct

SEQ ID NO: 2992555 - DNA, 15 bp, Homo sapiens
accaaagtctaaact

SEQ ID NO: 2992556 - DNA, 21 bp, Homo sapiens
accaaataggatcatatgaat

SEQ ID NO: 2992557 - DNA, 14 bp, Homo sapiens
accaaatatgttaa

SEQ ID NO: 2992558 - DNA, 19 bp, Homo sapiens
accaaattaaaaatttttt

SEQ ID NO: 2992559 - DNA, 14 bp, Homo sapiens
accaaattgcttct

SEQ ID NO: 2992560 - DNA, 23 bp, Homo sapiens
accaaattgcttctaggagtcaa

SEQ ID NO: 2992561 - DNA, 12 bp, Homo sapiens
accaaattttga

SEQ ID NO: 2992562 - DNA, 18 bp, Homo sapiens
accaacatcccattgccc

SEQ ID NO: 2992563 - DNA, 19 bp, Homo sapiens
accaaccccgcggcccaga

SEQ ID NO: 2992564 - DNA, 19 bp, Homo sapiens
accaacctgaagacaccgt

SEQ ID NO: 2992565 - DNA, 14 bp, Homo sapiens
accaacctttctga

SEQ ID NO: 2992566 - DNA, 23 bp, Homo sapiens
accaacgcgaaaccaattcctca

SEQ ID NO: 2992567 - DNA, 19 bp, Homo sapiens
accaagaagcctttcctgt

SEQ ID NO: 2992568 - DNA, 15 bp, Homo sapiens
accaagagattgcta

SEQ ID NO: 2992569 - DNA, 22 bp, Homo sapiens
accaagagattgctaattgctg

SEQ ID NO: 2992570 - DNA, 20 bp, Homo sapiens
accaagattttgaaggaaat

SEQ ID NO: 2992571 - DNA, 17 bp, Homo sapiens
accaagcacagcagcct

SEQ ID NO: 2992572 - DNA, 16 bp, Homo sapiens
accaagcaggaagctc

SEQ ID NO: 2992573 - DNA, 13 bp, Homo sapiens
accaaggaaggag

SEQ ID NO: 2992574 - DNA, 20 bp, Homo sapiens
accaaggaaggagcccctga

SEQ ID NO: 2992575 - DNA, 21 bp, Homo sapiens
accaaggcaacggcaccattg

SEQ ID NO: 2992576 - DNA, 22 bp, Homo sapiens
accaaggcaacggcaccattgg

SEQ ID NO: 2992577 - DNA, 16 bp, Homo sapiens
accaaggctgtgttta

SEQ ID NO: 2992578 - DNA, 19 bp, Homo sapiens
accaagtcaggccaggtgg

SEQ ID NO: 2992579 - DNA, 20 bp, Homo sapiens
accaagtcaggccaggtggg

SEQ ID NO: 2992580 - DNA, 21 bp, Homo sapiens
accaagtcaggccaggtgggc

SEQ ID NO: 2992581 - DNA, 14 bp, Homo sapiens
accaagtgggctgg

SEQ ID NO: 2992582 - DNA, 14 bp, Homo sapiens
accaatacatttgt

SEQ ID NO: 2992583 - DNA, 15 bp, Homo sapiens
accaatacatttgta

SEQ ID NO: 2992584 - DNA, 17 bp, Homo sapiens
accaatacatttgtatt

SEQ ID NO: 2992585 - DNA, 18 bp, Homo sapiens
accaatcaaatgtctggg

SEQ ID NO: 2992586 - DNA, 15 bp, Homo sapiens
accaatcgcaaagca

SEQ ID NO: 2992587 - DNA, 14 bp, Homo sapiens
accaatgaaaaaat

SEQ ID NO: 2992588 - DNA, 12 bp, Homo sapiens
accaatgtcttg

SEQ ID NO: 2992589 - DNA, 15 bp, Homo sapiens
accaattaagtgttg

SEQ ID NO: 2992590 - DNA, 16 bp, Homo sapiens
accaattaagtgttga

SEQ ID NO: 2992591 - DNA, 14 bp, Homo sapiens
accacaaactgtaa

SEQ ID NO: 2992592 - DNA, 22 bp, Homo sapiens
accacaaactgtaatacaatga

SEQ ID NO: 2992593 - DNA, 20 bp, Homo sapiens
accacaactattttcagatg

SEQ ID NO: 2992594 - DNA, 20 bp, Homo sapiens
accacaagccaccttttgta

SEQ ID NO: 2992595 - DNA, 14 bp, Homo sapiens
accacacacaacag

SEQ ID NO: 2992596 - DNA, 15 bp, Homo sapiens
accacacacaacagc

SEQ ID NO: 2992597 - DNA, 19 bp, Homo sapiens
accacacatcccagcccaa

SEQ ID NO: 2992598 - DNA, 14 bp, Homo sapiens
accacaccagcctc

SEQ ID NO: 2992599 - DNA, 18 bp, Homo sapiens
accacacccggctaattt

SEQ ID NO: 2992600 - DNA, 18 bp, Homo sapiens
accacaccctgcctgctg

SEQ ID NO: 2992601 - DNA, 16 bp, Homo sapiens
accacactggactccg

SEQ ID NO: 2992602 - DNA, 21 bp, Homo sapiens
accacactggactccggccct

SEQ ID NO: 2992603 - DNA, 14 bp, Homo sapiens
accacatcttgtct

SEQ ID NO: 2992604 - DNA, 23 bp, Homo sapiens
accacattttaggatctcgcctg

SEQ ID NO: 2992605 - DNA, 13 bp, Homo sapiens
accaccaaaatta

SEQ ID NO: 2992606 - DNA, 13 bp, Homo sapiens
accaccaggtctc

SEQ ID NO: 2992607 - DNA, 16 bp, Homo sapiens
accaccatgcccagct

SEQ ID NO: 2992608 - DNA, 16 bp, Homo sapiens
accaccgagctctgtg

SEQ ID NO: 2992609 - DNA, 17 bp, Homo sapiens
accaccgagctctgtgg

SEQ ID NO: 2992610 - DNA, 16 bp, Homo sapiens
accaccgcccgtctgt

SEQ ID NO: 2992611 - DNA, 15 bp, Homo sapiens
accaccgttcagtca

SEQ ID NO: 2992612 - DNA, 18 bp, Homo sapiens
accacctaggccactcct

SEQ ID NO: 2992613 - DNA, 14 bp, Homo sapiens
accacctctctgtc

SEQ ID NO: 2992614 - DNA, 17 bp, Homo sapiens
accaccttatacatcac

SEQ ID NO: 2992615 - DNA, 21 bp, Homo sapiens
accacgaaagcacacacaaaa

SEQ ID NO: 2992616 - DNA, 13 bp, Homo sapiens
accacgactggcc

SEQ ID NO: 2992617 - DNA, 24 bp, Homo sapiens
accacgactggccagggccacgct

SEQ ID NO: 2992618 - DNA, 17 bp, Homo sapiens
accacgatgtggccctg

SEQ ID NO: 2992619 - DNA, 20 bp, Homo sapiens
accacgatgtggccctggcc

SEQ ID NO: 2992620 - DNA, 22 bp, Homo sapiens
accacgatgtggccctggcctg

SEQ ID NO: 2992621 - DNA, 23 bp, Homo sapiens
accacgcacctccacgccactgc

SEQ ID NO: 2992622 - DNA, 14 bp, Homo sapiens
accactcctgccag

SEQ ID NO: 2992623 - DNA, 18 bp, Homo sapiens
accactcctgccagcccg

SEQ ID NO: 2992624 - DNA, 21 bp, Homo sapiens
accactcttctctccaaggaa

SEQ ID NO: 2992625 - DNA, 22 bp, Homo sapiens
accactcttctctccaaggaaa

SEQ ID NO: 2992626 - DNA, 19 bp, Homo sapiens
accactgagctctgcctca

SEQ ID NO: 2992627 - DNA, 22 bp, Homo sapiens
accactgagctctgcctcaact

SEQ ID NO: 2992628 - DNA, 12 bp, Homo sapiens
accactgggccc

SEQ ID NO: 2992629 - DNA, 20 bp, Homo sapiens
accactgtggaagtccctca

SEQ ID NO: 2992630 - DNA, 15 bp, Homo sapiens
accacttcttttata

SEQ ID NO: 2992631 - DNA, 16 bp, Homo sapiens
accacttcttttataa

SEQ ID NO: 2992632 - DNA, 20 bp, Homo sapiens
accacttggaaataaaccat

SEQ ID NO: 2992633 - DNA, 16 bp, Homo sapiens
accacttttctgctgt

SEQ ID NO: 2992634 - DNA, 16 bp, Homo sapiens
accagaaacagggaca

SEQ ID NO: 2992635 - DNA, 21 bp, Homo sapiens
accagaagctgttgggagaaa

SEQ ID NO: 2992636 - DNA, 17 bp, Homo sapiens
accagacacccaggact

SEQ ID NO: 2992637 - DNA, 12 bp, Homo sapiens
accagacagagg

SEQ ID NO: 2992638 - DNA, 22 bp, Homo sapiens
accagacagagggtcacagtgt

SEQ ID NO: 2992639 - DNA, 21 bp, Homo sapiens
accagactacttgggagcacc

SEQ ID NO: 2992640 - DNA, 18 bp, Homo sapiens
accagagaaaaagggagg

SEQ ID NO: 2992641 - DNA, 12 bp, Homo sapiens
accagagcaaaa

SEQ ID NO: 2992642 - DNA, 13 bp, Homo sapiens
accagagcaaaaa

SEQ ID NO: 2992643 - DNA, 16 bp, Homo sapiens
accagagcaggggctg

SEQ ID NO: 2992644 - DNA, 17 bp, Homo sapiens
accagagcaggggctgc

SEQ ID NO: 2992645 - DNA, 22 bp, Homo sapiens
accagagcaggggctgctgggg

SEQ ID NO: 2992646 - DNA, 23 bp, Homo sapiens
accagagcaggggctgctggggg

SEQ ID NO: 2992647 - DNA, 16 bp, Homo sapiens
accagagctgcctccc

SEQ ID NO: 2992648 - DNA, 19 bp, Homo sapiens
accagagctgcctccccaa

SEQ ID NO: 2992649 - DNA, 21 bp, Homo sapiens
accagagggatgggagagtca

SEQ ID NO: 2992650 - DNA, 17 bp, Homo sapiens
accagagttaaagcata

SEQ ID NO: 2992651 - DNA, 19 bp, Homo sapiens
accagcagaacagccattt

SEQ ID NO: 2992652 - DNA, 13 bp, Homo sapiens
accagcagcactg

SEQ ID NO: 2992653 - DNA, 18 bp, Homo sapiens
accagcagcgcctttccc

SEQ ID NO: 2992654 - DNA, 21 bp, Homo sapiens
accagcatccacactgccggc

SEQ ID NO: 2992655 - DNA, 18 bp, Homo sapiens
acatgaagattctttccc

SEQ ID NO: 2992656 - DNA, 23 bp, Homo sapiens
acatgaatcccacccacatgtga

SEQ ID NO: 2992657 - DNA, 19 bp, Homo sapiens
acatgacatcaaaatgagt

SEQ ID NO: 2992658 - DNA, 18 bp, Homo sapiens
acatgacatttaccagca

SEQ ID NO: 2992659 - DNA, 21 bp, Homo sapiens
acatgaccctaaatcttgact

SEQ ID NO: 2992660 - DNA, 23 bp, Homo sapiens
acatgaccctctgtccccaggcc

SEQ ID NO: 2992661 - DNA, 15 bp, Homo sapiens
acatgagaaagggag

SEQ ID NO: 2992662 - DNA, 21 bp, Homo sapiens
acatgaggaactgtagatgat

SEQ ID NO: 2992663 - DNA, 22 bp, Homo sapiens
acatgaggaactgtagatgatg

SEQ ID NO: 2992664 - DNA, 15 bp, Homo sapiens
acatgagtatcatca

SEQ ID NO: 2992665 - DNA, 19 bp, Homo sapiens
acatgatgaaaaattatag

SEQ ID NO: 2992666 - DNA, 23 bp, Homo sapiens
acatgatgcttttactgaacttt

SEQ ID NO: 2992667 - DNA, 18 bp, Homo sapiens
acatgcactcagctcttg

SEQ ID NO: 2992668 - DNA, 23 bp, Homo sapiens
acatgcagctctgcagcaatatt

SEQ ID NO: 2992669 - DNA, 10 bp, Homo sapiens
acatgcagtt

SEQ ID NO: 2992670 - DNA, 12 bp, Homo sapiens
acatgcagtttg

SEQ ID NO: 2992671 - DNA, 15 bp, Homo sapiens
acatgcagtttgaaa

SEQ ID NO: 2992672 - DNA, 18 bp, Homo sapiens
acatgcagtttgaaattc

SEQ ID NO: 2992673 - DNA, 12 bp, Homo sapiens
acatgcatacac

SEQ ID NO: 2992674 - DNA, 16 bp, Homo sapiens
acatgcatacacacac

SEQ ID NO: 2992675 - DNA, 14 bp, Homo sapiens
acatgccacaagga

SEQ ID NO: 2992676 - DNA, 14 bp, Homo sapiens
acatgccctgtgtg

SEQ ID NO: 2992677 - DNA, 18 bp, Homo sapiens
acatgcctgattttaaaa

SEQ ID NO: 2992678 - DNA, 17 bp, Homo sapiens
acatgcgggctcgccca

SEQ ID NO: 2992679 - DNA, 18 bp, Homo sapiens
acatgcggtagccagcac

SEQ ID NO: 2992680 - DNA, 20 bp, Homo sapiens
acatgcggtagccagcacac

SEQ ID NO: 2992681 - DNA, 20 bp, Homo sapiens
acatgctaaataactatata

SEQ ID NO: 2992682 - DNA, 20 bp, Homo sapiens
acatgctcagtacctgtgtt

SEQ ID NO: 2992683 - DNA, 23 bp, Homo sapiens
acatgcttcaatagttcaaggaa

SEQ ID NO: 2992684 - DNA, 13 bp, Homo sapiens
acatggaaaagga

SEQ ID NO: 2992685 - DNA, 20 bp, Homo sapiens
acatggaatctacatgtgtt

SEQ ID NO: 2992686 - DNA, 17 bp, Homo sapiens
acatggatacatatttc

SEQ ID NO: 2992687 - DNA, 14 bp, Homo sapiens
acatggatgtgttg

SEQ ID NO: 2992688 - DNA, 16 bp, Homo sapiens
acatggcagtgtttta

SEQ ID NO: 2992689 - DNA, 22 bp, Homo sapiens
acatggctccggcctctgcctt

SEQ ID NO: 2992690 - DNA, 21 bp, Homo sapiens
acatggctgggggagggactg

SEQ ID NO: 2992691 - DNA, 13 bp, Homo sapiens
acatggcttctcc

SEQ ID NO: 2992692 - DNA, 17 bp, Homo sapiens
acatggcttctcctttg

SEQ ID NO: 2992693 - DNA, 20 bp, Homo sapiens
acatgggctgtgattactgc

SEQ ID NO: 2992694 - DNA, 21 bp, Homo sapiens
acatgggctgtgattactgca

SEQ ID NO: 2992695 - DNA, 21 bp, Homo sapiens
acatggtaaacgctgtcccta

SEQ ID NO: 2992696 - DNA, 16 bp, Homo sapiens
acatggtctagtgaca

SEQ ID NO: 2992697 - DNA, 19 bp, Homo sapiens
acatggtgctacgcctgca

SEQ ID NO: 2992698 - DNA, 18 bp, Homo sapiens
acatggtgggtccatggg

SEQ ID NO: 2992699 - DNA, 21 bp, Homo sapiens
acatgtaactatttcttcaga

SEQ ID NO: 2992700 - DNA, 13 bp, Homo sapiens
acatgtaatttga

SEQ ID NO: 2992701 - DNA, 21 bp, Homo sapiens
acatgtaccccctttcccttc

SEQ ID NO: 2992702 - DNA, 15 bp, Homo sapiens
acatgtattatttca

SEQ ID NO: 2992703 - DNA, 19 bp, Homo sapiens
acatgtcagtaccttcaaa

SEQ ID NO: 2992704 - DNA, 21 bp, Homo sapiens
acatgtccttgtgtgttttga

SEQ ID NO: 2992705 - DNA, 16 bp, Homo sapiens
acatgtcttgtacatg

SEQ ID NO: 2992706 - DNA, 11 bp, Homo sapiens
acatgtgcaac

SEQ ID NO: 2992707 - DNA, 18 bp, Homo sapiens
acatgtgcaactcttgta

SEQ ID NO: 2992708 - DNA, 21 bp, Homo sapiens
acatgttcatctggaagtatt

SEQ ID NO: 2992709 - DNA, 11 bp, Homo sapiens
acatgtttctc

SEQ ID NO: 2992710 - DNA, 22 bp, Homo sapiens
acatgtttctctataaagtatg

SEQ ID NO: 2992711 - DNA, 22 bp, Homo sapiens
acatgttttgataaagtagtaa

SEQ ID NO: 2992712 - DNA, 23 bp, Homo sapiens
acatgttttgataaagtagtaaa

SEQ ID NO: 2992713 - DNA, 19 bp, Homo sapiens
acatgtttttatacaaaat

SEQ ID NO: 2992714 - DNA, 16 bp, Homo sapiens
acattaaaaagcctta

SEQ ID NO: 2992715 - DNA, 13 bp, Homo sapiens
acattaaaagaca

SEQ ID NO: 2992716 - DNA, 15 bp, Homo sapiens
acattaaagttaata

SEQ ID NO: 2992717 - DNA, 12 bp, Homo sapiens
acattaactgtt

SEQ ID NO: 2992718 - DNA, 13 bp, Homo sapiens
acattaactgttg

SEQ ID NO: 2992719 - DNA, 19 bp, Homo sapiens
acattaactgttgcacttt

SEQ ID NO: 2992720 - DNA, 19 bp, Homo sapiens
acattactctgcctctgta

SEQ ID NO: 2992721 - DNA, 11 bp, Homo sapiens
acattagaact

SEQ ID NO: 2992722 - DNA, 13 bp, Homo sapiens
acattagaacttc

SEQ ID NO: 2992723 - DNA, 14 bp, Homo sapiens
acattagaacttct

SEQ ID NO: 2992724 - DNA, 22 bp, Homo sapiens
acattagaacttctccgtcctc

SEQ ID NO: 2992725 - DNA, 21 bp, Homo sapiens
acattagaagacaattgacaa

SEQ ID NO: 2992726 - DNA, 23 bp, Homo sapiens
acattcaaaaaactctctcccag

SEQ ID NO: 2992727 - DNA, 20 bp, Homo sapiens
acattcacctgccccaactc

SEQ ID NO: 2992728 - DNA, 14 bp, Homo sapiens
acattccaagacag

SEQ ID NO: 2992729 - DNA, 17 bp, Homo sapiens
acattccaagacagtat

SEQ ID NO: 2992730 - DNA, 22 bp, Homo sapiens
acattcccctggggacccacgt

SEQ ID NO: 2992731 - DNA, 22 bp, Homo sapiens
acattctagggtattctgtaat

SEQ ID NO: 2992732 - DNA, 16 bp, Homo sapiens
acattctctaataaga

SEQ ID NO: 2992733 - DNA, 14 bp, Homo sapiens
acattctctattgt

SEQ ID NO: 2992734 - DNA, 20 bp, Homo sapiens
acattctctattgtaatttt

SEQ ID NO: 2992735 - DNA, 18 bp, Homo sapiens
acattctgtgtgtatcta

SEQ ID NO: 2992736 - DNA, 13 bp, Homo sapiens
acattcttaaaaa

SEQ ID NO: 2992737 - DNA, 16 bp, Homo sapiens
acattcttataaatat

SEQ ID NO: 2992738 - DNA, 17 bp, Homo sapiens
acattcttataaatatg

SEQ ID NO: 2992739 - DNA, 18 bp, Homo sapiens
acattcttataaatatga

SEQ ID NO: 2992740 - DNA, 20 bp, Homo sapiens
acattcttgtgtctgtttta

SEQ ID NO: 2992741 - DNA, 15 bp, Homo sapiens
acattgaaaacagat

SEQ ID NO: 2992742 - DNA, 14 bp, Homo sapiens
acattgccaaaaag

SEQ ID NO: 2992743 - DNA, 23 bp, Homo sapiens
acattgccaaaaaggatacataa

SEQ ID NO: 2992744 - DNA, 16 bp, Homo sapiens
acattgccttgcattt

SEQ ID NO: 2992745 - DNA, 23 bp, Homo sapiens
acattgcctttgaatgttaattt

SEQ ID NO: 2992746 - DNA, 23 bp, Homo sapiens
acattgcgtttgaccttttatgt

SEQ ID NO: 2992747 - DNA, 14 bp, Homo sapiens
acattgctaagatg

SEQ ID NO: 2992748 - DNA, 17 bp, Homo sapiens
acattgctaagatgctc

SEQ ID NO: 2992749 - DNA, 21 bp, Homo sapiens
acattgctccaagatgttctc

SEQ ID NO: 2992750 - DNA, 15 bp, Homo sapiens
acattggaaagcaca

SEQ ID NO: 2992751 - DNA, 19 bp, Homo sapiens
acattgggaaggggacccc

SEQ ID NO: 2992752 - DNA, 23 bp, Homo sapiens
acattgggaaggggacccccgcc

SEQ ID NO: 2992753 - DNA, 12 bp, Homo sapiens
acattgtaaata

SEQ ID NO: 2992754 - DNA, 14 bp, Homo sapiens
acattgtaaataaa

SEQ ID NO: 2992755 - DNA, 19 bp, Homo sapiens
acattgtaaataaattttg

SEQ ID NO: 2992756 - DNA, 21 bp, Homo sapiens
acattgtaaataaattttgtg

SEQ ID NO: 2992757 - DNA, 18 bp, Homo sapiens
acattgtgcccttgattt

SEQ ID NO: 2992758 - DNA, 13 bp, Homo sapiens
acattgttcaggt

SEQ ID NO: 2992759 - DNA, 17 bp, Homo sapiens
acattgttgagctattg

SEQ ID NO: 2992760 - DNA, 16 bp, Homo sapiens
acattgtttggatttc

SEQ ID NO: 2992761 - DNA, 19 bp, Homo sapiens
acattgtttggatttcctt

SEQ ID NO: 2992762 - DNA, 18 bp, Homo sapiens
acattgttttaaaaagaa

SEQ ID NO: 2992763 - DNA, 12 bp, Homo sapiens
acatttaaatcc

SEQ ID NO: 2992764 - DNA, 16 bp, Homo sapiens
acatttaatacagata

SEQ ID NO: 2992765 - DNA, 18 bp, Homo sapiens
acatttacaccacacttt

SEQ ID NO: 2992766 - DNA, 20 bp, Homo sapiens
acatttacaccacactttca

SEQ ID NO: 2992767 - DNA, 14 bp, Homo sapiens
acatttacatgtat

SEQ ID NO: 2992768 - DNA, 16 bp, Homo sapiens
acatttaggagaagtt

SEQ ID NO: 2992769 - DNA, 17 bp, Homo sapiens
acatttaggagaagttg

SEQ ID NO: 2992770 - DNA, 22 bp, Homo sapiens
acatttatatattgtctgtaaa

SEQ ID NO: 2992771 - DNA, 16 bp, Homo sapiens
acatttatctaaaaga

SEQ ID NO: 2992772 - DNA, 11 bp, Homo sapiens
acatttatgtg

SEQ ID NO: 2992773 - DNA, 15 bp, Homo sapiens
acatttatttttata

SEQ ID NO: 2992774 - DNA, 14 bp, Homo sapiens
acatttcaaaatta

SEQ ID NO: 2992775 - DNA, 16 bp, Homo sapiens
acatttcaaaattaat

SEQ ID NO: 2992776 - DNA, 16 bp, Homo sapiens
acatttcaccatggcc

SEQ ID NO: 2992777 - DNA, 13 bp, Homo sapiens
acatttctaaaat

SEQ ID NO: 2992778 - DNA, 12 bp, Homo sapiens
acatttctataa

SEQ ID NO: 2992779 - DNA, 12 bp, Homo sapiens
acatttctcaat

SEQ ID NO: 2992780 - DNA, 19 bp, Homo sapiens
acatttctttgtgctttgg

SEQ ID NO: 2992781 - DNA, 20 bp, Homo sapiens
acatttggaactaacacgtg

SEQ ID NO: 2992782 - DNA, 15 bp, Homo sapiens
acatttggaatactt

SEQ ID NO: 2992783 - DNA, 20 bp, Homo sapiens
acatttggagtgttcccctt

SEQ ID NO: 2992784 - DNA, 18 bp, Homo sapiens
acatttggcttacagtaa

SEQ ID NO: 2992785 - DNA, 20 bp, Homo sapiens
acatttggcttacagtaaat

SEQ ID NO: 2992786 - DNA, 21 bp, Homo sapiens
acatttgtagcatcctcttta

SEQ ID NO: 2992787 - DNA, 19 bp, Homo sapiens
acatttgtgatatatgtat

SEQ ID NO: 2992788 - DNA, 20 bp, Homo sapiens
acatttgtgccgacactgtt

SEQ ID NO: 2992789 - DNA, 22 bp, Homo sapiens
acatttgtgtcactgtacagtt

SEQ ID NO: 2992790 - DNA, 14 bp, Homo sapiens
acatttgtgtgtta

SEQ ID NO: 2992791 - DNA, 15 bp, Homo sapiens
acagtgtcccccagg

SEQ ID NO: 2992792 - DNA, 14 bp, Homo sapiens
acagtgtttatgac

SEQ ID NO: 2992793 - DNA, 18 bp, Homo sapiens
acagtgtttttgtaaagt

SEQ ID NO: 2992794 - DNA, 16 bp, Homo sapiens
acagttaaggaatata

SEQ ID NO: 2992795 - DNA, 17 bp, Homo sapiens
acagttaccctgctttg

SEQ ID NO: 2992796 - DNA, 12 bp, Homo sapiens
acagttagcatt

SEQ ID NO: 2992797 - DNA, 21 bp, Homo sapiens
acagttagggttttgcaataa

SEQ ID NO: 2992798 - DNA, 23 bp, Homo sapiens
acagttagggttttgcaataact

SEQ ID NO: 2992799 - DNA, 15 bp, Homo sapiens
acagttatcctgcaa

SEQ ID NO: 2992800 - DNA, 14 bp, Homo sapiens
acagttatgtgggt

SEQ ID NO: 2992801 - DNA, 21 bp, Homo sapiens
acagttatgtgggtggcttct

SEQ ID NO: 2992802 - DNA, 22 bp, Homo sapiens
acagttcaaaattctaaatgta

SEQ ID NO: 2992803 - DNA, 16 bp, Homo sapiens
acagttcataaatttg

SEQ ID NO: 2992804 - DNA, 23 bp, Homo sapiens
acagttcataaatttgttgtcat

SEQ ID NO: 2992805 - DNA, 13 bp, Homo sapiens
acagttccttcag

SEQ ID NO: 2992806 - DNA, 23 bp, Homo sapiens
acagttcggtgagctacaaatgc

SEQ ID NO: 2992807 - DNA, 12 bp, Homo sapiens
acagttctaggt

SEQ ID NO: 2992808 - DNA, 15 bp, Homo sapiens
acagttctgaagaat

SEQ ID NO: 2992809 - DNA, 19 bp, Homo sapiens
acagttctttgggccagac

SEQ ID NO: 2992810 - DNA, 22 bp, Homo sapiens
acagttgaagggaggggctgtg

SEQ ID NO: 2992811 - DNA, 17 bp, Homo sapiens
acagttgtttggagaac

SEQ ID NO: 2992812 - DNA, 20 bp, Homo sapiens
acagtttaacagagttttct

SEQ ID NO: 2992813 - DNA, 18 bp, Homo sapiens
acagtttactttgccaac

SEQ ID NO: 2992814 - DNA, 19 bp, Homo sapiens
acagtttataaagccaaga

SEQ ID NO: 2992815 - DNA, 23 bp, Homo sapiens
acagtttataaagccaagaattg

SEQ ID NO: 2992816 - DNA, 19 bp, Homo sapiens
acagtttcttttttcttac

SEQ ID NO: 2992817 - DNA, 18 bp, Homo sapiens
acagtttgtttcctgtct

SEQ ID NO: 2992818 - DNA, 21 bp, Homo sapiens
acagtttgtttcctgtctgat

SEQ ID NO: 2992819 - DNA, 22 bp, Homo sapiens
acagttttccttctcatctgtg

SEQ ID NO: 2992820 - DNA, 13 bp, Homo sapiens
acagttttgagaa

SEQ ID NO: 2992821 - DNA, 20 bp, Homo sapiens
acagttttgagaacgtaaag

SEQ ID NO: 2992822 - DNA, 16 bp, Homo sapiens
acagtttttgacattt

SEQ ID NO: 2992823 - DNA, 23 bp, Homo sapiens
acataaaaaagaagcactttgat

SEQ ID NO: 2992824 - DNA, 17 bp, Homo sapiens
acataaaatttacattt

SEQ ID NO: 2992825 - DNA, 18 bp, Homo sapiens
acataaaatttacattta

SEQ ID NO: 2992826 - DNA, 17 bp, Homo sapiens
acataaaggaacatggt

SEQ ID NO: 2992827 - DNA, 23 bp, Homo sapiens
acataaatagtagaaaaatcaga

SEQ ID NO: 2992828 - DNA, 16 bp, Homo sapiens
acataaccccttgaaa

SEQ ID NO: 2992829 - DNA, 20 bp, Homo sapiens
acataacttctcatgtatat

SEQ ID NO: 2992830 - DNA, 14 bp, Homo sapiens
acataagagaaaga

SEQ ID NO: 2992831 - DNA, 21 bp, Homo sapiens
acataagagaaagaggccaga

SEQ ID NO: 2992832 - DNA, 23 bp, Homo sapiens
acataaggcttttcctgttctgg

SEQ ID NO: 2992833 - DNA, 14 bp, Homo sapiens
acataataaattaa

SEQ ID NO: 2992834 - DNA, 15 bp, Homo sapiens
acataatagaatttc

SEQ ID NO: 2992835 - DNA, 20 bp, Homo sapiens
acataatgggccactgaaat

SEQ ID NO: 2992836 - DNA, 21 bp, Homo sapiens
acataatgggccactgaaatc

SEQ ID NO: 2992837 - DNA, 15 bp, Homo sapiens
acataattgattaaa

SEQ ID NO: 2992838 - DNA, 18 bp, Homo sapiens
acataattgattaaaatc

SEQ ID NO: 2992839 - DNA, 15 bp, Homo sapiens
acatacaccagcatt

SEQ ID NO: 2992840 - DNA, 19 bp, Homo sapiens
acatacagaattactgtaa

SEQ ID NO: 2992841 - DNA, 12 bp, Homo sapiens
acatacagtgat

SEQ ID NO: 2992842 - DNA, 14 bp, Homo sapiens
acatacatagacat

SEQ ID NO: 2992843 - DNA, 20 bp, Homo sapiens
acatacctgggtatgtgtag

SEQ ID NO: 2992844 - DNA, 16 bp, Homo sapiens
acataccttttatttt

SEQ ID NO: 2992845 - DNA, 14 bp, Homo sapiens
acatactacctaga

SEQ ID NO: 2992846 - DNA, 15 bp, Homo sapiens
acatacttgaagggc

SEQ ID NO: 2992847 - DNA, 16 bp, Homo sapiens
acatacttgaagggcc

SEQ ID NO: 2992848 - DNA, 19 bp, Homo sapiens
acatacttgaagggccaga

SEQ ID NO: 2992849 - DNA, 18 bp, Homo sapiens
acatagaaaaatgatgtc

SEQ ID NO: 2992850 - DNA, 18 bp, Homo sapiens
acatagacatttcaaaat

SEQ ID NO: 2992851 - DNA, 16 bp, Homo sapiens
acataggactcaaagt

SEQ ID NO: 2992852 - DNA, 20 bp, Homo sapiens
acataggtaggtatctttat

SEQ ID NO: 2992853 - DNA, 23 bp, Homo sapiens
acataggtaggtatctttatagt

SEQ ID NO: 2992854 - DNA, 17 bp, Homo sapiens
acatagtccagagaact

SEQ ID NO: 2992855 - DNA, 22 bp, Homo sapiens
acatagtgcattgtttctgtgg

SEQ ID NO: 2992856 - DNA, 13 bp, Homo sapiens
acatataaaataa

SEQ ID NO: 2992857 - DNA, 21 bp, Homo sapiens
acatataaagcactatacaga

SEQ ID NO: 2992858 - DNA, 15 bp, Homo sapiens
acatatacacacaca

SEQ ID NO: 2992859 - DNA, 16 bp, Homo sapiens
acatatatatatataa

SEQ ID NO: 2992860 - DNA, 17 bp, Homo sapiens
acatatattatatatag

SEQ ID NO: 2992861 - DNA, 21 bp, Homo sapiens
acatatattatatatagaaaa

SEQ ID NO: 2992862 - DNA, 15 bp, Homo sapiens
acatatcatgtgtga

SEQ ID NO: 2992863 - DNA, 23 bp, Homo sapiens
acatatggactctgcacatgaat

SEQ ID NO: 2992864 - DNA, 20 bp, Homo sapiens
acatatgtagaaacatttag

SEQ ID NO: 2992865 - DNA, 21 bp, Homo sapiens
acatatgttaataaactgcaa

SEQ ID NO: 2992866 - DNA, 22 bp, Homo sapiens
acatatgttaataaactgcaaa

SEQ ID NO: 2992867 - DNA, 19 bp, Homo sapiens
acatattgcaggagacatt

SEQ ID NO: 2992868 - DNA, 20 bp, Homo sapiens
acatattgcaggagacattt

SEQ ID NO: 2992869 - DNA, 23 bp, Homo sapiens
acatattgcaggagacattttca

SEQ ID NO: 2992870 - DNA, 20 bp, Homo sapiens
acatatttaactggtgcact

SEQ ID NO: 2992871 - DNA, 17 bp, Homo sapiens
acatatttaatgtttta

SEQ ID NO: 2992872 - DNA, 19 bp, Homo sapiens
acatattttattaagaact

SEQ ID NO: 2992873 - DNA, 12 bp, Homo sapiens
acatcaaagagg

SEQ ID NO: 2992874 - DNA, 12 bp, Homo sapiens
acatcaagcatc

SEQ ID NO: 2992875 - DNA, 13 bp, Homo sapiens
acatcaatatgta

SEQ ID NO: 2992876 - DNA, 14 bp, Homo sapiens
acatcacagggtgg

SEQ ID NO: 2992877 - DNA, 18 bp, Homo sapiens
acatcacagggtgggcct

SEQ ID NO: 2992878 - DNA, 13 bp, Homo sapiens
acacacacacaca

SEQ ID NO: 2992879 - DNA, 16 bp, Homo sapiens
acacacacacacacag

SEQ ID NO: 2992880 - DNA, 14 bp, Homo sapiens
acacacacacacag

SEQ ID NO: 2992881 - DNA, 15 bp, Homo sapiens
acacacacacacagc

SEQ ID NO: 2992882 - DNA, 15 bp, Homo sapiens
acacacacacacatg

SEQ ID NO: 2992883 - DNA, 17 bp, Homo sapiens
acacacacacacatgca

SEQ ID NO: 2992884 - DNA, 15 bp, Homo sapiens
acacacacacagcca

SEQ ID NO: 2992885 - DNA, 12 bp, Homo sapiens
acacacacacat

SEQ ID NO: 2992886 - DNA, 15 bp, Homo sapiens
acacacacacatgca

SEQ ID NO: 2992887 - DNA, 14 bp, Homo sapiens
acacacacagaaaa

SEQ ID NO: 2992888 - DNA, 16 bp, Homo sapiens
acacacacagaaaata

SEQ ID NO: 2992889 - DNA, 14 bp, Homo sapiens
acacacacagccac

SEQ ID NO: 2992890 - DNA, 14 bp, Homo sapiens
acacacacatgcat

SEQ ID NO: 2992891 - DNA, 20 bp, Homo sapiens
acacacagaaaatatactgt

SEQ ID NO: 2992892 - DNA, 13 bp, Homo sapiens
acacacagccaca

SEQ ID NO: 2992893 - DNA, 14 bp, Homo sapiens
acacacagccacac

SEQ ID NO: 2992894 - DNA, 15 bp, Homo sapiens
acacacagccacaca

SEQ ID NO: 2992895 - DNA, 18 bp, Homo sapiens
acacacagccacacacac

SEQ ID NO: 2992896 - DNA, 15 bp, Homo sapiens
acacacatgcataca

SEQ ID NO: 2992897 - DNA, 17 bp, Homo sapiens
acacacatgcatacaca

SEQ ID NO: 2992898 - DNA, 20 bp, Homo sapiens
acacacatgcatacacacac

SEQ ID NO: 2992899 - DNA, 17 bp, Homo sapiens
acacacctttaagtaga

SEQ ID NO: 2992900 - DNA, 13 bp, Homo sapiens
acacactacacca

SEQ ID NO: 2992901 - DNA, 16 bp, Homo sapiens
acacactacaccacac

SEQ ID NO: 2992902 - DNA, 12 bp, Homo sapiens
acacactccttc

SEQ ID NO: 2992903 - DNA, 13 bp, Homo sapiens
acacactccttcc

SEQ ID NO: 2992904 - DNA, 18 bp, Homo sapiens
acacactgccttattaca

SEQ ID NO: 2992905 - DNA, 15 bp, Homo sapiens
acacactttctcttc

SEQ ID NO: 2992906 - DNA, 18 bp, Homo sapiens
acacagaaacctttttaa

SEQ ID NO: 2992907 - DNA, 21 bp, Homo sapiens
acacagaaacctttttaaaaa

SEQ ID NO: 2992908 - DNA, 17 bp, Homo sapiens
acacagagtgtgttttt

SEQ ID NO: 2992909 - DNA, 16 bp, Homo sapiens
acacagatgttcggtt

SEQ ID NO: 2992910 - DNA, 13 bp, Homo sapiens
acacagcagacct

SEQ ID NO: 2992911 - DNA, 11 bp, Homo sapiens
acacagccaca

SEQ ID NO: 2992912 - DNA, 12 bp, Homo sapiens
acacagccacac

SEQ ID NO: 2992913 - DNA, 13 bp, Homo sapiens
acacagccacaca

SEQ ID NO: 2992914 - DNA, 15 bp, Homo sapiens
acacagccacacaca

SEQ ID NO: 2992915 - DNA, 21 bp, Homo sapiens
acacagccacacacacagaaa

SEQ ID NO: 2992916 - DNA, 22 bp, Homo sapiens
acacagccacacacacagaaaa

SEQ ID NO: 2992917 - DNA, 20 bp, Homo sapiens
acacagcccagttcccgtga

SEQ ID NO: 2992918 - DNA, 13 bp, Homo sapiens
acacagcctgggc

SEQ ID NO: 2992919 - DNA, 14 bp, Homo sapiens
acacagcctgggcc

SEQ ID NO: 2992920 - DNA, 20 bp, Homo sapiens
acacagcctgggccccagct

SEQ ID NO: 2992921 - DNA, 17 bp, Homo sapiens
acacagcggctgcctcc

SEQ ID NO: 2992922 - DNA, 17 bp, Homo sapiens
acacagctactctcccc

SEQ ID NO: 2992923 - DNA, 15 bp, Homo sapiens
acacaggtctttcct

SEQ ID NO: 2992924 - DNA, 16 bp, Homo sapiens
acacaggtctttccta

SEQ ID NO: 2992925 - DNA, 19 bp, Homo sapiens
acacagtcttggctcactg

SEQ ID NO: 2992926 - DNA, 22 bp, Homo sapiens
acacagtgagagtactcacttt

SEQ ID NO: 2992927 - DNA, 13 bp, Homo sapiens
acacatcagcatg

SEQ ID NO: 2992928 - DNA, 16 bp, Homo sapiens
acacatctctgtcagt

SEQ ID NO: 2992929 - DNA, 13 bp, Homo sapiens
acacatctgtgga

SEQ ID NO: 2992930 - DNA, 16 bp, Homo sapiens
acacatgcatacacac

SEQ ID NO: 2992931 - DNA, 19 bp, Homo sapiens
acacatgcatacacacaca

SEQ ID NO: 2992932 - DNA, 23 bp, Homo sapiens
acacatgtcctatccaaaggaat

SEQ ID NO: 2992933 - DNA, 13 bp, Homo sapiens
acacatttcacat

SEQ ID NO: 2992934 - DNA, 12 bp, Homo sapiens
acacattttgta

SEQ ID NO: 2992935 - DNA, 11 bp, Homo sapiens
acacatttttg

SEQ ID NO: 2992936 - DNA, 15 bp, Homo sapiens
acaccaaaaattgcg

SEQ ID NO: 2992937 - DNA, 14 bp, Homo sapiens
acaccaaatataac

SEQ ID NO: 2992938 - DNA, 16 bp, Homo sapiens
acaccaagatgtctgt

SEQ ID NO: 2992939 - DNA, 21 bp, Homo sapiens
acaccaagcacagcagcctgg

SEQ ID NO: 2992940 - DNA, 16 bp, Homo sapiens
acaccaagcagcaaca

SEQ ID NO: 2992941 - DNA, 22 bp, Homo sapiens
acaccaaggtttatgccaccag

SEQ ID NO: 2992942 - DNA, 12 bp, Homo sapiens
acaccacacaca

SEQ ID NO: 2992943 - DNA, 16 bp, Homo sapiens
acaccacacacaacag

SEQ ID NO: 2992944 - DNA, 17 bp, Homo sapiens
acaccaccgagctctgt

SEQ ID NO: 2992945 - DNA, 21 bp, Homo sapiens
acaccaccgagctctgtggga

SEQ ID NO: 2992946 - DNA, 19 bp, Homo sapiens
acaccactgagctctgcct

SEQ ID NO: 2992947 - DNA, 20 bp, Homo sapiens
acaccactgagctctgcctc

SEQ ID NO: 2992948 - DNA, 22 bp, Homo sapiens
acaccacttggagatctttgct

SEQ ID NO: 2992949 - DNA, 14 bp, Homo sapiens
acaccagacagaca

SEQ ID NO: 2992950 - DNA, 15 bp, Homo sapiens
acaccagcctcctgg

SEQ ID NO: 2992951 - DNA, 22 bp, Homo sapiens
acaccaggatagagactggaac

SEQ ID NO: 2992952 - DNA, 17 bp, Homo sapiens
acacccactcagctccg

SEQ ID NO: 2992953 - DNA, 20 bp, Homo sapiens
acaccccgcctgcctcctgg

SEQ ID NO: 2992954 - DNA, 21 bp, Homo sapiens
acacccgacaccagccctgct

SEQ ID NO: 2992955 - DNA, 17 bp, Homo sapiens
acaccctcaacctcttc

SEQ ID NO: 2992956 - DNA, 18 bp, Homo sapiens
acaccctcaacctcttct

SEQ ID NO: 2992957 - DNA, 22 bp, Homo sapiens
acaccctcaccacccaacagtg

SEQ ID NO: 2992958 - DNA, 11 bp, Homo sapiens
acaccctgcct

SEQ ID NO: 2992959 - DNA, 14 bp, Homo sapiens
acaccctgcctgct

SEQ ID NO: 2992960 - DNA, 18 bp, Homo sapiens
acaccctgcctgctgtgg

SEQ ID NO: 2992961 - DNA, 18 bp, Homo sapiens
acaccgtacatctgcaat

SEQ ID NO: 2992962 - DNA, 14 bp, Homo sapiens
acaccgtggcctgg

SEQ ID NO: 2992963 - DNA, 15 bp, Homo sapiens
acaccgtggcctggg

SEQ ID NO: 2992964 - DNA, 17 bp, Homo sapiens
acaccgtggcctgggct

SEQ ID NO: 2992965 - DNA, 18 bp, Homo sapiens
acaccgtggggaaggggt

SEQ ID NO: 2992966 - DNA, 21 bp, Homo sapiens
acacctaaaaccagttttgct

SEQ ID NO: 2992967 - DNA, 14 bp, Homo sapiens
acacctgcacctcc

SEQ ID NO: 2992968 - DNA, 16 bp, Homo sapiens
acacctgcacctcccc

SEQ ID NO: 2992969 - DNA, 11 bp, Homo sapiens
acacctgcctg

SEQ ID NO: 2992970 - DNA, 12 bp, Homo sapiens
acacctgcctgc

SEQ ID NO: 2992971 - DNA, 15 bp, Homo sapiens
acacctggccgggtc

SEQ ID NO: 2992972 - DNA, 20 bp, Homo sapiens
acacctggccgggtcaccct

SEQ ID NO: 2992973 - DNA, 17 bp, Homo sapiens
acacctgggcttaagaa

SEQ ID NO: 2992974 - DNA, 22 bp, Homo sapiens
acaccttggcttgttattgcct

SEQ ID NO: 2992975 - DNA, 14 bp, Homo sapiens
acacctttctcctt

SEQ ID NO: 2992976 - DNA, 12 bp, Homo sapiens
acacgcaggcgg

SEQ ID NO: 2992977 - DNA, 21 bp, Homo sapiens
acacgccccaattttcaggta

SEQ ID NO: 2992978 - DNA, 22 bp, Homo sapiens
acacgcctgcaaacgctgcctg

SEQ ID NO: 2992979 - DNA, 12 bp, Homo sapiens
acacggccacat

SEQ ID NO: 2992980 - DNA, 20 bp, Homo sapiens
acacggccacatcaaagagg

SEQ ID NO: 2992981 - DNA, 17 bp, Homo sapiens
acaacaaataatttaag

SEQ ID NO: 2992982 - DNA, 16 bp, Homo sapiens
acaacaacaataataa

SEQ ID NO: 2992983 - DNA, 19 bp, Homo sapiens
acaacaataataaagatgt

SEQ ID NO: 2992984 - DNA, 15 bp, Homo sapiens
acaacactacttccc

SEQ ID NO: 2992985 - DNA, 12 bp, Homo sapiens
acaacagaaaga

SEQ ID NO: 2992986 - DNA, 13 bp, Homo sapiens
acaacagaaagag

SEQ ID NO: 2992987 - DNA, 14 bp, Homo sapiens
acaacagatttgtg

SEQ ID NO: 2992988 - DNA, 15 bp, Homo sapiens
acaacagatttgtga

SEQ ID NO: 2992989 - DNA, 16 bp, Homo sapiens
acaacagccaacagct

SEQ ID NO: 2992990 - DNA, 24 bp, Homo sapiens
acaacagccaacagctacaacagc

SEQ ID NO: 2992991 - DNA, 17 bp, Homo sapiens
acaacatcttaaatctt

SEQ ID NO: 2992992 - DNA, 15 bp, Homo sapiens
acaacatggcttctc

SEQ ID NO: 2992993 - DNA, 21 bp, Homo sapiens
acaacatttatatattgtctg

SEQ ID NO: 2992994 - DNA, 23 bp, Homo sapiens
acaacatttatatattgtctgta

SEQ ID NO: 2992995 - DNA, 16 bp, Homo sapiens
acaaccaatggaatgt

SEQ ID NO: 2992996 - DNA, 20 bp, Homo sapiens
acaaccaccaccttatacat

SEQ ID NO: 2992997 - DNA, 17 bp, Homo sapiens
acaaccatctcatccta

SEQ ID NO: 2992998 - DNA, 13 bp, Homo sapiens
acaaccgttggaa

SEQ ID NO: 2992999 - DNA, 22 bp, Homo sapiens
acaacctgcttgggtggagaag

SEQ ID NO: 2993000 - DNA, 12 bp, Homo sapiens
acaaccttgcag

SEQ ID NO: 2993001 - DNA, 22 bp, Homo sapiens
acaacctttcccatttcgtgta

SEQ ID NO: 2993002 - DNA, 10 bp, Homo sapiens
acaactaagt

SEQ ID NO: 2993003 - DNA, 17 bp, Homo sapiens
acaactatttcggcctt

SEQ ID NO: 2993004 - DNA, 20 bp, Homo sapiens
acaactattttcagatgtga

SEQ ID NO: 2993005 - DNA, 20 bp, Homo sapiens
acaactccttccatccttga

SEQ ID NO: 2993006 - DNA, 21 bp, Homo sapiens
acaactgcctcgaaacacaga

SEQ ID NO: 2993007 - DNA, 12 bp, Homo sapiens
acaagaatgcat

SEQ ID NO: 2993008 - DNA, 15 bp, Homo sapiens
acaagaatgcattga

SEQ ID NO: 2993009 - DNA, 18 bp, Homo sapiens
acaagagtccccagactc

SEQ ID NO: 2993010 - DNA, 15 bp, Homo sapiens
acaagattcccagag

SEQ ID NO: 2993011 - DNA, 21 bp, Homo sapiens
acaagattcccagagacagga

SEQ ID NO: 2993012 - DNA, 16 bp, Homo sapiens
acaagcaaacccagac

SEQ ID NO: 2993013 - DNA, 22 bp, Homo sapiens
acaagcaaggatatcagagctg

SEQ ID NO: 2993014 - DNA, 18 bp, Homo sapiens
acaagcactaaacaaaga

SEQ ID NO: 2993015 - DNA, 19 bp, Homo sapiens
acaagcagatactgctgtg

SEQ ID NO: 2993016 - DNA, 15 bp, Homo sapiens
acaagccagctggag

SEQ ID NO: 2993017 - DNA, 14 bp, Homo sapiens
acaagcccaaattt

SEQ ID NO: 2993018 - DNA, 14 bp, Homo sapiens
acaagccccccctt

SEQ ID NO: 2993019 - DNA, 16 bp, Homo sapiens
acaagctacagttgtc

SEQ ID NO: 2993020 - DNA, 15 bp, Homo sapiens
acaagctgcctctga

SEQ ID NO: 2993021 - DNA, 19 bp, Homo sapiens
acaagctgtatcactgcct

SEQ ID NO: 2993022 - DNA, 21 bp, Homo sapiens
acaaggaagtcaaagcaagga

SEQ ID NO: 2993023 - DNA, 14 bp, Homo sapiens
acaaggaataaatg

SEQ ID NO: 2993024 - DNA, 14 bp, Homo sapiens
acaaggacacgcgc

SEQ ID NO: 2993025 - DNA, 21 bp, Homo sapiens
acaaggagagcggaggaggaa

SEQ ID NO: 2993026 - DNA, 16 bp, Homo sapiens
acaaggatagatgctg

SEQ ID NO: 2993027 - DNA, 21 bp, Homo sapiens
acaaggatagatgctggccca

SEQ ID NO: 2993028 - DNA, 21 bp, Homo sapiens
acaaggcaggcctttcctaca

SEQ ID NO: 2993029 - DNA, 18 bp, Homo sapiens
acaaggccatctgggctc

SEQ ID NO: 2993030 - DNA, 15 bp, Homo sapiens
acaaggcctggtctg

SEQ ID NO: 2993031 - DNA, 17 bp, Homo sapiens
acaaggcctggtctggg

SEQ ID NO: 2993032 - DNA, 14 bp, Homo sapiens
acaagggaggcagt

SEQ ID NO: 2993033 - DNA, 18 bp, Homo sapiens
acaagggtctagggagag

SEQ ID NO: 2993034 - DNA, 20 bp, Homo sapiens
acaagggtctagggagagac

SEQ ID NO: 2993035 - DNA, 21 bp, Homo sapiens
acaaggtacccctttctggct

SEQ ID NO: 2993036 - DNA, 19 bp, Homo sapiens
acaaggtcatggccacact

SEQ ID NO: 2993037 - DNA, 24 bp, Homo sapiens
acaaggtcatggccacactgtgac

SEQ ID NO: 2993038 - DNA, 23 bp, Homo sapiens
acaaggtcctctgtcagtcacag

SEQ ID NO: 2993039 - DNA, 15 bp, Homo sapiens
acaaggtgtgtgtgt

SEQ ID NO: 2993040 - DNA, 15 bp, Homo sapiens
acaaggtgttcattt

SEQ ID NO: 2993041 - DNA, 13 bp, Homo sapiens
acaagtaactcag

SEQ ID NO: 2993042 - DNA, 18 bp, Homo sapiens
acaagtgaaaaacatcca

SEQ ID NO: 2993043 - DNA, 13 bp, Homo sapiens
acaagtgaagttg

SEQ ID NO: 2993044 - DNA, 23 bp, Homo sapiens
acaagtgccgcaaattgtacctt

SEQ ID NO: 2993045 - DNA, 16 bp, Homo sapiens
acaagtgctcaagcag

SEQ ID NO: 2993046 - DNA, 15 bp, Homo sapiens
acaagtggcagacat

SEQ ID NO: 2993047 - DNA, 20 bp, Homo sapiens
acaagttaaggtatctggta

SEQ ID NO: 2993048 - DNA, 22 bp, Homo sapiens
acaagttatttaaatctgtttt

SEQ ID NO: 2993049 - DNA, 15 bp, Homo sapiens
acaagttgctttgtt

SEQ ID NO: 2993050 - DNA, 16 bp, Homo sapiens
acaagttgctttgtta

SEQ ID NO: 2993051 - DNA, 16 bp, Homo sapiens
acaagtttatatatat

SEQ ID NO: 2993052 - DNA, 16 bp, Homo sapiens
acaataaaacattaat

SEQ ID NO: 2993053 - DNA, 19 bp, Homo sapiens
acaataaaaccaagcctct

SEQ ID NO: 2993054 - DNA, 18 bp, Homo sapiens
acaataagagtctccttc

SEQ ID NO: 2993055 - DNA, 22 bp, Homo sapiens
acaataagtaaatccacaggct

SEQ ID NO: 2993056 - DNA, 13 bp, Homo sapiens
acaataatggaaa

SEQ ID NO: 2993057 - DNA, 21 bp, Homo sapiens
acaatactcataatgtgaagt

SEQ ID NO: 2993058 - DNA, 21 bp, Homo sapiens
acaatcacaaaagctgtgtct

SEQ ID NO: 2993059 - DNA, 15 bp, Homo sapiens
acaatcagtgtgaat

SEQ ID NO: 2993060 - DNA, 16 bp, Homo sapiens
acaatcagtgtgaatg

SEQ ID NO: 2993061 - DNA, 12 bp, Homo sapiens
acaatccaaatg

SEQ ID NO: 2993062 - DNA, 18 bp, Homo sapiens
acaatccaaatgcattca

SEQ ID NO: 2993063 - DNA, 17 bp, Homo sapiens
acaatcctaccttttga

SEQ ID NO: 2993064 - DNA, 16 bp, Homo sapiens
acaatcctagtgcttt

SEQ ID NO: 2993065 - DNA, 22 bp, Homo sapiens
acaatcctagtgctttcctttt

SEQ ID NO: 2993066 - DNA, 14 bp, Homo sapiens
acaatctgttctac

SEQ ID NO: 2993067 - DNA, 17 bp, Homo sapiens
acaatctgttctactct

SEQ ID NO: 2993068 - DNA, 21 bp, Homo sapiens
acaatctgttctactcttaat

SEQ ID NO: 2993069 - DNA, 11 bp, Homo sapiens
acaatctttat

SEQ ID NO: 2993070 - DNA, 12 bp, Homo sapiens
acaatctttatt

SEQ ID NO: 2993071 - DNA, 23 bp, Homo sapiens
acaatgactaagccaagctgtgt

SEQ ID NO: 2993072 - DNA, 17 bp, Homo sapiens
acaatgagtttgggcat

SEQ ID NO: 2993073 - DNA, 18 bp, Homo sapiens
acaatgccaagtcactct

SEQ ID NO: 2993074 - DNA, 21 bp, Homo sapiens
acaatgcgtggcacatctaaa

SEQ ID NO: 2993075 - DNA, 14 bp, Homo sapiens
acaatgggaaaaga

SEQ ID NO: 2993076 - DNA, 17 bp, Homo sapiens
acaatggggatgttgtg

SEQ ID NO: 2993077 - DNA, 19 bp, Homo sapiens
acaatggtgtggtgaatgt

SEQ ID NO: 2993078 - DNA, 22 bp, Homo sapiens
acaatggtgttatttgaaactt

SEQ ID NO: 2993079 - DNA, 18 bp, Homo sapiens
acaatggtttttaaattt

SEQ ID NO: 2993080 - DNA, 22 bp, Homo sapiens
acaatgtacaaggtatgtacag

SEQ ID NO: 2993081 - DNA, 11 bp, Homo sapiens
acaatgtattt

SEQ ID NO: 2993082 - DNA, 21 bp, Homo sapiens
acaatgtatttatttaaaaga

SEQ ID NO: 2993083 - DNA, 15 bp, Homo sapiens
acaattattgtatat

SEQ ID NO: 2993084 - DNA, 18 bp, Homo sapiens
acaattatttttacagtt

SEQ ID NO: 2993085 - DNA, 15 bp, Homo sapiens
acaattcatgaactt

SEQ ID NO: 2993086 - DNA, 15 bp, Homo sapiens
acaattctgttttta

SEQ ID NO: 2993087 - DNA, 17 bp, Homo sapiens
acaattctgtttttaat

SEQ ID NO: 2993088 - DNA, 17 bp, Homo sapiens
aatcaacttgcttatca

SEQ ID NO: 2993089 - DNA, 21 bp, Homo sapiens
aatcaactttttattgccttc

SEQ ID NO: 2993090 - DNA, 22 bp, Homo sapiens
aatcaactttttattgccttct

SEQ ID NO: 2993091 - DNA, 23 bp, Homo sapiens
aatcaactttttattgccttctc

SEQ ID NO: 2993092 - DNA, 21 bp, Homo sapiens
aatcaagagtctctccagcct

SEQ ID NO: 2993093 - DNA, 17 bp, Homo sapiens
aatcaagattatgatga

SEQ ID NO: 2993094 - DNA, 22 bp, Homo sapiens
aactggcaggcaggctcccagg

SEQ ID NO: 2993095 - DNA, 17 bp, Homo sapiens
aactggcagttttccat

SEQ ID NO: 2993096 - DNA, 15 bp, Homo sapiens
aactggcttgtacat

SEQ ID NO: 2993097 - DNA, 21 bp, Homo sapiens
aactggcttgtacatttttaa

SEQ ID NO: 2993098 - DNA, 22 bp, Homo sapiens
aactgggttttcagcataaatg

SEQ ID NO: 2993099 - DNA, 19 bp, Homo sapiens
aactggttcaagagacact

SEQ ID NO: 2993100 - DNA, 14 bp, Homo sapiens
aactggttcttgcc

SEQ ID NO: 2993101 - DNA, 16 bp, Homo sapiens
aactggttcttgcctt

SEQ ID NO: 2993102 - DNA, 14 bp, Homo sapiens
aactgtaaagcaaa

SEQ ID NO: 2993103 - DNA, 15 bp, Homo sapiens
aactgtaaagcaaat

SEQ ID NO: 2993104 - DNA, 13 bp, Homo sapiens
aactgtaaataaa

SEQ ID NO: 2993105 - DNA, 13 bp, Homo sapiens
aactgtactgaat

SEQ ID NO: 2993106 - DNA, 15 bp, Homo sapiens
aactgtagaaatgat

SEQ ID NO: 2993107 - DNA, 17 bp, Homo sapiens
aactgtagaaatgatga

SEQ ID NO: 2993108 - DNA, 14 bp, Homo sapiens
aactgtatatattc

SEQ ID NO: 2993109 - DNA, 22 bp, Homo sapiens
aactgtatttaaggaatcaaat

SEQ ID NO: 2993110 - DNA, 11 bp, Homo sapiens
aactgtccctg

SEQ ID NO: 2993111 - DNA, 17 bp, Homo sapiens
aactgtccctgctttct

SEQ ID NO: 2993112 - DNA, 16 bp, Homo sapiens
aactgtcggaggaaag

SEQ ID NO: 2993113 - DNA, 19 bp, Homo sapiens
aactgtcggaggaaagaca

SEQ ID NO: 2993114 - DNA, 19 bp, Homo sapiens
aactgtgaataataaatac

SEQ ID NO: 2993115 - DNA, 20 bp, Homo sapiens
aactgtgaataataaataca

SEQ ID NO: 2993116 - DNA, 11 bp, Homo sapiens
aactgtgaatg

SEQ ID NO: 2993117 - DNA, 15 bp, Homo sapiens
aactgtgaatgcttc

SEQ ID NO: 2993118 - DNA, 22 bp, Homo sapiens
aactgtgaatgcttctgattta

SEQ ID NO: 2993119 - DNA, 22 bp, Homo sapiens
aactgtgcagagtctagaagtt

SEQ ID NO: 2993120 - DNA, 19 bp, Homo sapiens
aactgtgcagttttgtttg

SEQ ID NO: 2993121 - DNA, 11 bp, Homo sapiens
aactgtggccg

SEQ ID NO: 2993122 - DNA, 19 bp, Homo sapiens
aactgtggtagctccagcg

SEQ ID NO: 2993123 - DNA, 15 bp, Homo sapiens
aactgtgtagcatct

SEQ ID NO: 2993124 - DNA, 19 bp, Homo sapiens
aactgttaaatgtggtttc

SEQ ID NO: 2993125 - DNA, 19 bp, Homo sapiens
aactgttgcacttttgaat

SEQ ID NO: 2993126 - DNA, 19 bp, Homo sapiens
aacttaaaaccttgaaggt

SEQ ID NO: 2993127 - DNA, 11 bp, Homo sapiens
aacttaaagat

SEQ ID NO: 2993128 - DNA, 13 bp, Homo sapiens
aacttaaataata

SEQ ID NO: 2993129 - DNA, 17 bp, Homo sapiens
aacttaacttaaaattg

SEQ ID NO: 2993130 - DNA, 16 bp, Homo sapiens
aacttagaggaaaatg

SEQ ID NO: 2993131 - DNA, 20 bp, Homo sapiens
aacttagatcatcagtcacc

SEQ ID NO: 2993132 - DNA, 23 bp, Homo sapiens
aacttattctgtagattctgtgg

SEQ ID NO: 2993133 - DNA, 19 bp, Homo sapiens
aacttattgcctgggcagt

SEQ ID NO: 2993134 - DNA, 23 bp, Homo sapiens
aacttattgcctgggcagtgccc

SEQ ID NO: 2993135 - DNA, 19 bp, Homo sapiens
aacttatttaaaaatattt

SEQ ID NO: 2993136 - DNA, 21 bp, Homo sapiens
aacttatttaaaaatatttca

SEQ ID NO: 2993137 - DNA, 18 bp, Homo sapiens
aacttatttatatgaagc

SEQ ID NO: 2993138 - DNA, 21 bp, Homo sapiens
aacttatttatatgaagcaag

SEQ ID NO: 2993139 - DNA, 19 bp, Homo sapiens
aacttcaacatttacatgt

SEQ ID NO: 2993140 - DNA, 22 bp, Homo sapiens
aacttcaggtgtgactctagca

SEQ ID NO: 2993141 - DNA, 18 bp, Homo sapiens
aacttccccatcttctaa

SEQ ID NO: 2993142 - DNA, 17 bp, Homo sapiens
aacttcctgtgcctttc

SEQ ID NO: 2993143 - DNA, 19 bp, Homo sapiens
aacttccttcacatctccc

SEQ ID NO: 2993144 - DNA, 22 bp, Homo sapiens
aacttctatattttaatagaaa

SEQ ID NO: 2993145 - DNA, 24 bp, Homo sapiens
aacttcttatggaattgatttgca

SEQ ID NO: 2993146 - DNA, 21 bp, Homo sapiens
aacttgaatttggtctgtata

SEQ ID NO: 2993147 - DNA, 16 bp, Homo sapiens
aacttggaaaaagaaa

SEQ ID NO: 2993148 - DNA, 12 bp, Homo sapiens
aacttggatcat

SEQ ID NO: 2993149 - DNA, 18 bp, Homo sapiens
aacttggctgcaggaatc

SEQ ID NO: 2993150 - DNA, 20 bp, Homo sapiens
aacttgtaatttttttaatt

SEQ ID NO: 2993151 - DNA, 13 bp, Homo sapiens
aacttgtcacttg

SEQ ID NO: 2993152 - DNA, 16 bp, Homo sapiens
aacttgtgagcatcag

SEQ ID NO: 2993153 - DNA, 18 bp, Homo sapiens
aacttgttactaaagaaa

SEQ ID NO: 2993154 - DNA, 22 bp, Homo sapiens
aagacattgggtctattccagc

SEQ ID NO: 2993155 - DNA, 14 bp, Homo sapiens
aagacatttcaaat

SEQ ID NO: 2993156 - DNA, 15 bp, Homo sapiens
aagacatttcctttt

SEQ ID NO: 2993157 - DNA, 23 bp, Homo sapiens
aagaccaaatgatagaactgtac

SEQ ID NO: 2993158 - DNA, 23 bp, Homo sapiens
aagaccaaggcctcggcagaact

SEQ ID NO: 2993159 - DNA, 18 bp, Homo sapiens
aagaccaccacttcgaaa

SEQ ID NO: 2993160 - DNA, 15 bp, Homo sapiens
aagacccccagcact

SEQ ID NO: 2993161 - DNA, 17 bp, Homo sapiens
aagacctactgttctaa

SEQ ID NO: 2993162 - DNA, 18 bp, Homo sapiens
aagacctactgttctaaa

SEQ ID NO: 2993163 - DNA, 22 bp, Homo sapiens
aagacctactgttctaaagctc

SEQ ID NO: 2993164 - DNA, 16 bp, Homo sapiens
aagacctcacctagaa

SEQ ID NO: 2993165 - DNA, 14 bp, Homo sapiens
aagacctgaatccc

SEQ ID NO: 2993166 - DNA, 21 bp, Homo sapiens
aagacggcacggtcttccctc

SEQ ID NO: 2993167 - DNA, 22 bp, Homo sapiens
aagactcccgccccgggctggc

SEQ ID NO: 2993168 - DNA, 12 bp, Homo sapiens
aagactccctga

SEQ ID NO: 2993169 - DNA, 15 bp, Homo sapiens
aagactctagagtcc

SEQ ID NO: 2993170 - DNA, 21 bp, Homo sapiens
aagactctagagtccaaggtt

SEQ ID NO: 2993171 - DNA, 14 bp, Homo sapiens
aagactgaaacggc

SEQ ID NO: 2993172 - DNA, 19 bp, Homo sapiens
aagactgagccagattggc

SEQ ID NO: 2993173 - DNA, 12 bp, Homo sapiens
aagactgccacg

SEQ ID NO: 2993174 - DNA, 20 bp, Homo sapiens
aagactgccacgtgccttag

SEQ ID NO: 2993175 - DNA, 23 bp, Homo sapiens
aagactgccacgtgccttaggaa

SEQ ID NO: 2993176 - DNA, 12 bp, Homo sapiens
aagactgcctcc

SEQ ID NO: 2993177 - DNA, 17 bp, Homo sapiens
aagactgctaaatgcac

SEQ ID NO: 2993178 - DNA, 20 bp, Homo sapiens
aagactggaagctaatttgc

SEQ ID NO: 2993179 - DNA, 19 bp, Homo sapiens
aagactggatttgcagaag

SEQ ID NO: 2993180 - DNA, 14 bp, Homo sapiens
aagacttactctaa

SEQ ID NO: 2993181 - DNA, 17 bp, Homo sapiens
aagacttactctaagat

SEQ ID NO: 2993182 - DNA, 20 bp, Homo sapiens
aagacttcagtcctggtctg

SEQ ID NO: 2993183 - DNA, 14 bp, Homo sapiens
aagacttgacagtg

SEQ ID NO: 2993184 - DNA, 19 bp, Homo sapiens
aagactttgggataggaaa

SEQ ID NO: 2993185 - DNA, 20 bp, Homo sapiens
aagactttgggataggaaaa

SEQ ID NO: 2993186 - DNA, 16 bp, Homo sapiens
aagagaaaaaaaaaca

SEQ ID NO: 2993187 - DNA, 11 bp, Homo sapiens
aagagaaagag

SEQ ID NO: 2993188 - DNA, 18 bp, Homo sapiens
aagagaaagagtttgaaa

SEQ ID NO: 2993189 - DNA, 19 bp, Homo sapiens
aagagacactcagaccaga

SEQ ID NO: 2993190 - DNA, 16 bp, Homo sapiens
aagagacactgcttgg

SEQ ID NO: 2993191 - DNA, 19 bp, Homo sapiens
aagagacatgagaaaggga

SEQ ID NO: 2993192 - DNA, 15 bp, Homo sapiens
aagagactcagcctg

SEQ ID NO: 2993193 - DNA, 17 bp, Homo sapiens
aagagactcagcctgca

SEQ ID NO: 2993194 - DNA, 16 bp, Homo sapiens
aagagagaaaataaaa

SEQ ID NO: 2993195 - DNA, 23 bp, Homo sapiens
aagagagaaaataaaaagttaaa

SEQ ID NO: 2993196 - DNA, 16 bp, Homo sapiens
aagagagattggattt

SEQ ID NO: 2993197 - DNA, 19 bp, Homo sapiens
aagagaggaaggacccctc

SEQ ID NO: 2993198 - DNA, 21 bp, Homo sapiens
aagagaggaaggacccctcac

SEQ ID NO: 2993199 - DNA, 13 bp, Homo sapiens
aagagatattttg

SEQ ID NO: 2993200 - DNA, 22 bp, Homo sapiens
aagagatattttgggcatgtgg

SEQ ID NO: 2993201 - DNA, 17 bp, Homo sapiens
aagagatgagaaatgat

SEQ ID NO: 2993202 - DNA, 15 bp, Homo sapiens
aagagattgcacagt

SEQ ID NO: 2993203 - DNA, 17 bp, Homo sapiens
aagagattgttgtttgc

SEQ ID NO: 2993204 - DNA, 15 bp, Homo sapiens
aagagcaagtctgga

SEQ ID NO: 2993205 - DNA, 19 bp, Homo sapiens
aagagcaatgtgtggctga

SEQ ID NO: 2993206 - DNA, 14 bp, Homo sapiens
aagagcagaacaga

SEQ ID NO: 2993207 - DNA, 17 bp, Homo sapiens
aagagcaggactccagg

SEQ ID NO: 2993208 - DNA, 18 bp, Homo sapiens
aagagcaggccagcccgg

SEQ ID NO: 2993209 - DNA, 19 bp, Homo sapiens
aagagccatataagtttga

SEQ ID NO: 2993210 - DNA, 18 bp, Homo sapiens
aagagccctaagtttgta

SEQ ID NO: 2993211 - DNA, 21 bp, Homo sapiens
aagagccttggtgtccacctg

SEQ ID NO: 2993212 - DNA, 22 bp, Homo sapiens
aagagccttggtgtccacctgg

SEQ ID NO: 2993213 - DNA, 16 bp, Homo sapiens
aagagctagcgctgcc

SEQ ID NO: 2993214 - DNA, 22 bp, Homo sapiens
aagagctgatgtgagtgtgtgt

SEQ ID NO: 2993215 - DNA, 15 bp, Homo sapiens
aagaggaaagaatga

SEQ ID NO: 2993216 - DNA, 20 bp, Homo sapiens
aagaggaatgaaaaaagctt

SEQ ID NO: 2993217 - DNA, 18 bp, Homo sapiens
aagaggagaggaaaacta

SEQ ID NO: 2993218 - DNA, 21 bp, Homo sapiens
aagaggagaggaaaactattc

SEQ ID NO: 2993219 - DNA, 11 bp, Homo sapiens
aagaggagcct

SEQ ID NO: 2993220 - DNA, 16 bp, Homo sapiens
aagaggaggaggtggg

SEQ ID NO: 2993221 - DNA, 17 bp, Homo sapiens
aagaggatgatttcaga

SEQ ID NO: 2993222 - DNA, 21 bp, Homo sapiens
aagaggatgatttcagaagga

SEQ ID NO: 2993223 - DNA, 19 bp, Homo sapiens
aagaggcagaaaattgcac

SEQ ID NO: 2993224 - DNA, 22 bp, Homo sapiens
aagaggcgttgctttcactctc

SEQ ID NO: 2993225 - DNA, 14 bp, Homo sapiens
aagaggctgcagcc

SEQ ID NO: 2993226 - DNA, 19 bp, Homo sapiens
aagagggaaggtgaccgcc

SEQ ID NO: 2993227 - DNA, 20 bp, Homo sapiens
aagagggacataagataaaa

SEQ ID NO: 2993228 - DNA, 13 bp, Homo sapiens
aagagggcaagtg

SEQ ID NO: 2993229 - DNA, 18 bp, Homo sapiens
aagaggggcctgatgaga

SEQ ID NO: 2993230 - DNA, 17 bp, Homo sapiens
aagagtaaaggaaatga

SEQ ID NO: 2993231 - DNA, 13 bp, Homo sapiens
aagagtagaaact

SEQ ID NO: 2993232 - DNA, 20 bp, Homo sapiens
aagagtagaaactgcaggga

SEQ ID NO: 2993233 - DNA, 19 bp, Homo sapiens
aagagtagaaagcttgaaa

SEQ ID NO: 2993234 - DNA, 21 bp, Homo sapiens
aagagtccccagactctgcct

SEQ ID NO: 2993235 - DNA, 23 bp, Homo sapiens
aagagtctagattcaaaggttct

SEQ ID NO: 2993236 - DNA, 21 bp, Homo sapiens
gtaaaagacagtgtatgtaga

SEQ ID NO: 2993237 - DNA, 22 bp, Homo sapiens
gtaaaaggccaaacctctgttc

SEQ ID NO: 2993238 - DNA, 22 bp, Homo sapiens
gtaaaatagtggatctcagttt

SEQ ID NO: 2993239 - DNA, 15 bp, Homo sapiens
gtaaaatattttgaa

SEQ ID NO: 2993240 - DNA, 21 bp, Homo sapiens
gtaaaatattttgaatcaata

SEQ ID NO: 2993241 - DNA, 18 bp, Homo sapiens
gtaaaatcttcagctggt

SEQ ID NO: 2993242 - DNA, 22 bp, Homo sapiens
gtaaacacgcctgcaaacgctg

SEQ ID NO: 2993243 - DNA, 20 bp, Homo sapiens
gtaaacagtgcctgctgaat

SEQ ID NO: 2993244 - DNA, 20 bp, Homo sapiens
gtaaaccctatctgtgattc

SEQ ID NO: 2993245 - DNA, 16 bp, Homo sapiens
gtaaacgctgtcccta

SEQ ID NO: 2993246 - DNA, 15 bp, Homo sapiens
gtaaactatttatct

SEQ ID NO: 2993247 - DNA, 17 bp, Homo sapiens
gtaaactcttcaccttg

SEQ ID NO: 2993248 - DNA, 17 bp, Homo sapiens
gtaaagaaagagagaaa

SEQ ID NO: 2993249 - DNA, 20 bp, Homo sapiens
gtaaagaaagagagaaaata

SEQ ID NO: 2993250 - DNA, 21 bp, Homo sapiens
gtaaagaaagagagaaaataa

SEQ ID NO: 2993251 - DNA, 22 bp, Homo sapiens
gtaaagaactgcacatgaagaa

SEQ ID NO: 2993252 - DNA, 14 bp, Homo sapiens
gtaaagactggctt

SEQ ID NO: 2993253 - DNA, 18 bp, Homo sapiens
gtaaagatctacatgaat

SEQ ID NO: 2993254 - DNA, 12 bp, Homo sapiens
gtaaagccatgc

SEQ ID NO: 2993255 - DNA, 19 bp, Homo sapiens
gtaaaggatattaaatgtt

SEQ ID NO: 2993256 - DNA, 15 bp, Homo sapiens
gtaaaggcctttaat

SEQ ID NO: 2993257 - DNA, 15 bp, Homo sapiens
gtaaaggtttttatt

SEQ ID NO: 2993258 - DNA, 20 bp, Homo sapiens
gtaaagtatttttgattaac

SEQ ID NO: 2993259 - DNA, 19 bp, Homo sapiens
gtaaagtgaagaatccttt

SEQ ID NO: 2993260 - DNA, 11 bp, Homo sapiens
gtaaagtgtgg

SEQ ID NO: 2993261 - DNA, 22 bp, Homo sapiens
gtaaagtgtggtcccaacagga

SEQ ID NO: 2993262 - DNA, 13 bp, Homo sapiens
gtaaataaaaaga

SEQ ID NO: 2993263 - DNA, 15 bp, Homo sapiens
gtaaataaagccctg

SEQ ID NO: 2993264 - DNA, 20 bp, Homo sapiens
gtaaataaattttgtgcaaa

SEQ ID NO: 2993265 - DNA, 17 bp, Homo sapiens
gtaaatacatcactgta

SEQ ID NO: 2993266 - DNA, 20 bp, Homo sapiens
gtaaataggatttttagaat

SEQ ID NO: 2993267 - DNA, 20 bp, Homo sapiens
gtaaatagttactccagtgc

SEQ ID NO: 2993268 - DNA, 15 bp, Homo sapiens
gtaaatatgaatctg

SEQ ID NO: 2993269 - DNA, 16 bp, Homo sapiens
gtaaatatgaatctgc

SEQ ID NO: 2993270 - DNA, 21 bp, Homo sapiens
gtaaatatggggatagtctgg

SEQ ID NO: 2993271 - DNA, 15 bp, Homo sapiens
gtaaatatttttccc

SEQ ID NO: 2993272 - DNA, 19 bp, Homo sapiens
gtaaatcagatgttgaatt

SEQ ID NO: 2993273 - DNA, 20 bp, Homo sapiens
gtaaatcgggaaggatggga

SEQ ID NO: 2993274 - DNA, 13 bp, Homo sapiens
gtaaatgatttta

SEQ ID NO: 2993275 - DNA, 12 bp, Homo sapiens
gtaaatgtactg

SEQ ID NO: 2993276 - DNA, 19 bp, Homo sapiens
gtaaatgtattggcacagt

SEQ ID NO: 2993277 - DNA, 15 bp, Homo sapiens
gtaaatgtgacaaaa

SEQ ID NO: 2993278 - DNA, 19 bp, Homo sapiens
gtaaatgtgttggacaaat

SEQ ID NO: 2993279 - DNA, 21 bp, Homo sapiens
gtaaatgtttgttaaaaataa

SEQ ID NO: 2993280 - DNA, 19 bp, Homo sapiens
gtaaattatatttgtgcta

SEQ ID NO: 2993281 - DNA, 23 bp, Homo sapiens
gtaaattatatttgtgctatagt

SEQ ID NO: 2993282 - DNA, 22 bp, Homo sapiens
gtaaattattaatttatgcaga

SEQ ID NO: 2993283 - DNA, 19 bp, Homo sapiens
gtaaatttgttgaaccctg

SEQ ID NO: 2993284 - DNA, 15 bp, Homo sapiens
gtaacaagccagatt

SEQ ID NO: 2993285 - DNA, 20 bp, Homo sapiens
gtaacacgggaatcacaggt

SEQ ID NO: 2993286 - DNA, 15 bp, Homo sapiens
gtaacagaaagggca

SEQ ID NO: 2993287 - DNA, 15 bp, Homo sapiens
gtaacagtattcagt

SEQ ID NO: 2993288 - DNA, 18 bp, Homo sapiens
gtaacagtctgatcgtga

SEQ ID NO: 2993289 - DNA, 15 bp, Homo sapiens
gtaacatcaaagatt

SEQ ID NO: 2993290 - DNA, 18 bp, Homo sapiens
gtaacatttatagaagaa

SEQ ID NO: 2993291 - DNA, 14 bp, Homo sapiens
gtaaccacctctct

SEQ ID NO: 2993292 - DNA, 23 bp, Homo sapiens
gtaaccacctctctgtctttttc

SEQ ID NO: 2993293 - DNA, 16 bp, Homo sapiens
gtaaccagctcagtgt

SEQ ID NO: 2993294 - DNA, 19 bp, Homo sapiens
gtaacccattaaaatgaat

SEQ ID NO: 2993295 - DNA, 14 bp, Homo sapiens
gtaaccctggtggt

SEQ ID NO: 2993296 - DNA, 18 bp, Homo sapiens
gtaacctcttcagaggcc

SEQ ID NO: 2993297 - DNA, 23 bp, Homo sapiens
gtaacgaacccctagaaaggaga

SEQ ID NO: 2993298 - DNA, 14 bp, Homo sapiens
gtaactataacaaa

SEQ ID NO: 2993299 - DNA, 17 bp, Homo sapiens
gtaactataacaaaaaa

SEQ ID NO: 2993300 - DNA, 12 bp, Homo sapiens
gtaactcccact

SEQ ID NO: 2993301 - DNA, 13 bp, Homo sapiens
gtaactcccactc

SEQ ID NO: 2993302 - DNA, 16 bp, Homo sapiens
gtaactcccactccta

SEQ ID NO: 2993303 - DNA, 19 bp, Homo sapiens
gtaactgcattgagaactg

SEQ ID NO: 2993304 - DNA, 12 bp, Homo sapiens
gtaactgctgtc

SEQ ID NO: 2993305 - DNA, 13 bp, Homo sapiens
gtaactgttcttg

SEQ ID NO: 2993306 - DNA, 18 bp, Homo sapiens
gtaacttcttatggaatt

SEQ ID NO: 2993307 - DNA, 12 bp, Homo sapiens
gtaactttatgt

SEQ ID NO: 2993308 - DNA, 19 bp, Homo sapiens
gtaacttttgtaaatacac

SEQ ID NO: 2993309 - DNA, 20 bp, Homo sapiens
gtaagaaacacactgaggca

SEQ ID NO: 2993310 - DNA, 20 bp, Homo sapiens
gtaagaaacctactgcccag

SEQ ID NO: 2993311 - DNA, 22 bp, Homo sapiens
gtaagaaatctcccatgtgcat

SEQ ID NO: 2993312 - DNA, 22 bp, Homo sapiens
gtaagaacagctcatcttcaaa

SEQ ID NO: 2993313 - DNA, 16 bp, Homo sapiens
gtaagaactaaagaag

SEQ ID NO: 2993314 - DNA, 17 bp, Homo sapiens
gtaagaagaggagcctc

SEQ ID NO: 2993315 - DNA, 22 bp, Homo sapiens
gtaagaagtctgatggtgagca

SEQ ID NO: 2993316 - DNA, 10 bp, Homo sapiens
gtaagagact

SEQ ID NO: 2993317 - DNA, 19 bp, Homo sapiens
gtaagatcgttctctgcct

SEQ ID NO: 2993318 - DNA, 14 bp, Homo sapiens
gtaagatgtctgtt

SEQ ID NO: 2993319 - DNA, 20 bp, Homo sapiens
gtaagattatagattctaaa

SEQ ID NO: 2993320 - DNA, 23 bp, Homo sapiens
gtaagctagagagaaaaagaaag

SEQ ID NO: 2993321 - DNA, 16 bp, Homo sapiens
gtaagctctatctgca

SEQ ID NO: 2993322 - DNA, 13 bp, Homo sapiens
gtaaggctctaga

SEQ ID NO: 2993323 - DNA, 14 bp, Homo sapiens
gtaaggctctagat

SEQ ID NO: 2993324 - DNA, 16 bp, Homo sapiens
gtaaggctctagatca

SEQ ID NO: 2993325 - DNA, 23 bp, Homo sapiens
gtaagggtctttggtgtttttaa

SEQ ID NO: 2993326 - DNA, 22 bp, Homo sapiens
gtaaggtctttgtaaaatcttg

SEQ ID NO: 2993327 - DNA, 14 bp, Homo sapiens
gtaagtaagtgaca

SEQ ID NO: 2993328 - DNA, 20 bp, Homo sapiens
gtaagtataacaaactatgt

SEQ ID NO: 2993329 - DNA, 20 bp, Homo sapiens
gtaagtgagtgtgctgctgt

SEQ ID NO: 2993330 - DNA, 19 bp, Homo sapiens
gtaagtgtctgtgatgctc

SEQ ID NO: 2993331 - DNA, 19 bp, Homo sapiens
gtaataaaatggtacattt

SEQ ID NO: 2993332 - DNA, 12 bp, Homo sapiens
gtaataaactat

SEQ ID NO: 2993333 - DNA, 20 bp, Homo sapiens
gtaataagaatggaaaagag

SEQ ID NO: 2993334 - DNA, 17 bp, Homo sapiens
gtaatagattatagttg

SEQ ID NO: 2993335 - DNA, 22 bp, Homo sapiens
gtaatatatatatttttgtgaa

SEQ ID NO: 2993336 - DNA, 14 bp, Homo sapiens
gtaatatttcttca

SEQ ID NO: 2993337 - DNA, 17 bp, Homo sapiens
gtaatcaataaacgatt

SEQ ID NO: 2993338 - DNA, 20 bp, Homo sapiens
gtaatcaataaacgatttaa

SEQ ID NO: 2993339 - DNA, 16 bp, Homo sapiens
gtaatcaggattgaat

SEQ ID NO: 2993340 - DNA, 15 bp, Homo sapiens
gtaatcatttgttta

SEQ ID NO: 2993341 - DNA, 18 bp, Homo sapiens
gtaatcatttgtttacat

SEQ ID NO: 2993342 - DNA, 14 bp, Homo sapiens
gtaatcccagcact

SEQ ID NO: 2993343 - DNA, 13 bp, Homo sapiens
gtaatcccagcta

SEQ ID NO: 2993344 - DNA, 14 bp, Homo sapiens
gtaatcccagctac

SEQ ID NO: 2993345 - DNA, 15 bp, Homo sapiens
gtaatcccagctact

SEQ ID NO: 2993346 - DNA, 18 bp, Homo sapiens
gtaatcccagctactcag

SEQ ID NO: 2993347 - DNA, 21 bp, Homo sapiens
gtaatcccagctactcaggag

SEQ ID NO: 2993348 - DNA, 22 bp, Homo sapiens
gtaatcctcaagaaataaaagg

SEQ ID NO: 2993349 - DNA, 15 bp, Homo sapiens
gtaatctatgtttat

SEQ ID NO: 2993350 - DNA, 12 bp, Homo sapiens
gtaatctgtgta

SEQ ID NO: 2993351 - DNA, 15 bp, Homo sapiens
gtaatgaaacttgga

SEQ ID NO: 2993352 - DNA, 21 bp, Homo sapiens
gtaatgaatttttatgatatt

SEQ ID NO: 2993353 - DNA, 16 bp, Homo sapiens
gtaatgcgattttatt

SEQ ID NO: 2993354 - DNA, 17 bp, Homo sapiens
gtaatgctaaatgtgta

SEQ ID NO: 2993355 - DNA, 20 bp, Homo sapiens
gtaatgctacgtgtgatttt

SEQ ID NO: 2993356 - DNA, 21 bp, Homo sapiens
gtaatgcttaagggagtttaa

SEQ ID NO: 2993357 - DNA, 19 bp, Homo sapiens
gtaatgggatttgaatcaa

SEQ ID NO: 2993358 - DNA, 22 bp, Homo sapiens
gtaatgggatttgaatcaatgt

SEQ ID NO: 2993359 - DNA, 22 bp, Homo sapiens
gtaatgtcaccaccttcccagc

SEQ ID NO: 2993360 - DNA, 17 bp, Homo sapiens
gtaatgtgttttagagt

SEQ ID NO: 2993361 - DNA, 20 bp, Homo sapiens
gtaatgttaatgttatatca

SEQ ID NO: 2993362 - DNA, 19 bp, Homo sapiens
gtaatgttttctttgcaaa

SEQ ID NO: 2993363 - DNA, 15 bp, Homo sapiens
gtaattataggaagt

SEQ ID NO: 2993364 - DNA, 20 bp, Homo sapiens
gtaattatgtaaataactct

SEQ ID NO: 2993365 - DNA, 18 bp, Homo sapiens
gtaattattatttaactc

SEQ ID NO: 2993366 - DNA, 21 bp, Homo sapiens
gtaattcagtgtatttcagtt

SEQ ID NO: 2993367 - DNA, 15 bp, Homo sapiens
gtaattgtaattttg

SEQ ID NO: 2993368 - DNA, 12 bp, Homo sapiens
gtaattgtacaa

SEQ ID NO: 2993369 - DNA, 13 bp, Homo sapiens
gtaattgtacaat

SEQ ID NO: 2993370 - DNA, 9 bp, Homo sapiens
gtaattgtg

SEQ ID NO: 2993371 - DNA, 18 bp, Homo sapiens
gtaatttagttaataaaa

SEQ ID NO: 2993372 - DNA, 20 bp, Homo sapiens
ggtggccatgcctcagccct

SEQ ID NO: 2993373 - DNA, 15 bp, Homo sapiens
ggtggcccaggtggc

SEQ ID NO: 2993374 - DNA, 23 bp, Homo sapiens
ggtggccctgactgtcagggagg

SEQ ID NO: 2993375 - DNA, 15 bp, Homo sapiens
ggtggcctctgctgg

SEQ ID NO: 2993376 - DNA, 18 bp, Homo sapiens
ggtggcctctgctggtct

SEQ ID NO: 2993377 - DNA, 19 bp, Homo sapiens
ggtggcgggtgcctgtaat

SEQ ID NO: 2993378 - DNA, 22 bp, Homo sapiens
ggtggctagtcaagctcctcct

SEQ ID NO: 2993379 - DNA, 23 bp, Homo sapiens
ggtggctagtcaagctcctcctc

SEQ ID NO: 2993380 - DNA, 15 bp, Homo sapiens
ggtggctagtcagag

SEQ ID NO: 2993381 - DNA, 15 bp, Homo sapiens
ggtggctgacccagt

SEQ ID NO: 2993382 - DNA, 18 bp, Homo sapiens
ggtggctgacccagtccc

SEQ ID NO: 2993383 - DNA, 12 bp, Homo sapiens
ggtggctgcctt

SEQ ID NO: 2993384 - DNA, 20 bp, Homo sapiens
ggtggctgggcccagcaggg

SEQ ID NO: 2993385 - DNA, 11 bp, Homo sapiens
ggtgggacccc

SEQ ID NO: 2993386 - DNA, 22 bp, Homo sapiens
ggtgggagccgggaccctcagg

SEQ ID NO: 2993387 - DNA, 22 bp, Homo sapiens
ggtgggaggaaagggcctggcc

SEQ ID NO: 2993388 - DNA, 17 bp, Homo sapiens
ggtgggatggaggagaa

SEQ ID NO: 2993389 - DNA, 18 bp, Homo sapiens
ggtgggcacccaccctgg

SEQ ID NO: 2993390 - DNA, 22 bp, Homo sapiens
ggtgggcggacaaaagggccag

SEQ ID NO: 2993391 - DNA, 20 bp, Homo sapiens
ggtgggcggatcacaaggtc

SEQ ID NO: 2993392 - DNA, 22 bp, Homo sapiens
ggtggggctgctcctccagggc

SEQ ID NO: 2993393 - DNA, 22 bp, Homo sapiens
ggtgggggggagaaggcctccc

SEQ ID NO: 2993394 - DNA, 19 bp, Homo sapiens
ggtggggtgatggccagag

SEQ ID NO: 2993395 - DNA, 17 bp, Homo sapiens
ggtgggtccatgggcag

SEQ ID NO: 2993396 - DNA, 14 bp, Homo sapiens
ggtggtaaccctgg

SEQ ID NO: 2993397 - DNA, 14 bp, Homo sapiens
ggtggtctgagctg

SEQ ID NO: 2993398 - DNA, 16 bp, Homo sapiens
ggtggtctgcaggcag

SEQ ID NO: 2993399 - DNA, 12 bp, Homo sapiens
ggtggtggcaca

SEQ ID NO: 2993400 - DNA, 19 bp, Homo sapiens
ggtggtgtccttcttcctc

SEQ ID NO: 2993401 - DNA, 22 bp, Homo sapiens
ggtggttcactcttggagcctg

SEQ ID NO: 2993402 - DNA, 18 bp, Homo sapiens
ggtggttcattccacagg

SEQ ID NO: 2993403 - DNA, 21 bp, Homo sapiens
ggtgtaattaataaacgaaga

SEQ ID NO: 2993404 - DNA, 17 bp, Homo sapiens
ggtgtagccctcccact

SEQ ID NO: 2993405 - DNA, 19 bp, Homo sapiens
ggtgtatatcatgaagcct

SEQ ID NO: 2993406 - DNA, 24 bp, Homo sapiens
ggtgtcacccaaaccggcaggtgc

SEQ ID NO: 2993407 - DNA, 13 bp, Homo sapiens
ggtgtcactgtcc

SEQ ID NO: 2993408 - DNA, 14 bp, Homo sapiens
ggtgtcactgtccc

SEQ ID NO: 2993409 - DNA, 20 bp, Homo sapiens
ggtgtcagccattgcaccca

SEQ ID NO: 2993410 - DNA, 20 bp, Homo sapiens
ggtgtccccgctgctgtgca

SEQ ID NO: 2993411 - DNA, 12 bp, Homo sapiens
ggtgtccctgcc

SEQ ID NO: 2993412 - DNA, 15 bp, Homo sapiens
ggtgtccctgccttc

SEQ ID NO: 2993413 - DNA, 20 bp, Homo sapiens
ggtgtcctgaagctgctgga

SEQ ID NO: 2993414 - DNA, 17 bp, Homo sapiens
ggtgtccttcttcctca

SEQ ID NO: 2993415 - DNA, 14 bp, Homo sapiens
ggtgtctggcctga

SEQ ID NO: 2993416 - DNA, 15 bp, Homo sapiens
ggtgtgactctagca

SEQ ID NO: 2993417 - DNA, 15 bp, Homo sapiens
ggtgtgatcgtctga

SEQ ID NO: 2993418 - DNA, 18 bp, Homo sapiens
ggtgtgatcgtctgactg

SEQ ID NO: 2993419 - DNA, 16 bp, Homo sapiens
ggtgtgcaccagggtt

SEQ ID NO: 2993420 - DNA, 15 bp, Homo sapiens
ggtgtgcatctgtgt

SEQ ID NO: 2993421 - DNA, 12 bp, Homo sapiens
ggtgtgctacag

SEQ ID NO: 2993422 - DNA, 15 bp, Homo sapiens
ggtgtggtgaatgtg

SEQ ID NO: 2993423 - DNA, 15 bp, Homo sapiens
ggtgtgtgtctctga

SEQ ID NO: 2993424 - DNA, 22 bp, Homo sapiens
ggtgtttctccctctcactgtc

SEQ ID NO: 2993425 - DNA, 20 bp, Homo sapiens
ggttaaaaaaatggcagtga

SEQ ID NO: 2993426 - DNA, 12 bp, Homo sapiens
ggttaaaggaaa

SEQ ID NO: 2993427 - DNA, 15 bp, Homo sapiens
ggttaaggctgagga

SEQ ID NO: 2993428 - DNA, 22 bp, Homo sapiens
ggttaatcatatttgaaaacca

SEQ ID NO: 2993429 - DNA, 22 bp, Homo sapiens
ggttaatttttacatggagaaa

SEQ ID NO: 2993430 - DNA, 14 bp, Homo sapiens
ggttacaacagatt

SEQ ID NO: 2993431 - DNA, 18 bp, Homo sapiens
ggttactaccctcaccct

SEQ ID NO: 2993432 - DNA, 19 bp, Homo sapiens
ggttactcagcagcagaga

SEQ ID NO: 2993433 - DNA, 18 bp, Homo sapiens
ggttagatgttgccatgt

SEQ ID NO: 2993434 - DNA, 15 bp, Homo sapiens
ggttatagtaacatc

SEQ ID NO: 2993435 - DNA, 17 bp, Homo sapiens
ggttatgtatcagaaga

SEQ ID NO: 2993436 - DNA, 12 bp, Homo sapiens
ggttatttaaaa

SEQ ID NO: 2993437 - DNA, 20 bp, Homo sapiens
ggttatttagggaactgctt

SEQ ID NO: 2993438 - DNA, 18 bp, Homo sapiens
ggttattttatatttgag

SEQ ID NO: 2993439 - DNA, 19 bp, Homo sapiens
ggttcaagagacactgctt

SEQ ID NO: 2993440 - DNA, 19 bp, Homo sapiens
ggttcacacagcccagttc

SEQ ID NO: 2993441 - DNA, 20 bp, Homo sapiens
ggttcacgccattctcctgc

SEQ ID NO: 2993442 - DNA, 20 bp, Homo sapiens
ggttcacgtgcagctcaagg

SEQ ID NO: 2993443 - DNA, 20 bp, Homo sapiens
ggttcactcttggagcctgc

SEQ ID NO: 2993444 - DNA, 21 bp, Homo sapiens
ggttcactcttggagcctgca

SEQ ID NO: 2993445 - DNA, 23 bp, Homo sapiens
ggttcactcttggagcctgcaga

SEQ ID NO: 2993446 - DNA, 16 bp, Homo sapiens
ggttcagcccctcctc

SEQ ID NO: 2993447 - DNA, 22 bp, Homo sapiens
ggttcagcccctcctctgccac

SEQ ID NO: 2993448 - DNA, 17 bp, Homo sapiens
ggttcagggaactgctt

SEQ ID NO: 2993449 - DNA, 20 bp, Homo sapiens
ggttcagtctagaagaatta

SEQ ID NO: 2993450 - DNA, 14 bp, Homo sapiens
ggttcagtttcttc

SEQ ID NO: 2993451 - DNA, 16 bp, Homo sapiens
ggttcatcatccctcc

SEQ ID NO: 2993452 - DNA, 20 bp, Homo sapiens
ggttcatcatccctccctgc

SEQ ID NO: 2993453 - DNA, 22 bp, Homo sapiens
ggttccacagagtaagacattg

SEQ ID NO: 2993454 - DNA, 16 bp, Homo sapiens
ggttccagcctgccac

SEQ ID NO: 2993455 - DNA, 15 bp, Homo sapiens
ggttcccacaagcct

SEQ ID NO: 2993456 - DNA, 18 bp, Homo sapiens
ggttcccgacaccagaag

SEQ ID NO: 2993457 - DNA, 19 bp, Homo sapiens
ggttccgccaggcgctgca

SEQ ID NO: 2993458 - DNA, 22 bp, Homo sapiens
ggttccgcttggagcagagggg

SEQ ID NO: 2993459 - DNA, 12 bp, Homo sapiens
ggttctaaagtt

SEQ ID NO: 2993460 - DNA, 23 bp, Homo sapiens
ggttctaaggcctaggattctaa

SEQ ID NO: 2993461 - DNA, 15 bp, Homo sapiens
ggttctaggtttcaa

SEQ ID NO: 2993462 - DNA, 20 bp, Homo sapiens
ggttctgcctgccagctgca

SEQ ID NO: 2993463 - DNA, 15 bp, Homo sapiens
ggttctgttttctaa

SEQ ID NO: 2993464 - DNA, 19 bp, Homo sapiens
ggttcttcctcgggattgg

SEQ ID NO: 2993465 - DNA, 17 bp, Homo sapiens
ggttgagtgagccggga

SEQ ID NO: 2993466 - DNA, 19 bp, Homo sapiens
ggttgataactttgcttgc

SEQ ID NO: 2993467 - DNA, 20 bp, Homo sapiens
ggttgattaaggcagtacaa

SEQ ID NO: 2993468 - DNA, 18 bp, Homo sapiens
ggttgcagtctttccccc

SEQ ID NO: 2993469 - DNA, 22 bp, Homo sapiens
ggttggaaaagaaatcaatttt

SEQ ID NO: 2993470 - DNA, 22 bp, Homo sapiens
ggttggaactttagggggtggg

SEQ ID NO: 2993471 - DNA, 19 bp, Homo sapiens
ggttgtattctttgatgtt

SEQ ID NO: 2993472 - DNA, 19 bp, Homo sapiens
ggttgtggggaggctgcac

SEQ ID NO: 2993473 - DNA, 20 bp, Homo sapiens
ggttgtttaaatataaatct

SEQ ID NO: 2993474 - DNA, 22 bp, Homo sapiens
ggttgtttctctgagctttgtt

SEQ ID NO: 2993475 - DNA, 22 bp, Homo sapiens
ggtttaaagagtctagattcaa

SEQ ID NO: 2993476 - DNA, 18 bp, Homo sapiens
ggtttacaacaaacactg

SEQ ID NO: 2993477 - DNA, 17 bp, Homo sapiens
ggtttaggctggtggcc

SEQ ID NO: 2993478 - DNA, 20 bp, Homo sapiens
ggtttaggctggtggcccag

SEQ ID NO: 2993479 - DNA, 15 bp, Homo sapiens
ggtttatttcccagt

SEQ ID NO: 2993480 - DNA, 14 bp, Homo sapiens
ggtttatttgttgt

SEQ ID NO: 2993481 - DNA, 18 bp, Homo sapiens
ggtttatttgttgttttc

SEQ ID NO: 2993482 - DNA, 12 bp, Homo sapiens
ggtttccaaagg

SEQ ID NO: 2993483 - DNA, 20 bp, Homo sapiens
ggtttcccaatggtgttttt

SEQ ID NO: 2993484 - DNA, 23 bp, Homo sapiens
ggtttcccatttgttgctgctgc

SEQ ID NO: 2993485 - DNA, 14 bp, Homo sapiens
ggtttcctgcccag

SEQ ID NO: 2993486 - DNA, 19 bp, Homo sapiens
ggtttcctgcccagcctgg

SEQ ID NO: 2993487 - DNA, 17 bp, Homo sapiens
ggtttcgtttctgtata

SEQ ID NO: 2993488 - DNA, 20 bp, Homo sapiens
ggtttctcttgtcttaaaat

SEQ ID NO: 2993489 - DNA, 16 bp, Homo sapiens
ggtttctgggggctgg

SEQ ID NO: 2993490 - DNA, 18 bp, Homo sapiens
ggtttgagcacaatctgt

SEQ ID NO: 2993491 - DNA, 13 bp, Homo sapiens
ggtttgagggtgg

SEQ ID NO: 2993492 - DNA, 14 bp, Homo sapiens
ggtttgggacccct

SEQ ID NO: 2993493 - DNA, 13 bp, Homo sapiens
ggttttacttaca

SEQ ID NO: 2993494 - DNA, 19 bp, Homo sapiens
ggttttcgtcatcttccct

SEQ ID NO: 2993495 - DNA, 23 bp, Homo sapiens
ggttttcgtcatcttccctgccc

SEQ ID NO: 2993496 - DNA, 14 bp, Homo sapiens
ggttttcttcccat

SEQ ID NO: 2993497 - DNA, 17 bp, Homo sapiens
ggttttgtattctctga

SEQ ID NO: 2993498 - DNA, 19 bp, Homo sapiens
ggttttgtattctctgagc

SEQ ID NO: 2993499 - DNA, 15 bp, Homo sapiens
ggttttgtttgctat

SEQ ID NO: 2993500 - DNA, 19 bp, Homo sapiens
ggtttttaaattttgtaat

SEQ ID NO: 2993501 - DNA, 12 bp, Homo sapiens
ggtttttgctct

SEQ ID NO: 2993502 - DNA, 14 bp, Homo sapiens
gtaaaaaaaagaag

SEQ ID NO: 2993503 - DNA, 12 bp, Homo sapiens
gtaaaaaacaaa

SEQ ID NO: 2993504 - DNA, 13 bp, Homo sapiens
gtaaaaaacaaaa

SEQ ID NO: 2993505 - DNA, 19 bp, Homo sapiens
gtaaaaacagcattgcttt

SEQ ID NO: 2993506 - DNA, 23 bp, Homo sapiens
gtaaaaacagcattgctttctga

SEQ ID NO: 2993507 - DNA, 13 bp, Homo sapiens
gtaaaacacagag

SEQ ID NO: 2993508 - DNA, 18 bp, Homo sapiens
ggtcccctccctctgtct

SEQ ID NO: 2993509 - DNA, 13 bp, Homo sapiens
ggtcccctggcag

SEQ ID NO: 2993510 - DNA, 14 bp, Homo sapiens
ggtcccggtcaccg

SEQ ID NO: 2993511 - DNA, 23 bp, Homo sapiens
ggtccctgggaggaaatttgaat

SEQ ID NO: 2993512 - DNA, 14 bp, Homo sapiens
ggtccctggtcctt

SEQ ID NO: 2993513 - DNA, 20 bp, Homo sapiens
ggtccgcatccctgcttctg

SEQ ID NO: 2993514 - DNA, 17 bp, Homo sapiens
ggtccggtgtccttttc

SEQ ID NO: 2993515 - DNA, 16 bp, Homo sapiens
ggtccggtgttctaag

SEQ ID NO: 2993516 - DNA, 21 bp, Homo sapiens
ggtccggtgttctaagatgtg

SEQ ID NO: 2993517 - DNA, 20 bp, Homo sapiens
ggtcctacccatccccgcag

SEQ ID NO: 2993518 - DNA, 18 bp, Homo sapiens
ggtcctagggtgggaagg

SEQ ID NO: 2993519 - DNA, 16 bp, Homo sapiens
ggtcctcagctgctcc

SEQ ID NO: 2993520 - DNA, 21 bp, Homo sapiens
ggtcctccgcctactgtccct

SEQ ID NO: 2993521 - DNA, 14 bp, Homo sapiens
ggtcctctctctgt

SEQ ID NO: 2993522 - DNA, 13 bp, Homo sapiens
ggtcctctgtcag

SEQ ID NO: 2993523 - DNA, 21 bp, Homo sapiens
ggtcctctgtcagtcacagcc

SEQ ID NO: 2993524 - DNA, 22 bp, Homo sapiens
ggtcctcttctgggcctgacca

SEQ ID NO: 2993525 - DNA, 21 bp, Homo sapiens
ggtcctgcacagattcccagg

SEQ ID NO: 2993526 - DNA, 22 bp, Homo sapiens
ggtcctgctccgctgcctggaa

SEQ ID NO: 2993527 - DNA, 13 bp, Homo sapiens
ggtcctggccatc

SEQ ID NO: 2993528 - DNA, 14 bp, Homo sapiens
ggtcctggctgcac

SEQ ID NO: 2993529 - DNA, 12 bp, Homo sapiens
ggtcctgggagg

SEQ ID NO: 2993530 - DNA, 23 bp, Homo sapiens
ggtcctgggaggctgcagccagg

SEQ ID NO: 2993531 - DNA, 12 bp, Homo sapiens
ggtcctgggcag

SEQ ID NO: 2993532 - DNA, 16 bp, Homo sapiens
ggtcctgggcaggtgg

SEQ ID NO: 2993533 - DNA, 15 bp, Homo sapiens
ggtcctgggggcagg

SEQ ID NO: 2993534 - DNA, 10 bp, Homo sapiens
ggtccttcaa

SEQ ID NO: 2993535 - DNA, 15 bp, Homo sapiens
ggtcctttggggtga

SEQ ID NO: 2993536 - DNA, 20 bp, Homo sapiens
ggtcgaagcaatcagcaaac

SEQ ID NO: 2993537 - DNA, 17 bp, Homo sapiens
ggtcgacttcgggctgg

SEQ ID NO: 2993538 - DNA, 15 bp, Homo sapiens
ggtcggaagcctgtc

SEQ ID NO: 2993539 - DNA, 17 bp, Homo sapiens
ggtcggaagcctgtcct

SEQ ID NO: 2993540 - DNA, 16 bp, Homo sapiens
ggtcggacggggcagg

SEQ ID NO: 2993541 - DNA, 12 bp, Homo sapiens
ggtcgggagagg

SEQ ID NO: 2993542 - DNA, 14 bp, Homo sapiens
ggtctaagcaagtg

SEQ ID NO: 2993543 - DNA, 13 bp, Homo sapiens
ggtctattccagc

SEQ ID NO: 2993544 - DNA, 18 bp, Homo sapiens
ggtctcacactcctcctg

SEQ ID NO: 2993545 - DNA, 22 bp, Homo sapiens
ggtctcacactcctcctgccag

SEQ ID NO: 2993546 - DNA, 14 bp, Homo sapiens
ggtctcaggtccag

SEQ ID NO: 2993547 - DNA, 22 bp, Homo sapiens
ggtctcccgggaagccaccctc

SEQ ID NO: 2993548 - DNA, 15 bp, Homo sapiens
ggtctccctctcctg

SEQ ID NO: 2993549 - DNA, 17 bp, Homo sapiens
ggtctccctctcctgcc

SEQ ID NO: 2993550 - DNA, 18 bp, Homo sapiens
ggtctccctctcctgcct

SEQ ID NO: 2993551 - DNA, 16 bp, Homo sapiens
ggtctcctctcagctt

SEQ ID NO: 2993552 - DNA, 23 bp, Homo sapiens
ggtctcctgactggtgctgcagc

SEQ ID NO: 2993553 - DNA, 23 bp, Homo sapiens
ggtctcctggaccttgacagagc

SEQ ID NO: 2993554 - DNA, 17 bp, Homo sapiens
ggtctcgatgctgctgg

SEQ ID NO: 2993555 - DNA, 20 bp, Homo sapiens
ggtctcgatgctgctggcct

SEQ ID NO: 2993556 - DNA, 19 bp, Homo sapiens
ggtctcgggggtccggaag

SEQ ID NO: 2993557 - DNA, 22 bp, Homo sapiens
ggtctctgcatttttctgcaga

SEQ ID NO: 2993558 - DNA, 13 bp, Homo sapiens
ggtctctgtttag

SEQ ID NO: 2993559 - DNA, 11 bp, Homo sapiens
ggtctgccaat

SEQ ID NO: 2993560 - DNA, 14 bp, Homo sapiens
ggtctgccaggccc

SEQ ID NO: 2993561 - DNA, 15 bp, Homo sapiens
ggtctgccaggcccc

SEQ ID NO: 2993562 - DNA, 22 bp, Homo sapiens
ggtctggcagcctcccatccag

SEQ ID NO: 2993563 - DNA, 21 bp, Homo sapiens
ggtctgggaggaatggacaga

SEQ ID NO: 2993564 - DNA, 17 bp, Homo sapiens
ggtctgttctgtttcaa

SEQ ID NO: 2993565 - DNA, 23 bp, Homo sapiens
ggtcttaagaaatgtataaactt

SEQ ID NO: 2993566 - DNA, 16 bp, Homo sapiens
ggtcttacattgcctg

SEQ ID NO: 2993567 - DNA, 15 bp, Homo sapiens
ggtcttcactgtgtg

SEQ ID NO: 2993568 - DNA, 21 bp, Homo sapiens
ggtcttcactgtgtgttttaa

SEQ ID NO: 2993569 - DNA, 18 bp, Homo sapiens
ggtcttcagcctctttct

SEQ ID NO: 2993570 - DNA, 12 bp, Homo sapiens
ggtcttcctgtg

SEQ ID NO: 2993571 - DNA, 23 bp, Homo sapiens
ggtcttccttctcattgctgccc

SEQ ID NO: 2993572 - DNA, 22 bp, Homo sapiens
ggtcttgaagtcctggcttcag

SEQ ID NO: 2993573 - DNA, 21 bp, Homo sapiens
ggtcttggttccagcctgcca

SEQ ID NO: 2993574 - DNA, 20 bp, Homo sapiens
ggtctttcagtactttttta

SEQ ID NO: 2993575 - DNA, 19 bp, Homo sapiens
ggtcttttcatctgggaaa

SEQ ID NO: 2993576 - DNA, 20 bp, Homo sapiens
ggtgaaagcataacatgggt

SEQ ID NO: 2993577 - DNA, 17 bp, Homo sapiens
ggtgaagctatttatct

SEQ ID NO: 2993578 - DNA, 12 bp, Homo sapiens
ggtgaaggcagg

SEQ ID NO: 2993579 - DNA, 13 bp, Homo sapiens
ggtgaaggctggc

SEQ ID NO: 2993580 - DNA, 23 bp, Homo sapiens
ggtgaagttaaaacacctttcct

SEQ ID NO: 2993581 - DNA, 14 bp, Homo sapiens
ggtgaatgtcttcc

SEQ ID NO: 2993582 - DNA, 13 bp, Homo sapiens
ggtgacacagact

SEQ ID NO: 2993583 - DNA, 23 bp, Homo sapiens
ggtgacagagcgagattccgtct

SEQ ID NO: 2993584 - DNA, 14 bp, Homo sapiens
ggtgacagagtgag

SEQ ID NO: 2993585 - DNA, 17 bp, Homo sapiens
ggtgaccagtttcttaa

SEQ ID NO: 2993586 - DNA, 19 bp, Homo sapiens
ggtgacttcacagtgaagt

SEQ ID NO: 2993587 - DNA, 18 bp, Homo sapiens
ggtgactttctgaaactc

SEQ ID NO: 2993588 - DNA, 21 bp, Homo sapiens
ggtgagaacctgggttgcaga

SEQ ID NO: 2993589 - DNA, 21 bp, Homo sapiens
ggtgagaattgggcggctctg

SEQ ID NO: 2993590 - DNA, 21 bp, Homo sapiens
ggtgagcctagccctgggaca

SEQ ID NO: 2993591 - DNA, 19 bp, Homo sapiens
ggtgaggccggccctgccc

SEQ ID NO: 2993592 - DNA, 17 bp, Homo sapiens
ggtgaggcctgtctgtg

SEQ ID NO: 2993593 - DNA, 20 bp, Homo sapiens
ggtgaggcgttctcctgctt

SEQ ID NO: 2993594 - DNA, 16 bp, Homo sapiens
ggtgagtgtgagggca

SEQ ID NO: 2993595 - DNA, 20 bp, Homo sapiens
ggtgatccgcctacctcagc

SEQ ID NO: 2993596 - DNA, 20 bp, Homo sapiens
ggtgcacacatcaccaggtg

SEQ ID NO: 2993597 - DNA, 14 bp, Homo sapiens
ggtgcagctgcgtt

SEQ ID NO: 2993598 - DNA, 13 bp, Homo sapiens
ggtgcaggtgggg

SEQ ID NO: 2993599 - DNA, 17 bp, Homo sapiens
ggtgccaaatagcccca

SEQ ID NO: 2993600 - DNA, 18 bp, Homo sapiens
ggtgccaaatagccccag

SEQ ID NO: 2993601 - DNA, 22 bp, Homo sapiens
ggtgccaaatagccccagactg

SEQ ID NO: 2993602 - DNA, 23 bp, Homo sapiens
ggtgcccagaataagttattgca

SEQ ID NO: 2993603 - DNA, 20 bp, Homo sapiens
ggtgcccagaatgaggctgc

SEQ ID NO: 2993604 - DNA, 15 bp, Homo sapiens
ggtgccccaggacca

SEQ ID NO: 2993605 - DNA, 20 bp, Homo sapiens
ggtgccccaggaccagctca

SEQ ID NO: 2993606 - DNA, 21 bp, Homo sapiens
ggtgccccaggaccagctcag

SEQ ID NO: 2993607 - DNA, 22 bp, Homo sapiens
ggtgccccaggaccagctcagg

SEQ ID NO: 2993608 - DNA, 21 bp, Homo sapiens
ggtgcccgagtgcggcgtgga

SEQ ID NO: 2993609 - DNA, 20 bp, Homo sapiens
ggtgcccgtaatcccagcta

SEQ ID NO: 2993610 - DNA, 17 bp, Homo sapiens
ggtgcccttggaggcca

SEQ ID NO: 2993611 - DNA, 18 bp, Homo sapiens
ggtgcccttggaggccag

SEQ ID NO: 2993612 - DNA, 13 bp, Homo sapiens
ggtgcctgagccc

SEQ ID NO: 2993613 - DNA, 23 bp, Homo sapiens
ggtgcctgctttgacgggccagg

SEQ ID NO: 2993614 - DNA, 17 bp, Homo sapiens
ggtgcctgtgaggcagg

SEQ ID NO: 2993615 - DNA, 20 bp, Homo sapiens
ggtgccttcttcagggcctg

SEQ ID NO: 2993616 - DNA, 22 bp, Homo sapiens
ggtgcgtggcttccctgtccca

SEQ ID NO: 2993617 - DNA, 23 bp, Homo sapiens
ggtgctaaagccaaccagccttt

SEQ ID NO: 2993618 - DNA, 15 bp, Homo sapiens
ggtgctacgcctgca

SEQ ID NO: 2993619 - DNA, 18 bp, Homo sapiens
ggtgctccatctccgcct

SEQ ID NO: 2993620 - DNA, 19 bp, Homo sapiens
ggtgctcgggaagggaggg

SEQ ID NO: 2993621 - DNA, 15 bp, Homo sapiens
ggtgctgacggccag

SEQ ID NO: 2993622 - DNA, 20 bp, Homo sapiens
ggtgctgacggccagggaga

SEQ ID NO: 2993623 - DNA, 21 bp, Homo sapiens
ggtgctgacttcatctcccac

SEQ ID NO: 2993624 - DNA, 16 bp, Homo sapiens
ggtgctggtagctgag

SEQ ID NO: 2993625 - DNA, 13 bp, Homo sapiens
ggtgctggtcccg

SEQ ID NO: 2993626 - DNA, 12 bp, Homo sapiens
ggtgctggttta

SEQ ID NO: 2993627 - DNA, 15 bp, Homo sapiens
ggtgctgtcctcagg

SEQ ID NO: 2993628 - DNA, 21 bp, Homo sapiens
ggtgcttctagttctgccagg

SEQ ID NO: 2993629 - DNA, 19 bp, Homo sapiens
ggtggaacatatggtctcc

SEQ ID NO: 2993630 - DNA, 13 bp, Homo sapiens
ggtggaagccctc

SEQ ID NO: 2993631 - DNA, 23 bp, Homo sapiens
ggtggaccaaacccttagcagcc

SEQ ID NO: 2993632 - DNA, 18 bp, Homo sapiens
ggtggacccagggaacag

SEQ ID NO: 2993633 - DNA, 13 bp, Homo sapiens
ggtggacctggca

SEQ ID NO: 2993634 - DNA, 20 bp, Homo sapiens
ggtggacctggcagtggtgg

SEQ ID NO: 2993635 - DNA, 11 bp, Homo sapiens
ggtggagaagc

SEQ ID NO: 2993636 - DNA, 15 bp, Homo sapiens
ggtggagaagccatt

SEQ ID NO: 2993637 - DNA, 20 bp, Homo sapiens
ggtggaggttgcattgagct

SEQ ID NO: 2993638 - DNA, 19 bp, Homo sapiens
ggtggagtgcagtggtgcg

SEQ ID NO: 2993639 - DNA, 13 bp, Homo sapiens
ggtggatggtgac

SEQ ID NO: 2993640 - DNA, 23 bp, Homo sapiens
ggtggattgggcagaatcctggg

SEQ ID NO: 2993641 - DNA, 23 bp, Homo sapiens
ggtggcacaggagtgtcctcttc

SEQ ID NO: 2993642 - DNA, 17 bp, Homo sapiens
ggtggccagaggtgtca

SEQ ID NO: 2993643 - DNA, 10 bp, Homo sapiens
ggtggccatg

SEQ ID NO: 2993644 - DNA, 15 bp, Homo sapiens
gggtcggaagcctgt

SEQ ID NO: 2993645 - DNA, 22 bp, Homo sapiens
gggtcggacggggcaggcgctg

SEQ ID NO: 2993646 - DNA, 15 bp, Homo sapiens
gggtcgggagagggg

SEQ ID NO: 2993647 - DNA, 20 bp, Homo sapiens
gggtctagccgctgccctgg

SEQ ID NO: 2993648 - DNA, 15 bp, Homo sapiens
gggtctccctctcct

SEQ ID NO: 2993649 - DNA, 19 bp, Homo sapiens
gggtctcctggaccttgac

SEQ ID NO: 2993650 - DNA, 14 bp, Homo sapiens
gggtctctgctcca

SEQ ID NO: 2993651 - DNA, 13 bp, Homo sapiens
gggtctgacctgg

SEQ ID NO: 2993652 - DNA, 15 bp, Homo sapiens
gggtctgacctggtg

SEQ ID NO: 2993653 - DNA, 18 bp, Homo sapiens
gggtctgcaggtgagcag

SEQ ID NO: 2993654 - DNA, 22 bp, Homo sapiens
gggtctggagttgatctggaac

SEQ ID NO: 2993655 - DNA, 20 bp, Homo sapiens
gggtctggctagagggccca

SEQ ID NO: 2993656 - DNA, 20 bp, Homo sapiens
gggtcttggttccagcctgc

SEQ ID NO: 2993657 - DNA, 12 bp, Homo sapiens
gggtgaaggctg

SEQ ID NO: 2993658 - DNA, 13 bp, Homo sapiens
gggtgaaggctgg

SEQ ID NO: 2993659 - DNA, 13 bp, Homo sapiens
gggtgacaagata

SEQ ID NO: 2993660 - DNA, 13 bp, Homo sapiens
gggtgacacagac

SEQ ID NO: 2993661 - DNA, 22 bp, Homo sapiens
gggtgatgcacccattgtgatt

SEQ ID NO: 2993662 - DNA, 18 bp, Homo sapiens
gggtgccatccacatttt

SEQ ID NO: 2993663 - DNA, 16 bp, Homo sapiens
gggtgctccctaccac

SEQ ID NO: 2993664 - DNA, 20 bp, Homo sapiens
gggtggagaactcctagggt

SEQ ID NO: 2993665 - DNA, 13 bp, Homo sapiens
gggtggagaagcc

SEQ ID NO: 2993666 - DNA, 14 bp, Homo sapiens
gggtggagaagcca

SEQ ID NO: 2993667 - DNA, 23 bp, Homo sapiens
gggtggcccctgctgtctctctg

SEQ ID NO: 2993668 - DNA, 14 bp, Homo sapiens
gggtgggccaggct

SEQ ID NO: 2993669 - DNA, 19 bp, Homo sapiens
gggtgggccaggctgatgg

SEQ ID NO: 2993670 - DNA, 13 bp, Homo sapiens
gggtggggagaga

SEQ ID NO: 2993671 - DNA, 12 bp, Homo sapiens
gggtggggctgc

SEQ ID NO: 2993672 - DNA, 17 bp, Homo sapiens
gggtgggggccaggcct

SEQ ID NO: 2993673 - DNA, 21 bp, Homo sapiens
gggtggggtcatgccctcctc

SEQ ID NO: 2993674 - DNA, 15 bp, Homo sapiens
gggtggtggcctggt

SEQ ID NO: 2993675 - DNA, 23 bp, Homo sapiens
gggtgtcctgcaccggggcctgg

SEQ ID NO: 2993676 - DNA, 14 bp, Homo sapiens
gggtgtggcacgca

SEQ ID NO: 2993677 - DNA, 16 bp, Homo sapiens
gggttaatttatcagt

SEQ ID NO: 2993678 - DNA, 22 bp, Homo sapiens
gggttcaagcaatcctcctacc

SEQ ID NO: 2993679 - DNA, 17 bp, Homo sapiens
gggttcagcccctcctc

SEQ ID NO: 2993680 - DNA, 20 bp, Homo sapiens
gggttcagcccctcctctgc

SEQ ID NO: 2993681 - DNA, 16 bp, Homo sapiens
gggttcataggggcag

SEQ ID NO: 2993682 - DNA, 16 bp, Homo sapiens
gggttcatcatccctc

SEQ ID NO: 2993683 - DNA, 19 bp, Homo sapiens
gggttccagcaccacactc

SEQ ID NO: 2993684 - DNA, 22 bp, Homo sapiens
gggttccccactggtctgggaa

SEQ ID NO: 2993685 - DNA, 11 bp, Homo sapiens
gggttgattaa

SEQ ID NO: 2993686 - DNA, 17 bp, Homo sapiens
gggttgattaaggcagt

SEQ ID NO: 2993687 - DNA, 14 bp, Homo sapiens
gggtttctctccca

SEQ ID NO: 2993688 - DNA, 17 bp, Homo sapiens
gggtttcttaaatatat

SEQ ID NO: 2993689 - DNA, 13 bp, Homo sapiens
gggtttggcccaa

SEQ ID NO: 2993690 - DNA, 14 bp, Homo sapiens
gggtttggcccctg

SEQ ID NO: 2993691 - DNA, 21 bp, Homo sapiens
gggttttgcaataacttctat

SEQ ID NO: 2993692 - DNA, 18 bp, Homo sapiens
gggttttgtattctctga

SEQ ID NO: 2993693 - DNA, 14 bp, Homo sapiens
ggtaaaaaaaagaa

SEQ ID NO: 2993694 - DNA, 22 bp, Homo sapiens
ggtaaaattagatgcatgttga

SEQ ID NO: 2993695 - DNA, 20 bp, Homo sapiens
ggtaaagaaaagcctcagct

SEQ ID NO: 2993696 - DNA, 15 bp, Homo sapiens
ggtaaaggatgaggg

SEQ ID NO: 2993697 - DNA, 18 bp, Homo sapiens
ggtaaatacaagtgaaca

SEQ ID NO: 2993698 - DNA, 20 bp, Homo sapiens
ggtaaatttccccaacagtg

SEQ ID NO: 2993699 - DNA, 13 bp, Homo sapiens
ggtaaggtgcctt

SEQ ID NO: 2993700 - DNA, 18 bp, Homo sapiens
ggtaatgtgttttagagt

SEQ ID NO: 2993701 - DNA, 13 bp, Homo sapiens
ggtacaaaaataa

SEQ ID NO: 2993702 - DNA, 15 bp, Homo sapiens
ggtacaaaaataaat

SEQ ID NO: 2993703 - DNA, 19 bp, Homo sapiens
ggtacacaactagttttgt

SEQ ID NO: 2993704 - DNA, 18 bp, Homo sapiens
ggtacagttgcaggagcg

SEQ ID NO: 2993705 - DNA, 17 bp, Homo sapiens
ggtaccagataaaatta

SEQ ID NO: 2993706 - DNA, 13 bp, Homo sapiens
ggtaccagccact

SEQ ID NO: 2993707 - DNA, 21 bp, Homo sapiens
ggtaccaggcacatggctggg

SEQ ID NO: 2993708 - DNA, 19 bp, Homo sapiens
ggtacccctttctggctct

SEQ ID NO: 2993709 - DNA, 20 bp, Homo sapiens
ggtacctcatgaggaccagg

SEQ ID NO: 2993710 - DNA, 18 bp, Homo sapiens
ggtacctgcaagcagaac

SEQ ID NO: 2993711 - DNA, 12 bp, Homo sapiens
ggtacctggacg

SEQ ID NO: 2993712 - DNA, 15 bp, Homo sapiens
ggtacgcacagacag

SEQ ID NO: 2993713 - DNA, 20 bp, Homo sapiens
ggtacttcaggggcacttca

SEQ ID NO: 2993714 - DNA, 18 bp, Homo sapiens
ggtagaaaactccagggt

SEQ ID NO: 2993715 - DNA, 21 bp, Homo sapiens
ggtagaaaatgcaccaaatag

SEQ ID NO: 2993716 - DNA, 20 bp, Homo sapiens
ggtagaaagagatacagagg

SEQ ID NO: 2993717 - DNA, 21 bp, Homo sapiens
ggtagaagccacccttccctg

SEQ ID NO: 2993718 - DNA, 18 bp, Homo sapiens
ggtagacctttattgggt

SEQ ID NO: 2993719 - DNA, 16 bp, Homo sapiens
ggtagccatcatggat

SEQ ID NO: 2993720 - DNA, 14 bp, Homo sapiens
ggtagctccagcga

SEQ ID NO: 2993721 - DNA, 15 bp, Homo sapiens
ggtagctgaaaaaac

SEQ ID NO: 2993722 - DNA, 12 bp, Homo sapiens
ggtagctgaggg

SEQ ID NO: 2993723 - DNA, 13 bp, Homo sapiens
ggtagctgagggg

SEQ ID NO: 2993724 - DNA, 19 bp, Homo sapiens
ggtagctgcccctggctct

SEQ ID NO: 2993725 - DNA, 15 bp, Homo sapiens
ggtaggaggaggcat

SEQ ID NO: 2993726 - DNA, 14 bp, Homo sapiens
ggtaggtaaatcta

SEQ ID NO: 2993727 - DNA, 18 bp, Homo sapiens
ggtagttgcaattgaatt

SEQ ID NO: 2993728 - DNA, 21 bp, Homo sapiens
ggtatatttttgataccttca

SEQ ID NO: 2993729 - DNA, 19 bp, Homo sapiens
ggtatcattcaactctcca

SEQ ID NO: 2993730 - DNA, 21 bp, Homo sapiens
ggtatctgcatgtaaaatctt

SEQ ID NO: 2993731 - DNA, 13 bp, Homo sapiens
ggtatgtgccagg

SEQ ID NO: 2993732 - DNA, 16 bp, Homo sapiens
ggtattttttcctttt

SEQ ID NO: 2993733 - DNA, 13 bp, Homo sapiens
ggtcaagctgagc

SEQ ID NO: 2993734 - DNA, 16 bp, Homo sapiens
ggtcaagctgagctgg

SEQ ID NO: 2993735 - DNA, 14 bp, Homo sapiens
ggtcaataaactta

SEQ ID NO: 2993736 - DNA, 20 bp, Homo sapiens
ggtcaatacagtacaggcag

SEQ ID NO: 2993737 - DNA, 14 bp, Homo sapiens
ggtcacacactgat

SEQ ID NO: 2993738 - DNA, 22 bp, Homo sapiens
ggtcaccgcggacgtgctggcc

SEQ ID NO: 2993739 - DNA, 18 bp, Homo sapiens
ggtcactctgccctctgc

SEQ ID NO: 2993740 - DNA, 20 bp, Homo sapiens
ggtcactctgccctctgctg

SEQ ID NO: 2993741 - DNA, 21 bp, Homo sapiens
ggtcactctgccctctgctgc

SEQ ID NO: 2993742 - DNA, 22 bp, Homo sapiens
ggtcactctgccctctgctgct

SEQ ID NO: 2993743 - DNA, 16 bp, Homo sapiens
ggtcactgtcactgcc

SEQ ID NO: 2993744 - DNA, 15 bp, Homo sapiens
ggtcacttaaaatgt

SEQ ID NO: 2993745 - DNA, 14 bp, Homo sapiens
ggtcagacccatct

SEQ ID NO: 2993746 - DNA, 16 bp, Homo sapiens
ggtcagatttatttgt

SEQ ID NO: 2993747 - DNA, 21 bp, Homo sapiens
ggtcaggaccaggacccaggg

SEQ ID NO: 2993748 - DNA, 13 bp, Homo sapiens
ggtcaggcagggt

SEQ ID NO: 2993749 - DNA, 18 bp, Homo sapiens
ggtcaggcggagctgctg

SEQ ID NO: 2993750 - DNA, 17 bp, Homo sapiens
ggtcaggggtgacacag

SEQ ID NO: 2993751 - DNA, 22 bp, Homo sapiens
ggtcataaagaggcgttgcttt

SEQ ID NO: 2993752 - DNA, 15 bp, Homo sapiens
ggtcatagattcttg

SEQ ID NO: 2993753 - DNA, 14 bp, Homo sapiens
ggtcatcagggagg

SEQ ID NO: 2993754 - DNA, 17 bp, Homo sapiens
ggtcatccttgcccatc

SEQ ID NO: 2993755 - DNA, 17 bp, Homo sapiens
ggtcatgccctcctctc

SEQ ID NO: 2993756 - DNA, 20 bp, Homo sapiens
ggtcatgccctcctctccca

SEQ ID NO: 2993757 - DNA, 17 bp, Homo sapiens
ggtcatggccacactgt

SEQ ID NO: 2993758 - DNA, 13 bp, Homo sapiens
ggtcattgaggga

SEQ ID NO: 2993759 - DNA, 15 bp, Homo sapiens
ggtcattgagggacc

SEQ ID NO: 2993760 - DNA, 21 bp, Homo sapiens
ggtccaaaaaaaggaaaaata

SEQ ID NO: 2993761 - DNA, 15 bp, Homo sapiens
ggtccaactgcaact

SEQ ID NO: 2993762 - DNA, 20 bp, Homo sapiens
ggtccaattctcgagcttgg

SEQ ID NO: 2993763 - DNA, 23 bp, Homo sapiens
ggtccacacccaattccactctg

SEQ ID NO: 2993764 - DNA, 15 bp, Homo sapiens
ggtccacagggcacc

SEQ ID NO: 2993765 - DNA, 18 bp, Homo sapiens
ggtccacaggtctagact

SEQ ID NO: 2993766 - DNA, 24 bp, Homo sapiens
ggtccagctttactgtggctgtct

SEQ ID NO: 2993767 - DNA, 16 bp, Homo sapiens
ggtccagggagcaggc

SEQ ID NO: 2993768 - DNA, 23 bp, Homo sapiens
ggtccagtgcattttgtttctgt

SEQ ID NO: 2993769 - DNA, 14 bp, Homo sapiens
ggtccatgggcaga

SEQ ID NO: 2993770 - DNA, 14 bp, Homo sapiens
ggtcccacccagga

SEQ ID NO: 2993771 - DNA, 15 bp, Homo sapiens
ggtcccacccaggaa

SEQ ID NO: 2993772 - DNA, 15 bp, Homo sapiens
ggtcccagcgagcca

SEQ ID NO: 2993773 - DNA, 17 bp, Homo sapiens
ggtcccagcgagccaca

SEQ ID NO: 2993774 - DNA, 22 bp, Homo sapiens
ggtccccaacatggatgtgttg

SEQ ID NO: 2993775 - DNA, 21 bp, Homo sapiens
ggtccccacagactgccccag

SEQ ID NO: 2993776 - DNA, 12 bp, Homo sapiens
ggtccccagggc

SEQ ID NO: 2993777 - DNA, 18 bp, Homo sapiens
ggtcccccgactgcctgt

SEQ ID NO: 2993778 - DNA, 15 bp, Homo sapiens
ggtccccctgcagct

SEQ ID NO: 2993779 - DNA, 16 bp, Homo sapiens
ggtccccctgcagcta

SEQ ID NO: 2993780 - DNA, 14 bp, Homo sapiens
ggtccccgccctct

SEQ ID NO: 2993781 - DNA, 17 bp, Homo sapiens
ggcgcggcctcccgagg

SEQ ID NO: 2993782 - DNA, 19 bp, Homo sapiens
ggcgcggcctcccgaggag

SEQ ID NO: 2993783 - DNA, 16 bp, Homo sapiens
ggcgcggctgggagga

SEQ ID NO: 2993784 - DNA, 15 bp, Homo sapiens
ggcgctgaggtgtct

SEQ ID NO: 2993785 - DNA, 20 bp, Homo sapiens
ggcgctgaggtgtctggcct

SEQ ID NO: 2993786 - DNA, 22 bp, Homo sapiens
ggcgctgaggtgtctggcctga

SEQ ID NO: 2993787 - DNA, 13 bp, Homo sapiens
ggcgctgcctcag

SEQ ID NO: 2993788 - DNA, 15 bp, Homo sapiens
ggcgctgcctcaggc

SEQ ID NO: 2993789 - DNA, 23 bp, Homo sapiens
ggcgctgcggacaccgtggcctg

SEQ ID NO: 2993790 - DNA, 21 bp, Homo sapiens
ggcgctgtgctagctttcctt

SEQ ID NO: 2993791 - DNA, 20 bp, Homo sapiens
ggcggatgttgaagtgagct

SEQ ID NO: 2993792 - DNA, 20 bp, Homo sapiens
ggcggcagctcttctgggca

SEQ ID NO: 2993793 - DNA, 14 bp, Homo sapiens
ggcggcagggctgg

SEQ ID NO: 2993794 - DNA, 15 bp, Homo sapiens
ggcggcagggctggg

SEQ ID NO: 2993795 - DNA, 11 bp, Homo sapiens
ggcggccaggg

SEQ ID NO: 2993796 - DNA, 12 bp, Homo sapiens
ggcggccagggc

SEQ ID NO: 2993797 - DNA, 13 bp, Homo sapiens
ggcggccagggcg

SEQ ID NO: 2993798 - DNA, 18 bp, Homo sapiens
ggcggctcggaggaagcc

SEQ ID NO: 2993799 - DNA, 17 bp, Homo sapiens
ggcggctgccgactccc

SEQ ID NO: 2993800 - DNA, 15 bp, Homo sapiens
ggcggggactgctgg

SEQ ID NO: 2993801 - DNA, 19 bp, Homo sapiens
ggcggggcttatgactgca

SEQ ID NO: 2993802 - DNA, 22 bp, Homo sapiens
ggcggggggggcgcctggagag

SEQ ID NO: 2993803 - DNA, 12 bp, Homo sapiens
ggcggggtgggg

SEQ ID NO: 2993804 - DNA, 23 bp, Homo sapiens
ggcgggtccacttgccagggctc

SEQ ID NO: 2993805 - DNA, 12 bp, Homo sapiens
ggcggtcctgca

SEQ ID NO: 2993806 - DNA, 14 bp, Homo sapiens
ggcggtggacttga

SEQ ID NO: 2993807 - DNA, 22 bp, Homo sapiens
ggcggtggccacagcgtgctgg

SEQ ID NO: 2993808 - DNA, 16 bp, Homo sapiens
ggcgtctgttccccct

SEQ ID NO: 2993809 - DNA, 12 bp, Homo sapiens
ggcgtgagccac

SEQ ID NO: 2993810 - DNA, 13 bp, Homo sapiens
ggcgtgagccact

SEQ ID NO: 2993811 - DNA, 15 bp, Homo sapiens
ggcgtggagactggc

SEQ ID NO: 2993812 - DNA, 18 bp, Homo sapiens
ggcgtggagactggcagg

SEQ ID NO: 2993813 - DNA, 19 bp, Homo sapiens
ggcgtggagactggcaggc

SEQ ID NO: 2993814 - DNA, 15 bp, Homo sapiens
ggcgtggagggaggc

SEQ ID NO: 2993815 - DNA, 14 bp, Homo sapiens
ggctaactggaagc

SEQ ID NO: 2993816 - DNA, 19 bp, Homo sapiens
ggctaagatactgctgatg

SEQ ID NO: 2993817 - DNA, 20 bp, Homo sapiens
ggctaagcttcactgtaaaa

SEQ ID NO: 2993818 - DNA, 17 bp, Homo sapiens
ggctacaaaggaggaca

SEQ ID NO: 2993819 - DNA, 19 bp, Homo sapiens
ggctaccctgagctgaggc

SEQ ID NO: 2993820 - DNA, 15 bp, Homo sapiens
ggctactcagcagcc

SEQ ID NO: 2993821 - DNA, 17 bp, Homo sapiens
ggctactcagcagccct

SEQ ID NO: 2993822 - DNA, 13 bp, Homo sapiens
ggctagaaaaaac

SEQ ID NO: 2993823 - DNA, 18 bp, Homo sapiens
ggctagagcttctgtatt

SEQ ID NO: 2993824 - DNA, 13 bp, Homo sapiens
ggctagagggccc

SEQ ID NO: 2993825 - DNA, 16 bp, Homo sapiens
ggctagctggagcctg

SEQ ID NO: 2993826 - DNA, 14 bp, Homo sapiens
ggctagggggagcc

SEQ ID NO: 2993827 - DNA, 17 bp, Homo sapiens
ggctagtcaagctcctc

SEQ ID NO: 2993828 - DNA, 23 bp, Homo sapiens
ggctagtcaagctcctcctccct

SEQ ID NO: 2993829 - DNA, 14 bp, Homo sapiens
ggctagtcagagag

SEQ ID NO: 2993830 - DNA, 18 bp, Homo sapiens
ggctagtcagagagagtg

SEQ ID NO: 2993831 - DNA, 14 bp, Homo sapiens
ggctatataaaatg

SEQ ID NO: 2993832 - DNA, 15 bp, Homo sapiens
ggctatataaaatgt

SEQ ID NO: 2993833 - DNA, 18 bp, Homo sapiens
ggctatataaaatgtggc

SEQ ID NO: 2993834 - DNA, 17 bp, Homo sapiens
ggctatggtgtggactg

SEQ ID NO: 2993835 - DNA, 18 bp, Homo sapiens
ggctcacgccccgctgtg

SEQ ID NO: 2993836 - DNA, 12 bp, Homo sapiens
ggctcacgcctg

SEQ ID NO: 2993837 - DNA, 13 bp, Homo sapiens
ggctcacgcctgt

SEQ ID NO: 2993838 - DNA, 17 bp, Homo sapiens
ggctcacgcctgtaatc

SEQ ID NO: 2993839 - DNA, 24 bp, Homo sapiens
ggctcacgcctgtaatcccagcag

SEQ ID NO: 2993840 - DNA, 15 bp, Homo sapiens
ggctcactgcaacct

SEQ ID NO: 2993841 - DNA, 16 bp, Homo sapiens
ggctcagaagagcagc

SEQ ID NO: 2993842 - DNA, 20 bp, Homo sapiens
ggctcagagggtgtcctgca

SEQ ID NO: 2993843 - DNA, 21 bp, Homo sapiens
ggctcagctcggggagcctta

SEQ ID NO: 2993844 - DNA, 12 bp, Homo sapiens
ggctcagctgtg

SEQ ID NO: 2993845 - DNA, 13 bp, Homo sapiens
ggctcagctgtgg

SEQ ID NO: 2993846 - DNA, 14 bp, Homo sapiens
ggctcagctgtggt

SEQ ID NO: 2993847 - DNA, 16 bp, Homo sapiens
ggctcagctgtggtcc

SEQ ID NO: 2993848 - DNA, 20 bp, Homo sapiens
ggctcagctgtggtcccacc

SEQ ID NO: 2993849 - DNA, 21 bp, Homo sapiens
ggctcagtgcaacctctgctt

SEQ ID NO: 2993850 - DNA, 17 bp, Homo sapiens
ggctccaaaccctcgag

SEQ ID NO: 2993851 - DNA, 21 bp, Homo sapiens
ggctccagaatgtgctgcctt

SEQ ID NO: 2993852 - DNA, 18 bp, Homo sapiens
ggctccagatgcagggca

SEQ ID NO: 2993853 - DNA, 17 bp, Homo sapiens
ggctcccagggacacct

SEQ ID NO: 2993854 - DNA, 12 bp, Homo sapiens
ggctcccctgag

SEQ ID NO: 2993855 - DNA, 12 bp, Homo sapiens
ggctccctctct

SEQ ID NO: 2993856 - DNA, 15 bp, Homo sapiens
ggctccctctctcct

SEQ ID NO: 2993857 - DNA, 18 bp, Homo sapiens
ggctccctctctcctgga

SEQ ID NO: 2993858 - DNA, 19 bp, Homo sapiens
ggctccctctctcctggac

SEQ ID NO: 2993859 - DNA, 21 bp, Homo sapiens
ggctccctctctcctggactg

SEQ ID NO: 2993860 - DNA, 18 bp, Homo sapiens
ggctccctgactgggagt

SEQ ID NO: 2993861 - DNA, 20 bp, Homo sapiens
ggctccgaaattccaaggcc

SEQ ID NO: 2993862 - DNA, 14 bp, Homo sapiens
ggctcctccctccc

SEQ ID NO: 2993863 - DNA, 20 bp, Homo sapiens
ggctcctcgagatcccaaca

SEQ ID NO: 2993864 - DNA, 21 bp, Homo sapiens
ggctcctctgtggtgtctgcc

SEQ ID NO: 2993865 - DNA, 19 bp, Homo sapiens
ggctcctgagggagctcca

SEQ ID NO: 2993866 - DNA, 15 bp, Homo sapiens
ggctcctgtggcagc

SEQ ID NO: 2993867 - DNA, 18 bp, Homo sapiens
ggctcctgtggcagctgc

SEQ ID NO: 2993868 - DNA, 18 bp, Homo sapiens
ggctctatgagtctagat

SEQ ID NO: 2993869 - DNA, 12 bp, Homo sapiens
ggctctccacct

SEQ ID NO: 2993870 - DNA, 13 bp, Homo sapiens
ggctctccacctc

SEQ ID NO: 2993871 - DNA, 15 bp, Homo sapiens
ggctctccacctcag

SEQ ID NO: 2993872 - DNA, 20 bp, Homo sapiens
ggctctccacctcagccttg

SEQ ID NO: 2993873 - DNA, 22 bp, Homo sapiens
ggctctcgggtgggggagccag

SEQ ID NO: 2993874 - DNA, 11 bp, Homo sapiens
ggctctgattc

SEQ ID NO: 2993875 - DNA, 14 bp, Homo sapiens
ggctctgcccacct

SEQ ID NO: 2993876 - DNA, 16 bp, Homo sapiens
ggctctgcccacctct

SEQ ID NO: 2993877 - DNA, 21 bp, Homo sapiens
ggctctgcccacctctctttt

SEQ ID NO: 2993878 - DNA, 12 bp, Homo sapiens
ggctctggctct

SEQ ID NO: 2993879 - DNA, 23 bp, Homo sapiens
ggctctgtgccttggtctctcct

SEQ ID NO: 2993880 - DNA, 17 bp, Homo sapiens
ggctctgtggaggggcc

SEQ ID NO: 2993881 - DNA, 21 bp, Homo sapiens
ggctctgttatcagctgggca

SEQ ID NO: 2993882 - DNA, 23 bp, Homo sapiens
ggctctgttcggcctttgggtgt

SEQ ID NO: 2993883 - DNA, 21 bp, Homo sapiens
ggctcttctccttggaggaca

SEQ ID NO: 2993884 - DNA, 16 bp, Homo sapiens
ggctcttctgagcaga

SEQ ID NO: 2993885 - DNA, 13 bp, Homo sapiens
ggctgaaagacag

SEQ ID NO: 2993886 - DNA, 15 bp, Homo sapiens
ggctgaacggggaga

SEQ ID NO: 2993887 - DNA, 21 bp, Homo sapiens
ggctgacacttcaaggtgaca

SEQ ID NO: 2993888 - DNA, 22 bp, Homo sapiens
ggctgacacttcaaggtgacag

SEQ ID NO: 2993889 - DNA, 18 bp, Homo sapiens
ggctgaccacagcacagc

SEQ ID NO: 2993890 - DNA, 22 bp, Homo sapiens
ggctgaccacagcacagccaac

SEQ ID NO: 2993891 - DNA, 18 bp, Homo sapiens
ggctgacccagtccctgg

SEQ ID NO: 2993892 - DNA, 22 bp, Homo sapiens
ggctgacccagtccctggggga

SEQ ID NO: 2993893 - DNA, 17 bp, Homo sapiens
ggctgagacaggagaaa

SEQ ID NO: 2993894 - DNA, 21 bp, Homo sapiens
ggctgagatagcagaggggct

SEQ ID NO: 2993895 - DNA, 13 bp, Homo sapiens
ggctgagccaaag

SEQ ID NO: 2993896 - DNA, 19 bp, Homo sapiens
ggctgagccaaagccagag

SEQ ID NO: 2993897 - DNA, 17 bp, Homo sapiens
ggctgaggcagaagaat

SEQ ID NO: 2993898 - DNA, 17 bp, Homo sapiens
ggctgaggctggcacag

SEQ ID NO: 2993899 - DNA, 16 bp, Homo sapiens
ggctgagggagcctgg

SEQ ID NO: 2993900 - DNA, 17 bp, Homo sapiens
ggctgagggcatctctg

SEQ ID NO: 2993901 - DNA, 16 bp, Homo sapiens
ggctgaggggatacca

SEQ ID NO: 2993902 - DNA, 14 bp, Homo sapiens
ggctgaggtggcta

SEQ ID NO: 2993903 - DNA, 22 bp, Homo sapiens
ggctgagtcatgatctccctgc

SEQ ID NO: 2993904 - DNA, 23 bp, Homo sapiens
ggctgagtcatgatctccctgcc

SEQ ID NO: 2993905 - DNA, 18 bp, Homo sapiens
ggctgatgtggactgtct

SEQ ID NO: 2993906 - DNA, 23 bp, Homo sapiens
ggctgcactggagccacaggcag

SEQ ID NO: 2993907 - DNA, 13 bp, Homo sapiens
ggctgcagccagg

SEQ ID NO: 2993908 - DNA, 15 bp, Homo sapiens
ggctgcagccaggcc

SEQ ID NO: 2993909 - DNA, 16 bp, Homo sapiens
ggctgcagccaggcca

SEQ ID NO: 2993910 - DNA, 12 bp, Homo sapiens
ggctgcagcctc

SEQ ID NO: 2993911 - DNA, 13 bp, Homo sapiens
ggctgcaggaggg

SEQ ID NO: 2993912 - DNA, 18 bp, Homo sapiens
ggctgcaggagggcactg

SEQ ID NO: 2993913 - DNA, 17 bp, Homo sapiens
ggctgcaggtgctgctg

SEQ ID NO: 2993914 - DNA, 14 bp, Homo sapiens
ggctgccagagaaa

SEQ ID NO: 2993915 - DNA, 15 bp, Homo sapiens
ggctgccccaggccg

SEQ ID NO: 2993916 - DNA, 16 bp, Homo sapiens
ggctgccccaggccgg

SEQ ID NO: 2993917 - DNA, 20 bp, Homo sapiens
ggctgccccaggccggagcc

SEQ ID NO: 2993918 - DNA, 13 bp, Homo sapiens
ggccggagcccag

SEQ ID NO: 2993919 - DNA, 14 bp, Homo sapiens
ggccggagcccaga

SEQ ID NO: 2993920 - DNA, 15 bp, Homo sapiens
ggccggagcccagat

SEQ ID NO: 2993921 - DNA, 13 bp, Homo sapiens
ggccggccagcca

SEQ ID NO: 2993922 - DNA, 16 bp, Homo sapiens
ggccggccagccagcc

SEQ ID NO: 2993923 - DNA, 12 bp, Homo sapiens
ggccggccctgc

SEQ ID NO: 2993924 - DNA, 13 bp, Homo sapiens
ggccggccctgcc

SEQ ID NO: 2993925 - DNA, 12 bp, Homo sapiens
ggccggccctgt

SEQ ID NO: 2993926 - DNA, 15 bp, Homo sapiens
ggccggccctgtgtg

SEQ ID NO: 2993927 - DNA, 15 bp, Homo sapiens
ggccggcgagccctg

SEQ ID NO: 2993928 - DNA, 18 bp, Homo sapiens
ggccggcgagccctgtgg

SEQ ID NO: 2993929 - DNA, 13 bp, Homo sapiens
ggccggctggcct

SEQ ID NO: 2993930 - DNA, 21 bp, Homo sapiens
ggccggctggcctggaggctc

SEQ ID NO: 2993931 - DNA, 23 bp, Homo sapiens
ggccgggaccccgagcctggctc

SEQ ID NO: 2993932 - DNA, 13 bp, Homo sapiens
ggccgggcaggcg

SEQ ID NO: 2993933 - DNA, 14 bp, Homo sapiens
ggccgggcctgggg

SEQ ID NO: 2993934 - DNA, 22 bp, Homo sapiens
ggccgggcctgtacagtctgtc

SEQ ID NO: 2993935 - DNA, 15 bp, Homo sapiens
ggccgtggctccaga

SEQ ID NO: 2993936 - DNA, 14 bp, Homo sapiens
ggccgtgtgtttag

SEQ ID NO: 2993937 - DNA, 19 bp, Homo sapiens
ggcctaaatttattaaata

SEQ ID NO: 2993938 - DNA, 16 bp, Homo sapiens
ggcctaacctgccgag

SEQ ID NO: 2993939 - DNA, 21 bp, Homo sapiens
ggcctaacctgccgagagtcc

SEQ ID NO: 2993940 - DNA, 20 bp, Homo sapiens
ggcctacagctttgatccct

SEQ ID NO: 2993941 - DNA, 16 bp, Homo sapiens
ggcctagctgctacaa

SEQ ID NO: 2993942 - DNA, 21 bp, Homo sapiens
ggcctagctgctacaaagaag

SEQ ID NO: 2993943 - DNA, 14 bp, Homo sapiens
ggcctaggcctcag

SEQ ID NO: 2993944 - DNA, 20 bp, Homo sapiens
ggcctaggcctcagccagag

SEQ ID NO: 2993945 - DNA, 18 bp, Homo sapiens
ggcctatctcctagggct

SEQ ID NO: 2993946 - DNA, 20 bp, Homo sapiens
ggcctatgcacatatggact

SEQ ID NO: 2993947 - DNA, 21 bp, Homo sapiens
ggcctatgcacatatggactc

SEQ ID NO: 2993948 - DNA, 18 bp, Homo sapiens
ggcctcaagatcaatgaa

SEQ ID NO: 2993949 - DNA, 21 bp, Homo sapiens
ggcctcaagccatcttcccgc

SEQ ID NO: 2993950 - DNA, 13 bp, Homo sapiens
ggcctcactggct

SEQ ID NO: 2993951 - DNA, 15 bp, Homo sapiens
ggcctcactggctca

SEQ ID NO: 2993952 - DNA, 18 bp, Homo sapiens
ggcctcagactgcaccca

SEQ ID NO: 2993953 - DNA, 19 bp, Homo sapiens
ggcctcagactgcacccag

SEQ ID NO: 2993954 - DNA, 21 bp, Homo sapiens
ggcctcagactgcacccagga

SEQ ID NO: 2993955 - DNA, 15 bp, Homo sapiens
ggcctcagccagaga

SEQ ID NO: 2993956 - DNA, 17 bp, Homo sapiens
ggcctcagccagagaag

SEQ ID NO: 2993957 - DNA, 15 bp, Homo sapiens
ggcctcagggccagg

SEQ ID NO: 2993958 - DNA, 16 bp, Homo sapiens
ggcctcagggccagga

SEQ ID NO: 2993959 - DNA, 17 bp, Homo sapiens
ggcctcagggccaggaa

SEQ ID NO: 2993960 - DNA, 14 bp, Homo sapiens
ggcctcagggtcta

SEQ ID NO: 2993961 - DNA, 15 bp, Homo sapiens
ggcctccagaactca

SEQ ID NO: 2993962 - DNA, 14 bp, Homo sapiens
ggcctccagctcag

SEQ ID NO: 2993963 - DNA, 10 bp, Homo sapiens
ggcctccagg

SEQ ID NO: 2993964 - DNA, 12 bp, Homo sapiens
ggcctccccgag

SEQ ID NO: 2993965 - DNA, 19 bp, Homo sapiens
ggcctcccgaggaggggcc

SEQ ID NO: 2993966 - DNA, 20 bp, Homo sapiens
ggcctccctccgtccctctg

SEQ ID NO: 2993967 - DNA, 13 bp, Homo sapiens
ggcctcccttgag

SEQ ID NO: 2993968 - DNA, 21 bp, Homo sapiens
ggcctcgcacttgcagaggag

SEQ ID NO: 2993969 - DNA, 22 bp, Homo sapiens
ggcctcgcacttgcagaggagc

SEQ ID NO: 2993970 - DNA, 23 bp, Homo sapiens
ggcctcgcacttgcagaggagcc

SEQ ID NO: 2993971 - DNA, 15 bp, Homo sapiens
ggcctcgcctgccct

SEQ ID NO: 2993972 - DNA, 21 bp, Homo sapiens
ggcctcgcctgccctcctctc

SEQ ID NO: 2993973 - DNA, 18 bp, Homo sapiens
ggcctcggaggctcctcc

SEQ ID NO: 2993974 - DNA, 20 bp, Homo sapiens
ggcctcggaggctcctccct

SEQ ID NO: 2993975 - DNA, 14 bp, Homo sapiens
ggcctcggcagaac

SEQ ID NO: 2993976 - DNA, 18 bp, Homo sapiens
ggcctctcggtgctccat

SEQ ID NO: 2993977 - DNA, 12 bp, Homo sapiens
ggcctctgcctg

SEQ ID NO: 2993978 - DNA, 13 bp, Homo sapiens
ggcctctgcctgg

SEQ ID NO: 2993979 - DNA, 23 bp, Homo sapiens
ggcctctgctggtctctggctct

SEQ ID NO: 2993980 - DNA, 16 bp, Homo sapiens
ggcctctgtgccttct

SEQ ID NO: 2993981 - DNA, 20 bp, Homo sapiens
ggcctcttggataccagctc

SEQ ID NO: 2993982 - DNA, 22 bp, Homo sapiens
ggcctcttggataccagctcag

SEQ ID NO: 2993983 - DNA, 16 bp, Homo sapiens
ggcctcttggcacctg

SEQ ID NO: 2993984 - DNA, 21 bp, Homo sapiens
ggcctcttggcacctgcctag

SEQ ID NO: 2993985 - DNA, 13 bp, Homo sapiens
ggcctcttggcag

SEQ ID NO: 2993986 - DNA, 19 bp, Homo sapiens
ggcctgaagagtcctctga

SEQ ID NO: 2993987 - DNA, 23 bp, Homo sapiens
ggcctgaagagtcctctgaatga

SEQ ID NO: 2993988 - DNA, 21 bp, Homo sapiens
ggcctgacctccagtcctgct

SEQ ID NO: 2993989 - DNA, 16 bp, Homo sapiens
ggcctgagacccagga

SEQ ID NO: 2993990 - DNA, 17 bp, Homo sapiens
ggcctgagacccaggac

SEQ ID NO: 2993991 - DNA, 14 bp, Homo sapiens
ggcctgagaggttg

SEQ ID NO: 2993992 - DNA, 15 bp, Homo sapiens
ggcctgagcctggcc

SEQ ID NO: 2993993 - DNA, 15 bp, Homo sapiens
ggcctgatcagacca

SEQ ID NO: 2993994 - DNA, 23 bp, Homo sapiens
ggcctgcaccgacccgaggccca

SEQ ID NO: 2993995 - DNA, 20 bp, Homo sapiens
ggcctgcaggacctgcctgt

SEQ ID NO: 2993996 - DNA, 12 bp, Homo sapiens
ggcctgcccagc

SEQ ID NO: 2993997 - DNA, 18 bp, Homo sapiens
ggcctgcccagcctcaat

SEQ ID NO: 2993998 - DNA, 12 bp, Homo sapiens
ggcctgccctgc

SEQ ID NO: 2993999 - DNA, 17 bp, Homo sapiens
ggcctgccggacacagc

SEQ ID NO: 2994000 - DNA, 21 bp, Homo sapiens
ggcctgcgtctccatatgtgt

SEQ ID NO: 2994001 - DNA, 15 bp, Homo sapiens
ggcctgcgtgcgctg

SEQ ID NO: 2994002 - DNA, 14 bp, Homo sapiens
ggcctgctccagac

SEQ ID NO: 2994003 - DNA, 16 bp, Homo sapiens
ggcctgctccagacct

SEQ ID NO: 2994004 - DNA, 19 bp, Homo sapiens
ggcctgctgggctctccac

SEQ ID NO: 2994005 - DNA, 23 bp, Homo sapiens
ggcctgctgggctctccacctca

SEQ ID NO: 2994006 - DNA, 20 bp, Homo sapiens
ggcctggagcgtttgctgtg

SEQ ID NO: 2994007 - DNA, 13 bp, Homo sapiens
ggcctggaggctc

SEQ ID NO: 2994008 - DNA, 13 bp, Homo sapiens
ggcctggcagggg

SEQ ID NO: 2994009 - DNA, 23 bp, Homo sapiens
ggcctggcagggggtgaaggcag

SEQ ID NO: 2994010 - DNA, 17 bp, Homo sapiens
ggcctggcatctgtgtg

SEQ ID NO: 2994011 - DNA, 15 bp, Homo sapiens
ggcctggccagtctt

SEQ ID NO: 2994012 - DNA, 16 bp, Homo sapiens
ggcctggccagtcttc

SEQ ID NO: 2994013 - DNA, 17 bp, Homo sapiens
ggcctggctccccgagg

SEQ ID NO: 2994014 - DNA, 14 bp, Homo sapiens
ggcctgggcaggag

SEQ ID NO: 2994015 - DNA, 13 bp, Homo sapiens
ggcctggtccctg

SEQ ID NO: 2994016 - DNA, 18 bp, Homo sapiens
ggcctggtccctggtcct

SEQ ID NO: 2994017 - DNA, 20 bp, Homo sapiens
ggcctggtccctggtccttc

SEQ ID NO: 2994018 - DNA, 11 bp, Homo sapiens
ggcctggtctg

SEQ ID NO: 2994019 - DNA, 16 bp, Homo sapiens
ggcctgtacagtctgt

SEQ ID NO: 2994020 - DNA, 18 bp, Homo sapiens
ggcctgtacagtctgtct

SEQ ID NO: 2994021 - DNA, 15 bp, Homo sapiens
ggcctgtctcagtga

SEQ ID NO: 2994022 - DNA, 19 bp, Homo sapiens
ggcctgtgagtctcccctt

SEQ ID NO: 2994023 - DNA, 18 bp, Homo sapiens
ggcctgtggtggctcccc

SEQ ID NO: 2994024 - DNA, 20 bp, Homo sapiens
ggcctgtggtggctccccct

SEQ ID NO: 2994025 - DNA, 18 bp, Homo sapiens
ggcctgtgtggccacttc

SEQ ID NO: 2994026 - DNA, 15 bp, Homo sapiens
ggccttctcagctct

SEQ ID NO: 2994027 - DNA, 15 bp, Homo sapiens
ggccttgcctggcct

SEQ ID NO: 2994028 - DNA, 17 bp, Homo sapiens
ggccttgcctggcctga

SEQ ID NO: 2994029 - DNA, 18 bp, Homo sapiens
ggccttgctcttctcctt

SEQ ID NO: 2994030 - DNA, 11 bp, Homo sapiens
ggccttgctga

SEQ ID NO: 2994031 - DNA, 16 bp, Homo sapiens
ggccttggggtggggg

SEQ ID NO: 2994032 - DNA, 17 bp, Homo sapiens
ggccttggggtgggggc

SEQ ID NO: 2994033 - DNA, 17 bp, Homo sapiens
ggcctttgctgcccttg

SEQ ID NO: 2994034 - DNA, 17 bp, Homo sapiens
ggccttttctggcaccg

SEQ ID NO: 2994035 - DNA, 22 bp, Homo sapiens
ggccttttgctacgtgcctccc

SEQ ID NO: 2994036 - DNA, 22 bp, Homo sapiens
ggcgaagcgttgtcctcagccc

SEQ ID NO: 2994037 - DNA, 22 bp, Homo sapiens
ggcgacactcagggcagctgcc

SEQ ID NO: 2994038 - DNA, 21 bp, Homo sapiens
ggcgagccctgtggatgagcc

SEQ ID NO: 2994039 - DNA, 11 bp, Homo sapiens
ggcgagccctt

SEQ ID NO: 2994040 - DNA, 15 bp, Homo sapiens
ggcgagcctgactct

SEQ ID NO: 2994041 - DNA, 18 bp, Homo sapiens
ggcgagcctgactctgtt

SEQ ID NO: 2994042 - DNA, 14 bp, Homo sapiens
ggcgcaagcctgta

SEQ ID NO: 2994043 - DNA, 22 bp, Homo sapiens
ggcgcaagcctgtaatcccagc

SEQ ID NO: 2994044 - DNA, 17 bp, Homo sapiens
ggcgccaccagctctgc

SEQ ID NO: 2994045 - DNA, 18 bp, Homo sapiens
ggcgccaccagctctgcc

SEQ ID NO: 2994046 - DNA, 14 bp, Homo sapiens
ggcgcccagcagcc

SEQ ID NO: 2994047 - DNA, 21 bp, Homo sapiens
ggcgcccagcagcctgccagc

SEQ ID NO: 2994048 - DNA, 12 bp, Homo sapiens
ggcgccctggac

SEQ ID NO: 2994049 - DNA, 16 bp, Homo sapiens
ggcgccctggacttgg

SEQ ID NO: 2994050 - DNA, 22 bp, Homo sapiens
ggcgccgcaaaccacactggac

SEQ ID NO: 2994051 - DNA, 20 bp, Homo sapiens
ggcgcctagagcgcggctgg

SEQ ID NO: 2994052 - DNA, 16 bp, Homo sapiens
ggcgcctggcctccag

SEQ ID NO: 2994053 - DNA, 15 bp, Homo sapiens
ggcgccttctcggag

SEQ ID NO: 2994054 - DNA, 12 bp, Homo sapiens
ggcgcgcctgcc

SEQ ID NO: 2994055 - DNA, 13 bp, Homo sapiens
ggcgcgcctgcct

SEQ ID NO: 2994056 - DNA, 16 bp, Homo sapiens
ggccaggtgcggcctg

SEQ ID NO: 2994057 - DNA, 22 bp, Homo sapiens
ggccaggtgcggcctgggggga

SEQ ID NO: 2994058 - DNA, 21 bp, Homo sapiens
ggccagtatctatatatgtgt

SEQ ID NO: 2994059 - DNA, 15 bp, Homo sapiens
ggccagtcctggtcc

SEQ ID NO: 2994060 - DNA, 16 bp, Homo sapiens
ggccagtcctggtcct

SEQ ID NO: 2994061 - DNA, 20 bp, Homo sapiens
ggccagtcctggtcctggct

SEQ ID NO: 2994062 - DNA, 15 bp, Homo sapiens
ggccagtcttcctct

SEQ ID NO: 2994063 - DNA, 16 bp, Homo sapiens
ggccatcactcagccc

SEQ ID NO: 2994064 - DNA, 23 bp, Homo sapiens
ggccatcactcagcccctacccc

SEQ ID NO: 2994065 - DNA, 14 bp, Homo sapiens
ggccatcccacaag

SEQ ID NO: 2994066 - DNA, 15 bp, Homo sapiens
ggccatgctgtccct

SEQ ID NO: 2994067 - DNA, 17 bp, Homo sapiens
ggccatgctgtccctgc

SEQ ID NO: 2994068 - DNA, 21 bp, Homo sapiens
ggccatggctttcatcctgtg

SEQ ID NO: 2994069 - DNA, 23 bp, Homo sapiens
ggccatggctttcatcctgtgtc

SEQ ID NO: 2994070 - DNA, 15 bp, Homo sapiens
ggccatgtggcctgc

SEQ ID NO: 2994071 - DNA, 17 bp, Homo sapiens
ggcccaagactgggctg

SEQ ID NO: 2994072 - DNA, 19 bp, Homo sapiens
ggcccaagtttctaaggga

SEQ ID NO: 2994073 - DNA, 20 bp, Homo sapiens
ggcccaatctcgtcaggctg

SEQ ID NO: 2994074 - DNA, 23 bp, Homo sapiens
ggcccacagcccccaccccagca

SEQ ID NO: 2994075 - DNA, 15 bp, Homo sapiens
ggcccacagctccca

SEQ ID NO: 2994076 - DNA, 20 bp, Homo sapiens
ggcccacccggtgggacccc

SEQ ID NO: 2994077 - DNA, 23 bp, Homo sapiens
ggcccactcaggggtcactgagg

SEQ ID NO: 2994078 - DNA, 23 bp, Homo sapiens
ggcccagacccagcccgcggcct

SEQ ID NO: 2994079 - DNA, 23 bp, Homo sapiens
ggcccagcaccccctctcctgga

SEQ ID NO: 2994080 - DNA, 19 bp, Homo sapiens
ggcccagcgctctcctgga

SEQ ID NO: 2994081 - DNA, 15 bp, Homo sapiens
ggcccaggagctctg

SEQ ID NO: 2994082 - DNA, 13 bp, Homo sapiens
ggcccaggaggag

SEQ ID NO: 2994083 - DNA, 12 bp, Homo sapiens
ggcccaggcagg

SEQ ID NO: 2994084 - DNA, 21 bp, Homo sapiens
ggcccaggcaggtctgcaagg

SEQ ID NO: 2994085 - DNA, 22 bp, Homo sapiens
ggcccaggccatgtggcctgcc

SEQ ID NO: 2994086 - DNA, 16 bp, Homo sapiens
ggcccaggcctggagc

SEQ ID NO: 2994087 - DNA, 21 bp, Homo sapiens
ggcccaggccttgctgactct

SEQ ID NO: 2994088 - DNA, 13 bp, Homo sapiens
ggcccagggaggg

SEQ ID NO: 2994089 - DNA, 15 bp, Homo sapiens
ggcccagggcccaga

SEQ ID NO: 2994090 - DNA, 19 bp, Homo sapiens
ggcccagggcccagagccc

SEQ ID NO: 2994091 - DNA, 12 bp, Homo sapiens
ggcccagggccg

SEQ ID NO: 2994092 - DNA, 18 bp, Homo sapiens
ggcccaggggaggcggca

SEQ ID NO: 2994093 - DNA, 17 bp, Homo sapiens
ggcccagggggcctgga

SEQ ID NO: 2994094 - DNA, 13 bp, Homo sapiens
ggcccaggtggct

SEQ ID NO: 2994095 - DNA, 18 bp, Homo sapiens
ggcccaggtggctatttt

SEQ ID NO: 2994096 - DNA, 21 bp, Homo sapiens
ggcccagtccttggctgtatc

SEQ ID NO: 2994097 - DNA, 15 bp, Homo sapiens
ggcccagtgcatggt

SEQ ID NO: 2994098 - DNA, 16 bp, Homo sapiens
ggccccacaaggcctg

SEQ ID NO: 2994099 - DNA, 18 bp, Homo sapiens
ggccccacaaggcctggt

SEQ ID NO: 2994100 - DNA, 13 bp, Homo sapiens
ggccccagcctcc

SEQ ID NO: 2994101 - DNA, 21 bp, Homo sapiens
ggccccaggacctggctgcca

SEQ ID NO: 2994102 - DNA, 20 bp, Homo sapiens
ggcccccaccacacatccca

SEQ ID NO: 2994103 - DNA, 19 bp, Homo sapiens
ggccccctcaccccagctc

SEQ ID NO: 2994104 - DNA, 16 bp, Homo sapiens
ggccccctcagctctg

SEQ ID NO: 2994105 - DNA, 19 bp, Homo sapiens
ggccccctcagctctgtcc

SEQ ID NO: 2994106 - DNA, 20 bp, Homo sapiens
ggccccctctcaggagccat

SEQ ID NO: 2994107 - DNA, 13 bp, Homo sapiens
ggccccctgcccg

SEQ ID NO: 2994108 - DNA, 19 bp, Homo sapiens
ggccccgcttgtccagcgc

SEQ ID NO: 2994109 - DNA, 12 bp, Homo sapiens
ggcccctcaccc

SEQ ID NO: 2994110 - DNA, 15 bp, Homo sapiens
ggcccctcacctggt

SEQ ID NO: 2994111 - DNA, 21 bp, Homo sapiens
ggcccctcacctggtacctgg

SEQ ID NO: 2994112 - DNA, 13 bp, Homo sapiens
ggcccctcccctc

SEQ ID NO: 2994113 - DNA, 23 bp, Homo sapiens
ggcccctcccctcagagcccatg

SEQ ID NO: 2994114 - DNA, 12 bp, Homo sapiens
ggcccctctcct

SEQ ID NO: 2994115 - DNA, 17 bp, Homo sapiens
ggcccctgccagacccc

SEQ ID NO: 2994116 - DNA, 20 bp, Homo sapiens
ggcccctgccagaccccctg

SEQ ID NO: 2994117 - DNA, 16 bp, Homo sapiens
ggcccctgctgtctct

SEQ ID NO: 2994118 - DNA, 15 bp, Homo sapiens
ggcccctggcctgcc

SEQ ID NO: 2994119 - DNA, 19 bp, Homo sapiens
ggcccctttgggccctgca

SEQ ID NO: 2994120 - DNA, 21 bp, Homo sapiens
ggcccctttgggccctgcatg

SEQ ID NO: 2994121 - DNA, 14 bp, Homo sapiens
ggcccgcggcctgc

SEQ ID NO: 2994122 - DNA, 16 bp, Homo sapiens
ggcccggccccgagag

SEQ ID NO: 2994123 - DNA, 13 bp, Homo sapiens
ggcccggcccctc

SEQ ID NO: 2994124 - DNA, 14 bp, Homo sapiens
ggcccggcccctca

SEQ ID NO: 2994125 - DNA, 22 bp, Homo sapiens
ggcccgggccgaccctgcggcc

SEQ ID NO: 2994126 - DNA, 19 bp, Homo sapiens
ggcccggggctggcggcta

SEQ ID NO: 2994127 - DNA, 16 bp, Homo sapiens
ggcccggtggcggcag

SEQ ID NO: 2994128 - DNA, 17 bp, Homo sapiens
ggcccggtggcggcagg

SEQ ID NO: 2994129 - DNA, 14 bp, Homo sapiens
ggcccgtcggagct

SEQ ID NO: 2994130 - DNA, 21 bp, Homo sapiens
ggcccgtcggagctgcctgca

SEQ ID NO: 2994131 - DNA, 22 bp, Homo sapiens
ggcccgtcggagctgcctgcag

SEQ ID NO: 2994132 - DNA, 18 bp, Homo sapiens
ggcccgtctgtccatctg

SEQ ID NO: 2994133 - DNA, 20 bp, Homo sapiens
ggcccgtctgtccatctgcc

SEQ ID NO: 2994134 - DNA, 18 bp, Homo sapiens
ggcccgtggcctggcatc

SEQ ID NO: 2994135 - DNA, 21 bp, Homo sapiens
ggcccgtggcctggcatctgt

SEQ ID NO: 2994136 - DNA, 17 bp, Homo sapiens
ggccctatgtctcagga

SEQ ID NO: 2994137 - DNA, 11 bp, Homo sapiens
ggccctcccac

SEQ ID NO: 2994138 - DNA, 15 bp, Homo sapiens
ggccctcccaccacc

SEQ ID NO: 2994139 - DNA, 13 bp, Homo sapiens
ggccctccctgcg

SEQ ID NO: 2994140 - DNA, 21 bp, Homo sapiens
ggccctccctgttccccagag

SEQ ID NO: 2994141 - DNA, 23 bp, Homo sapiens
ggccctccctgttccccagagaa

SEQ ID NO: 2994142 - DNA, 17 bp, Homo sapiens
ggccctcctaccctgcg

SEQ ID NO: 2994143 - DNA, 21 bp, Homo sapiens
ggccctcctaccctgcgccca

SEQ ID NO: 2994144 - DNA, 19 bp, Homo sapiens
ggccctcgctgccagctct

SEQ ID NO: 2994145 - DNA, 21 bp, Homo sapiens
ggccctcgctgccagctctgt

SEQ ID NO: 2994146 - DNA, 22 bp, Homo sapiens
ggccctcgctgccagctctgta

SEQ ID NO: 2994147 - DNA, 13 bp, Homo sapiens
ggccctctgcctg

SEQ ID NO: 2994148 - DNA, 15 bp, Homo sapiens
ggccctctgcctgca

SEQ ID NO: 2994149 - DNA, 16 bp, Homo sapiens
ggccctctgcctgcac

SEQ ID NO: 2994150 - DNA, 17 bp, Homo sapiens
ggccctctgcctgcact

SEQ ID NO: 2994151 - DNA, 19 bp, Homo sapiens
ggccctctggagtggccac

SEQ ID NO: 2994152 - DNA, 19 bp, Homo sapiens
ggccctgcaaaaggactct

SEQ ID NO: 2994153 - DNA, 13 bp, Homo sapiens
ggccctgcaggag

SEQ ID NO: 2994154 - DNA, 15 bp, Homo sapiens
ggccctgcaggagca

SEQ ID NO: 2994155 - DNA, 11 bp, Homo sapiens
ggccctgcatg

SEQ ID NO: 2994156 - DNA, 13 bp, Homo sapiens
ggccctgcccctc

SEQ ID NO: 2994157 - DNA, 18 bp, Homo sapiens
ggccctgcccctccccct

SEQ ID NO: 2994158 - DNA, 23 bp, Homo sapiens
ggccctgcccctccccctaccgc

SEQ ID NO: 2994159 - DNA, 10 bp, Homo sapiens
ggccctgcct

SEQ ID NO: 2994160 - DNA, 20 bp, Homo sapiens
ggccctgctgaagctgctgc

SEQ ID NO: 2994161 - DNA, 12 bp, Homo sapiens
ggccctggaaga

SEQ ID NO: 2994162 - DNA, 17 bp, Homo sapiens
ggccctggagggcagag

SEQ ID NO: 2994163 - DNA, 19 bp, Homo sapiens
ggccctggagggcagagac

SEQ ID NO: 2994164 - DNA, 16 bp, Homo sapiens
ggccctggcctgctgg

SEQ ID NO: 2994165 - DNA, 17 bp, Homo sapiens
ggccctggcctgctggg

SEQ ID NO: 2994166 - DNA, 17 bp, Homo sapiens
ggccctggcgggtggct

SEQ ID NO: 2994167 - DNA, 21 bp, Homo sapiens
ggccctggggcgggcagccag

SEQ ID NO: 2994168 - DNA, 17 bp, Homo sapiens
ggccctgtccagccccc

SEQ ID NO: 2994169 - DNA, 15 bp, Homo sapiens
ggcccttcccctccc

SEQ ID NO: 2994170 - DNA, 16 bp, Homo sapiens
ggcccttcctcctcca

SEQ ID NO: 2994171 - DNA, 20 bp, Homo sapiens
ggccgaagctgctgtgactg

SEQ ID NO: 2994172 - DNA, 20 bp, Homo sapiens
ggccgaccctgcggcctcca

SEQ ID NO: 2994173 - DNA, 12 bp, Homo sapiens
ggccgagaagca

SEQ ID NO: 2994174 - DNA, 18 bp, Homo sapiens
ggccgagcggtggccccg

SEQ ID NO: 2994175 - DNA, 20 bp, Homo sapiens
ggccgagcggtggccccgag

SEQ ID NO: 2994176 - DNA, 15 bp, Homo sapiens
ggccgagctggtttc

SEQ ID NO: 2994177 - DNA, 17 bp, Homo sapiens
ggccgaggtcccattgt

SEQ ID NO: 2994178 - DNA, 15 bp, Homo sapiens
ggccgcattccctga

SEQ ID NO: 2994179 - DNA, 16 bp, Homo sapiens
ggccgcattccctgag

SEQ ID NO: 2994180 - DNA, 15 bp, Homo sapiens
ggccgccatctgcgc

SEQ ID NO: 2994181 - DNA, 20 bp, Homo sapiens
ggccgccatctgcgcagggt

SEQ ID NO: 2994182 - DNA, 14 bp, Homo sapiens
ggccgcctgcctta

SEQ ID NO: 2994183 - DNA, 14 bp, Homo sapiens
ggccgcgagaggcc

SEQ ID NO: 2994184 - DNA, 22 bp, Homo sapiens
ggccgcggccctggggcgggca

SEQ ID NO: 2994185 - DNA, 17 bp, Homo sapiens
ggccgcgtgccgggccc

SEQ ID NO: 2994186 - DNA, 20 bp, Homo sapiens
ggccgcgtgccgggccccca

SEQ ID NO: 2994187 - DNA, 23 bp, Homo sapiens
ggccgcgtgccgggcccccaccg

SEQ ID NO: 2994188 - DNA, 14 bp, Homo sapiens
ggccgctccaccag

SEQ ID NO: 2994189 - DNA, 21 bp, Homo sapiens
ggccgctgccacccacctccc

SEQ ID NO: 2994190 - DNA, 19 bp, Homo sapiens
ggccgctgttcacccacag

SEQ ID NO: 2994191 - DNA, 15 bp, Homo sapiens
ggccggacctgagcc

SEQ ID NO: 2994192 - DNA, 13 bp, Homo sapiens
ggcagccccagca

SEQ ID NO: 2994193 - DNA, 15 bp, Homo sapiens
ggcagcccctgcaga

SEQ ID NO: 2994194 - DNA, 16 bp, Homo sapiens
ggcagccctccttacc

SEQ ID NO: 2994195 - DNA, 22 bp, Homo sapiens
ggcagcctcccatccagggccc

SEQ ID NO: 2994196 - DNA, 14 bp, Homo sapiens
ggcagcctgcacct

SEQ ID NO: 2994197 - DNA, 20 bp, Homo sapiens
ggcagcctggacatagagag

SEQ ID NO: 2994198 - DNA, 22 bp, Homo sapiens
ggcagccttgggggggctgcct

SEQ ID NO: 2994199 - DNA, 15 bp, Homo sapiens
ggcagcgcctgtccc

SEQ ID NO: 2994200 - DNA, 16 bp, Homo sapiens
ggcagcgcctgtcccc

SEQ ID NO: 2994201 - DNA, 20 bp, Homo sapiens
ggcagctctggacagcccca

SEQ ID NO: 2994202 - DNA, 21 bp, Homo sapiens
ggcagctgcccctcctggagc

SEQ ID NO: 2994203 - DNA, 17 bp, Homo sapiens
ggcagctgcccctggca

SEQ ID NO: 2994204 - DNA, 19 bp, Homo sapiens
ggcagctgcctggccatgc

SEQ ID NO: 2994205 - DNA, 21 bp, Homo sapiens
ggcagctgcctggccatgctg

SEQ ID NO: 2994206 - DNA, 20 bp, Homo sapiens
ggcagctgggcccacagccc

SEQ ID NO: 2994207 - DNA, 23 bp, Homo sapiens
ggcaggaagcccaattgctggag

SEQ ID NO: 2994208 - DNA, 14 bp, Homo sapiens
ggcaggaaggagcg

SEQ ID NO: 2994209 - DNA, 16 bp, Homo sapiens
ggcaggaaggagcggc

SEQ ID NO: 2994210 - DNA, 13 bp, Homo sapiens
ggcaggagggagg

SEQ ID NO: 2994211 - DNA, 14 bp, Homo sapiens
ggcaggagtcacca

SEQ ID NO: 2994212 - DNA, 18 bp, Homo sapiens
ggcaggagttgggggcag

SEQ ID NO: 2994213 - DNA, 10 bp, Homo sapiens
ggcaggcacc

SEQ ID NO: 2994214 - DNA, 18 bp, Homo sapiens
ggcaggcaggctcccagg

SEQ ID NO: 2994215 - DNA, 10 bp, Homo sapiens
ggcaggcagt

SEQ ID NO: 2994216 - DNA, 16 bp, Homo sapiens
ggcaggcatggccctg

SEQ ID NO: 2994217 - DNA, 20 bp, Homo sapiens
ggcaggcatggctggtgcct

SEQ ID NO: 2994218 - DNA, 23 bp, Homo sapiens
ggcagggccactcaacagagagg

SEQ ID NO: 2994219 - DNA, 18 bp, Homo sapiens
ggcagggcccctgaccct

SEQ ID NO: 2994220 - DNA, 21 bp, Homo sapiens
ggcagggccgctcgatgcctt

SEQ ID NO: 2994221 - DNA, 18 bp, Homo sapiens
ggcagggccttgcccaga

SEQ ID NO: 2994222 - DNA, 20 bp, Homo sapiens
ggcagggccttgcccagaga

SEQ ID NO: 2994223 - DNA, 15 bp, Homo sapiens
ggcagggctgactct

SEQ ID NO: 2994224 - DNA, 15 bp, Homo sapiens
ggcagggctgggcct

SEQ ID NO: 2994225 - DNA, 16 bp, Homo sapiens
ggcaggggagccaggg

SEQ ID NO: 2994226 - DNA, 17 bp, Homo sapiens
ggcaggggagccagggt

SEQ ID NO: 2994227 - DNA, 12 bp, Homo sapiens
ggcaggggccgg

SEQ ID NO: 2994228 - DNA, 20 bp, Homo sapiens
ggcagggggtgaaggcagga

SEQ ID NO: 2994229 - DNA, 18 bp, Homo sapiens
ggcagggtctctgctcca

SEQ ID NO: 2994230 - DNA, 21 bp, Homo sapiens
ggcagggtgggatggaggaga

SEQ ID NO: 2994231 - DNA, 20 bp, Homo sapiens
ggcaggtcactgtcactgcc

SEQ ID NO: 2994232 - DNA, 22 bp, Homo sapiens
ggcaggtctgcaagggcccaga

SEQ ID NO: 2994233 - DNA, 11 bp, Homo sapiens
ggcaggtggcc

SEQ ID NO: 2994234 - DNA, 20 bp, Homo sapiens
ggcaggtggccgcccctgag

SEQ ID NO: 2994235 - DNA, 23 bp, Homo sapiens
ggcaggtggccgcccctgaggct

SEQ ID NO: 2994236 - DNA, 13 bp, Homo sapiens
ggcaggtgggagc

SEQ ID NO: 2994237 - DNA, 15 bp, Homo sapiens
ggcagtccagagctt

SEQ ID NO: 2994238 - DNA, 19 bp, Homo sapiens
ggcagtcgatagagctgta

SEQ ID NO: 2994239 - DNA, 15 bp, Homo sapiens
ggcagtcgctgcagg

SEQ ID NO: 2994240 - DNA, 21 bp, Homo sapiens
ggcagtgagggagggctgtca

SEQ ID NO: 2994241 - DNA, 15 bp, Homo sapiens
ggcagtgccagccaa

SEQ ID NO: 2994242 - DNA, 22 bp, Homo sapiens
ggcagtgtcttaaggagactgg

SEQ ID NO: 2994243 - DNA, 13 bp, Homo sapiens
ggcagtgttttgg

SEQ ID NO: 2994244 - DNA, 21 bp, Homo sapiens
ggcagttttgacatcagccag

SEQ ID NO: 2994245 - DNA, 20 bp, Homo sapiens
ggcatcaccttaggcaggga

SEQ ID NO: 2994246 - DNA, 20 bp, Homo sapiens
ggcatcagtgtccttggcag

SEQ ID NO: 2994247 - DNA, 18 bp, Homo sapiens
ggcatccagagtccctgc

SEQ ID NO: 2994248 - DNA, 15 bp, Homo sapiens
ggcatccaggccagg

SEQ ID NO: 2994249 - DNA, 17 bp, Homo sapiens
ggcatcctctttttcca

SEQ ID NO: 2994250 - DNA, 13 bp, Homo sapiens
ggcatcctgtgaa

SEQ ID NO: 2994251 - DNA, 15 bp, Homo sapiens
ggcatccttgcctgt

SEQ ID NO: 2994252 - DNA, 22 bp, Homo sapiens
ggcatcggggagccgggagcct

SEQ ID NO: 2994253 - DNA, 23 bp, Homo sapiens
ggcatcggggagccgggagcctg

SEQ ID NO: 2994254 - DNA, 20 bp, Homo sapiens
ggcatctcattgaggacaaa

SEQ ID NO: 2994255 - DNA, 19 bp, Homo sapiens
ggcatctctgagtgtctct

SEQ ID NO: 2994256 - DNA, 13 bp, Homo sapiens
ggcatctttgggg

SEQ ID NO: 2994257 - DNA, 16 bp, Homo sapiens
ggcatctttggggagg

SEQ ID NO: 2994258 - DNA, 13 bp, Homo sapiens
ggcatgagccact

SEQ ID NO: 2994259 - DNA, 16 bp, Homo sapiens
ggcatgatccaagcaa

SEQ ID NO: 2994260 - DNA, 18 bp, Homo sapiens
ggcatgcacacggctggt

SEQ ID NO: 2994261 - DNA, 22 bp, Homo sapiens
ggcatgcacacggctggtcact

SEQ ID NO: 2994262 - DNA, 13 bp, Homo sapiens
ggcatgccaggac

SEQ ID NO: 2994263 - DNA, 15 bp, Homo sapiens
ggcatggaaggggct

SEQ ID NO: 2994264 - DNA, 14 bp, Homo sapiens
ggcatgggtcggga

SEQ ID NO: 2994265 - DNA, 20 bp, Homo sapiens
ggcattaattgttccttgct

SEQ ID NO: 2994266 - DNA, 22 bp, Homo sapiens
ggcattaattgttccttgcttt

SEQ ID NO: 2994267 - DNA, 20 bp, Homo sapiens
ggcattatgtccactgtgta

SEQ ID NO: 2994268 - DNA, 14 bp, Homo sapiens
ggcattccacagga

SEQ ID NO: 2994269 - DNA, 20 bp, Homo sapiens
ggcatttgcagggtcctctt

SEQ ID NO: 2994270 - DNA, 21 bp, Homo sapiens
ggcatttgcagggtcctcttc

SEQ ID NO: 2994271 - DNA, 16 bp, Homo sapiens
ggcatttgctggcctg

SEQ ID NO: 2994272 - DNA, 23 bp, Homo sapiens
ggcatttgctggcctggcagggg

SEQ ID NO: 2994273 - DNA, 13 bp, Homo sapiens
ggccaacatggtg

SEQ ID NO: 2994274 - DNA, 13 bp, Homo sapiens
ggccaaggagctg

SEQ ID NO: 2994275 - DNA, 15 bp, Homo sapiens
ggccaaggagctgct

SEQ ID NO: 2994276 - DNA, 13 bp, Homo sapiens
ggccaatagtttt

SEQ ID NO: 2994277 - DNA, 16 bp, Homo sapiens
ggccacactcagcaca

SEQ ID NO: 2994278 - DNA, 21 bp, Homo sapiens
ggccacactcagcacaaggcc

SEQ ID NO: 2994279 - DNA, 15 bp, Homo sapiens
ggccacactgtgaca

SEQ ID NO: 2994280 - DNA, 19 bp, Homo sapiens
ggccacagaaggtgaactt

SEQ ID NO: 2994281 - DNA, 13 bp, Homo sapiens
ggccacagcgtgc

SEQ ID NO: 2994282 - DNA, 13 bp, Homo sapiens
ggccacagggcaa

SEQ ID NO: 2994283 - DNA, 18 bp, Homo sapiens
ggccaccaggtgcctttc

SEQ ID NO: 2994284 - DNA, 20 bp, Homo sapiens
ggccaccgggggtggctctg

SEQ ID NO: 2994285 - DNA, 14 bp, Homo sapiens
ggccacgctccagc

SEQ ID NO: 2994286 - DNA, 13 bp, Homo sapiens
ggccacggcccag

SEQ ID NO: 2994287 - DNA, 18 bp, Homo sapiens
ggccacggcccagggagg

SEQ ID NO: 2994288 - DNA, 21 bp, Homo sapiens
ggccacgtatagtcctagctg

SEQ ID NO: 2994289 - DNA, 18 bp, Homo sapiens
ggccacgttcagggaggg

SEQ ID NO: 2994290 - DNA, 20 bp, Homo sapiens
ggccactaagcagaggaggg

SEQ ID NO: 2994291 - DNA, 21 bp, Homo sapiens
ggccactaagcagaggagggg

SEQ ID NO: 2994292 - DNA, 22 bp, Homo sapiens
ggccactgtgtttctgtgctcc

SEQ ID NO: 2994293 - DNA, 17 bp, Homo sapiens
ggccagacacaggccct

SEQ ID NO: 2994294 - DNA, 12 bp, Homo sapiens
ggccagacatgg

SEQ ID NO: 2994295 - DNA, 14 bp, Homo sapiens
ggccagacatggtg

SEQ ID NO: 2994296 - DNA, 11 bp, Homo sapiens
ggccagactcg

SEQ ID NO: 2994297 - DNA, 14 bp, Homo sapiens
ggccagagccaagg

SEQ ID NO: 2994298 - DNA, 14 bp, Homo sapiens
ggccagagccaggg

SEQ ID NO: 2994299 - DNA, 22 bp, Homo sapiens
ggccagagctacccgcagagtt

SEQ ID NO: 2994300 - DNA, 11 bp, Homo sapiens
ggccagaggct

SEQ ID NO: 2994301 - DNA, 12 bp, Homo sapiens
ggccagatccag

SEQ ID NO: 2994302 - DNA, 17 bp, Homo sapiens
ggccagatccagcctgg

SEQ ID NO: 2994303 - DNA, 18 bp, Homo sapiens
ggccagatccagcctggg

SEQ ID NO: 2994304 - DNA, 15 bp, Homo sapiens
ggccagccagccact

SEQ ID NO: 2994305 - DNA, 15 bp, Homo sapiens
ggccagccatgtctg

SEQ ID NO: 2994306 - DNA, 17 bp, Homo sapiens
ggccagcccctccatct

SEQ ID NO: 2994307 - DNA, 13 bp, Homo sapiens
ggccagccgctct

SEQ ID NO: 2994308 - DNA, 15 bp, Homo sapiens
ggccagcgccagggc

SEQ ID NO: 2994309 - DNA, 16 bp, Homo sapiens
ggccagcgccagggcc

SEQ ID NO: 2994310 - DNA, 17 bp, Homo sapiens
ggccagcgccagggccc

SEQ ID NO: 2994311 - DNA, 21 bp, Homo sapiens
ggccaggaaggacagactggc

SEQ ID NO: 2994312 - DNA, 12 bp, Homo sapiens
ggccaggccctg

SEQ ID NO: 2994313 - DNA, 13 bp, Homo sapiens
ggccaggccctgg

SEQ ID NO: 2994314 - DNA, 22 bp, Homo sapiens
ggccaggccctggagggcagag

SEQ ID NO: 2994315 - DNA, 14 bp, Homo sapiens
ggccaggcgagcct

SEQ ID NO: 2994316 - DNA, 16 bp, Homo sapiens
ggccaggcgagcctga

SEQ ID NO: 2994317 - DNA, 18 bp, Homo sapiens
ggccaggcgagcctgact

SEQ ID NO: 2994318 - DNA, 14 bp, Homo sapiens
ggccagggacccaa

SEQ ID NO: 2994319 - DNA, 15 bp, Homo sapiens
ggccagggagaagct

SEQ ID NO: 2994320 - DNA, 17 bp, Homo sapiens
ggccagggaggcagagc

SEQ ID NO: 2994321 - DNA, 20 bp, Homo sapiens
ggccagggccacgctccagc

SEQ ID NO: 2994322 - DNA, 16 bp, Homo sapiens
ggccagggcggccagg

SEQ ID NO: 2994323 - DNA, 19 bp, Homo sapiens
ggccagggcggccagggac

SEQ ID NO: 2994324 - DNA, 21 bp, Homo sapiens
ggccagggcggccagggaccc

SEQ ID NO: 2994325 - DNA, 19 bp, Homo sapiens
ggccagggctcctgtggca

SEQ ID NO: 2994326 - DNA, 14 bp, Homo sapiens
ggccagggctgggt

SEQ ID NO: 2994327 - DNA, 18 bp, Homo sapiens
ggccagggctgggtcaca

SEQ ID NO: 2994328 - DNA, 14 bp, Homo sapiens
ggccagggctttgg

SEQ ID NO: 2994329 - DNA, 21 bp, Homo sapiens
ggatggaagcaggacagacac

SEQ ID NO: 2994330 - DNA, 18 bp, Homo sapiens
ggatggcaggatccaagg

SEQ ID NO: 2994331 - DNA, 20 bp, Homo sapiens
ggatggcatctccatgtaga

SEQ ID NO: 2994332 - DNA, 20 bp, Homo sapiens
ggatggcccttcctcctcca

SEQ ID NO: 2994333 - DNA, 13 bp, Homo sapiens
ggatgggaaaaac

SEQ ID NO: 2994334 - DNA, 20 bp, Homo sapiens
ggatgggaggccgggagagg

SEQ ID NO: 2994335 - DNA, 22 bp, Homo sapiens
ggatgggggaactcagatccag

SEQ ID NO: 2994336 - DNA, 14 bp, Homo sapiens
ggatgggttttatg

SEQ ID NO: 2994337 - DNA, 20 bp, Homo sapiens
ggatggtaggattgctgggg

SEQ ID NO: 2994338 - DNA, 19 bp, Homo sapiens
ggatgtaaacagtgcctgc

SEQ ID NO: 2994339 - DNA, 19 bp, Homo sapiens
ggatgtagcttttcacctt

SEQ ID NO: 2994340 - DNA, 20 bp, Homo sapiens
ggatgtatgaatacagcagc

SEQ ID NO: 2994341 - DNA, 21 bp, Homo sapiens
ggatgtatgaatacagcagca

SEQ ID NO: 2994342 - DNA, 16 bp, Homo sapiens
ggatgtatggggaatc

SEQ ID NO: 2994343 - DNA, 22 bp, Homo sapiens
ggatgtgctttgtggcttctct

SEQ ID NO: 2994344 - DNA, 18 bp, Homo sapiens
ggatgtgggtctttttct

SEQ ID NO: 2994345 - DNA, 18 bp, Homo sapiens
ggatgtggttttcttaag

SEQ ID NO: 2994346 - DNA, 17 bp, Homo sapiens
ggatgtttacctggtgc

SEQ ID NO: 2994347 - DNA, 18 bp, Homo sapiens
ggatgtttacctggtgct

SEQ ID NO: 2994348 - DNA, 16 bp, Homo sapiens
ggattaaacttatgaa

SEQ ID NO: 2994349 - DNA, 20 bp, Homo sapiens
ggattaaacttatgaatgtt

SEQ ID NO: 2994350 - DNA, 14 bp, Homo sapiens
ggattacagaaact

SEQ ID NO: 2994351 - DNA, 20 bp, Homo sapiens
ggattacagaaactgatgcc

SEQ ID NO: 2994352 - DNA, 19 bp, Homo sapiens
ggattacaggcgtgagcca

SEQ ID NO: 2994353 - DNA, 15 bp, Homo sapiens
ggattacccaagcaa

SEQ ID NO: 2994354 - DNA, 20 bp, Homo sapiens
ggattataggcatgagccac

SEQ ID NO: 2994355 - DNA, 11 bp, Homo sapiens
ggattatgtca

SEQ ID NO: 2994356 - DNA, 16 bp, Homo sapiens
ggattccaaccttcct

SEQ ID NO: 2994357 - DNA, 14 bp, Homo sapiens
ggattccccctgcc

SEQ ID NO: 2994358 - DNA, 17 bp, Homo sapiens
ggattccccctgccctg

SEQ ID NO: 2994359 - DNA, 22 bp, Homo sapiens
ggattccccctgccctgtgccg

SEQ ID NO: 2994360 - DNA, 19 bp, Homo sapiens
ggattcctaagactgctgc

SEQ ID NO: 2994361 - DNA, 23 bp, Homo sapiens
ggattctaaacagatgtccctga

SEQ ID NO: 2994362 - DNA, 20 bp, Homo sapiens
ggattctcatgggaagggga

SEQ ID NO: 2994363 - DNA, 23 bp, Homo sapiens
ggattctgtacatgcattgagct

SEQ ID NO: 2994364 - DNA, 22 bp, Homo sapiens
ggattgatcttcagggctgttt

SEQ ID NO: 2994365 - DNA, 19 bp, Homo sapiens
ggattgcaatatctgaagc

SEQ ID NO: 2994366 - DNA, 20 bp, Homo sapiens
ggattgcttcaattaaaatt

SEQ ID NO: 2994367 - DNA, 15 bp, Homo sapiens
ggattggcactgttt

SEQ ID NO: 2994368 - DNA, 14 bp, Homo sapiens
ggattggccctgcc

SEQ ID NO: 2994369 - DNA, 18 bp, Homo sapiens
ggattgggcccctgccag

SEQ ID NO: 2994370 - DNA, 22 bp, Homo sapiens
ggattgtgcaatagtcagagtg

SEQ ID NO: 2994371 - DNA, 14 bp, Homo sapiens
ggatttagaagtgt

SEQ ID NO: 2994372 - DNA, 18 bp, Homo sapiens
ggatttcacggagacagc

SEQ ID NO: 2994373 - DNA, 15 bp, Homo sapiens
ggatttcttaaattt

SEQ ID NO: 2994374 - DNA, 22 bp, Homo sapiens
ggatttgcacagaagcacatgc

SEQ ID NO: 2994375 - DNA, 22 bp, Homo sapiens
ggatttgtccaaacaggtgctg

SEQ ID NO: 2994376 - DNA, 15 bp, Homo sapiens
ggattttaaactaga

SEQ ID NO: 2994377 - DNA, 19 bp, Homo sapiens
ggattttaaactagatgac

SEQ ID NO: 2994378 - DNA, 15 bp, Homo sapiens
ggatttttaattaaa

SEQ ID NO: 2994379 - DNA, 22 bp, Homo sapiens
ggcaaaatcgccataggccaag

SEQ ID NO: 2994380 - DNA, 14 bp, Homo sapiens
ggcaaacatgtgca

SEQ ID NO: 2994381 - DNA, 15 bp, Homo sapiens
ggcaaacgggcttga

SEQ ID NO: 2994382 - DNA, 16 bp, Homo sapiens
ggcaaaggcagaggaa

SEQ ID NO: 2994383 - DNA, 12 bp, Homo sapiens
ggcaaataaaag

SEQ ID NO: 2994384 - DNA, 21 bp, Homo sapiens
ggcaacaagagcaaaactccg

SEQ ID NO: 2994385 - DNA, 19 bp, Homo sapiens
ggcaacagatctggaacct

SEQ ID NO: 2994386 - DNA, 18 bp, Homo sapiens
ggcaacattccaagaata

SEQ ID NO: 2994387 - DNA, 19 bp, Homo sapiens
ggcaacctggaggtctgaa

SEQ ID NO: 2994388 - DNA, 16 bp, Homo sapiens
ggcaacgcacaaaaca

SEQ ID NO: 2994389 - DNA, 21 bp, Homo sapiens
ggcaactctggctccaggcag

SEQ ID NO: 2994390 - DNA, 19 bp, Homo sapiens
ggcaagagggaaggtgacc

SEQ ID NO: 2994391 - DNA, 19 bp, Homo sapiens
ggcaagattggaaagacag

SEQ ID NO: 2994392 - DNA, 21 bp, Homo sapiens
ggcaagcaggcgctgtgctat

SEQ ID NO: 2994393 - DNA, 14 bp, Homo sapiens
ggcaagtgagaggg

SEQ ID NO: 2994394 - DNA, 20 bp, Homo sapiens
ggcaagtgagaggggaggga

SEQ ID NO: 2994395 - DNA, 22 bp, Homo sapiens
ggcaagtgagaggggagggagg

SEQ ID NO: 2994396 - DNA, 15 bp, Homo sapiens
ggcacacgcctccca

SEQ ID NO: 2994397 - DNA, 13 bp, Homo sapiens
ggcacagatgacc

SEQ ID NO: 2994398 - DNA, 17 bp, Homo sapiens
ggcacagatgaccaaag

SEQ ID NO: 2994399 - DNA, 12 bp, Homo sapiens
ggcacagcctgg

SEQ ID NO: 2994400 - DNA, 13 bp, Homo sapiens
ggcacagcctggc

SEQ ID NO: 2994401 - DNA, 12 bp, Homo sapiens
ggcacaggaaac

SEQ ID NO: 2994402 - DNA, 12 bp, Homo sapiens
ggcacaggaggc

SEQ ID NO: 2994403 - DNA, 20 bp, Homo sapiens
ggcacatgaacagcttgcca

SEQ ID NO: 2994404 - DNA, 14 bp, Homo sapiens
ggcacattaactgt

SEQ ID NO: 2994405 - DNA, 15 bp, Homo sapiens
ggcacattaactgtt

SEQ ID NO: 2994406 - DNA, 13 bp, Homo sapiens
ggcaccagacacc

SEQ ID NO: 2994407 - DNA, 16 bp, Homo sapiens
ggcaccagacacccag

SEQ ID NO: 2994408 - DNA, 20 bp, Homo sapiens
ggcaccagacacccaggact

SEQ ID NO: 2994409 - DNA, 17 bp, Homo sapiens
ggcaccagtccctgtcc

SEQ ID NO: 2994410 - DNA, 13 bp, Homo sapiens
ggcacccaccctg

SEQ ID NO: 2994411 - DNA, 20 bp, Homo sapiens
ggcacccctttccccagcct

SEQ ID NO: 2994412 - DNA, 21 bp, Homo sapiens
ggcacccctttccccagcctc

SEQ ID NO: 2994413 - DNA, 14 bp, Homo sapiens
ggcaccgcagcctg

SEQ ID NO: 2994414 - DNA, 15 bp, Homo sapiens
ggcacctaatccagg

SEQ ID NO: 2994415 - DNA, 17 bp, Homo sapiens
ggcacctaatccaggca

SEQ ID NO: 2994416 - DNA, 18 bp, Homo sapiens
ggcacctaatccaggcag

SEQ ID NO: 2994417 - DNA, 21 bp, Homo sapiens
ggcacctgcctagctcttggg

SEQ ID NO: 2994418 - DNA, 19 bp, Homo sapiens
ggcacctgtgttccagccc

SEQ ID NO: 2994419 - DNA, 19 bp, Homo sapiens
ggcacgaacccacctgctg

SEQ ID NO: 2994420 - DNA, 13 bp, Homo sapiens
ggcacggcaggcg

SEQ ID NO: 2994421 - DNA, 21 bp, Homo sapiens
ggcacggcaggcgtgtggcag

SEQ ID NO: 2994422 - DNA, 13 bp, Homo sapiens
ggcacgtgtgggc

SEQ ID NO: 2994423 - DNA, 14 bp, Homo sapiens
ggcactccaaccta

SEQ ID NO: 2994424 - DNA, 18 bp, Homo sapiens
ggcactgtagttctaaga

SEQ ID NO: 2994425 - DNA, 13 bp, Homo sapiens
ggcacttccctgc

SEQ ID NO: 2994426 - DNA, 17 bp, Homo sapiens
ggcagaaaattgcacaa

SEQ ID NO: 2994427 - DNA, 21 bp, Homo sapiens
ggcagaacatcgcgatgggaa

SEQ ID NO: 2994428 - DNA, 15 bp, Homo sapiens
ggcagaactctctgt

SEQ ID NO: 2994429 - DNA, 19 bp, Homo sapiens
ggcagaactgctggggctg

SEQ ID NO: 2994430 - DNA, 23 bp, Homo sapiens
ggcagaactgctggggctggtga

SEQ ID NO: 2994431 - DNA, 17 bp, Homo sapiens
ggcagaagaattgaacc

SEQ ID NO: 2994432 - DNA, 17 bp, Homo sapiens
ggcagaaggcaaaccca

SEQ ID NO: 2994433 - DNA, 14 bp, Homo sapiens
ggcagaagggaatt

SEQ ID NO: 2994434 - DNA, 14 bp, Homo sapiens
ggcagaatcctggg

SEQ ID NO: 2994435 - DNA, 18 bp, Homo sapiens
ggcagaatcctgggcccc

SEQ ID NO: 2994436 - DNA, 12 bp, Homo sapiens
ggcagacacaac

SEQ ID NO: 2994437 - DNA, 19 bp, Homo sapiens
ggcagactctttatgcttg

SEQ ID NO: 2994438 - DNA, 16 bp, Homo sapiens
ggcagagcccaaggga

SEQ ID NO: 2994439 - DNA, 12 bp, Homo sapiens
ggcagagcctgt

SEQ ID NO: 2994440 - DNA, 19 bp, Homo sapiens
ggcagagcgggagggagtc

SEQ ID NO: 2994441 - DNA, 13 bp, Homo sapiens
ggcagagcttctt

SEQ ID NO: 2994442 - DNA, 21 bp, Homo sapiens
ggcagagcttgcagtgagccg

SEQ ID NO: 2994443 - DNA, 21 bp, Homo sapiens
ggcagaggaatttggctgctt

SEQ ID NO: 2994444 - DNA, 19 bp, Homo sapiens
ggcagaggctggaggcagg

SEQ ID NO: 2994445 - DNA, 21 bp, Homo sapiens
ggcagaggctggaggcagggc

SEQ ID NO: 2994446 - DNA, 14 bp, Homo sapiens
ggcagagggcagag

SEQ ID NO: 2994447 - DNA, 16 bp, Homo sapiens
ggcagagggcagaggc

SEQ ID NO: 2994448 - DNA, 14 bp, Homo sapiens
ggcagagggctgga

SEQ ID NO: 2994449 - DNA, 15 bp, Homo sapiens
ggcagaggttgtagt

SEQ ID NO: 2994450 - DNA, 20 bp, Homo sapiens
ggcagaggttgtagtgagcc

SEQ ID NO: 2994451 - DNA, 22 bp, Homo sapiens
ggcagaggttgtagtgagccca

SEQ ID NO: 2994452 - DNA, 15 bp, Homo sapiens
ggcagataactgctg

SEQ ID NO: 2994453 - DNA, 14 bp, Homo sapiens
ggcagatcacctga

SEQ ID NO: 2994454 - DNA, 15 bp, Homo sapiens
ggcagatggacttct

SEQ ID NO: 2994455 - DNA, 15 bp, Homo sapiens
ggcagattcccactg

SEQ ID NO: 2994456 - DNA, 21 bp, Homo sapiens
ggcagcacctgtctcctttca

SEQ ID NO: 2994457 - DNA, 22 bp, Homo sapiens
ggcagcacggcccggcccctca

SEQ ID NO: 2994458 - DNA, 22 bp, Homo sapiens
ggcagcagcatcccagccttga

SEQ ID NO: 2994459 - DNA, 13 bp, Homo sapiens
ggcagcagggcta

SEQ ID NO: 2994460 - DNA, 13 bp, Homo sapiens
ggcagcagtgtga

SEQ ID NO: 2994461 - DNA, 14 bp, Homo sapiens
ggcagcagtgtgag

SEQ ID NO: 2994462 - DNA, 20 bp, Homo sapiens
ggcagcagtgtgaggccagg

SEQ ID NO: 2994463 - DNA, 15 bp, Homo sapiens
ggcagccacacgcag

SEQ ID NO: 2994464 - DNA, 16 bp, Homo sapiens
ggcagccacacgcagg

SEQ ID NO: 2994465 - DNA, 20 bp, Homo sapiens
ggaggcaggggacaagggag

SEQ ID NO: 2994466 - DNA, 17 bp, Homo sapiens
ggaggcatcatggaaag

SEQ ID NO: 2994467 - DNA, 14 bp, Homo sapiens
ggaggcatggaaac

SEQ ID NO: 2994468 - DNA, 12 bp, Homo sapiens
ggaggccagcca

SEQ ID NO: 2994469 - DNA, 13 bp, Homo sapiens
ggaggccagccag

SEQ ID NO: 2994470 - DNA, 23 bp, Homo sapiens
ggaggccaggccggcgagccctg

SEQ ID NO: 2994471 - DNA, 16 bp, Homo sapiens
ggaggccagtgagcca

SEQ ID NO: 2994472 - DNA, 20 bp, Homo sapiens
ggaggcccagccgcaggaag

SEQ ID NO: 2994473 - DNA, 22 bp, Homo sapiens
ggaggcccaggctgggaactca

SEQ ID NO: 2994474 - DNA, 13 bp, Homo sapiens
ggaggcccagttc

SEQ ID NO: 2994475 - DNA, 19 bp, Homo sapiens
ggaggcccagttcaccctg

SEQ ID NO: 2994476 - DNA, 17 bp, Homo sapiens
ggaggccccactgggga

SEQ ID NO: 2994477 - DNA, 19 bp, Homo sapiens
ggaggccccggcgcccgca

SEQ ID NO: 2994478 - DNA, 23 bp, Homo sapiens
ggaggccctgtgccccttgacaa

SEQ ID NO: 2994479 - DNA, 14 bp, Homo sapiens
ggaggcctcaggga

SEQ ID NO: 2994480 - DNA, 23 bp, Homo sapiens
ggaggccttggggtgggggccag

SEQ ID NO: 2994481 - DNA, 17 bp, Homo sapiens
ggaggcgcggcctcccg

SEQ ID NO: 2994482 - DNA, 14 bp, Homo sapiens
ggaggctgaggcag

SEQ ID NO: 2994483 - DNA, 16 bp, Homo sapiens
ggaggctgaggcagga

SEQ ID NO: 2994484 - DNA, 14 bp, Homo sapiens
ggaggctgcagcca

SEQ ID NO: 2994485 - DNA, 21 bp, Homo sapiens
ggaggctgcagccaggcctcg

SEQ ID NO: 2994486 - DNA, 22 bp, Homo sapiens
ggaggctgcagccaggcctcgc

SEQ ID NO: 2994487 - DNA, 18 bp, Homo sapiens
ggaggctgccctgagggg

SEQ ID NO: 2994488 - DNA, 20 bp, Homo sapiens
ggaggctgccctgaggggct

SEQ ID NO: 2994489 - DNA, 17 bp, Homo sapiens
ggagggaaactgtgaat

SEQ ID NO: 2994490 - DNA, 18 bp, Homo sapiens
ggagggaaactgtgaatg

SEQ ID NO: 2994491 - DNA, 15 bp, Homo sapiens
ggagggaagtcctgg

SEQ ID NO: 2994492 - DNA, 22 bp, Homo sapiens
ggagggacaagtggactcaggg

SEQ ID NO: 2994493 - DNA, 14 bp, Homo sapiens
ggagggactgctga

SEQ ID NO: 2994494 - DNA, 15 bp, Homo sapiens
ggagggactgctgac

SEQ ID NO: 2994495 - DNA, 13 bp, Homo sapiens
ggagggagatgga

SEQ ID NO: 2994496 - DNA, 11 bp, Homo sapiens
ggagggaggcc

SEQ ID NO: 2994497 - DNA, 16 bp, Homo sapiens
ggagggaggctcaggt

SEQ ID NO: 2994498 - DNA, 14 bp, Homo sapiens
ggagggagggaagt

SEQ ID NO: 2994499 - DNA, 23 bp, Homo sapiens
ggagggcactggagctgggaggt

SEQ ID NO: 2994500 - DNA, 17 bp, Homo sapiens
ggagggcacttggccag

SEQ ID NO: 2994501 - DNA, 13 bp, Homo sapiens
ggagggcagcagg

SEQ ID NO: 2994502 - DNA, 17 bp, Homo sapiens
ggagggcagcagggcta

SEQ ID NO: 2994503 - DNA, 19 bp, Homo sapiens
ggagggccacatgggaggc

SEQ ID NO: 2994504 - DNA, 22 bp, Homo sapiens
ggagggcgcccagcagcctgcc

SEQ ID NO: 2994505 - DNA, 22 bp, Homo sapiens
ggagggcgttcttaggctgctg

SEQ ID NO: 2994506 - DNA, 22 bp, Homo sapiens
ggagggctgtcatctgtgcact

SEQ ID NO: 2994507 - DNA, 18 bp, Homo sapiens
ggaggggaaaaaaatgtt

SEQ ID NO: 2994508 - DNA, 14 bp, Homo sapiens
ggaggggaaggggc

SEQ ID NO: 2994509 - DNA, 16 bp, Homo sapiens
ggaggggccctccgag

SEQ ID NO: 2994510 - DNA, 15 bp, Homo sapiens
ggaggggcctaggcc

SEQ ID NO: 2994511 - DNA, 21 bp, Homo sapiens
ggaggggcctaggcctcagcc

SEQ ID NO: 2994512 - DNA, 13 bp, Homo sapiens
ggaggggcctttg

SEQ ID NO: 2994513 - DNA, 14 bp, Homo sapiens
ggagggggagaggg

SEQ ID NO: 2994514 - DNA, 13 bp, Homo sapiens
ggagggggcacgg

SEQ ID NO: 2994515 - DNA, 14 bp, Homo sapiens
ggagggggcggcag

SEQ ID NO: 2994516 - DNA, 20 bp, Homo sapiens
ggagggtgaggttgcagtga

SEQ ID NO: 2994517 - DNA, 20 bp, Homo sapiens
ggagggttggcctgagttag

SEQ ID NO: 2994518 - DNA, 16 bp, Homo sapiens
ggaggtcgaagcaatc

SEQ ID NO: 2994519 - DNA, 17 bp, Homo sapiens
ggaggtgggaggccagg

SEQ ID NO: 2994520 - DNA, 21 bp, Homo sapiens
ggaggttaaggctgaggaaag

SEQ ID NO: 2994521 - DNA, 23 bp, Homo sapiens
ggaggttctaaggcctaggattc

SEQ ID NO: 2994522 - DNA, 18 bp, Homo sapiens
ggaggttgagtgagccgg

SEQ ID NO: 2994523 - DNA, 23 bp, Homo sapiens
ggagtcatctcaaccatcccctc

SEQ ID NO: 2994524 - DNA, 17 bp, Homo sapiens
ggagtcccaggggcagc

SEQ ID NO: 2994525 - DNA, 21 bp, Homo sapiens
ggagtcccttttcattctcct

SEQ ID NO: 2994526 - DNA, 17 bp, Homo sapiens
ggagtctcaggaggagg

SEQ ID NO: 2994527 - DNA, 18 bp, Homo sapiens
ggagtctcaggaggaggc

SEQ ID NO: 2994528 - DNA, 21 bp, Homo sapiens
ggagtctcaggaggaggctgc

SEQ ID NO: 2994529 - DNA, 15 bp, Homo sapiens
ggagtctgaagcaga

SEQ ID NO: 2994530 - DNA, 21 bp, Homo sapiens
ggagtgcagaacacctggccg

SEQ ID NO: 2994531 - DNA, 22 bp, Homo sapiens
ggagtgcccccagcccagagcc

SEQ ID NO: 2994532 - DNA, 17 bp, Homo sapiens
ggagtggctcgccaggc

SEQ ID NO: 2994533 - DNA, 20 bp, Homo sapiens
ggagtggttgggctgtgcct

SEQ ID NO: 2994534 - DNA, 12 bp, Homo sapiens
ggagtgtaaacc

SEQ ID NO: 2994535 - DNA, 20 bp, Homo sapiens
ggagtgtgtcagagcccagg

SEQ ID NO: 2994536 - DNA, 12 bp, Homo sapiens
ggagtgttcccc

SEQ ID NO: 2994537 - DNA, 15 bp, Homo sapiens
ggagttaagacctgg

SEQ ID NO: 2994538 - DNA, 23 bp, Homo sapiens
ggagttaagacctggcagctctg

SEQ ID NO: 2994539 - DNA, 19 bp, Homo sapiens
ggagttcaagaccagcctg

SEQ ID NO: 2994540 - DNA, 18 bp, Homo sapiens
ggagttcaagactagcct

SEQ ID NO: 2994541 - DNA, 14 bp, Homo sapiens
ggagttccacagat

SEQ ID NO: 2994542 - DNA, 16 bp, Homo sapiens
ggagttctatgctctc

SEQ ID NO: 2994543 - DNA, 22 bp, Homo sapiens
ggagttctttggctctattgga

SEQ ID NO: 2994544 - DNA, 23 bp, Homo sapiens
ggagttgatcgcctttcccaggt

SEQ ID NO: 2994545 - DNA, 14 bp, Homo sapiens
ggagttgatctgga

SEQ ID NO: 2994546 - DNA, 21 bp, Homo sapiens
ggagttgatctggaacccaga

SEQ ID NO: 2994547 - DNA, 20 bp, Homo sapiens
ggagtttgaggctgcaatga

SEQ ID NO: 2994548 - DNA, 21 bp, Homo sapiens
ggagttttgctcttgtagccc

SEQ ID NO: 2994549 - DNA, 16 bp, Homo sapiens
ggagttttttgtacca

SEQ ID NO: 2994550 - DNA, 16 bp, Homo sapiens
ggataaactgagcctc

SEQ ID NO: 2994551 - DNA, 14 bp, Homo sapiens
ggataacaaagata

SEQ ID NO: 2994552 - DNA, 16 bp, Homo sapiens
ggataacaaagatatc

SEQ ID NO: 2994553 - DNA, 16 bp, Homo sapiens
ggataatgaaataatc

SEQ ID NO: 2994554 - DNA, 18 bp, Homo sapiens
ggataccagctcagggga

SEQ ID NO: 2994555 - DNA, 14 bp, Homo sapiens
ggatagccttgaaa

SEQ ID NO: 2994556 - DNA, 18 bp, Homo sapiens
ggatagccttgaaaacaa

SEQ ID NO: 2994557 - DNA, 18 bp, Homo sapiens
ggatagctaactgtaaat

SEQ ID NO: 2994558 - DNA, 18 bp, Homo sapiens
ggataggaaaaatgagta

SEQ ID NO: 2994559 - DNA, 15 bp, Homo sapiens
ggatagtatgtaatt

SEQ ID NO: 2994560 - DNA, 16 bp, Homo sapiens
ggatatgcttagtaat

SEQ ID NO: 2994561 - DNA, 19 bp, Homo sapiens
ggatatttgtactgtttaa

SEQ ID NO: 2994562 - DNA, 20 bp, Homo sapiens
ggatattttgaaatgaactt

SEQ ID NO: 2994563 - DNA, 16 bp, Homo sapiens
ggatcaaagttctgct

SEQ ID NO: 2994564 - DNA, 19 bp, Homo sapiens
ggatcaattttcattaaac

SEQ ID NO: 2994565 - DNA, 22 bp, Homo sapiens
ggatcacaggtgtcagccattg

SEQ ID NO: 2994566 - DNA, 17 bp, Homo sapiens
ggatcacctgaggtcag

SEQ ID NO: 2994567 - DNA, 17 bp, Homo sapiens
ggatcagtgaaaaacat

SEQ ID NO: 2994568 - DNA, 13 bp, Homo sapiens
ggatcatatgaat

SEQ ID NO: 2994569 - DNA, 21 bp, Homo sapiens
ggatcatctaattctctgtgg

SEQ ID NO: 2994570 - DNA, 19 bp, Homo sapiens
ggatcatctgccgtgcctg

SEQ ID NO: 2994571 - DNA, 12 bp, Homo sapiens
ggatcatgaaag

SEQ ID NO: 2994572 - DNA, 17 bp, Homo sapiens
ggatcccaaagcaagga

SEQ ID NO: 2994573 - DNA, 13 bp, Homo sapiens
ggatcccacagcc

SEQ ID NO: 2994574 - DNA, 18 bp, Homo sapiens
ggatcccacagccctagt

SEQ ID NO: 2994575 - DNA, 20 bp, Homo sapiens
ggatcccctgtcccctgggg

SEQ ID NO: 2994576 - DNA, 22 bp, Homo sapiens
ggatcccctgtcccctggggct

SEQ ID NO: 2994577 - DNA, 19 bp, Homo sapiens
ggatcccgttcagaaaacc

SEQ ID NO: 2994578 - DNA, 16 bp, Homo sapiens
ggatcctgcccccaag

SEQ ID NO: 2994579 - DNA, 20 bp, Homo sapiens
ggatcctgcccccaagtcat

SEQ ID NO: 2994580 - DNA, 18 bp, Homo sapiens
ggatcctgggctgggtgg

SEQ ID NO: 2994581 - DNA, 20 bp, Homo sapiens
ggatccttcccaaggtacag

SEQ ID NO: 2994582 - DNA, 15 bp, Homo sapiens
ggatcgaggcatggg

SEQ ID NO: 2994583 - DNA, 13 bp, Homo sapiens
ggatctagaaggg

SEQ ID NO: 2994584 - DNA, 15 bp, Homo sapiens
ggatctagaagggac

SEQ ID NO: 2994585 - DNA, 12 bp, Homo sapiens
ggatctatttat

SEQ ID NO: 2994586 - DNA, 16 bp, Homo sapiens
ggatctcgcctggaaa

SEQ ID NO: 2994587 - DNA, 19 bp, Homo sapiens
ggatctgaaaacttggctg

SEQ ID NO: 2994588 - DNA, 16 bp, Homo sapiens
ggatctttgtggccaa

SEQ ID NO: 2994589 - DNA, 19 bp, Homo sapiens
ggatgacaggcgcctgcca

SEQ ID NO: 2994590 - DNA, 17 bp, Homo sapiens
ggatgaccatactcaga

SEQ ID NO: 2994591 - DNA, 18 bp, Homo sapiens
ggatgcacggtttctgtt

SEQ ID NO: 2994592 - DNA, 16 bp, Homo sapiens
ggatgcatggagatag

SEQ ID NO: 2994593 - DNA, 20 bp, Homo sapiens
ggatgcattcgagatggcag

SEQ ID NO: 2994594 - DNA, 22 bp, Homo sapiens
ggatgccaatattaaatctgct

SEQ ID NO: 2994595 - DNA, 18 bp, Homo sapiens
ggatgccactcctccctc

SEQ ID NO: 2994596 - DNA, 15 bp, Homo sapiens
ggatgccctggaggt

SEQ ID NO: 2994597 - DNA, 19 bp, Homo sapiens
ggatgctatttcagccaat

SEQ ID NO: 2994598 - DNA, 23 bp, Homo sapiens
ggatgctccgaggactggactgt

SEQ ID NO: 2994599 - DNA, 13 bp, Homo sapiens
ggatgctgtgcta

SEQ ID NO: 2994600 - DNA, 14 bp, Homo sapiens
ggatggaaaaataa

SEQ ID NO: 2994601 - DNA, 13 bp, Homo sapiens
ggactgctgaccc

SEQ ID NO: 2994602 - DNA, 18 bp, Homo sapiens
ggactggaaaaatgaact

SEQ ID NO: 2994603 - DNA, 17 bp, Homo sapiens
ggactggccgtggctcc

SEQ ID NO: 2994604 - DNA, 15 bp, Homo sapiens
ggactgggggccaga

SEQ ID NO: 2994605 - DNA, 21 bp, Homo sapiens
ggactgggtctgacctggtgg

SEQ ID NO: 2994606 - DNA, 20 bp, Homo sapiens
ggactgtcattttggcatct

SEQ ID NO: 2994607 - DNA, 21 bp, Homo sapiens
ggacttcacgaagtgttgcat

SEQ ID NO: 2994608 - DNA, 20 bp, Homo sapiens
ggacttcctgtccagctcca

SEQ ID NO: 2994609 - DNA, 21 bp, Homo sapiens
ggacttcctgtccagctccaa

SEQ ID NO: 2994610 - DNA, 18 bp, Homo sapiens
ggacttctgaaaaatgaa

SEQ ID NO: 2994611 - DNA, 11 bp, Homo sapiens
ggacttgaaaa

SEQ ID NO: 2994612 - DNA, 20 bp, Homo sapiens
ggacttttaaacaaaagtgt

SEQ ID NO: 2994613 - DNA, 20 bp, Homo sapiens
ggagaaaaaaagcatgtgtc

SEQ ID NO: 2994614 - DNA, 21 bp, Homo sapiens
ggagaaaagacggatggcagg

SEQ ID NO: 2994615 - DNA, 13 bp, Homo sapiens
ggagaaagagggg

SEQ ID NO: 2994616 - DNA, 15 bp, Homo sapiens
ggagaaattgacaga

SEQ ID NO: 2994617 - DNA, 22 bp, Homo sapiens
ggagaagaattttcagacccca

SEQ ID NO: 2994618 - DNA, 13 bp, Homo sapiens
ggagaagccacct

SEQ ID NO: 2994619 - DNA, 11 bp, Homo sapiens
ggagaagccat

SEQ ID NO: 2994620 - DNA, 16 bp, Homo sapiens
ggagaagccattgtct

SEQ ID NO: 2994621 - DNA, 17 bp, Homo sapiens
ggagaagccattgtctt

SEQ ID NO: 2994622 - DNA, 19 bp, Homo sapiens
ggagaagctcctctcccca

SEQ ID NO: 2994623 - DNA, 14 bp, Homo sapiens
ggagaaggaaaaag

SEQ ID NO: 2994624 - DNA, 22 bp, Homo sapiens
ggagaaggtcagcgagaaggag

SEQ ID NO: 2994625 - DNA, 12 bp, Homo sapiens
ggagaatcactt

SEQ ID NO: 2994626 - DNA, 14 bp, Homo sapiens
ggagaatgcagccc

SEQ ID NO: 2994627 - DNA, 16 bp, Homo sapiens
ggagaatgcagcccac

SEQ ID NO: 2994628 - DNA, 17 bp, Homo sapiens
ggagaattaaactccta

SEQ ID NO: 2994629 - DNA, 14 bp, Homo sapiens
ggagaattgtggaa

SEQ ID NO: 2994630 - DNA, 19 bp, Homo sapiens
ggagacaggttagctgctc

SEQ ID NO: 2994631 - DNA, 16 bp, Homo sapiens
ggagacccaacaatga

SEQ ID NO: 2994632 - DNA, 13 bp, Homo sapiens
ggagactcacctc

SEQ ID NO: 2994633 - DNA, 15 bp, Homo sapiens
ggagactggcaggcg

SEQ ID NO: 2994634 - DNA, 22 bp, Homo sapiens
ggagactggtaggaggaggcat

SEQ ID NO: 2994635 - DNA, 16 bp, Homo sapiens
ggagacttgccagagc

SEQ ID NO: 2994636 - DNA, 19 bp, Homo sapiens
ggagagaactgagcatctc

SEQ ID NO: 2994637 - DNA, 18 bp, Homo sapiens
ggagagaccagcctttct

SEQ ID NO: 2994638 - DNA, 16 bp, Homo sapiens
ggagagatagcctgtg

SEQ ID NO: 2994639 - DNA, 19 bp, Homo sapiens
ggagagatgacccctaccc

SEQ ID NO: 2994640 - DNA, 23 bp, Homo sapiens
ggagagatgacccctaccccctc

SEQ ID NO: 2994641 - DNA, 21 bp, Homo sapiens
ggagagattattaaatcgttt

SEQ ID NO: 2994642 - DNA, 14 bp, Homo sapiens
ggagagccagagaa

SEQ ID NO: 2994643 - DNA, 14 bp, Homo sapiens
ggagagccagccct

SEQ ID NO: 2994644 - DNA, 21 bp, Homo sapiens
ggagagccagccctccctgtc

SEQ ID NO: 2994645 - DNA, 15 bp, Homo sapiens
ggagagcgaggaggc

SEQ ID NO: 2994646 - DNA, 14 bp, Homo sapiens
ggagaggagagcca

SEQ ID NO: 2994647 - DNA, 15 bp, Homo sapiens
ggagaggagagccag

SEQ ID NO: 2994648 - DNA, 18 bp, Homo sapiens
ggagagggcctctgcctg

SEQ ID NO: 2994649 - DNA, 21 bp, Homo sapiens
ggagagggctacaaaggagga

SEQ ID NO: 2994650 - DNA, 20 bp, Homo sapiens
ggagaggggacgcaggcccc

SEQ ID NO: 2994651 - DNA, 17 bp, Homo sapiens
ggagagggtctggagaa

SEQ ID NO: 2994652 - DNA, 14 bp, Homo sapiens
ggagagtgagagca

SEQ ID NO: 2994653 - DNA, 21 bp, Homo sapiens
ggagagtggccattctttttt

SEQ ID NO: 2994654 - DNA, 21 bp, Homo sapiens
ggagatagccccacaggaggt

SEQ ID NO: 2994655 - DNA, 22 bp, Homo sapiens
ggagatatttatggggggagaa

SEQ ID NO: 2994656 - DNA, 18 bp, Homo sapiens
ggagatctgaacccagct

SEQ ID NO: 2994657 - DNA, 18 bp, Homo sapiens
ggagattagcccttcctt

SEQ ID NO: 2994658 - DNA, 13 bp, Homo sapiens
ggagattcagagc

SEQ ID NO: 2994659 - DNA, 13 bp, Homo sapiens
ggagattgaactt

SEQ ID NO: 2994660 - DNA, 16 bp, Homo sapiens
ggagcaagttgcagtc

SEQ ID NO: 2994661 - DNA, 14 bp, Homo sapiens
ggagcaatcacagg

SEQ ID NO: 2994662 - DNA, 21 bp, Homo sapiens
ggagcaattacggggtgacct

SEQ ID NO: 2994663 - DNA, 21 bp, Homo sapiens
ggagcacatactacctagaag

SEQ ID NO: 2994664 - DNA, 13 bp, Homo sapiens
ggagcaccacggc

SEQ ID NO: 2994665 - DNA, 14 bp, Homo sapiens
ggagcaccacggcc

SEQ ID NO: 2994666 - DNA, 17 bp, Homo sapiens
ggagcaccaggcacgaa

SEQ ID NO: 2994667 - DNA, 18 bp, Homo sapiens
ggagcacctggaccccct

SEQ ID NO: 2994668 - DNA, 12 bp, Homo sapiens
ggagcagagggg

SEQ ID NO: 2994669 - DNA, 21 bp, Homo sapiens
ggagcaggcggtgggcaccca

SEQ ID NO: 2994670 - DNA, 13 bp, Homo sapiens
ggagcagggcggc

SEQ ID NO: 2994671 - DNA, 24 bp, Homo sapiens
ggagcatcagctgtctgtcatctg

SEQ ID NO: 2994672 - DNA, 17 bp, Homo sapiens
ggagcatgattttaaga

SEQ ID NO: 2994673 - DNA, 19 bp, Homo sapiens
ggagcattaagcccaatct

SEQ ID NO: 2994674 - DNA, 21 bp, Homo sapiens
ggagccagctccctctattta

SEQ ID NO: 2994675 - DNA, 23 bp, Homo sapiens
ggagcccactgtcctgggcctgc

SEQ ID NO: 2994676 - DNA, 18 bp, Homo sapiens
ggagcccagcggcccaag

SEQ ID NO: 2994677 - DNA, 16 bp, Homo sapiens
ggagcccagtgggctg

SEQ ID NO: 2994678 - DNA, 18 bp, Homo sapiens
ggagcccagtgggctgca

SEQ ID NO: 2994679 - DNA, 15 bp, Homo sapiens
ggagccccactgccc

SEQ ID NO: 2994680 - DNA, 17 bp, Homo sapiens
ggagcccccagctgcca

SEQ ID NO: 2994681 - DNA, 20 bp, Homo sapiens
ggagcccctcctcccccggc

SEQ ID NO: 2994682 - DNA, 22 bp, Homo sapiens
ggagcccctcctcccccggctg

SEQ ID NO: 2994683 - DNA, 11 bp, Homo sapiens
ggagcccctga

SEQ ID NO: 2994684 - DNA, 20 bp, Homo sapiens
ggagcccttatctgtgctca

SEQ ID NO: 2994685 - DNA, 22 bp, Homo sapiens
ggagcccttatctgtgctcagg

SEQ ID NO: 2994686 - DNA, 16 bp, Homo sapiens
ggagccgggaccctca

SEQ ID NO: 2994687 - DNA, 17 bp, Homo sapiens
ggagccgggtctgcctc

SEQ ID NO: 2994688 - DNA, 16 bp, Homo sapiens
ggagcctacccacccc

SEQ ID NO: 2994689 - DNA, 12 bp, Homo sapiens
ggagcctcagaa

SEQ ID NO: 2994690 - DNA, 15 bp, Homo sapiens
ggagcctgaggcagg

SEQ ID NO: 2994691 - DNA, 19 bp, Homo sapiens
ggagcctttttaaaacaca

SEQ ID NO: 2994692 - DNA, 14 bp, Homo sapiens
ggagcgctagtgcc

SEQ ID NO: 2994693 - DNA, 19 bp, Homo sapiens
ggagcgctagtgccttgcc

SEQ ID NO: 2994694 - DNA, 21 bp, Homo sapiens
ggagcgctagtgccttgccca

SEQ ID NO: 2994695 - DNA, 16 bp, Homo sapiens
ggagcggaaagcagct

SEQ ID NO: 2994696 - DNA, 16 bp, Homo sapiens
ggagcgggcagggccg

SEQ ID NO: 2994697 - DNA, 23 bp, Homo sapiens
ggagcgttctaaatatgaatgaa

SEQ ID NO: 2994698 - DNA, 21 bp, Homo sapiens
ggagctcaggaaccgaggcag

SEQ ID NO: 2994699 - DNA, 20 bp, Homo sapiens
ggagctccaactcagaaggg

SEQ ID NO: 2994700 - DNA, 17 bp, Homo sapiens
ggagctctgcgccaggc

SEQ ID NO: 2994701 - DNA, 19 bp, Homo sapiens
ggagctgagaagaggagga

SEQ ID NO: 2994702 - DNA, 21 bp, Homo sapiens
ggagctgagaagaggaggagg

SEQ ID NO: 2994703 - DNA, 12 bp, Homo sapiens
ggagctgaggcc

SEQ ID NO: 2994704 - DNA, 20 bp, Homo sapiens
ggagctgagggagggagcca

SEQ ID NO: 2994705 - DNA, 22 bp, Homo sapiens
ggagctgagggagggagccatg

SEQ ID NO: 2994706 - DNA, 12 bp, Homo sapiens
ggagctgcctgc

SEQ ID NO: 2994707 - DNA, 14 bp, Homo sapiens
ggagctgcctgcag

SEQ ID NO: 2994708 - DNA, 17 bp, Homo sapiens
ggagctgccttggctca

SEQ ID NO: 2994709 - DNA, 15 bp, Homo sapiens
ggagctggcccaggg

SEQ ID NO: 2994710 - DNA, 18 bp, Homo sapiens
ggagctggccccgccgcc

SEQ ID NO: 2994711 - DNA, 20 bp, Homo sapiens
ggagctggccccgccgcctg

SEQ ID NO: 2994712 - DNA, 12 bp, Homo sapiens
ggagctgggagg

SEQ ID NO: 2994713 - DNA, 14 bp, Homo sapiens
ggagctgggaggaa

SEQ ID NO: 2994714 - DNA, 15 bp, Homo sapiens
ggagctgggaggaaa

SEQ ID NO: 2994715 - DNA, 20 bp, Homo sapiens
ggagctgttctctgtcgtga

SEQ ID NO: 2994716 - DNA, 20 bp, Homo sapiens
ggagcttcatggcagaaggc

SEQ ID NO: 2994717 - DNA, 15 bp, Homo sapiens
ggagctttcttgttt

SEQ ID NO: 2994718 - DNA, 20 bp, Homo sapiens
ggaggaaagggcctggccag

SEQ ID NO: 2994719 - DNA, 24 bp, Homo sapiens
ggaggaaagggcctggccagtcct

SEQ ID NO: 2994720 - DNA, 11 bp, Homo sapiens
ggaggaagccc

SEQ ID NO: 2994721 - DNA, 16 bp, Homo sapiens
ggaggaatgtgtgcct

SEQ ID NO: 2994722 - DNA, 18 bp, Homo sapiens
ggaggacaagaccctctc

SEQ ID NO: 2994723 - DNA, 13 bp, Homo sapiens
ggaggacaattca

SEQ ID NO: 2994724 - DNA, 10 bp, Homo sapiens
ggaggacagt

SEQ ID NO: 2994725 - DNA, 20 bp, Homo sapiens
ggaggaccacaggtgtgagc

SEQ ID NO: 2994726 - DNA, 15 bp, Homo sapiens
ggaggagctgaggga

SEQ ID NO: 2994727 - DNA, 15 bp, Homo sapiens
ggaggagcttctggg

SEQ ID NO: 2994728 - DNA, 14 bp, Homo sapiens
ggaggaggcatgga

SEQ ID NO: 2994729 - DNA, 15 bp, Homo sapiens
ggaggaggctgccct

SEQ ID NO: 2994730 - DNA, 23 bp, Homo sapiens
ggaggaggctgccctgaggggct

SEQ ID NO: 2994731 - DNA, 15 bp, Homo sapiens
ggaggagggcaggca

SEQ ID NO: 2994732 - DNA, 15 bp, Homo sapiens
ggaggagtgagacag

SEQ ID NO: 2994733 - DNA, 14 bp, Homo sapiens
ggaggattgtgctg

SEQ ID NO: 2994734 - DNA, 11 bp, Homo sapiens
ggaggatttgg

SEQ ID NO: 2994735 - DNA, 13 bp, Homo sapiens
ggaggcactgaag

SEQ ID NO: 2994736 - DNA, 19 bp, Homo sapiens
ggaggcagagcgggaggga

SEQ ID NO: 2994737 - DNA, 20 bp, Homo sapiens
ggaggcagaggttgtagtga

SEQ ID NO: 2994738 - DNA, 16 bp, Homo sapiens
ggaatttcccaggacc

SEQ ID NO: 2994739 - DNA, 18 bp, Homo sapiens
ggaatttcccaggaccct

SEQ ID NO: 2994740 - DNA, 14 bp, Homo sapiens
ggaatttggctgct

SEQ ID NO: 2994741 - DNA, 14 bp, Homo sapiens
ggacaaaagggcca

SEQ ID NO: 2994742 - DNA, 15 bp, Homo sapiens
ggacaaaagggccag

SEQ ID NO: 2994743 - DNA, 17 bp, Homo sapiens
ggacaaaagggccaggt

SEQ ID NO: 2994744 - DNA, 13 bp, Homo sapiens
ggacaaagaacct

SEQ ID NO: 2994745 - DNA, 14 bp, Homo sapiens
ggacaaagaacctt

SEQ ID NO: 2994746 - DNA, 19 bp, Homo sapiens
ggacaaagtccaagtctgt

SEQ ID NO: 2994747 - DNA, 12 bp, Homo sapiens
ggacaaagtgcc

SEQ ID NO: 2994748 - DNA, 17 bp, Homo sapiens
ggacaaagtgccaaaga

SEQ ID NO: 2994749 - DNA, 18 bp, Homo sapiens
ggacaaagtgccaaagaa

SEQ ID NO: 2994750 - DNA, 12 bp, Homo sapiens
ggacaaatgtga

SEQ ID NO: 2994751 - DNA, 14 bp, Homo sapiens
ggacaacttattta

SEQ ID NO: 2994752 - DNA, 21 bp, Homo sapiens
ggacaacttatttaaaaatat

SEQ ID NO: 2994753 - DNA, 22 bp, Homo sapiens
ggacaacttatttaaaaatatt

SEQ ID NO: 2994754 - DNA, 14 bp, Homo sapiens
ggacaactttatgt

SEQ ID NO: 2994755 - DNA, 22 bp, Homo sapiens
ggacaactttatgtagagaaaa

SEQ ID NO: 2994756 - DNA, 18 bp, Homo sapiens
ggacaagggaggcagtgg

SEQ ID NO: 2994757 - DNA, 17 bp, Homo sapiens
ggacaagtcatggacat

SEQ ID NO: 2994758 - DNA, 20 bp, Homo sapiens
ggacaagtggactcagggca

SEQ ID NO: 2994759 - DNA, 15 bp, Homo sapiens
ggacaccccctcgct

SEQ ID NO: 2994760 - DNA, 16 bp, Homo sapiens
ggacaccgtggcctgg

SEQ ID NO: 2994761 - DNA, 18 bp, Homo sapiens
ggacaccgtggcctgggc

SEQ ID NO: 2994762 - DNA, 17 bp, Homo sapiens
ggacaccgtggggaagg

SEQ ID NO: 2994763 - DNA, 16 bp, Homo sapiens
ggacagaagcagctct

SEQ ID NO: 2994764 - DNA, 18 bp, Homo sapiens
ggacagactggccgggca

SEQ ID NO: 2994765 - DNA, 22 bp, Homo sapiens
ggacagactggccgggcaggcg

SEQ ID NO: 2994766 - DNA, 17 bp, Homo sapiens
ggacagagacacctgca

SEQ ID NO: 2994767 - DNA, 19 bp, Homo sapiens
ggacagagacacctgcacc

SEQ ID NO: 2994768 - DNA, 20 bp, Homo sapiens
ggacagagacacctgcacct

SEQ ID NO: 2994769 - DNA, 21 bp, Homo sapiens
ggacagagacacctgcacctc

SEQ ID NO: 2994770 - DNA, 13 bp, Homo sapiens
ggacagagccagc

SEQ ID NO: 2994771 - DNA, 16 bp, Homo sapiens
ggacagagccagcggc

SEQ ID NO: 2994772 - DNA, 19 bp, Homo sapiens
ggacagagccagcggctcc

SEQ ID NO: 2994773 - DNA, 18 bp, Homo sapiens
ggacagaggccccagcct

SEQ ID NO: 2994774 - DNA, 16 bp, Homo sapiens
ggacagagggcacatg

SEQ ID NO: 2994775 - DNA, 16 bp, Homo sapiens
ggacagagtatgaaca

SEQ ID NO: 2994776 - DNA, 21 bp, Homo sapiens
ggacagatggacgcaggccct

SEQ ID NO: 2994777 - DNA, 14 bp, Homo sapiens
ggacagccccaccc

SEQ ID NO: 2994778 - DNA, 21 bp, Homo sapiens
ggacagcctgtggcggtgcct

SEQ ID NO: 2994779 - DNA, 22 bp, Homo sapiens
ggacagcctgtggcggtgcctg

SEQ ID NO: 2994780 - DNA, 23 bp, Homo sapiens
ggacagcctgtggcggtgcctgg

SEQ ID NO: 2994781 - DNA, 15 bp, Homo sapiens
ggacagccttcagca

SEQ ID NO: 2994782 - DNA, 17 bp, Homo sapiens
ggacaggatgaggacag

SEQ ID NO: 2994783 - DNA, 22 bp, Homo sapiens
ggacaggcccggcgcggtggct

SEQ ID NO: 2994784 - DNA, 13 bp, Homo sapiens
ggacaggctggaa

SEQ ID NO: 2994785 - DNA, 21 bp, Homo sapiens
ggacaggctggaatgagggag

SEQ ID NO: 2994786 - DNA, 23 bp, Homo sapiens
ggacaggctggaatgagggaggc

SEQ ID NO: 2994787 - DNA, 13 bp, Homo sapiens
ggacaggctggct

SEQ ID NO: 2994788 - DNA, 17 bp, Homo sapiens
ggacaggggcaggagga

SEQ ID NO: 2994789 - DNA, 18 bp, Homo sapiens
ggacagtcggaaaagcgt

SEQ ID NO: 2994790 - DNA, 16 bp, Homo sapiens
ggacagtttgtttcct

SEQ ID NO: 2994791 - DNA, 18 bp, Homo sapiens
ggacataagataaaatga

SEQ ID NO: 2994792 - DNA, 22 bp, Homo sapiens
ggacataagataaaatgatgtt

SEQ ID NO: 2994793 - DNA, 21 bp, Homo sapiens
ggacatcacagggtgggcctc

SEQ ID NO: 2994794 - DNA, 18 bp, Homo sapiens
ggacatcaggagactggg

SEQ ID NO: 2994795 - DNA, 16 bp, Homo sapiens
ggacatgcggtagcca

SEQ ID NO: 2994796 - DNA, 19 bp, Homo sapiens
ggacatgcggtagccagca

SEQ ID NO: 2994797 - DNA, 21 bp, Homo sapiens
ggacatgcggtagccagcaca

SEQ ID NO: 2994798 - DNA, 18 bp, Homo sapiens
ggacatgctaaataacta

SEQ ID NO: 2994799 - DNA, 16 bp, Homo sapiens
ggacatgttttgataa

SEQ ID NO: 2994800 - DNA, 16 bp, Homo sapiens
ggacattccaagacag

SEQ ID NO: 2994801 - DNA, 17 bp, Homo sapiens
ggacattccaagacagt

SEQ ID NO: 2994802 - DNA, 17 bp, Homo sapiens
ggacattgcagagtggc

SEQ ID NO: 2994803 - DNA, 24 bp, Homo sapiens
ggacattgcagagtggcctagagc

SEQ ID NO: 2994804 - DNA, 14 bp, Homo sapiens
ggacatttctctaa

SEQ ID NO: 2994805 - DNA, 14 bp, Homo sapiens
ggaccaaaggggga

SEQ ID NO: 2994806 - DNA, 17 bp, Homo sapiens
ggaccaaagggggagtc

SEQ ID NO: 2994807 - DNA, 13 bp, Homo sapiens
ggaccaaatagcc

SEQ ID NO: 2994808 - DNA, 16 bp, Homo sapiens
ggaccaaatagccacc

SEQ ID NO: 2994809 - DNA, 20 bp, Homo sapiens
ggaccaccgttcagtcattt

SEQ ID NO: 2994810 - DNA, 18 bp, Homo sapiens
ggaccactgggcccctca

SEQ ID NO: 2994811 - DNA, 20 bp, Homo sapiens
ggaccactgggcccctcagg

SEQ ID NO: 2994812 - DNA, 13 bp, Homo sapiens
ggaccagagggat

SEQ ID NO: 2994813 - DNA, 22 bp, Homo sapiens
ggaccagctcaggacagatgcc

SEQ ID NO: 2994814 - DNA, 14 bp, Homo sapiens
ggaccaggacagga

SEQ ID NO: 2994815 - DNA, 17 bp, Homo sapiens
ggaccaggacaggacca

SEQ ID NO: 2994816 - DNA, 13 bp, Homo sapiens
ggaccagggtgga

SEQ ID NO: 2994817 - DNA, 19 bp, Homo sapiens
ggaccagggtggagctgag

SEQ ID NO: 2994818 - DNA, 22 bp, Homo sapiens
ggacccaaggaaaactgcatgg

SEQ ID NO: 2994819 - DNA, 16 bp, Homo sapiens
ggacccagggagaggc

SEQ ID NO: 2994820 - DNA, 16 bp, Homo sapiens
ggacccagtgcagaat

SEQ ID NO: 2994821 - DNA, 14 bp, Homo sapiens
ggaccccctgcccg

SEQ ID NO: 2994822 - DNA, 18 bp, Homo sapiens
ggaccccgagcctggctc

SEQ ID NO: 2994823 - DNA, 14 bp, Homo sapiens
ggacccctatgaag

SEQ ID NO: 2994824 - DNA, 16 bp, Homo sapiens
ggacccctcaccaccc

SEQ ID NO: 2994825 - DNA, 19 bp, Homo sapiens
ggacccctcaccaccccca

SEQ ID NO: 2994826 - DNA, 23 bp, Homo sapiens
ggacccgaccccccgtgggctcc

SEQ ID NO: 2994827 - DNA, 14 bp, Homo sapiens
ggacccgccagccc

SEQ ID NO: 2994828 - DNA, 13 bp, Homo sapiens
ggaccctgaaggg

SEQ ID NO: 2994829 - DNA, 12 bp, Homo sapiens
ggaccctttcct

SEQ ID NO: 2994830 - DNA, 17 bp, Homo sapiens
ggaccctttccttcctt

SEQ ID NO: 2994831 - DNA, 21 bp, Homo sapiens
ggaccctttccttccttccct

SEQ ID NO: 2994832 - DNA, 17 bp, Homo sapiens
ggaccgccatggtgctg

SEQ ID NO: 2994833 - DNA, 18 bp, Homo sapiens
ggaccgcccttttcccct

SEQ ID NO: 2994834 - DNA, 21 bp, Homo sapiens
ggaccggttcccacaagcctg

SEQ ID NO: 2994835 - DNA, 14 bp, Homo sapiens
ggacctcagcctgc

SEQ ID NO: 2994836 - DNA, 15 bp, Homo sapiens
ggacctcagcctgca

SEQ ID NO: 2994837 - DNA, 13 bp, Homo sapiens
ggacctgagcccg

SEQ ID NO: 2994838 - DNA, 20 bp, Homo sapiens
ggacctgagcccgcagccca

SEQ ID NO: 2994839 - DNA, 23 bp, Homo sapiens
ggacctgatttattgaaattttt

SEQ ID NO: 2994840 - DNA, 20 bp, Homo sapiens
ggaccttacgatcaggcaca

SEQ ID NO: 2994841 - DNA, 18 bp, Homo sapiens
ggaccttaggccttcctc

SEQ ID NO: 2994842 - DNA, 20 bp, Homo sapiens
ggaccttcgggctgtgcccg

SEQ ID NO: 2994843 - DNA, 16 bp, Homo sapiens
ggaccttgacagagca

SEQ ID NO: 2994844 - DNA, 14 bp, Homo sapiens
ggaccttggtctga

SEQ ID NO: 2994845 - DNA, 19 bp, Homo sapiens
ggacgaagaagagccacag

SEQ ID NO: 2994846 - DNA, 23 bp, Homo sapiens
ggacgcagcaggaggccaggccg

SEQ ID NO: 2994847 - DNA, 13 bp, Homo sapiens
ggacgcaggcccc

SEQ ID NO: 2994848 - DNA, 16 bp, Homo sapiens
ggacgcaggcccctct

SEQ ID NO: 2994849 - DNA, 19 bp, Homo sapiens
ggacgcaggcccctctcct

SEQ ID NO: 2994850 - DNA, 14 bp, Homo sapiens
ggacgcaggccctg

SEQ ID NO: 2994851 - DNA, 19 bp, Homo sapiens
ggacgcaggccctgtccag

SEQ ID NO: 2994852 - DNA, 21 bp, Homo sapiens
ggacgcaggccctgtccagcc

SEQ ID NO: 2994853 - DNA, 19 bp, Homo sapiens
ggacgcaggtgctgcggcg

SEQ ID NO: 2994854 - DNA, 14 bp, Homo sapiens
ggacgcctgggggt

SEQ ID NO: 2994855 - DNA, 15 bp, Homo sapiens
ggacggatgggccct

SEQ ID NO: 2994856 - DNA, 12 bp, Homo sapiens
ggacggcgctgc

SEQ ID NO: 2994857 - DNA, 17 bp, Homo sapiens
ggacggggcaggcgctg

SEQ ID NO: 2994858 - DNA, 13 bp, Homo sapiens
ggacgtaaaattt

SEQ ID NO: 2994859 - DNA, 14 bp, Homo sapiens
ggacgtaaaattta
